United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 118

SEQ ID NO: 5000558 - DNA, 11 bp, Homo sapiens
ccctctcctgg

SEQ ID NO: 5000559 - DNA, 14 bp, Homo sapiens
ccctctcctgggca

SEQ ID NO: 5000560 - DNA, 15 bp, Homo sapiens
ccctctcctgggcag

SEQ ID NO: 5000561 - DNA, 16 bp, Homo sapiens
ccctgcccaccccatc

SEQ ID NO: 5000562 - DNA, 22 bp, Homo sapiens
ccctggaggactctagaagctc

SEQ ID NO: 5000563 - DNA, 20 bp, Homo sapiens
ccctgggctccctggaggac

SEQ ID NO: 5000564 - DNA, 12 bp, Homo sapiens
ccctgtgcctgc

SEQ ID NO: 5000565 - DNA, 14 bp, Homo sapiens
ccgactcagggacc

SEQ ID NO: 5000566 - DNA, 15 bp, Homo sapiens
ccgactcagggacct

SEQ ID NO: 5000567 - DNA, 20 bp, Homo sapiens
cctaaagggtatgagctgga

SEQ ID NO: 5000568 - DNA, 22 bp, Homo sapiens
cctaaagggtatgagctggagc

SEQ ID NO: 5000569 - DNA, 22 bp, Homo sapiens
cctaaccatgggctcagggcca

SEQ ID NO: 5000570 - DNA, 23 bp, Homo sapiens
cctaaccatgggctcagggccag

SEQ ID NO: 5000571 - DNA, 18 bp, Homo sapiens
cctaagcaatcactgggc

SEQ ID NO: 5000572 - DNA, 19 bp, Homo sapiens
cctaagcaatcactgggcc

SEQ ID NO: 5000573 - DNA, 14 bp, Homo sapiens
cctcaacagcagga

SEQ ID NO: 5000574 - DNA, 15 bp, Homo sapiens
cctcaacagcaggag

SEQ ID NO: 5000575 - DNA, 18 bp, Homo sapiens
cctcaacagcaggaggca

SEQ ID NO: 5000576 - DNA, 20 bp, Homo sapiens
cctcaacagcaggaggcaca

SEQ ID NO: 5000577 - DNA, 21 bp, Homo sapiens
cctcaacagcaggaggcacag

SEQ ID NO: 5000578 - DNA, 23 bp, Homo sapiens
cctcaacagcaggaggcacagca

SEQ ID NO: 5000579 - DNA, 14 bp, Homo sapiens
cctcacctcccagg

SEQ ID NO: 5000580 - DNA, 15 bp, Homo sapiens
cctcacctcccaggg

SEQ ID NO: 5000581 - DNA, 17 bp, Homo sapiens
cctcacctcccagggct

SEQ ID NO: 5000582 - DNA, 19 bp, Homo sapiens
cctcacctcccagggctac

SEQ ID NO: 5000583 - DNA, 15 bp, Homo sapiens
cctcagaaagtgcag

SEQ ID NO: 5000584 - DNA, 15 bp, Homo sapiens
cctcagatcccaggg

SEQ ID NO: 5000585 - DNA, 17 bp, Homo sapiens
cctcagatcccagggta

SEQ ID NO: 5000586 - DNA, 18 bp, Homo sapiens
cctcagatcccagggtac

SEQ ID NO: 5000587 - DNA, 19 bp, Homo sapiens
cctcagatcccagggtaca

SEQ ID NO: 5000588 - DNA, 14 bp, Homo sapiens
cctcagtcctggaa

SEQ ID NO: 5000589 - DNA, 15 bp, Homo sapiens
cctcagtcctggaag

SEQ ID NO: 5000590 - DNA, 15 bp, Homo sapiens
cctcatcttccccag

SEQ ID NO: 5000591 - DNA, 17 bp, Homo sapiens
cctcatcttccccagcc

SEQ ID NO: 5000592 - DNA, 14 bp, Homo sapiens
cctccacctccctg

SEQ ID NO: 5000593 - DNA, 17 bp, Homo sapiens
cctccacctccctgcaa

SEQ ID NO: 5000594 - DNA, 12 bp, Homo sapiens
cctccagggcca

SEQ ID NO: 5000595 - DNA, 15 bp, Homo sapiens
cctcccagggctaca

SEQ ID NO: 5000596 - DNA, 16 bp, Homo sapiens
cctccccacctgctca

SEQ ID NO: 5000597 - DNA, 14 bp, Homo sapiens
cctccccctgtccc

SEQ ID NO: 5000598 - DNA, 17 bp, Homo sapiens
cctcccctcctctgctt

SEQ ID NO: 5000599 - DNA, 20 bp, Homo sapiens
cctccctccacctccctgca

SEQ ID NO: 5000600 - DNA, 13 bp, Homo sapiens
cctcctctgcttg

SEQ ID NO: 5000601 - DNA, 19 bp, Homo sapiens
cctccttcctcagtcctgg

SEQ ID NO: 5000602 - DNA, 15 bp, Homo sapiens
cctcggtactcccat

SEQ ID NO: 5000603 - DNA, 19 bp, Homo sapiens
cctctcctgggcagctgcc

SEQ ID NO: 5000604 - DNA, 21 bp, Homo sapiens
cctgaaccagtcctgctgcct

SEQ ID NO: 5000605 - DNA, 24 bp, Homo sapiens
cctgaaccagtcctgctgcctgga

SEQ ID NO: 5000606 - DNA, 21 bp, Homo sapiens
cctgatcctaaccctgggctc

SEQ ID NO: 5000607 - DNA, 21 bp, Homo sapiens
cctgatgggagtaggctccag

SEQ ID NO: 5000608 - DNA, 22 bp, Homo sapiens
cctgatgggagtaggctccaga

SEQ ID NO: 5000609 - DNA, 16 bp, Homo sapiens
cctgcaataaaatggg

SEQ ID NO: 5000610 - DNA, 13 bp, Homo sapiens
cctgcccacccca

SEQ ID NO: 5000611 - DNA, 17 bp, Homo sapiens
cctgctgggcactgggc

SEQ ID NO: 5000612 - DNA, 22 bp, Homo sapiens
cctgctgggcactgggcactag

SEQ ID NO: 5000613 - DNA, 17 bp, Homo sapiens
cctgctgtggatgtccc

SEQ ID NO: 5000614 - DNA, 19 bp, Homo sapiens
cctgctgtggatgtcccta

SEQ ID NO: 5000615 - DNA, 20 bp, Homo sapiens
cctggaaggacatccatgtt

SEQ ID NO: 5000616 - DNA, 22 bp, Homo sapiens
cctggaaggacatccatgttcc

SEQ ID NO: 5000617 - DNA, 16 bp, Homo sapiens
cctggaggactctaga

SEQ ID NO: 5000618 - DNA, 17 bp, Homo sapiens
cctggagtcagtagcca

SEQ ID NO: 5000619 - DNA, 20 bp, Homo sapiens
cctggagtcagtagccagag

SEQ ID NO: 5000620 - DNA, 22 bp, Homo sapiens
cctggagtcagtagccagagtt

SEQ ID NO: 5000621 - DNA, 16 bp, Homo sapiens
cctgggcagctgcctc

SEQ ID NO: 5000622 - DNA, 14 bp, Homo sapiens
ctgacctgctgtgg

SEQ ID NO: 5000623 - DNA, 17 bp, Homo sapiens
ctgagaagatggcactg

SEQ ID NO: 5000624 - DNA, 11 bp, Homo sapiens
ctgaggagccc

SEQ ID NO: 5000625 - DNA, 12 bp, Homo sapiens
ctgaggagccca

SEQ ID NO: 5000626 - DNA, 13 bp, Homo sapiens
ctgaggagcccac

SEQ ID NO: 5000627 - DNA, 23 bp, Homo sapiens
ctgaggagcccacggggcaaagc

SEQ ID NO: 5000628 - DNA, 22 bp, Homo sapiens
ctgaggataccccaaagtccag

SEQ ID NO: 5000629 - DNA, 12 bp, Homo sapiens
ctgaggctctcc

SEQ ID NO: 5000630 - DNA, 18 bp, Homo sapiens
ctgatcctaaccctgggc

SEQ ID NO: 5000631 - DNA, 20 bp, Homo sapiens
ctgatcctaaccctgggctc

SEQ ID NO: 5000632 - DNA, 19 bp, Homo sapiens
ctgatccttcaactctgtg

SEQ ID NO: 5000633 - DNA, 21 bp, Homo sapiens
ctgatccttcaactctgtgag

SEQ ID NO: 5000634 - DNA, 22 bp, Homo sapiens
ctgatccttcaactctgtgagg

SEQ ID NO: 5000635 - DNA, 20 bp, Homo sapiens
ctgatgggagtaggctccag

SEQ ID NO: 5000636 - DNA, 15 bp, Homo sapiens
ctgcaataaaatggg

SEQ ID NO: 5000637 - DNA, 21 bp, Homo sapiens
ctgcacccccctgtgcctgct

SEQ ID NO: 5000638 - DNA, 22 bp, Homo sapiens
ctgcacccccctgtgcctgctg

SEQ ID NO: 5000639 - DNA, 17 bp, Homo sapiens
ctgcagaacagcttcat

SEQ ID NO: 5000640 - DNA, 14 bp, Homo sapiens
ctgcaggaatgctg

SEQ ID NO: 5000641 - DNA, 17 bp, Homo sapiens
ctgcaggaatgctgaca

SEQ ID NO: 5000642 - DNA, 20 bp, Homo sapiens
ctgccaccccttggcactgt

SEQ ID NO: 5000643 - DNA, 17 bp, Homo sapiens
ctgccaccttgggtctg

SEQ ID NO: 5000644 - DNA, 22 bp, Homo sapiens
ctgccaggcaccatctgccaat

SEQ ID NO: 5000645 - DNA, 12 bp, Homo sapiens
ctgccatgccca

SEQ ID NO: 5000646 - DNA, 11 bp, Homo sapiens
ctgccatggga

SEQ ID NO: 5000647 - DNA, 20 bp, Homo sapiens
ctgccatgggagagtccagg

SEQ ID NO: 5000648 - DNA, 21 bp, Homo sapiens
ctgccatgggagagtccaggc

SEQ ID NO: 5000649 - DNA, 23 bp, Homo sapiens
ctgccatgggagagtccaggcct

SEQ ID NO: 5000650 - DNA, 12 bp, Homo sapiens
ctgcccacccca

SEQ ID NO: 5000651 - DNA, 19 bp, Homo sapiens
ctgcccaccccatccctgg

SEQ ID NO: 5000652 - DNA, 17 bp, Homo sapiens
ctgccccaactgcagga

SEQ ID NO: 5000653 - DNA, 13 bp, Homo sapiens
ctgccctccaggg

SEQ ID NO: 5000654 - DNA, 17 bp, Homo sapiens
ctgccctccagggccag

SEQ ID NO: 5000655 - DNA, 19 bp, Homo sapiens
ctgccctccagggccagga

SEQ ID NO: 5000656 - DNA, 12 bp, Homo sapiens
ctgccctctcct

SEQ ID NO: 5000657 - DNA, 15 bp, Homo sapiens
ctgccctctcctggg

SEQ ID NO: 5000658 - DNA, 12 bp, Homo sapiens
ctgcctccaggt

SEQ ID NO: 5000659 - DNA, 13 bp, Homo sapiens
ctgcctccaggtt

SEQ ID NO: 5000660 - DNA, 19 bp, Homo sapiens
ctgcctccaggttgcctca

SEQ ID NO: 5000661 - DNA, 19 bp, Homo sapiens
ctgcctcccctcctctgct

SEQ ID NO: 5000662 - DNA, 21 bp, Homo sapiens
ctgcctcccctcctctgcttg

SEQ ID NO: 5000663 - DNA, 22 bp, Homo sapiens
ctgcctggagtcagtagccaga

SEQ ID NO: 5000664 - DNA, 24 bp, Homo sapiens
ctgctgcctggagtcagtagccag

SEQ ID NO: 5000665 - DNA, 17 bp, Homo sapiens
ctgctgggcactgggca

SEQ ID NO: 5000666 - DNA, 22 bp, Homo sapiens
ctgctgtatgaatagctgtgta

SEQ ID NO: 5000667 - DNA, 15 bp, Homo sapiens
ctgcttgccatccct

SEQ ID NO: 5000668 - DNA, 20 bp, Homo sapiens
ctggagtcagtagccagagt

SEQ ID NO: 5000669 - DNA, 14 bp, Homo sapiens
ctggatgcacagtg

SEQ ID NO: 5000670 - DNA, 19 bp, Homo sapiens
ctggatgcacagtgcctga

SEQ ID NO: 5000671 - DNA, 21 bp, Homo sapiens
ctggatgcacagtgcctgatg

SEQ ID NO: 5000672 - DNA, 16 bp, Homo sapiens
ctggctgacctgctgt

SEQ ID NO: 5000673 - DNA, 21 bp, Homo sapiens
ctgggcactagctagatgctt

SEQ ID NO: 5000674 - DNA, 17 bp, Homo sapiens
ctgggcactgggcacta

SEQ ID NO: 5000675 - DNA, 18 bp, Homo sapiens
ctgggcactgggcactag

SEQ ID NO: 5000676 - DNA, 15 bp, Homo sapiens
ctgggcagctgcctc

SEQ ID NO: 5000677 - DNA, 21 bp, Homo sapiens
ctgggcagctgcctcccctcc

SEQ ID NO: 5000678 - DNA, 23 bp, Homo sapiens
ctgggcaggtctcctctgggagg

SEQ ID NO: 5000679 - DNA, 13 bp, Homo sapiens
ctgggccagtggc

SEQ ID NO: 5000680 - DNA, 22 bp, Homo sapiens
ctgggccagtggcactctgtgt

SEQ ID NO: 5000681 - DNA, 13 bp, Homo sapiens
ctgggcccagagg

SEQ ID NO: 5000682 - DNA, 13 bp, Homo sapiens
ctgggctccctgg

SEQ ID NO: 5000683 - DNA, 16 bp, Homo sapiens
ctgggctccctggagg

SEQ ID NO: 5000684 - DNA, 21 bp, Homo sapiens
ctgggctccctggaggactct

SEQ ID NO: 5000685 - DNA, 22 bp, Homo sapiens
ctggggcagagtggagcccagg

SEQ ID NO: 5000686 - DNA, 21 bp, Homo sapiens
ctgggggtaaagccctcagat

SEQ ID NO: 5000687 - DNA, 21 bp, Homo sapiens
ctggtcccagccagcagttca

SEQ ID NO: 5000688 - DNA, 11 bp, Homo sapiens
ctgtccagggc

SEQ ID NO: 5000689 - DNA, 12 bp, Homo sapiens
ctgtccagggcc

SEQ ID NO: 5000690 - DNA, 15 bp, Homo sapiens
ctgtgaatggctgtg

SEQ ID NO: 5000691 - DNA, 17 bp, Homo sapiens
ctgtgaatggctgtgcc

SEQ ID NO: 5000692 - DNA, 18 bp, Homo sapiens
ctgtgaatggctgtgccc

SEQ ID NO: 5000693 - DNA, 21 bp, Homo sapiens
ctgtgaatggctgtgccccac

SEQ ID NO: 5000694 - DNA, 15 bp, Homo sapiens
ctgtgcctgctgggc

SEQ ID NO: 5000695 - DNA, 18 bp, Homo sapiens
ctgtgcctgctgggcact

SEQ ID NO: 5000696 - DNA, 18 bp, Homo sapiens
ctgtgctaggtctgacca

SEQ ID NO: 5000697 - DNA, 15 bp, Homo sapiens
ctgtggaactgccac

SEQ ID NO: 5000698 - DNA, 17 bp, Homo sapiens
ctgtggaactgccacct

SEQ ID NO: 5000699 - DNA, 15 bp, Homo sapiens
ctgtggatgtcccta

SEQ ID NO: 5000700 - DNA, 16 bp, Homo sapiens
ctgtgtgccctagggc

SEQ ID NO: 5000701 - DNA, 18 bp, Homo sapiens
ctgtgtgccctagggctc

SEQ ID NO: 5000702 - DNA, 16 bp, Homo sapiens
ctgttccacttctcta

SEQ ID NO: 5000703 - DNA, 15 bp, Homo sapiens
ctgttgtcctgaact

SEQ ID NO: 5000704 - DNA, 17 bp, Homo sapiens
cttattttgtaataaac

SEQ ID NO: 5000705 - DNA, 19 bp, Homo sapiens
cttattttgtaataaactc

SEQ ID NO: 5000706 - DNA, 21 bp, Homo sapiens
cttattttgtaataaactctc

SEQ ID NO: 5000707 - DNA, 23 bp, Homo sapiens
cttattttgtaataaactctcta

SEQ ID NO: 5000708 - DNA, 14 bp, Homo sapiens
cttcaactctgtga

SEQ ID NO: 5000709 - DNA, 12 bp, Homo sapiens
cttcctgcccca

SEQ ID NO: 5000710 - DNA, 21 bp, Homo sapiens
cttctcaaagctgggattaca

SEQ ID NO: 5000711 - DNA, 13 bp, Homo sapiens
cttctctttctta

SEQ ID NO: 5000712 - DNA, 16 bp, Homo sapiens
cttgaaggtgctgcca

SEQ ID NO: 5000713 - DNA, 14 bp, Homo sapiens
cttgccatccctcc

SEQ ID NO: 5000714 - DNA, 17 bp, Homo sapiens
cttgccatccctccctc

SEQ ID NO: 5000715 - DNA, 23 bp, Homo sapiens
cttggcactgtggaactgccacc

SEQ ID NO: 5000716 - DNA, 15 bp, Homo sapiens
cttggccgactcagg

SEQ ID NO: 5000717 - DNA, 17 bp, Homo sapiens
cttggccgactcaggga

SEQ ID NO: 5000718 - DNA, 20 bp, Homo sapiens
cttggggttttcagtatgaa

SEQ ID NO: 5000719 - DNA, 19 bp, Homo sapiens
cttgtaggtttctctgcct

SEQ ID NO: 5000720 - DNA, 10 bp, Homo sapiens
cttgtgtatg

SEQ ID NO: 5000721 - DNA, 21 bp, Homo sapiens
ctttagctgtgaatggctgtg

SEQ ID NO: 5000722 - DNA, 22 bp, Homo sapiens
ctttagtacatggagctcaggt

SEQ ID NO: 5000723 - DNA, 22 bp, Homo sapiens
ctttcaatggtttgcaaggaag

SEQ ID NO: 5000724 - DNA, 19 bp, Homo sapiens
ctttccttttcttgtctct

SEQ ID NO: 5000725 - DNA, 20 bp, Homo sapiens
ctttctcttttcctctacca

SEQ ID NO: 5000726 - DNA, 22 bp, Homo sapiens
ctttctgaatttcattctcttg

SEQ ID NO: 5000727 - DNA, 21 bp, Homo sapiens
ctttcttacacaagagctgga

SEQ ID NO: 5000728 - DNA, 17 bp, Homo sapiens
ctttcttattttgtaat

SEQ ID NO: 5000729 - DNA, 22 bp, Homo sapiens
ctttgcatagcagctgctacta

SEQ ID NO: 5000730 - DNA, 21 bp, Homo sapiens
ctttggggcttttacaccagt

SEQ ID NO: 5000731 - DNA, 17 bp, Homo sapiens
cttttatttcttaaaca

SEQ ID NO: 5000732 - DNA, 14 bp, Homo sapiens
cttttcttgtctct

SEQ ID NO: 5000733 - DNA, 15 bp, Homo sapiens
cttttcttgtctctg

SEQ ID NO: 5000734 - DNA, 18 bp, Homo sapiens
cttttcttgtctctgagg

SEQ ID NO: 5000735 - DNA, 23 bp, Homo sapiens
gaaaatctgaactctaagcagaa

SEQ ID NO: 5000736 - DNA, 13 bp, Homo sapiens
gaaaatggcagaa

SEQ ID NO: 5000737 - DNA, 13 bp, Homo sapiens
gaaaattaacact

SEQ ID NO: 5000738 - DNA, 15 bp, Homo sapiens
gaaagatggagaggc

SEQ ID NO: 5000739 - DNA, 18 bp, Homo sapiens
gaaagatgtcccacaggg

SEQ ID NO: 5000740 - DNA, 19 bp, Homo sapiens
gaaagatgtcccacaggga

SEQ ID NO: 5000741 - DNA, 21 bp, Homo sapiens
gaaagatgtcccacagggacc

SEQ ID NO: 5000742 - DNA, 22 bp, Homo sapiens
gaaagatgtcccacagggacca

SEQ ID NO: 5000743 - DNA, 17 bp, Homo sapiens
gaaaggaaaagattcct

SEQ ID NO: 5000744 - DNA, 17 bp, Homo sapiens
gaacagataatccctgt

SEQ ID NO: 5000745 - DNA, 17 bp, Homo sapiens
gaaccagtcctgctgcc

SEQ ID NO: 5000746 - DNA, 14 bp, Homo sapiens
gaacctcaaactgg

SEQ ID NO: 5000747 - DNA, 14 bp, Homo sapiens
gcatgggggcccaa

SEQ ID NO: 5000748 - DNA, 14 bp, Homo sapiens
gcatgttcagggat

SEQ ID NO: 5000749 - DNA, 17 bp, Homo sapiens
gccaatgccatgactgc

SEQ ID NO: 5000750 - DNA, 19 bp, Homo sapiens
gccaatgccatgactgctc

SEQ ID NO: 5000751 - DNA, 22 bp, Homo sapiens
gccagatgcacatccctggaag

SEQ ID NO: 5000752 - DNA, 13 bp, Homo sapiens
gccagcagttcag

SEQ ID NO: 5000753 - DNA, 22 bp, Homo sapiens
gccagcagttcagagctgccct

SEQ ID NO: 5000754 - DNA, 22 bp, Homo sapiens
gccaggattcaggcctctgagg

SEQ ID NO: 5000755 - DNA, 11 bp, Homo sapiens
gccaggcctct

SEQ ID NO: 5000756 - DNA, 21 bp, Homo sapiens
gccaggcctctactaggtctg

SEQ ID NO: 5000757 - DNA, 17 bp, Homo sapiens
gccaggtcctcacagca

SEQ ID NO: 5000758 - DNA, 19 bp, Homo sapiens
gccaggtcctcacagcagt

SEQ ID NO: 5000759 - DNA, 21 bp, Homo sapiens
gccaggtcctcacagcagtca

SEQ ID NO: 5000760 - DNA, 20 bp, Homo sapiens
gccagtggcactctgtgtgg

SEQ ID NO: 5000761 - DNA, 16 bp, Homo sapiens
gccatcatgtgcctgg

SEQ ID NO: 5000762 - DNA, 19 bp, Homo sapiens
gccatcatgtgcctggaaa

SEQ ID NO: 5000763 - DNA, 16 bp, Homo sapiens
gccatgactgctcagg

SEQ ID NO: 5000764 - DNA, 15 bp, Homo sapiens
gccatgcccaccatc

SEQ ID NO: 5000765 - DNA, 16 bp, Homo sapiens
gccatgggagagtcca

SEQ ID NO: 5000766 - DNA, 21 bp, Homo sapiens
gccatgggagagtccaggcct

SEQ ID NO: 5000767 - DNA, 21 bp, Homo sapiens
gcccaccccatccctggctga

SEQ ID NO: 5000768 - DNA, 18 bp, Homo sapiens
gcccacggggcaaagctg

SEQ ID NO: 5000769 - DNA, 21 bp, Homo sapiens
gcccacggggcaaagctgctg

SEQ ID NO: 5000770 - DNA, 13 bp, Homo sapiens
gcccagaggagag

SEQ ID NO: 5000771 - DNA, 19 bp, Homo sapiens
gcccagaggagaggagaca

SEQ ID NO: 5000772 - DNA, 19 bp, Homo sapiens
gcccaggaaggcggcaggc

SEQ ID NO: 5000773 - DNA, 17 bp, Homo sapiens
aaaacataaaatataca

SEQ ID NO: 5000774 - DNA, 18 bp, Homo sapiens
aaaataaaaacataaaat

SEQ ID NO: 5000775 - DNA, 21 bp, Homo sapiens
aaaatctgaactctaagcaga

SEQ ID NO: 5000776 - DNA, 16 bp, Homo sapiens
aaaatgggttttactg

SEQ ID NO: 5000777 - DNA, 12 bp, Homo sapiens
aaacactgtgta

SEQ ID NO: 5000778 - DNA, 18 bp, Homo sapiens
aaacataaaatatacaaa

SEQ ID NO: 5000779 - DNA, 22 bp, Homo sapiens
aaacatgtggcaacctgttctt

SEQ ID NO: 5000780 - DNA, 15 bp, Homo sapiens
aaaccagagggcagt

SEQ ID NO: 5000781 - DNA, 20 bp, Homo sapiens
aaaccattatgaagaagaga

SEQ ID NO: 5000782 - DNA, 14 bp, Homo sapiens
aaagagatacagag

SEQ ID NO: 5000783 - DNA, 18 bp, Homo sapiens
aaagatgtcccacaggga

SEQ ID NO: 5000784 - DNA, 23 bp, Homo sapiens
aaagatgtcccacagggaccaca

SEQ ID NO: 5000785 - DNA, 20 bp, Homo sapiens
aaagccctcagatcccaggg

SEQ ID NO: 5000786 - DNA, 15 bp, Homo sapiens
aaagctgctgggcca

SEQ ID NO: 5000787 - DNA, 16 bp, Homo sapiens
aaagctgctgggccag

SEQ ID NO: 5000788 - DNA, 23 bp, Homo sapiens
aaagggcccacagtgacttttgc

SEQ ID NO: 5000789 - DNA, 13 bp, Homo sapiens
aaatataaacttg

SEQ ID NO: 5000790 - DNA, 14 bp, Homo sapiens
aaatataaacttgt

SEQ ID NO: 5000791 - DNA, 15 bp, Homo sapiens
aaatgctaaatgcaa

SEQ ID NO: 5000792 - DNA, 18 bp, Homo sapiens
aaatgtatgattacatca

SEQ ID NO: 5000793 - DNA, 12 bp, Homo sapiens
aaattaacactg

SEQ ID NO: 5000794 - DNA, 13 bp, Homo sapiens
aacaacatgtata

SEQ ID NO: 5000795 - DNA, 21 bp, Homo sapiens
aacaagcatttcccccaggga

SEQ ID NO: 5000796 - DNA, 21 bp, Homo sapiens
aacactatatggcagtgtctt

SEQ ID NO: 5000797 - DNA, 17 bp, Homo sapiens
aacactgcttgtgtttt

SEQ ID NO: 5000798 - DNA, 16 bp, Homo sapiens
aacactgtgtatttat

SEQ ID NO: 5000799 - DNA, 13 bp, Homo sapiens
aacagcaggaggc

SEQ ID NO: 5000800 - DNA, 17 bp, Homo sapiens
aacatgtataatatttt

SEQ ID NO: 5000801 - DNA, 16 bp, Homo sapiens
aaccagtcctgctgcc

SEQ ID NO: 5000802 - DNA, 18 bp, Homo sapiens
aaccagtcctgctgcctg

SEQ ID NO: 5000803 - DNA, 15 bp, Homo sapiens
aaccatgggctcagg

SEQ ID NO: 5000804 - DNA, 18 bp, Homo sapiens
aaccatgggctcagggcc

SEQ ID NO: 5000805 - DNA, 21 bp, Homo sapiens
aaccatgggctcagggccagg

SEQ ID NO: 5000806 - DNA, 17 bp, Homo sapiens
aaccctgggctccctgg

SEQ ID NO: 5000807 - DNA, 18 bp, Homo sapiens
aaccctgggctccctgga

SEQ ID NO: 5000808 - DNA, 13 bp, Homo sapiens
aacctcaaactgg

SEQ ID NO: 5000809 - DNA, 20 bp, Homo sapiens
aacctgttcttcctaccaaa

SEQ ID NO: 5000810 - DNA, 18 bp, Homo sapiens
aactagcttggaaactgg

SEQ ID NO: 5000811 - DNA, 14 bp, Homo sapiens
aactgcaggaatgc

SEQ ID NO: 5000812 - DNA, 22 bp, Homo sapiens
aactttgcatagcagctgctac

SEQ ID NO: 5000813 - DNA, 20 bp, Homo sapiens
aagaaggcacaggtgtaaat

SEQ ID NO: 5000814 - DNA, 14 bp, Homo sapiens
cagaaaaaaataaa

SEQ ID NO: 5000815 - DNA, 14 bp, Homo sapiens
cagaagaaggcagc

SEQ ID NO: 5000816 - DNA, 14 bp, Homo sapiens
cagaagactctcca

SEQ ID NO: 5000817 - DNA, 19 bp, Homo sapiens
cagaagactctccactgac

SEQ ID NO: 5000818 - DNA, 21 bp, Homo sapiens
cagaagactctccactgacct

SEQ ID NO: 5000819 - DNA, 12 bp, Homo sapiens
cagacacacact

SEQ ID NO: 5000820 - DNA, 14 bp, Homo sapiens
cagacacacactgg

SEQ ID NO: 5000821 - DNA, 15 bp, Homo sapiens
cagacacacactggc

SEQ ID NO: 5000822 - DNA, 18 bp, Homo sapiens
cagacacacactggctcc

SEQ ID NO: 5000823 - DNA, 11 bp, Homo sapiens
cagacagcagc

SEQ ID NO: 5000824 - DNA, 12 bp, Homo sapiens
cagacagcagct

SEQ ID NO: 5000825 - DNA, 14 bp, Homo sapiens
cagacagcagctgg

SEQ ID NO: 5000826 - DNA, 16 bp, Homo sapiens
cagacagcagctggac

SEQ ID NO: 5000827 - DNA, 14 bp, Homo sapiens
cagacattttcctc

SEQ ID NO: 5000828 - DNA, 22 bp, Homo sapiens
cagacattttcctcacacccac

SEQ ID NO: 5000829 - DNA, 18 bp, Homo sapiens
cagaccctgcccacccca

SEQ ID NO: 5000830 - DNA, 17 bp, Homo sapiens
cagacttctctttctta

SEQ ID NO: 5000831 - DNA, 16 bp, Homo sapiens
cagagataaagacctt

SEQ ID NO: 5000832 - DNA, 18 bp, Homo sapiens
cagagctgccctctcctg

SEQ ID NO: 5000833 - DNA, 17 bp, Homo sapiens
cagaggagaggagacag

SEQ ID NO: 5000834 - DNA, 19 bp, Homo sapiens
cagaggagaggagacagac

SEQ ID NO: 5000835 - DNA, 20 bp, Homo sapiens
cagaggagaggagacagaca

SEQ ID NO: 5000836 - DNA, 13 bp, Homo sapiens
cagagtggagccc

SEQ ID NO: 5000837 - DNA, 16 bp, Homo sapiens
cagagtggagcccagg

SEQ ID NO: 5000838 - DNA, 18 bp, Homo sapiens
cagagtggagcccagggt

SEQ ID NO: 5000839 - DNA, 20 bp, Homo sapiens
cagagtggagcccagggtgc

SEQ ID NO: 5000840 - DNA, 17 bp, Homo sapiens
cagagttgttctcaggg

SEQ ID NO: 5000841 - DNA, 18 bp, Homo sapiens
cagagttgttctcagggg

SEQ ID NO: 5000842 - DNA, 22 bp, Homo sapiens
cagatagaatttggcccagaga

SEQ ID NO: 5000843 - DNA, 12 bp, Homo sapiens
cagatcccaggg

SEQ ID NO: 5000844 - DNA, 18 bp, Homo sapiens
cagatcccagggtacact

SEQ ID NO: 5000845 - DNA, 16 bp, Homo sapiens
cagcaggaggcacagc

SEQ ID NO: 5000846 - DNA, 13 bp, Homo sapiens
cagcatggaggaa

SEQ ID NO: 5000847 - DNA, 14 bp, Homo sapiens
cagccagcagttca

SEQ ID NO: 5000848 - DNA, 18 bp, Homo sapiens
cagccatcatgtgcctgg

SEQ ID NO: 5000849 - DNA, 17 bp, Homo sapiens
cagcccaaagaaggaaa

SEQ ID NO: 5000850 - DNA, 14 bp, Homo sapiens
cagccccactgccc

SEQ ID NO: 5000851 - DNA, 23 bp, Homo sapiens
cagccccactgccctccagggcc

SEQ ID NO: 5000852 - DNA, 19 bp, Homo sapiens
cagccctccccacctgctc

SEQ ID NO: 5000853 - DNA, 23 bp, Homo sapiens
cagccctccccacctgctcacca

SEQ ID NO: 5000854 - DNA, 23 bp, Homo sapiens
cagcctccccctgtcccctctat

SEQ ID NO: 5000855 - DNA, 23 bp, Homo sapiens
cagctaataaaagtcagagctca

SEQ ID NO: 5000856 - DNA, 14 bp, Homo sapiens
cagctaggaagcaa

SEQ ID NO: 5000857 - DNA, 13 bp, Homo sapiens
cagctatttttat

SEQ ID NO: 5000858 - DNA, 10 bp, Homo sapiens
cagctgcctc

SEQ ID NO: 5000859 - DNA, 17 bp, Homo sapiens
cagctgcctcccctcct

SEQ ID NO: 5000860 - DNA, 21 bp, Homo sapiens
cagctgcctcccctcctctgc

SEQ ID NO: 5000861 - DNA, 12 bp, Homo sapiens
caggaaagatgt

SEQ ID NO: 5000862 - DNA, 17 bp, Homo sapiens
caggaaagatgtcccac

SEQ ID NO: 5000863 - DNA, 19 bp, Homo sapiens
caggaaagatgtcccacag

SEQ ID NO: 5000864 - DNA, 18 bp, Homo sapiens
caggaggagtgggacaga

SEQ ID NO: 5000865 - DNA, 20 bp, Homo sapiens
caggaggagtgggacagaca

SEQ ID NO: 5000866 - DNA, 21 bp, Homo sapiens
caggatgaggaacctcaaact

SEQ ID NO: 5000867 - DNA, 14 bp, Homo sapiens
caggattcaggcct

SEQ ID NO: 5000868 - DNA, 17 bp, Homo sapiens
caggcaccatctgccaa

SEQ ID NO: 5000869 - DNA, 22 bp, Homo sapiens
caggcccaggaaggcggcaggc

SEQ ID NO: 5000870 - DNA, 17 bp, Homo sapiens
caggcctcacctcccag

SEQ ID NO: 5000871 - DNA, 18 bp, Homo sapiens
caggcctcacctcccagg

SEQ ID NO: 5000872 - DNA, 21 bp, Homo sapiens
caggcctctgaggagcccacg

SEQ ID NO: 5000873 - DNA, 22 bp, Homo sapiens
caggcctgggtcacgctcaagg

SEQ ID NO: 5000874 - DNA, 14 bp, Homo sapiens
cagggaccacatcc

SEQ ID NO: 5000875 - DNA, 21 bp, Homo sapiens
tgtgcctgctgggcactgggc

SEQ ID NO: 5000876 - DNA, 17 bp, Homo sapiens
tgtgctaggtctgacca

SEQ ID NO: 5000877 - DNA, 22 bp, Homo sapiens
tgtgctaggtctgaccaaaacc

SEQ ID NO: 5000878 - DNA, 16 bp, Homo sapiens
tgtggcaggggcagtg

SEQ ID NO: 5000879 - DNA, 20 bp, Homo sapiens
tgtggcaggggcagtggcct

SEQ ID NO: 5000880 - DNA, 23 bp, Homo sapiens
tccctccacctccctgcaataaa

SEQ ID NO: 5000881 - DNA, 17 bp, Homo sapiens
tccctccctccacctcc

SEQ ID NO: 5000882 - DNA, 16 bp, Homo sapiens
tccctgcaataaaatg

SEQ ID NO: 5000883 - DNA, 16 bp, Homo sapiens
tccctggctgacctgc

SEQ ID NO: 5000884 - DNA, 19 bp, Homo sapiens
tccctggctgacctgctgt

SEQ ID NO: 5000885 - DNA, 22 bp, Homo sapiens
tcctaaccctgggctccctgga

SEQ ID NO: 5000886 - DNA, 19 bp, Homo sapiens
tcctcacacccacctgctg

SEQ ID NO: 5000887 - DNA, 12 bp, Homo sapiens
tcctcacagcag

SEQ ID NO: 5000888 - DNA, 13 bp, Homo sapiens
tcctcacagcagt

SEQ ID NO: 5000889 - DNA, 16 bp, Homo sapiens
tcctcagtcctggaag

SEQ ID NO: 5000890 - DNA, 17 bp, Homo sapiens
tcctcagtcctggaagc

SEQ ID NO: 5000891 - DNA, 15 bp, Homo sapiens
tcctcggtactccca

SEQ ID NO: 5000892 - DNA, 16 bp, Homo sapiens
tcctcggtactcccat

SEQ ID NO: 5000893 - DNA, 17 bp, Homo sapiens
tcctctgcttgccatcc

SEQ ID NO: 5000894 - DNA, 19 bp, Homo sapiens
tcctctgcttgccatccct

SEQ ID NO: 5000895 - DNA, 21 bp, Homo sapiens
tcctctgcttgccatccctcc

SEQ ID NO: 5000896 - DNA, 20 bp, Homo sapiens
tcctgaaccagtcctgctgc

SEQ ID NO: 5000897 - DNA, 21 bp, Homo sapiens
tcctgaaccagtcctgctgcc

SEQ ID NO: 5000898 - DNA, 21 bp, Homo sapiens
tcctgatcctaaccctgggct

SEQ ID NO: 5000899 - DNA, 16 bp, Homo sapiens
tcctggacctaaaggg

SEQ ID NO: 5000900 - DNA, 14 bp, Homo sapiens
tcctgggcagctgc

SEQ ID NO: 5000901 - DNA, 18 bp, Homo sapiens
tcctgggcagctgcctcc

SEQ ID NO: 5000902 - DNA, 19 bp, Homo sapiens
tcctgggcagctgcctccc

SEQ ID NO: 5000903 - DNA, 15 bp, Homo sapiens
tcctgtccttcacct

SEQ ID NO: 5000904 - DNA, 17 bp, Homo sapiens
tccttaattcactccca

SEQ ID NO: 5000905 - DNA, 15 bp, Homo sapiens
tccttcaactctgtg

SEQ ID NO: 5000906 - DNA, 19 bp, Homo sapiens
tcctttcaatggtttgcaa

SEQ ID NO: 5000907 - DNA, 13 bp, Homo sapiens
tccttttcttgtc

SEQ ID NO: 5000908 - DNA, 20 bp, Homo sapiens
tccttttcttgtctctgagg

SEQ ID NO: 5000909 - DNA, 21 bp, Homo sapiens
tccttttcttgtctctgaggc

SEQ ID NO: 5000910 - DNA, 21 bp, Homo sapiens
tcggctgtaaacagctctgtg

SEQ ID NO: 5000911 - DNA, 13 bp, Homo sapiens
tcggtactcccat

SEQ ID NO: 5000912 - DNA, 23 bp, Homo sapiens
tctaaacccaaataaatgtgtaa

SEQ ID NO: 5000913 - DNA, 13 bp, Homo sapiens
tctaagcagaaga

SEQ ID NO: 5000914 - DNA, 17 bp, Homo sapiens
tctactaggtctgctcc

SEQ ID NO: 5000915 - DNA, 13 bp, Homo sapiens
tctagaaggccag

SEQ ID NO: 5000916 - DNA, 15 bp, Homo sapiens
tctagaaggccaggc

SEQ ID NO: 5000917 - DNA, 15 bp, Homo sapiens
tctattttgcagata

SEQ ID NO: 5000918 - DNA, 19 bp, Homo sapiens
tctcaaatgctaaatgcaa

SEQ ID NO: 5000919 - DNA, 21 bp, Homo sapiens
tctcactttccttttcttgtc

SEQ ID NO: 5000920 - DNA, 19 bp, Homo sapiens
tctcaggggtgctggggca

SEQ ID NO: 5000921 - DNA, 16 bp, Homo sapiens
tctcattcctgttctt

SEQ ID NO: 5000922 - DNA, 22 bp, Homo sapiens
tctccattccctccacccactt

SEQ ID NO: 5000923 - DNA, 13 bp, Homo sapiens
tctcctgggcagc

SEQ ID NO: 5000924 - DNA, 14 bp, Homo sapiens
tctcctgggcagct

SEQ ID NO: 5000925 - DNA, 15 bp, Homo sapiens
tctcctgggcagctg

SEQ ID NO: 5000926 - DNA, 16 bp, Homo sapiens
tctcctgggcagctgc

SEQ ID NO: 5000927 - DNA, 18 bp, Homo sapiens
tctcctgggcagctgcct

SEQ ID NO: 5000928 - DNA, 14 bp, Homo sapiens
tctctaaacccaaa

SEQ ID NO: 5000929 - DNA, 14 bp, Homo sapiens
tctctagagaacat

SEQ ID NO: 5000930 - DNA, 14 bp, Homo sapiens
tctctgagaacaga

SEQ ID NO: 5000931 - DNA, 14 bp, Homo sapiens
tctctttcttattt

SEQ ID NO: 5000932 - DNA, 20 bp, Homo sapiens
tctctttcttattttgtaat

SEQ ID NO: 5000933 - DNA, 17 bp, Homo sapiens
tctgaaaattaacactg

SEQ ID NO: 5000934 - DNA, 20 bp, Homo sapiens
tctgaactctaagcagaaga

SEQ ID NO: 5000935 - DNA, 16 bp, Homo sapiens
tctgaccaaaaccaga

SEQ ID NO: 5000936 - DNA, 21 bp, Homo sapiens
tctgaccaaaaccagagggca

SEQ ID NO: 5000937 - DNA, 23 bp, Homo sapiens
tctgaccaaaaccagagggcagt

SEQ ID NO: 5000938 - DNA, 13 bp, Homo sapiens
tctgccaatgcca

SEQ ID NO: 5000939 - DNA, 19 bp, Homo sapiens
tctgccatgggagagtcca

SEQ ID NO: 5000940 - DNA, 17 bp, Homo sapiens
tctgcttgccatccctc

SEQ ID NO: 5000941 - DNA, 20 bp, Homo sapiens
tctgcttgccatccctccct

SEQ ID NO: 5000942 - DNA, 23 bp, Homo sapiens
tctgcttgccatccctccctcca

SEQ ID NO: 5000943 - DNA, 16 bp, Homo sapiens
tcttacacaagagctg

SEQ ID NO: 5000944 - DNA, 15 bp, Homo sapiens
tcttattttgtaata

SEQ ID NO: 5000945 - DNA, 18 bp, Homo sapiens
tcttattttgtaataaac

SEQ ID NO: 5000946 - DNA, 19 bp, Homo sapiens
tcttattttgtaataaact

SEQ ID NO: 5000947 - DNA, 21 bp, Homo sapiens
tcttattttgtaataaactct

SEQ ID NO: 5000948 - DNA, 22 bp, Homo sapiens
tcttattttgtaataaactctc

SEQ ID NO: 5000949 - DNA, 17 bp, Homo sapiens
tcttcctaccaaatata

SEQ ID NO: 5000950 - DNA, 18 bp, Homo sapiens
tcttcctaccaaatataa

SEQ ID NO: 5000951 - DNA, 17 bp, Homo sapiens
tcttctcaaagctggga

SEQ ID NO: 5000952 - DNA, 18 bp, Homo sapiens
tcttgaaggtgctgccac

SEQ ID NO: 5000953 - DNA, 20 bp, Homo sapiens
tcttgaaggtgctgccaccc

SEQ ID NO: 5000954 - DNA, 17 bp, Homo sapiens
tcttggccgactcaggg

SEQ ID NO: 5000955 - DNA, 18 bp, Homo sapiens
tctttgagataatacatt

SEQ ID NO: 5000956 - DNA, 20 bp, Homo sapiens
tgaaaatgcaacaacatgta

SEQ ID NO: 5000957 - DNA, 15 bp, Homo sapiens
tgaaaattaacactg

SEQ ID NO: 5000958 - DNA, 16 bp, Homo sapiens
tgaacaccactttgtc

SEQ ID NO: 5000959 - DNA, 19 bp, Homo sapiens
tgaacaccactttgtctct

SEQ ID NO: 5000960 - DNA, 19 bp, Homo sapiens
tgaaccagtcctgctgcct

SEQ ID NO: 5000961 - DNA, 22 bp, Homo sapiens
tgaaccagtcctgctgcctgga

SEQ ID NO: 5000962 - DNA, 22 bp, Homo sapiens
tgaactctaagcagaagactct

SEQ ID NO: 5000963 - DNA, 16 bp, Homo sapiens
tgaactgtgagtcctg

SEQ ID NO: 5000964 - DNA, 21 bp, Homo sapiens
tgaacttatttacacatagtt

SEQ ID NO: 5000965 - DNA, 16 bp, Homo sapiens
tgaaggtgctgccacc

SEQ ID NO: 5000966 - DNA, 17 bp, Homo sapiens
tgaaggtgctgccaccc

SEQ ID NO: 5000967 - DNA, 18 bp, Homo sapiens
tgaaggtttctgaaaatt

SEQ ID NO: 5000968 - DNA, 21 bp, Homo sapiens
tgaaggtttgatgccaaagca

SEQ ID NO: 5000969 - DNA, 20 bp, Homo sapiens
tgaatagctgtgtatctgtt

SEQ ID NO: 5000970 - DNA, 15 bp, Homo sapiens
tgaatgacatcaaca

SEQ ID NO: 5000971 - DNA, 15 bp, Homo sapiens
tgaatggctgtgccc

SEQ ID NO: 5000972 - DNA, 16 bp, Homo sapiens
tgaatggctgtgcccc

SEQ ID NO: 5000973 - DNA, 18 bp, Homo sapiens
tgaatggctgtgccccac

SEQ ID NO: 5000974 - DNA, 18 bp, Homo sapiens
tgacaatgctgccatgcc

SEQ ID NO: 5000975 - DNA, 17 bp, Homo sapiens
tgacagaacactgtctt

SEQ ID NO: 5000976 - DNA, 22 bp, Homo sapiens
tgaccaaaaccagagggcagtc

SEQ ID NO: 5000977 - DNA, 18 bp, Homo sapiens
tgacctggttgtccaggt

SEQ ID NO: 5000978 - DNA, 17 bp, Homo sapiens
tgaccttctaggaagct

SEQ ID NO: 5000979 - DNA, 11 bp, Homo sapiens
tgactctgcct

SEQ ID NO: 5000980 - DNA, 22 bp, Homo sapiens
tgactctgcctaaccatgggct

SEQ ID NO: 5000981 - DNA, 12 bp, Homo sapiens
tgactgctcagg

SEQ ID NO: 5000982 - DNA, 13 bp, Homo sapiens
tgactgctcaggc

SEQ ID NO: 5000983 - DNA, 17 bp, Homo sapiens
tgactgctcaggcctca

SEQ ID NO: 5000984 - DNA, 17 bp, Homo sapiens
tgagataatacattccg

SEQ ID NO: 5000985 - DNA, 12 bp, Homo sapiens
tgagctggagct

SEQ ID NO: 5000986 - DNA, 18 bp, Homo sapiens
tgaggataccccaaagtc

SEQ ID NO: 5000987 - DNA, 20 bp, Homo sapiens
tgagggtggggtgccccagc

SEQ ID NO: 5000988 - DNA, 23 bp, Homo sapiens
tgagggtggggtgccccagctag

SEQ ID NO: 5000989 - DNA, 15 bp, Homo sapiens
tgagtacagcagaaa

SEQ ID NO: 5000990 - DNA, 14 bp, Homo sapiens
tgagttggccaaga

SEQ ID NO: 5000991 - DNA, 20 bp, Homo sapiens
tgagttggtgttgacatgtg

SEQ ID NO: 5000992 - DNA, 20 bp, Homo sapiens
tgatccaggaaagatgtccc

SEQ ID NO: 5000993 - DNA, 22 bp, Homo sapiens
tgatccaggaaagatgtcccac

SEQ ID NO: 5000994 - DNA, 18 bp, Homo sapiens
tgcaaaaggcctgtgatc

SEQ ID NO: 5000995 - DNA, 14 bp, Homo sapiens
tgcaaacactgtgt

SEQ ID NO: 5000996 - DNA, 15 bp, Homo sapiens
tgcaaacactgtgta

SEQ ID NO: 5000997 - DNA, 13 bp, Homo sapiens
tgcaacaacatgt

SEQ ID NO: 5000998 - DNA, 19 bp, Homo sapiens
tgcaaggaagccacagctg

SEQ ID NO: 5000999 - DNA, 12 bp, Homo sapiens
tgcacagtgcct

SEQ ID NO: 5001000 - DNA, 20 bp, Homo sapiens
tgcacccccctgtgcctgct

SEQ ID NO: 5001001 - DNA, 23 bp, Homo sapiens
tgcacgtgctcttctgttctcaa

SEQ ID NO: 5001002 - DNA, 22 bp, Homo sapiens
tgcacttatttatgaacctgcc

SEQ ID NO: 5001003 - DNA, 23 bp, Homo sapiens
tgcagatagaatttggcccagag

SEQ ID NO: 5001004 - DNA, 15 bp, Homo sapiens
tgcagcatggaggaa

SEQ ID NO: 5001005 - DNA, 18 bp, Homo sapiens
ggcctcatcttccccagc

SEQ ID NO: 5001006 - DNA, 22 bp, Homo sapiens
ggcctcatcttccccagccctc

SEQ ID NO: 5001007 - DNA, 15 bp, Homo sapiens
ggcctctgaggagcc

SEQ ID NO: 5001008 - DNA, 17 bp, Homo sapiens
ggcctctgaggagccca

SEQ ID NO: 5001009 - DNA, 17 bp, Homo sapiens
ggcctgggtcacgctca

SEQ ID NO: 5001010 - DNA, 15 bp, Homo sapiens
ggcctgtgatccagg

SEQ ID NO: 5001011 - DNA, 23 bp, Homo sapiens
ggcgctacaaaataaagctgttc

SEQ ID NO: 5001012 - DNA, 13 bp, Homo sapiens
ggcggcaggcaga

SEQ ID NO: 5001013 - DNA, 20 bp, Homo sapiens
ggctacacagaccctgccca

SEQ ID NO: 5001014 - DNA, 12 bp, Homo sapiens
ggctcagggcca

SEQ ID NO: 5001015 - DNA, 17 bp, Homo sapiens
ggctcagggccaggtcc

SEQ ID NO: 5001016 - DNA, 15 bp, Homo sapiens
ggctgacctgctgtg

SEQ ID NO: 5001017 - DNA, 15 bp, Homo sapiens
gggaaaatggcagaa

SEQ ID NO: 5001018 - DNA, 16 bp, Homo sapiens
gggaatggcacagccc

SEQ ID NO: 5001019 - DNA, 15 bp, Homo sapiens
gggacagacagcagc

SEQ ID NO: 5001020 - DNA, 15 bp, Homo sapiens
gggcaaagctgctgg

SEQ ID NO: 5001021 - DNA, 17 bp, Homo sapiens
ataccccaaagtccagg

SEQ ID NO: 5001022 - DNA, 19 bp, Homo sapiens
atagaatttggcccagaga

SEQ ID NO: 5001023 - DNA, 20 bp, Homo sapiens
atagaatttggcccagagag

SEQ ID NO: 5001024 - DNA, 21 bp, Homo sapiens
atagaatttggcccagagagg

SEQ ID NO: 5001025 - DNA, 15 bp, Homo sapiens
atagcacccatatct

SEQ ID NO: 5001026 - DNA, 17 bp, Homo sapiens
atagcacccatatctgt

SEQ ID NO: 5001027 - DNA, 13 bp, Homo sapiens
atatatattttaa

SEQ ID NO: 5001028 - DNA, 17 bp, Homo sapiens
atatctgtgtgccctag

SEQ ID NO: 5001029 - DNA, 20 bp, Homo sapiens
atatgaaaaaaatgcatttt

SEQ ID NO: 5001030 - DNA, 16 bp, Homo sapiens
atatggggatgcagca

SEQ ID NO: 5001031 - DNA, 23 bp, Homo sapiens
atattaggcatgttcagggatgc

SEQ ID NO: 5001032 - DNA, 11 bp, Homo sapiens
atattttaatt

SEQ ID NO: 5001033 - DNA, 15 bp, Homo sapiens
atcactgggcccaga

SEQ ID NO: 5001034 - DNA, 18 bp, Homo sapiens
atcactgggcccagagga

SEQ ID NO: 5001035 - DNA, 23 bp, Homo sapiens
atcactgggcccagaggagagga

SEQ ID NO: 5001036 - DNA, 16 bp, Homo sapiens
atcatgtgcctggaaa

SEQ ID NO: 5001037 - DNA, 17 bp, Homo sapiens
atcatgtgcctggaaat

SEQ ID NO: 5001038 - DNA, 22 bp, Homo sapiens
atccaagtattttatctgtgtt

SEQ ID NO: 5001039 - DNA, 20 bp, Homo sapiens
atccaccccagccccactgc

SEQ ID NO: 5001040 - DNA, 21 bp, Homo sapiens
atccaggaaagatgtcccaca

SEQ ID NO: 5001041 - DNA, 17 bp, Homo sapiens
atcccagggtacactct

SEQ ID NO: 5001042 - DNA, 19 bp, Homo sapiens
atccctggctgacctgctg

SEQ ID NO: 5001043 - DNA, 20 bp, Homo sapiens
atccctggctgacctgctgt

SEQ ID NO: 5001044 - DNA, 21 bp, Homo sapiens
atccctggctgacctgctgtg

SEQ ID NO: 5001045 - DNA, 22 bp, Homo sapiens
atccctggctgacctgctgtgg

SEQ ID NO: 5001046 - DNA, 19 bp, Homo sapiens
atcctcttctcaaagctgg

SEQ ID NO: 5001047 - DNA, 14 bp, Homo sapiens
atccttcaactctg

SEQ ID NO: 5001048 - DNA, 17 bp, Homo sapiens
atccttcaactctgtga

SEQ ID NO: 5001049 - DNA, 22 bp, Homo sapiens
atcgggtgtaggtgaaaggcat

SEQ ID NO: 5001050 - DNA, 19 bp, Homo sapiens
atctgaactctaagcagaa

SEQ ID NO: 5001051 - DNA, 21 bp, Homo sapiens
atctgaactctaagcagaaga

SEQ ID NO: 5001052 - DNA, 13 bp, Homo sapiens
atctgccaatgcc

SEQ ID NO: 5001053 - DNA, 15 bp, Homo sapiens
atctgtgtgccctag

SEQ ID NO: 5001054 - DNA, 23 bp, Homo sapiens
atctgtgtgccctagggctcaga

SEQ ID NO: 5001055 - DNA, 15 bp, Homo sapiens
atctttgaggtgagg

SEQ ID NO: 5001056 - DNA, 13 bp, Homo sapiens
atgaatagctgtg

SEQ ID NO: 5001057 - DNA, 14 bp, Homo sapiens
atgactgctcaggc

SEQ ID NO: 5001058 - DNA, 16 bp, Homo sapiens
atgactgctcaggcct

SEQ ID NO: 5001059 - DNA, 20 bp, Homo sapiens
atgagctggagctaaggcca

SEQ ID NO: 5001060 - DNA, 19 bp, Homo sapiens
atgaggaacctcaaactgg

SEQ ID NO: 5001061 - DNA, 22 bp, Homo sapiens
atgaggaacctcaaactgggta

SEQ ID NO: 5001062 - DNA, 15 bp, Homo sapiens
atgatcttttcaagt

SEQ ID NO: 5001063 - DNA, 20 bp, Homo sapiens
atgcaaacactgtgtattta

SEQ ID NO: 5001064 - DNA, 12 bp, Homo sapiens
atgcacagtgcc

SEQ ID NO: 5001065 - DNA, 17 bp, Homo sapiens
atgccatgactgctcag

SEQ ID NO: 5001066 - DNA, 14 bp, Homo sapiens
atgccttttatttc

SEQ ID NO: 5001067 - DNA, 18 bp, Homo sapiens
atgctgacaatgctgcca

SEQ ID NO: 5001068 - DNA, 19 bp, Homo sapiens
atgctgacaatgctgccat

SEQ ID NO: 5001069 - DNA, 20 bp, Homo sapiens
atgctgccatgcccaccatc

SEQ ID NO: 5001070 - DNA, 14 bp, Homo sapiens
atggcactgtccag

SEQ ID NO: 5001071 - DNA, 21 bp, Homo sapiens
atggcagaaagatggagaggc

SEQ ID NO: 5001072 - DNA, 22 bp, Homo sapiens
atggcagaaagatggagaggca

SEQ ID NO: 5001073 - DNA, 13 bp, Homo sapiens
atggctgtgcccc

SEQ ID NO: 5001074 - DNA, 14 bp, Homo sapiens
atgggagagtccag

SEQ ID NO: 5001075 - DNA, 16 bp, Homo sapiens
atgggagagtccaggc

SEQ ID NO: 5001076 - DNA, 18 bp, Homo sapiens
atgggagtaggctccaga

SEQ ID NO: 5001077 - DNA, 21 bp, Homo sapiens
atgggagtaggctccagacag

SEQ ID NO: 5001078 - DNA, 22 bp, Homo sapiens
atgggagtaggctccagacagg

SEQ ID NO: 5001079 - DNA, 14 bp, Homo sapiens
atgggctcagggcc

SEQ ID NO: 5001080 - DNA, 16 bp, Homo sapiens
atggtttgcaaggaag

SEQ ID NO: 5001081 - DNA, 17 bp, Homo sapiens
atggtttgcaaggaagc

SEQ ID NO: 5001082 - DNA, 14 bp, Homo sapiens
atgtatgattacat

SEQ ID NO: 5001083 - DNA, 22 bp, Homo sapiens
atgtcgtagttactctcaggca

SEQ ID NO: 5001084 - DNA, 14 bp, Homo sapiens
atgtgcctctgtcc

SEQ ID NO: 5001085 - DNA, 16 bp, Homo sapiens
atgtgcctctgtcctt

SEQ ID NO: 5001086 - DNA, 13 bp, Homo sapiens
atgtgcctggaaa

SEQ ID NO: 5001087 - DNA, 16 bp, Homo sapiens
atgtggcaggggcagt

SEQ ID NO: 5001088 - DNA, 18 bp, Homo sapiens
atgtggcaggggcagtgg

SEQ ID NO: 5001089 - DNA, 20 bp, Homo sapiens
atgtggcaggggcagtggcc

SEQ ID NO: 5001090 - DNA, 14 bp, Homo sapiens
atgttatagctgca

SEQ ID NO: 5001091 - DNA, 17 bp, Homo sapiens
atgtttttgtgtatttg

SEQ ID NO: 5001092 - DNA, 18 bp, Homo sapiens
attactaaagacagaaaa

SEQ ID NO: 5001093 - DNA, 21 bp, Homo sapiens
attagaggatgtggcaggggc

SEQ ID NO: 5001094 - DNA, 13 bp, Homo sapiens
attcactcccaca

SEQ ID NO: 5001095 - DNA, 12 bp, Homo sapiens
attcaggcctct

SEQ ID NO: 5001096 - DNA, 16 bp, Homo sapiens
attcaggcctctgagg

SEQ ID NO: 5001097 - DNA, 19 bp, Homo sapiens
attcaggcctctgaggagc

SEQ ID NO: 5001098 - DNA, 22 bp, Homo sapiens
attcaggcctctgaggagccca

SEQ ID NO: 5001099 - DNA, 18 bp, Homo sapiens
attccatgactctgccta

SEQ ID NO: 5001100 - DNA, 15 bp, Homo sapiens
attccctccacccac

SEQ ID NO: 5001101 - DNA, 21 bp, Homo sapiens
attccctccacccacttgcct

SEQ ID NO: 5001102 - DNA, 19 bp, Homo sapiens
attctcttgaaggtgctgc

SEQ ID NO: 5001103 - DNA, 23 bp, Homo sapiens
attctcttgaaggtgctgccacc

SEQ ID NO: 5001104 - DNA, 16 bp, Homo sapiens
attcttacaaacatgt

SEQ ID NO: 5001105 - DNA, 17 bp, Homo sapiens
attcttacaaacatgtg

SEQ ID NO: 5001106 - DNA, 23 bp, Homo sapiens
atttattagttaggtgtgccaaa

SEQ ID NO: 5001107 - DNA, 15 bp, Homo sapiens
atttcattctcttga

SEQ ID NO: 5001108 - DNA, 14 bp, Homo sapiens
atttcccccaggga

SEQ ID NO: 5001109 - DNA, 13 bp, Homo sapiens
atttcttaaacaa

SEQ ID NO: 5001110 - DNA, 13 bp, Homo sapiens
atttggcccagag

SEQ ID NO: 5001111 - DNA, 21 bp, Homo sapiens
attttatctgtgttgtctctc

SEQ ID NO: 5001112 - DNA, 21 bp, Homo sapiens
attttatgccttttatttctt

SEQ ID NO: 5001113 - DNA, 15 bp, Homo sapiens
attttccatgaaaat

SEQ ID NO: 5001114 - DNA, 10 bp, Homo sapiens
attttgtaat

SEQ ID NO: 5001115 - DNA, 12 bp, Homo sapiens
attttgtaataa

SEQ ID NO: 5001116 - DNA, 14 bp, Homo sapiens
attttgtaataaac

SEQ ID NO: 5001117 - DNA, 18 bp, Homo sapiens
attttgtaataaactctc

SEQ ID NO: 5001118 - DNA, 11 bp, Homo sapiens
caaaatgcaag

SEQ ID NO: 5001119 - DNA, 14 bp, Homo sapiens
caaacactgtgtat

SEQ ID NO: 5001120 - DNA, 11 bp, Homo sapiens
caaacatgtgg

SEQ ID NO: 5001121 - DNA, 18 bp, Homo sapiens
caaacatgtggttaatgc

SEQ ID NO: 5001122 - DNA, 19 bp, Homo sapiens
caaagaaggaaaaggcagg

SEQ ID NO: 5001123 - DNA, 13 bp, Homo sapiens
caaataaatgtgt

SEQ ID NO: 5001124 - DNA, 15 bp, Homo sapiens
caaataaatgtgtaa

SEQ ID NO: 5001125 - DNA, 19 bp, Homo sapiens
caaataaatgtgtaaatgt

SEQ ID NO: 5001126 - DNA, 20 bp, Homo sapiens
caaataaatgtgtaaatgtg

SEQ ID NO: 5001127 - DNA, 12 bp, Homo sapiens
caaatataaact

SEQ ID NO: 5001128 - DNA, 13 bp, Homo sapiens
caaatataaactt

SEQ ID NO: 5001129 - DNA, 14 bp, Homo sapiens
caaatataaacttg

SEQ ID NO: 5001130 - DNA, 13 bp, Homo sapiens
caacaagtaactt

SEQ ID NO: 5001131 - DNA, 15 bp, Homo sapiens
caacagcaggaggca

SEQ ID NO: 5001132 - DNA, 17 bp, Homo sapiens
caacatgtataatattt

SEQ ID NO: 5001133 - DNA, 23 bp, Homo sapiens
caacatgtataatatttttaatt

SEQ ID NO: 5001134 - DNA, 12 bp, Homo sapiens
caagagctgagg

SEQ ID NO: 5001135 - DNA, 13 bp, Homo sapiens
caagctgttccac

SEQ ID NO: 5001136 - DNA, 14 bp, Homo sapiens
caagtagctgctac

SEQ ID NO: 5001137 - DNA, 14 bp, Homo sapiens
caatacctcttgga

SEQ ID NO: 5001138 - DNA, 23 bp, Homo sapiens
caatattctattttgcagataga

SEQ ID NO: 5001139 - DNA, 16 bp, Homo sapiens
caatattttccatgaa

SEQ ID NO: 5001140 - DNA, 17 bp, Homo sapiens
caatcactgggcccaga

SEQ ID NO: 5001141 - DNA, 18 bp, Homo sapiens
caatcactgggcccagag

SEQ ID NO: 5001142 - DNA, 20 bp, Homo sapiens
caatcactgggcccagagga

SEQ ID NO: 5001143 - DNA, 22 bp, Homo sapiens
caatcactgggcccagaggaga

SEQ ID NO: 5001144 - DNA, 20 bp, Homo sapiens
caatgccatgactgctcagg

SEQ ID NO: 5001145 - DNA, 15 bp, Homo sapiens
caatgctgccatgcc

SEQ ID NO: 5001146 - DNA, 18 bp, Homo sapiens
caatgctgccatgcccac

SEQ ID NO: 5001147 - DNA, 20 bp, Homo sapiens
caatggtttgcaaggaagcc

SEQ ID NO: 5001148 - DNA, 12 bp, Homo sapiens
cacaaaatgcaa

SEQ ID NO: 5001149 - DNA, 13 bp, Homo sapiens
cacacactggctc

SEQ ID NO: 5001150 - DNA, 21 bp, Homo sapiens
cacacactggctcctggacct

SEQ ID NO: 5001151 - DNA, 18 bp, Homo sapiens
cacacccacctgctgctg

SEQ ID NO: 5001152 - DNA, 22 bp, Homo sapiens
cacactatttgagttggccaag

SEQ ID NO: 5001153 - DNA, 12 bp, Homo sapiens
cacactggctcc

SEQ ID NO: 5001154 - DNA, 17 bp, Homo sapiens
cacactggctcctggac

SEQ ID NO: 5001155 - DNA, 19 bp, Homo sapiens
cacagaccctgcccacccc

SEQ ID NO: 5001156 - DNA, 18 bp, Homo sapiens
cacagcagtcacaggccc

SEQ ID NO: 5001157 - DNA, 20 bp, Homo sapiens
cacagcagtcacaggcccag

SEQ ID NO: 5001158 - DNA, 21 bp, Homo sapiens
cacagctaataaaagtcagag

SEQ ID NO: 5001159 - DNA, 13 bp, Homo sapiens
cacagggaccaca

SEQ ID NO: 5001160 - DNA, 23 bp, Homo sapiens
cacaggtatgaccttctaggaag

SEQ ID NO: 5001161 - DNA, 16 bp, Homo sapiens
cacaggtgtaaatata

SEQ ID NO: 5001162 - DNA, 12 bp, Homo sapiens
cacagtgcctga

SEQ ID NO: 5001163 - DNA, 11 bp, Homo sapiens
cacatcactga

SEQ ID NO: 5001164 - DNA, 17 bp, Homo sapiens
cacatccaccccagccc

SEQ ID NO: 5001165 - DNA, 13 bp, Homo sapiens
cacatcctcagaa

SEQ ID NO: 5001166 - DNA, 21 bp, Homo sapiens
cacatctgtggagatgcccag

SEQ ID NO: 5001167 - DNA, 18 bp, Homo sapiens
cacatggctatgttttag

SEQ ID NO: 5001168 - DNA, 22 bp, Homo sapiens
caccactttgtctctgagaaca

SEQ ID NO: 5001169 - DNA, 16 bp, Homo sapiens
caccaggtagaacaca

SEQ ID NO: 5001170 - DNA, 18 bp, Homo sapiens
caccagttcctttcaatg

SEQ ID NO: 5001171 - DNA, 14 bp, Homo sapiens
caccatctgccaat

SEQ ID NO: 5001172 - DNA, 14 bp, Homo sapiens
caccatctttgagg

SEQ ID NO: 5001173 - DNA, 12 bp, Homo sapiens
cacccacctgct

SEQ ID NO: 5001174 - DNA, 17 bp, Homo sapiens
cacccacctgctgctgt

SEQ ID NO: 5001175 - DNA, 16 bp, Homo sapiens
cacccacttgcctgtc

SEQ ID NO: 5001176 - DNA, 16 bp, Homo sapiens
cacccatatctgtgtg

SEQ ID NO: 5001177 - DNA, 14 bp, Homo sapiens
caccgttcattcag

SEQ ID NO: 5001178 - DNA, 23 bp, Homo sapiens
cacctaagcaatcactgggccca

SEQ ID NO: 5001179 - DNA, 24 bp, Homo sapiens
cacctaagcaatcactgggcccag

SEQ ID NO: 5001180 - DNA, 12 bp, Homo sapiens
cacctcccaggg

SEQ ID NO: 5001181 - DNA, 13 bp, Homo sapiens
cacctcccagggc

SEQ ID NO: 5001182 - DNA, 15 bp, Homo sapiens
cacctcccagggcta

SEQ ID NO: 5001183 - DNA, 20 bp, Homo sapiens
cacctcccagggctacacag

SEQ ID NO: 5001184 - DNA, 14 bp, Homo sapiens
cacctccctgcaat

SEQ ID NO: 5001185 - DNA, 15 bp, Homo sapiens
caccttatatttacg

SEQ ID NO: 5001186 - DNA, 15 bp, Homo sapiens
caccttgggtctgtg

SEQ ID NO: 5001187 - DNA, 23 bp, Homo sapiens
cacggggcaaagctgctgggcca

SEQ ID NO: 5001188 - DNA, 23 bp, Homo sapiens
cactaagtagaataaagaaaaac

SEQ ID NO: 5001189 - DNA, 15 bp, Homo sapiens
cactaatacaccagg

SEQ ID NO: 5001190 - DNA, 16 bp, Homo sapiens
cactagctagatgctt

SEQ ID NO: 5001191 - DNA, 23 bp, Homo sapiens
cactgacctggttgtccaggtct

SEQ ID NO: 5001192 - DNA, 16 bp, Homo sapiens
cactgagaagatggca

SEQ ID NO: 5001193 - DNA, 23 bp, Homo sapiens
cactgagaagatggcactgtcca

SEQ ID NO: 5001194 - DNA, 16 bp, Homo sapiens
cactgccctccagggc

SEQ ID NO: 5001195 - DNA, 18 bp, Homo sapiens
cactgggcccagaggaga

SEQ ID NO: 5001196 - DNA, 19 bp, Homo sapiens
cactgggcccagaggagag

SEQ ID NO: 5001197 - DNA, 14 bp, Homo sapiens
cactgtccagggcc

SEQ ID NO: 5001198 - DNA, 15 bp, Homo sapiens
cactgtccagggccc

SEQ ID NO: 5001199 - DNA, 16 bp, Homo sapiens
cactgtggaactgcca

SEQ ID NO: 5001200 - DNA, 17 bp, Homo sapiens
cactgtggaactgccac

SEQ ID NO: 5001201 - DNA, 21 bp, Homo sapiens
cactgtggaactgccaccttg

SEQ ID NO: 5001202 - DNA, 12 bp, Homo sapiens
cacttcctgccc

SEQ ID NO: 5001203 - DNA, 14 bp, Homo sapiens
cacttcctgcccca

SEQ ID NO: 5001204 - DNA, 20 bp, Homo sapiens
cacttcctgccccaactgca

SEQ ID NO: 5001205 - DNA, 22 bp, Homo sapiens
cacttcctgccccaactgcagg

SEQ ID NO: 5001206 - DNA, 20 bp, Homo sapiens
cacttctctactctggaagt

SEQ ID NO: 5001207 - DNA, 12 bp, Homo sapiens
cacttctctaga

SEQ ID NO: 5001208 - DNA, 17 bp, Homo sapiens
cactttcagtgaaagca

SEQ ID NO: 5001209 - DNA, 21 bp, Homo sapiens
cactttccttttcttgtctct

SEQ ID NO: 5001210 - DNA, 14 bp, Homo sapiens
aataaactctctag

SEQ ID NO: 5001211 - DNA, 15 bp, Homo sapiens
aataaactctctagg

SEQ ID NO: 5001212 - DNA, 22 bp, Homo sapiens
aataaagctgttctcattcctg

SEQ ID NO: 5001213 - DNA, 15 bp, Homo sapiens
aataaatgtgtaaat

SEQ ID NO: 5001214 - DNA, 18 bp, Homo sapiens
aatagcacccatatctgt

SEQ ID NO: 5001215 - DNA, 17 bp, Homo sapiens
aatagctgtgtatctgt

SEQ ID NO: 5001216 - DNA, 14 bp, Homo sapiens
aatataaacactat

SEQ ID NO: 5001217 - DNA, 15 bp, Homo sapiens
aatatacaaacatgt

SEQ ID NO: 5001218 - DNA, 20 bp, Homo sapiens
aatatacaaacatgtggcaa

SEQ ID NO: 5001219 - DNA, 22 bp, Homo sapiens
aatattctattttgcagataga

SEQ ID NO: 5001220 - DNA, 21 bp, Homo sapiens
aatattttccatgaaaatgca

SEQ ID NO: 5001221 - DNA, 15 bp, Homo sapiens
aatcactgggcccag

SEQ ID NO: 5001222 - DNA, 20 bp, Homo sapiens
aatcactgggcccagaggag

SEQ ID NO: 5001223 - DNA, 20 bp, Homo sapiens
aatctgaactctaagcagaa

SEQ ID NO: 5001224 - DNA, 17 bp, Homo sapiens
aatgatcttttcaagtt

SEQ ID NO: 5001225 - DNA, 15 bp, Homo sapiens
aatgccatgactgct

SEQ ID NO: 5001226 - DNA, 18 bp, Homo sapiens
aatgccatgactgctcag

SEQ ID NO: 5001227 - DNA, 12 bp, Homo sapiens
aatgctaaatgc

SEQ ID NO: 5001228 - DNA, 21 bp, Homo sapiens
aatgctgacaatgctgccatg

SEQ ID NO: 5001229 - DNA, 19 bp, Homo sapiens
aatggcacagcccaaagaa

SEQ ID NO: 5001230 - DNA, 20 bp, Homo sapiens
aatggcacagcccaaagaag

SEQ ID NO: 5001231 - DNA, 18 bp, Homo sapiens
aatggctgtgccccacct

SEQ ID NO: 5001232 - DNA, 20 bp, Homo sapiens
aatggctgtgccccacctgt

SEQ ID NO: 5001233 - DNA, 23 bp, Homo sapiens
aatggtttgaatataaacactat

SEQ ID NO: 5001234 - DNA, 13 bp, Homo sapiens
aatgtgtaaatgt

SEQ ID NO: 5001235 - DNA, 23 bp, Homo sapiens
aattaaaccctgccccacttctc

SEQ ID NO: 5001236 - DNA, 13 bp, Homo sapiens
aattcactcccac

SEQ ID NO: 5001237 - DNA, 14 bp, Homo sapiens
aattctaacttttt

SEQ ID NO: 5001238 - DNA, 12 bp, Homo sapiens
aatttaaagcaa

SEQ ID NO: 5001239 - DNA, 16 bp, Homo sapiens
aatttcattctcttga

SEQ ID NO: 5001240 - DNA, 13 bp, Homo sapiens
aatttggcccaga

SEQ ID NO: 5001241 - DNA, 17 bp, Homo sapiens
aatttggcccagagagg

SEQ ID NO: 5001242 - DNA, 16 bp, Homo sapiens
aattttgtatgaaaaa

SEQ ID NO: 5001243 - DNA, 19 bp, Homo sapiens
acaaacatgtggttaatgc

SEQ ID NO: 5001244 - DNA, 13 bp, Homo sapiens
acaaatgtatgat

SEQ ID NO: 5001245 - DNA, 14 bp, Homo sapiens
acaacatgtataat

SEQ ID NO: 5001246 - DNA, 13 bp, Homo sapiens
acaatttaaagca

SEQ ID NO: 5001247 - DNA, 14 bp, Homo sapiens
acaatttaaagcaa

SEQ ID NO: 5001248 - DNA, 20 bp, Homo sapiens
acaatttaaagcaaaggagt

SEQ ID NO: 5001249 - DNA, 14 bp, Homo sapiens
acacaagagctgga

SEQ ID NO: 5001250 - DNA, 15 bp, Homo sapiens
acacacactggctcc

SEQ ID NO: 5001251 - DNA, 17 bp, Homo sapiens
acacagaccctgcccac

SEQ ID NO: 5001252 - DNA, 23 bp, Homo sapiens
acacagctaataaaagtcagagc

SEQ ID NO: 5001253 - DNA, 13 bp, Homo sapiens
acacatctgtgga

SEQ ID NO: 5001254 - DNA, 19 bp, Homo sapiens
acaccactttgtctctgag

SEQ ID NO: 5001255 - DNA, 13 bp, Homo sapiens
acacccacctgct

SEQ ID NO: 5001256 - DNA, 15 bp, Homo sapiens
acacccacctgctgc

SEQ ID NO: 5001257 - DNA, 17 bp, Homo sapiens
acacccacctgctgctg

SEQ ID NO: 5001258 - DNA, 23 bp, Homo sapiens
acacctccttcctcagtcctgga

SEQ ID NO: 5001259 - DNA, 23 bp, Homo sapiens
acactatttgagttggccaagaa

SEQ ID NO: 5001260 - DNA, 19 bp, Homo sapiens
acactgcttgtgtttttaa

SEQ ID NO: 5001261 - DNA, 23 bp, Homo sapiens
acactgcttgtgtttttaactca

SEQ ID NO: 5001262 - DNA, 18 bp, Homo sapiens
acactggctcctggacct

SEQ ID NO: 5001263 - DNA, 12 bp, Homo sapiens
acagaacactgt

SEQ ID NO: 5001264 - DNA, 14 bp, Homo sapiens
acagaacactgtct

SEQ ID NO: 5001265 - DNA, 15 bp, Homo sapiens
acagaccctgcccac

SEQ ID NO: 5001266 - DNA, 19 bp, Homo sapiens
acagaccctgcccacccca

SEQ ID NO: 5001267 - DNA, 15 bp, Homo sapiens
acagcaattcctcag

SEQ ID NO: 5001268 - DNA, 19 bp, Homo sapiens
acagcaattcctcaggcta

SEQ ID NO: 5001269 - DNA, 14 bp, Homo sapiens
acagcaggaggcac

SEQ ID NO: 5001270 - DNA, 18 bp, Homo sapiens
acagcaggaggcacagca

SEQ ID NO: 5001271 - DNA, 14 bp, Homo sapiens
acagcagtcacagg

SEQ ID NO: 5001272 - DNA, 16 bp, Homo sapiens
acagcccaaagaagga

SEQ ID NO: 5001273 - DNA, 20 bp, Homo sapiens
acagctaataaaagtcagag

SEQ ID NO: 5001274 - DNA, 12 bp, Homo sapiens
acagggaccaca

SEQ ID NO: 5001275 - DNA, 16 bp, Homo sapiens
acagggaccacatcca

SEQ ID NO: 5001276 - DNA, 22 bp, Homo sapiens
acagggaccacatccaccccag

SEQ ID NO: 5001277 - DNA, 20 bp, Homo sapiens
acataaaatatacaaacatg

SEQ ID NO: 5001278 - DNA, 15 bp, Homo sapiens
acatccaccccagcc

SEQ ID NO: 5001279 - DNA, 12 bp, Homo sapiens
acatcctcagaa

SEQ ID NO: 5001280 - DNA, 15 bp, Homo sapiens
acatggagctcaggt

SEQ ID NO: 5001281 - DNA, 18 bp, Homo sapiens
acatggagctcaggtttc

SEQ ID NO: 5001282 - DNA, 22 bp, Homo sapiens
acattttcctcacacccacctg

SEQ ID NO: 5001283 - DNA, 15 bp, Homo sapiens
accaaaaccagaggg

SEQ ID NO: 5001284 - DNA, 19 bp, Homo sapiens
accaacctgaagacaccgt

SEQ ID NO: 5001285 - DNA, 23 bp, Homo sapiens
accaagctgttccacttctctag

SEQ ID NO: 5001286 - DNA, 18 bp, Homo sapiens
accacatccaccccagcc

SEQ ID NO: 5001287 - DNA, 14 bp, Homo sapiens
accagagggcagtc

SEQ ID NO: 5001288 - DNA, 20 bp, Homo sapiens
accagccatcatgtgcctgg

SEQ ID NO: 5001289 - DNA, 18 bp, Homo sapiens
accagtcctgctgcctgg

SEQ ID NO: 5001290 - DNA, 13 bp, Homo sapiens
accatctttgagg

SEQ ID NO: 5001291 - DNA, 17 bp, Homo sapiens
accatgggctcagggcc

SEQ ID NO: 5001292 - DNA, 21 bp, Homo sapiens
accatgggctcagggccaggt

SEQ ID NO: 5001293 - DNA, 18 bp, Homo sapiens
accattatgaagaagaga

SEQ ID NO: 5001294 - DNA, 15 bp, Homo sapiens
acccacctgctgctg

SEQ ID NO: 5001295 - DNA, 16 bp, Homo sapiens
accccatccctggctg

SEQ ID NO: 5001296 - DNA, 14 bp, Homo sapiens
acccccctgtgcct

SEQ ID NO: 5001297 - DNA, 19 bp, Homo sapiens
acccccctgtgcctgctgg

SEQ ID NO: 5001298 - DNA, 16 bp, Homo sapiens
accccttggcactgtg

SEQ ID NO: 5001299 - DNA, 16 bp, Homo sapiens
accctgggctccctgg

SEQ ID NO: 5001300 - DNA, 17 bp, Homo sapiens
acctaagcaatcactgg

SEQ ID NO: 5001301 - DNA, 21 bp, Homo sapiens
acctaagcaatcactgggccc

SEQ ID NO: 5001302 - DNA, 12 bp, Homo sapiens
acctcccagggc

SEQ ID NO: 5001303 - DNA, 19 bp, Homo sapiens
acctggttgtccaggtcta

SEQ ID NO: 5001304 - DNA, 13 bp, Homo sapiens
acctgttgtcctg

SEQ ID NO: 5001305 - DNA, 15 bp, Homo sapiens
acgctcaaggaagga

SEQ ID NO: 5001306 - DNA, 22 bp, Homo sapiens
aggaaagatgtcccacagggac

SEQ ID NO: 5001307 - DNA, 24 bp, Homo sapiens
aggaaagatgtcccacagggacca

SEQ ID NO: 5001308 - DNA, 15 bp, Homo sapiens
aggaagccacagctg

SEQ ID NO: 5001309 - DNA, 18 bp, Homo sapiens
aggaagccacagctggtg

SEQ ID NO: 5001310 - DNA, 16 bp, Homo sapiens
aggaaggcggcaggca

SEQ ID NO: 5001311 - DNA, 17 bp, Homo sapiens
aggaaggcggcaggcag

SEQ ID NO: 5001312 - DNA, 19 bp, Homo sapiens
aggaaggcggcaggcagag

SEQ ID NO: 5001313 - DNA, 21 bp, Homo sapiens
aggaatgctgacaatgctgcc

SEQ ID NO: 5001314 - DNA, 22 bp, Homo sapiens
aggaatgctgacaatgctgcca

SEQ ID NO: 5001315 - DNA, 17 bp, Homo sapiens
aggagacagacacacac

SEQ ID NO: 5001316 - DNA, 18 bp, Homo sapiens
aggagacagacacacact

SEQ ID NO: 5001317 - DNA, 14 bp, Homo sapiens
aggagaggagacag

SEQ ID NO: 5001318 - DNA, 15 bp, Homo sapiens
aggagaggagacaga

SEQ ID NO: 5001319 - DNA, 19 bp, Homo sapiens
aggagaggagacagacaca

SEQ ID NO: 5001320 - DNA, 17 bp, Homo sapiens
aggaggagtgggacaga

SEQ ID NO: 5001321 - DNA, 13 bp, Homo sapiens
aggaggcacagca

SEQ ID NO: 5001322 - DNA, 14 bp, Homo sapiens
aggagtgggacaga

SEQ ID NO: 5001323 - DNA, 20 bp, Homo sapiens
aggagtgggacagacagcag

SEQ ID NO: 5001324 - DNA, 21 bp, Homo sapiens
aggagtgggacagacagcagc

SEQ ID NO: 5001325 - DNA, 13 bp, Homo sapiens
aggatgtggcagg

SEQ ID NO: 5001326 - DNA, 21 bp, Homo sapiens
aggatgtggcaggggcagtgg

SEQ ID NO: 5001327 - DNA, 16 bp, Homo sapiens
aggattcaggcctctg

SEQ ID NO: 5001328 - DNA, 19 bp, Homo sapiens
aggattcaggcctctgagg

SEQ ID NO: 5001329 - DNA, 18 bp, Homo sapiens
aggcaaatccgaaatcag

SEQ ID NO: 5001330 - DNA, 18 bp, Homo sapiens
aggcaccatctgccaatg

SEQ ID NO: 5001331 - DNA, 20 bp, Homo sapiens
aggcaccatctgccaatgcc

SEQ ID NO: 5001332 - DNA, 21 bp, Homo sapiens
aggcaccatctgccaatgcca

SEQ ID NO: 5001333 - DNA, 19 bp, Homo sapiens
aggcatgggggcccaaagg

SEQ ID NO: 5001334 - DNA, 16 bp, Homo sapiens
aggcatgttcagggat

SEQ ID NO: 5001335 - DNA, 17 bp, Homo sapiens
aggcatgttcagggatg

SEQ ID NO: 5001336 - DNA, 21 bp, Homo sapiens
aggcatgttcagggatgctca

SEQ ID NO: 5001337 - DNA, 13 bp, Homo sapiens
aggccaggcctct

SEQ ID NO: 5001338 - DNA, 14 bp, Homo sapiens
aggcccaggaaggc

SEQ ID NO: 5001339 - DNA, 18 bp, Homo sapiens
aggcctcacctcccaggg

SEQ ID NO: 5001340 - DNA, 19 bp, Homo sapiens
aggcctcacctcccagggc

SEQ ID NO: 5001341 - DNA, 23 bp, Homo sapiens
aggcctctactaggtctgctcct

SEQ ID NO: 5001342 - DNA, 20 bp, Homo sapiens
aggcctctgaggagcccacg

SEQ ID NO: 5001343 - DNA, 20 bp, Homo sapiens
aggcctgggtcacgctcaag

SEQ ID NO: 5001344 - DNA, 17 bp, Homo sapiens
aggcggcaggcagagaa

SEQ ID NO: 5001345 - DNA, 12 bp, Homo sapiens
gccctccagggc

SEQ ID NO: 5001346 - DNA, 13 bp, Homo sapiens
gccctccagggcc

SEQ ID NO: 5001347 - DNA, 16 bp, Homo sapiens
gccctccagggccagg

SEQ ID NO: 5001348 - DNA, 17 bp, Homo sapiens
gccctccagggccagga

SEQ ID NO: 5001349 - DNA, 12 bp, Homo sapiens
gccctctcctgg

SEQ ID NO: 5001350 - DNA, 19 bp, Homo sapiens
gccctctcctgggcagctg

SEQ ID NO: 5001351 - DNA, 11 bp, Homo sapiens
gccgactcagg

SEQ ID NO: 5001352 - DNA, 13 bp, Homo sapiens
gccgactcaggga

SEQ ID NO: 5001353 - DNA, 16 bp, Homo sapiens
gccgactcagggacct

SEQ ID NO: 5001354 - DNA, 14 bp, Homo sapiens
gcctaaccatgggc

SEQ ID NO: 5001355 - DNA, 21 bp, Homo sapiens
gcctaaccatgggctcagggc

SEQ ID NO: 5001356 - DNA, 22 bp, Homo sapiens
gcctaaccatgggctcagggcc

SEQ ID NO: 5001357 - DNA, 13 bp, Homo sapiens
gcctcaacagcag

SEQ ID NO: 5001358 - DNA, 14 bp, Homo sapiens
gcctcaacagcagg

SEQ ID NO: 5001359 - DNA, 15 bp, Homo sapiens
gcctcaacagcagga

SEQ ID NO: 5001360 - DNA, 14 bp, Homo sapiens
gcctcacctcccag

SEQ ID NO: 5001361 - DNA, 16 bp, Homo sapiens
gcctcacctcccaggg

SEQ ID NO: 5001362 - DNA, 17 bp, Homo sapiens
gcctcacctcccagggc

SEQ ID NO: 5001363 - DNA, 20 bp, Homo sapiens
gcctcacctcccagggctac

SEQ ID NO: 5001364 - DNA, 16 bp, Homo sapiens
gcctcatcttccccag

SEQ ID NO: 5001365 - DNA, 17 bp, Homo sapiens
gcctcccctcctctgct

SEQ ID NO: 5001366 - DNA, 22 bp, Homo sapiens
gcctcccctcctctgcttgcca

SEQ ID NO: 5001367 - DNA, 15 bp, Homo sapiens
tccccacctgctcac

SEQ ID NO: 5001368 - DNA, 23 bp, Homo sapiens
tccccagacttctctttcttatt

SEQ ID NO: 5001369 - DNA, 12 bp, Homo sapiens
tcccctcctctg

SEQ ID NO: 5001370 - DNA, 14 bp, Homo sapiens
tcccctcctctgct

SEQ ID NO: 5001371 - DNA, 20 bp, Homo sapiens
taaaccctgccccacttctc

SEQ ID NO: 5001372 - DNA, 14 bp, Homo sapiens
taaagacagaaaaa

SEQ ID NO: 5001373 - DNA, 20 bp, Homo sapiens
taaagacagaaaaaaataaa

SEQ ID NO: 5001374 - DNA, 22 bp, Homo sapiens
taaagcacagtctgatgacaca

SEQ ID NO: 5001375 - DNA, 14 bp, Homo sapiens
taaagccctcagat

SEQ ID NO: 5001376 - DNA, 13 bp, Homo sapiens
taaagctgttctc

SEQ ID NO: 5001377 - DNA, 23 bp, Homo sapiens
taaagctgttctcattcctgttc

SEQ ID NO: 5001378 - DNA, 17 bp, Homo sapiens
taaagggtatgagctgg

SEQ ID NO: 5001379 - DNA, 12 bp, Homo sapiens
taaatgtgtaaa

SEQ ID NO: 5001380 - DNA, 22 bp, Homo sapiens
tgcaggaatgctgacaatgctg

SEQ ID NO: 5001381 - DNA, 21 bp, Homo sapiens
tgcatagcagctgctactagc

SEQ ID NO: 5001382 - DNA, 21 bp, Homo sapiens
tgcatgaaggtttctgaaaat

SEQ ID NO: 5001383 - DNA, 12 bp, Homo sapiens
tgccatccctcc

SEQ ID NO: 5001384 - DNA, 15 bp, Homo sapiens
tgccatccctccctc

SEQ ID NO: 5001385 - DNA, 20 bp, Homo sapiens
tgccatccctccctccacct

SEQ ID NO: 5001386 - DNA, 20 bp, Homo sapiens
tgccatgactgctcaggcct

SEQ ID NO: 5001387 - DNA, 21 bp, Homo sapiens
tgccatgactgctcaggcctc

SEQ ID NO: 5001388 - DNA, 15 bp, Homo sapiens
tgccatgcccaccat

SEQ ID NO: 5001389 - DNA, 17 bp, Homo sapiens
tgccatgggagagtcca

SEQ ID NO: 5001390 - DNA, 19 bp, Homo sapiens
tgccatgggagagtccagg

SEQ ID NO: 5001391 - DNA, 22 bp, Homo sapiens
tgccatgggagagtccaggcct

SEQ ID NO: 5001392 - DNA, 12 bp, Homo sapiens
tgcccaccccat

SEQ ID NO: 5001393 - DNA, 21 bp, Homo sapiens
tgcccaccccatccctggctg

SEQ ID NO: 5001394 - DNA, 16 bp, Homo sapiens
tgccctagggctcaga

SEQ ID NO: 5001395 - DNA, 19 bp, Homo sapiens
tgccctagggctcagaggg

SEQ ID NO: 5001396 - DNA, 12 bp, Homo sapiens
tgccctccaggg

SEQ ID NO: 5001397 - DNA, 14 bp, Homo sapiens
tgccctccagggcc

SEQ ID NO: 5001398 - DNA, 19 bp, Homo sapiens
tgccctccagggccaggat

SEQ ID NO: 5001399 - DNA, 12 bp, Homo sapiens
tgccctctcctg

SEQ ID NO: 5001400 - DNA, 18 bp, Homo sapiens
tgccctctcctgggcagc

SEQ ID NO: 5001401 - DNA, 20 bp, Homo sapiens
tgcctaaccatgggctcagg

SEQ ID NO: 5001402 - DNA, 11 bp, Homo sapiens
tgcctcccctc

SEQ ID NO: 5001403 - DNA, 12 bp, Homo sapiens
tgcctcccctcc

SEQ ID NO: 5001404 - DNA, 18 bp, Homo sapiens
tgcctcccctcctctgct

SEQ ID NO: 5001405 - DNA, 19 bp, Homo sapiens
tgcctcccctcctctgctt

SEQ ID NO: 5001406 - DNA, 22 bp, Homo sapiens
tgcctcccctcctctgcttgcc

SEQ ID NO: 5001407 - DNA, 23 bp, Homo sapiens
tgcctcccctcctctgcttgcca

SEQ ID NO: 5001408 - DNA, 23 bp, Homo sapiens
tgcctgatgggagtaggctccag

SEQ ID NO: 5001409 - DNA, 16 bp, Homo sapiens
tgcctgctgggcactg

SEQ ID NO: 5001410 - DNA, 18 bp, Homo sapiens
tgcctgctgggcactggg

SEQ ID NO: 5001411 - DNA, 21 bp, Homo sapiens
tgcctggagtcagtagccaga

SEQ ID NO: 5001412 - DNA, 22 bp, Homo sapiens
tgcctggagtcagtagccagag

SEQ ID NO: 5001413 - DNA, 11 bp, Homo sapiens
tgcctgtcacc

SEQ ID NO: 5001414 - DNA, 19 bp, Homo sapiens
tgcctgtcaccccagtcac

SEQ ID NO: 5001415 - DNA, 21 bp, Homo sapiens
tgccttatctaaatcaccaga

SEQ ID NO: 5001416 - DNA, 19 bp, Homo sapiens
tgctaaatgcaaacactgt

SEQ ID NO: 5001417 - DNA, 22 bp, Homo sapiens
tgctaactagcttggaaactgg

SEQ ID NO: 5001418 - DNA, 15 bp, Homo sapiens
tgctaggtctgacca

SEQ ID NO: 5001419 - DNA, 16 bp, Homo sapiens
tgctaggtctgaccaa

SEQ ID NO: 5001420 - DNA, 19 bp, Homo sapiens
tgctcaccaagctgttcca

SEQ ID NO: 5001421 - DNA, 13 bp, Homo sapiens
tgctcaggcctca

SEQ ID NO: 5001422 - DNA, 17 bp, Homo sapiens
tgctcaggcctcacctc

SEQ ID NO: 5001423 - DNA, 22 bp, Homo sapiens
tgctcctgaaccagtcctgctg

SEQ ID NO: 5001424 - DNA, 21 bp, Homo sapiens
tgctgccaccccttggcactg

SEQ ID NO: 5001425 - DNA, 22 bp, Homo sapiens
tgctgccaccccttggcactgt

SEQ ID NO: 5001426 - DNA, 16 bp, Homo sapiens
tgctgcctggagtcag

SEQ ID NO: 5001427 - DNA, 11 bp, Homo sapiens
tgctgggccag

SEQ ID NO: 5001428 - DNA, 17 bp, Homo sapiens
tgctgggccagtggcac

SEQ ID NO: 5001429 - DNA, 22 bp, Homo sapiens
tgctgggccagtggcactctgt

SEQ ID NO: 5001430 - DNA, 16 bp, Homo sapiens
tgctggggcagagtgg

SEQ ID NO: 5001431 - DNA, 23 bp, Homo sapiens
tgctggggcagagtggagcccag

SEQ ID NO: 5001432 - DNA, 14 bp, Homo sapiens
tggaaatacacagt

SEQ ID NO: 5001433 - DNA, 14 bp, Homo sapiens
tggaacatccttgg

SEQ ID NO: 5001434 - DNA, 13 bp, Homo sapiens
tggaactgccacc

SEQ ID NO: 5001435 - DNA, 22 bp, Homo sapiens
tggaagccggccggctgggatc

SEQ ID NO: 5001436 - DNA, 12 bp, Homo sapiens
tggacagaagaa

SEQ ID NO: 5001437 - DNA, 14 bp, Homo sapiens
tggagaggcatggg

SEQ ID NO: 5001438 - DNA, 21 bp, Homo sapiens
tggagaggcatgggggcccaa

SEQ ID NO: 5001439 - DNA, 17 bp, Homo sapiens
tggagcccagggtgctg

SEQ ID NO: 5001440 - DNA, 19 bp, Homo sapiens
tggaggagctcaggacact

SEQ ID NO: 5001441 - DNA, 20 bp, Homo sapiens
tggaggttgcagtgagctga

SEQ ID NO: 5001442 - DNA, 18 bp, Homo sapiens
tggagtcagtagccagag

SEQ ID NO: 5001443 - DNA, 19 bp, Homo sapiens
tggagtcagtagccagagt

SEQ ID NO: 5001444 - DNA, 22 bp, Homo sapiens
tggagtcatgtgcctctgtcct

SEQ ID NO: 5001445 - DNA, 21 bp, Homo sapiens
tggcaagctgcaaaaggcctg

SEQ ID NO: 5001446 - DNA, 20 bp, Homo sapiens
tggcacagcccaaagaagga

SEQ ID NO: 5001447 - DNA, 14 bp, Homo sapiens
tggcactctgtgtg

SEQ ID NO: 5001448 - DNA, 12 bp, Homo sapiens
tggcactgtcca

SEQ ID NO: 5001449 - DNA, 14 bp, Homo sapiens
tggcactgtccagg

SEQ ID NO: 5001450 - DNA, 16 bp, Homo sapiens
tggcactgtccagggc

SEQ ID NO: 5001451 - DNA, 19 bp, Homo sapiens
tggcactgtggaactgcca

SEQ ID NO: 5001452 - DNA, 22 bp, Homo sapiens
tggcactgtggaactgccacct

SEQ ID NO: 5001453 - DNA, 18 bp, Homo sapiens
tggcagaaagatggagag

SEQ ID NO: 5001454 - DNA, 14 bp, Homo sapiens
tggcagctgggcag

SEQ ID NO: 5001455 - DNA, 22 bp, Homo sapiens
tggcaggggcagtggcctggat

SEQ ID NO: 5001456 - DNA, 15 bp, Homo sapiens
tggctagtccttgtt

SEQ ID NO: 5001457 - DNA, 21 bp, Homo sapiens
tggctatattaggcatgttca

SEQ ID NO: 5001458 - DNA, 13 bp, Homo sapiens
tggctgtgcccca

SEQ ID NO: 5001459 - DNA, 15 bp, Homo sapiens
tgggacagacagcag

SEQ ID NO: 5001460 - DNA, 17 bp, Homo sapiens
tgggacagacagcagct

SEQ ID NO: 5001461 - DNA, 18 bp, Homo sapiens
tgggacagacagcagctg

SEQ ID NO: 5001462 - DNA, 20 bp, Homo sapiens
tgggacagacagcagctgga

SEQ ID NO: 5001463 - DNA, 21 bp, Homo sapiens
tgggacagacagcagctggac

SEQ ID NO: 5001464 - DNA, 19 bp, Homo sapiens
tgggagagtccaggcctgg

SEQ ID NO: 5001465 - DNA, 20 bp, Homo sapiens
tgggagagtccaggcctggg

SEQ ID NO: 5001466 - DNA, 17 bp, Homo sapiens
tgggagtaggctccaga

SEQ ID NO: 5001467 - DNA, 13 bp, Homo sapiens
tgggcactgggca

SEQ ID NO: 5001468 - DNA, 17 bp, Homo sapiens
tgggcactgggcactag

SEQ ID NO: 5001469 - DNA, 20 bp, Homo sapiens
tgggcaggtctcctctggga

SEQ ID NO: 5001470 - DNA, 16 bp, Homo sapiens
tgggccagtggcactc

SEQ ID NO: 5001471 - DNA, 19 bp, Homo sapiens
tgggccagtggcactctgt

SEQ ID NO: 5001472 - DNA, 16 bp, Homo sapiens
tgggcccagaggagag

SEQ ID NO: 5001473 - DNA, 13 bp, Homo sapiens
tgggctcagggcc

SEQ ID NO: 5001474 - DNA, 16 bp, Homo sapiens
tgggctcagggccagg

SEQ ID NO: 5001475 - DNA, 20 bp, Homo sapiens
tgggctcagggccaggtcct

SEQ ID NO: 5001476 - DNA, 18 bp, Homo sapiens
tggggaggggctgaggat

SEQ ID NO: 5001477 - DNA, 11 bp, Homo sapiens
tggggcagagt

SEQ ID NO: 5001478 - DNA, 13 bp, Homo sapiens
tggggcagagtgg

SEQ ID NO: 5001479 - DNA, 21 bp, Homo sapiens
tggggcagagtggagcccagg

SEQ ID NO: 5001480 - DNA, 23 bp, Homo sapiens
tggggtgccccagctaggaagca

SEQ ID NO: 5001481 - DNA, 17 bp, Homo sapiens
tggtttgcaaggaagcc

SEQ ID NO: 5001482 - DNA, 20 bp, Homo sapiens
tgtaaattttgtatgaaaaa

SEQ ID NO: 5001483 - DNA, 17 bp, Homo sapiens
tgtaataaactctctag

SEQ ID NO: 5001484 - DNA, 22 bp, Homo sapiens
tgtaggtttctctgcctccagg

SEQ ID NO: 5001485 - DNA, 20 bp, Homo sapiens
tgtatttgttaatggtttga

SEQ ID NO: 5001486 - DNA, 17 bp, Homo sapiens
tgtcaccagctgccaaa

SEQ ID NO: 5001487 - DNA, 18 bp, Homo sapiens
tgtcaccagctgccaaaa

SEQ ID NO: 5001488 - DNA, 17 bp, Homo sapiens
tgtcaccccagtcacct

SEQ ID NO: 5001489 - DNA, 23 bp, Homo sapiens
tgtcacttgtaggtttctctgcc

SEQ ID NO: 5001490 - DNA, 22 bp, Homo sapiens
tgtcagtcccactgcacccccc

SEQ ID NO: 5001491 - DNA, 17 bp, Homo sapiens
tgtccagggcccatgta

SEQ ID NO: 5001492 - DNA, 23 bp, Homo sapiens
tgtccaggtctagaaggccaggc

SEQ ID NO: 5001493 - DNA, 17 bp, Homo sapiens
tgtcccacagggaccac

SEQ ID NO: 5001494 - DNA, 17 bp, Homo sapiens
tgtccctattctgccat

SEQ ID NO: 5001495 - DNA, 22 bp, Homo sapiens
tgtcgtagttactctcaggcat

SEQ ID NO: 5001496 - DNA, 12 bp, Homo sapiens
tgtctctgaggc

SEQ ID NO: 5001497 - DNA, 17 bp, Homo sapiens
tgtgaatggctgtgccc

SEQ ID NO: 5001498 - DNA, 21 bp, Homo sapiens
tgtgccccacctgttgtcctg

SEQ ID NO: 5001499 - DNA, 18 bp, Homo sapiens
tgtgccctagggctcaga

SEQ ID NO: 5001500 - DNA, 14 bp, Homo sapiens
tgtgcctctgtcct

SEQ ID NO: 5001501 - DNA, 15 bp, Homo sapiens
tgtgcctctgtcctt

SEQ ID NO: 5001502 - DNA, 16 bp, Homo sapiens
tgtgcctctgtcctta

SEQ ID NO: 5001503 - DNA, 15 bp, Homo sapiens
gaggagtgggacaga

SEQ ID NO: 5001504 - DNA, 17 bp, Homo sapiens
gaggagtgggacagaca

SEQ ID NO: 5001505 - DNA, 15 bp, Homo sapiens
gaggataccccaaag

SEQ ID NO: 5001506 - DNA, 22 bp, Homo sapiens
gaggataccccaaagtccaggc

SEQ ID NO: 5001507 - DNA, 14 bp, Homo sapiens
gaggatgtggcagg

SEQ ID NO: 5001508 - DNA, 17 bp, Homo sapiens
gaggatgtggcaggggc

SEQ ID NO: 5001509 - DNA, 18 bp, Homo sapiens
gaggatgtggcaggggca

SEQ ID NO: 5001510 - DNA, 13 bp, Homo sapiens
gaggcatgggggc

SEQ ID NO: 5001511 - DNA, 18 bp, Homo sapiens
gaggcatgggggcccaaa

SEQ ID NO: 5001512 - DNA, 19 bp, Homo sapiens
gaggcatgggggcccaaag

SEQ ID NO: 5001513 - DNA, 21 bp, Homo sapiens
gaggcatgggggcccaaaggg

SEQ ID NO: 5001514 - DNA, 19 bp, Homo sapiens
gaggttgcagtgagctgag

SEQ ID NO: 5001515 - DNA, 20 bp, Homo sapiens
gagtagaaagacagagctgg

SEQ ID NO: 5001516 - DNA, 17 bp, Homo sapiens
gagtaggctccagacag

SEQ ID NO: 5001517 - DNA, 13 bp, Homo sapiens
gagtcatgtgcct

SEQ ID NO: 5001518 - DNA, 14 bp, Homo sapiens
gagtggagcccagg

SEQ ID NO: 5001519 - DNA, 21 bp, Homo sapiens
gagtggagcccagggtgctgg

SEQ ID NO: 5001520 - DNA, 13 bp, Homo sapiens
gagttggccaaga

SEQ ID NO: 5001521 - DNA, 18 bp, Homo sapiens
gagttgttctcaggggtg

SEQ ID NO: 5001522 - DNA, 19 bp, Homo sapiens
gagttgttctcaggggtgc

SEQ ID NO: 5001523 - DNA, 21 bp, Homo sapiens
gagttgttctcaggggtgctg

SEQ ID NO: 5001524 - DNA, 22 bp, Homo sapiens
gatagaatttggcccagagagg

SEQ ID NO: 5001525 - DNA, 13 bp, Homo sapiens
gatccaggaaaga

SEQ ID NO: 5001526 - DNA, 16 bp, Homo sapiens
gatccaggaaagatgt

SEQ ID NO: 5001527 - DNA, 21 bp, Homo sapiens
gatccaggaaagatgtcccac

SEQ ID NO: 5001528 - DNA, 11 bp, Homo sapiens
gatcccagggt

SEQ ID NO: 5001529 - DNA, 18 bp, Homo sapiens
gatcgctgtgctaggtct

SEQ ID NO: 5001530 - DNA, 17 bp, Homo sapiens
ctgttccacttctctag

SEQ ID NO: 5001531 - DNA, 16 bp, Homo sapiens
ctgttctcattcctgt

SEQ ID NO: 5001532 - DNA, 21 bp, Homo sapiens
cttaggttgtagcagaaagga

SEQ ID NO: 5001533 - DNA, 14 bp, Homo sapiens
cttatctcttctca

SEQ ID NO: 5001534 - DNA, 15 bp, Homo sapiens
cttatctcttctcac

SEQ ID NO: 5001535 - DNA, 15 bp, Homo sapiens
cttcaactctgtgag

SEQ ID NO: 5001536 - DNA, 17 bp, Homo sapiens
cttcaactctgtgaggt

SEQ ID NO: 5001537 - DNA, 21 bp, Homo sapiens
cttcagaatatggacaaagaa

SEQ ID NO: 5001538 - DNA, 23 bp, Homo sapiens
cttccaccaagttggaacatcct

SEQ ID NO: 5001539 - DNA, 14 bp, Homo sapiens
cttccactgtcagc

SEQ ID NO: 5001540 - DNA, 18 bp, Homo sapiens
cttccactgtcagccctc

SEQ ID NO: 5001541 - DNA, 20 bp, Homo sapiens
cttccactgtcagccctcac

SEQ ID NO: 5001542 - DNA, 21 bp, Homo sapiens
cttccactgtcagccctcact

SEQ ID NO: 5001543 - DNA, 13 bp, Homo sapiens
cttccccagccct

SEQ ID NO: 5001544 - DNA, 17 bp, Homo sapiens
cttcctaccaaatataa

SEQ ID NO: 5001545 - DNA, 13 bp, Homo sapiens
cttctaggaagct

SEQ ID NO: 5001546 - DNA, 20 bp, Homo sapiens
cttctccattccctccaccc

SEQ ID NO: 5001547 - DNA, 22 bp, Homo sapiens
cttctccattccctccacccac

SEQ ID NO: 5001548 - DNA, 17 bp, Homo sapiens
cttctctactctggaag

SEQ ID NO: 5001549 - DNA, 22 bp, Homo sapiens
cttctctttcttattttgtaat

SEQ ID NO: 5001550 - DNA, 18 bp, Homo sapiens
cttctggtgccagatcct

SEQ ID NO: 5001551 - DNA, 17 bp, Homo sapiens
cttgaaggtgctgccac

SEQ ID NO: 5001552 - DNA, 18 bp, Homo sapiens
cttgaaggtgctgccacc

SEQ ID NO: 5001553 - DNA, 17 bp, Homo sapiens
cttgacagaacactgtc

SEQ ID NO: 5001554 - DNA, 15 bp, Homo sapiens
cttgccatccctccc

SEQ ID NO: 5001555 - DNA, 22 bp, Homo sapiens
cttgctcaccaagctgttccac

SEQ ID NO: 5001556 - DNA, 21 bp, Homo sapiens
cttggaaactggatgaggtca

SEQ ID NO: 5001557 - DNA, 13 bp, Homo sapiens
cttggcactgtgg

SEQ ID NO: 5001558 - DNA, 22 bp, Homo sapiens
cttggcactgtggaactgccac

SEQ ID NO: 5001559 - DNA, 19 bp, Homo sapiens
cttggccgactcagggacc

SEQ ID NO: 5001560 - DNA, 18 bp, Homo sapiens
cttgtaggtttctctgcc

SEQ ID NO: 5001561 - DNA, 20 bp, Homo sapiens
cttgtaggtttctctgcctc

SEQ ID NO: 5001562 - DNA, 18 bp, Homo sapiens
cttgtctctgaggctctc

SEQ ID NO: 5001563 - DNA, 21 bp, Homo sapiens
cttgtctctgaggctctccaa

SEQ ID NO: 5001564 - DNA, 12 bp, Homo sapiens
ctttagctgtga

SEQ ID NO: 5001565 - DNA, 20 bp, Homo sapiens
ctttaggttgcttcagctga

SEQ ID NO: 5001566 - DNA, 20 bp, Homo sapiens
ctttccttttcttgtctctg

SEQ ID NO: 5001567 - DNA, 22 bp, Homo sapiens
ctttccttttcttgtctctgag

SEQ ID NO: 5001568 - DNA, 20 bp, Homo sapiens
ctttctgaatttcattctct

SEQ ID NO: 5001569 - DNA, 18 bp, Homo sapiens
ctttcttattttgtaata

SEQ ID NO: 5001570 - DNA, 17 bp, Homo sapiens
ctttgagataatacatt

SEQ ID NO: 5001571 - DNA, 19 bp, Homo sapiens
ctttgcatagcagctgcta

SEQ ID NO: 5001572 - DNA, 20 bp, Homo sapiens
ctttggggcttttacaccag

SEQ ID NO: 5001573 - DNA, 14 bp, Homo sapiens
ctttggtccttcaa

SEQ ID NO: 5001574 - DNA, 20 bp, Homo sapiens
cttttcttgtctctgaggct

SEQ ID NO: 5001575 - DNA, 20 bp, Homo sapiens
gaaaatgcaacaacatgtat

SEQ ID NO: 5001576 - DNA, 16 bp, Homo sapiens
gaaaatggcagaaaga

SEQ ID NO: 5001577 - DNA, 15 bp, Homo sapiens
gaaaattaacactgc

SEQ ID NO: 5001578 - DNA, 16 bp, Homo sapiens
gaaagacagagctggg

SEQ ID NO: 5001579 - DNA, 14 bp, Homo sapiens
gaaagatggagagg

SEQ ID NO: 5001580 - DNA, 14 bp, Homo sapiens
gaaagatgtcccac

SEQ ID NO: 5001581 - DNA, 19 bp, Homo sapiens
gaaaggaaaagattcctgt

SEQ ID NO: 5001582 - DNA, 18 bp, Homo sapiens
gaaagtgcagcatggagg

SEQ ID NO: 5001583 - DNA, 16 bp, Homo sapiens
gaaattggaagagcac

SEQ ID NO: 5001584 - DNA, 20 bp, Homo sapiens
gaacaccactttgtctctga

SEQ ID NO: 5001585 - DNA, 20 bp, Homo sapiens
gaaccagtcctgctgcctgg

SEQ ID NO: 5001586 - DNA, 20 bp, Homo sapiens
gaacctaactccccacccca

SEQ ID NO: 5001587 - DNA, 18 bp, Homo sapiens
gaactctaagcagaagac

SEQ ID NO: 5001588 - DNA, 14 bp, Homo sapiens
gaactgccaccttg

SEQ ID NO: 5001589 - DNA, 20 bp, Homo sapiens
gaagaagaggcctagcctga

SEQ ID NO: 5001590 - DNA, 22 bp, Homo sapiens
gaagactctccactgacctggt

SEQ ID NO: 5001591 - DNA, 21 bp, Homo sapiens
gaagagtccttttagcacatc

SEQ ID NO: 5001592 - DNA, 17 bp, Homo sapiens
gaagatggcactgtcca

SEQ ID NO: 5001593 - DNA, 22 bp, Homo sapiens
gaagatggcactgtccagggcc

SEQ ID NO: 5001594 - DNA, 23 bp, Homo sapiens
gaagatggcactgtccagggccc

SEQ ID NO: 5001595 - DNA, 19 bp, Homo sapiens
gaagctcaggttccctgcc

SEQ ID NO: 5001596 - DNA, 20 bp, Homo sapiens
gaaggaaaaggcagggagcg

SEQ ID NO: 5001597 - DNA, 18 bp, Homo sapiens
gaaggcacaggtgtaaat

SEQ ID NO: 5001598 - DNA, 19 bp, Homo sapiens
gaaggcacaggtgtaaata

SEQ ID NO: 5001599 - DNA, 17 bp, Homo sapiens
gaaggcagcaggtggca

SEQ ID NO: 5001600 - DNA, 18 bp, Homo sapiens
gaaggcggcaggcagaga

SEQ ID NO: 5001601 - DNA, 19 bp, Homo sapiens
gaaggcggcaggcagagaa

SEQ ID NO: 5001602 - DNA, 16 bp, Homo sapiens
gaaggtgctgccaccc

SEQ ID NO: 5001603 - DNA, 18 bp, Homo sapiens
gaaggtgctgccacccct

SEQ ID NO: 5001604 - DNA, 19 bp, Homo sapiens
gaaggtttgatgccaaagc

SEQ ID NO: 5001605 - DNA, 21 bp, Homo sapiens
gaaggtttgatgccaaagcag

SEQ ID NO: 5001606 - DNA, 22 bp, Homo sapiens
gaatagcacccatatctgtgtg

SEQ ID NO: 5001607 - DNA, 21 bp, Homo sapiens
gaatataaacactatatggca

SEQ ID NO: 5001608 - DNA, 16 bp, Homo sapiens
gaatatggacaaagaa

SEQ ID NO: 5001609 - DNA, 17 bp, Homo sapiens
gaatggctgtgccccac

SEQ ID NO: 5001610 - DNA, 15 bp, Homo sapiens
gacaagaagagtcct

SEQ ID NO: 5001611 - DNA, 13 bp, Homo sapiens
gacaatgctgcca

SEQ ID NO: 5001612 - DNA, 14 bp, Homo sapiens
gacagaaaaaaata

SEQ ID NO: 5001613 - DNA, 17 bp, Homo sapiens
gacagacacacactggc

SEQ ID NO: 5001614 - DNA, 18 bp, Homo sapiens
gacagacacacactggct

SEQ ID NO: 5001615 - DNA, 15 bp, Homo sapiens
gacagacagcagctg

SEQ ID NO: 5001616 - DNA, 18 bp, Homo sapiens
gacagcctccccctgtcc

SEQ ID NO: 5001617 - DNA, 14 bp, Homo sapiens
gacagcgccacctc

SEQ ID NO: 5001618 - DNA, 14 bp, Homo sapiens
gacattttcctcac

SEQ ID NO: 5001619 - DNA, 19 bp, Homo sapiens
gaccaaaaccagagggcag

SEQ ID NO: 5001620 - DNA, 14 bp, Homo sapiens
gaccacatccaccc

SEQ ID NO: 5001621 - DNA, 19 bp, Homo sapiens
gaccacatccaccccagcc

SEQ ID NO: 5001622 - DNA, 17 bp, Homo sapiens
gacccaagtagctgcta

SEQ ID NO: 5001623 - DNA, 22 bp, Homo sapiens
gaccctgcccaccccatccctg

SEQ ID NO: 5001624 - DNA, 23 bp, Homo sapiens
gaccctgcccaccccatccctgg

SEQ ID NO: 5001625 - DNA, 17 bp, Homo sapiens
gacctggttgtccaggt

SEQ ID NO: 5001626 - DNA, 20 bp, Homo sapiens
gacgactgttttcccaacac

SEQ ID NO: 5001627 - DNA, 18 bp, Homo sapiens
gactacttgggagcaccg

SEQ ID NO: 5001628 - DNA, 19 bp, Homo sapiens
gactcagggacctaagcca

SEQ ID NO: 5001629 - DNA, 18 bp, Homo sapiens
gactctagaagctcaggt

SEQ ID NO: 5001630 - DNA, 21 bp, Homo sapiens
gactctgcctaaccatgggct

SEQ ID NO: 5001631 - DNA, 13 bp, Homo sapiens
gactgctcaggcc

SEQ ID NO: 5001632 - DNA, 12 bp, Homo sapiens
gacttcacaaaa

SEQ ID NO: 5001633 - DNA, 17 bp, Homo sapiens
gacttcacaaaatgcaa

SEQ ID NO: 5001634 - DNA, 15 bp, Homo sapiens
gacttctctttctta

SEQ ID NO: 5001635 - DNA, 16 bp, Homo sapiens
gacttgacagaacact

SEQ ID NO: 5001636 - DNA, 18 bp, Homo sapiens
gacttgacagaacactgt

SEQ ID NO: 5001637 - DNA, 16 bp, Homo sapiens
gagaagatggcactgt

SEQ ID NO: 5001638 - DNA, 21 bp, Homo sapiens
gagaagatggcactgtccagg

SEQ ID NO: 5001639 - DNA, 22 bp, Homo sapiens
gagaattgtgcgacttcacaaa

SEQ ID NO: 5001640 - DNA, 13 bp, Homo sapiens
gagaggagacaga

SEQ ID NO: 5001641 - DNA, 16 bp, Homo sapiens
gagaggagacagacac

SEQ ID NO: 5001642 - DNA, 13 bp, Homo sapiens
gagagtccaggcc

SEQ ID NO: 5001643 - DNA, 15 bp, Homo sapiens
gagagtccaggcctg

SEQ ID NO: 5001644 - DNA, 18 bp, Homo sapiens
gagatccagggcaaggcc

SEQ ID NO: 5001645 - DNA, 18 bp, Homo sapiens
gagcccacggggcaaagc

SEQ ID NO: 5001646 - DNA, 12 bp, Homo sapiens
gagcccagggtg

SEQ ID NO: 5001647 - DNA, 23 bp, Homo sapiens
gagcgtggggaggggctgaggat

SEQ ID NO: 5001648 - DNA, 18 bp, Homo sapiens
gagctaaggccagctaga

SEQ ID NO: 5001649 - DNA, 16 bp, Homo sapiens
gagctcaggtttctgg

SEQ ID NO: 5001650 - DNA, 19 bp, Homo sapiens
gagctgccctctcctgggc

SEQ ID NO: 5001651 - DNA, 21 bp, Homo sapiens
gagctgccctctcctgggcag

SEQ ID NO: 5001652 - DNA, 23 bp, Homo sapiens
gagctgccctctcctgggcagct

SEQ ID NO: 5001653 - DNA, 11 bp, Homo sapiens
gagctggagct

SEQ ID NO: 5001654 - DNA, 20 bp, Homo sapiens
gagcttccactgtcagccct

SEQ ID NO: 5001655 - DNA, 20 bp, Homo sapiens
gaggactctagaagctcagg

SEQ ID NO: 5001656 - DNA, 21 bp, Homo sapiens
gaggactctagaagctcaggt

SEQ ID NO: 5001657 - DNA, 17 bp, Homo sapiens
gaggagaggagacagac

SEQ ID NO: 5001658 - DNA, 16 bp, Homo sapiens
ctcaggtttctggaca

SEQ ID NO: 5001659 - DNA, 14 bp, Homo sapiens
ctcagtcctggaag

SEQ ID NO: 5001660 - DNA, 17 bp, Homo sapiens
ctcatcttccccagccc

SEQ ID NO: 5001661 - DNA, 21 bp, Homo sapiens
ctcatcttccccagccctccc

SEQ ID NO: 5001662 - DNA, 15 bp, Homo sapiens
ctccacctccctgca

SEQ ID NO: 5001663 - DNA, 12 bp, Homo sapiens
ctccactgacct

SEQ ID NO: 5001664 - DNA, 20 bp, Homo sapiens
ctccagggccaggattcagg

SEQ ID NO: 5001665 - DNA, 23 bp, Homo sapiens
ctccagggccaggattcaggcct

SEQ ID NO: 5001666 - DNA, 23 bp, Homo sapiens
ctccaggttgcctcaacagcagg

SEQ ID NO: 5001667 - DNA, 14 bp, Homo sapiens
ctccccacctgctc

SEQ ID NO: 5001668 - DNA, 12 bp, Homo sapiens
ctccctcccaca

SEQ ID NO: 5001669 - DNA, 22 bp, Homo sapiens
ctcctattctcttaatttttct

SEQ ID NO: 5001670 - DNA, 14 bp, Homo sapiens
ctcctctgcttgcc

SEQ ID NO: 5001671 - DNA, 18 bp, Homo sapiens
ctcctgaaccagtcctgc

SEQ ID NO: 5001672 - DNA, 22 bp, Homo sapiens
ctcctgaaccagtcctgctgcc

SEQ ID NO: 5001673 - DNA, 15 bp, Homo sapiens
ctcctgggcagctgc

SEQ ID NO: 5001674 - DNA, 19 bp, Homo sapiens
ctccttcctcagtcctgga

SEQ ID NO: 5001675 - DNA, 19 bp, Homo sapiens
ctctaaacccaaataaatg

SEQ ID NO: 5001676 - DNA, 16 bp, Homo sapiens
ctctactaggtctgct

SEQ ID NO: 5001677 - DNA, 19 bp, Homo sapiens
ctctactaggtctgctcct

SEQ ID NO: 5001678 - DNA, 15 bp, Homo sapiens
ctctagaagctcagg

SEQ ID NO: 5001679 - DNA, 13 bp, Homo sapiens
ctctagagaacat

SEQ ID NO: 5001680 - DNA, 13 bp, Homo sapiens
ctctccactgacc

SEQ ID NO: 5001681 - DNA, 16 bp, Homo sapiens
ctctccactgacctgg

SEQ ID NO: 5001682 - DNA, 15 bp, Homo sapiens
ctctcctgggcagct

SEQ ID NO: 5001683 - DNA, 21 bp, Homo sapiens
ctctcctgggcagctgcctcc

SEQ ID NO: 5001684 - DNA, 18 bp, Homo sapiens
ctctgcctaaccatgggc

SEQ ID NO: 5001685 - DNA, 19 bp, Homo sapiens
ctctgcctaaccatgggct

SEQ ID NO: 5001686 - DNA, 20 bp, Homo sapiens
ctctgcctaaccatgggctc

SEQ ID NO: 5001687 - DNA, 22 bp, Homo sapiens
ctctgcctaaccatgggctcag

SEQ ID NO: 5001688 - DNA, 21 bp, Homo sapiens
ctctgtgtgggaaaatggcag

SEQ ID NO: 5001689 - DNA, 23 bp, Homo sapiens
ctcttcagaatatggacaaagaa

SEQ ID NO: 5001690 - DNA, 19 bp, Homo sapiens
ctcttctgttctcaaatgc

SEQ ID NO: 5001691 - DNA, 18 bp, Homo sapiens
ctcttgaaggtgctgcca

SEQ ID NO: 5001692 - DNA, 21 bp, Homo sapiens
ctcttgaaggtgctgccaccc

SEQ ID NO: 5001693 - DNA, 23 bp, Homo sapiens
ctcttgaaggtgctgccacccct

SEQ ID NO: 5001694 - DNA, 23 bp, Homo sapiens
ctctttcttattttgtaataaac

SEQ ID NO: 5001695 - DNA, 20 bp, Homo sapiens
ctcttttccaaacacaggca

SEQ ID NO: 5001696 - DNA, 17 bp, Homo sapiens
ctgaactctaagcagaa

SEQ ID NO: 5001697 - DNA, 15 bp, Homo sapiens
ctgacaatgctgcca

SEQ ID NO: 5001698 - DNA, 19 bp, Homo sapiens
ctgacaatgctgccatgcc

SEQ ID NO: 5001699 - DNA, 13 bp, Homo sapiens
ctgacctgctgtg

SEQ ID NO: 5001700 - DNA, 17 bp, Homo sapiens
ctgacctggttgtccag

SEQ ID NO: 5001701 - DNA, 18 bp, Homo sapiens
ctgacctggttgtccagg

SEQ ID NO: 5001702 - DNA, 20 bp, Homo sapiens
ctgacctggttgtccaggtc

SEQ ID NO: 5001703 - DNA, 18 bp, Homo sapiens
ctgagaagatggcactgt

SEQ ID NO: 5001704 - DNA, 20 bp, Homo sapiens
ctgagaagatggcactgtcc

SEQ ID NO: 5001705 - DNA, 22 bp, Homo sapiens
ctgagaagatggcactgtccag

SEQ ID NO: 5001706 - DNA, 21 bp, Homo sapiens
ctgagactttcagtgcactgt

SEQ ID NO: 5001707 - DNA, 15 bp, Homo sapiens
ctgagattgcgccac

SEQ ID NO: 5001708 - DNA, 16 bp, Homo sapiens
ctgaggagcccacggg

SEQ ID NO: 5001709 - DNA, 23 bp, Homo sapiens
ctgaggataccccaaagtccagg

SEQ ID NO: 5001710 - DNA, 11 bp, Homo sapiens
ctgaggctctc

SEQ ID NO: 5001711 - DNA, 21 bp, Homo sapiens
ctgagttggtgttgacatgtg

SEQ ID NO: 5001712 - DNA, 17 bp, Homo sapiens
ctgatcctaaccctggg

SEQ ID NO: 5001713 - DNA, 21 bp, Homo sapiens
ctgatcctaaccctgggctcc

SEQ ID NO: 5001714 - DNA, 16 bp, Homo sapiens
ctgatccttcaactct

SEQ ID NO: 5001715 - DNA, 19 bp, Homo sapiens
ctgatgggagtaggctcca

SEQ ID NO: 5001716 - DNA, 16 bp, Homo sapiens
ctgatttgttccttct

SEQ ID NO: 5001717 - DNA, 15 bp, Homo sapiens
ctgcaaaaggcctgt

SEQ ID NO: 5001718 - DNA, 17 bp, Homo sapiens
ctgcacccccctgtgcc

SEQ ID NO: 5001719 - DNA, 20 bp, Homo sapiens
ctgcacccccctgtgcctgc

SEQ ID NO: 5001720 - DNA, 20 bp, Homo sapiens
ctgcagaacagcttcatgtt

SEQ ID NO: 5001721 - DNA, 17 bp, Homo sapiens
ctgcatttgtctggcct

SEQ ID NO: 5001722 - DNA, 21 bp, Homo sapiens
ctgccaatgccatgactgctc

SEQ ID NO: 5001723 - DNA, 17 bp, Homo sapiens
ctgccaccccttggcac

SEQ ID NO: 5001724 - DNA, 22 bp, Homo sapiens
ctgccaccttgggtctgtgtca

SEQ ID NO: 5001725 - DNA, 17 bp, Homo sapiens
ctgccatgcccaccatc

SEQ ID NO: 5001726 - DNA, 18 bp, Homo sapiens
ctgccatgggagagtcca

SEQ ID NO: 5001727 - DNA, 19 bp, Homo sapiens
ctgccatgggagagtccag

SEQ ID NO: 5001728 - DNA, 17 bp, Homo sapiens
ctgcccaccccatccct

SEQ ID NO: 5001729 - DNA, 16 bp, Homo sapiens
ctgccccaactgcagg

SEQ ID NO: 5001730 - DNA, 15 bp, Homo sapiens
ctgccctccagggcc

SEQ ID NO: 5001731 - DNA, 13 bp, Homo sapiens
ctgccctctcctg

SEQ ID NO: 5001732 - DNA, 16 bp, Homo sapiens
ctgccctctcctgggc

SEQ ID NO: 5001733 - DNA, 21 bp, Homo sapiens
ctgccctctcctgggcagctg

SEQ ID NO: 5001734 - DNA, 16 bp, Homo sapiens
ctgcctaaccatgggc

SEQ ID NO: 5001735 - DNA, 23 bp, Homo sapiens
ctgcctaaccatgggctcagggc

SEQ ID NO: 5001736 - DNA, 17 bp, Homo sapiens
ctgcctcccctcctctg

SEQ ID NO: 5001737 - DNA, 20 bp, Homo sapiens
ctgcctggagtcagtagcca

SEQ ID NO: 5001738 - DNA, 14 bp, Homo sapiens
ctgctcaggcctca

SEQ ID NO: 5001739 - DNA, 23 bp, Homo sapiens
ctgctcctgaaccagtcctgctg

SEQ ID NO: 5001740 - DNA, 22 bp, Homo sapiens
ctgctgcctggagtcagtagcc

SEQ ID NO: 5001741 - DNA, 16 bp, Homo sapiens
ctgctgggcactgggc

SEQ ID NO: 5001742 - DNA, 21 bp, Homo sapiens
ctgctgggcactgggcactag

SEQ ID NO: 5001743 - DNA, 23 bp, Homo sapiens
ctgctgggcactgggcactagct

SEQ ID NO: 5001744 - DNA, 16 bp, Homo sapiens
ctgctgggccagtggc

SEQ ID NO: 5001745 - DNA, 17 bp, Homo sapiens
ctgctgggccagtggca

SEQ ID NO: 5001746 - DNA, 20 bp, Homo sapiens
ctgctgggccagtggcactc

SEQ ID NO: 5001747 - DNA, 21 bp, Homo sapiens
ctgctgtatgaatagctgtgt

SEQ ID NO: 5001748 - DNA, 17 bp, Homo sapiens
ctgctgtggatgtccct

SEQ ID NO: 5001749 - DNA, 18 bp, Homo sapiens
ctgcttgccatccctccc

SEQ ID NO: 5001750 - DNA, 22 bp, Homo sapiens
ctgcttgccatccctccctcca

SEQ ID NO: 5001751 - DNA, 18 bp, Homo sapiens
ctggacaagaagagtcct

SEQ ID NO: 5001752 - DNA, 16 bp, Homo sapiens
ctggagctaaggccag

SEQ ID NO: 5001753 - DNA, 17 bp, Homo sapiens
ctggagctaaggccagc

SEQ ID NO: 5001754 - DNA, 21 bp, Homo sapiens
ctggagctaaggccagctaga

SEQ ID NO: 5001755 - DNA, 15 bp, Homo sapiens
ctggatgcacagtgc

SEQ ID NO: 5001756 - DNA, 16 bp, Homo sapiens
ctggatgcacagtgcc

SEQ ID NO: 5001757 - DNA, 14 bp, Homo sapiens
ctggctcctggacc

SEQ ID NO: 5001758 - DNA, 17 bp, Homo sapiens
ctggctgacctgctgtg

SEQ ID NO: 5001759 - DNA, 20 bp, Homo sapiens
ctgggcactagctagatgct

SEQ ID NO: 5001760 - DNA, 19 bp, Homo sapiens
ctgggcagctgcctcccct

SEQ ID NO: 5001761 - DNA, 22 bp, Homo sapiens
ctgggcagctgcctcccctcct

SEQ ID NO: 5001762 - DNA, 14 bp, Homo sapiens
ctgggccagtggca

SEQ ID NO: 5001763 - DNA, 12 bp, Homo sapiens
ctgggcccagag

SEQ ID NO: 5001764 - DNA, 17 bp, Homo sapiens
ctgggctccctggagga

SEQ ID NO: 5001765 - DNA, 20 bp, Homo sapiens
ctgggctccctggaggactc

SEQ ID NO: 5001766 - DNA, 20 bp, Homo sapiens
ctggggcagagtggagccca

SEQ ID NO: 5001767 - DNA, 18 bp, Homo sapiens
ctgggtcacgctcaagga

SEQ ID NO: 5001768 - DNA, 22 bp, Homo sapiens
ctgggtcacgctcaaggaagga

SEQ ID NO: 5001769 - DNA, 18 bp, Homo sapiens
ctggttgtccaggtctag

SEQ ID NO: 5001770 - DNA, 12 bp, Homo sapiens
ctgtcaccccag

SEQ ID NO: 5001771 - DNA, 16 bp, Homo sapiens
ctgtcagccctcactg

SEQ ID NO: 5001772 - DNA, 13 bp, Homo sapiens
ctgtccagggccc

SEQ ID NO: 5001773 - DNA, 21 bp, Homo sapiens
ctgtgatccaggaaagatgtc

SEQ ID NO: 5001774 - DNA, 15 bp, Homo sapiens
ctgtgccccacctgt

SEQ ID NO: 5001775 - DNA, 16 bp, Homo sapiens
ctgtgcctgctgggca

SEQ ID NO: 5001776 - DNA, 19 bp, Homo sapiens
ctgtgcctgctgggcactg

SEQ ID NO: 5001777 - DNA, 20 bp, Homo sapiens
ctgtgcctgctgggcactgg

SEQ ID NO: 5001778 - DNA, 15 bp, Homo sapiens
ctgtgctaggtctga

SEQ ID NO: 5001779 - DNA, 19 bp, Homo sapiens
ctgtgctaggtctgaccaa

SEQ ID NO: 5001780 - DNA, 14 bp, Homo sapiens
ctgtggaactgcca

SEQ ID NO: 5001781 - DNA, 16 bp, Homo sapiens
ctgtggaactgccacc

SEQ ID NO: 5001782 - DNA, 21 bp, Homo sapiens
ctgtggaactgccaccttggg

SEQ ID NO: 5001783 - DNA, 14 bp, Homo sapiens
ctgtgtgccctagg

SEQ ID NO: 5001784 - DNA, 21 bp, Homo sapiens
ctgtgtgccctagggctcaga

SEQ ID NO: 5001785 - DNA, 18 bp, Homo sapiens
ctgtgtgggaaaatggca

SEQ ID NO: 5001786 - DNA, 17 bp, Homo sapiens
ccctccacctccctgca

SEQ ID NO: 5001787 - DNA, 16 bp, Homo sapiens
ccctccagggccagga

SEQ ID NO: 5001788 - DNA, 14 bp, Homo sapiens
ccctccccacctgc

SEQ ID NO: 5001789 - DNA, 16 bp, Homo sapiens
ccctccccacctgctc

SEQ ID NO: 5001790 - DNA, 13 bp, Homo sapiens
ccctgccacacta

SEQ ID NO: 5001791 - DNA, 22 bp, Homo sapiens
ccctgcccaccccatccctggc

SEQ ID NO: 5001792 - DNA, 21 bp, Homo sapiens
ccctggaaggacatccatgtt

SEQ ID NO: 5001793 - DNA, 17 bp, Homo sapiens
ccctggctgacctgctg

SEQ ID NO: 5001794 - DNA, 16 bp, Homo sapiens
ccctgggctccctgga

SEQ ID NO: 5001795 - DNA, 17 bp, Homo sapiens
ccctgtgcctgctgggc

SEQ ID NO: 5001796 - DNA, 21 bp, Homo sapiens
ccctgtgcctgctgggcactg

SEQ ID NO: 5001797 - DNA, 10 bp, Homo sapiens
ccgactcagg

SEQ ID NO: 5001798 - DNA, 13 bp, Homo sapiens
ccgagaagaacag

SEQ ID NO: 5001799 - DNA, 23 bp, Homo sapiens
ccgtacgactcttttccaaacac

SEQ ID NO: 5001800 - DNA, 23 bp, Homo sapiens
cctaaagggtatgagctggagct

SEQ ID NO: 5001801 - DNA, 14 bp, Homo sapiens
cctaaccatgggct

SEQ ID NO: 5001802 - DNA, 14 bp, Homo sapiens
cctaccaaatataa

SEQ ID NO: 5001803 - DNA, 15 bp, Homo sapiens
cctagggctcagagg

SEQ ID NO: 5001804 - DNA, 11 bp, Homo sapiens
cctcaaactgg

SEQ ID NO: 5001805 - DNA, 16 bp, Homo sapiens
cctcaacagcaggagg

SEQ ID NO: 5001806 - DNA, 16 bp, Homo sapiens
cctcacacccacctgc

SEQ ID NO: 5001807 - DNA, 19 bp, Homo sapiens
cctcacacccacctgctgc

SEQ ID NO: 5001808 - DNA, 23 bp, Homo sapiens
cctcacacccacctgctgctgta

SEQ ID NO: 5001809 - DNA, 11 bp, Homo sapiens
cctcagaaagt

SEQ ID NO: 5001810 - DNA, 16 bp, Homo sapiens
cctcagaaagtgcagc

SEQ ID NO: 5001811 - DNA, 21 bp, Homo sapiens
cctcagaaagtgcagcatgga

SEQ ID NO: 5001812 - DNA, 18 bp, Homo sapiens
cctccacccacttgcctg

SEQ ID NO: 5001813 - DNA, 15 bp, Homo sapiens
cctccacctccctgc

SEQ ID NO: 5001814 - DNA, 22 bp, Homo sapiens
cctccacctccctgcaataaaa

SEQ ID NO: 5001815 - DNA, 16 bp, Homo sapiens
cctccagggccaggat

SEQ ID NO: 5001816 - DNA, 19 bp, Homo sapiens
cctcccagggctacacaga

SEQ ID NO: 5001817 - DNA, 14 bp, Homo sapiens
cctccccacctgct

SEQ ID NO: 5001818 - DNA, 18 bp, Homo sapiens
cctcctctgcttgccatc

SEQ ID NO: 5001819 - DNA, 11 bp, Homo sapiens
cctctcctggg

SEQ ID NO: 5001820 - DNA, 17 bp, Homo sapiens
cctctcctgggcagctg

SEQ ID NO: 5001821 - DNA, 20 bp, Homo sapiens
cctctcctgggcagctgcct

SEQ ID NO: 5001822 - DNA, 22 bp, Homo sapiens
cctctcctgggcagctgcctcc

SEQ ID NO: 5001823 - DNA, 14 bp, Homo sapiens
cctctgaggagccc

SEQ ID NO: 5001824 - DNA, 19 bp, Homo sapiens
cctgatcctaaccctgggc

SEQ ID NO: 5001825 - DNA, 20 bp, Homo sapiens
cctgatcctaaccctgggct

SEQ ID NO: 5001826 - DNA, 19 bp, Homo sapiens
cctgatgggagtaggctcc

SEQ ID NO: 5001827 - DNA, 24 bp, Homo sapiens
cctgcccaccccatccctggctga

SEQ ID NO: 5001828 - DNA, 13 bp, Homo sapiens
caggttgcctcaa

SEQ ID NO: 5001829 - DNA, 21 bp, Homo sapiens
caggttgcctcaacagcagga

SEQ ID NO: 5001830 - DNA, 23 bp, Homo sapiens
cagtagccagagttgttctcagg

SEQ ID NO: 5001831 - DNA, 15 bp, Homo sapiens
cagtcacaggcccag

SEQ ID NO: 5001832 - DNA, 16 bp, Homo sapiens
cagtcccactgcaccc

SEQ ID NO: 5001833 - DNA, 18 bp, Homo sapiens
cagtcccactgcaccccc

SEQ ID NO: 5001834 - DNA, 19 bp, Homo sapiens
ccttggcactgtggaactg

SEQ ID NO: 5001835 - DNA, 22 bp, Homo sapiens
ccttggcactgtggaactgcca

SEQ ID NO: 5001836 - DNA, 20 bp, Homo sapiens
ccttttagcacatcactgag

SEQ ID NO: 5001837 - DNA, 12 bp, Homo sapiens
ccttttccatgc

SEQ ID NO: 5001838 - DNA, 16 bp, Homo sapiens
ccttttcttgtctctg

SEQ ID NO: 5001839 - DNA, 17 bp, Homo sapiens
ccttttcttgtctctga

SEQ ID NO: 5001840 - DNA, 17 bp, Homo sapiens
cgaccacttttcagttc

SEQ ID NO: 5001841 - DNA, 21 bp, Homo sapiens
cgatgggcccaattcttacaa

SEQ ID NO: 5001842 - DNA, 12 bp, Homo sapiens
cgcatcatatgc

SEQ ID NO: 5001843 - DNA, 12 bp, Homo sapiens
cggcaggcagag

SEQ ID NO: 5001844 - DNA, 23 bp, Homo sapiens
cggggcaaagctgctgggccagt

SEQ ID NO: 5001845 - DNA, 12 bp, Homo sapiens
cggtactcccat

SEQ ID NO: 5001846 - DNA, 14 bp, Homo sapiens
cgtgccctaccaca

SEQ ID NO: 5001847 - DNA, 17 bp, Homo sapiens
cgtgctcttctgttctc

SEQ ID NO: 5001848 - DNA, 17 bp, Homo sapiens
cgtggggaggggctgag

SEQ ID NO: 5001849 - DNA, 20 bp, Homo sapiens
cgtggggaggggctgaggat

SEQ ID NO: 5001850 - DNA, 15 bp, Homo sapiens
ctaaacccaaataaa

SEQ ID NO: 5001851 - DNA, 17 bp, Homo sapiens
ctaaacccaaataaatg

SEQ ID NO: 5001852 - DNA, 19 bp, Homo sapiens
ctaaacccaaataaatgtg

SEQ ID NO: 5001853 - DNA, 13 bp, Homo sapiens
ctaaccatgggct

SEQ ID NO: 5001854 - DNA, 17 bp, Homo sapiens
ctaaccatgggctcagg

SEQ ID NO: 5001855 - DNA, 18 bp, Homo sapiens
ctaaccatgggctcaggg

SEQ ID NO: 5001856 - DNA, 19 bp, Homo sapiens
ctaaccatgggctcagggc

SEQ ID NO: 5001857 - DNA, 23 bp, Homo sapiens
ctaaccatgggctcagggccagg

SEQ ID NO: 5001858 - DNA, 13 bp, Homo sapiens
ctaaccctgggct

SEQ ID NO: 5001859 - DNA, 20 bp, Homo sapiens
ctaaccctgggctccctgga

SEQ ID NO: 5001860 - DNA, 18 bp, Homo sapiens
ctaagcaatcactgggcc

SEQ ID NO: 5001861 - DNA, 23 bp, Homo sapiens
ctaagcaatcactgggcccagag

SEQ ID NO: 5001862 - DNA, 16 bp, Homo sapiens
ctaaggccagctagag

SEQ ID NO: 5001863 - DNA, 18 bp, Homo sapiens
ctaataaaagtcagagct

SEQ ID NO: 5001864 - DNA, 16 bp, Homo sapiens
ctaatatatccatgat

SEQ ID NO: 5001865 - DNA, 13 bp, Homo sapiens
ctacacagaccct

SEQ ID NO: 5001866 - DNA, 18 bp, Homo sapiens
ctactagctctttgagat

SEQ ID NO: 5001867 - DNA, 22 bp, Homo sapiens
ctagaagctcaggttccctgcc

SEQ ID NO: 5001868 - DNA, 12 bp, Homo sapiens
ctagaaggccag

SEQ ID NO: 5001869 - DNA, 15 bp, Homo sapiens
ctagaaggccaggcc

SEQ ID NO: 5001870 - DNA, 18 bp, Homo sapiens
ctagagcttccactgtca

SEQ ID NO: 5001871 - DNA, 19 bp, Homo sapiens
ctagatgctttaggttgct

SEQ ID NO: 5001872 - DNA, 13 bp, Homo sapiens
ctagctagatgct

SEQ ID NO: 5001873 - DNA, 18 bp, Homo sapiens
ctagggctcagaggggcc

SEQ ID NO: 5001874 - DNA, 14 bp, Homo sapiens
ctaggtctgctcct

SEQ ID NO: 5001875 - DNA, 12 bp, Homo sapiens
ctagtccttgtt

SEQ ID NO: 5001876 - DNA, 20 bp, Homo sapiens
ctatattaggcatgttcagg

SEQ ID NO: 5001877 - DNA, 21 bp, Homo sapiens
ctatattaggcatgttcaggg

SEQ ID NO: 5001878 - DNA, 14 bp, Homo sapiens
ctatattgtacaca

SEQ ID NO: 5001879 - DNA, 15 bp, Homo sapiens
ctatattgtacacac

SEQ ID NO: 5001880 - DNA, 20 bp, Homo sapiens
ctattctgccatgggagagt

SEQ ID NO: 5001881 - DNA, 17 bp, Homo sapiens
ctcaaatgctaaatgca

SEQ ID NO: 5001882 - DNA, 18 bp, Homo sapiens
ctcaaatgctaaatgcaa

SEQ ID NO: 5001883 - DNA, 15 bp, Homo sapiens
ctcaacagcaggagg

SEQ ID NO: 5001884 - DNA, 20 bp, Homo sapiens
ctcaacagcaggaggcacag

SEQ ID NO: 5001885 - DNA, 23 bp, Homo sapiens
ctcaacagcaggaggcacagcag

SEQ ID NO: 5001886 - DNA, 21 bp, Homo sapiens
ctcacacccacctgctgctgt

SEQ ID NO: 5001887 - DNA, 18 bp, Homo sapiens
ctcacagcagtcacaggc

SEQ ID NO: 5001888 - DNA, 18 bp, Homo sapiens
ctcactgtcagtcccact

SEQ ID NO: 5001889 - DNA, 12 bp, Homo sapiens
ctcagggccagg

SEQ ID NO: 5001890 - DNA, 16 bp, Homo sapiens
ctcagggccaggtcct

SEQ ID NO: 5001891 - DNA, 17 bp, Homo sapiens
ctcagggccaggtcctc

SEQ ID NO: 5001892 - DNA, 18 bp, Homo sapiens
ctcagggccaggtcctca

SEQ ID NO: 5001893 - DNA, 15 bp, Homo sapiens
ctcaggggtgctggg

SEQ ID NO: 5001894 - DNA, 19 bp, Homo sapiens
ctcaggggtgctggggcag

SEQ ID NO: 5001895 - DNA, 20 bp, Homo sapiens
ctcaggggtgctggggcaga

SEQ ID NO: 5001896 - DNA, 15 bp, Homo sapiens
ctcaggttccctgcc

SEQ ID NO: 5001897 - DNA, 18 bp, Homo sapiens
ctcaggttccctgccaca

SEQ ID NO: 5001898 - DNA, 22 bp, Homo sapiens
ctcaggtttctggacaagaaga

SEQ ID NO: 5001899 - DNA, 13 bp, Homo sapiens
ctcagtcctggaa

SEQ ID NO: 5001900 - DNA, 14 bp, Homo sapiens
ctcagttctgcctt

SEQ ID NO: 5001901 - DNA, 18 bp, Homo sapiens
ctcattccatgactctgc

SEQ ID NO: 5001902 - DNA, 20 bp, Homo sapiens
ctcattccatgactctgcct

SEQ ID NO: 5001903 - DNA, 12 bp, Homo sapiens
ctcattcctgtt

SEQ ID NO: 5001904 - DNA, 18 bp, Homo sapiens
ctccagacaggaggagtg

SEQ ID NO: 5001905 - DNA, 14 bp, Homo sapiens
ctccaggttgcctc

SEQ ID NO: 5001906 - DNA, 15 bp, Homo sapiens
ctccaggttgcctca

SEQ ID NO: 5001907 - DNA, 22 bp, Homo sapiens
ctccaggttgcctcaacagcag

SEQ ID NO: 5001908 - DNA, 14 bp, Homo sapiens
ctccattccctcca

SEQ ID NO: 5001909 - DNA, 21 bp, Homo sapiens
ctcccagggctacacagaccc

SEQ ID NO: 5001910 - DNA, 11 bp, Homo sapiens
ctcccctcctc

SEQ ID NO: 5001911 - DNA, 13 bp, Homo sapiens
ctcccctcctctg

SEQ ID NO: 5001912 - DNA, 15 bp, Homo sapiens
ctccctccacctccc

SEQ ID NO: 5001913 - DNA, 17 bp, Homo sapiens
ctccctccacctccctg

SEQ ID NO: 5001914 - DNA, 21 bp, Homo sapiens
ctccctccacctccctgcaat

SEQ ID NO: 5001915 - DNA, 12 bp, Homo sapiens
ctcctctgcttg

SEQ ID NO: 5001916 - DNA, 17 bp, Homo sapiens
ctcctgaaccagtcctg

SEQ ID NO: 5001917 - DNA, 23 bp, Homo sapiens
ctcctgaaccagtcctgctgcct

SEQ ID NO: 5001918 - DNA, 12 bp, Homo sapiens
ctcctgggcagc

SEQ ID NO: 5001919 - DNA, 14 bp, Homo sapiens
ctcctgggcagctg

SEQ ID NO: 5001920 - DNA, 16 bp, Homo sapiens
ctcctgggcagctgcc

SEQ ID NO: 5001921 - DNA, 22 bp, Homo sapiens
ctccttcctcagtcctggaagc

SEQ ID NO: 5001922 - DNA, 20 bp, Homo sapiens
ctcgaccacttttcagttca

SEQ ID NO: 5001923 - DNA, 22 bp, Homo sapiens
ctctaagcagaagactctccac

SEQ ID NO: 5001924 - DNA, 13 bp, Homo sapiens
ctctactctggaa

SEQ ID NO: 5001925 - DNA, 19 bp, Homo sapiens
ctctagaagctcaggttcc

SEQ ID NO: 5001926 - DNA, 20 bp, Homo sapiens
ctctctaaacccaaataaat

SEQ ID NO: 5001927 - DNA, 13 bp, Homo sapiens
ctctgagaacaga

SEQ ID NO: 5001928 - DNA, 20 bp, Homo sapiens
ctctgaggagcccacggggc

SEQ ID NO: 5001929 - DNA, 23 bp, Homo sapiens
ctctgatgagagagtgctgagaa

SEQ ID NO: 5001930 - DNA, 14 bp, Homo sapiens
ctctgcctccaggt

SEQ ID NO: 5001931 - DNA, 19 bp, Homo sapiens
ctctgtgtgggaaaatggc

SEQ ID NO: 5001932 - DNA, 17 bp, Homo sapiens
ctcttctccattccctc

SEQ ID NO: 5001933 - DNA, 15 bp, Homo sapiens
ctcttctgttctcaa

SEQ ID NO: 5001934 - DNA, 16 bp, Homo sapiens
ctcttttccaaacaca

SEQ ID NO: 5001935 - DNA, 22 bp, Homo sapiens
ctcttttcctttggtccttcaa

SEQ ID NO: 5001936 - DNA, 17 bp, Homo sapiens
ctgaaaattaacactgc

SEQ ID NO: 5001937 - DNA, 15 bp, Homo sapiens
ctgaactctaagcag

SEQ ID NO: 5001938 - DNA, 14 bp, Homo sapiens
ctgacaatgctgcc

SEQ ID NO: 5001939 - DNA, 20 bp, Homo sapiens
ctgacaatgctgccatgccc

SEQ ID NO: 5001940 - DNA, 24 bp, Homo sapiens
ctgacaatgctgccatgcccacca

SEQ ID NO: 5001941 - DNA, 16 bp, Homo sapiens
ctgaccaaaaccagag

SEQ ID NO: 5001942 - DNA, 20 bp, Homo sapiens
ctgaccaaaaccagagggca

SEQ ID NO: 5001943 - DNA, 22 bp, Homo sapiens
gcccaggaaggcggcaggcaga

SEQ ID NO: 5001944 - DNA, 21 bp, Homo sapiens
gcccagggtgctgggatggct

SEQ ID NO: 5001945 - DNA, 18 bp, Homo sapiens
gcccatgtagctggcaag

SEQ ID NO: 5001946 - DNA, 11 bp, Homo sapiens
gccccacctgt

SEQ ID NO: 5001947 - DNA, 19 bp, Homo sapiens
gccccactgccctccaggg

SEQ ID NO: 5001948 - DNA, 24 bp, Homo sapiens
gccccactgccctccagggccagg

SEQ ID NO: 5001949 - DNA, 13 bp, Homo sapiens
gccctagggctca

SEQ ID NO: 5001950 - DNA, 18 bp, Homo sapiens
gccctcagatcccagggt

SEQ ID NO: 5001951 - DNA, 21 bp, Homo sapiens
gccctcagatcccagggtaca

SEQ ID NO: 5001952 - DNA, 18 bp, Homo sapiens
gccctccagggccaggat

SEQ ID NO: 5001953 - DNA, 14 bp, Homo sapiens
gccctctcctgggc

SEQ ID NO: 5001954 - DNA, 18 bp, Homo sapiens
gccctctcctgggcagct

SEQ ID NO: 5001955 - DNA, 22 bp, Homo sapiens
gccctctcctgggcagctgcct

SEQ ID NO: 5001956 - DNA, 14 bp, Homo sapiens
gccggccggctggg

SEQ ID NO: 5001957 - DNA, 19 bp, Homo sapiens
gccgggacatgcagctctg

SEQ ID NO: 5001958 - DNA, 17 bp, Homo sapiens
gcctaaccatgggctca

SEQ ID NO: 5001959 - DNA, 18 bp, Homo sapiens
gcctaaccatgggctcag

SEQ ID NO: 5001960 - DNA, 23 bp, Homo sapiens
gcctaaccatgggctcagggcca

SEQ ID NO: 5001961 - DNA, 15 bp, Homo sapiens
gcctagcctgagcca

SEQ ID NO: 5001962 - DNA, 19 bp, Homo sapiens
gcctcaacagcaggaggca

SEQ ID NO: 5001963 - DNA, 22 bp, Homo sapiens
gcctcaacagcaggaggcacag

SEQ ID NO: 5001964 - DNA, 24 bp, Homo sapiens
gcctcaacagcaggaggcacagca

SEQ ID NO: 5001965 - DNA, 18 bp, Homo sapiens
gcctcacctcccagggct

SEQ ID NO: 5001966 - DNA, 21 bp, Homo sapiens
gcctccaggttgcctcaacag

SEQ ID NO: 5001967 - DNA, 12 bp, Homo sapiens
gcctcccctcct

SEQ ID NO: 5001968 - DNA, 13 bp, Homo sapiens
gcctcccctcctc

SEQ ID NO: 5001969 - DNA, 20 bp, Homo sapiens
gcctcccctcctctgcttgc

SEQ ID NO: 5001970 - DNA, 15 bp, Homo sapiens
gcctctgaggagccc

SEQ ID NO: 5001971 - DNA, 14 bp, Homo sapiens
gcctgatgggagta

SEQ ID NO: 5001972 - DNA, 15 bp, Homo sapiens
gcctgctgggcactg

SEQ ID NO: 5001973 - DNA, 20 bp, Homo sapiens
gcctgctgggcactgggcac

SEQ ID NO: 5001974 - DNA, 22 bp, Homo sapiens
gcctgggtcacgctcaaggaag

SEQ ID NO: 5001975 - DNA, 19 bp, Homo sapiens
gcctgtgatccaggaaaga

SEQ ID NO: 5001976 - DNA, 21 bp, Homo sapiens
gctaaatgcaaacactgtgta

SEQ ID NO: 5001977 - DNA, 21 bp, Homo sapiens
gctaagccccctactgagaaa

SEQ ID NO: 5001978 - DNA, 21 bp, Homo sapiens
gctaataaaagtcagagctca

SEQ ID NO: 5001979 - DNA, 12 bp, Homo sapiens
gctacacagacc

SEQ ID NO: 5001980 - DNA, 14 bp, Homo sapiens
gctactagctcttt

SEQ ID NO: 5001981 - DNA, 14 bp, Homo sapiens
gctaggtctgacca

SEQ ID NO: 5001982 - DNA, 17 bp, Homo sapiens
gctaggtctgaccaaaa

SEQ ID NO: 5001983 - DNA, 18 bp, Homo sapiens
gctcaccaagctgttcca

SEQ ID NO: 5001984 - DNA, 14 bp, Homo sapiens
gctcagaggggcct

SEQ ID NO: 5001985 - DNA, 23 bp, Homo sapiens
gctcaggcctcacctcccagggc

SEQ ID NO: 5001986 - DNA, 12 bp, Homo sapiens
gctcagggccag

SEQ ID NO: 5001987 - DNA, 14 bp, Homo sapiens
gctcagggccaggt

SEQ ID NO: 5001988 - DNA, 14 bp, Homo sapiens
gctcaggttccctg

SEQ ID NO: 5001989 - DNA, 16 bp, Homo sapiens
gctcaggtttctggac

SEQ ID NO: 5001990 - DNA, 17 bp, Homo sapiens
gctcaggtttctggaca

SEQ ID NO: 5001991 - DNA, 12 bp, Homo sapiens
gctcattccatg

SEQ ID NO: 5001992 - DNA, 22 bp, Homo sapiens
gctcattccatgactctgccta

SEQ ID NO: 5001993 - DNA, 15 bp, Homo sapiens
gctccagacaggagg

SEQ ID NO: 5001994 - DNA, 16 bp, Homo sapiens
gctcttctgttctcaa

SEQ ID NO: 5001995 - DNA, 22 bp, Homo sapiens
gctgacaatgctgccatgccca

SEQ ID NO: 5001996 - DNA, 23 bp, Homo sapiens
gctgacaatgctgccatgcccac

SEQ ID NO: 5001997 - DNA, 13 bp, Homo sapiens
gctgacctgctgt

SEQ ID NO: 5001998 - DNA, 20 bp, Homo sapiens
gctgatccttcaactctgtg

SEQ ID NO: 5001999 - DNA, 23 bp, Homo sapiens
gctgatccttcaactctgtgagg

SEQ ID NO: 5002000 - DNA, 21 bp, Homo sapiens
gctgccaggcaccatctgcca

SEQ ID NO: 5002001 - DNA, 15 bp, Homo sapiens
gctgccctctcctgg

SEQ ID NO: 5002002 - DNA, 17 bp, Homo sapiens
gctgccctctcctgggc

SEQ ID NO: 5002003 - DNA, 14 bp, Homo sapiens
gctgcctcccctcc

SEQ ID NO: 5002004 - DNA, 16 bp, Homo sapiens
gctgcctcccctcctc

SEQ ID NO: 5002005 - DNA, 20 bp, Homo sapiens
gctgcctcccctcctctgct

SEQ ID NO: 5002006 - DNA, 21 bp, Homo sapiens
gctgcctcccctcctctgctt

SEQ ID NO: 5002007 - DNA, 15 bp, Homo sapiens
gctgcctggagtcag

SEQ ID NO: 5002008 - DNA, 21 bp, Homo sapiens
gctgcctggagtcagtagcca

SEQ ID NO: 5002009 - DNA, 16 bp, Homo sapiens
gctgctactagctctt

SEQ ID NO: 5002010 - DNA, 14 bp, Homo sapiens
gctgctgggccagt

SEQ ID NO: 5002011 - DNA, 15 bp, Homo sapiens
gctgggcactgggca

SEQ ID NO: 5002012 - DNA, 12 bp, Homo sapiens
gctgggccagtg

SEQ ID NO: 5002013 - DNA, 14 bp, Homo sapiens
gctgtgctaggtct

SEQ ID NO: 5002014 - DNA, 16 bp, Homo sapiens
gctgtgctaggtctga

SEQ ID NO: 5002015 - DNA, 13 bp, Homo sapiens
gctgtgtatctgt

SEQ ID NO: 5002016 - DNA, 22 bp, Homo sapiens
gcttcatgttcccaaaatcacc

SEQ ID NO: 5002017 - DNA, 16 bp, Homo sapiens
gcttgccatccctccc

SEQ ID NO: 5002018 - DNA, 18 bp, Homo sapiens
gcttggaaactggatgag

SEQ ID NO: 5002019 - DNA, 21 bp, Homo sapiens
gctttaggttgcttcagctga

SEQ ID NO: 5002020 - DNA, 22 bp, Homo sapiens
gctttagtacatggagctcagg

SEQ ID NO: 5002021 - DNA, 20 bp, Homo sapiens
ggaaaaggcagggagcgagg

SEQ ID NO: 5002022 - DNA, 20 bp, Homo sapiens
ggaaaatctgaactctaagc

SEQ ID NO: 5002023 - DNA, 15 bp, Homo sapiens
ggaaagatgtcccac

SEQ ID NO: 5002024 - DNA, 13 bp, Homo sapiens
ggaactgccacct

SEQ ID NO: 5002025 - DNA, 14 bp, Homo sapiens
ggaactgccacctt

SEQ ID NO: 5002026 - DNA, 21 bp, Homo sapiens
ggaactgccaccttgggtctg

SEQ ID NO: 5002027 - DNA, 21 bp, Homo sapiens
ggaagttttgtggaggagctc

SEQ ID NO: 5002028 - DNA, 21 bp, Homo sapiens
ggaatgctgacaatgctgcca

SEQ ID NO: 5002029 - DNA, 16 bp, Homo sapiens
ggacaagaagagtcct

SEQ ID NO: 5002030 - DNA, 14 bp, Homo sapiens
ggacagacagcagc

SEQ ID NO: 5002031 - DNA, 17 bp, Homo sapiens
ggacagacagcagctgg

SEQ ID NO: 5002032 - DNA, 15 bp, Homo sapiens
ggacatgcagctctg

SEQ ID NO: 5002033 - DNA, 20 bp, Homo sapiens
ggaccacatccaccccagcc

SEQ ID NO: 5002034 - DNA, 21 bp, Homo sapiens
ggactctagaagctcaggttc

SEQ ID NO: 5002035 - DNA, 16 bp, Homo sapiens
ggagaatagcacccat

SEQ ID NO: 5002036 - DNA, 22 bp, Homo sapiens
ggagaggcatgggggcccaaag

SEQ ID NO: 5002037 - DNA, 13 bp, Homo sapiens
ggagagtccaggc

SEQ ID NO: 5002038 - DNA, 15 bp, Homo sapiens
ggagagtccaggcct

SEQ ID NO: 5002039 - DNA, 19 bp, Homo sapiens
ggagagtccaggcctgggt

SEQ ID NO: 5002040 - DNA, 13 bp, Homo sapiens
tttatttcttaaa

SEQ ID NO: 5002041 - DNA, 17 bp, Homo sapiens
tttcagtgaaagcatca

SEQ ID NO: 5002042 - DNA, 22 bp, Homo sapiens
tttccttttcttgtctctgagg

SEQ ID NO: 5002043 - DNA, 23 bp, Homo sapiens
tttccttttcttgtctctgaggc

SEQ ID NO: 5002044 - DNA, 16 bp, Homo sapiens
tttctggacaagaaga

SEQ ID NO: 5002045 - DNA, 16 bp, Homo sapiens
tttcttaaacaaatgt

SEQ ID NO: 5002046 - DNA, 21 bp, Homo sapiens
tttcttacacaagagctggag

SEQ ID NO: 5002047 - DNA, 20 bp, Homo sapiens
tttcttattttgtaataaac

SEQ ID NO: 5002048 - DNA, 18 bp, Homo sapiens
tttgaatataaacactat

SEQ ID NO: 5002049 - DNA, 12 bp, Homo sapiens
tttgcaaggaag

SEQ ID NO: 5002050 - DNA, 14 bp, Homo sapiens
tttgcaaggaagcc

SEQ ID NO: 5002051 - DNA, 21 bp, Homo sapiens
tttgcaaggaagccacagctg

SEQ ID NO: 5002052 - DNA, 21 bp, Homo sapiens
tttgcatagcagctgctacta

SEQ ID NO: 5002053 - DNA, 12 bp, Homo sapiens
tttggcccagag

SEQ ID NO: 5002054 - DNA, 16 bp, Homo sapiens
tttggctagtccttgt

SEQ ID NO: 5002055 - DNA, 19 bp, Homo sapiens
tttgtaataaactctctag

SEQ ID NO: 5002056 - DNA, 22 bp, Homo sapiens
tttttaactcaatattttccat

SEQ ID NO: 5002057 - DNA, 19 bp, Homo sapiens
tttttatttgtttgtgcat

SEQ ID NO: 5002058 - DNA, 20 bp, Homo sapiens
agacacacactggctcctgg

SEQ ID NO: 5002059 - DNA, 21 bp, Homo sapiens
agacagaaaaaaataaaaaca

SEQ ID NO: 5002060 - DNA, 20 bp, Homo sapiens
agacagacacacactggctc

SEQ ID NO: 5002061 - DNA, 22 bp, Homo sapiens
agacaggaggagtgggacagac

SEQ ID NO: 5002062 - DNA, 23 bp, Homo sapiens
agacaggaggagtgggacagaca

SEQ ID NO: 5002063 - DNA, 16 bp, Homo sapiens
agacattttcctcaca

SEQ ID NO: 5002064 - DNA, 23 bp, Homo sapiens
agaccctgcccaccccatccctg

SEQ ID NO: 5002065 - DNA, 18 bp, Homo sapiens
agacctctgtgcacttat

SEQ ID NO: 5002066 - DNA, 22 bp, Homo sapiens
agactctccactgacctggttg

SEQ ID NO: 5002067 - DNA, 18 bp, Homo sapiens
agactgttaaatgaaacc

SEQ ID NO: 5002068 - DNA, 16 bp, Homo sapiens
agagctgccctctcct

SEQ ID NO: 5002069 - DNA, 20 bp, Homo sapiens
agagctgccctctcctgggc

SEQ ID NO: 5002070 - DNA, 21 bp, Homo sapiens
agagcttccactgtcagccct

SEQ ID NO: 5002071 - DNA, 22 bp, Homo sapiens
agagcttccactgtcagccctc

SEQ ID NO: 5002072 - DNA, 12 bp, Homo sapiens
agaggagacaga

SEQ ID NO: 5002073 - DNA, 14 bp, Homo sapiens
agaggagacagaca

SEQ ID NO: 5002074 - DNA, 15 bp, Homo sapiens
agaggagacagacac

SEQ ID NO: 5002075 - DNA, 15 bp, Homo sapiens
agaggagaggagaca

SEQ ID NO: 5002076 - DNA, 19 bp, Homo sapiens
agaggatgtggcaggggca

SEQ ID NO: 5002077 - DNA, 22 bp, Homo sapiens
agaggatgtggcaggggcagtg

SEQ ID NO: 5002078 - DNA, 11 bp, Homo sapiens
agagggcagtc

SEQ ID NO: 5002079 - DNA, 14 bp, Homo sapiens
agagtccaggcctg

SEQ ID NO: 5002080 - DNA, 16 bp, Homo sapiens
agagtccaggcctggg

SEQ ID NO: 5002081 - DNA, 17 bp, Homo sapiens
agagtccaggcctgggt

SEQ ID NO: 5002082 - DNA, 19 bp, Homo sapiens
agagtccaggcctgggtca

SEQ ID NO: 5002083 - DNA, 21 bp, Homo sapiens
agagtccttttagcacatcac

SEQ ID NO: 5002084 - DNA, 22 bp, Homo sapiens
agagtccttttagcacatcact

SEQ ID NO: 5002085 - DNA, 20 bp, Homo sapiens
agagtgctgagaaggacacc

SEQ ID NO: 5002086 - DNA, 13 bp, Homo sapiens
agagtggagccca

SEQ ID NO: 5002087 - DNA, 15 bp, Homo sapiens
agagtggagcccagg

SEQ ID NO: 5002088 - DNA, 16 bp, Homo sapiens
agagttgttctcaggg

SEQ ID NO: 5002089 - DNA, 17 bp, Homo sapiens
agatagaatttggccca

SEQ ID NO: 5002090 - DNA, 18 bp, Homo sapiens
agatagaatttggcccag

SEQ ID NO: 5002091 - DNA, 19 bp, Homo sapiens
agatagaatttggcccaga

SEQ ID NO: 5002092 - DNA, 20 bp, Homo sapiens
agatagaatttggcccagag

SEQ ID NO: 5002093 - DNA, 11 bp, Homo sapiens
agatcccaggg

SEQ ID NO: 5002094 - DNA, 15 bp, Homo sapiens
agatggagaggcatg

SEQ ID NO: 5002095 - DNA, 16 bp, Homo sapiens
agatggcactgtccag

SEQ ID NO: 5002096 - DNA, 19 bp, Homo sapiens
agatggcactgtccagggc

SEQ ID NO: 5002097 - DNA, 21 bp, Homo sapiens
agatggccgggacatgcagct

SEQ ID NO: 5002098 - DNA, 15 bp, Homo sapiens
agatgtcccacaggg

SEQ ID NO: 5002099 - DNA, 20 bp, Homo sapiens
agatgtcccacagggaccac

SEQ ID NO: 5002100 - DNA, 23 bp, Homo sapiens
agcaaaggagtagaaagacagag

SEQ ID NO: 5002101 - DNA, 18 bp, Homo sapiens
agcaagatcgctgtgcta

SEQ ID NO: 5002102 - DNA, 15 bp, Homo sapiens
agcaatcactgggcc

SEQ ID NO: 5002103 - DNA, 22 bp, Homo sapiens
agcaatcactgggcccagagga

SEQ ID NO: 5002104 - DNA, 15 bp, Homo sapiens
agcacatcactgaga

SEQ ID NO: 5002105 - DNA, 21 bp, Homo sapiens
agcactcctcggtactcccat

SEQ ID NO: 5002106 - DNA, 22 bp, Homo sapiens
agcagaaaggaaaagattcctg

SEQ ID NO: 5002107 - DNA, 12 bp, Homo sapiens
agcagctgctac

SEQ ID NO: 5002108 - DNA, 15 bp, Homo sapiens
agcaggaggcacagc

SEQ ID NO: 5002109 - DNA, 16 bp, Homo sapiens
agcaggaggcacagca

SEQ ID NO: 5002110 - DNA, 12 bp, Homo sapiens
agcagtcacagg

SEQ ID NO: 5002111 - DNA, 15 bp, Homo sapiens
agcagtcacaggccc

SEQ ID NO: 5002112 - DNA, 17 bp, Homo sapiens
agcagtcacaggcccag

SEQ ID NO: 5002113 - DNA, 15 bp, Homo sapiens
agcagttcagagctg

SEQ ID NO: 5002114 - DNA, 17 bp, Homo sapiens
agcagttcagagctgcc

SEQ ID NO: 5002115 - DNA, 19 bp, Homo sapiens
agcagttcagagctgccct

SEQ ID NO: 5002116 - DNA, 23 bp, Homo sapiens
agcagttcagagctgccctctcc

SEQ ID NO: 5002117 - DNA, 21 bp, Homo sapiens
agccagagttgttctcagggg

SEQ ID NO: 5002118 - DNA, 15 bp, Homo sapiens
agccagcagttcaga

SEQ ID NO: 5002119 - DNA, 19 bp, Homo sapiens
agccagcagttcagagctg

SEQ ID NO: 5002120 - DNA, 22 bp, Homo sapiens
agccagcagttcagagctgccc

SEQ ID NO: 5002121 - DNA, 16 bp, Homo sapiens
agcccacggggcaaag

SEQ ID NO: 5002122 - DNA, 17 bp, Homo sapiens
agcccacggggcaaagc

SEQ ID NO: 5002123 - DNA, 18 bp, Homo sapiens
agcccacggggcaaagct

SEQ ID NO: 5002124 - DNA, 15 bp, Homo sapiens
agcccagggtgctgg

SEQ ID NO: 5002125 - DNA, 22 bp, Homo sapiens
agccccactgccctccagggcc

SEQ ID NO: 5002126 - DNA, 19 bp, Homo sapiens
agccctcagatcccagggt

SEQ ID NO: 5002127 - DNA, 22 bp, Homo sapiens
agccctcagatcccagggtaca

SEQ ID NO: 5002128 - DNA, 17 bp, Homo sapiens
agccctccccacctgct

SEQ ID NO: 5002129 - DNA, 19 bp, Homo sapiens
agccctccccacctgctca

SEQ ID NO: 5002130 - DNA, 21 bp, Homo sapiens
agccctccccacctgctcacc

SEQ ID NO: 5002131 - DNA, 19 bp, Homo sapiens
agcgtggggaggggctgag

SEQ ID NO: 5002132 - DNA, 20 bp, Homo sapiens
agctaataaaagtcagagct

SEQ ID NO: 5002133 - DNA, 15 bp, Homo sapiens
agctagagcttccac

SEQ ID NO: 5002134 - DNA, 19 bp, Homo sapiens
agctagagcttccactgtc

SEQ ID NO: 5002135 - DNA, 16 bp, Homo sapiens
agctagatgctttagg

SEQ ID NO: 5002136 - DNA, 15 bp, Homo sapiens
agctaggaagcaaga

SEQ ID NO: 5002137 - DNA, 22 bp, Homo sapiens
agctatttttatttgtttgtgc

SEQ ID NO: 5002138 - DNA, 12 bp, Homo sapiens
agctcaggttcc

SEQ ID NO: 5002139 - DNA, 15 bp, Homo sapiens
agctcaggttccctg

SEQ ID NO: 5002140 - DNA, 19 bp, Homo sapiens
agctcaggttccctgccac

SEQ ID NO: 5002141 - DNA, 20 bp, Homo sapiens
agctcaggttccctgccaca

SEQ ID NO: 5002142 - DNA, 18 bp, Homo sapiens
agctcaggtttctggaca

SEQ ID NO: 5002143 - DNA, 19 bp, Homo sapiens
agctgcaaaaggcctgtga

SEQ ID NO: 5002144 - DNA, 17 bp, Homo sapiens
agctgccctctcctggg

SEQ ID NO: 5002145 - DNA, 18 bp, Homo sapiens
agctgccctctcctgggc

SEQ ID NO: 5002146 - DNA, 17 bp, Homo sapiens
agctgcctcccctcctc

SEQ ID NO: 5002147 - DNA, 20 bp, Homo sapiens
agctgcctcccctcctctgc

SEQ ID NO: 5002148 - DNA, 21 bp, Homo sapiens
agctgcctcccctcctctgct

SEQ ID NO: 5002149 - DNA, 22 bp, Homo sapiens
agctgcctcccctcctctgctt

SEQ ID NO: 5002150 - DNA, 17 bp, Homo sapiens
agctgctgggccagtgg

SEQ ID NO: 5002151 - DNA, 23 bp, Homo sapiens
agctgctgggccagtggcactct

SEQ ID NO: 5002152 - DNA, 16 bp, Homo sapiens
agctggagcccgtgcc

SEQ ID NO: 5002153 - DNA, 11 bp, Homo sapiens
agctggagcta

SEQ ID NO: 5002154 - DNA, 17 bp, Homo sapiens
agctgggatgtttctgt

SEQ ID NO: 5002155 - DNA, 21 bp, Homo sapiens
agctggtggtatctgagttga

SEQ ID NO: 5002156 - DNA, 16 bp, Homo sapiens
agctgtgaatggctgt

SEQ ID NO: 5002157 - DNA, 17 bp, Homo sapiens
agctgtgaatggctgtg

SEQ ID NO: 5002158 - DNA, 16 bp, Homo sapiens
agctgtgtatctgttt

SEQ ID NO: 5002159 - DNA, 16 bp, Homo sapiens
agcttccactgtcagc

SEQ ID NO: 5002160 - DNA, 13 bp, Homo sapiens
aggaaagatgtcc

SEQ ID NO: 5002161 - DNA, 21 bp, Homo sapiens
aggaaagatgtcccacaggga

SEQ ID NO: 5002162 - DNA, 16 bp, Homo sapiens
aggaacctcaaactgg

SEQ ID NO: 5002163 - DNA, 16 bp, Homo sapiens
aggaagccacagctgg

SEQ ID NO: 5002164 - DNA, 23 bp, Homo sapiens
aggaattaagttagggaatggca

SEQ ID NO: 5002165 - DNA, 21 bp, Homo sapiens
aggactaatccaatacctctt

SEQ ID NO: 5002166 - DNA, 22 bp, Homo sapiens
aggagcccacggggcaaagctg

SEQ ID NO: 5002167 - DNA, 14 bp, Homo sapiens
aggaggcacagcag

SEQ ID NO: 5002168 - DNA, 21 bp, Homo sapiens
aggaggcacagcagtttcacc

SEQ ID NO: 5002169 - DNA, 19 bp, Homo sapiens
aggagtgggacagacagca

SEQ ID NO: 5002170 - DNA, 23 bp, Homo sapiens
aggagtgggacagacagcagctg

SEQ ID NO: 5002171 - DNA, 22 bp, Homo sapiens
aggatgaggaacctcaaactgg

SEQ ID NO: 5002172 - DNA, 18 bp, Homo sapiens
aggatgccttatctcttc

SEQ ID NO: 5002173 - DNA, 18 bp, Homo sapiens
aggatgtggcaggggcag

SEQ ID NO: 5002174 - DNA, 24 bp, Homo sapiens
aggatgtggcaggggcagtggcct

SEQ ID NO: 5002175 - DNA, 14 bp, Homo sapiens
aggcaccatctgcc

SEQ ID NO: 5002176 - DNA, 15 bp, Homo sapiens
aggcaccatctgcca

SEQ ID NO: 5002177 - DNA, 16 bp, Homo sapiens
aggcaccatctgccaa

SEQ ID NO: 5002178 - DNA, 12 bp, Homo sapiens
aggcagagaagt

SEQ ID NO: 5002179 - DNA, 14 bp, Homo sapiens
aggcagagaagtgg

SEQ ID NO: 5002180 - DNA, 17 bp, Homo sapiens
aggcagagaagtggagt

SEQ ID NO: 5002181 - DNA, 18 bp, Homo sapiens
aggcatgggggcccaaag

SEQ ID NO: 5002182 - DNA, 23 bp, Homo sapiens
aggccaggcctctactaggtctg

SEQ ID NO: 5002183 - DNA, 18 bp, Homo sapiens
atggctatattaggcatg

SEQ ID NO: 5002184 - DNA, 17 bp, Homo sapiens
atggctgtgccccacct

SEQ ID NO: 5002185 - DNA, 21 bp, Homo sapiens
atggctgtgccccacctgttg

SEQ ID NO: 5002186 - DNA, 11 bp, Homo sapiens
atgggctcagg

SEQ ID NO: 5002187 - DNA, 15 bp, Homo sapiens
atgggctcagggcca

SEQ ID NO: 5002188 - DNA, 12 bp, Homo sapiens
atggggatgcag

SEQ ID NO: 5002189 - DNA, 21 bp, Homo sapiens
atggtttgaatataaacacta

SEQ ID NO: 5002190 - DNA, 14 bp, Homo sapiens
atgtataatatttt

SEQ ID NO: 5002191 - DNA, 16 bp, Homo sapiens
atgtcccacagggacc

SEQ ID NO: 5002192 - DNA, 20 bp, Homo sapiens
atgtcccacagggaccacat

SEQ ID NO: 5002193 - DNA, 18 bp, Homo sapiens
atgtccctattctgccat

SEQ ID NO: 5002194 - DNA, 23 bp, Homo sapiens
atgtggcaggggcagtggcctgg

SEQ ID NO: 5002195 - DNA, 19 bp, Homo sapiens
atgtgtaaatgtggacaca

SEQ ID NO: 5002196 - DNA, 14 bp, Homo sapiens
atgttcagggatgc

SEQ ID NO: 5002197 - DNA, 17 bp, Homo sapiens
attaggcatgttcaggg

SEQ ID NO: 5002198 - DNA, 15 bp, Homo sapiens
attcaggcctctgag

SEQ ID NO: 5002199 - DNA, 22 bp, Homo sapiens
attcatctctctttaatataaa

SEQ ID NO: 5002200 - DNA, 15 bp, Homo sapiens
attccacttcctgcc

SEQ ID NO: 5002201 - DNA, 13 bp, Homo sapiens
attccatgactct

SEQ ID NO: 5002202 - DNA, 13 bp, Homo sapiens
attccctccaccc

SEQ ID NO: 5002203 - DNA, 16 bp, Homo sapiens
attccctccacccact

SEQ ID NO: 5002204 - DNA, 19 bp, Homo sapiens
attctattttgcagataga

SEQ ID NO: 5002205 - DNA, 17 bp, Homo sapiens
atttgagttggccaaga

SEQ ID NO: 5002206 - DNA, 18 bp, Homo sapiens
atttgagttggccaagaa

SEQ ID NO: 5002207 - DNA, 15 bp, Homo sapiens
atttggcccagagag

SEQ ID NO: 5002208 - DNA, 14 bp, Homo sapiens
attttatctgtgtt

SEQ ID NO: 5002209 - DNA, 20 bp, Homo sapiens
attttgtaataaactctcta

SEQ ID NO: 5002210 - DNA, 15 bp, Homo sapiens
caaagctgctgggcc

SEQ ID NO: 5002211 - DNA, 16 bp, Homo sapiens
caaagctgctgggcca

SEQ ID NO: 5002212 - DNA, 17 bp, Homo sapiens
caaagctgctgggccag

SEQ ID NO: 5002213 - DNA, 21 bp, Homo sapiens
caaagctgctgggccagtggc

SEQ ID NO: 5002214 - DNA, 22 bp, Homo sapiens
caaagctgctgggccagtggca

SEQ ID NO: 5002215 - DNA, 12 bp, Homo sapiens
caaataaatgtg

SEQ ID NO: 5002216 - DNA, 14 bp, Homo sapiens
caaatgctaaatgc

SEQ ID NO: 5002217 - DNA, 17 bp, Homo sapiens
caaattggtgtttctga

SEQ ID NO: 5002218 - DNA, 21 bp, Homo sapiens
caacaacatgtataatatttt

SEQ ID NO: 5002219 - DNA, 11 bp, Homo sapiens
caacagcagga

SEQ ID NO: 5002220 - DNA, 19 bp, Homo sapiens
caacagcaggaggcacagc

SEQ ID NO: 5002221 - DNA, 19 bp, Homo sapiens
caacattcccccaacatta

SEQ ID NO: 5002222 - DNA, 14 bp, Homo sapiens
caagaggagatcca

SEQ ID NO: 5002223 - DNA, 18 bp, Homo sapiens
caagctgcaaaaggcctg

SEQ ID NO: 5002224 - DNA, 21 bp, Homo sapiens
caagctgcaaaaggcctgtga

SEQ ID NO: 5002225 - DNA, 22 bp, Homo sapiens
caaggactaatccaatacctct

SEQ ID NO: 5002226 - DNA, 17 bp, Homo sapiens
caagttcaatctgtttt

SEQ ID NO: 5002227 - DNA, 15 bp, Homo sapiens
caataaaatgggttt

SEQ ID NO: 5002228 - DNA, 11 bp, Homo sapiens
caatattttcc

SEQ ID NO: 5002229 - DNA, 15 bp, Homo sapiens
caatattttccatga

SEQ ID NO: 5002230 - DNA, 19 bp, Homo sapiens
caatattttccatgaaaat

SEQ ID NO: 5002231 - DNA, 14 bp, Homo sapiens
caatcactgggccc

SEQ ID NO: 5002232 - DNA, 16 bp, Homo sapiens
caatcactgggcccag

SEQ ID NO: 5002233 - DNA, 19 bp, Homo sapiens
caatgccatgactgctcag

SEQ ID NO: 5002234 - DNA, 17 bp, Homo sapiens
caatggtttgcaaggaa

SEQ ID NO: 5002235 - DNA, 18 bp, Homo sapiens
caatggtttgcaaggaag

SEQ ID NO: 5002236 - DNA, 23 bp, Homo sapiens
caattccacttcctgccccaact

SEQ ID NO: 5002237 - DNA, 17 bp, Homo sapiens
caattcttacaaacatg

SEQ ID NO: 5002238 - DNA, 13 bp, Homo sapiens
caatttaaagcaa

SEQ ID NO: 5002239 - DNA, 23 bp, Homo sapiens
cacaagacccaagtagctgctac

SEQ ID NO: 5002240 - DNA, 13 bp, Homo sapiens
cacaagagctgga

SEQ ID NO: 5002241 - DNA, 14 bp, Homo sapiens
cacacactggctcc

SEQ ID NO: 5002242 - DNA, 20 bp, Homo sapiens
cacacactggctcctggacc

SEQ ID NO: 5002243 - DNA, 16 bp, Homo sapiens
cacacatctgtggaga

SEQ ID NO: 5002244 - DNA, 13 bp, Homo sapiens
cacacccacctgc

SEQ ID NO: 5002245 - DNA, 16 bp, Homo sapiens
cacacccacctgctgc

SEQ ID NO: 5002246 - DNA, 16 bp, Homo sapiens
cacactggctcctgga

SEQ ID NO: 5002247 - DNA, 13 bp, Homo sapiens
cacagaccctgcc

SEQ ID NO: 5002248 - DNA, 16 bp, Homo sapiens
cacagaccctgcccac

SEQ ID NO: 5002249 - DNA, 23 bp, Homo sapiens
cacagaccctgcccaccccatcc

SEQ ID NO: 5002250 - DNA, 16 bp, Homo sapiens
cacagcaattcctcag

SEQ ID NO: 5002251 - DNA, 22 bp, Homo sapiens
cacagcagtcacaggcccagga

SEQ ID NO: 5002252 - DNA, 19 bp, Homo sapiens
cacagcccaaagaaggaaa

SEQ ID NO: 5002253 - DNA, 14 bp, Homo sapiens
cacaggtgtaaata

SEQ ID NO: 5002254 - DNA, 19 bp, Homo sapiens
cacagtgcctgatgggagt

SEQ ID NO: 5002255 - DNA, 24 bp, Homo sapiens
cacatcagctccactttcagtgaa

SEQ ID NO: 5002256 - DNA, 13 bp, Homo sapiens
cacatccacccca

SEQ ID NO: 5002257 - DNA, 16 bp, Homo sapiens
cacatccaccccagcc

SEQ ID NO: 5002258 - DNA, 12 bp, Homo sapiens
cacatcctcaga

SEQ ID NO: 5002259 - DNA, 16 bp, Homo sapiens
cacatcctcagaaagt

SEQ ID NO: 5002260 - DNA, 17 bp, Homo sapiens
cacatcctcagaaagtg

SEQ ID NO: 5002261 - DNA, 14 bp, Homo sapiens
caccaagctgttcc

SEQ ID NO: 5002262 - DNA, 17 bp, Homo sapiens
caccaattccacttcct

SEQ ID NO: 5002263 - DNA, 13 bp, Homo sapiens
caccatctgccaa

SEQ ID NO: 5002264 - DNA, 20 bp, Homo sapiens
caccatctgccaatgccatg

SEQ ID NO: 5002265 - DNA, 11 bp, Homo sapiens
caccatgaaac

SEQ ID NO: 5002266 - DNA, 13 bp, Homo sapiens
cacccacctgctg

SEQ ID NO: 5002267 - DNA, 15 bp, Homo sapiens
cacccacctgctgct

SEQ ID NO: 5002268 - DNA, 19 bp, Homo sapiens
cacccatatctgtgtgccc

SEQ ID NO: 5002269 - DNA, 13 bp, Homo sapiens
caccccagtcacc

SEQ ID NO: 5002270 - DNA, 12 bp, Homo sapiens
caccccatccct

SEQ ID NO: 5002271 - DNA, 15 bp, Homo sapiens
caccccatccctggc

SEQ ID NO: 5002272 - DNA, 22 bp, Homo sapiens
caccccatccctggctgacctg

SEQ ID NO: 5002273 - DNA, 15 bp, Homo sapiens
cacccccctgtgcct

SEQ ID NO: 5002274 - DNA, 19 bp, Homo sapiens
cacctcccagggctacaca

SEQ ID NO: 5002275 - DNA, 18 bp, Homo sapiens
cacggggcaaagctgctg

SEQ ID NO: 5002276 - DNA, 13 bp, Homo sapiens
cactagctagatg

SEQ ID NO: 5002277 - DNA, 22 bp, Homo sapiens
cactctgtgtgggaaaatggca

SEQ ID NO: 5002278 - DNA, 19 bp, Homo sapiens
cactgacctggttgtccag

SEQ ID NO: 5002279 - DNA, 20 bp, Homo sapiens
cactgacctggttgtccagg

SEQ ID NO: 5002280 - DNA, 19 bp, Homo sapiens
cactgagaagatggcactg

SEQ ID NO: 5002281 - DNA, 24 bp, Homo sapiens
cactgagaagatggcactgtccag

SEQ ID NO: 5002282 - DNA, 19 bp, Homo sapiens
cactgcacccccctgtgcc

SEQ ID NO: 5002283 - DNA, 14 bp, Homo sapiens
cactgccctccagg

SEQ ID NO: 5002284 - DNA, 13 bp, Homo sapiens
cactggctcctgg

SEQ ID NO: 5002285 - DNA, 14 bp, Homo sapiens
cactggctcctgga

SEQ ID NO: 5002286 - DNA, 17 bp, Homo sapiens
cactggctcctggacct

SEQ ID NO: 5002287 - DNA, 15 bp, Homo sapiens
cactgggcccagagg

SEQ ID NO: 5002288 - DNA, 16 bp, Homo sapiens
cactgggcccagagga

SEQ ID NO: 5002289 - DNA, 21 bp, Homo sapiens
cactgggcccagaggagagga

SEQ ID NO: 5002290 - DNA, 14 bp, Homo sapiens
cactgtcagccctc

SEQ ID NO: 5002291 - DNA, 20 bp, Homo sapiens
cactgtcagccctcactgtc

SEQ ID NO: 5002292 - DNA, 21 bp, Homo sapiens
cactgtcagccctcactgtca

SEQ ID NO: 5002293 - DNA, 13 bp, Homo sapiens
cactgtcagtccc

SEQ ID NO: 5002294 - DNA, 15 bp, Homo sapiens
cactgtggaactgcc

SEQ ID NO: 5002295 - DNA, 15 bp, Homo sapiens
cacttgcctgtcacc

SEQ ID NO: 5002296 - DNA, 20 bp, Homo sapiens
cacttgtaggtttctctgcc

SEQ ID NO: 5002297 - DNA, 21 bp, Homo sapiens
cacttgtaggtttctctgcct

SEQ ID NO: 5002298 - DNA, 22 bp, Homo sapiens
cacttgtaggtttctctgcctc

SEQ ID NO: 5002299 - DNA, 23 bp, Homo sapiens
cactttccttttcttgtctctga

SEQ ID NO: 5002300 - DNA, 22 bp, Homo sapiens
cagaaaggaaaagattcctgtc

SEQ ID NO: 5002301 - DNA, 11 bp, Homo sapiens
cagaacactgt

SEQ ID NO: 5002302 - DNA, 14 bp, Homo sapiens
cagaacagcttcat

SEQ ID NO: 5002303 - DNA, 17 bp, Homo sapiens
cagaagactctccactg

SEQ ID NO: 5002304 - DNA, 20 bp, Homo sapiens
cagaagactctccactgacc

SEQ ID NO: 5002305 - DNA, 23 bp, Homo sapiens
cagaagactctccactgacctgg

SEQ ID NO: 5002306 - DNA, 20 bp, Homo sapiens
cagacacacactggctcctg

SEQ ID NO: 5002307 - DNA, 22 bp, Homo sapiens
cagacacacactggctcctgga

SEQ ID NO: 5002308 - DNA, 15 bp, Homo sapiens
cagacagcagctgga

SEQ ID NO: 5002309 - DNA, 17 bp, Homo sapiens
cagacagcagctggact

SEQ ID NO: 5002310 - DNA, 14 bp, Homo sapiens
ccaaagtccaggct

SEQ ID NO: 5002311 - DNA, 16 bp, Homo sapiens
ccaaataaatgtgtaa

SEQ ID NO: 5002312 - DNA, 17 bp, Homo sapiens
ccaaataaatgtgtaaa

SEQ ID NO: 5002313 - DNA, 12 bp, Homo sapiens
ccaactgcagga

SEQ ID NO: 5002314 - DNA, 22 bp, Homo sapiens
ccaagaaataaattcacatcct

SEQ ID NO: 5002315 - DNA, 14 bp, Homo sapiens
ccaagtagctgcta

SEQ ID NO: 5002316 - DNA, 20 bp, Homo sapiens
ccaagtattttatctgtgtt

SEQ ID NO: 5002317 - DNA, 18 bp, Homo sapiens
ccaattcttacaaacatg

SEQ ID NO: 5002318 - DNA, 18 bp, Homo sapiens
ccacagggaccacatcca

SEQ ID NO: 5002319 - DNA, 16 bp, Homo sapiens
ccacatccaccccagc

SEQ ID NO: 5002320 - DNA, 22 bp, Homo sapiens
ccacatccaccccagccccact

SEQ ID NO: 5002321 - DNA, 12 bp, Homo sapiens
ccaccccaacat

SEQ ID NO: 5002322 - DNA, 18 bp, Homo sapiens
ccaccccatccctggctg

SEQ ID NO: 5002323 - DNA, 14 bp, Homo sapiens
ccacggggcaaagc

SEQ ID NO: 5002324 - DNA, 21 bp, Homo sapiens
ccacggggcaaagctgctggg

SEQ ID NO: 5002325 - DNA, 21 bp, Homo sapiens
ccactgacctggttgtccagg

SEQ ID NO: 5002326 - DNA, 22 bp, Homo sapiens
ccactgacctggttgtccaggt

SEQ ID NO: 5002327 - DNA, 18 bp, Homo sapiens
ccactgccctccagggcc

SEQ ID NO: 5002328 - DNA, 19 bp, Homo sapiens
ccactgtcagccctcactg

SEQ ID NO: 5002329 - DNA, 18 bp, Homo sapiens
ccacttctctactctgga

SEQ ID NO: 5002330 - DNA, 14 bp, Homo sapiens
ccagacaggaggag

SEQ ID NO: 5002331 - DNA, 22 bp, Homo sapiens
ccagagggcagtctagtcctgg

SEQ ID NO: 5002332 - DNA, 15 bp, Homo sapiens
ccagatcctcttctc

SEQ ID NO: 5002333 - DNA, 13 bp, Homo sapiens
ccagcagttcaga

SEQ ID NO: 5002334 - DNA, 18 bp, Homo sapiens
ccagcagttcagagctgc

SEQ ID NO: 5002335 - DNA, 23 bp, Homo sapiens
ccagcagttcagagctgccctct

SEQ ID NO: 5002336 - DNA, 14 bp, Homo sapiens
ccagccctccccac

SEQ ID NO: 5002337 - DNA, 21 bp, Homo sapiens
ccagccctccccacctgctca

SEQ ID NO: 5002338 - DNA, 22 bp, Homo sapiens
ccagctagagcttccactgtca

SEQ ID NO: 5002339 - DNA, 17 bp, Homo sapiens
ccagctaggaagcaaga

SEQ ID NO: 5002340 - DNA, 21 bp, Homo sapiens
ccaggaaagatgtcccacagg

SEQ ID NO: 5002341 - DNA, 18 bp, Homo sapiens
ccaggaaggcggcaggca

SEQ ID NO: 5002342 - DNA, 15 bp, Homo sapiens
ccaggattcaggcct

SEQ ID NO: 5002343 - DNA, 17 bp, Homo sapiens
ccaggcaccatctgcca

SEQ ID NO: 5002344 - DNA, 14 bp, Homo sapiens
ccaggcctgggtca

SEQ ID NO: 5002345 - DNA, 17 bp, Homo sapiens
ccaggctaattagagga

SEQ ID NO: 5002346 - DNA, 17 bp, Homo sapiens
ccagggccaggattcag

SEQ ID NO: 5002347 - DNA, 14 bp, Homo sapiens
ccagggctacacag

SEQ ID NO: 5002348 - DNA, 18 bp, Homo sapiens
ccagggctacacagaccc

SEQ ID NO: 5002349 - DNA, 18 bp, Homo sapiens
ccagggtacactcttctc

SEQ ID NO: 5002350 - DNA, 19 bp, Homo sapiens
ccaggtcctcacagcagtc

SEQ ID NO: 5002351 - DNA, 17 bp, Homo sapiens
ccaggtctagaaggcca

SEQ ID NO: 5002352 - DNA, 19 bp, Homo sapiens
ccaggtctagaaggccagg

SEQ ID NO: 5002353 - DNA, 21 bp, Homo sapiens
ccaggtctagaaggccaggcc

SEQ ID NO: 5002354 - DNA, 18 bp, Homo sapiens
ccaggttgcctcaacagc

SEQ ID NO: 5002355 - DNA, 21 bp, Homo sapiens
ccaggttgcctcaacagcagg

SEQ ID NO: 5002356 - DNA, 15 bp, Homo sapiens
ccagtcctgctgcct

SEQ ID NO: 5002357 - DNA, 21 bp, Homo sapiens
ccagtgatgctaaaggttgta

SEQ ID NO: 5002358 - DNA, 17 bp, Homo sapiens
ccagtggcactctgtgt

SEQ ID NO: 5002359 - DNA, 17 bp, Homo sapiens
ccatatctgtgtgccct

SEQ ID NO: 5002360 - DNA, 20 bp, Homo sapiens
ccatcatgtgcctggaaatt

SEQ ID NO: 5002361 - DNA, 14 bp, Homo sapiens
ccatccctccctcc

SEQ ID NO: 5002362 - DNA, 15 bp, Homo sapiens
ccatccctccctcca

SEQ ID NO: 5002363 - DNA, 15 bp, Homo sapiens
ccatccctggctgac

SEQ ID NO: 5002364 - DNA, 16 bp, Homo sapiens
ccatctgccaatgcca

SEQ ID NO: 5002365 - DNA, 19 bp, Homo sapiens
ccatctgccaatgccatga

SEQ ID NO: 5002366 - DNA, 14 bp, Homo sapiens
ccatgactctgcct

SEQ ID NO: 5002367 - DNA, 14 bp, Homo sapiens
ccatgactgctcag

SEQ ID NO: 5002368 - DNA, 15 bp, Homo sapiens
ccatgatcacacagc

SEQ ID NO: 5002369 - DNA, 15 bp, Homo sapiens
ccatgggagagtcca

SEQ ID NO: 5002370 - DNA, 18 bp, Homo sapiens
ccatgggctcagggccag

SEQ ID NO: 5002371 - DNA, 21 bp, Homo sapiens
ccatgggctcagggccaggtc

SEQ ID NO: 5002372 - DNA, 22 bp, Homo sapiens
ccatgtagctggcaagctgcaa

SEQ ID NO: 5002373 - DNA, 14 bp, Homo sapiens
cccaaataaatgtg

SEQ ID NO: 5002374 - DNA, 13 bp, Homo sapiens
cccaacacgggta

SEQ ID NO: 5002375 - DNA, 16 bp, Homo sapiens
cccaccccatccctgg

SEQ ID NO: 5002376 - DNA, 15 bp, Homo sapiens
cccacctgctcacca

SEQ ID NO: 5002377 - DNA, 13 bp, Homo sapiens
cccacctgctgct

SEQ ID NO: 5002378 - DNA, 16 bp, Homo sapiens
cccacctgttgtcctg

SEQ ID NO: 5002379 - DNA, 22 bp, Homo sapiens
cccacctgttgtcctgaactgt

SEQ ID NO: 5002380 - DNA, 15 bp, Homo sapiens
cccacggggcaaagc

SEQ ID NO: 5002381 - DNA, 23 bp, Homo sapiens
cccactaagtagaataaagaaaa

SEQ ID NO: 5002382 - DNA, 17 bp, Homo sapiens
cccactgccctccaggg

SEQ ID NO: 5002383 - DNA, 18 bp, Homo sapiens
cccactgccctccagggc

SEQ ID NO: 5002384 - DNA, 12 bp, Homo sapiens
cccacttgcctg

SEQ ID NO: 5002385 - DNA, 12 bp, Homo sapiens
cccagaggagag

SEQ ID NO: 5002386 - DNA, 20 bp, Homo sapiens
cccagaggagaggagacaga

SEQ ID NO: 5002387 - DNA, 23 bp, Homo sapiens
cccagaggagaggagacagacac

SEQ ID NO: 5002388 - DNA, 16 bp, Homo sapiens
cccagccagcagttca

SEQ ID NO: 5002389 - DNA, 23 bp, Homo sapiens
cccagccccactgccctccaggg

SEQ ID NO: 5002390 - DNA, 20 bp, Homo sapiens
cccagccctccccacctgct

SEQ ID NO: 5002391 - DNA, 22 bp, Homo sapiens
cccagccctccccacctgctca

SEQ ID NO: 5002392 - DNA, 15 bp, Homo sapiens
cccagctaggaagca

SEQ ID NO: 5002393 - DNA, 20 bp, Homo sapiens
cccaggaaggcggcaggcag

SEQ ID NO: 5002394 - DNA, 22 bp, Homo sapiens
cccaggaaggcggcaggcagag

SEQ ID NO: 5002395 - DNA, 22 bp, Homo sapiens
cccaggatttgactcgggcctt

SEQ ID NO: 5002396 - DNA, 21 bp, Homo sapiens
cccagggaagtttctgggtgc

SEQ ID NO: 5002397 - DNA, 14 bp, Homo sapiens
cccagggtgctggg

SEQ ID NO: 5002398 - DNA, 13 bp, Homo sapiens
cccatccctggct

SEQ ID NO: 5002399 - DNA, 20 bp, Homo sapiens
cccatgtagctggcaagctg

SEQ ID NO: 5002400 - DNA, 16 bp, Homo sapiens
ccccaaagtccaggct

SEQ ID NO: 5002401 - DNA, 19 bp, Homo sapiens
ccccaacatctccctccca

SEQ ID NO: 5002402 - DNA, 13 bp, Homo sapiens
ccccaactgcagg

SEQ ID NO: 5002403 - DNA, 12 bp, Homo sapiens
ccccacctgttg

SEQ ID NO: 5002404 - DNA, 20 bp, Homo sapiens
ccccactgccctccagggcc

SEQ ID NO: 5002405 - DNA, 18 bp, Homo sapiens
ccccagacttctctttct

SEQ ID NO: 5002406 - DNA, 16 bp, Homo sapiens
ccccagccctccccac

SEQ ID NO: 5002407 - DNA, 13 bp, Homo sapiens
ccccatccctggc

SEQ ID NO: 5002408 - DNA, 16 bp, Homo sapiens
ccccatccctggctga

SEQ ID NO: 5002409 - DNA, 23 bp, Homo sapiens
ccccatccctggctgacctgctg

SEQ ID NO: 5002410 - DNA, 16 bp, Homo sapiens
ccccctgtgcctgctg

SEQ ID NO: 5002411 - DNA, 17 bp, Homo sapiens
cccctcctctgcttgcc

SEQ ID NO: 5002412 - DNA, 19 bp, Homo sapiens
cccctgtgcctgctgggca

SEQ ID NO: 5002413 - DNA, 12 bp, Homo sapiens
ccctagggctca

SEQ ID NO: 5002414 - DNA, 14 bp, Homo sapiens
ccctagggctcaga

SEQ ID NO: 5002415 - DNA, 15 bp, Homo sapiens
ccctagggctcagag

SEQ ID NO: 5002416 - DNA, 22 bp, Homo sapiens
ccctcactgtcagtcccactgc

SEQ ID NO: 5002417 - DNA, 19 bp, Homo sapiens
ccctcagatcccagggtac

SEQ ID NO: 5002418 - DNA, 12 bp, Homo sapiens
ccctccagggcc

SEQ ID NO: 5002419 - DNA, 13 bp, Homo sapiens
ccctccagggcca

SEQ ID NO: 5002420 - DNA, 14 bp, Homo sapiens
ccctccagggccag

SEQ ID NO: 5002421 - DNA, 13 bp, Homo sapiens
ccctccccacctg

SEQ ID NO: 5002422 - DNA, 17 bp, Homo sapiens
ccctccccacctgctca

SEQ ID NO: 5002423 - DNA, 12 bp, Homo sapiens
ccctccctccac

SEQ ID NO: 5002424 - DNA, 22 bp, Homo sapiens
ccctcctctgcttgccatccct

SEQ ID NO: 5002425 - DNA, 12 bp, Homo sapiens
ccctctcctggg

SEQ ID NO: 5002426 - DNA, 13 bp, Homo sapiens
ccctctcctgggc

SEQ ID NO: 5002427 - DNA, 20 bp, Homo sapiens
ccctctcctgggcagctgcc

SEQ ID NO: 5002428 - DNA, 14 bp, Homo sapiens
ccctgcaataaaat

SEQ ID NO: 5002429 - DNA, 14 bp, Homo sapiens
ccctgcccacccca

SEQ ID NO: 5002430 - DNA, 20 bp, Homo sapiens
ccctgcccaccccatccctg

SEQ ID NO: 5002431 - DNA, 16 bp, Homo sapiens
ccctggctgacctgct

SEQ ID NO: 5002432 - DNA, 19 bp, Homo sapiens
ccctggctgacctgctgtg

SEQ ID NO: 5002433 - DNA, 21 bp, Homo sapiens
ccctggctgacctgctgtgga

SEQ ID NO: 5002434 - DNA, 18 bp, Homo sapiens
ccctgggctccctggagg

SEQ ID NO: 5002435 - DNA, 19 bp, Homo sapiens
ccctgggctccctggagga

SEQ ID NO: 5002436 - DNA, 14 bp, Homo sapiens
ctgtgcctgctggg

SEQ ID NO: 5002437 - DNA, 18 bp, Homo sapiens
ctgtggaactgccacctt

SEQ ID NO: 5002438 - DNA, 20 bp, Homo sapiens
ctgtgtgccctagggctcag

SEQ ID NO: 5002439 - DNA, 23 bp, Homo sapiens
ctgtgtgccctagggctcagagg

SEQ ID NO: 5002440 - DNA, 14 bp, Homo sapiens
ctgttccacttctc

SEQ ID NO: 5002441 - DNA, 12 bp, Homo sapiens
ctgttctcaaat

SEQ ID NO: 5002442 - DNA, 15 bp, Homo sapiens
ctgttctcaaatgct

SEQ ID NO: 5002443 - DNA, 20 bp, Homo sapiens
ctgttctcattcctgttctt

SEQ ID NO: 5002444 - DNA, 17 bp, Homo sapiens
ctgttgaatttcccaca

SEQ ID NO: 5002445 - DNA, 14 bp, Homo sapiens
cttaaacaaatgta

SEQ ID NO: 5002446 - DNA, 14 bp, Homo sapiens
cttactccaggaga

SEQ ID NO: 5002447 - DNA, 13 bp, Homo sapiens
cttattttgtaat

SEQ ID NO: 5002448 - DNA, 14 bp, Homo sapiens
cttattttgtaata

SEQ ID NO: 5002449 - DNA, 18 bp, Homo sapiens
cttattttgtaataaact

SEQ ID NO: 5002450 - DNA, 13 bp, Homo sapiens
cttcaactctgtg

SEQ ID NO: 5002451 - DNA, 16 bp, Homo sapiens
cttcaactctgtgagg

SEQ ID NO: 5002452 - DNA, 14 bp, Homo sapiens
cttcacaaaatgca

SEQ ID NO: 5002453 - DNA, 18 bp, Homo sapiens
cttcctcagtcctggaag

SEQ ID NO: 5002454 - DNA, 19 bp, Homo sapiens
cttccttaattcactccca

SEQ ID NO: 5002455 - DNA, 14 bp, Homo sapiens
cttctcactttcct

SEQ ID NO: 5002456 - DNA, 12 bp, Homo sapiens
cttctgttctca

SEQ ID NO: 5002457 - DNA, 17 bp, Homo sapiens
cttctttaattgatcta

SEQ ID NO: 5002458 - DNA, 18 bp, Homo sapiens
cttgaacatgttttgtat

SEQ ID NO: 5002459 - DNA, 15 bp, Homo sapiens
cttgaaggtgctgcc

SEQ ID NO: 5002460 - DNA, 17 bp, Homo sapiens
cttgaaggtttgatgcc

SEQ ID NO: 5002461 - DNA, 21 bp, Homo sapiens
cttgaaggtttgatgccaaag

SEQ ID NO: 5002462 - DNA, 19 bp, Homo sapiens
cttgccatccctccctcca

SEQ ID NO: 5002463 - DNA, 21 bp, Homo sapiens
cttgccatccctccctccacc

SEQ ID NO: 5002464 - DNA, 16 bp, Homo sapiens
cttgcctgtcacccca

SEQ ID NO: 5002465 - DNA, 17 bp, Homo sapiens
cttgcctgtcaccccag

SEQ ID NO: 5002466 - DNA, 14 bp, Homo sapiens
cttggcactgtgga

SEQ ID NO: 5002467 - DNA, 17 bp, Homo sapiens
cttgggtcccagggaag

SEQ ID NO: 5002468 - DNA, 15 bp, Homo sapiens
cttgtaggtttctct

SEQ ID NO: 5002469 - DNA, 21 bp, Homo sapiens
cttgtaggtttctctgcctcc

SEQ ID NO: 5002470 - DNA, 14 bp, Homo sapiens
cttgtctctgaggc

SEQ ID NO: 5002471 - DNA, 18 bp, Homo sapiens
ctttagtacatggagctc

SEQ ID NO: 5002472 - DNA, 15 bp, Homo sapiens
ctttcagtgaaagca

SEQ ID NO: 5002473 - DNA, 18 bp, Homo sapiens
ctttcccactttcttcta

SEQ ID NO: 5002474 - DNA, 16 bp, Homo sapiens
ctttcttattttgtaa

SEQ ID NO: 5002475 - DNA, 19 bp, Homo sapiens
ctttcttattttgtaataa

SEQ ID NO: 5002476 - DNA, 21 bp, Homo sapiens
ctttcttattttgtaataaac

SEQ ID NO: 5002477 - DNA, 17 bp, Homo sapiens
ctttgaggtgagggtgg

SEQ ID NO: 5002478 - DNA, 16 bp, Homo sapiens
cttttcttgtctctga

SEQ ID NO: 5002479 - DNA, 11 bp, Homo sapiens
gaaaaggcagg

SEQ ID NO: 5002480 - DNA, 18 bp, Homo sapiens
gaaaatgcaacaacatgt

SEQ ID NO: 5002481 - DNA, 16 bp, Homo sapiens
gaaagatgtcccacag

SEQ ID NO: 5002482 - DNA, 17 bp, Homo sapiens
gaaagatgtcccacagg

SEQ ID NO: 5002483 - DNA, 23 bp, Homo sapiens
gaaagatgtcccacagggaccac

SEQ ID NO: 5002484 - DNA, 16 bp, Homo sapiens
gaaagtgcagcatgga

SEQ ID NO: 5002485 - DNA, 18 bp, Homo sapiens
gaacagataatccctgta

SEQ ID NO: 5002486 - DNA, 20 bp, Homo sapiens
gaacatgccctcagctaagc

SEQ ID NO: 5002487 - DNA, 15 bp, Homo sapiens
gaaccagtcctgctg

SEQ ID NO: 5002488 - DNA, 12 bp, Homo sapiens
gaactgccacct

SEQ ID NO: 5002489 - DNA, 20 bp, Homo sapiens
gaactggtcaccatgaaact

SEQ ID NO: 5002490 - DNA, 19 bp, Homo sapiens
gaagactctccactgacct

SEQ ID NO: 5002491 - DNA, 18 bp, Homo sapiens
gaagatggcactgtccag

SEQ ID NO: 5002492 - DNA, 19 bp, Homo sapiens
gaagatggcactgtccagg

SEQ ID NO: 5002493 - DNA, 21 bp, Homo sapiens
gaagatggcactgtccagggc

SEQ ID NO: 5002494 - DNA, 18 bp, Homo sapiens
gaagcaagatcgctgtgc

SEQ ID NO: 5002495 - DNA, 11 bp, Homo sapiens
gaagctcaggt

SEQ ID NO: 5002496 - DNA, 22 bp, Homo sapiens
gaagctcaggttccctgccaca

SEQ ID NO: 5002497 - DNA, 14 bp, Homo sapiens
gaaggcggcaggca

SEQ ID NO: 5002498 - DNA, 20 bp, Homo sapiens
gaaggcggcaggcagagaag

SEQ ID NO: 5002499 - DNA, 15 bp, Homo sapiens
gaaggtgctgccacc

SEQ ID NO: 5002500 - DNA, 16 bp, Homo sapiens
gaaggtttgatgccaa

SEQ ID NO: 5002501 - DNA, 13 bp, Homo sapiens
gaatatggacaaa

SEQ ID NO: 5002502 - DNA, 23 bp, Homo sapiens
gaatattttgttttgtgcagaga

SEQ ID NO: 5002503 - DNA, 19 bp, Homo sapiens
gaatgctgacaatgctgcc

SEQ ID NO: 5002504 - DNA, 20 bp, Homo sapiens
gaatgctgacaatgctgcca

SEQ ID NO: 5002505 - DNA, 17 bp, Homo sapiens
gaatggcacagcccaaa

SEQ ID NO: 5002506 - DNA, 14 bp, Homo sapiens
gaatggctgtgccc

SEQ ID NO: 5002507 - DNA, 16 bp, Homo sapiens
gaatttggcccagaga

SEQ ID NO: 5002508 - DNA, 14 bp, Homo sapiens
gacacacactggct

SEQ ID NO: 5002509 - DNA, 16 bp, Homo sapiens
gacacacactggctcc

SEQ ID NO: 5002510 - DNA, 20 bp, Homo sapiens
gacacacactggctcctgga

SEQ ID NO: 5002511 - DNA, 13 bp, Homo sapiens
gacagaacactgt

SEQ ID NO: 5002512 - DNA, 22 bp, Homo sapiens
gacagacacacactggctcctg

SEQ ID NO: 5002513 - DNA, 12 bp, Homo sapiens
gacagacagcag

SEQ ID NO: 5002514 - DNA, 14 bp, Homo sapiens
gacagacagcagct

SEQ ID NO: 5002515 - DNA, 13 bp, Homo sapiens
gacagcagctgga

SEQ ID NO: 5002516 - DNA, 13 bp, Homo sapiens
gacaggaggagtg

SEQ ID NO: 5002517 - DNA, 18 bp, Homo sapiens
gacaggaggagtgggaca

SEQ ID NO: 5002518 - DNA, 23 bp, Homo sapiens
gacaggaggagtgggacagacag

SEQ ID NO: 5002519 - DNA, 23 bp, Homo sapiens
gacatccatgttccgagaagaac

SEQ ID NO: 5002520 - DNA, 16 bp, Homo sapiens
gacattttcctcacac

SEQ ID NO: 5002521 - DNA, 16 bp, Homo sapiens
gaccacatccacccca

SEQ ID NO: 5002522 - DNA, 22 bp, Homo sapiens
gacccaagtagctgctaccttc

SEQ ID NO: 5002523 - DNA, 17 bp, Homo sapiens
gaccctgcccaccccat

SEQ ID NO: 5002524 - DNA, 21 bp, Homo sapiens
gacctaaagggtatgagctgg

SEQ ID NO: 5002525 - DNA, 18 bp, Homo sapiens
gacctggttgtccaggtc

SEQ ID NO: 5002526 - DNA, 15 bp, Homo sapiens
gaccttctaggaagc

SEQ ID NO: 5002527 - DNA, 17 bp, Homo sapiens
gactctagaagctcagg

SEQ ID NO: 5002528 - DNA, 20 bp, Homo sapiens
gactctagaagctcaggttc

SEQ ID NO: 5002529 - DNA, 16 bp, Homo sapiens
gactctccactgacct

SEQ ID NO: 5002530 - DNA, 20 bp, Homo sapiens
gactctgcctaaccatgggc

SEQ ID NO: 5002531 - DNA, 22 bp, Homo sapiens
gactctgcctaaccatgggctc

SEQ ID NO: 5002532 - DNA, 23 bp, Homo sapiens
gactctgcctaaccatgggctca

SEQ ID NO: 5002533 - DNA, 15 bp, Homo sapiens
gactgctcaggcctc

SEQ ID NO: 5002534 - DNA, 16 bp, Homo sapiens
gactggtaagtaactg

SEQ ID NO: 5002535 - DNA, 23 bp, Homo sapiens
gacttctctttcttattttgtaa

SEQ ID NO: 5002536 - DNA, 12 bp, Homo sapiens
gagaagatggca

SEQ ID NO: 5002537 - DNA, 15 bp, Homo sapiens
gagaagatggcactg

SEQ ID NO: 5002538 - DNA, 18 bp, Homo sapiens
gagaagatggcactgtcc

SEQ ID NO: 5002539 - DNA, 19 bp, Homo sapiens
gagaagatggcactgtcca

SEQ ID NO: 5002540 - DNA, 16 bp, Homo sapiens
gagataatacattccg

SEQ ID NO: 5002541 - DNA, 15 bp, Homo sapiens
gagcccagggtgctg

SEQ ID NO: 5002542 - DNA, 13 bp, Homo sapiens
gagctaaggccag

SEQ ID NO: 5002543 - DNA, 17 bp, Homo sapiens
gagctgaggcaattcta

SEQ ID NO: 5002544 - DNA, 15 bp, Homo sapiens
gagctgccctctcct

SEQ ID NO: 5002545 - DNA, 16 bp, Homo sapiens
gagctgccctctcctg

SEQ ID NO: 5002546 - DNA, 18 bp, Homo sapiens
gagctgccctctcctggg

SEQ ID NO: 5002547 - DNA, 18 bp, Homo sapiens
gagctggagctaaggcca

SEQ ID NO: 5002548 - DNA, 12 bp, Homo sapiens
gaggactctaga

SEQ ID NO: 5002549 - DNA, 18 bp, Homo sapiens
gaggagctcaggacacta

SEQ ID NO: 5002550 - DNA, 12 bp, Homo sapiens
gaggcacagcag

SEQ ID NO: 5002551 - DNA, 23 bp, Homo sapiens
gaggcagcgtgaaagcagatgag

SEQ ID NO: 5002552 - DNA, 20 bp, Homo sapiens
gaggcatgggggcccaaagg

SEQ ID NO: 5002553 - DNA, 13 bp, Homo sapiens
gaggctctccaaa

SEQ ID NO: 5002554 - DNA, 19 bp, Homo sapiens
gagggcagtctagtcctgg

SEQ ID NO: 5002555 - DNA, 24 bp, Homo sapiens
gagggtggggtgccccagctagga

SEQ ID NO: 5002556 - DNA, 23 bp, Homo sapiens
gaggtcttggccgactcagggac

SEQ ID NO: 5002557 - DNA, 22 bp, Homo sapiens
gagtagaaagacagagctggga

SEQ ID NO: 5002558 - DNA, 13 bp, Homo sapiens
gagtaggctccag

SEQ ID NO: 5002559 - DNA, 15 bp, Homo sapiens
gagtcagtagccaga

SEQ ID NO: 5002560 - DNA, 22 bp, Homo sapiens
gagtcatgtgcctctgtcctta

SEQ ID NO: 5002561 - DNA, 14 bp, Homo sapiens
gagtccaggcctgg

SEQ ID NO: 5002562 - DNA, 14 bp, Homo sapiens
ggcccagaggagag

SEQ ID NO: 5002563 - DNA, 15 bp, Homo sapiens
ggcccagaggagagg

SEQ ID NO: 5002564 - DNA, 22 bp, Homo sapiens
ggcccagaggagaggagacaga

SEQ ID NO: 5002565 - DNA, 22 bp, Homo sapiens
ggcccaggaaggcggcaggcag

SEQ ID NO: 5002566 - DNA, 17 bp, Homo sapiens
ggcccatgtagctggca

SEQ ID NO: 5002567 - DNA, 17 bp, Homo sapiens
ggccgactcagggacct

SEQ ID NO: 5002568 - DNA, 17 bp, Homo sapiens
ggcctcatcttccccag

SEQ ID NO: 5002569 - DNA, 22 bp, Homo sapiens
ggcctctactaggtctgctcct

SEQ ID NO: 5002570 - DNA, 24 bp, Homo sapiens
ggcctctactaggtctgctcctga

SEQ ID NO: 5002571 - DNA, 13 bp, Homo sapiens
ggcctctgaggag

SEQ ID NO: 5002572 - DNA, 19 bp, Homo sapiens
ggcctctgaggagcccacg

SEQ ID NO: 5002573 - DNA, 23 bp, Homo sapiens
ggcctctgaggagcccacggggc

SEQ ID NO: 5002574 - DNA, 15 bp, Homo sapiens
ggcctggatgcacag

SEQ ID NO: 5002575 - DNA, 22 bp, Homo sapiens
ggcctggatgcacagtgcctga

SEQ ID NO: 5002576 - DNA, 16 bp, Homo sapiens
ggcctgggtcacgctc

SEQ ID NO: 5002577 - DNA, 12 bp, Homo sapiens
ggcggcaggcag

SEQ ID NO: 5002578 - DNA, 21 bp, Homo sapiens
ggctaattagaggatgtggca

SEQ ID NO: 5002579 - DNA, 15 bp, Homo sapiens
ggctacacagaccct

SEQ ID NO: 5002580 - DNA, 17 bp, Homo sapiens
ggctcagaggggcctca

SEQ ID NO: 5002581 - DNA, 13 bp, Homo sapiens
ggctcagggccag

SEQ ID NO: 5002582 - DNA, 14 bp, Homo sapiens
ggctcagggccagg

SEQ ID NO: 5002583 - DNA, 16 bp, Homo sapiens
ggctccagacaggagg

SEQ ID NO: 5002584 - DNA, 19 bp, Homo sapiens
ggctccagacaggaggagt

SEQ ID NO: 5002585 - DNA, 14 bp, Homo sapiens
ggctgacctgctgt

SEQ ID NO: 5002586 - DNA, 16 bp, Homo sapiens
ggctgacctgctgtgg

SEQ ID NO: 5002587 - DNA, 19 bp, Homo sapiens
ggctgaggataccccaaag

SEQ ID NO: 5002588 - DNA, 21 bp, Homo sapiens
ggctgaggataccccaaagtc

SEQ ID NO: 5002589 - DNA, 18 bp, Homo sapiens
ggctgtaaacagctctgt

SEQ ID NO: 5002590 - DNA, 19 bp, Homo sapiens
ggctgtaaacagctctgtg

SEQ ID NO: 5002591 - DNA, 17 bp, Homo sapiens
ggctgtgccccacctgt

SEQ ID NO: 5002592 - DNA, 18 bp, Homo sapiens
gggaaaatggcagaaaga

SEQ ID NO: 5002593 - DNA, 16 bp, Homo sapiens
gggaagtttctgggtg

SEQ ID NO: 5002594 - DNA, 12 bp, Homo sapiens
gggacagacagc

SEQ ID NO: 5002595 - DNA, 11 bp, Homo sapiens
gggagagtcca

SEQ ID NO: 5002596 - DNA, 15 bp, Homo sapiens
gggagagtccaggcc

SEQ ID NO: 5002597 - DNA, 18 bp, Homo sapiens
gggagtaggctccagaca

SEQ ID NO: 5002598 - DNA, 19 bp, Homo sapiens
gggagtaggctccagacag

SEQ ID NO: 5002599 - DNA, 22 bp, Homo sapiens
gggatggctatattaggcatgt

SEQ ID NO: 5002600 - DNA, 14 bp, Homo sapiens
gggcactagctaga

SEQ ID NO: 5002601 - DNA, 16 bp, Homo sapiens
gggcactagctagatg

SEQ ID NO: 5002602 - DNA, 14 bp, Homo sapiens
gggcactgggcact

SEQ ID NO: 5002603 - DNA, 18 bp, Homo sapiens
gggcagagtggagcccag

SEQ ID NO: 5002604 - DNA, 20 bp, Homo sapiens
gggcagagtggagcccaggg

SEQ ID NO: 5002605 - DNA, 21 bp, Homo sapiens
gggcagagtggagcccagggt

SEQ ID NO: 5002606 - DNA, 12 bp, Homo sapiens
gggcagctgcct

SEQ ID NO: 5002607 - DNA, 19 bp, Homo sapiens
gggcagctgcctcccctcc

SEQ ID NO: 5002608 - DNA, 22 bp, Homo sapiens
gggcagtggcctggatgcacag

SEQ ID NO: 5002609 - DNA, 20 bp, Homo sapiens
gggccaggtcctcacagcag

SEQ ID NO: 5002610 - DNA, 23 bp, Homo sapiens
gggccaggtcctcacagcagtca

SEQ ID NO: 5002611 - DNA, 13 bp, Homo sapiens
gggcccagaggag

SEQ ID NO: 5002612 - DNA, 17 bp, Homo sapiens
gggcccatgtagctggc

SEQ ID NO: 5002613 - DNA, 22 bp, Homo sapiens
gggcccatgtagctggcaagct

SEQ ID NO: 5002614 - DNA, 15 bp, Homo sapiens
gggctacacagaccc

SEQ ID NO: 5002615 - DNA, 13 bp, Homo sapiens
gggctcagagggg

SEQ ID NO: 5002616 - DNA, 14 bp, Homo sapiens
gggctcagaggggc

SEQ ID NO: 5002617 - DNA, 11 bp, Homo sapiens
gggctcagggc

SEQ ID NO: 5002618 - DNA, 12 bp, Homo sapiens
gggctcagggcc

SEQ ID NO: 5002619 - DNA, 15 bp, Homo sapiens
gggctcagggccagg

SEQ ID NO: 5002620 - DNA, 18 bp, Homo sapiens
gggctcagggccaggtcc

SEQ ID NO: 5002621 - DNA, 22 bp, Homo sapiens
gggctgaggataccccaaagtc

SEQ ID NO: 5002622 - DNA, 21 bp, Homo sapiens
ggggcaaagctgctgggccag

SEQ ID NO: 5002623 - DNA, 19 bp, Homo sapiens
ggggcagagtggagcccag

SEQ ID NO: 5002624 - DNA, 22 bp, Homo sapiens
ggggcctcatcttccccagccc

SEQ ID NO: 5002625 - DNA, 20 bp, Homo sapiens
gggtaaagccctcagatccc

SEQ ID NO: 5002626 - DNA, 15 bp, Homo sapiens
gggtgctggggcaga

SEQ ID NO: 5002627 - DNA, 16 bp, Homo sapiens
gggtgctggggcagag

SEQ ID NO: 5002628 - DNA, 13 bp, Homo sapiens
ggtatgagctgga

SEQ ID NO: 5002629 - DNA, 16 bp, Homo sapiens
ggtatgagctggagct

SEQ ID NO: 5002630 - DNA, 17 bp, Homo sapiens
ggtcacgctcaaggaag

SEQ ID NO: 5002631 - DNA, 14 bp, Homo sapiens
ggtcctcacagcag

SEQ ID NO: 5002632 - DNA, 15 bp, Homo sapiens
ggtctagaaggccag

SEQ ID NO: 5002633 - DNA, 20 bp, Homo sapiens
ggtctagaaggccaggcctc

SEQ ID NO: 5002634 - DNA, 20 bp, Homo sapiens
ggtctgaccaaaaccagagg

SEQ ID NO: 5002635 - DNA, 20 bp, Homo sapiens
ggtcttggccgactcaggga

SEQ ID NO: 5002636 - DNA, 17 bp, Homo sapiens
ggtgctggggcagagtg

SEQ ID NO: 5002637 - DNA, 15 bp, Homo sapiens
ggtggggtgccccag

SEQ ID NO: 5002638 - DNA, 10 bp, Homo sapiens
ggtgtaaata

SEQ ID NO: 5002639 - DNA, 23 bp, Homo sapiens
ggttgcctcaacagcaggaggca

SEQ ID NO: 5002640 - DNA, 14 bp, Homo sapiens
ggttgtccaggtct

SEQ ID NO: 5002641 - DNA, 18 bp, Homo sapiens
ggtttgaatataaacact

SEQ ID NO: 5002642 - DNA, 18 bp, Homo sapiens
ggtttgatgccaaagcag

SEQ ID NO: 5002643 - DNA, 19 bp, Homo sapiens
ggtttgatgccaaagcaga

SEQ ID NO: 5002644 - DNA, 20 bp, Homo sapiens
gtaaagccctcagatcccag

SEQ ID NO: 5002645 - DNA, 21 bp, Homo sapiens
gtaaagccctcagatcccagg

SEQ ID NO: 5002646 - DNA, 13 bp, Homo sapiens
gtaaatatagtag

SEQ ID NO: 5002647 - DNA, 11 bp, Homo sapiens
gtaataaactc

SEQ ID NO: 5002648 - DNA, 14 bp, Homo sapiens
gtaataaactctct

SEQ ID NO: 5002649 - DNA, 16 bp, Homo sapiens
gtaatgcttcaatcag

SEQ ID NO: 5002650 - DNA, 21 bp, Homo sapiens
gtacgactcttttccaaacac

SEQ ID NO: 5002651 - DNA, 17 bp, Homo sapiens
gtagaataaagaaaaac

SEQ ID NO: 5002652 - DNA, 12 bp, Homo sapiens
gtagctggcaag

SEQ ID NO: 5002653 - DNA, 13 bp, Homo sapiens
gtagctggcaagc

SEQ ID NO: 5002654 - DNA, 15 bp, Homo sapiens
gtagctggcaagctg

SEQ ID NO: 5002655 - DNA, 16 bp, Homo sapiens
gtaggctccagacagg

SEQ ID NO: 5002656 - DNA, 19 bp, Homo sapiens
gtcacaggcccaggaaggc

SEQ ID NO: 5002657 - DNA, 11 bp, Homo sapiens
gtcaccccagt

SEQ ID NO: 5002658 - DNA, 23 bp, Homo sapiens
gtcacttgtaggtttctctgcct

SEQ ID NO: 5002659 - DNA, 15 bp, Homo sapiens
gtcagtagccagagt

SEQ ID NO: 5002660 - DNA, 16 bp, Homo sapiens
gtcatgtgcctctgtc

SEQ ID NO: 5002661 - DNA, 16 bp, Homo sapiens
gtccaggcctgggtca

SEQ ID NO: 5002662 - DNA, 12 bp, Homo sapiens
gtcccacaggga

SEQ ID NO: 5002663 - DNA, 14 bp, Homo sapiens
gtcccacagggacc

SEQ ID NO: 5002664 - DNA, 13 bp, Homo sapiens
gtcctcacagcag

SEQ ID NO: 5002665 - DNA, 16 bp, Homo sapiens
gtcctcacagcagtca

SEQ ID NO: 5002666 - DNA, 23 bp, Homo sapiens
gtcctcacagcagtcacaggccc

SEQ ID NO: 5002667 - DNA, 16 bp, Homo sapiens
gtcctgaactgtgagt

SEQ ID NO: 5002668 - DNA, 11 bp, Homo sapiens
gtcctgctgcc

SEQ ID NO: 5002669 - DNA, 15 bp, Homo sapiens
gtcgtctggcatctc

SEQ ID NO: 5002670 - DNA, 18 bp, Homo sapiens
gtctagaaggccaggcct

SEQ ID NO: 5002671 - DNA, 12 bp, Homo sapiens
gtctctgaggct

SEQ ID NO: 5002672 - DNA, 22 bp, Homo sapiens
gtctgaccaaaaccagagggca

SEQ ID NO: 5002673 - DNA, 23 bp, Homo sapiens
gtctgaccaaaaccagagggcag

SEQ ID NO: 5002674 - DNA, 21 bp, Homo sapiens
gtctgctcctgaaccagtcct

SEQ ID NO: 5002675 - DNA, 20 bp, Homo sapiens
gtgaaagcatcacttgggat

SEQ ID NO: 5002676 - DNA, 19 bp, Homo sapiens
gtgactatttggagaatag

SEQ ID NO: 5002677 - DNA, 22 bp, Homo sapiens
gtgatgctaaaggttgtattgc

SEQ ID NO: 5002678 - DNA, 21 bp, Homo sapiens
gtgccccacctgttgtcctga

SEQ ID NO: 5002679 - DNA, 16 bp, Homo sapiens
gtgccctagggctcag

SEQ ID NO: 5002680 - DNA, 18 bp, Homo sapiens
gtgccctagggctcagag

SEQ ID NO: 5002681 - DNA, 15 bp, Homo sapiens
gtgcctgatgggagt

SEQ ID NO: 5002682 - DNA, 15 bp, Homo sapiens
gtgcgacttcacaaa

SEQ ID NO: 5002683 - DNA, 20 bp, Homo sapiens
gtgcgacttcacaaaatgca

SEQ ID NO: 5002684 - DNA, 23 bp, Homo sapiens
gtgctgagttggtgttgacatgt

SEQ ID NO: 5002685 - DNA, 23 bp, Homo sapiens
gtgctgccaccccttggcactgt

SEQ ID NO: 5002686 - DNA, 15 bp, Homo sapiens
gtgctggggcagagt

SEQ ID NO: 5002687 - DNA, 18 bp, Homo sapiens
gtgctggggcagagtgga

SEQ ID NO: 5002688 - DNA, 13 bp, Homo sapiens
gtggagcccaggg

SEQ ID NO: 5002689 - DNA, 16 bp, Homo sapiens
gtggaggagctcagga

SEQ ID NO: 5002690 - DNA, 18 bp, Homo sapiens
gtggcaggggcagtggcc

SEQ ID NO: 5002691 - DNA, 12 bp, Homo sapiens
gtgggacagaca

SEQ ID NO: 5002692 - DNA, 23 bp, Homo sapiens
gtgtcacttgtaggtttctctgc

SEQ ID NO: 5002693 - DNA, 19 bp, Homo sapiens
gtgtgccctagggctcaga

SEQ ID NO: 5002694 - DNA, 13 bp, Homo sapiens
gttccctgccaca

SEQ ID NO: 5002695 - DNA, 16 bp, Homo sapiens
gttctcaggggtgctg

SEQ ID NO: 5002696 - DNA, 16 bp, Homo sapiens
gttgcagtgagctgag

SEQ ID NO: 5002697 - DNA, 17 bp, Homo sapiens
gttgcctcaacagcagg

SEQ ID NO: 5002698 - DNA, 20 bp, Homo sapiens
gttgcctcaacagcaggagg

SEQ ID NO: 5002699 - DNA, 22 bp, Homo sapiens
gttgcctcaacagcaggaggca

SEQ ID NO: 5002700 - DNA, 14 bp, Homo sapiens
gtttctctgcctcc

SEQ ID NO: 5002701 - DNA, 17 bp, Homo sapiens
gtttctctgcctccagg

SEQ ID NO: 5002702 - DNA, 17 bp, Homo sapiens
gtttgaatataaacact

SEQ ID NO: 5002703 - DNA, 19 bp, Homo sapiens
gtttgatgccaaagcagac

SEQ ID NO: 5002704 - DNA, 20 bp, Homo sapiens
gtttgatgccaaagcagaca

SEQ ID NO: 5002705 - DNA, 22 bp, Homo sapiens
gtttgatgccaaagcagacatt

SEQ ID NO: 5002706 - DNA, 13 bp, Homo sapiens
gtttgcaaggaag

SEQ ID NO: 5002707 - DNA, 15 bp, Homo sapiens
gtttgcaaggaagcc

SEQ ID NO: 5002708 - DNA, 17 bp, Homo sapiens
taaaagtcagagctcag

SEQ ID NO: 5002709 - DNA, 16 bp, Homo sapiens
taaaatatacaaacat

SEQ ID NO: 5002710 - DNA, 18 bp, Homo sapiens
taaaatatacaaacatgt

SEQ ID NO: 5002711 - DNA, 19 bp, Homo sapiens
taaacaaatgtatgattac

SEQ ID NO: 5002712 - DNA, 22 bp, Homo sapiens
taaagacagaaaaaaataaaaa

SEQ ID NO: 5002713 - DNA, 19 bp, Homo sapiens
taaagccctcagatcccag

SEQ ID NO: 5002714 - DNA, 21 bp, Homo sapiens
taaagccctcagatcccaggg

SEQ ID NO: 5002715 - DNA, 21 bp, Homo sapiens
taaagggtatgagctggagct

SEQ ID NO: 5002716 - DNA, 14 bp, Homo sapiens
taaatgtgtaaatg

SEQ ID NO: 5002717 - DNA, 17 bp, Homo sapiens
taaatgtgtaaatgtgg

SEQ ID NO: 5002718 - DNA, 15 bp, Homo sapiens
taaccatgggctcag

SEQ ID NO: 5002719 - DNA, 17 bp, Homo sapiens
taaccatgggctcaggg

SEQ ID NO: 5002720 - DNA, 20 bp, Homo sapiens
taaccatgggctcagggcca

SEQ ID NO: 5002721 - DNA, 21 bp, Homo sapiens
taaccatgggctcagggccag

SEQ ID NO: 5002722 - DNA, 22 bp, Homo sapiens
taagcaatcactgggcccagag

SEQ ID NO: 5002723 - DNA, 20 bp, Homo sapiens
taagtagaataaagaaaaac

SEQ ID NO: 5002724 - DNA, 12 bp, Homo sapiens
taataaactctc

SEQ ID NO: 5002725 - DNA, 13 bp, Homo sapiens
taataaactctct

SEQ ID NO: 5002726 - DNA, 16 bp, Homo sapiens
taatatggggatgcag

SEQ ID NO: 5002727 - DNA, 14 bp, Homo sapiens
taatatttttaatt

SEQ ID NO: 5002728 - DNA, 19 bp, Homo sapiens
taatccaatacctcttgga

SEQ ID NO: 5002729 - DNA, 15 bp, Homo sapiens
taatggtttgaatat

SEQ ID NO: 5002730 - DNA, 22 bp, Homo sapiens
tacaggtgtgagcatagtgaga

SEQ ID NO: 5002731 - DNA, 15 bp, Homo sapiens
tacatggagctcagg

SEQ ID NO: 5002732 - DNA, 18 bp, Homo sapiens
taccaaatataaacttgt

SEQ ID NO: 5002733 - DNA, 22 bp, Homo sapiens
tactaggtctgctcctgaacca

SEQ ID NO: 5002734 - DNA, 21 bp, Homo sapiens
tactcttcagaatatggacaa

SEQ ID NO: 5002735 - DNA, 17 bp, Homo sapiens
tacttttgcatgaaaat

SEQ ID NO: 5002736 - DNA, 17 bp, Homo sapiens
tagaaagagatacagag

SEQ ID NO: 5002737 - DNA, 13 bp, Homo sapiens
tagaagctcaggt

SEQ ID NO: 5002738 - DNA, 17 bp, Homo sapiens
tagagcttccactgtca

SEQ ID NO: 5002739 - DNA, 16 bp, Homo sapiens
tagaggatgtggcagg

SEQ ID NO: 5002740 - DNA, 17 bp, Homo sapiens
tagaggatgtggcaggg

SEQ ID NO: 5002741 - DNA, 19 bp, Homo sapiens
tagaggatgtggcaggggc

SEQ ID NO: 5002742 - DNA, 23 bp, Homo sapiens
tagaggatgtggcaggggcagtg

SEQ ID NO: 5002743 - DNA, 22 bp, Homo sapiens
tagcacatcactgagaagatgg

SEQ ID NO: 5002744 - DNA, 18 bp, Homo sapiens
tagccagagttgttctca

SEQ ID NO: 5002745 - DNA, 13 bp, Homo sapiens
tagctggcaagct

SEQ ID NO: 5002746 - DNA, 21 bp, Homo sapiens
tagctgtgaatggctgtgccc

SEQ ID NO: 5002747 - DNA, 15 bp, Homo sapiens
tagcttggaaactgg

SEQ ID NO: 5002748 - DNA, 19 bp, Homo sapiens
taggcatgttcagggatgc

SEQ ID NO: 5002749 - DNA, 15 bp, Homo sapiens
tagggctcagagggg

SEQ ID NO: 5002750 - DNA, 22 bp, Homo sapiens
taggtctgaccaaaaccagagg

SEQ ID NO: 5002751 - DNA, 17 bp, Homo sapiens
taggtttctctgcctcc

SEQ ID NO: 5002752 - DNA, 17 bp, Homo sapiens
tagtacatggagctcag

SEQ ID NO: 5002753 - DNA, 17 bp, Homo sapiens
tagttaggtgtgccaaa

SEQ ID NO: 5002754 - DNA, 14 bp, Homo sapiens
tataaacactatat

SEQ ID NO: 5002755 - DNA, 22 bp, Homo sapiens
tataatatttttaattaaataa

SEQ ID NO: 5002756 - DNA, 15 bp, Homo sapiens
tatacaaacatgtgg

SEQ ID NO: 5002757 - DNA, 21 bp, Homo sapiens
tatacaaacctttagctgtga

SEQ ID NO: 5002758 - DNA, 22 bp, Homo sapiens
tatatacaaacctttagctgtg

SEQ ID NO: 5002759 - DNA, 14 bp, Homo sapiens
tatattttaatttg

SEQ ID NO: 5002760 - DNA, 17 bp, Homo sapiens
tatccatgatcacacag

SEQ ID NO: 5002761 - DNA, 18 bp, Homo sapiens
tatccatgatcacacagc

SEQ ID NO: 5002762 - DNA, 22 bp, Homo sapiens
tatctgtgtgccctagggctca

SEQ ID NO: 5002763 - DNA, 15 bp, Homo sapiens
tatgaagaagagagt

SEQ ID NO: 5002764 - DNA, 14 bp, Homo sapiens
tatgtttttgtgta

SEQ ID NO: 5002765 - DNA, 13 bp, Homo sapiens
tcaaatgctaaat

SEQ ID NO: 5002766 - DNA, 18 bp, Homo sapiens
tcaatggtttgcaaggaa

SEQ ID NO: 5002767 - DNA, 15 bp, Homo sapiens
tcaatgtcaagtacc

SEQ ID NO: 5002768 - DNA, 18 bp, Homo sapiens
tcaatttccaagagctga

SEQ ID NO: 5002769 - DNA, 22 bp, Homo sapiens
tcacacagctaataaaagtcag

SEQ ID NO: 5002770 - DNA, 13 bp, Homo sapiens
tcacacccacctg

SEQ ID NO: 5002771 - DNA, 14 bp, Homo sapiens
tcacacccacctgc

SEQ ID NO: 5002772 - DNA, 20 bp, Homo sapiens
tcacagcagtcacaggccca

SEQ ID NO: 5002773 - DNA, 23 bp, Homo sapiens
tcacagcagtcacaggcccagga

SEQ ID NO: 5002774 - DNA, 12 bp, Homo sapiens
tcacaggcccag

SEQ ID NO: 5002775 - DNA, 13 bp, Homo sapiens
tcacaggcccagg

SEQ ID NO: 5002776 - DNA, 22 bp, Homo sapiens
tcacatcctcagaaagtgcagc

SEQ ID NO: 5002777 - DNA, 23 bp, Homo sapiens
tcacatcctcagaaagtgcagca

SEQ ID NO: 5002778 - DNA, 14 bp, Homo sapiens
tcaccatctttgag

SEQ ID NO: 5002779 - DNA, 23 bp, Homo sapiens
tcacctaagcaatcactgggccc

SEQ ID NO: 5002780 - DNA, 13 bp, Homo sapiens
tcacctcccaggg

SEQ ID NO: 5002781 - DNA, 14 bp, Homo sapiens
tcacctttcccact

SEQ ID NO: 5002782 - DNA, 19 bp, Homo sapiens
tcacctttcccactttctt

SEQ ID NO: 5002783 - DNA, 14 bp, Homo sapiens
tcactgagaagatg

SEQ ID NO: 5002784 - DNA, 18 bp, Homo sapiens
tcactgggcccagaggag

SEQ ID NO: 5002785 - DNA, 20 bp, Homo sapiens
tcactgggcccagaggagag

SEQ ID NO: 5002786 - DNA, 21 bp, Homo sapiens
tcactgggcccagaggagagg

SEQ ID NO: 5002787 - DNA, 14 bp, Homo sapiens
tcactgtcagtccc

SEQ ID NO: 5002788 - DNA, 21 bp, Homo sapiens
tcacttgtaggtttctctgcc

SEQ ID NO: 5002789 - DNA, 22 bp, Homo sapiens
tcacttgtaggtttctctgcct

SEQ ID NO: 5002790 - DNA, 15 bp, Homo sapiens
tcagagctgccctct

SEQ ID NO: 5002791 - DNA, 18 bp, Homo sapiens
tcagagctgccctctcct

SEQ ID NO: 5002792 - DNA, 21 bp, Homo sapiens
tcagagctgccctctcctggg

SEQ ID NO: 5002793 - DNA, 13 bp, Homo sapiens
tcagatcccaggg

SEQ ID NO: 5002794 - DNA, 15 bp, Homo sapiens
tcagatcccagggta

SEQ ID NO: 5002795 - DNA, 13 bp, Homo sapiens
tcaggacactaat

SEQ ID NO: 5002796 - DNA, 22 bp, Homo sapiens
tcaggcctcacctcccagggct

SEQ ID NO: 5002797 - DNA, 20 bp, Homo sapiens
tcaggcctctgaggagccca

SEQ ID NO: 5002798 - DNA, 22 bp, Homo sapiens
tcagtagccagagttgttctca

SEQ ID NO: 5002799 - DNA, 23 bp, Homo sapiens
tcagtagccagagttgttctcag

SEQ ID NO: 5002800 - DNA, 17 bp, Homo sapiens
tcagtcccactgcaccc

SEQ ID NO: 5002801 - DNA, 13 bp, Homo sapiens
tcagttctgcctt

SEQ ID NO: 5002802 - DNA, 16 bp, Homo sapiens
tcatctctctttaata

SEQ ID NO: 5002803 - DNA, 16 bp, Homo sapiens
tcatgtaaattttgta

SEQ ID NO: 5002804 - DNA, 17 bp, Homo sapiens
tcatgtgcctctgtcct

SEQ ID NO: 5002805 - DNA, 18 bp, Homo sapiens
tcattccatgactctgcc

SEQ ID NO: 5002806 - DNA, 19 bp, Homo sapiens
tcattccatgactctgcct

SEQ ID NO: 5002807 - DNA, 20 bp, Homo sapiens
tcattccatgactctgccta

SEQ ID NO: 5002808 - DNA, 13 bp, Homo sapiens
tcattttgcacgt

SEQ ID NO: 5002809 - DNA, 13 bp, Homo sapiens
tccaagtatttta

SEQ ID NO: 5002810 - DNA, 17 bp, Homo sapiens
tccaagtattttatctg

SEQ ID NO: 5002811 - DNA, 11 bp, Homo sapiens
tccaatacctc

SEQ ID NO: 5002812 - DNA, 15 bp, Homo sapiens
tccaccccagcccca

SEQ ID NO: 5002813 - DNA, 14 bp, Homo sapiens
tccacctccctgca

SEQ ID NO: 5002814 - DNA, 17 bp, Homo sapiens
tgttctcaggggtgctg

SEQ ID NO: 5002815 - DNA, 12 bp, Homo sapiens
ttaactcaatat

SEQ ID NO: 5002816 - DNA, 15 bp, Homo sapiens
ttaattcactcccac

SEQ ID NO: 5002817 - DNA, 16 bp, Homo sapiens
ttacacaagagctgga

SEQ ID NO: 5002818 - DNA, 18 bp, Homo sapiens
ttacatcaaggcttcaaa

SEQ ID NO: 5002819 - DNA, 22 bp, Homo sapiens
ttagctgtgaatggctgtgccc

SEQ ID NO: 5002820 - DNA, 19 bp, Homo sapiens
ttagtacatggagctcagg

SEQ ID NO: 5002821 - DNA, 17 bp, Homo sapiens
ttagttaggtgtgccaa

SEQ ID NO: 5002822 - DNA, 21 bp, Homo sapiens
ttatcatctcgaccacttttc

SEQ ID NO: 5002823 - DNA, 11 bp, Homo sapiens
ttatctgtgtt

SEQ ID NO: 5002824 - DNA, 16 bp, Homo sapiens
ttattttgtaataaac

SEQ ID NO: 5002825 - DNA, 17 bp, Homo sapiens
ttattttgtaataaact

SEQ ID NO: 5002826 - DNA, 22 bp, Homo sapiens
ttcaatggtttgcaaggaagcc

SEQ ID NO: 5002827 - DNA, 14 bp, Homo sapiens
ttcagagctgccct

SEQ ID NO: 5002828 - DNA, 17 bp, Homo sapiens
ttcagagctgccctctc

SEQ ID NO: 5002829 - DNA, 22 bp, Homo sapiens
ttcagagctgccctctcctggg

SEQ ID NO: 5002830 - DNA, 23 bp, Homo sapiens
ttcagagctgccctctcctgggc

SEQ ID NO: 5002831 - DNA, 18 bp, Homo sapiens
ttcaggcctctgaggagc

SEQ ID NO: 5002832 - DNA, 16 bp, Homo sapiens
ttcagtgaaagcatca

SEQ ID NO: 5002833 - DNA, 18 bp, Homo sapiens
ttccacttcctgccccaa

SEQ ID NO: 5002834 - DNA, 15 bp, Homo sapiens
ttccatgaaaatgca

SEQ ID NO: 5002835 - DNA, 16 bp, Homo sapiens
ttccatgactctgcct

SEQ ID NO: 5002836 - DNA, 17 bp, Homo sapiens
ttccatgactctgccta

SEQ ID NO: 5002837 - DNA, 21 bp, Homo sapiens
ttcctcacacccacctgctgc

SEQ ID NO: 5002838 - DNA, 15 bp, Homo sapiens
ttctcaaagctggga

SEQ ID NO: 5002839 - DNA, 18 bp, Homo sapiens
ttctcaaatgctaaatgc

SEQ ID NO: 5002840 - DNA, 16 bp, Homo sapiens
ttctcattcctgttct

SEQ ID NO: 5002841 - DNA, 15 bp, Homo sapiens
ttctctactctggaa

SEQ ID NO: 5002842 - DNA, 15 bp, Homo sapiens
ttctctgcctccagg

SEQ ID NO: 5002843 - DNA, 17 bp, Homo sapiens
ttctcttgaaggtgctg

SEQ ID NO: 5002844 - DNA, 22 bp, Homo sapiens
ttctcttgaaggtgctgccacc

SEQ ID NO: 5002845 - DNA, 20 bp, Homo sapiens
ttctctttcttattttgtaa

SEQ ID NO: 5002846 - DNA, 22 bp, Homo sapiens
ttctctttcttattttgtaata

SEQ ID NO: 5002847 - DNA, 21 bp, Homo sapiens
ttctgccatgggagagtccag

SEQ ID NO: 5002848 - DNA, 16 bp, Homo sapiens
ttcttattttgtaata

SEQ ID NO: 5002849 - DNA, 22 bp, Homo sapiens
ttcttattttgtaataaactct

SEQ ID NO: 5002850 - DNA, 15 bp, Homo sapiens
ttcttgtctctgagg

SEQ ID NO: 5002851 - DNA, 22 bp, Homo sapiens
ttctttggccccttgctggagt

SEQ ID NO: 5002852 - DNA, 16 bp, Homo sapiens
ttgaaggtgctgccac

SEQ ID NO: 5002853 - DNA, 21 bp, Homo sapiens
ttgaaggtttgatgccaaagc

SEQ ID NO: 5002854 - DNA, 18 bp, Homo sapiens
ttgaatataaacactata

SEQ ID NO: 5002855 - DNA, 18 bp, Homo sapiens
ttgatgccaaagcagaca

SEQ ID NO: 5002856 - DNA, 20 bp, Homo sapiens
ttgatgccaaagcagacatt

SEQ ID NO: 5002857 - DNA, 12 bp, Homo sapiens
ttgcaaggaagc

SEQ ID NO: 5002858 - DNA, 13 bp, Homo sapiens
ttgccatccctcc

SEQ ID NO: 5002859 - DNA, 14 bp, Homo sapiens
ttgccatccctccc

SEQ ID NO: 5002860 - DNA, 16 bp, Homo sapiens
ttgccatccctccctc

SEQ ID NO: 5002861 - DNA, 13 bp, Homo sapiens
ttgggattaatat

SEQ ID NO: 5002862 - DNA, 23 bp, Homo sapiens
ttgggtagaaagagatacagagg

SEQ ID NO: 5002863 - DNA, 17 bp, Homo sapiens
ttgtaataaactctcta

SEQ ID NO: 5002864 - DNA, 22 bp, Homo sapiens
ttgtccaggtctagaaggccag

SEQ ID NO: 5002865 - DNA, 16 bp, Homo sapiens
ttgtcctgaactgtga

SEQ ID NO: 5002866 - DNA, 13 bp, Homo sapiens
tttaattaaataa

SEQ ID NO: 5002867 - DNA, 20 bp, Homo sapiens
tttatttgtttgtgcatttg

SEQ ID NO: 5002868 - DNA, 14 bp, Homo sapiens
tttcattctcttga

SEQ ID NO: 5002869 - DNA, 14 bp, Homo sapiens
tttccaagagctga

SEQ ID NO: 5002870 - DNA, 17 bp, Homo sapiens
tttccatgaaaatgcaa

SEQ ID NO: 5002871 - DNA, 22 bp, Homo sapiens
tttcctcacacccacctgctgc

SEQ ID NO: 5002872 - DNA, 19 bp, Homo sapiens
tttccttttcttgtctctg

SEQ ID NO: 5002873 - DNA, 20 bp, Homo sapiens
tttctgaaaattaacactgc

SEQ ID NO: 5002874 - DNA, 21 bp, Homo sapiens
tttcttattttgtaataaact

SEQ ID NO: 5002875 - DNA, 17 bp, Homo sapiens
tttgaatataaacacta

SEQ ID NO: 5002876 - DNA, 17 bp, Homo sapiens
tttgatgccaaagcaga

SEQ ID NO: 5002877 - DNA, 13 bp, Homo sapiens
tttggcccagaga

SEQ ID NO: 5002878 - DNA, 21 bp, Homo sapiens
tttggtccttcaaaggcttgt

SEQ ID NO: 5002879 - DNA, 12 bp, Homo sapiens
tttgtaataaac

SEQ ID NO: 5002880 - DNA, 13 bp, Homo sapiens
ttttaactcaata

SEQ ID NO: 5002881 - DNA, 13 bp, Homo sapiens
ttttaattaaata

SEQ ID NO: 5002882 - DNA, 21 bp, Homo sapiens
ttttcattcaggtatttgtaa

SEQ ID NO: 5002883 - DNA, 19 bp, Homo sapiens
ttttccatgaaaatgcaac

SEQ ID NO: 5002884 - DNA, 13 bp, Homo sapiens
ttttgtaataaac

SEQ ID NO: 5002885 - DNA, 16 bp, Homo sapiens
ttttgtaataaactct

SEQ ID NO: 5002886 - DNA, 17 bp, Homo sapiens
gaactctaagcagaaga

SEQ ID NO: 5002887 - DNA, 11 bp, Homo sapiens
gaactgccacc

SEQ ID NO: 5002888 - DNA, 19 bp, Homo sapiens
gaactttgcatagcagctg

SEQ ID NO: 5002889 - DNA, 21 bp, Homo sapiens
gaagagagtccatatttcaat

SEQ ID NO: 5002890 - DNA, 18 bp, Homo sapiens
gaagaggcctagcctgag

SEQ ID NO: 5002891 - DNA, 20 bp, Homo sapiens
gaagcaagatcgctgtgcta

SEQ ID NO: 5002892 - DNA, 21 bp, Homo sapiens
gaagctcaggttccctgccac

SEQ ID NO: 5002893 - DNA, 23 bp, Homo sapiens
gaagctcaggttccctgccacac

SEQ ID NO: 5002894 - DNA, 16 bp, Homo sapiens
gaaggcggcaggcaga

SEQ ID NO: 5002895 - DNA, 14 bp, Homo sapiens
gaaggtgctgccac

SEQ ID NO: 5002896 - DNA, 18 bp, Homo sapiens
gaaggtttgatgccaaag

SEQ ID NO: 5002897 - DNA, 13 bp, Homo sapiens
gaatataaacact

SEQ ID NO: 5002898 - DNA, 14 bp, Homo sapiens
gaatataaacacta

SEQ ID NO: 5002899 - DNA, 22 bp, Homo sapiens
gaatggcacagcccaaagaagg

SEQ ID NO: 5002900 - DNA, 21 bp, Homo sapiens
gaattaagttagggaatggca

SEQ ID NO: 5002901 - DNA, 22 bp, Homo sapiens
gaattgtgcgacttcacaaaat

SEQ ID NO: 5002902 - DNA, 13 bp, Homo sapiens
gaatttggcccag

SEQ ID NO: 5002903 - DNA, 15 bp, Homo sapiens
gaatttggcccagag

SEQ ID NO: 5002904 - DNA, 14 bp, Homo sapiens
gacaatgctgccat

SEQ ID NO: 5002905 - DNA, 18 bp, Homo sapiens
gacaatgctgccatgccc

SEQ ID NO: 5002906 - DNA, 20 bp, Homo sapiens
gacagaaaaaaataaaaaca

SEQ ID NO: 5002907 - DNA, 15 bp, Homo sapiens
gacagaacactgtct

SEQ ID NO: 5002908 - DNA, 13 bp, Homo sapiens
gacagaagaaggc

SEQ ID NO: 5002909 - DNA, 10 bp, Homo sapiens
gacagacagc

SEQ ID NO: 5002910 - DNA, 13 bp, Homo sapiens
gacagacagcagc

SEQ ID NO: 5002911 - DNA, 20 bp, Homo sapiens
gacagcctccccctgtcccc

SEQ ID NO: 5002912 - DNA, 22 bp, Homo sapiens
gacaggaggagtgggacagaca

SEQ ID NO: 5002913 - DNA, 15 bp, Homo sapiens
gaccaaaaccagagg

SEQ ID NO: 5002914 - DNA, 13 bp, Homo sapiens
gaccacatccacc

SEQ ID NO: 5002915 - DNA, 15 bp, Homo sapiens
gaccacatccacccc

SEQ ID NO: 5002916 - DNA, 20 bp, Homo sapiens
gaccacatccaccccagccc

SEQ ID NO: 5002917 - DNA, 21 bp, Homo sapiens
gaccctgcccaccccatccct

SEQ ID NO: 5002918 - DNA, 22 bp, Homo sapiens
gacctaaagggtatgagctgga

SEQ ID NO: 5002919 - DNA, 12 bp, Homo sapiens
gacctgctgtgg

SEQ ID NO: 5002920 - DNA, 16 bp, Homo sapiens
gacctggttgtccagg

SEQ ID NO: 5002921 - DNA, 20 bp, Homo sapiens
gacctggttgtccaggtcta

SEQ ID NO: 5002922 - DNA, 18 bp, Homo sapiens
gactatattgtacacacc

SEQ ID NO: 5002923 - DNA, 12 bp, Homo sapiens
gactcagggacc

SEQ ID NO: 5002924 - DNA, 14 bp, Homo sapiens
gactgctcaggcct

SEQ ID NO: 5002925 - DNA, 18 bp, Homo sapiens
gacttcacaaaatgcaag

SEQ ID NO: 5002926 - DNA, 17 bp, Homo sapiens
gacttctctttcttatt

SEQ ID NO: 5002927 - DNA, 23 bp, Homo sapiens
gagaagatggcactgtccagggc

SEQ ID NO: 5002928 - DNA, 19 bp, Homo sapiens
gagacagacacacactggc

SEQ ID NO: 5002929 - DNA, 15 bp, Homo sapiens
gagaggagacagaca

SEQ ID NO: 5002930 - DNA, 21 bp, Homo sapiens
gagattgcgccactgcactcc

SEQ ID NO: 5002931 - DNA, 22 bp, Homo sapiens
gagcaccgcctgtgaaatacca

SEQ ID NO: 5002932 - DNA, 16 bp, Homo sapiens
gagcgtggggaggggc

SEQ ID NO: 5002933 - DNA, 18 bp, Homo sapiens
gagcgtggggaggggctg

SEQ ID NO: 5002934 - DNA, 17 bp, Homo sapiens
gagctaaggccagctag

SEQ ID NO: 5002935 - DNA, 14 bp, Homo sapiens
gagctcaggacact

SEQ ID NO: 5002936 - DNA, 14 bp, Homo sapiens
gagctgccctctcc

SEQ ID NO: 5002937 - DNA, 17 bp, Homo sapiens
gagctgccctctcctgg

SEQ ID NO: 5002938 - DNA, 14 bp, Homo sapiens
gagctggagctaag

SEQ ID NO: 5002939 - DNA, 20 bp, Homo sapiens
gagctggagctaaggccagc

SEQ ID NO: 5002940 - DNA, 17 bp, Homo sapiens
gagcttccactgtcagc

SEQ ID NO: 5002941 - DNA, 19 bp, Homo sapiens
gaggagacagacacacact

SEQ ID NO: 5002942 - DNA, 14 bp, Homo sapiens
gaggagaggagaca

SEQ ID NO: 5002943 - DNA, 16 bp, Homo sapiens
gaggagaggagacaga

SEQ ID NO: 5002944 - DNA, 18 bp, Homo sapiens
gaggagaggagacagaca

SEQ ID NO: 5002945 - DNA, 21 bp, Homo sapiens
gaggagcccacggggcaaagc

SEQ ID NO: 5002946 - DNA, 19 bp, Homo sapiens
gaggagtgggacagacagc

SEQ ID NO: 5002947 - DNA, 20 bp, Homo sapiens
gaggagtgggacagacagca

SEQ ID NO: 5002948 - DNA, 16 bp, Homo sapiens
gaggataccccaaagt

SEQ ID NO: 5002949 - DNA, 21 bp, Homo sapiens
gaggataccccaaagtccagg

SEQ ID NO: 5002950 - DNA, 15 bp, Homo sapiens
gaggatgtggcaggg

SEQ ID NO: 5002951 - DNA, 21 bp, Homo sapiens
gaggcagcgtgaaagcagatg

SEQ ID NO: 5002952 - DNA, 17 bp, Homo sapiens
gagggtggggtgcccca

SEQ ID NO: 5002953 - DNA, 19 bp, Homo sapiens
gagggtggggtgccccagc

SEQ ID NO: 5002954 - DNA, 16 bp, Homo sapiens
gaggtcttggccgact

SEQ ID NO: 5002955 - DNA, 20 bp, Homo sapiens
gaggtggaggttgcagtgag

SEQ ID NO: 5002956 - DNA, 17 bp, Homo sapiens
gagtagaaagacagagc

SEQ ID NO: 5002957 - DNA, 19 bp, Homo sapiens
gagtaggctccagacagga

SEQ ID NO: 5002958 - DNA, 16 bp, Homo sapiens
gagtcagtagccagag

SEQ ID NO: 5002959 - DNA, 17 bp, Homo sapiens
gagtcagtagccagagt

SEQ ID NO: 5002960 - DNA, 12 bp, Homo sapiens
gagtcctgatcc

SEQ ID NO: 5002961 - DNA, 17 bp, Homo sapiens
gagtggagcccagggtg

SEQ ID NO: 5002962 - DNA, 18 bp, Homo sapiens
gagtgggacagacagcag

SEQ ID NO: 5002963 - DNA, 23 bp, Homo sapiens
gagttgacttgacagaacactgt

SEQ ID NO: 5002964 - DNA, 19 bp, Homo sapiens
gataccccaaagtccaggc

SEQ ID NO: 5002965 - DNA, 17 bp, Homo sapiens
gatagaatttggcccag

SEQ ID NO: 5002966 - DNA, 20 bp, Homo sapiens
gatagaatttggcccagaga

SEQ ID NO: 5002967 - DNA, 16 bp, Homo sapiens
gatagtattgtgcata

SEQ ID NO: 5002968 - DNA, 11 bp, Homo sapiens
gatcacacagc

SEQ ID NO: 5002969 - DNA, 17 bp, Homo sapiens
gatccaggaaagatgtc

SEQ ID NO: 5002970 - DNA, 17 bp, Homo sapiens
gatcctaaccctgggct

SEQ ID NO: 5002971 - DNA, 18 bp, Homo sapiens
gatcctaaccctgggctc

SEQ ID NO: 5002972 - DNA, 22 bp, Homo sapiens
gatcctaaccctgggctccctg

SEQ ID NO: 5002973 - DNA, 19 bp, Homo sapiens
gatccttcaactctgtgag

SEQ ID NO: 5002974 - DNA, 22 bp, Homo sapiens
gatgaataaatgttatagctgc

SEQ ID NO: 5002975 - DNA, 18 bp, Homo sapiens
gatgcacagtgcctgatg

SEQ ID NO: 5002976 - DNA, 22 bp, Homo sapiens
gatgcacagtgcctgatgggag

SEQ ID NO: 5002977 - DNA, 15 bp, Homo sapiens
gatgcacatccctgg

SEQ ID NO: 5002978 - DNA, 13 bp, Homo sapiens
gatgccaaagcag

SEQ ID NO: 5002979 - DNA, 16 bp, Homo sapiens
gatgccaaagcagaca

SEQ ID NO: 5002980 - DNA, 20 bp, Homo sapiens
gatgctttaggttgcttcag

SEQ ID NO: 5002981 - DNA, 15 bp, Homo sapiens
gatggcactgtccag

SEQ ID NO: 5002982 - DNA, 18 bp, Homo sapiens
gatggcactgtccagggc

SEQ ID NO: 5002983 - DNA, 21 bp, Homo sapiens
gatggcactgtccagggccca

SEQ ID NO: 5002984 - DNA, 15 bp, Homo sapiens
gatgtcccacaggga

SEQ ID NO: 5002985 - DNA, 15 bp, Homo sapiens
gatgtggcaggggca

SEQ ID NO: 5002986 - DNA, 22 bp, Homo sapiens
gcaaaaggcctgtgatccagga

SEQ ID NO: 5002987 - DNA, 14 bp, Homo sapiens
gcaaacactgtgta

SEQ ID NO: 5002988 - DNA, 15 bp, Homo sapiens
gcaaagctgctgggc

SEQ ID NO: 5002989 - DNA, 16 bp, Homo sapiens
gcaaagctgctgggcc

SEQ ID NO: 5002990 - DNA, 19 bp, Homo sapiens
gcaaagctgctgggccagt

SEQ ID NO: 5002991 - DNA, 16 bp, Homo sapiens
gcaagatcgctgtgct

SEQ ID NO: 5002992 - DNA, 17 bp, Homo sapiens
gcaagatcgctgtgcta

SEQ ID NO: 5002993 - DNA, 20 bp, Homo sapiens
gcaatcactgggcccagagg

SEQ ID NO: 5002994 - DNA, 16 bp, Homo sapiens
gcacaggtgtaaatat

SEQ ID NO: 5002995 - DNA, 15 bp, Homo sapiens
gcacagtgcctgatg

SEQ ID NO: 5002996 - DNA, 20 bp, Homo sapiens
gcacagtgcctgatgggagt

SEQ ID NO: 5002997 - DNA, 14 bp, Homo sapiens
gcacatcactgaga

SEQ ID NO: 5002998 - DNA, 19 bp, Homo sapiens
gcacccccctgtgcctgct

SEQ ID NO: 5002999 - DNA, 20 bp, Homo sapiens
gcaccctcatacacagaaac

SEQ ID NO: 5003000 - DNA, 12 bp, Homo sapiens
gcactgggcact

SEQ ID NO: 5003001 - DNA, 19 bp, Homo sapiens
gcactgggcactagctaga

SEQ ID NO: 5003002 - DNA, 17 bp, Homo sapiens
gcactgtggaactgcca

SEQ ID NO: 5003003 - DNA, 20 bp, Homo sapiens
gcagaaagatggagaggcat

SEQ ID NO: 5003004 - DNA, 15 bp, Homo sapiens
gcagagtggagccca

SEQ ID NO: 5003005 - DNA, 23 bp, Homo sapiens
gcagatagaatttggcccagaga

SEQ ID NO: 5003006 - DNA, 17 bp, Homo sapiens
gcaggaggcacagcagt

SEQ ID NO: 5003007 - DNA, 23 bp, Homo sapiens
gcagtcacaggcccaggaaggcg

SEQ ID NO: 5003008 - DNA, 22 bp, Homo sapiens
gcagttcagagctgccctctcc

SEQ ID NO: 5003009 - DNA, 23 bp, Homo sapiens
gcagttcagagctgccctctcct

SEQ ID NO: 5003010 - DNA, 13 bp, Homo sapiens
gcatgaaggtttc

SEQ ID NO: 5003011 - DNA, 13 bp, Homo sapiens
gcatggaggaaaa

SEQ ID NO: 5003012 - DNA, 16 bp, Homo sapiens
tattttccatgaaaat

SEQ ID NO: 5003013 - DNA, 13 bp, Homo sapiens
tattttgtaataa

SEQ ID NO: 5003014 - DNA, 14 bp, Homo sapiens
tattttgtaataaa

SEQ ID NO: 5003015 - DNA, 16 bp, Homo sapiens
tattttgtaataaact

SEQ ID NO: 5003016 - DNA, 21 bp, Homo sapiens
tattttgtaataaactctcta

SEQ ID NO: 5003017 - DNA, 21 bp, Homo sapiens
tattttgttttgtgcagagat

SEQ ID NO: 5003018 - DNA, 13 bp, Homo sapiens
tatttttatttgt

SEQ ID NO: 5003019 - DNA, 15 bp, Homo sapiens
tcaaatgctaaatgc

SEQ ID NO: 5003020 - DNA, 21 bp, Homo sapiens
tcaacagcaggaggcacagca

SEQ ID NO: 5003021 - DNA, 13 bp, Homo sapiens
tcaactctgtgag

SEQ ID NO: 5003022 - DNA, 14 bp, Homo sapiens
tcaaggaaggatgc

SEQ ID NO: 5003023 - DNA, 17 bp, Homo sapiens
tcaatattttccatgaa

SEQ ID NO: 5003024 - DNA, 17 bp, Homo sapiens
tcaatggtttgcaagga

SEQ ID NO: 5003025 - DNA, 13 bp, Homo sapiens
tcaatttccaaga

SEQ ID NO: 5003026 - DNA, 12 bp, Homo sapiens
tcacaaaatgca

SEQ ID NO: 5003027 - DNA, 17 bp, Homo sapiens
tcacacccacctgctgc

SEQ ID NO: 5003028 - DNA, 20 bp, Homo sapiens
tcacacccacctgctgctgt

SEQ ID NO: 5003029 - DNA, 21 bp, Homo sapiens
tcacacccacctgctgctgta

SEQ ID NO: 5003030 - DNA, 16 bp, Homo sapiens
tcacagcagtcacagg

SEQ ID NO: 5003031 - DNA, 17 bp, Homo sapiens
tcacagcagtcacaggc

SEQ ID NO: 5003032 - DNA, 18 bp, Homo sapiens
tcacagcagtcacaggcc

SEQ ID NO: 5003033 - DNA, 14 bp, Homo sapiens
tcacaggcccagga

SEQ ID NO: 5003034 - DNA, 13 bp, Homo sapiens
tcacatcctcaga

SEQ ID NO: 5003035 - DNA, 17 bp, Homo sapiens
tcacatcctcagaaagt

SEQ ID NO: 5003036 - DNA, 20 bp, Homo sapiens
tcaccagctgccaaaatcgt

SEQ ID NO: 5003037 - DNA, 17 bp, Homo sapiens
tcactgagaagatggca

SEQ ID NO: 5003038 - DNA, 23 bp, Homo sapiens
tcactgagaagatggcactgtcc

SEQ ID NO: 5003039 - DNA, 13 bp, Homo sapiens
tcactgggcccag

SEQ ID NO: 5003040 - DNA, 14 bp, Homo sapiens
tcactgggcccaga

SEQ ID NO: 5003041 - DNA, 17 bp, Homo sapiens
tcactgggcccagagga

SEQ ID NO: 5003042 - DNA, 19 bp, Homo sapiens
tcactgggcccagaggaga

SEQ ID NO: 5003043 - DNA, 22 bp, Homo sapiens
tcactgggcccagaggagagga

SEQ ID NO: 5003044 - DNA, 17 bp, Homo sapiens
tcactgtcagtcccact

SEQ ID NO: 5003045 - DNA, 16 bp, Homo sapiens
tcacttgaactcggga

SEQ ID NO: 5003046 - DNA, 23 bp, Homo sapiens
tcactttccttttcttgtctctg

SEQ ID NO: 5003047 - DNA, 23 bp, Homo sapiens
tcagaaagtgcagcatggaggaa

SEQ ID NO: 5003048 - DNA, 13 bp, Homo sapiens
tcagagctgccct

SEQ ID NO: 5003049 - DNA, 22 bp, Homo sapiens
tcagagctgccctctcctgggc

SEQ ID NO: 5003050 - DNA, 12 bp, Homo sapiens
cagtcctgctgc

SEQ ID NO: 5003051 - DNA, 14 bp, Homo sapiens
cagtcctgctgcct

SEQ ID NO: 5003052 - DNA, 19 bp, Homo sapiens
cagtcctgctgcctggagt

SEQ ID NO: 5003053 - DNA, 11 bp, Homo sapiens
cagtcctggaa

SEQ ID NO: 5003054 - DNA, 14 bp, Homo sapiens
cagtgaaagcatca

SEQ ID NO: 5003055 - DNA, 22 bp, Homo sapiens
cagtgcctgatgggagtaggct

SEQ ID NO: 5003056 - DNA, 17 bp, Homo sapiens
cagtggcctggatgcac

SEQ ID NO: 5003057 - DNA, 15 bp, Homo sapiens
cagttcagagctgcc

SEQ ID NO: 5003058 - DNA, 16 bp, Homo sapiens
cagttcagagctgccc

SEQ ID NO: 5003059 - DNA, 21 bp, Homo sapiens
cagttcagagctgccctctcc

SEQ ID NO: 5003060 - DNA, 9 bp, Homo sapiens
cataaaata

SEQ ID NO: 5003061 - DNA, 12 bp, Homo sapiens
cataaaatatac

SEQ ID NO: 5003062 - DNA, 15 bp, Homo sapiens
catatctgtgtgccc

SEQ ID NO: 5003063 - DNA, 16 bp, Homo sapiens
catatctgtgtgccct

SEQ ID NO: 5003064 - DNA, 17 bp, Homo sapiens
catatctgtgtgcccta

SEQ ID NO: 5003065 - DNA, 19 bp, Homo sapiens
catatctgtgtgccctagg

SEQ ID NO: 5003066 - DNA, 17 bp, Homo sapiens
catcatgtgcctggaaa

SEQ ID NO: 5003067 - DNA, 23 bp, Homo sapiens
catccaccccagccccactgccc

SEQ ID NO: 5003068 - DNA, 19 bp, Homo sapiens
catccatgttccgagaaga

SEQ ID NO: 5003069 - DNA, 22 bp, Homo sapiens
catccctccctccacctccctg

SEQ ID NO: 5003070 - DNA, 19 bp, Homo sapiens
catccctggctgacctgct

SEQ ID NO: 5003071 - DNA, 14 bp, Homo sapiens
catcctcagaaagt

SEQ ID NO: 5003072 - DNA, 14 bp, Homo sapiens
catctgccaatgcc

SEQ ID NO: 5003073 - DNA, 15 bp, Homo sapiens
catcttccccagccc

SEQ ID NO: 5003074 - DNA, 20 bp, Homo sapiens
catcttccccagccctcccc

SEQ ID NO: 5003075 - DNA, 13 bp, Homo sapiens
catgaaaatgcaa

SEQ ID NO: 5003076 - DNA, 18 bp, Homo sapiens
catgaaggtttctgaaaa

SEQ ID NO: 5003077 - DNA, 18 bp, Homo sapiens
catgactctgcctaacca

SEQ ID NO: 5003078 - DNA, 23 bp, Homo sapiens
catgactctgcctaaccatgggc

SEQ ID NO: 5003079 - DNA, 12 bp, Homo sapiens
catgactgctca

SEQ ID NO: 5003080 - DNA, 13 bp, Homo sapiens
catgactgctcag

SEQ ID NO: 5003081 - DNA, 14 bp, Homo sapiens
catgactgctcagg

SEQ ID NO: 5003082 - DNA, 15 bp, Homo sapiens
catgactgctcaggc

SEQ ID NO: 5003083 - DNA, 20 bp, Homo sapiens
catgcaccctcatacacaga

SEQ ID NO: 5003084 - DNA, 13 bp, Homo sapiens
catgcccaccatc

SEQ ID NO: 5003085 - DNA, 19 bp, Homo sapiens
catgctgaaggctgaaaga

SEQ ID NO: 5003086 - DNA, 14 bp, Homo sapiens
catggagctcaggt

SEQ ID NO: 5003087 - DNA, 13 bp, Homo sapiens
catgtagctggca

SEQ ID NO: 5003088 - DNA, 20 bp, Homo sapiens
catgtagctggcaagctgca

SEQ ID NO: 5003089 - DNA, 18 bp, Homo sapiens
catgtataatatttttaa

SEQ ID NO: 5003090 - DNA, 14 bp, Homo sapiens
catgtgcctggaaa

SEQ ID NO: 5003091 - DNA, 12 bp, Homo sapiens
catgttttgtat

SEQ ID NO: 5003092 - DNA, 19 bp, Homo sapiens
cattctcttgaaggtgctg

SEQ ID NO: 5003093 - DNA, 23 bp, Homo sapiens
cattgcctgatttgttccttctg

SEQ ID NO: 5003094 - DNA, 21 bp, Homo sapiens
cattttcctcacacccacctg

SEQ ID NO: 5003095 - DNA, 13 bp, Homo sapiens
ccaaagcagacat

SEQ ID NO: 5003096 - DNA, 17 bp, Homo sapiens
ccaaagcagacattttc

SEQ ID NO: 5003097 - DNA, 18 bp, Homo sapiens
ccaaataaatgtgtaaat

SEQ ID NO: 5003098 - DNA, 20 bp, Homo sapiens
ccaaataaatgtgtaaatgt

SEQ ID NO: 5003099 - DNA, 22 bp, Homo sapiens
ccaaataaatgtgtaaatgtgg

SEQ ID NO: 5003100 - DNA, 14 bp, Homo sapiens
ccaaatataaactt

SEQ ID NO: 5003101 - DNA, 21 bp, Homo sapiens
ccaagtattttatctgtgttg

SEQ ID NO: 5003102 - DNA, 15 bp, Homo sapiens
ccaatacctcttgga

SEQ ID NO: 5003103 - DNA, 21 bp, Homo sapiens
ccaatgccatgactgctcagg

SEQ ID NO: 5003104 - DNA, 15 bp, Homo sapiens
ccaattccacttcct

SEQ ID NO: 5003105 - DNA, 15 bp, Homo sapiens
ccacacatctgtgga

SEQ ID NO: 5003106 - DNA, 11 bp, Homo sapiens
ccacagggacc

SEQ ID NO: 5003107 - DNA, 16 bp, Homo sapiens
ccacagggaccacatc

SEQ ID NO: 5003108 - DNA, 15 bp, Homo sapiens
ccacatccaccccag

SEQ ID NO: 5003109 - DNA, 20 bp, Homo sapiens
ccaccccagccccactgccc

SEQ ID NO: 5003110 - DNA, 17 bp, Homo sapiens
ccaccccatccctggct

SEQ ID NO: 5003111 - DNA, 14 bp, Homo sapiens
ccacctccctgcaa

SEQ ID NO: 5003112 - DNA, 15 bp, Homo sapiens
ccacctccctgcaat

SEQ ID NO: 5003113 - DNA, 15 bp, Homo sapiens
ccacctgctgctgta

SEQ ID NO: 5003114 - DNA, 17 bp, Homo sapiens
ccacctgctgctgtatg

SEQ ID NO: 5003115 - DNA, 21 bp, Homo sapiens
ccacctgttgtcctgaactgt

SEQ ID NO: 5003116 - DNA, 14 bp, Homo sapiens
ccaccttgggtctg

SEQ ID NO: 5003117 - DNA, 22 bp, Homo sapiens
ccactgcacccccctgtgcctg

SEQ ID NO: 5003118 - DNA, 23 bp, Homo sapiens
ccactgcacccccctgtgcctgc

SEQ ID NO: 5003119 - DNA, 15 bp, Homo sapiens
ccactgccctccagg

SEQ ID NO: 5003120 - DNA, 16 bp, Homo sapiens
ccactgccctccaggg

SEQ ID NO: 5003121 - DNA, 19 bp, Homo sapiens
ccactgccctccagggcca

SEQ ID NO: 5003122 - DNA, 14 bp, Homo sapiens
ccactgtcagccct

SEQ ID NO: 5003123 - DNA, 15 bp, Homo sapiens
ccacttgcctgtcac

SEQ ID NO: 5003124 - DNA, 19 bp, Homo sapiens
ccacttgcctgtcacccca

SEQ ID NO: 5003125 - DNA, 20 bp, Homo sapiens
ccactttcttctaccagacc

SEQ ID NO: 5003126 - DNA, 17 bp, Homo sapiens
ccagaggagaggagaca

SEQ ID NO: 5003127 - DNA, 19 bp, Homo sapiens
ccagaggagaggagacaga

SEQ ID NO: 5003128 - DNA, 20 bp, Homo sapiens
ccagaggagaggagacagac

SEQ ID NO: 5003129 - DNA, 12 bp, Homo sapiens
ccagagggcagt

SEQ ID NO: 5003130 - DNA, 13 bp, Homo sapiens
ccagagggcagtc

SEQ ID NO: 5003131 - DNA, 18 bp, Homo sapiens
ccagagttgttctcaggg

SEQ ID NO: 5003132 - DNA, 18 bp, Homo sapiens
ccagatgcacatccctgg

SEQ ID NO: 5003133 - DNA, 20 bp, Homo sapiens
ccagcagttcagagctgccc

SEQ ID NO: 5003134 - DNA, 21 bp, Homo sapiens
ccagccatcatgtgcctggaa

SEQ ID NO: 5003135 - DNA, 13 bp, Homo sapiens
ccagccccactgc

SEQ ID NO: 5003136 - DNA, 14 bp, Homo sapiens
ccagccccactgcc

SEQ ID NO: 5003137 - DNA, 15 bp, Homo sapiens
ccagccccactgccc

SEQ ID NO: 5003138 - DNA, 17 bp, Homo sapiens
ccagccccactgccctc

SEQ ID NO: 5003139 - DNA, 19 bp, Homo sapiens
ccagccctccccacctgct

SEQ ID NO: 5003140 - DNA, 22 bp, Homo sapiens
ccaggaaagatgtcccacaggg

SEQ ID NO: 5003141 - DNA, 23 bp, Homo sapiens
ccaggaaagatgtcccacaggga

SEQ ID NO: 5003142 - DNA, 20 bp, Homo sapiens
ccaggaaggcggcaggcaga

SEQ ID NO: 5003143 - DNA, 14 bp, Homo sapiens
ccaggattcaggcc

SEQ ID NO: 5003144 - DNA, 13 bp, Homo sapiens
ccaggcctgggtc

SEQ ID NO: 5003145 - DNA, 22 bp, Homo sapiens
ccaggctgccaggcaccatctg

SEQ ID NO: 5003146 - DNA, 12 bp, Homo sapiens
ccagggccagga

SEQ ID NO: 5003147 - DNA, 18 bp, Homo sapiens
ccagggcccatgtagctg

SEQ ID NO: 5003148 - DNA, 16 bp, Homo sapiens
ccagggctacacagac

SEQ ID NO: 5003149 - DNA, 23 bp, Homo sapiens
ccagggctacacagaccctgccc

SEQ ID NO: 5003150 - DNA, 18 bp, Homo sapiens
ccagggtgctgggatggc

SEQ ID NO: 5003151 - DNA, 14 bp, Homo sapiens
ccaggtcctcacag

SEQ ID NO: 5003152 - DNA, 16 bp, Homo sapiens
ccaggtcctcacagca

SEQ ID NO: 5003153 - DNA, 20 bp, Homo sapiens
ccaggtctagaaggccaggc

SEQ ID NO: 5003154 - DNA, 15 bp, Homo sapiens
ccagtcacctaagca

SEQ ID NO: 5003155 - DNA, 13 bp, Homo sapiens
ccagtcctgctgc

SEQ ID NO: 5003156 - DNA, 14 bp, Homo sapiens
ccagtcctgctgcc

SEQ ID NO: 5003157 - DNA, 17 bp, Homo sapiens
ccagtcctgctgcctgg

SEQ ID NO: 5003158 - DNA, 21 bp, Homo sapiens
ccagttcctttcaatggtttg

SEQ ID NO: 5003159 - DNA, 23 bp, Homo sapiens
ccagttcctttcaatggtttgca

SEQ ID NO: 5003160 - DNA, 11 bp, Homo sapiens
ccatatctgtg

SEQ ID NO: 5003161 - DNA, 18 bp, Homo sapiens
ccatatctgtgtgcccta

SEQ ID NO: 5003162 - DNA, 21 bp, Homo sapiens
ccatatctgtgtgccctaggg

SEQ ID NO: 5003163 - DNA, 17 bp, Homo sapiens
ccatcatgtgcctggaa

SEQ ID NO: 5003164 - DNA, 14 bp, Homo sapiens
ccatccctggctga

SEQ ID NO: 5003165 - DNA, 19 bp, Homo sapiens
ccatccctggctgacctgc

SEQ ID NO: 5003166 - DNA, 21 bp, Homo sapiens
ccatccctggctgacctgctg

SEQ ID NO: 5003167 - DNA, 16 bp, Homo sapiens
ccatctttgaggtgag

SEQ ID NO: 5003168 - DNA, 15 bp, Homo sapiens
ccatgactctgccta

SEQ ID NO: 5003169 - DNA, 17 bp, Homo sapiens
cctgggcagctgcctcc

SEQ ID NO: 5003170 - DNA, 18 bp, Homo sapiens
cctgggcagctgcctccc

SEQ ID NO: 5003171 - DNA, 18 bp, Homo sapiens
cctgggctccctggagga

SEQ ID NO: 5003172 - DNA, 18 bp, Homo sapiens
cctgggggtaaagccctc

SEQ ID NO: 5003173 - DNA, 11 bp, Homo sapiens
cctgggtcacg

SEQ ID NO: 5003174 - DNA, 19 bp, Homo sapiens
cctgggtcacgctcaagga

SEQ ID NO: 5003175 - DNA, 23 bp, Homo sapiens
cctgggtcacgctcaaggaagga

SEQ ID NO: 5003176 - DNA, 16 bp, Homo sapiens
cctgtcaccccagtca

SEQ ID NO: 5003177 - DNA, 17 bp, Homo sapiens
cctgtgatccaggaaag

SEQ ID NO: 5003178 - DNA, 16 bp, Homo sapiens
cctgtgcctgctgggc

SEQ ID NO: 5003179 - DNA, 17 bp, Homo sapiens
ccttaattcactcccac

SEQ ID NO: 5003180 - DNA, 14 bp, Homo sapiens
ccttcaactctgtg

SEQ ID NO: 5003181 - DNA, 16 bp, Homo sapiens
ccttcaactctgtgag

SEQ ID NO: 5003182 - DNA, 17 bp, Homo sapiens
ccttcaactctgtgagg

SEQ ID NO: 5003183 - DNA, 18 bp, Homo sapiens
ccttgctcaccaagctgt

SEQ ID NO: 5003184 - DNA, 12 bp, Homo sapiens
aactctgtgagg

SEQ ID NO: 5003185 - DNA, 19 bp, Homo sapiens
aactgcaggaatgctgaca

SEQ ID NO: 5003186 - DNA, 12 bp, Homo sapiens
aactgccacctt

SEQ ID NO: 5003187 - DNA, 18 bp, Homo sapiens
aacttcctttgagaattg

SEQ ID NO: 5003188 - DNA, 17 bp, Homo sapiens
aagaaggaaaaggcagg

SEQ ID NO: 5003189 - DNA, 23 bp, Homo sapiens
aagaaggcacaggtgtaaatata

SEQ ID NO: 5003190 - DNA, 16 bp, Homo sapiens
aagactctccactgac

SEQ ID NO: 5003191 - DNA, 22 bp, Homo sapiens
aagatcgctgtgctaggtctga

SEQ ID NO: 5003192 - DNA, 17 bp, Homo sapiens
aagatggcactgtccag

SEQ ID NO: 5003193 - DNA, 18 bp, Homo sapiens
aagatggcactgtccagg

SEQ ID NO: 5003194 - DNA, 21 bp, Homo sapiens
aagatggcactgtccagggcc

SEQ ID NO: 5003195 - DNA, 15 bp, Homo sapiens
aagatgtcccacagg

SEQ ID NO: 5003196 - DNA, 18 bp, Homo sapiens
aagatgtcccacagggac

SEQ ID NO: 5003197 - DNA, 19 bp, Homo sapiens
aagatgtcccacagggacc

SEQ ID NO: 5003198 - DNA, 14 bp, Homo sapiens
aagattcctgtcct

SEQ ID NO: 5003199 - DNA, 18 bp, Homo sapiens
aagcaatcactgggccca

SEQ ID NO: 5003200 - DNA, 22 bp, Homo sapiens
tctgcctaaccatgggctcagg

SEQ ID NO: 5003201 - DNA, 23 bp, Homo sapiens
tctgcctccaggttgcctcaaca

SEQ ID NO: 5003202 - DNA, 22 bp, Homo sapiens
tctgctcctgaaccagtcctgc

SEQ ID NO: 5003203 - DNA, 11 bp, Homo sapiens
tctgcttgcca

SEQ ID NO: 5003204 - DNA, 16 bp, Homo sapiens
tctgcttgccatccct

SEQ ID NO: 5003205 - DNA, 15 bp, Homo sapiens
tctggacaagaagag

SEQ ID NO: 5003206 - DNA, 12 bp, Homo sapiens
tctgtggagatg

SEQ ID NO: 5003207 - DNA, 15 bp, Homo sapiens
tctgtgtgccctagg

SEQ ID NO: 5003208 - DNA, 17 bp, Homo sapiens
tcttaaacaaatgtatg

SEQ ID NO: 5003209 - DNA, 19 bp, Homo sapiens
tcttacacaagagctggag

SEQ ID NO: 5003210 - DNA, 14 bp, Homo sapiens
tcttattttgtaat

SEQ ID NO: 5003211 - DNA, 16 bp, Homo sapiens
tcttattttgtaataa

SEQ ID NO: 5003212 - DNA, 23 bp, Homo sapiens
tcttccccagccctccccacctg

SEQ ID NO: 5003213 - DNA, 22 bp, Homo sapiens
tcttcctaccaaatataaactt

SEQ ID NO: 5003214 - DNA, 12 bp, Homo sapiens
tcttctaccaga

SEQ ID NO: 5003215 - DNA, 13 bp, Homo sapiens
tcttctgttctca

SEQ ID NO: 5003216 - DNA, 19 bp, Homo sapiens
tcttgaaggtgctgccacc

SEQ ID NO: 5003217 - DNA, 22 bp, Homo sapiens
tcttgaaggtgctgccacccct

SEQ ID NO: 5003218 - DNA, 18 bp, Homo sapiens
tcttggccgactcaggga

SEQ ID NO: 5003219 - DNA, 13 bp, Homo sapiens
tcttgtctctgag

SEQ ID NO: 5003220 - DNA, 15 bp, Homo sapiens
tcttgtctctgaggc

SEQ ID NO: 5003221 - DNA, 17 bp, Homo sapiens
tctttcttattttgtaa

SEQ ID NO: 5003222 - DNA, 20 bp, Homo sapiens
tctttcttattttgtaataa

SEQ ID NO: 5003223 - DNA, 22 bp, Homo sapiens
tctttcttattttgtaataaac

SEQ ID NO: 5003224 - DNA, 23 bp, Homo sapiens
tctttcttattttgtaataaact

SEQ ID NO: 5003225 - DNA, 20 bp, Homo sapiens
tctttggccccttgctggag

SEQ ID NO: 5003226 - DNA, 21 bp, Homo sapiens
tgaaataccaacctgaagaca

SEQ ID NO: 5003227 - DNA, 18 bp, Homo sapiens
tgaaccagtcctgctgcc

SEQ ID NO: 5003228 - DNA, 20 bp, Homo sapiens
tgaaccagtcctgctgcctg

SEQ ID NO: 5003229 - DNA, 11 bp, Homo sapiens
tgaagaagaga

SEQ ID NO: 5003230 - DNA, 16 bp, Homo sapiens
tgaaggtttctgaaaa

SEQ ID NO: 5003231 - DNA, 22 bp, Homo sapiens
tgaaggtttgatgccaaagcag

SEQ ID NO: 5003232 - DNA, 14 bp, Homo sapiens
tgaatataaacact

SEQ ID NO: 5003233 - DNA, 16 bp, Homo sapiens
tgaatataaacactat

SEQ ID NO: 5003234 - DNA, 23 bp, Homo sapiens
tgaatttcattctcttgaaggtg

SEQ ID NO: 5003235 - DNA, 21 bp, Homo sapiens
tgacaatgctgccatgcccac

SEQ ID NO: 5003236 - DNA, 13 bp, Homo sapiens
tgacagaacactg

SEQ ID NO: 5003237 - DNA, 21 bp, Homo sapiens
tgacagaacactgtcttgaag

SEQ ID NO: 5003238 - DNA, 13 bp, Homo sapiens
tgacctgctgtgg

SEQ ID NO: 5003239 - DNA, 22 bp, Homo sapiens
tgacctgctgtggatgtcccta

SEQ ID NO: 5003240 - DNA, 16 bp, Homo sapiens
tgacctggttgtccag

SEQ ID NO: 5003241 - DNA, 17 bp, Homo sapiens
tgacctggttgtccagg

SEQ ID NO: 5003242 - DNA, 17 bp, Homo sapiens
tgacttgacagaacact

SEQ ID NO: 5003243 - DNA, 19 bp, Homo sapiens
tgacttgacagaacactgt

SEQ ID NO: 5003244 - DNA, 13 bp, Homo sapiens
tgagaagatggca

SEQ ID NO: 5003245 - DNA, 19 bp, Homo sapiens
tgagaagatggcactgtcc

SEQ ID NO: 5003246 - DNA, 20 bp, Homo sapiens
tgagaagatggcactgtcca

SEQ ID NO: 5003247 - DNA, 23 bp, Homo sapiens
tgagaagatggcactgtccaggg

SEQ ID NO: 5003248 - DNA, 15 bp, Homo sapiens
tgagagagtgctgag

SEQ ID NO: 5003249 - DNA, 20 bp, Homo sapiens
tgagctggagctaaggccag

SEQ ID NO: 5003250 - DNA, 23 bp, Homo sapiens
tgaggagcccacggggcaaagct

SEQ ID NO: 5003251 - DNA, 17 bp, Homo sapiens
tgaggataccccaaagt

SEQ ID NO: 5003252 - DNA, 22 bp, Homo sapiens
tgaggataccccaaagtccagg

SEQ ID NO: 5003253 - DNA, 14 bp, Homo sapiens
tgagtcctgatcct

SEQ ID NO: 5003254 - DNA, 21 bp, Homo sapiens
tgataatatatacaaaccttt

SEQ ID NO: 5003255 - DNA, 18 bp, Homo sapiens
tgatcctaaccctgggct

SEQ ID NO: 5003256 - DNA, 19 bp, Homo sapiens
tgatccttcaactctgtga

SEQ ID NO: 5003257 - DNA, 20 bp, Homo sapiens
tgatccttcaactctgtgag

SEQ ID NO: 5003258 - DNA, 13 bp, Homo sapiens
tgatgccaaagca

SEQ ID NO: 5003259 - DNA, 14 bp, Homo sapiens
tgatgccaaagcag

SEQ ID NO: 5003260 - DNA, 19 bp, Homo sapiens
tgcaaacactgtgtattta

SEQ ID NO: 5003261 - DNA, 16 bp, Homo sapiens
tgcacagtgcctgatg

SEQ ID NO: 5003262 - DNA, 21 bp, Homo sapiens
tgcacagtgcctgatgggagt

SEQ ID NO: 5003263 - DNA, 12 bp, Homo sapiens
tgcacatccctg

SEQ ID NO: 5003264 - DNA, 16 bp, Homo sapiens
tgcacccccctgtgcc

SEQ ID NO: 5003265 - DNA, 21 bp, Homo sapiens
tgcacccccctgtgcctgctg

SEQ ID NO: 5003266 - DNA, 22 bp, Homo sapiens
tgcacccccctgtgcctgctgg

SEQ ID NO: 5003267 - DNA, 19 bp, Homo sapiens
tgcatagagccacgtatgt

SEQ ID NO: 5003268 - DNA, 15 bp, Homo sapiens
tgccaaagcagacat

SEQ ID NO: 5003269 - DNA, 17 bp, Homo sapiens
tgccaaagcagacattt

SEQ ID NO: 5003270 - DNA, 18 bp, Homo sapiens
tgccaccccttggcactg

SEQ ID NO: 5003271 - DNA, 22 bp, Homo sapiens
tgccaccttgggtctgtgtcac

SEQ ID NO: 5003272 - DNA, 14 bp, Homo sapiens
tgccagatcctctt

SEQ ID NO: 5003273 - DNA, 11 bp, Homo sapiens
tgccatccctc

SEQ ID NO: 5003274 - DNA, 21 bp, Homo sapiens
tgccatccctccctccacctc

SEQ ID NO: 5003275 - DNA, 22 bp, Homo sapiens
tgccatccctccctccacctcc

SEQ ID NO: 5003276 - DNA, 15 bp, Homo sapiens
tgccatgactgctca

SEQ ID NO: 5003277 - DNA, 17 bp, Homo sapiens
tgccatgactgctcagg

SEQ ID NO: 5003278 - DNA, 18 bp, Homo sapiens
tgccatggacagaagaag

SEQ ID NO: 5003279 - DNA, 20 bp, Homo sapiens
tgccatggacagaagaaggc

SEQ ID NO: 5003280 - DNA, 23 bp, Homo sapiens
tgccatggacagaagaaggcagc

SEQ ID NO: 5003281 - DNA, 14 bp, Homo sapiens
tgcccaggatttga

SEQ ID NO: 5003282 - DNA, 14 bp, Homo sapiens
tgccctagggctca

SEQ ID NO: 5003283 - DNA, 18 bp, Homo sapiens
tgccctagggctcagagg

SEQ ID NO: 5003284 - DNA, 16 bp, Homo sapiens
tgccctctcctgggca

SEQ ID NO: 5003285 - DNA, 22 bp, Homo sapiens
tgcctaaccatgggctcagggc

SEQ ID NO: 5003286 - DNA, 21 bp, Homo sapiens
tgcctcaacagcaggaggcac

SEQ ID NO: 5003287 - DNA, 24 bp, Homo sapiens
tgcctcaacagcaggaggcacagc

SEQ ID NO: 5003288 - DNA, 12 bp, Homo sapiens
tgcctccaggtt

SEQ ID NO: 5003289 - DNA, 15 bp, Homo sapiens
tgcctcccctcctct

SEQ ID NO: 5003290 - DNA, 18 bp, Homo sapiens
tgcctgatgggagtaggc

SEQ ID NO: 5003291 - DNA, 21 bp, Homo sapiens
tgcctgatgggagtaggctcc

SEQ ID NO: 5003292 - DNA, 15 bp, Homo sapiens
tgcctgctgggcact

SEQ ID NO: 5003293 - DNA, 19 bp, Homo sapiens
tgcctgctgggcactgggc

SEQ ID NO: 5003294 - DNA, 18 bp, Homo sapiens
tgcctggagtcagtagcc

SEQ ID NO: 5003295 - DNA, 20 bp, Homo sapiens
tgcctggagtcagtagccag

SEQ ID NO: 5003296 - DNA, 15 bp, Homo sapiens
tgccttatctcttct

SEQ ID NO: 5003297 - DNA, 20 bp, Homo sapiens
tgctaactagcttggaaact

SEQ ID NO: 5003298 - DNA, 15 bp, Homo sapiens
tgctaccttctttgg

SEQ ID NO: 5003299 - DNA, 16 bp, Homo sapiens
tgctcaggcctcacct

SEQ ID NO: 5003300 - DNA, 20 bp, Homo sapiens
tgctcaggcctcacctccca

SEQ ID NO: 5003301 - DNA, 22 bp, Homo sapiens
tgctcaggcctcacctcccagg

SEQ ID NO: 5003302 - DNA, 15 bp, Homo sapiens
tgctgacaatgctgc

SEQ ID NO: 5003303 - DNA, 12 bp, Homo sapiens
tgctgccacccc

SEQ ID NO: 5003304 - DNA, 21 bp, Homo sapiens
tgctgcctggagtcagtagcc

SEQ ID NO: 5003305 - DNA, 17 bp, Homo sapiens
tgctggagtcatgtgcc

SEQ ID NO: 5003306 - DNA, 13 bp, Homo sapiens
tgctgggatggct

SEQ ID NO: 5003307 - DNA, 18 bp, Homo sapiens
tgctgggcactgggcact

SEQ ID NO: 5003308 - DNA, 13 bp, Homo sapiens
tgctggggcagag

SEQ ID NO: 5003309 - DNA, 15 bp, Homo sapiens
tgctggggcagagtg

SEQ ID NO: 5003310 - DNA, 17 bp, Homo sapiens
tgctgtggatgtcccta

SEQ ID NO: 5003311 - DNA, 23 bp, Homo sapiens
tgctttaggttgcttcagctgat

SEQ ID NO: 5003312 - DNA, 15 bp, Homo sapiens
tggaaatacacagtg

SEQ ID NO: 5003313 - DNA, 17 bp, Homo sapiens
tggaaattggaagagca

SEQ ID NO: 5003314 - DNA, 16 bp, Homo sapiens
tggacaagaagagtcc

SEQ ID NO: 5003315 - DNA, 13 bp, Homo sapiens
tggagcccagggt

SEQ ID NO: 5003316 - DNA, 22 bp, Homo sapiens
tggagctaaggccagctagagc

SEQ ID NO: 5003317 - DNA, 20 bp, Homo sapiens
tggaggagctcaggacacta

SEQ ID NO: 5003318 - DNA, 21 bp, Homo sapiens
tggaggttgcagtgagctgag

SEQ ID NO: 5003319 - DNA, 12 bp, Homo sapiens
tggagtgtcacc

SEQ ID NO: 5003320 - DNA, 21 bp, Homo sapiens
tggatgtccctattctgccat

SEQ ID NO: 5003321 - DNA, 14 bp, Homo sapiens
tggcaacctgttct

SEQ ID NO: 5003322 - DNA, 18 bp, Homo sapiens
tggcacagcccaaagaag

SEQ ID NO: 5003323 - DNA, 13 bp, Homo sapiens
tggcactgtccag

SEQ ID NO: 5003324 - DNA, 15 bp, Homo sapiens
tggcactgtccaggg

SEQ ID NO: 5003325 - DNA, 20 bp, Homo sapiens
acgggctcagcagccagagg

SEQ ID NO: 5003326 - DNA, 18 bp, Homo sapiens
acgtgctcttctgttctc

SEQ ID NO: 5003327 - DNA, 19 bp, Homo sapiens
actaatccaatacctcttg

SEQ ID NO: 5003328 - DNA, 22 bp, Homo sapiens
actcaatattttccatgaaaat

SEQ ID NO: 5003329 - DNA, 23 bp, Homo sapiens
actcaatattttccatgaaaatg

SEQ ID NO: 5003330 - DNA, 19 bp, Homo sapiens
actcacatggctatgtttt

SEQ ID NO: 5003331 - DNA, 12 bp, Homo sapiens
actcagggacct

SEQ ID NO: 5003332 - DNA, 13 bp, Homo sapiens
actctaagcagaa

SEQ ID NO: 5003333 - DNA, 16 bp, Homo sapiens
actctagaagctcagg

SEQ ID NO: 5003334 - DNA, 17 bp, Homo sapiens
actctagaagctcaggt

SEQ ID NO: 5003335 - DNA, 17 bp, Homo sapiens
actctccactgacctgg

SEQ ID NO: 5003336 - DNA, 22 bp, Homo sapiens
actctgtgtgggaaaatggcag

SEQ ID NO: 5003337 - DNA, 19 bp, Homo sapiens
actgacctggttgtccagg

SEQ ID NO: 5003338 - DNA, 18 bp, Homo sapiens
actgagaagatggcactg

SEQ ID NO: 5003339 - DNA, 18 bp, Homo sapiens
actgcaggaatgctgaca

SEQ ID NO: 5003340 - DNA, 21 bp, Homo sapiens
actgccaccttgggtctgtgt

SEQ ID NO: 5003341 - DNA, 16 bp, Homo sapiens
actgccctccagggcc

SEQ ID NO: 5003342 - DNA, 18 bp, Homo sapiens
actgccctccagggccag

SEQ ID NO: 5003343 - DNA, 14 bp, Homo sapiens
actgctcaggcctc

SEQ ID NO: 5003344 - DNA, 18 bp, Homo sapiens
actgcttgtgtttttaac

SEQ ID NO: 5003345 - DNA, 13 bp, Homo sapiens
actggctcctgga

SEQ ID NO: 5003346 - DNA, 12 bp, Homo sapiens
actgggcccaga

SEQ ID NO: 5003347 - DNA, 15 bp, Homo sapiens
actgggcccagagga

SEQ ID NO: 5003348 - DNA, 22 bp, Homo sapiens
actggtttatccacccacaaca

SEQ ID NO: 5003349 - DNA, 14 bp, Homo sapiens
actgtcagccctca

SEQ ID NO: 5003350 - DNA, 16 bp, Homo sapiens
actgtcagccctcact

SEQ ID NO: 5003351 - DNA, 23 bp, Homo sapiens
actgtcagtcccactgcaccccc

SEQ ID NO: 5003352 - DNA, 17 bp, Homo sapiens
actgtggaactgccacc

SEQ ID NO: 5003353 - DNA, 13 bp, Homo sapiens
acttcacaaaatg

SEQ ID NO: 5003354 - DNA, 22 bp, Homo sapiens
acttctctttcttattttgtaa

SEQ ID NO: 5003355 - DNA, 18 bp, Homo sapiens
acttgacagaacactgtc

SEQ ID NO: 5003356 - DNA, 18 bp, Homo sapiens
actttcagtgaaagcatc

SEQ ID NO: 5003357 - DNA, 17 bp, Homo sapiens
agaaagtgcagcatgga

SEQ ID NO: 5003358 - DNA, 22 bp, Homo sapiens
agaaataaattcacatcctcag

SEQ ID NO: 5003359 - DNA, 16 bp, Homo sapiens
attcacatcctcagaa

SEQ ID NO: 5003360 - DNA, 21 bp, Homo sapiens
attcactcccacacccaagaa

SEQ ID NO: 5003361 - DNA, 18 bp, Homo sapiens
attcaggcctctgaggag

SEQ ID NO: 5003362 - DNA, 12 bp, Homo sapiens
attcataaatct

SEQ ID NO: 5003363 - DNA, 17 bp, Homo sapiens
attcatctctctttaat

SEQ ID NO: 5003364 - DNA, 22 bp, Homo sapiens
attccatgactctgcctaacca

SEQ ID NO: 5003365 - DNA, 15 bp, Homo sapiens
attcctgtccttcac

SEQ ID NO: 5003366 - DNA, 16 bp, Homo sapiens
attcctgttctttctt

SEQ ID NO: 5003367 - DNA, 19 bp, Homo sapiens
attctaacttttttgctat

SEQ ID NO: 5003368 - DNA, 17 bp, Homo sapiens
attctcttgaaggtgct

SEQ ID NO: 5003369 - DNA, 21 bp, Homo sapiens
attctcttgaaggtgctgcca

SEQ ID NO: 5003370 - DNA, 22 bp, Homo sapiens
attctcttgaaggtgctgccac

SEQ ID NO: 5003371 - DNA, 14 bp, Homo sapiens
attctgccatggga

SEQ ID NO: 5003372 - DNA, 21 bp, Homo sapiens
atttcttaaacaaatgtatga

SEQ ID NO: 5003373 - DNA, 14 bp, Homo sapiens
atttggcccagaga

SEQ ID NO: 5003374 - DNA, 12 bp, Homo sapiens
atttgttaatgg

SEQ ID NO: 5003375 - DNA, 20 bp, Homo sapiens
attttatgccttttatttct

SEQ ID NO: 5003376 - DNA, 16 bp, Homo sapiens
attttgtaataaactc

SEQ ID NO: 5003377 - DNA, 19 bp, Homo sapiens
attttgtaataaactctct

SEQ ID NO: 5003378 - DNA, 22 bp, Homo sapiens
caaaaccagagggcagtctagt

SEQ ID NO: 5003379 - DNA, 12 bp, Homo sapiens
caaacacaggca

SEQ ID NO: 5003380 - DNA, 15 bp, Homo sapiens
caaacactgtgtatt

SEQ ID NO: 5003381 - DNA, 19 bp, Homo sapiens
caaacatgtggcaacctgt

SEQ ID NO: 5003382 - DNA, 22 bp, Homo sapiens
caaacatgtggcaacctgttct

SEQ ID NO: 5003383 - DNA, 20 bp, Homo sapiens
caaacatgtggttaatgcca

SEQ ID NO: 5003384 - DNA, 23 bp, Homo sapiens
caaacctttagctgtgaatggct

SEQ ID NO: 5003385 - DNA, 23 bp, Homo sapiens
caaagaaggcacaggtgtaaata

SEQ ID NO: 5003386 - DNA, 14 bp, Homo sapiens
caaagctgctgggc

SEQ ID NO: 5003387 - DNA, 16 bp, Homo sapiens
caaaggagtagaaaga

SEQ ID NO: 5003388 - DNA, 18 bp, Homo sapiens
caaataaatgtgtaaatg

SEQ ID NO: 5003389 - DNA, 15 bp, Homo sapiens
caaatataaacttgt

SEQ ID NO: 5003390 - DNA, 17 bp, Homo sapiens
caaatgctaaatgcaaa

SEQ ID NO: 5003391 - DNA, 15 bp, Homo sapiens
caaattggtgtttct

SEQ ID NO: 5003392 - DNA, 22 bp, Homo sapiens
caacaacatgtataatattttt

SEQ ID NO: 5003393 - DNA, 14 bp, Homo sapiens
caacagcaggaggc

SEQ ID NO: 5003394 - DNA, 16 bp, Homo sapiens
caacagcaggaggcac

SEQ ID NO: 5003395 - DNA, 18 bp, Homo sapiens
caacagcaggaggcacag

SEQ ID NO: 5003396 - DNA, 21 bp, Homo sapiens
caacagcaggaggcacagcag

SEQ ID NO: 5003397 - DNA, 16 bp, Homo sapiens
caactgcaggaatgct

SEQ ID NO: 5003398 - DNA, 22 bp, Homo sapiens
caagaagaaatgctttccaaaa

SEQ ID NO: 5003399 - DNA, 20 bp, Homo sapiens
caagaaggggacagcgccac

SEQ ID NO: 5003400 - DNA, 16 bp, Homo sapiens
caagacccaagtagct

SEQ ID NO: 5003401 - DNA, 16 bp, Homo sapiens
caagatcgctgtgcta

SEQ ID NO: 5003402 - DNA, 22 bp, Homo sapiens
caagatcgctgtgctaggtctg

SEQ ID NO: 5003403 - DNA, 17 bp, Homo sapiens
caagctgcaaaaggcct

SEQ ID NO: 5003404 - DNA, 13 bp, Homo sapiens
caagtagctgcta

SEQ ID NO: 5003405 - DNA, 18 bp, Homo sapiens
caagtattttatctgtgt

SEQ ID NO: 5003406 - DNA, 12 bp, Homo sapiens
caagttcaatct

SEQ ID NO: 5003407 - DNA, 22 bp, Homo sapiens
caatattttccatgaaaatgca

SEQ ID NO: 5003408 - DNA, 21 bp, Homo sapiens
caatcactgggcccagaggag

SEQ ID NO: 5003409 - DNA, 21 bp, Homo sapiens
caatgccatgactgctcaggc

SEQ ID NO: 5003410 - DNA, 16 bp, Homo sapiens
caatgctgccatgccc

SEQ ID NO: 5003411 - DNA, 18 bp, Homo sapiens
caatggcttactccagga

SEQ ID NO: 5003412 - DNA, 13 bp, Homo sapiens
caatggtttgcaa

SEQ ID NO: 5003413 - DNA, 18 bp, Homo sapiens
caattcttacaaacatgt

SEQ ID NO: 5003414 - DNA, 19 bp, Homo sapiens
caattcttacaaacatgtg

SEQ ID NO: 5003415 - DNA, 17 bp, Homo sapiens
caatttccaagagctga

SEQ ID NO: 5003416 - DNA, 22 bp, Homo sapiens
cacacactggctcctggaccta

SEQ ID NO: 5003417 - DNA, 15 bp, Homo sapiens
cacacccacctgctg

SEQ ID NO: 5003418 - DNA, 17 bp, Homo sapiens
cacacccacctgctgct

SEQ ID NO: 5003419 - DNA, 16 bp, Homo sapiens
cacagaaaccaatttt

SEQ ID NO: 5003420 - DNA, 20 bp, Homo sapiens
cacagaccctgcccacccca

SEQ ID NO: 5003421 - DNA, 18 bp, Homo sapiens
cacagcaattcctcaggc

SEQ ID NO: 5003422 - DNA, 13 bp, Homo sapiens
cacagcagtcaca

SEQ ID NO: 5003423 - DNA, 21 bp, Homo sapiens
cacagcagtcacaggcccagg

SEQ ID NO: 5003424 - DNA, 20 bp, Homo sapiens
cacagctaataaaagtcaga

SEQ ID NO: 5003425 - DNA, 22 bp, Homo sapiens
cacagctaataaaagtcagagc

SEQ ID NO: 5003426 - DNA, 23 bp, Homo sapiens
cacagctaataaaagtcagagct

SEQ ID NO: 5003427 - DNA, 17 bp, Homo sapiens
cacaggcccaggaaggc

SEQ ID NO: 5003428 - DNA, 11 bp, Homo sapiens
cacagggacca

SEQ ID NO: 5003429 - DNA, 13 bp, Homo sapiens
cacaggtgtaaat

SEQ ID NO: 5003430 - DNA, 20 bp, Homo sapiens
cacatcactgagaagatggc

SEQ ID NO: 5003431 - DNA, 21 bp, Homo sapiens
cacatcctcagaaagtgcagc

SEQ ID NO: 5003432 - DNA, 23 bp, Homo sapiens
caccaagttggaacatccttgga

SEQ ID NO: 5003433 - DNA, 18 bp, Homo sapiens
caccatctgccaatgcca

SEQ ID NO: 5003434 - DNA, 14 bp, Homo sapiens
cacccacctgctgc

SEQ ID NO: 5003435 - DNA, 15 bp, Homo sapiens
cacccacttgcctgt

SEQ ID NO: 5003436 - DNA, 22 bp, Homo sapiens
cacccatatctgtgtgccctag

SEQ ID NO: 5003437 - DNA, 17 bp, Homo sapiens
caccccagccccactgc

SEQ ID NO: 5003438 - DNA, 19 bp, Homo sapiens
caccccagccccactgccc

SEQ ID NO: 5003439 - DNA, 13 bp, Homo sapiens
caccccatccctg

SEQ ID NO: 5003440 - DNA, 16 bp, Homo sapiens
caccccatccctggct

SEQ ID NO: 5003441 - DNA, 17 bp, Homo sapiens
caccccatccctggctg

SEQ ID NO: 5003442 - DNA, 19 bp, Homo sapiens
cacccccctgtgcctgctg

SEQ ID NO: 5003443 - DNA, 22 bp, Homo sapiens
cacctaagcaatcactgggccc

SEQ ID NO: 5003444 - DNA, 16 bp, Homo sapiens
cacctcccagggctac

SEQ ID NO: 5003445 - DNA, 10 bp, Homo sapiens
cacctccctg

SEQ ID NO: 5003446 - DNA, 14 bp, Homo sapiens
cacctgctgctgta

SEQ ID NO: 5003447 - DNA, 14 bp, Homo sapiens
cacctgttgtcctg

SEQ ID NO: 5003448 - DNA, 15 bp, Homo sapiens
cacctgttgtcctga

SEQ ID NO: 5003449 - DNA, 15 bp, Homo sapiens
cacgctcaaggaagg

SEQ ID NO: 5003450 - DNA, 13 bp, Homo sapiens
cacggggcaaagc

SEQ ID NO: 5003451 - DNA, 21 bp, Homo sapiens
cacgggtaaatctagtaccat

SEQ ID NO: 5003452 - DNA, 19 bp, Homo sapiens
cacgtgctcttctgttctc

SEQ ID NO: 5003453 - DNA, 22 bp, Homo sapiens
cactaagtagaataaagaaaaa

SEQ ID NO: 5003454 - DNA, 23 bp, Homo sapiens
cactctgtgtgggaaaatggcag

SEQ ID NO: 5003455 - DNA, 20 bp, Homo sapiens
cactgagaagatggcactgt

SEQ ID NO: 5003456 - DNA, 22 bp, Homo sapiens
cactgagaagatggcactgtcc

SEQ ID NO: 5003457 - DNA, 24 bp, Homo sapiens
cactgcacccccctgtgcctgctg

SEQ ID NO: 5003458 - DNA, 21 bp, Homo sapiens
cactgcagaacagcttcatgt

SEQ ID NO: 5003459 - DNA, 18 bp, Homo sapiens
cactgggcactagctaga

SEQ ID NO: 5003460 - DNA, 20 bp, Homo sapiens
cactgggcccagaggagagg

SEQ ID NO: 5003461 - DNA, 18 bp, Homo sapiens
cactgtcagccctcactg

SEQ ID NO: 5003462 - DNA, 21 bp, Homo sapiens
cactgtcagtcccactgcacc

SEQ ID NO: 5003463 - DNA, 22 bp, Homo sapiens
cactgtcagtcccactgcaccc

SEQ ID NO: 5003464 - DNA, 14 bp, Homo sapiens
cactgtcttgaaga

SEQ ID NO: 5003465 - DNA, 18 bp, Homo sapiens
cactgtggaactgccacc

SEQ ID NO: 5003466 - DNA, 19 bp, Homo sapiens
cactgtggaactgccacct

SEQ ID NO: 5003467 - DNA, 20 bp, Homo sapiens
cacttatttatgaacctgcc

SEQ ID NO: 5003468 - DNA, 16 bp, Homo sapiens
cacttctctactctgg

SEQ ID NO: 5003469 - DNA, 18 bp, Homo sapiens
cacttctctactctggaa

SEQ ID NO: 5003470 - DNA, 19 bp, Homo sapiens
cacttgcctgtcaccccag

SEQ ID NO: 5003471 - DNA, 22 bp, Homo sapiens
cacttgcctgtcaccccagtca

SEQ ID NO: 5003472 - DNA, 17 bp, Homo sapiens
cacttgtaggtttctct

SEQ ID NO: 5003473 - DNA, 24 bp, Homo sapiens
cacttgtaggtttctctgcctcca

SEQ ID NO: 5003474 - DNA, 19 bp, Homo sapiens
cactttcagtgaaagcatc

SEQ ID NO: 5003475 - DNA, 20 bp, Homo sapiens
cagaaaggaaaagattcctg

SEQ ID NO: 5003476 - DNA, 22 bp, Homo sapiens
cagaagactctccactgacctg

SEQ ID NO: 5003477 - DNA, 19 bp, Homo sapiens
cagacacacactggctcct

SEQ ID NO: 5003478 - DNA, 21 bp, Homo sapiens
cagacaggaggagtgggacag

SEQ ID NO: 5003479 - DNA, 23 bp, Homo sapiens
cagacattttcctcacacccacc

SEQ ID NO: 5003480 - DNA, 13 bp, Homo sapiens
cagaccctgccca

SEQ ID NO: 5003481 - DNA, 13 bp, Homo sapiens
cagagctgccctc

SEQ ID NO: 5003482 - DNA, 17 bp, Homo sapiens
cagagctgccctctcct

SEQ ID NO: 5003483 - DNA, 9 bp, Homo sapiens
cagagctgg

SEQ ID NO: 5003484 - DNA, 20 bp, Homo sapiens
cagagctgggatgtttctgt

SEQ ID NO: 5003485 - DNA, 16 bp, Homo sapiens
cagaggagaggagaca

SEQ ID NO: 5003486 - DNA, 21 bp, Homo sapiens
cagaggagaggagacagacac

SEQ ID NO: 5003487 - DNA, 12 bp, Homo sapiens
cagagggcagtc

SEQ ID NO: 5003488 - DNA, 15 bp, Homo sapiens
cagagtggagcccag

SEQ ID NO: 5003489 - DNA, 17 bp, Homo sapiens
cagagtggagcccaggg

SEQ ID NO: 5003490 - DNA, 19 bp, Homo sapiens
cagagtggagcccagggtg

SEQ ID NO: 5003491 - DNA, 20 bp, Homo sapiens
cagagttgttctcaggggtg

SEQ ID NO: 5003492 - DNA, 15 bp, Homo sapiens
cagataatccctgta

SEQ ID NO: 5003493 - DNA, 19 bp, Homo sapiens
cagatagaatttggcccag

SEQ ID NO: 5003494 - DNA, 20 bp, Homo sapiens
cagatagaatttggcccaga

SEQ ID NO: 5003495 - DNA, 13 bp, Homo sapiens
cagatcccagggt

SEQ ID NO: 5003496 - DNA, 17 bp, Homo sapiens
cagatcccagggtacac

SEQ ID NO: 5003497 - DNA, 23 bp, Homo sapiens
cagatcctcttctcaaagctggg

SEQ ID NO: 5003498 - DNA, 13 bp, Homo sapiens
cagcagctggact

SEQ ID NO: 5003499 - DNA, 14 bp, Homo sapiens
cagcaggaggcaca

SEQ ID NO: 5003500 - DNA, 17 bp, Homo sapiens
cagcaggaggcacagca

SEQ ID NO: 5003501 - DNA, 15 bp, Homo sapiens
cagcagtcacaggcc

SEQ ID NO: 5003502 - DNA, 17 bp, Homo sapiens
cagcagtcacaggccca

SEQ ID NO: 5003503 - DNA, 13 bp, Homo sapiens
cagcagttcagag

SEQ ID NO: 5003504 - DNA, 19 bp, Homo sapiens
cagcagttcagagctgccc

SEQ ID NO: 5003505 - DNA, 20 bp, Homo sapiens
cagcagttcagagctgccct

SEQ ID NO: 5003506 - DNA, 21 bp, Homo sapiens
cagcagttcagagctgccctc

SEQ ID NO: 5003507 - DNA, 22 bp, Homo sapiens
cagcagttcagagctgccctct

SEQ ID NO: 5003508 - DNA, 23 bp, Homo sapiens
cagcagtttcaccatctttgagg

SEQ ID NO: 5003509 - DNA, 15 bp, Homo sapiens
cagccagcagttcag

SEQ ID NO: 5003510 - DNA, 20 bp, Homo sapiens
cagccccactgccctccagg

SEQ ID NO: 5003511 - DNA, 19 bp, Homo sapiens
cagctaataaaagtcagag

SEQ ID NO: 5003512 - DNA, 17 bp, Homo sapiens
cagctagagcttccact

SEQ ID NO: 5003513 - DNA, 23 bp, Homo sapiens
cagctgatccttcaactctgtga

SEQ ID NO: 5003514 - DNA, 18 bp, Homo sapiens
cagctgcctcccctcctc

SEQ ID NO: 5003515 - DNA, 19 bp, Homo sapiens
cagctgcctcccctcctct

SEQ ID NO: 5003516 - DNA, 24 bp, Homo sapiens
cagctgcctcccctcctctgcttg

SEQ ID NO: 5003517 - DNA, 20 bp, Homo sapiens
caggaaagatgtcccacagg

SEQ ID NO: 5003518 - DNA, 18 bp, Homo sapiens
caggaaggcggcaggcag

SEQ ID NO: 5003519 - DNA, 19 bp, Homo sapiens
caggaaggcggcaggcaga

SEQ ID NO: 5003520 - DNA, 21 bp, Homo sapiens
caggaaggcggcaggcagaga

SEQ ID NO: 5003521 - DNA, 19 bp, Homo sapiens
caggaggagtgggacagac

SEQ ID NO: 5003522 - DNA, 22 bp, Homo sapiens
caggaggagtgggacagacagc

SEQ ID NO: 5003523 - DNA, 15 bp, Homo sapiens
caggaggcacagcag

SEQ ID NO: 5003524 - DNA, 16 bp, Homo sapiens
caggaggcacagcagt

SEQ ID NO: 5003525 - DNA, 23 bp, Homo sapiens
caggatgaggaacctcaaactgg

SEQ ID NO: 5003526 - DNA, 17 bp, Homo sapiens
caggattcaggcctctg

SEQ ID NO: 5003527 - DNA, 22 bp, Homo sapiens
caggcaacgcacaaaacagaaa

SEQ ID NO: 5003528 - DNA, 16 bp, Homo sapiens
caggcaccatctgcca

SEQ ID NO: 5003529 - DNA, 22 bp, Homo sapiens
caggcaccatctgccaatgcca

SEQ ID NO: 5003530 - DNA, 18 bp, Homo sapiens
caggcagagaagtggagt

SEQ ID NO: 5003531 - DNA, 15 bp, Homo sapiens
caggcctcacctccc

SEQ ID NO: 5003532 - DNA, 20 bp, Homo sapiens
caggcctcacctcccagggc

SEQ ID NO: 5003533 - DNA, 21 bp, Homo sapiens
caggcctcacctcccagggct

SEQ ID NO: 5003534 - DNA, 22 bp, Homo sapiens
caggcctctactaggtctgctc

SEQ ID NO: 5003535 - DNA, 12 bp, Homo sapiens
caggcctctgag

SEQ ID NO: 5003536 - DNA, 13 bp, Homo sapiens
caggcctctgagg

SEQ ID NO: 5003537 - DNA, 18 bp, Homo sapiens
caggcctctgaggagccc

SEQ ID NO: 5003538 - DNA, 22 bp, Homo sapiens
caggcctctgaggagcccacgg

SEQ ID NO: 5003539 - DNA, 20 bp, Homo sapiens
cagggaccacatccacccca

SEQ ID NO: 5003540 - DNA, 22 bp, Homo sapiens
cagggatgctcattccatgact

SEQ ID NO: 5003541 - DNA, 11 bp, Homo sapiens
cagggccagga

SEQ ID NO: 5003542 - DNA, 22 bp, Homo sapiens
cagggccaggattcaggcctct

SEQ ID NO: 5003543 - DNA, 12 bp, Homo sapiens
cagggccaggtc

SEQ ID NO: 5003544 - DNA, 13 bp, Homo sapiens
cagggccaggtcc

SEQ ID NO: 5003545 - DNA, 14 bp, Homo sapiens
cagggccaggtcct

SEQ ID NO: 5003546 - DNA, 16 bp, Homo sapiens
cagggccaggtcctca

SEQ ID NO: 5003547 - DNA, 20 bp, Homo sapiens
cagggccaggtcctcacagc

SEQ ID NO: 5003548 - DNA, 23 bp, Homo sapiens
cagggccaggtcctcacagcagt

SEQ ID NO: 5003549 - DNA, 20 bp, Homo sapiens
cagggcccatgtagctggca

SEQ ID NO: 5003550 - DNA, 16 bp, Homo sapiens
cagggctacacagacc

SEQ ID NO: 5003551 - DNA, 18 bp, Homo sapiens
caggggcagtggcctgga

SEQ ID NO: 5003552 - DNA, 22 bp, Homo sapiens
caggggcagtggcctggatgca

SEQ ID NO: 5003553 - DNA, 16 bp, Homo sapiens
caggggtgctggggca

SEQ ID NO: 5003554 - DNA, 19 bp, Homo sapiens
caggggtgctggggcagag

SEQ ID NO: 5003555 - DNA, 18 bp, Homo sapiens
cagggtacactcttctcc

SEQ ID NO: 5003556 - DNA, 13 bp, Homo sapiens
cagggtgctggga

SEQ ID NO: 5003557 - DNA, 16 bp, Homo sapiens
caggtcctcacagcag

SEQ ID NO: 5003558 - DNA, 17 bp, Homo sapiens
caggtcctcacagcagt

SEQ ID NO: 5003559 - DNA, 18 bp, Homo sapiens
caggtcctcacagcagtc

SEQ ID NO: 5003560 - DNA, 17 bp, Homo sapiens
caggtctagaaggccag

SEQ ID NO: 5003561 - DNA, 18 bp, Homo sapiens
caggtctagaaggccagg

SEQ ID NO: 5003562 - DNA, 23 bp, Homo sapiens
caggtctagaaggccaggcctct

SEQ ID NO: 5003563 - DNA, 12 bp, Homo sapiens
caggtgtaaata

SEQ ID NO: 5003564 - DNA, 21 bp, Homo sapiens
caggtgtaaatatagtagcag

SEQ ID NO: 5003565 - DNA, 18 bp, Homo sapiens
caggttccctgccacact

SEQ ID NO: 5003566 - DNA, 16 bp, Homo sapiens
cagtcacaggcccagg

SEQ ID NO: 5003567 - DNA, 17 bp, Homo sapiens
cagtcacaggcccagga

SEQ ID NO: 5003568 - DNA, 18 bp, Homo sapiens
cagtcctgctgcctggag

SEQ ID NO: 5003569 - DNA, 13 bp, Homo sapiens
cagtgaaagcatc

SEQ ID NO: 5003570 - DNA, 23 bp, Homo sapiens
cagtgctgaccagacagcctccc

SEQ ID NO: 5003571 - DNA, 16 bp, Homo sapiens
cagtggcactctgtgt

SEQ ID NO: 5003572 - DNA, 17 bp, Homo sapiens
cagttcagagctgccct

SEQ ID NO: 5003573 - DNA, 22 bp, Homo sapiens
cagttcagagctgccctctcct

SEQ ID NO: 5003574 - DNA, 23 bp, Homo sapiens
cagttcagagctgccctctcctg

SEQ ID NO: 5003575 - DNA, 15 bp, Homo sapiens
cagttcctttcaatg

SEQ ID NO: 5003576 - DNA, 17 bp, Homo sapiens
cataaaatatacaaaca

SEQ ID NO: 5003577 - DNA, 20 bp, Homo sapiens
cataaaatatacaaacatgt

SEQ ID NO: 5003578 - DNA, 18 bp, Homo sapiens
catatctgtgtgccctag

SEQ ID NO: 5003579 - DNA, 22 bp, Homo sapiens
catatgaaaaaaatgcatttta

SEQ ID NO: 5003580 - DNA, 11 bp, Homo sapiens
catccacccca

SEQ ID NO: 5003581 - DNA, 12 bp, Homo sapiens
catccaccccag

SEQ ID NO: 5003582 - DNA, 14 bp, Homo sapiens
catccctccctcca

SEQ ID NO: 5003583 - DNA, 15 bp, Homo sapiens
catctccctcccaca

SEQ ID NO: 5003584 - DNA, 15 bp, Homo sapiens
catctgccaatgcca

SEQ ID NO: 5003585 - DNA, 22 bp, Homo sapiens
catgaaaatgcaacaacatgta

SEQ ID NO: 5003586 - DNA, 13 bp, Homo sapiens
catgactctgcct

SEQ ID NO: 5003587 - DNA, 14 bp, Homo sapiens
catgactctgccta

SEQ ID NO: 5003588 - DNA, 16 bp, Homo sapiens
catgactgctcaggcc

SEQ ID NO: 5003589 - DNA, 19 bp, Homo sapiens
catgactgctcaggcctca

SEQ ID NO: 5003590 - DNA, 16 bp, Homo sapiens
catgcaccctcataca

SEQ ID NO: 5003591 - DNA, 15 bp, Homo sapiens
catggacagaagaag

SEQ ID NO: 5003592 - DNA, 21 bp, Homo sapiens
catggacagaagaaggcagca

SEQ ID NO: 5003593 - DNA, 12 bp, Homo sapiens
catgggagagtc

SEQ ID NO: 5003594 - DNA, 16 bp, Homo sapiens
catgggagagtccagg

SEQ ID NO: 5003595 - DNA, 21 bp, Homo sapiens
catgggagagtccaggcctgg

SEQ ID NO: 5003596 - DNA, 13 bp, Homo sapiens
catgggctcaggg

SEQ ID NO: 5003597 - DNA, 13 bp, Homo sapiens
catgggggcccaa

SEQ ID NO: 5003598 - DNA, 16 bp, Homo sapiens
catgtaaattttgtat

SEQ ID NO: 5003599 - DNA, 17 bp, Homo sapiens
catgtgcctctgtcctt

SEQ ID NO: 5003600 - DNA, 21 bp, Homo sapiens
cattatgatgtgggtcaagga

SEQ ID NO: 5003601 - DNA, 14 bp, Homo sapiens
cattccatgactct

SEQ ID NO: 5003602 - DNA, 20 bp, Homo sapiens
cattccatgactctgcctaa

SEQ ID NO: 5003603 - DNA, 14 bp, Homo sapiens
cattccctccaccc

SEQ ID NO: 5003604 - DNA, 17 bp, Homo sapiens
cattccctccacccact

SEQ ID NO: 5003605 - DNA, 21 bp, Homo sapiens
cattctcttgaaggtgctgcc

SEQ ID NO: 5003606 - DNA, 21 bp, Homo sapiens
cattgcctgatttgttccttc

SEQ ID NO: 5003607 - DNA, 20 bp, Homo sapiens
catttgctaactagcttgga

SEQ ID NO: 5003608 - DNA, 23 bp, Homo sapiens
cattttcctcacacccacctgct

SEQ ID NO: 5003609 - DNA, 15 bp, Homo sapiens
ccaaaaccagagggc

SEQ ID NO: 5003610 - DNA, 13 bp, Homo sapiens
ccaaacacaggca

SEQ ID NO: 5003611 - DNA, 14 bp, Homo sapiens
ccaaacacaggcaa

SEQ ID NO: 5003612 - DNA, 21 bp, Homo sapiens
ccaaagcagacattttcctca

SEQ ID NO: 5003613 - DNA, 13 bp, Homo sapiens
ccaaataaatgtg

SEQ ID NO: 5003614 - DNA, 16 bp, Homo sapiens
ccaaattggtgtttct

SEQ ID NO: 5003615 - DNA, 20 bp, Homo sapiens
ccaatgccatgactgctcag

SEQ ID NO: 5003616 - DNA, 22 bp, Homo sapiens
ccaatgccatgactgctcaggc

SEQ ID NO: 5003617 - DNA, 22 bp, Homo sapiens
ccacaaatgggaaaaccagact

SEQ ID NO: 5003618 - DNA, 19 bp, Homo sapiens
ccaccccatccctggctga

SEQ ID NO: 5003619 - DNA, 13 bp, Homo sapiens
ccaccccttggca

SEQ ID NO: 5003620 - DNA, 18 bp, Homo sapiens
ccaccccttggcactgtg

SEQ ID NO: 5003621 - DNA, 21 bp, Homo sapiens
ccacctccctgcaataaaatg

SEQ ID NO: 5003622 - DNA, 13 bp, Homo sapiens
ccacctgctgctg

SEQ ID NO: 5003623 - DNA, 16 bp, Homo sapiens
ccacctgttgtcctga

SEQ ID NO: 5003624 - DNA, 21 bp, Homo sapiens
ccaccttgggtctgtgtcact

SEQ ID NO: 5003625 - DNA, 15 bp, Homo sapiens
ccacggggcaaagct

SEQ ID NO: 5003626 - DNA, 22 bp, Homo sapiens
ccacggggcaaagctgctgggc

SEQ ID NO: 5003627 - DNA, 12 bp, Homo sapiens
ccactgacctgg

SEQ ID NO: 5003628 - DNA, 13 bp, Homo sapiens
ccactgacctggt

SEQ ID NO: 5003629 - DNA, 20 bp, Homo sapiens
ccactgacctggttgtccag

SEQ ID NO: 5003630 - DNA, 21 bp, Homo sapiens
ccactgcacccccctgtgcct

SEQ ID NO: 5003631 - DNA, 13 bp, Homo sapiens
ccactgccctcca

SEQ ID NO: 5003632 - DNA, 17 bp, Homo sapiens
ccactgccctccagggc

SEQ ID NO: 5003633 - DNA, 22 bp, Homo sapiens
ccactgtcagccctcactgtca

SEQ ID NO: 5003634 - DNA, 13 bp, Homo sapiens
ccagacaggagga

SEQ ID NO: 5003635 - DNA, 15 bp, Homo sapiens
ccagacaggaggagt

SEQ ID NO: 5003636 - DNA, 21 bp, Homo sapiens
ccagacaggaggagtgggaca

SEQ ID NO: 5003637 - DNA, 22 bp, Homo sapiens
ccagacaggaggagtgggacag

SEQ ID NO: 5003638 - DNA, 21 bp, Homo sapiens
ccagaggagaggagacagaca

SEQ ID NO: 5003639 - DNA, 22 bp, Homo sapiens
ccagaggagaggagacagacac

SEQ ID NO: 5003640 - DNA, 15 bp, Homo sapiens
ccagagttgttctca

SEQ ID NO: 5003641 - DNA, 16 bp, Homo sapiens
ccagagttgttctcag

SEQ ID NO: 5003642 - DNA, 19 bp, Homo sapiens
ccagagttgttctcagggg

SEQ ID NO: 5003643 - DNA, 19 bp, Homo sapiens
ccagcagttcagagctgcc

SEQ ID NO: 5003644 - DNA, 17 bp, Homo sapiens
ccagctagagcttccac

SEQ ID NO: 5003645 - DNA, 18 bp, Homo sapiens
ccaggaaagatgtcccac

SEQ ID NO: 5003646 - DNA, 21 bp, Homo sapiens
ccaggaaggcggcaggcagag

SEQ ID NO: 5003647 - DNA, 22 bp, Homo sapiens
ccaggaaggcggcaggcagaga

SEQ ID NO: 5003648 - DNA, 18 bp, Homo sapiens
ccaggcaccatctgccaa

SEQ ID NO: 5003649 - DNA, 20 bp, Homo sapiens
ccaggcctctactaggtctg

SEQ ID NO: 5003650 - DNA, 20 bp, Homo sapiens
ccaggctaattagaggatgt

SEQ ID NO: 5003651 - DNA, 21 bp, Homo sapiens
ccagggcccatgtagctggca

SEQ ID NO: 5003652 - DNA, 13 bp, Homo sapiens
ccagggctacaca

SEQ ID NO: 5003653 - DNA, 20 bp, Homo sapiens
ccagggtacactcttctcca

SEQ ID NO: 5003654 - DNA, 14 bp, Homo sapiens
ccaggtagaacaca

SEQ ID NO: 5003655 - DNA, 13 bp, Homo sapiens
ccaggtcctcaca

SEQ ID NO: 5003656 - DNA, 20 bp, Homo sapiens
ccaggtcctcacagcagtca

SEQ ID NO: 5003657 - DNA, 18 bp, Homo sapiens
ccaggtctagaaggccag

SEQ ID NO: 5003658 - DNA, 22 bp, Homo sapiens
ccaggtctagaaggccaggcct

SEQ ID NO: 5003659 - DNA, 18 bp, Homo sapiens
ccagtcctgctgcctgga

SEQ ID NO: 5003660 - DNA, 22 bp, Homo sapiens
ccagtcctgctgcctggagtca

SEQ ID NO: 5003661 - DNA, 18 bp, Homo sapiens
ccagtggcactctgtgtg

SEQ ID NO: 5003662 - DNA, 19 bp, Homo sapiens
ccatcatgtgcctggaaat

SEQ ID NO: 5003663 - DNA, 24 bp, Homo sapiens
ccatctgccaatgccatgactgct

SEQ ID NO: 5003664 - DNA, 16 bp, Homo sapiens
ccatgactctgcctaa

SEQ ID NO: 5003665 - DNA, 17 bp, Homo sapiens
ccatgatcacacagcta

SEQ ID NO: 5003666 - DNA, 14 bp, Homo sapiens
ccatgcccaccatc

SEQ ID NO: 5003667 - DNA, 16 bp, Homo sapiens
ccatgggctcagggcc

SEQ ID NO: 5003668 - DNA, 17 bp, Homo sapiens
ccatgggctcagggcca

SEQ ID NO: 5003669 - DNA, 19 bp, Homo sapiens
ccatgggctcagggccagg

SEQ ID NO: 5003670 - DNA, 20 bp, Homo sapiens
ccatgggctcagggccaggt

SEQ ID NO: 5003671 - DNA, 17 bp, Homo sapiens
ccattccctccacccac

SEQ ID NO: 5003672 - DNA, 17 bp, Homo sapiens
cccaccccatccctggc

SEQ ID NO: 5003673 - DNA, 14 bp, Homo sapiens
cccacctgctgctg

SEQ ID NO: 5003674 - DNA, 15 bp, Homo sapiens
cccacctgctgctgt

SEQ ID NO: 5003675 - DNA, 20 bp, Homo sapiens
cccacctgttgtcctgaact

SEQ ID NO: 5003676 - DNA, 20 bp, Homo sapiens
cccacggggcaaagctgctg

SEQ ID NO: 5003677 - DNA, 20 bp, Homo sapiens
cccactgcacccccctgtgc

SEQ ID NO: 5003678 - DNA, 22 bp, Homo sapiens
cccactgcacccccctgtgcct

SEQ ID NO: 5003679 - DNA, 14 bp, Homo sapiens
cccactgccctcca

SEQ ID NO: 5003680 - DNA, 19 bp, Homo sapiens
cccactgccctccagggcc

SEQ ID NO: 5003681 - DNA, 23 bp, Homo sapiens
cccactgccctccagggccagga

SEQ ID NO: 5003682 - DNA, 20 bp, Homo sapiens
cccacttctctactctggaa

SEQ ID NO: 5003683 - DNA, 22 bp, Homo sapiens
cccacttgcctgtcaccccagt

SEQ ID NO: 5003684 - DNA, 18 bp, Homo sapiens
cccagacttctctttctt

SEQ ID NO: 5003685 - DNA, 24 bp, Homo sapiens
cccagccagcagttcagagctgcc

SEQ ID NO: 5003686 - DNA, 13 bp, Homo sapiens
cccagggctacac

SEQ ID NO: 5003687 - DNA, 14 bp, Homo sapiens
cccatatctgtgtg

SEQ ID NO: 5003688 - DNA, 22 bp, Homo sapiens
cccatatctgtgtgccctaggg

SEQ ID NO: 5003689 - DNA, 24 bp, Homo sapiens
cccatatctgtgtgccctagggct

SEQ ID NO: 5003690 - DNA, 15 bp, Homo sapiens
cccatccctggctga

SEQ ID NO: 5003691 - DNA, 14 bp, Homo sapiens
cccatgtagctggc

SEQ ID NO: 5003692 - DNA, 18 bp, Homo sapiens
ccccactgccctccaggg

SEQ ID NO: 5003693 - DNA, 20 bp, Homo sapiens
ccccacttctctactctgga

SEQ ID NO: 5003694 - DNA, 23 bp, Homo sapiens
ccccacttctctactctggaagt

SEQ ID NO: 5003695 - DNA, 20 bp, Homo sapiens
ccccagacttctctttctta

SEQ ID NO: 5003696 - DNA, 19 bp, Homo sapiens
ccccagccctccccacctg

SEQ ID NO: 5003697 - DNA, 12 bp, Homo sapiens
ccccagctagga

SEQ ID NO: 5003698 - DNA, 12 bp, Homo sapiens
ccccatccctgg

SEQ ID NO: 5003699 - DNA, 18 bp, Homo sapiens
ccccctgtgcctgctggg

SEQ ID NO: 5003700 - DNA, 16 bp, Homo sapiens
cccctgtgcctgctgg

SEQ ID NO: 5003701 - DNA, 18 bp, Homo sapiens
cccctgtgcctgctgggc

SEQ ID NO: 5003702 - DNA, 14 bp, Homo sapiens
ccccttggcactgt

SEQ ID NO: 5003703 - DNA, 20 bp, Homo sapiens
ccctaccacacatctgtgga

SEQ ID NO: 5003704 - DNA, 14 bp, Homo sapiens
ccctactgagaaac

SEQ ID NO: 5003705 - DNA, 20 bp, Homo sapiens
ccctcagatcccagggtaca

SEQ ID NO: 5003706 - DNA, 12 bp, Homo sapiens
ccctccacctcc

SEQ ID NO: 5003707 - DNA, 14 bp, Homo sapiens
ccctccacctccct

SEQ ID NO: 5003708 - DNA, 13 bp, Homo sapiens
ccctccctccacc

SEQ ID NO: 5003709 - DNA, 20 bp, Homo sapiens
ccctccctccacctccctgc

SEQ ID NO: 5003710 - DNA, 13 bp, Homo sapiens
ccctcctctgctt

SEQ ID NO: 5003711 - DNA, 21 bp, Homo sapiens
ccctctcctgggcagctgcct

SEQ ID NO: 5003712 - DNA, 22 bp, Homo sapiens
ccctctcctgggcagctgcctc

SEQ ID NO: 5003713 - DNA, 23 bp, Homo sapiens
ccctctcctgggcagctgcctcc

SEQ ID NO: 5003714 - DNA, 15 bp, Homo sapiens
ccctgcaataaaatg

SEQ ID NO: 5003715 - DNA, 17 bp, Homo sapiens
ccctgctcccacagaac

SEQ ID NO: 5003716 - DNA, 14 bp, Homo sapiens
ccctggctgacctg

SEQ ID NO: 5003717 - DNA, 18 bp, Homo sapiens
ccctggctgacctgctgt

SEQ ID NO: 5003718 - DNA, 13 bp, Homo sapiens
ccctgtgcctgct

SEQ ID NO: 5003719 - DNA, 15 bp, Homo sapiens
ccctgtgcctgctgg

SEQ ID NO: 5003720 - DNA, 22 bp, Homo sapiens
cccttctggtgccagatcctct

SEQ ID NO: 5003721 - DNA, 22 bp, Homo sapiens
cccttgctggagtcatgtgcct

SEQ ID NO: 5003722 - DNA, 20 bp, Homo sapiens
cccttggcactgtggaactg

SEQ ID NO: 5003723 - DNA, 19 bp, Homo sapiens
cctaaccatgggctcaggg

SEQ ID NO: 5003724 - DNA, 20 bp, Homo sapiens
cctaaccatgggctcagggc

SEQ ID NO: 5003725 - DNA, 14 bp, Homo sapiens
cctaaccctgggct

SEQ ID NO: 5003726 - DNA, 17 bp, Homo sapiens
cctaaccctgggctccc

SEQ ID NO: 5003727 - DNA, 23 bp, Homo sapiens
cctaagcaatcactgggcccaga

SEQ ID NO: 5003728 - DNA, 18 bp, Homo sapiens
cctaccaaatataaactt

SEQ ID NO: 5003729 - DNA, 11 bp, Homo sapiens
cctagggctca

SEQ ID NO: 5003730 - DNA, 13 bp, Homo sapiens
cctagggctcaga

SEQ ID NO: 5003731 - DNA, 14 bp, Homo sapiens
cctagggctcagag

SEQ ID NO: 5003732 - DNA, 13 bp, Homo sapiens
cctattctgccat

SEQ ID NO: 5003733 - DNA, 13 bp, Homo sapiens
cctcaacagcagg

SEQ ID NO: 5003734 - DNA, 17 bp, Homo sapiens
cctcaacagcaggaggc

SEQ ID NO: 5003735 - DNA, 22 bp, Homo sapiens
cctcaacagcaggaggcacagc

SEQ ID NO: 5003736 - DNA, 18 bp, Homo sapiens
cctcacacccacctgctg

SEQ ID NO: 5003737 - DNA, 22 bp, Homo sapiens
cctcacacccacctgctgctgt

SEQ ID NO: 5003738 - DNA, 18 bp, Homo sapiens
cctcacagcagtcacagg

SEQ ID NO: 5003739 - DNA, 19 bp, Homo sapiens
cctcacagcagtcacaggc

SEQ ID NO: 5003740 - DNA, 13 bp, Homo sapiens
cctcagtcctgga

SEQ ID NO: 5003741 - DNA, 16 bp, Homo sapiens
cctcatcttccccagc

SEQ ID NO: 5003742 - DNA, 19 bp, Homo sapiens
cctcatcttccccagccct

SEQ ID NO: 5003743 - DNA, 13 bp, Homo sapiens
cctccacctccct

SEQ ID NO: 5003744 - DNA, 21 bp, Homo sapiens
cctccaggttgcctcaacagc

SEQ ID NO: 5003745 - DNA, 13 bp, Homo sapiens
cctccccacctgc

SEQ ID NO: 5003746 - DNA, 15 bp, Homo sapiens
cctcccctcctctgc

SEQ ID NO: 5003747 - DNA, 18 bp, Homo sapiens
cctcccctcctctgcttg

SEQ ID NO: 5003748 - DNA, 16 bp, Homo sapiens
cctccctgcaataaaa

SEQ ID NO: 5003749 - DNA, 16 bp, Homo sapiens
cctcctctgcttgcca

SEQ ID NO: 5003750 - DNA, 14 bp, Homo sapiens
cctctactaggtct

SEQ ID NO: 5003751 - DNA, 13 bp, Homo sapiens
cctctcctgggca

SEQ ID NO: 5003752 - DNA, 14 bp, Homo sapiens
cctctcctgggcag

SEQ ID NO: 5003753 - DNA, 15 bp, Homo sapiens
cctctcctgggcagc

SEQ ID NO: 5003754 - DNA, 18 bp, Homo sapiens
cctctcctgggcagctgc

SEQ ID NO: 5003755 - DNA, 21 bp, Homo sapiens
cctctgaggagcccacggggc

SEQ ID NO: 5003756 - DNA, 20 bp, Homo sapiens
cctctgcttgccatccctcc

SEQ ID NO: 5003757 - DNA, 21 bp, Homo sapiens
cctctgcttgccatccctccc

SEQ ID NO: 5003758 - DNA, 13 bp, Homo sapiens
cctgaaccagtcc

SEQ ID NO: 5003759 - DNA, 19 bp, Homo sapiens
cctgaaccagtcctgctgc

SEQ ID NO: 5003760 - DNA, 20 bp, Homo sapiens
cctgaaccagtcctgctgcc

SEQ ID NO: 5003761 - DNA, 17 bp, Homo sapiens
cctgccccaactgcagg

SEQ ID NO: 5003762 - DNA, 15 bp, Homo sapiens
cctgctgcctggagt

SEQ ID NO: 5003763 - DNA, 23 bp, Homo sapiens
cctgctgcctggagtcagtagcc

SEQ ID NO: 5003764 - DNA, 18 bp, Homo sapiens
cctggagtcagtagccag

SEQ ID NO: 5003765 - DNA, 21 bp, Homo sapiens
cctggagtcagtagccagagt

SEQ ID NO: 5003766 - DNA, 18 bp, Homo sapiens
cctggctgacctgctgtg

SEQ ID NO: 5003767 - DNA, 19 bp, Homo sapiens
cctggctgacctgctgtgg

SEQ ID NO: 5003768 - DNA, 22 bp, Homo sapiens
cctgggcagctgcctcccctcc

SEQ ID NO: 5003769 - DNA, 20 bp, Homo sapiens
cctgggctccctggaggact

SEQ ID NO: 5003770 - DNA, 14 bp, Homo sapiens
cctggttgtccagg

SEQ ID NO: 5003771 - DNA, 16 bp, Homo sapiens
cctggttgtccaggtc

SEQ ID NO: 5003772 - DNA, 15 bp, Homo sapiens
cctgtcaccccagtc

SEQ ID NO: 5003773 - DNA, 18 bp, Homo sapiens
cctgtgatccaggaaaga

SEQ ID NO: 5003774 - DNA, 17 bp, Homo sapiens
cctgtgcctgctgggca

SEQ ID NO: 5003775 - DNA, 20 bp, Homo sapiens
cctgtgcctgctgggcactg

SEQ ID NO: 5003776 - DNA, 13 bp, Homo sapiens
cctgttgtcctga

SEQ ID NO: 5003777 - DNA, 15 bp, Homo sapiens
ccttcaactctgtga

SEQ ID NO: 5003778 - DNA, 22 bp, Homo sapiens
ccttgctcaccaagctgttcca

SEQ ID NO: 5003779 - DNA, 19 bp, Homo sapiens
ccttttcttgtctctgagg

SEQ ID NO: 5003780 - DNA, 12 bp, Homo sapiens
cgactcagggac

SEQ ID NO: 5003781 - DNA, 14 bp, Homo sapiens
cgactcagggacct

SEQ ID NO: 5003782 - DNA, 21 bp, Homo sapiens
cgccactgcactccagtctgg

SEQ ID NO: 5003783 - DNA, 16 bp, Homo sapiens
cgctgtgctaggtctg

SEQ ID NO: 5003784 - DNA, 14 bp, Homo sapiens
cggcaggcagagaa

SEQ ID NO: 5003785 - DNA, 24 bp, Homo sapiens
cgggagcctctccttgcctggtga

SEQ ID NO: 5003786 - DNA, 20 bp, Homo sapiens
cgggaggtggaggttgcagt

SEQ ID NO: 5003787 - DNA, 11 bp, Homo sapiens
cgggctcagca

SEQ ID NO: 5003788 - DNA, 18 bp, Homo sapiens
cgtgctcttctgttctca

SEQ ID NO: 5003789 - DNA, 17 bp, Homo sapiens
ctaaagggtatgagctg

SEQ ID NO: 5003790 - DNA, 19 bp, Homo sapiens
ctaaagggtatgagctgga

SEQ ID NO: 5003791 - DNA, 20 bp, Homo sapiens
ctaaatgcaaacactgtgta

SEQ ID NO: 5003792 - DNA, 22 bp, Homo sapiens
ctaaccatgggctcagggccag

SEQ ID NO: 5003793 - DNA, 19 bp, Homo sapiens
ctaagcaatcactgggccc

SEQ ID NO: 5003794 - DNA, 22 bp, Homo sapiens
ctaagcaatcactgggcccaga

SEQ ID NO: 5003795 - DNA, 16 bp, Homo sapiens
ctaagcagaagactct

SEQ ID NO: 5003796 - DNA, 20 bp, Homo sapiens
ctaataaaagtcagagctca

SEQ ID NO: 5003797 - DNA, 21 bp, Homo sapiens
ctaataaaagtcagagctcag

SEQ ID NO: 5003798 - DNA, 22 bp, Homo sapiens
ctaataaaagtcagagctcagg

SEQ ID NO: 5003799 - DNA, 15 bp, Homo sapiens
ctaatccaatacctc

SEQ ID NO: 5003800 - DNA, 21 bp, Homo sapiens
ctacaaaataaagctgttctc

SEQ ID NO: 5003801 - DNA, 16 bp, Homo sapiens
ctacaatttaaagcaa

SEQ ID NO: 5003802 - DNA, 23 bp, Homo sapiens
ctacacagaccctgcccacccca

SEQ ID NO: 5003803 - DNA, 19 bp, Homo sapiens
ctaccaaatataaacttgt

SEQ ID NO: 5003804 - DNA, 20 bp, Homo sapiens
ctaccacacatctgtggaga

SEQ ID NO: 5003805 - DNA, 17 bp, Homo sapiens
ctactaggtctgctcct

SEQ ID NO: 5003806 - DNA, 19 bp, Homo sapiens
ctactaggtctgctcctga

SEQ ID NO: 5003807 - DNA, 14 bp, Homo sapiens
ctactgagaaactt

SEQ ID NO: 5003808 - DNA, 18 bp, Homo sapiens
ctacttttgcatgaaaat

SEQ ID NO: 5003809 - DNA, 13 bp, Homo sapiens
ctagaagctcagg

SEQ ID NO: 5003810 - DNA, 17 bp, Homo sapiens
ctagagcttccactgtc

SEQ ID NO: 5003811 - DNA, 22 bp, Homo sapiens
ctaggaagcaagatcgctgtgc

SEQ ID NO: 5003812 - DNA, 12 bp, Homo sapiens
ctagggctcaga

SEQ ID NO: 5003813 - DNA, 17 bp, Homo sapiens
ctagtcctgggggtaaa

SEQ ID NO: 5003814 - DNA, 13 bp, Homo sapiens
ctatattgtacac

SEQ ID NO: 5003815 - DNA, 16 bp, Homo sapiens
ctattctgccatggga

SEQ ID NO: 5003816 - DNA, 13 bp, Homo sapiens
ctcaaactgggta

SEQ ID NO: 5003817 - DNA, 12 bp, Homo sapiens
ctcaacagcagg

SEQ ID NO: 5003818 - DNA, 13 bp, Homo sapiens
ctcaacagcagga

SEQ ID NO: 5003819 - DNA, 18 bp, Homo sapiens
ctcaacagcaggaggcac

SEQ ID NO: 5003820 - DNA, 20 bp, Homo sapiens
ctcaaggaaggatgccttat

SEQ ID NO: 5003821 - DNA, 13 bp, Homo sapiens
ctcaatattttcc

SEQ ID NO: 5003822 - DNA, 16 bp, Homo sapiens
ctcacacccacctgct

SEQ ID NO: 5003823 - DNA, 23 bp, Homo sapiens
ctcaccaattccacttcctgccc

SEQ ID NO: 5003824 - DNA, 14 bp, Homo sapiens
ctcacctcccaggg

SEQ ID NO: 5003825 - DNA, 17 bp, Homo sapiens
ctcacctcccagggcta

SEQ ID NO: 5003826 - DNA, 22 bp, Homo sapiens
ctcactgtcagtcccactgcac

SEQ ID NO: 5003827 - DNA, 13 bp, Homo sapiens
ctcagatcccagg

SEQ ID NO: 5003828 - DNA, 14 bp, Homo sapiens
ctcagatcccaggg

SEQ ID NO: 5003829 - DNA, 20 bp, Homo sapiens
ctcaggcctcacctcccagg

SEQ ID NO: 5003830 - DNA, 11 bp, Homo sapiens
ctcagggccag

SEQ ID NO: 5003831 - DNA, 15 bp, Homo sapiens
ctcagggccaggtcc

SEQ ID NO: 5003832 - DNA, 20 bp, Homo sapiens
ctcaggttccctgccacact

SEQ ID NO: 5003833 - DNA, 13 bp, Homo sapiens
ctcaggtttctgg

SEQ ID NO: 5003834 - DNA, 19 bp, Homo sapiens
ctcaggtttctggacaaga

SEQ ID NO: 5003835 - DNA, 12 bp, Homo sapiens
ctcatcttcccc

SEQ ID NO: 5003836 - DNA, 15 bp, Homo sapiens
ctcatcttccccagc

SEQ ID NO: 5003837 - DNA, 16 bp, Homo sapiens
ctcatcttccccagcc

SEQ ID NO: 5003838 - DNA, 15 bp, Homo sapiens
ctcattcctgttctt

SEQ ID NO: 5003839 - DNA, 14 bp, Homo sapiens
ctccacccacttgc

SEQ ID NO: 5003840 - DNA, 16 bp, Homo sapiens
ctccacctccctgcaa

SEQ ID NO: 5003841 - DNA, 17 bp, Homo sapiens
ctccacctccctgcaat

SEQ ID NO: 5003842 - DNA, 14 bp, Homo sapiens
ctccactgacctgg

SEQ ID NO: 5003843 - DNA, 23 bp, Homo sapiens
ctccactgacctggttgtccagg

SEQ ID NO: 5003844 - DNA, 11 bp, Homo sapiens
ctccagacagg

SEQ ID NO: 5003845 - DNA, 14 bp, Homo sapiens
ctccagggccagga

SEQ ID NO: 5003846 - DNA, 15 bp, Homo sapiens
ctccattccctccac

SEQ ID NO: 5003847 - DNA, 17 bp, Homo sapiens
ctcccagggctacacag

SEQ ID NO: 5003848 - DNA, 12 bp, Homo sapiens
ctccccacctgc

SEQ ID NO: 5003849 - DNA, 13 bp, Homo sapiens
ctccccacctgct

SEQ ID NO: 5003850 - DNA, 19 bp, Homo sapiens
ctccctccacctccctgca

SEQ ID NO: 5003851 - DNA, 22 bp, Homo sapiens
ctccctccacctccctgcaata

SEQ ID NO: 5003852 - DNA, 14 bp, Homo sapiens
ctccctgcaataaa

SEQ ID NO: 5003853 - DNA, 12 bp, Homo sapiens
ctccctggagga

SEQ ID NO: 5003854 - DNA, 19 bp, Homo sapiens
ctccctggaggactctaga

SEQ ID NO: 5003855 - DNA, 15 bp, Homo sapiens
ctcctctgcttgcca

SEQ ID NO: 5003856 - DNA, 16 bp, Homo sapiens
ctcctctgcttgccat

SEQ ID NO: 5003857 - DNA, 17 bp, Homo sapiens
ctcctctgcttgccatc

SEQ ID NO: 5003858 - DNA, 21 bp, Homo sapiens
ctcctctgcttgccatccctc

SEQ ID NO: 5003859 - DNA, 16 bp, Homo sapiens
ctcctgaaccagtcct

SEQ ID NO: 5003860 - DNA, 20 bp, Homo sapiens
ctcctgaaccagtcctgctg

SEQ ID NO: 5003861 - DNA, 21 bp, Homo sapiens
ctcctgaaccagtcctgctgc

SEQ ID NO: 5003862 - DNA, 17 bp, Homo sapiens
ctcctgggcagctgcct

SEQ ID NO: 5003863 - DNA, 18 bp, Homo sapiens
ctcctgggcagctgcctc

SEQ ID NO: 5003864 - DNA, 15 bp, Homo sapiens
ctccttgcctggtga

SEQ ID NO: 5003865 - DNA, 21 bp, Homo sapiens
ctctactaggtctgctcctga

SEQ ID NO: 5003866 - DNA, 14 bp, Homo sapiens
ctctagaagctcag

SEQ ID NO: 5003867 - DNA, 16 bp, Homo sapiens
ctctagaagctcaggt

SEQ ID NO: 5003868 - DNA, 12 bp, Homo sapiens
ctctcctgggca

SEQ ID NO: 5003869 - DNA, 19 bp, Homo sapiens
ctctcctgggcagctgcct

SEQ ID NO: 5003870 - DNA, 20 bp, Homo sapiens
ctctcctgggcagctgcctc

SEQ ID NO: 5003871 - DNA, 17 bp, Homo sapiens
ctctccttgcctggtga

SEQ ID NO: 5003872 - DNA, 12 bp, Homo sapiens
ctctgagaacag

SEQ ID NO: 5003873 - DNA, 16 bp, Homo sapiens
ctctgaggagcccacg

SEQ ID NO: 5003874 - DNA, 17 bp, Homo sapiens
ctctgcctaaccatggg

SEQ ID NO: 5003875 - DNA, 21 bp, Homo sapiens
ctctgcctaaccatgggctca

SEQ ID NO: 5003876 - DNA, 12 bp, Homo sapiens
ctctgcttgcca

SEQ ID NO: 5003877 - DNA, 20 bp, Homo sapiens
ctctgtgcacttatttatga

SEQ ID NO: 5003878 - DNA, 16 bp, Homo sapiens
ctcttctgttctcaaa

SEQ ID NO: 5003879 - DNA, 20 bp, Homo sapiens
ctcttgaaggtgctgccacc

SEQ ID NO: 5003880 - DNA, 21 bp, Homo sapiens
ctctttcttattttgtaataa

SEQ ID NO: 5003881 - DNA, 22 bp, Homo sapiens
ctctttcttattttgtaataaa

SEQ ID NO: 5003882 - DNA, 22 bp, Homo sapiens
ctctttgagataatacattccg

SEQ ID NO: 5003883 - DNA, 22 bp, Homo sapiens
ctgaaccagtcctgctgcctgg

SEQ ID NO: 5003884 - DNA, 13 bp, Homo sapiens
ctgaactgtgagt

SEQ ID NO: 5003885 - DNA, 23 bp, Homo sapiens
ctgaagacaccgttcattcaggc

SEQ ID NO: 5003886 - DNA, 16 bp, Homo sapiens
ctgacaatgctgccat

SEQ ID NO: 5003887 - DNA, 18 bp, Homo sapiens
ctgacaatgctgccatgc

SEQ ID NO: 5003888 - DNA, 21 bp, Homo sapiens
ctgacaatgctgccatgccca

SEQ ID NO: 5003889 - DNA, 18 bp, Homo sapiens
ctgaccaaaaccagaggg

SEQ ID NO: 5003890 - DNA, 19 bp, Homo sapiens
ctgaccaaaaccagagggc

SEQ ID NO: 5003891 - DNA, 12 bp, Homo sapiens
ctgacctgctgt

SEQ ID NO: 5003892 - DNA, 23 bp, Homo sapiens
ctgacctgctgtggatgtcccta

SEQ ID NO: 5003893 - DNA, 16 bp, Homo sapiens
ctgacctggttgtcca

SEQ ID NO: 5003894 - DNA, 16 bp, Homo sapiens
ctgagaagatggcact

SEQ ID NO: 5003895 - DNA, 22 bp, Homo sapiens
ctgaggagcccacggggcaaag

SEQ ID NO: 5003896 - DNA, 20 bp, Homo sapiens
ctgagttgacttgacagaac

SEQ ID NO: 5003897 - DNA, 23 bp, Homo sapiens
ctgatcctaaccctgggctccct

SEQ ID NO: 5003898 - DNA, 20 bp, Homo sapiens
ctgatccttcaactctgtga

SEQ ID NO: 5003899 - DNA, 19 bp, Homo sapiens
ctgcaaaaggcctgtgatc

SEQ ID NO: 5003900 - DNA, 21 bp, Homo sapiens
ctgcaaaaggcctgtgatcca

SEQ ID NO: 5003901 - DNA, 22 bp, Homo sapiens
ctgcaaaaggcctgtgatccag

SEQ ID NO: 5003902 - DNA, 23 bp, Homo sapiens
ctgcaaaaggcctgtgatccagg

SEQ ID NO: 5003903 - DNA, 18 bp, Homo sapiens
ctgcacccccctgtgcct

SEQ ID NO: 5003904 - DNA, 22 bp, Homo sapiens
ctgcaggaatgctgacaatgct

SEQ ID NO: 5003905 - DNA, 17 bp, Homo sapiens
ctgccaatgccatgact

SEQ ID NO: 5003906 - DNA, 19 bp, Homo sapiens
ctgccaccccttggcactg

SEQ ID NO: 5003907 - DNA, 14 bp, Homo sapiens
ctgccaggcaccat

SEQ ID NO: 5003908 - DNA, 15 bp, Homo sapiens
ctgccatgggagagt

SEQ ID NO: 5003909 - DNA, 22 bp, Homo sapiens
ctgccatgggagagtccaggcc

SEQ ID NO: 5003910 - DNA, 13 bp, Homo sapiens
ctgcccaccccat

SEQ ID NO: 5003911 - DNA, 12 bp, Homo sapiens
ctgccctccagg

SEQ ID NO: 5003912 - DNA, 14 bp, Homo sapiens
ctgccctccagggc

SEQ ID NO: 5003913 - DNA, 16 bp, Homo sapiens
ctgccctccagggcca

SEQ ID NO: 5003914 - DNA, 19 bp, Homo sapiens
ctgccctctcctgggcagc

SEQ ID NO: 5003915 - DNA, 20 bp, Homo sapiens
ctgccctctcctgggcagct

SEQ ID NO: 5003916 - DNA, 23 bp, Homo sapiens
ctgccggttcttaaatccatcct

SEQ ID NO: 5003917 - DNA, 15 bp, Homo sapiens
ctgcctaaccatggg

SEQ ID NO: 5003918 - DNA, 19 bp, Homo sapiens
ctgcctaaccatgggctca

SEQ ID NO: 5003919 - DNA, 13 bp, Homo sapiens
ctgcctcccctcc

SEQ ID NO: 5003920 - DNA, 14 bp, Homo sapiens
ctgcctcccctcct

SEQ ID NO: 5003921 - DNA, 20 bp, Homo sapiens
ctgcctcccctcctctgctt

SEQ ID NO: 5003922 - DNA, 17 bp, Homo sapiens
ctgcctggagtcagtag

SEQ ID NO: 5003923 - DNA, 24 bp, Homo sapiens
ctgctcaggcctcacctcccaggg

SEQ ID NO: 5003924 - DNA, 14 bp, Homo sapiens
ctgctcctgaacca

SEQ ID NO: 5003925 - DNA, 17 bp, Homo sapiens
ctgctgcctggagtcag

SEQ ID NO: 5003926 - DNA, 10 bp, Homo sapiens
ctgctgctgt

SEQ ID NO: 5003927 - DNA, 19 bp, Homo sapiens
ctgctgggcactgggcact

SEQ ID NO: 5003928 - DNA, 13 bp, Homo sapiens
ctgctgggccagt

SEQ ID NO: 5003929 - DNA, 15 bp, Homo sapiens
ctgctgggccagtgg

SEQ ID NO: 5003930 - DNA, 18 bp, Homo sapiens
ctgctgggccagtggcac

SEQ ID NO: 5003931 - DNA, 17 bp, Homo sapiens
ctgctgtatgaatagct

SEQ ID NO: 5003932 - DNA, 20 bp, Homo sapiens
ctgctgtatgaatagctgtg

SEQ ID NO: 5003933 - DNA, 16 bp, Homo sapiens
ctgcttgccatccctc

SEQ ID NO: 5003934 - DNA, 19 bp, Homo sapiens
ctgcttgccatccctccct

SEQ ID NO: 5003935 - DNA, 21 bp, Homo sapiens
ctggaagccggccggctggga

SEQ ID NO: 5003936 - DNA, 15 bp, Homo sapiens
ctggacttgaaggtt

SEQ ID NO: 5003937 - DNA, 15 bp, Homo sapiens
ctggagctaaggcca

SEQ ID NO: 5003938 - DNA, 18 bp, Homo sapiens
ctggagctaaggccagct

SEQ ID NO: 5003939 - DNA, 22 bp, Homo sapiens
ctggaggactctagaagctcag

SEQ ID NO: 5003940 - DNA, 24 bp, Homo sapiens
ctggaggactctagaagctcaggt

SEQ ID NO: 5003941 - DNA, 16 bp, Homo sapiens
ctggagtcagtagcca

SEQ ID NO: 5003942 - DNA, 18 bp, Homo sapiens
ctggagtcagtagccaga

SEQ ID NO: 5003943 - DNA, 19 bp, Homo sapiens
ctggagtcagtagccagag

SEQ ID NO: 5003944 - DNA, 22 bp, Homo sapiens
ctggagtcatgtgcctctgtcc

SEQ ID NO: 5003945 - DNA, 17 bp, Homo sapiens
ctggatgcacagtgcct

SEQ ID NO: 5003946 - DNA, 13 bp, Homo sapiens
ctggcaagctgca

SEQ ID NO: 5003947 - DNA, 22 bp, Homo sapiens
ctggcaagctgcaaaaggcctg

SEQ ID NO: 5003948 - DNA, 14 bp, Homo sapiens
ctgggatgtttctg

SEQ ID NO: 5003949 - DNA, 16 bp, Homo sapiens
ctgggcactagctaga

SEQ ID NO: 5003950 - DNA, 13 bp, Homo sapiens
ctgggcagctgcc

SEQ ID NO: 5003951 - DNA, 16 bp, Homo sapiens
ctgggcagctgcctcc

SEQ ID NO: 5003952 - DNA, 20 bp, Homo sapiens
ctgggcagctgcctcccctc

SEQ ID NO: 5003953 - DNA, 12 bp, Homo sapiens
ctgggcattttc

SEQ ID NO: 5003954 - DNA, 17 bp, Homo sapiens
ctgggccagtggcactc

SEQ ID NO: 5003955 - DNA, 15 bp, Homo sapiens
ctgggcccagaggag

SEQ ID NO: 5003956 - DNA, 14 bp, Homo sapiens
ctgggctccctgga

SEQ ID NO: 5003957 - DNA, 14 bp, Homo sapiens
ctggggcagagtgg

SEQ ID NO: 5003958 - DNA, 15 bp, Homo sapiens
ctggggcagagtgga

SEQ ID NO: 5003959 - DNA, 21 bp, Homo sapiens
ctggggcagagtggagcccag

SEQ ID NO: 5003960 - DNA, 23 bp, Homo sapiens
ctggggcagagtggagcccaggg

SEQ ID NO: 5003961 - DNA, 17 bp, Homo sapiens
ctgggtcacgctcaagg

SEQ ID NO: 5003962 - DNA, 17 bp, Homo sapiens
ctgtcagtcccactgca

SEQ ID NO: 5003963 - DNA, 14 bp, Homo sapiens
ctgtccagggccca

SEQ ID NO: 5003964 - DNA, 22 bp, Homo sapiens
ctgtccagggcccatgtagctg

SEQ ID NO: 5003965 - DNA, 23 bp, Homo sapiens
ctgtccagggcccatgtagctgg

SEQ ID NO: 5003966 - DNA, 24 bp, Homo sapiens
ctgtccagggcccatgtagctggc

SEQ ID NO: 5003967 - DNA, 16 bp, Homo sapiens
ctgtgaatggctgtgc

SEQ ID NO: 5003968 - DNA, 19 bp, Homo sapiens
ctgtgaatggctgtgcccc

SEQ ID NO: 5003969 - DNA, 13 bp, Homo sapiens
ctgtgagtcctga

SEQ ID NO: 5003970 - DNA, 14 bp, Homo sapiens
ctgtgccccacctg

SEQ ID NO: 5003971 - DNA, 13 bp, Homo sapiens
ctgtgcctgctgg

SEQ ID NO: 5003972 - DNA, 17 bp, Homo sapiens
ctgtgcctgctgggcac

SEQ ID NO: 5003973 - DNA, 14 bp, Homo sapiens
ctgtgctaggtctg

SEQ ID NO: 5003974 - DNA, 21 bp, Homo sapiens
ctgtgtcacttgtaggtttct

SEQ ID NO: 5003975 - DNA, 22 bp, Homo sapiens
ctgtgtgggaaaatggcagaaa

SEQ ID NO: 5003976 - DNA, 14 bp, Homo sapiens
ctgttctcaaatgc

SEQ ID NO: 5003977 - DNA, 15 bp, Homo sapiens
ctgttctcattcctg

SEQ ID NO: 5003978 - DNA, 12 bp, Homo sapiens
ctgttgtcctga

SEQ ID NO: 5003979 - DNA, 15 bp, Homo sapiens
cttattttgtaataa

SEQ ID NO: 5003980 - DNA, 16 bp, Homo sapiens
cttattttgtaataaa

SEQ ID NO: 5003981 - DNA, 20 bp, Homo sapiens
cttattttgtaataaactct

SEQ ID NO: 5003982 - DNA, 13 bp, Homo sapiens
cttcacaaaatgc

SEQ ID NO: 5003983 - DNA, 20 bp, Homo sapiens
cttcacctttcccactttct

SEQ ID NO: 5003984 - DNA, 14 bp, Homo sapiens
cttcagctgatcct

SEQ ID NO: 5003985 - DNA, 17 bp, Homo sapiens
cttccactgtcagccct

SEQ ID NO: 5003986 - DNA, 22 bp, Homo sapiens
cttccccagacttctctttctt

SEQ ID NO: 5003987 - DNA, 22 bp, Homo sapiens
cttcctaccaaatataaacttg

SEQ ID NO: 5003988 - DNA, 16 bp, Homo sapiens
cttcctcagtcctgga

SEQ ID NO: 5003989 - DNA, 21 bp, Homo sapiens
cttccttaattcactcccaca

SEQ ID NO: 5003990 - DNA, 13 bp, Homo sapiens
cttctaccagacc

SEQ ID NO: 5003991 - DNA, 15 bp, Homo sapiens
cttctcactttcctt

SEQ ID NO: 5003992 - DNA, 21 bp, Homo sapiens
cttctctttcttattttgtaa

SEQ ID NO: 5003993 - DNA, 15 bp, Homo sapiens
cttctgttctcaaat

SEQ ID NO: 5003994 - DNA, 19 bp, Homo sapiens
cttgaaggtgctgccaccc

SEQ ID NO: 5003995 - DNA, 14 bp, Homo sapiens
cttgacagaacact

SEQ ID NO: 5003996 - DNA, 16 bp, Homo sapiens
cttgacagaacactgt

SEQ ID NO: 5003997 - DNA, 16 bp, Homo sapiens
cttgccatccctccct

SEQ ID NO: 5003998 - DNA, 22 bp, Homo sapiens
cttgccatccctccctccacct

SEQ ID NO: 5003999 - DNA, 14 bp, Homo sapiens
cttgcctgtcaccc

SEQ ID NO: 5004000 - DNA, 23 bp, Homo sapiens
cttgctggagtcatgtgcctctg

SEQ ID NO: 5004001 - DNA, 18 bp, Homo sapiens
cttggccgactcagggac

SEQ ID NO: 5004002 - DNA, 19 bp, Homo sapiens
cttgggtctgtgtcacttg

SEQ ID NO: 5004003 - DNA, 13 bp, Homo sapiens
cttgtctctgagg

SEQ ID NO: 5004004 - DNA, 22 bp, Homo sapiens
cttgtgtttttaactcaatatt

SEQ ID NO: 5004005 - DNA, 12 bp, Homo sapiens
ctttaatataaa

SEQ ID NO: 5004006 - DNA, 17 bp, Homo sapiens
ctttagtacatggagct

SEQ ID NO: 5004007 - DNA, 20 bp, Homo sapiens
ctttagtacatggagctcag

SEQ ID NO: 5004008 - DNA, 21 bp, Homo sapiens
ctttagtacatggagctcagg

SEQ ID NO: 5004009 - DNA, 20 bp, Homo sapiens
ctttcaatggtttgcaagga

SEQ ID NO: 5004010 - DNA, 21 bp, Homo sapiens
ctttcaatggtttgcaaggaa

SEQ ID NO: 5004011 - DNA, 17 bp, Homo sapiens
ctttcagtgaaagcatc

SEQ ID NO: 5004012 - DNA, 23 bp, Homo sapiens
ctttccttttcttgtctctgagg

SEQ ID NO: 5004013 - DNA, 20 bp, Homo sapiens
ctttcttattttgtaataaa

SEQ ID NO: 5004014 - DNA, 22 bp, Homo sapiens
ctttcttattttgtaataaact

SEQ ID NO: 5004015 - DNA, 23 bp, Homo sapiens
ctttcttattttgtaataaactc

SEQ ID NO: 5004016 - DNA, 15 bp, Homo sapiens
ctttcttctaccaga

SEQ ID NO: 5004017 - DNA, 20 bp, Homo sapiens
ctttgagataatacattccg

SEQ ID NO: 5004018 - DNA, 21 bp, Homo sapiens
ctttgagataatacattccga

SEQ ID NO: 5004019 - DNA, 20 bp, Homo sapiens
cttttagcacatcactgaga

SEQ ID NO: 5004020 - DNA, 17 bp, Homo sapiens
cttttcttgtctctgag

SEQ ID NO: 5004021 - DNA, 21 bp, Homo sapiens
gaaaccattatgaagaagaga

SEQ ID NO: 5004022 - DNA, 14 bp, Homo sapiens
gaaagacagagctg

SEQ ID NO: 5004023 - DNA, 16 bp, Homo sapiens
gaaagagatacagagg

SEQ ID NO: 5004024 - DNA, 13 bp, Homo sapiens
gaaagatgtccca

SEQ ID NO: 5004025 - DNA, 20 bp, Homo sapiens
gaaagatgtcccacagggac

SEQ ID NO: 5004026 - DNA, 16 bp, Homo sapiens
gaaccagtcctgctgc

SEQ ID NO: 5004027 - DNA, 18 bp, Homo sapiens
gaaccagtcctgctgcct

SEQ ID NO: 5004028 - DNA, 21 bp, Homo sapiens
gaaccagtcctgctgcctgga

SEQ ID NO: 5004029 - DNA, 23 bp, Homo sapiens
gaaccagtcctgctgcctggagt

SEQ ID NO: 5004030 - DNA, 17 bp, Homo sapiens
gaactgccaccttgggt

SEQ ID NO: 5004031 - DNA, 21 bp, Homo sapiens
gaagactctccactgacctgg

SEQ ID NO: 5004032 - DNA, 22 bp, Homo sapiens
gaagagtccttttagcacatca

SEQ ID NO: 5004033 - DNA, 13 bp, Homo sapiens
gaagatggcactg

SEQ ID NO: 5004034 - DNA, 20 bp, Homo sapiens
gaagatggcactgtccaggg

SEQ ID NO: 5004035 - DNA, 19 bp, Homo sapiens
gaagcaagatcgctgtgct

SEQ ID NO: 5004036 - DNA, 20 bp, Homo sapiens
gaagctcaggttccctgcca

SEQ ID NO: 5004037 - DNA, 18 bp, Homo sapiens
gaaggaaaaggcagggag

SEQ ID NO: 5004038 - DNA, 21 bp, Homo sapiens
gaaggcacaggtgtaaatata

SEQ ID NO: 5004039 - DNA, 13 bp, Homo sapiens
gaaggccaggcct

SEQ ID NO: 5004040 - DNA, 14 bp, Homo sapiens
gaaggccaggcctc

SEQ ID NO: 5004041 - DNA, 17 bp, Homo sapiens
gaaggcggcaggcagag

SEQ ID NO: 5004042 - DNA, 19 bp, Homo sapiens
gaaggggacagcgccacct

SEQ ID NO: 5004043 - DNA, 13 bp, Homo sapiens
gaaggtgctgcca

SEQ ID NO: 5004044 - DNA, 15 bp, Homo sapiens
gaagtggagtgacta

SEQ ID NO: 5004045 - DNA, 14 bp, Homo sapiens
gaataaagaaaaac

SEQ ID NO: 5004046 - DNA, 22 bp, Homo sapiens
gaatgacatcaacattccccca

SEQ ID NO: 5004047 - DNA, 21 bp, Homo sapiens
gaatgctgacaatgctgccat

SEQ ID NO: 5004048 - DNA, 13 bp, Homo sapiens
gaatggctgtgcc

SEQ ID NO: 5004049 - DNA, 18 bp, Homo sapiens
gaattaagttagggaatg

SEQ ID NO: 5004050 - DNA, 17 bp, Homo sapiens
gaatttcccacataccc

SEQ ID NO: 5004051 - DNA, 14 bp, Homo sapiens
gaatttggcccaga

SEQ ID NO: 5004052 - DNA, 15 bp, Homo sapiens
gacaattgtcttttt

SEQ ID NO: 5004053 - DNA, 23 bp, Homo sapiens
gacacacactggctcctggacct

SEQ ID NO: 5004054 - DNA, 14 bp, Homo sapiens
gacagaacactgtc

SEQ ID NO: 5004055 - DNA, 16 bp, Homo sapiens
gacagacacacactgg

SEQ ID NO: 5004056 - DNA, 12 bp, Homo sapiens
gacagcagctgg

SEQ ID NO: 5004057 - DNA, 20 bp, Homo sapiens
gacaggaggagtgggacaga

SEQ ID NO: 5004058 - DNA, 16 bp, Homo sapiens
gacatgcagctctgat

SEQ ID NO: 5004059 - DNA, 16 bp, Homo sapiens
gaccaaaaccagaggg

SEQ ID NO: 5004060 - DNA, 17 bp, Homo sapiens
gaccaaaaccagagggc

SEQ ID NO: 5004061 - DNA, 20 bp, Homo sapiens
gaccaaaaccagagggcagt

SEQ ID NO: 5004062 - DNA, 21 bp, Homo sapiens
gaccaaaaccagagggcagtc

SEQ ID NO: 5004063 - DNA, 12 bp, Homo sapiens
gaccctgcccac

SEQ ID NO: 5004064 - DNA, 15 bp, Homo sapiens
gaccctgcccacccc

SEQ ID NO: 5004065 - DNA, 16 bp, Homo sapiens
gaccctgcccacccca

SEQ ID NO: 5004066 - DNA, 23 bp, Homo sapiens
gacctaaagggtatgagctggag

SEQ ID NO: 5004067 - DNA, 20 bp, Homo sapiens
gacctactaaaaatataaaa

SEQ ID NO: 5004068 - DNA, 18 bp, Homo sapiens
gacctgctgtggatgtcc

SEQ ID NO: 5004069 - DNA, 15 bp, Homo sapiens
gacctggttgtccag

SEQ ID NO: 5004070 - DNA, 19 bp, Homo sapiens
gacctggttgtccaggtct

SEQ ID NO: 5004071 - DNA, 20 bp, Homo sapiens
gactacttgggagcaccgcc

SEQ ID NO: 5004072 - DNA, 13 bp, Homo sapiens
gactcagggacct

SEQ ID NO: 5004073 - DNA, 21 bp, Homo sapiens
gactctagaagctcaggttcc

SEQ ID NO: 5004074 - DNA, 11 bp, Homo sapiens
gactctgccta

SEQ ID NO: 5004075 - DNA, 22 bp, Homo sapiens
gactcttttccaaacacaggca

SEQ ID NO: 5004076 - DNA, 19 bp, Homo sapiens
gactgctcaggcctcacct

SEQ ID NO: 5004077 - DNA, 15 bp, Homo sapiens
gacttcacaaaatgc

SEQ ID NO: 5004078 - DNA, 14 bp, Homo sapiens
gacttctctttctt

SEQ ID NO: 5004079 - DNA, 14 bp, Homo sapiens
gagaagatggcact

SEQ ID NO: 5004080 - DNA, 22 bp, Homo sapiens
gagaagatggcactgtccaggg

SEQ ID NO: 5004081 - DNA, 12 bp, Homo sapiens
gagacagacaca

SEQ ID NO: 5004082 - DNA, 14 bp, Homo sapiens
gagagagtgctgag

SEQ ID NO: 5004083 - DNA, 18 bp, Homo sapiens
gagaggcatgggggccca

SEQ ID NO: 5004084 - DNA, 23 bp, Homo sapiens
gagaggcatgggggcccaaaggg

SEQ ID NO: 5004085 - DNA, 14 bp, Homo sapiens
gagagtccaggcct

SEQ ID NO: 5004086 - DNA, 16 bp, Homo sapiens
gagagtccaggcctgg

SEQ ID NO: 5004087 - DNA, 13 bp, Homo sapiens
gagagtgctgaga

SEQ ID NO: 5004088 - DNA, 12 bp, Homo sapiens
gagataatacat

SEQ ID NO: 5004089 - DNA, 22 bp, Homo sapiens
gagcacaagaggagatccaggg

SEQ ID NO: 5004090 - DNA, 17 bp, Homo sapiens
gagcccacggggcaaag

SEQ ID NO: 5004091 - DNA, 13 bp, Homo sapiens
gagcccagggtgc

SEQ ID NO: 5004092 - DNA, 16 bp, Homo sapiens
gagcccagggtgctgg

SEQ ID NO: 5004093 - DNA, 16 bp, Homo sapiens
gagcctgaggcatgag

SEQ ID NO: 5004094 - DNA, 21 bp, Homo sapiens
gagcgtggggaggggctgagg

SEQ ID NO: 5004095 - DNA, 15 bp, Homo sapiens
gagctaaggccagct

SEQ ID NO: 5004096 - DNA, 17 bp, Homo sapiens
gagctcaggacactaat

SEQ ID NO: 5004097 - DNA, 19 bp, Homo sapiens
gagctcaggtttctggaca

SEQ ID NO: 5004098 - DNA, 20 bp, Homo sapiens
gagctgagattgcgccactg

SEQ ID NO: 5004099 - DNA, 19 bp, Homo sapiens
gagctggagctaaggccag

SEQ ID NO: 5004100 - DNA, 15 bp, Homo sapiens
gagcttccactgtca

SEQ ID NO: 5004101 - DNA, 19 bp, Homo sapiens
gagcttccactgtcagccc

SEQ ID NO: 5004102 - DNA, 17 bp, Homo sapiens
gaggaacctcaaactgg

SEQ ID NO: 5004103 - DNA, 16 bp, Homo sapiens
gaggactctagaagct

SEQ ID NO: 5004104 - DNA, 14 bp, Homo sapiens
gaggagacagacac

SEQ ID NO: 5004105 - DNA, 14 bp, Homo sapiens
gaggagcccacggg

SEQ ID NO: 5004106 - DNA, 22 bp, Homo sapiens
gaggagcccacggggcaaagct

SEQ ID NO: 5004107 - DNA, 23 bp, Homo sapiens
gaggagcccacggggcaaagctg

SEQ ID NO: 5004108 - DNA, 14 bp, Homo sapiens
gaggagtgggacag

SEQ ID NO: 5004109 - DNA, 13 bp, Homo sapiens
gaggcacagcagt

SEQ ID NO: 5004110 - DNA, 16 bp, Homo sapiens
gaggcatgggggccca

SEQ ID NO: 5004111 - DNA, 17 bp, Homo sapiens
gaggcatgggggcccaa

SEQ ID NO: 5004112 - DNA, 22 bp, Homo sapiens
gaggggcctcatcttccccagc

SEQ ID NO: 5004113 - DNA, 23 bp, Homo sapiens
gaggggcctcatcttccccagcc

SEQ ID NO: 5004114 - DNA, 20 bp, Homo sapiens
gagggtggggtgccccagct

SEQ ID NO: 5004115 - DNA, 19 bp, Homo sapiens
gaggtggaggttgcagtga

SEQ ID NO: 5004116 - DNA, 18 bp, Homo sapiens
gagtaggctccagacagg

SEQ ID NO: 5004117 - DNA, 20 bp, Homo sapiens
gagtaggctccagacaggag

SEQ ID NO: 5004118 - DNA, 14 bp, Homo sapiens
gagtcagtagccag

SEQ ID NO: 5004119 - DNA, 13 bp, Homo sapiens
gagtccaggcctg

SEQ ID NO: 5004120 - DNA, 21 bp, Homo sapiens
gagtcctgatcctaaccctgg

SEQ ID NO: 5004121 - DNA, 22 bp, Homo sapiens
gagtcctgatcctaaccctggg

SEQ ID NO: 5004122 - DNA, 15 bp, Homo sapiens
gagtggagcccaggg

SEQ ID NO: 5004123 - DNA, 16 bp, Homo sapiens
gagtggagcccagggt

SEQ ID NO: 5004124 - DNA, 15 bp, Homo sapiens
gagtgggacagacag

SEQ ID NO: 5004125 - DNA, 16 bp, Homo sapiens
gagtgggacagacagc

SEQ ID NO: 5004126 - DNA, 22 bp, Homo sapiens
gagtgggacagacagcagctgg

SEQ ID NO: 5004127 - DNA, 23 bp, Homo sapiens
gagtgggacagacagcagctgga

SEQ ID NO: 5004128 - DNA, 14 bp, Homo sapiens
gataatacattccg

SEQ ID NO: 5004129 - DNA, 14 bp, Homo sapiens
gataccccaaagtc

SEQ ID NO: 5004130 - DNA, 16 bp, Homo sapiens
gataccccaaagtcca

SEQ ID NO: 5004131 - DNA, 18 bp, Homo sapiens
gatagaatttggcccaga

SEQ ID NO: 5004132 - DNA, 20 bp, Homo sapiens
gatccaggaaagatgtccca

SEQ ID NO: 5004133 - DNA, 22 bp, Homo sapiens
gatcccagggtacactcttctc

SEQ ID NO: 5004134 - DNA, 21 bp, Homo sapiens
gatcctaaccctgggctccct

SEQ ID NO: 5004135 - DNA, 18 bp, Homo sapiens
gatccttcaactctgtga

SEQ ID NO: 5004136 - DNA, 17 bp, Homo sapiens
gatgagagagtgctgag

SEQ ID NO: 5004137 - DNA, 16 bp, Homo sapiens
gatgcagcattatgat

SEQ ID NO: 5004138 - DNA, 18 bp, Homo sapiens
gatgctcattccatgact

SEQ ID NO: 5004139 - DNA, 22 bp, Homo sapiens
gatgctcattccatgactctgc

SEQ ID NO: 5004140 - DNA, 15 bp, Homo sapiens
gatggagaggcatgg

SEQ ID NO: 5004141 - DNA, 14 bp, Homo sapiens
gatggcactgtcca

SEQ ID NO: 5004142 - DNA, 18 bp, Homo sapiens
gatgggagtaggctccag

SEQ ID NO: 5004143 - DNA, 23 bp, Homo sapiens
gatgggagtaggctccagacagg

SEQ ID NO: 5004144 - DNA, 19 bp, Homo sapiens
gatgtcccacagggaccac

SEQ ID NO: 5004145 - DNA, 18 bp, Homo sapiens
gatgtccctattctgcca

SEQ ID NO: 5004146 - DNA, 16 bp, Homo sapiens
gatgtggcaggggcag

SEQ ID NO: 5004147 - DNA, 18 bp, Homo sapiens
gatgtggcaggggcagtg

SEQ ID NO: 5004148 - DNA, 18 bp, Homo sapiens
gattaatatggggatgca

SEQ ID NO: 5004149 - DNA, 16 bp, Homo sapiens
gcaaacactgtgtatt

SEQ ID NO: 5004150 - DNA, 18 bp, Homo sapiens
gcaaagctgctgggccag

SEQ ID NO: 5004151 - DNA, 17 bp, Homo sapiens
gcaaaggagtagaaaga

SEQ ID NO: 5004152 - DNA, 13 bp, Homo sapiens
gcaacctgttctt

SEQ ID NO: 5004153 - DNA, 16 bp, Homo sapiens
gcaataaaatgggttt

SEQ ID NO: 5004154 - DNA, 15 bp, Homo sapiens
gcaatcactgggccc

SEQ ID NO: 5004155 - DNA, 21 bp, Homo sapiens
gcaatcactgggcccagagga

SEQ ID NO: 5004156 - DNA, 17 bp, Homo sapiens
gcacagcccaaagaagg

SEQ ID NO: 5004157 - DNA, 15 bp, Homo sapiens
gcacaggtgtaaata

SEQ ID NO: 5004158 - DNA, 12 bp, Homo sapiens
gcacagtgcctg

SEQ ID NO: 5004159 - DNA, 13 bp, Homo sapiens
gcacagtgcctga

SEQ ID NO: 5004160 - DNA, 22 bp, Homo sapiens
gcacagtgcctgatgggagtag

SEQ ID NO: 5004161 - DNA, 19 bp, Homo sapiens
gcacatcactgagaagatg

SEQ ID NO: 5004162 - DNA, 14 bp, Homo sapiens
gcaccatctgccaa

SEQ ID NO: 5004163 - DNA, 16 bp, Homo sapiens
gcacccccctgtgcct

SEQ ID NO: 5004164 - DNA, 17 bp, Homo sapiens
gcacccccctgtgcctg

SEQ ID NO: 5004165 - DNA, 20 bp, Homo sapiens
gcacccccctgtgcctgctg

SEQ ID NO: 5004166 - DNA, 20 bp, Homo sapiens
gcactcctcggtactcccat

SEQ ID NO: 5004167 - DNA, 16 bp, Homo sapiens
gcactgtccagggccc

SEQ ID NO: 5004168 - DNA, 20 bp, Homo sapiens
gcactgtccagggcccatgt

SEQ ID NO: 5004169 - DNA, 20 bp, Homo sapiens
gcagagtggagcccagggtg

SEQ ID NO: 5004170 - DNA, 21 bp, Homo sapiens
gcagagtggagcccagggtgc

SEQ ID NO: 5004171 - DNA, 22 bp, Homo sapiens
gcagagtggagcccagggtgct

SEQ ID NO: 5004172 - DNA, 20 bp, Homo sapiens
gcagatagaatttggcccag

SEQ ID NO: 5004173 - DNA, 15 bp, Homo sapiens
gcagctgcctcccct

SEQ ID NO: 5004174 - DNA, 18 bp, Homo sapiens
gcagctgcctcccctcct

SEQ ID NO: 5004175 - DNA, 14 bp, Homo sapiens
gcaggacactgcag

SEQ ID NO: 5004176 - DNA, 14 bp, Homo sapiens
gcaggaggcacagc

SEQ ID NO: 5004177 - DNA, 16 bp, Homo sapiens
gcaggaggcacagcag

SEQ ID NO: 5004178 - DNA, 15 bp, Homo sapiens
gcaggcagagaagtg

SEQ ID NO: 5004179 - DNA, 12 bp, Homo sapiens
gcaggggcagtg

SEQ ID NO: 5004180 - DNA, 16 bp, Homo sapiens
gcaggggcagtggcct

SEQ ID NO: 5004181 - DNA, 15 bp, Homo sapiens
gcagtaagtcttttt

SEQ ID NO: 5004182 - DNA, 18 bp, Homo sapiens
gcagtaagtcttttttga

SEQ ID NO: 5004183 - DNA, 13 bp, Homo sapiens
gcagtcacaggcc

SEQ ID NO: 5004184 - DNA, 18 bp, Homo sapiens
gcagtcacaggcccagga

SEQ ID NO: 5004185 - DNA, 16 bp, Homo sapiens
gcagtggcctggatgc

SEQ ID NO: 5004186 - DNA, 20 bp, Homo sapiens
gcagtggcctggatgcacag

SEQ ID NO: 5004187 - DNA, 17 bp, Homo sapiens
gcagttcagagctgccc

SEQ ID NO: 5004188 - DNA, 18 bp, Homo sapiens
gcagttcagagctgccct

SEQ ID NO: 5004189 - DNA, 20 bp, Homo sapiens
gcagttcagagctgccctct

SEQ ID NO: 5004190 - DNA, 16 bp, Homo sapiens
gcatttcccccaggga

SEQ ID NO: 5004191 - DNA, 17 bp, Homo sapiens
gcatttcccccagggaa

SEQ ID NO: 5004192 - DNA, 15 bp, Homo sapiens
gccaaagcagacatt

SEQ ID NO: 5004193 - DNA, 22 bp, Homo sapiens
gccaatgccatgactgctcagg

SEQ ID NO: 5004194 - DNA, 20 bp, Homo sapiens
gccaccttgggtctgtgtca

SEQ ID NO: 5004195 - DNA, 15 bp, Homo sapiens
gccacgttaagtcca

SEQ ID NO: 5004196 - DNA, 16 bp, Homo sapiens
gccagagttgttctca

SEQ ID NO: 5004197 - DNA, 14 bp, Homo sapiens
gccagcagttcaga

SEQ ID NO: 5004198 - DNA, 20 bp, Homo sapiens
gccagcagttcagagctgcc

SEQ ID NO: 5004199 - DNA, 18 bp, Homo sapiens
gccagctagagcttccac

SEQ ID NO: 5004200 - DNA, 16 bp, Homo sapiens
gccaggattcaggcct

SEQ ID NO: 5004201 - DNA, 18 bp, Homo sapiens
gccaggattcaggcctct

SEQ ID NO: 5004202 - DNA, 23 bp, Homo sapiens
gccaggattcaggcctctgagga

SEQ ID NO: 5004203 - DNA, 13 bp, Homo sapiens
gccagtggcactc

SEQ ID NO: 5004204 - DNA, 20 bp, Homo sapiens
gccatcatgtgcctggaaat

SEQ ID NO: 5004205 - DNA, 11 bp, Homo sapiens
gccatccctcc

SEQ ID NO: 5004206 - DNA, 14 bp, Homo sapiens
gccatccctccctc

SEQ ID NO: 5004207 - DNA, 15 bp, Homo sapiens
gccatccctccctcc

SEQ ID NO: 5004208 - DNA, 18 bp, Homo sapiens
gccatccctccctccacc

SEQ ID NO: 5004209 - DNA, 15 bp, Homo sapiens
gccatgactgctcag

SEQ ID NO: 5004210 - DNA, 17 bp, Homo sapiens
gccatgactgctcaggc

SEQ ID NO: 5004211 - DNA, 20 bp, Homo sapiens
gccatgactgctcaggcctc

SEQ ID NO: 5004212 - DNA, 21 bp, Homo sapiens
gccatgactgctcaggcctca

SEQ ID NO: 5004213 - DNA, 19 bp, Homo sapiens
gccatgggagagtccaggc

SEQ ID NO: 5004214 - DNA, 20 bp, Homo sapiens
gccatgggagagtccaggcc

SEQ ID NO: 5004215 - DNA, 22 bp, Homo sapiens
gccatgggagagtccaggcctg

SEQ ID NO: 5004216 - DNA, 14 bp, Homo sapiens
gcccaaaggggagc

SEQ ID NO: 5004217 - DNA, 18 bp, Homo sapiens
gcccaccccatccctggc

SEQ ID NO: 5004218 - DNA, 22 bp, Homo sapiens
gcccacggggcaaagctgctgg

SEQ ID NO: 5004219 - DNA, 18 bp, Homo sapiens
gcccagaggagaggagac

SEQ ID NO: 5004220 - DNA, 18 bp, Homo sapiens
gcccagggtgctgggatg

SEQ ID NO: 5004221 - DNA, 19 bp, Homo sapiens
gcccatgtagctggcaagc

SEQ ID NO: 5004222 - DNA, 22 bp, Homo sapiens
gcccatgtagctggcaagctgc

SEQ ID NO: 5004223 - DNA, 14 bp, Homo sapiens
gccccaactgcagg

SEQ ID NO: 5004224 - DNA, 20 bp, Homo sapiens
gccccactgccctccagggc

SEQ ID NO: 5004225 - DNA, 19 bp, Homo sapiens
gccctcactgtcagtccca

SEQ ID NO: 5004226 - DNA, 20 bp, Homo sapiens
gccctcactgtcagtcccac

SEQ ID NO: 5004227 - DNA, 23 bp, Homo sapiens
gccctcactgtcagtcccactgc

SEQ ID NO: 5004228 - DNA, 15 bp, Homo sapiens
gccctcagatcccag

SEQ ID NO: 5004229 - DNA, 20 bp, Homo sapiens
gccctcagatcccagggtac

SEQ ID NO: 5004230 - DNA, 14 bp, Homo sapiens
gccctccagggcca

SEQ ID NO: 5004231 - DNA, 15 bp, Homo sapiens
gccctccagggccag

SEQ ID NO: 5004232 - DNA, 21 bp, Homo sapiens
gccctccagggccaggattca

SEQ ID NO: 5004233 - DNA, 22 bp, Homo sapiens
gccctccagggccaggattcag

SEQ ID NO: 5004234 - DNA, 13 bp, Homo sapiens
gccctccccacct

SEQ ID NO: 5004235 - DNA, 14 bp, Homo sapiens
gccctccccacctg

SEQ ID NO: 5004236 - DNA, 15 bp, Homo sapiens
gccctccccacctgc

SEQ ID NO: 5004237 - DNA, 16 bp, Homo sapiens
gccctccccacctgct

SEQ ID NO: 5004238 - DNA, 20 bp, Homo sapiens
gccctccccacctgctcacc

SEQ ID NO: 5004239 - DNA, 21 bp, Homo sapiens
gccctccccacctgctcacca

SEQ ID NO: 5004240 - DNA, 15 bp, Homo sapiens
gccctctcctgggca

SEQ ID NO: 5004241 - DNA, 21 bp, Homo sapiens
gccctctcctgggcagctgcc

SEQ ID NO: 5004242 - DNA, 15 bp, Homo sapiens
gccgactcagggacc

SEQ ID NO: 5004243 - DNA, 20 bp, Homo sapiens
gcctaaccatgggctcaggg

SEQ ID NO: 5004244 - DNA, 17 bp, Homo sapiens
gcctcaacagcaggagg

SEQ ID NO: 5004245 - DNA, 19 bp, Homo sapiens
gcctcatcttccccagccc

SEQ ID NO: 5004246 - DNA, 11 bp, Homo sapiens
gcctcccctcc

SEQ ID NO: 5004247 - DNA, 14 bp, Homo sapiens
gcctcccctcctct

SEQ ID NO: 5004248 - DNA, 19 bp, Homo sapiens
gcctcccctcctctgcttg

SEQ ID NO: 5004249 - DNA, 16 bp, Homo sapiens
gcctctactaggtctg

SEQ ID NO: 5004250 - DNA, 22 bp, Homo sapiens
gcctctactaggtctgctcctg

SEQ ID NO: 5004251 - DNA, 16 bp, Homo sapiens
gcctctccttgcctgg

SEQ ID NO: 5004252 - DNA, 20 bp, Homo sapiens
gcctctgaggagcccacggg

SEQ ID NO: 5004253 - DNA, 21 bp, Homo sapiens
gcctgatgggagtaggctcca

SEQ ID NO: 5004254 - DNA, 22 bp, Homo sapiens
gcctgatgggagtaggctccag

SEQ ID NO: 5004255 - DNA, 12 bp, Homo sapiens
gcctgctgggca

SEQ ID NO: 5004256 - DNA, 13 bp, Homo sapiens
gcctgctgggcac

SEQ ID NO: 5004257 - DNA, 16 bp, Homo sapiens
gcctgctgggcactgg

SEQ ID NO: 5004258 - DNA, 15 bp, Homo sapiens
gcctggaaattaaac

SEQ ID NO: 5004259 - DNA, 19 bp, Homo sapiens
gcctggagtcagtagccag

SEQ ID NO: 5004260 - DNA, 20 bp, Homo sapiens
gcctggagtcagtagccaga

SEQ ID NO: 5004261 - DNA, 21 bp, Homo sapiens
gcctggagtcagtagccagag

SEQ ID NO: 5004262 - DNA, 19 bp, Homo sapiens
gcctggatgcacagtgcct

SEQ ID NO: 5004263 - DNA, 17 bp, Homo sapiens
gcctgggtcacgctcaa

SEQ ID NO: 5004264 - DNA, 14 bp, Homo sapiens
gcctggttagaggc

SEQ ID NO: 5004265 - DNA, 17 bp, Homo sapiens
gcctgtcaccccagtca

SEQ ID NO: 5004266 - DNA, 13 bp, Homo sapiens
gcctgtgatccag

SEQ ID NO: 5004267 - DNA, 14 bp, Homo sapiens
gcctgtgatccagg

SEQ ID NO: 5004268 - DNA, 17 bp, Homo sapiens
gcgacttcacaaaatgc

SEQ ID NO: 5004269 - DNA, 14 bp, Homo sapiens
gcggcaggcagaga

SEQ ID NO: 5004270 - DNA, 18 bp, Homo sapiens
gcggcaggcagagaagtg

SEQ ID NO: 5004271 - DNA, 19 bp, Homo sapiens
gcgtggggaggggctgagg

SEQ ID NO: 5004272 - DNA, 20 bp, Homo sapiens
gcgtggggaggggctgagga

SEQ ID NO: 5004273 - DNA, 13 bp, Homo sapiens
gctaaatgcaaac

SEQ ID NO: 5004274 - DNA, 21 bp, Homo sapiens
gctaactagcttggaaactgg

SEQ ID NO: 5004275 - DNA, 18 bp, Homo sapiens
gctaaggccagctagagc

SEQ ID NO: 5004276 - DNA, 22 bp, Homo sapiens
gctaataaaagtcagagctcag

SEQ ID NO: 5004277 - DNA, 20 bp, Homo sapiens
gctacacagaccctgcccac

SEQ ID NO: 5004278 - DNA, 14 bp, Homo sapiens
gctactcttcagaa

SEQ ID NO: 5004279 - DNA, 22 bp, Homo sapiens
gctatattaggcatgttcaggg

SEQ ID NO: 5004280 - DNA, 16 bp, Homo sapiens
gctcaccaattccact

SEQ ID NO: 5004281 - DNA, 23 bp, Homo sapiens
gctcaccaattccacttcctgcc

SEQ ID NO: 5004282 - DNA, 17 bp, Homo sapiens
gctcaggcctcacctcc

SEQ ID NO: 5004283 - DNA, 20 bp, Homo sapiens
gctcaggcctcacctcccag

SEQ ID NO: 5004284 - DNA, 17 bp, Homo sapiens
gctcagggccaggtcct

SEQ ID NO: 5004285 - DNA, 13 bp, Homo sapiens
gctcaggttccct

SEQ ID NO: 5004286 - DNA, 18 bp, Homo sapiens
gctcaggttccctgccac

SEQ ID NO: 5004287 - DNA, 20 bp, Homo sapiens
gctcattccatgactctgcc

SEQ ID NO: 5004288 - DNA, 21 bp, Homo sapiens
gctcattccatgactctgcct

SEQ ID NO: 5004289 - DNA, 12 bp, Homo sapiens
gctccagacagg

SEQ ID NO: 5004290 - DNA, 12 bp, Homo sapiens
gctgaccagaca

SEQ ID NO: 5004291 - DNA, 14 bp, Homo sapiens
gctgaggcaattct

SEQ ID NO: 5004292 - DNA, 22 bp, Homo sapiens
gctgatccttcaactctgtgag

SEQ ID NO: 5004293 - DNA, 17 bp, Homo sapiens
gctgccaccccttggca

SEQ ID NO: 5004294 - DNA, 13 bp, Homo sapiens
gctgccctctcct

SEQ ID NO: 5004295 - DNA, 14 bp, Homo sapiens
gctgccctctcctg

SEQ ID NO: 5004296 - DNA, 21 bp, Homo sapiens
gctgctgggccagtggcactc

SEQ ID NO: 5004297 - DNA, 10 bp, Homo sapiens
gctggagcta

SEQ ID NO: 5004298 - DNA, 19 bp, Homo sapiens
gctgggattacaggtgtga

SEQ ID NO: 5004299 - DNA, 20 bp, Homo sapiens
gctgggcactgggcactagc

SEQ ID NO: 5004300 - DNA, 13 bp, Homo sapiens
gctgggccagtgg

SEQ ID NO: 5004301 - DNA, 12 bp, Homo sapiens
gctggggcagag

SEQ ID NO: 5004302 - DNA, 21 bp, Homo sapiens
gctggggcagagtggagccca

SEQ ID NO: 5004303 - DNA, 23 bp, Homo sapiens
gctggggcagagtggagcccagg

SEQ ID NO: 5004304 - DNA, 23 bp, Homo sapiens
gctggtcccagccagcagttcag

SEQ ID NO: 5004305 - DNA, 19 bp, Homo sapiens
gctgtgaatggctgtgccc

SEQ ID NO: 5004306 - DNA, 18 bp, Homo sapiens
gctgtgccccacctgttg

SEQ ID NO: 5004307 - DNA, 21 bp, Homo sapiens
gctgtgtatctgtttttccat

SEQ ID NO: 5004308 - DNA, 18 bp, Homo sapiens
gctgttccacttctctag

SEQ ID NO: 5004309 - DNA, 19 bp, Homo sapiens
gctgttctcattcctgttc

SEQ ID NO: 5004310 - DNA, 21 bp, Homo sapiens
gctgttctcattcctgttctt

SEQ ID NO: 5004311 - DNA, 18 bp, Homo sapiens
gcttccactgtcagccct

SEQ ID NO: 5004312 - DNA, 18 bp, Homo sapiens
gcttgccatccctccctc

SEQ ID NO: 5004313 - DNA, 21 bp, Homo sapiens
gcttgccatccctccctccac

SEQ ID NO: 5004314 - DNA, 21 bp, Homo sapiens
gctttagtacatggagctcag

SEQ ID NO: 5004315 - DNA, 14 bp, Homo sapiens
ggaaaatggcagaa

SEQ ID NO: 5004316 - DNA, 16 bp, Homo sapiens
ggaaagatgtcccaca

SEQ ID NO: 5004317 - DNA, 20 bp, Homo sapiens
ggaaagatgtcccacaggga

SEQ ID NO: 5004318 - DNA, 17 bp, Homo sapiens
ggaaattggaagagcac

SEQ ID NO: 5004319 - DNA, 15 bp, Homo sapiens
ggaacctcaaactgg

SEQ ID NO: 5004320 - DNA, 12 bp, Homo sapiens
ggaactgccacc

SEQ ID NO: 5004321 - DNA, 15 bp, Homo sapiens
ggaactgccaccttg

SEQ ID NO: 5004322 - DNA, 20 bp, Homo sapiens
ggaagcaagatcgctgtgct

SEQ ID NO: 5004323 - DNA, 18 bp, Homo sapiens
ggaaggcggcaggcagag

SEQ ID NO: 5004324 - DNA, 15 bp, Homo sapiens
ggaatggcacagccc

SEQ ID NO: 5004325 - DNA, 20 bp, Homo sapiens
ggaattcatctctctttaat

SEQ ID NO: 5004326 - DNA, 15 bp, Homo sapiens
ggacagacagcagct

SEQ ID NO: 5004327 - DNA, 18 bp, Homo sapiens
ggacagacagcagctgga

SEQ ID NO: 5004328 - DNA, 16 bp, Homo sapiens
ggacatgcagctctga

SEQ ID NO: 5004329 - DNA, 19 bp, Homo sapiens
ggaccacatccaccccagc

SEQ ID NO: 5004330 - DNA, 21 bp, Homo sapiens
ggaccacatccaccccagccc

SEQ ID NO: 5004331 - DNA, 12 bp, Homo sapiens
ggagacagacac

SEQ ID NO: 5004332 - DNA, 18 bp, Homo sapiens
ggagagtccaggcctggg

SEQ ID NO: 5004333 - DNA, 14 bp, Homo sapiens
ggagcccacggggc

SEQ ID NO: 5004334 - DNA, 19 bp, Homo sapiens
ggagcgtggggaggggctg

SEQ ID NO: 5004335 - DNA, 14 bp, Homo sapiens
ggagctaaggccag

SEQ ID NO: 5004336 - DNA, 16 bp, Homo sapiens
ggagctaaggccagct

SEQ ID NO: 5004337 - DNA, 21 bp, Homo sapiens
ggagctaaggccagctagagc

SEQ ID NO: 5004338 - DNA, 20 bp, Homo sapiens
ggagctcaggtttctggaca

SEQ ID NO: 5004339 - DNA, 13 bp, Homo sapiens
ggaggactctaga

SEQ ID NO: 5004340 - DNA, 21 bp, Homo sapiens
ggaggactctagaagctcagg

SEQ ID NO: 5004341 - DNA, 19 bp, Homo sapiens
ggaggtggaggttgcagtg

SEQ ID NO: 5004342 - DNA, 14 bp, Homo sapiens
ggagtaggctccag

SEQ ID NO: 5004343 - DNA, 18 bp, Homo sapiens
ggagtaggctccagacag

SEQ ID NO: 5004344 - DNA, 23 bp, Homo sapiens
ggagtaggctccagacaggagga

SEQ ID NO: 5004345 - DNA, 15 bp, Homo sapiens
ggagtcagtagccag

SEQ ID NO: 5004346 - DNA, 16 bp, Homo sapiens
ggagtcagtagccaga

SEQ ID NO: 5004347 - DNA, 17 bp, Homo sapiens
ggagtcagtagccagag

SEQ ID NO: 5004348 - DNA, 18 bp, Homo sapiens
ggagtcagtagccagagt

SEQ ID NO: 5004349 - DNA, 14 bp, Homo sapiens
ggagtcatgtgcct

SEQ ID NO: 5004350 - DNA, 16 bp, Homo sapiens
ggagtgggacagacag

SEQ ID NO: 5004351 - DNA, 22 bp, Homo sapiens
ggagtgggacagacagcagctg

SEQ ID NO: 5004352 - DNA, 23 bp, Homo sapiens
ggatgtccctattctgccatggg

SEQ ID NO: 5004353 - DNA, 13 bp, Homo sapiens
ggatgtggcaggg

SEQ ID NO: 5004354 - DNA, 15 bp, Homo sapiens
ggatgtggcaggggc

SEQ ID NO: 5004355 - DNA, 19 bp, Homo sapiens
ggatgtggcaggggcagtg

SEQ ID NO: 5004356 - DNA, 21 bp, Homo sapiens
ggattcaggcctctgaggagc

SEQ ID NO: 5004357 - DNA, 20 bp, Homo sapiens
ggcaaatccgaaatcagcag

SEQ ID NO: 5004358 - DNA, 16 bp, Homo sapiens
ggcaacgcacaaaaca

SEQ ID NO: 5004359 - DNA, 19 bp, Homo sapiens
ggcaagctgcaaaaggcct

SEQ ID NO: 5004360 - DNA, 23 bp, Homo sapiens
ggcaagctgcaaaaggcctgtga

SEQ ID NO: 5004361 - DNA, 14 bp, Homo sapiens
ggcaccatctgcca

SEQ ID NO: 5004362 - DNA, 13 bp, Homo sapiens
ggcactagctaga

SEQ ID NO: 5004363 - DNA, 17 bp, Homo sapiens
ggcactagctagatgct

SEQ ID NO: 5004364 - DNA, 14 bp, Homo sapiens
ggcactgtccaggg

SEQ ID NO: 5004365 - DNA, 15 bp, Homo sapiens
ggcactgtccagggc

SEQ ID NO: 5004366 - DNA, 16 bp, Homo sapiens
ggcactgtccagggcc

SEQ ID NO: 5004367 - DNA, 22 bp, Homo sapiens
ggcactgtccagggcccatgta

SEQ ID NO: 5004368 - DNA, 18 bp, Homo sapiens
ggcactgtggaactgcca

SEQ ID NO: 5004369 - DNA, 11 bp, Homo sapiens
ggcagctgcct

SEQ ID NO: 5004370 - DNA, 12 bp, Homo sapiens
ggcagctgcctc

SEQ ID NO: 5004371 - DNA, 19 bp, Homo sapiens
ggcaggacactgcagaaca

SEQ ID NO: 5004372 - DNA, 17 bp, Homo sapiens
ggcaggcagagaagtgg

SEQ ID NO: 5004373 - DNA, 13 bp, Homo sapiens
ggcaggggcagtg

SEQ ID NO: 5004374 - DNA, 21 bp, Homo sapiens
ggcatctttctgaatttcatt

SEQ ID NO: 5004375 - DNA, 14 bp, Homo sapiens
ggcatgggggccca

SEQ ID NO: 5004376 - DNA, 19 bp, Homo sapiens
ggcatgggggcccaaaggg

SEQ ID NO: 5004377 - DNA, 16 bp, Homo sapiens
ggcatgttcagggatg

SEQ ID NO: 5004378 - DNA, 14 bp, Homo sapiens
ggccagctagagct

SEQ ID NO: 5004379 - DNA, 16 bp, Homo sapiens
ggccaggtcctcacag

SEQ ID NO: 5004380 - DNA, 13 bp, Homo sapiens
ggccagtggcact

SEQ ID NO: 5004381 - DNA, 13 bp, Homo sapiens
ggcccagagaggt

SEQ ID NO: 5004382 - DNA, 19 bp, Homo sapiens
ggcccatgtagctggcaag

SEQ ID NO: 5004383 - DNA, 16 bp, Homo sapiens
ggccccttgctggagt

SEQ ID NO: 5004384 - DNA, 15 bp, Homo sapiens
ggcctcacctcccag

SEQ ID NO: 5004385 - DNA, 19 bp, Homo sapiens
ggcctcacctcccagggct

SEQ ID NO: 5004386 - DNA, 20 bp, Homo sapiens
ggcctcatcttccccagccc

SEQ ID NO: 5004387 - DNA, 23 bp, Homo sapiens
ggcctctactaggtctgctcctg

SEQ ID NO: 5004388 - DNA, 20 bp, Homo sapiens
ggcctggatgcacagtgcct

SEQ ID NO: 5004389 - DNA, 20 bp, Homo sapiens
ggcctgggtcacgctcaagg

SEQ ID NO: 5004390 - DNA, 16 bp, Homo sapiens
ggcctgtgatccagga

SEQ ID NO: 5004391 - DNA, 14 bp, Homo sapiens
ggcggcaggcagag

SEQ ID NO: 5004392 - DNA, 15 bp, Homo sapiens
ggcggcaggcagaga

SEQ ID NO: 5004393 - DNA, 22 bp, Homo sapiens
ggctaattagaggatgtggcag

SEQ ID NO: 5004394 - DNA, 13 bp, Homo sapiens
ggctacacagacc

SEQ ID NO: 5004395 - DNA, 16 bp, Homo sapiens
ggctcagggccaggtc

SEQ ID NO: 5004396 - DNA, 18 bp, Homo sapiens
ggctcagggccaggtcct

SEQ ID NO: 5004397 - DNA, 12 bp, Homo sapiens
ggctccagacag

SEQ ID NO: 5004398 - DNA, 13 bp, Homo sapiens
ggctgaaagacag

SEQ ID NO: 5004399 - DNA, 17 bp, Homo sapiens
ggctgtaaacagctctg

SEQ ID NO: 5004400 - DNA, 22 bp, Homo sapiens
gggaatggcacagcccaaagaa

SEQ ID NO: 5004401 - DNA, 17 bp, Homo sapiens
gggaccacatccacccc

SEQ ID NO: 5004402 - DNA, 21 bp, Homo sapiens
gggaccacatccaccccagcc

SEQ ID NO: 5004403 - DNA, 17 bp, Homo sapiens
gggagagtccaggcctg

SEQ ID NO: 5004404 - DNA, 20 bp, Homo sapiens
gggagtaggctccagacagg

SEQ ID NO: 5004405 - DNA, 19 bp, Homo sapiens
gggcaaagctgctgggcca

SEQ ID NO: 5004406 - DNA, 21 bp, Homo sapiens
gggcaaagctgctgggccagt

SEQ ID NO: 5004407 - DNA, 18 bp, Homo sapiens
gggcactagctagatgct

SEQ ID NO: 5004408 - DNA, 15 bp, Homo sapiens
gggccagtggcactc

SEQ ID NO: 5004409 - DNA, 16 bp, Homo sapiens
gggcccaaaggggagc

SEQ ID NO: 5004410 - DNA, 22 bp, Homo sapiens
gggcctcatcttccccagccct

SEQ ID NO: 5004411 - DNA, 11 bp, Homo sapiens
gggctacacag

SEQ ID NO: 5004412 - DNA, 14 bp, Homo sapiens
gggctacacagacc

SEQ ID NO: 5004413 - DNA, 16 bp, Homo sapiens
gggctacacagaccct

SEQ ID NO: 5004414 - DNA, 19 bp, Homo sapiens
gggctacacagaccctgcc

SEQ ID NO: 5004415 - DNA, 22 bp, Homo sapiens
gggctacacagaccctgcccac

SEQ ID NO: 5004416 - DNA, 12 bp, Homo sapiens
gggctcagaggg

SEQ ID NO: 5004417 - DNA, 13 bp, Homo sapiens
ggggaggggctga

SEQ ID NO: 5004418 - DNA, 15 bp, Homo sapiens
ggggtgccccagcta

SEQ ID NO: 5004419 - DNA, 18 bp, Homo sapiens
ggggtgctggggcagagt

SEQ ID NO: 5004420 - DNA, 16 bp, Homo sapiens
gggtatgagctggagc

SEQ ID NO: 5004421 - DNA, 17 bp, Homo sapiens
gggtgctggggcagagt

SEQ ID NO: 5004422 - DNA, 19 bp, Homo sapiens
gggtgctggggcagagtgg

SEQ ID NO: 5004423 - DNA, 19 bp, Homo sapiens
gggtgtaggtgaaaggcat

SEQ ID NO: 5004424 - DNA, 20 bp, Homo sapiens
ggtaaagccctcagatccca

SEQ ID NO: 5004425 - DNA, 22 bp, Homo sapiens
ggtaaagccctcagatcccagg

SEQ ID NO: 5004426 - DNA, 20 bp, Homo sapiens
ggtagaaagagatacagagg

SEQ ID NO: 5004427 - DNA, 11 bp, Homo sapiens
ggtagaacaca

SEQ ID NO: 5004428 - DNA, 16 bp, Homo sapiens
ggtcatagcagtgctt

SEQ ID NO: 5004429 - DNA, 22 bp, Homo sapiens
ggtctgaccaaaaccagagggc

SEQ ID NO: 5004430 - DNA, 18 bp, Homo sapiens
ggtcttggccgactcagg

SEQ ID NO: 5004431 - DNA, 21 bp, Homo sapiens
ggtgagggtggggtgccccag

SEQ ID NO: 5004432 - DNA, 15 bp, Homo sapiens
ggtgctggggcagag

SEQ ID NO: 5004433 - DNA, 17 bp, Homo sapiens
ggtgttgacatgtgctt

SEQ ID NO: 5004434 - DNA, 12 bp, Homo sapiens
ggttccctgcca

SEQ ID NO: 5004435 - DNA, 19 bp, Homo sapiens
ggtttctctgcctccaggt

SEQ ID NO: 5004436 - DNA, 15 bp, Homo sapiens
ggtttgaatataaac

SEQ ID NO: 5004437 - DNA, 16 bp, Homo sapiens
ggtttgatgccaaagc

SEQ ID NO: 5004438 - DNA, 23 bp, Homo sapiens
gtaaagccctcagatcccagggt

SEQ ID NO: 5004439 - DNA, 10 bp, Homo sapiens
gtaataaact

SEQ ID NO: 5004440 - DNA, 13 bp, Homo sapiens
gtacatggagctc

SEQ ID NO: 5004441 - DNA, 12 bp, Homo sapiens
gtactacaattt

SEQ ID NO: 5004442 - DNA, 22 bp, Homo sapiens
gtagaacacaaggtcatttgct

SEQ ID NO: 5004443 - DNA, 22 bp, Homo sapiens
gtagccagagttgttctcaggg

SEQ ID NO: 5004444 - DNA, 23 bp, Homo sapiens
gtagccagagttgttctcagggg

SEQ ID NO: 5004445 - DNA, 17 bp, Homo sapiens
gtagctgctaccttctt

SEQ ID NO: 5004446 - DNA, 17 bp, Homo sapiens
gtagctggcaagctgca

SEQ ID NO: 5004447 - DNA, 23 bp, Homo sapiens
gtagctggcaagctgcaaaaggc

SEQ ID NO: 5004448 - DNA, 21 bp, Homo sapiens
gtaggtttctctgcctccagg

SEQ ID NO: 5004449 - DNA, 22 bp, Homo sapiens
gtaggtttctctgcctccaggt

SEQ ID NO: 5004450 - DNA, 14 bp, Homo sapiens
gtatgaatagctgt

SEQ ID NO: 5004451 - DNA, 15 bp, Homo sapiens
gtatgagctggagct

SEQ ID NO: 5004452 - DNA, 16 bp, Homo sapiens
gtatgagctggagcta

SEQ ID NO: 5004453 - DNA, 19 bp, Homo sapiens
gtatgtttttgtgtatttg

SEQ ID NO: 5004454 - DNA, 13 bp, Homo sapiens
gtcacaggcccag

SEQ ID NO: 5004455 - DNA, 14 bp, Homo sapiens
gtcacaggcccagg

SEQ ID NO: 5004456 - DNA, 17 bp, Homo sapiens
gtcacaggcccaggaag

SEQ ID NO: 5004457 - DNA, 17 bp, Homo sapiens
gtcagtagccagagttg

SEQ ID NO: 5004458 - DNA, 15 bp, Homo sapiens
gtcagtcccactgca

SEQ ID NO: 5004459 - DNA, 22 bp, Homo sapiens
gtccaggtctagaaggccaggc

SEQ ID NO: 5004460 - DNA, 22 bp, Homo sapiens
gtcccactgcacccccctgtgc

SEQ ID NO: 5004461 - DNA, 13 bp, Homo sapiens
gtccctattctgc

SEQ ID NO: 5004462 - DNA, 12 bp, Homo sapiens
gtcctcacagca

SEQ ID NO: 5004463 - DNA, 14 bp, Homo sapiens
gtcctcacagcagt

SEQ ID NO: 5004464 - DNA, 21 bp, Homo sapiens
gtcctcacagcagtcacaggc

SEQ ID NO: 5004465 - DNA, 22 bp, Homo sapiens
gtcctcacagcagtcacaggcc

SEQ ID NO: 5004466 - DNA, 15 bp, Homo sapiens
gtcctgctgcctgga

SEQ ID NO: 5004467 - DNA, 17 bp, Homo sapiens
gtccttcacctttccca

SEQ ID NO: 5004468 - DNA, 14 bp, Homo sapiens
gtctagaaggccag

SEQ ID NO: 5004469 - DNA, 15 bp, Homo sapiens
gtctagaaggccagg

SEQ ID NO: 5004470 - DNA, 14 bp, Homo sapiens
gtctctgaggctct

SEQ ID NO: 5004471 - DNA, 18 bp, Homo sapiens
gtctctgaggctctccaa

SEQ ID NO: 5004472 - DNA, 17 bp, Homo sapiens
gtctggcatctcccaca

SEQ ID NO: 5004473 - DNA, 22 bp, Homo sapiens
gtgaaataccaacctgaagaca

SEQ ID NO: 5004474 - DNA, 16 bp, Homo sapiens
gtgaatggctgtgccc

SEQ ID NO: 5004475 - DNA, 19 bp, Homo sapiens
gtgagggtggggtgcccca

SEQ ID NO: 5004476 - DNA, 14 bp, Homo sapiens
gtgatttttttgtc

SEQ ID NO: 5004477 - DNA, 22 bp, Homo sapiens
gtgcatgaaggtttctgaaaat

SEQ ID NO: 5004478 - DNA, 16 bp, Homo sapiens
gtgccccacctgttgt

SEQ ID NO: 5004479 - DNA, 19 bp, Homo sapiens
gtgccccagctaggaagca

SEQ ID NO: 5004480 - DNA, 19 bp, Homo sapiens
gtgccctagggctcagagg

SEQ ID NO: 5004481 - DNA, 15 bp, Homo sapiens
gtgcctctgtcctta

SEQ ID NO: 5004482 - DNA, 17 bp, Homo sapiens
gtgcctgatgggagtag

SEQ ID NO: 5004483 - DNA, 14 bp, Homo sapiens
gtgcctgctgggca

SEQ ID NO: 5004484 - DNA, 18 bp, Homo sapiens
gtgcctgctgggcactgg

SEQ ID NO: 5004485 - DNA, 20 bp, Homo sapiens
gtgcctgctgggcactgggc

SEQ ID NO: 5004486 - DNA, 17 bp, Homo sapiens
gtgcgacttcacaaaat

SEQ ID NO: 5004487 - DNA, 22 bp, Homo sapiens
gtgcgacttcacaaaatgcaag

SEQ ID NO: 5004488 - DNA, 12 bp, Homo sapiens
gtgctaggtctg

SEQ ID NO: 5004489 - DNA, 17 bp, Homo sapiens
gtgctcttctgttctca

SEQ ID NO: 5004490 - DNA, 13 bp, Homo sapiens
gtgctgccacccc

SEQ ID NO: 5004491 - DNA, 18 bp, Homo sapiens
gtgctgccaccccttggc

SEQ ID NO: 5004492 - DNA, 14 bp, Homo sapiens
gtgctggggcagag

SEQ ID NO: 5004493 - DNA, 20 bp, Homo sapiens
gtgctggggcagagtggagc

SEQ ID NO: 5004494 - DNA, 14 bp, Homo sapiens
gtggaactgccacc

SEQ ID NO: 5004495 - DNA, 12 bp, Homo sapiens
gtggagatgccc

SEQ ID NO: 5004496 - DNA, 14 bp, Homo sapiens
gtggagcccagggt

SEQ ID NO: 5004497 - DNA, 16 bp, Homo sapiens
gtggagcccagggtgc

SEQ ID NO: 5004498 - DNA, 17 bp, Homo sapiens
gtggagcccagggtgct

SEQ ID NO: 5004499 - DNA, 20 bp, Homo sapiens
gtggaggagctcaggacact

SEQ ID NO: 5004500 - DNA, 23 bp, Homo sapiens
gtggaggagctcaggacactaat

SEQ ID NO: 5004501 - DNA, 22 bp, Homo sapiens
gtggatgtccctattctgccat

SEQ ID NO: 5004502 - DNA, 15 bp, Homo sapiens
gtggcaggggcagtg

SEQ ID NO: 5004503 - DNA, 17 bp, Homo sapiens
gtggcaggggcagtggc

SEQ ID NO: 5004504 - DNA, 19 bp, Homo sapiens
gtggcaggggcagtggcct

SEQ ID NO: 5004505 - DNA, 13 bp, Homo sapiens
gtgggacagacag

SEQ ID NO: 5004506 - DNA, 16 bp, Homo sapiens
gtggtgggtgcctgta

SEQ ID NO: 5004507 - DNA, 14 bp, Homo sapiens
gtgtatgatccaag

SEQ ID NO: 5004508 - DNA, 18 bp, Homo sapiens
gtgtgccctagggctcag

SEQ ID NO: 5004509 - DNA, 21 bp, Homo sapiens
gtgtgggaaaatggcagaaag

SEQ ID NO: 5004510 - DNA, 15 bp, Homo sapiens
gtgtttttaactcaa

SEQ ID NO: 5004511 - DNA, 13 bp, Homo sapiens
gttagggaatggc

SEQ ID NO: 5004512 - DNA, 14 bp, Homo sapiens
gttcagagctgccc

SEQ ID NO: 5004513 - DNA, 16 bp, Homo sapiens
gttcagagctgccctc

SEQ ID NO: 5004514 - DNA, 19 bp, Homo sapiens
gttcagagctgccctctcc

SEQ ID NO: 5004515 - DNA, 20 bp, Homo sapiens
gttcagagctgccctctcct

SEQ ID NO: 5004516 - DNA, 22 bp, Homo sapiens
gttcagagctgccctctcctgg

SEQ ID NO: 5004517 - DNA, 23 bp, Homo sapiens
gttcagagctgccctctcctggg

SEQ ID NO: 5004518 - DNA, 19 bp, Homo sapiens
gttccacttctctagagaa

SEQ ID NO: 5004519 - DNA, 20 bp, Homo sapiens
gttgacttgacagaacactg

SEQ ID NO: 5004520 - DNA, 16 bp, Homo sapiens
gttgcctcaacagcag

SEQ ID NO: 5004521 - DNA, 21 bp, Homo sapiens
gtttgatgccaaagcagacat

SEQ ID NO: 5004522 - DNA, 17 bp, Homo sapiens
gtttgcaaggaagccac

SEQ ID NO: 5004523 - DNA, 19 bp, Homo sapiens
gtttttaactcaatatttt

SEQ ID NO: 5004524 - DNA, 15 bp, Homo sapiens
taaaaacataaaata

SEQ ID NO: 5004525 - DNA, 21 bp, Homo sapiens
taaaacacacctaagagaaaa

SEQ ID NO: 5004526 - DNA, 15 bp, Homo sapiens
taaaagtcagagctc

SEQ ID NO: 5004527 - DNA, 14 bp, Homo sapiens
taaaatatacaaac

SEQ ID NO: 5004528 - DNA, 15 bp, Homo sapiens
taaaatatacaaaca

SEQ ID NO: 5004529 - DNA, 17 bp, Homo sapiens
taaaatgggttttactg

SEQ ID NO: 5004530 - DNA, 12 bp, Homo sapiens
taaacaaatgta

SEQ ID NO: 5004531 - DNA, 13 bp, Homo sapiens
taaacttgtgtat

SEQ ID NO: 5004532 - DNA, 20 bp, Homo sapiens
taaacttgtgtatgatccaa

SEQ ID NO: 5004533 - DNA, 17 bp, Homo sapiens
taaagccctcagatccc

SEQ ID NO: 5004534 - DNA, 22 bp, Homo sapiens
taaagccctcagatcccagggt

SEQ ID NO: 5004535 - DNA, 18 bp, Homo sapiens
taaagggtatgagctgga

SEQ ID NO: 5004536 - DNA, 20 bp, Homo sapiens
taaagggtatgagctggagc

SEQ ID NO: 5004537 - DNA, 16 bp, Homo sapiens
taaatgcaaacactgt

SEQ ID NO: 5004538 - DNA, 17 bp, Homo sapiens
taaatgcaaacactgtg

SEQ ID NO: 5004539 - DNA, 18 bp, Homo sapiens
taaatgcaaacactgtgt

SEQ ID NO: 5004540 - DNA, 13 bp, Homo sapiens
taaatgtgtaaat

SEQ ID NO: 5004541 - DNA, 17 bp, Homo sapiens
taaattttgtatgaaaa

SEQ ID NO: 5004542 - DNA, 18 bp, Homo sapiens
taaccatgggctcagggc

SEQ ID NO: 5004543 - DNA, 15 bp, Homo sapiens
taactccccacccca

SEQ ID NO: 5004544 - DNA, 14 bp, Homo sapiens
taagcaatcactgg

SEQ ID NO: 5004545 - DNA, 16 bp, Homo sapiens
taagcaatcactgggc

SEQ ID NO: 5004546 - DNA, 18 bp, Homo sapiens
taagcaatcactgggccc

SEQ ID NO: 5004547 - DNA, 23 bp, Homo sapiens
taagcaatcactgggcccagagg

SEQ ID NO: 5004548 - DNA, 14 bp, Homo sapiens
taatataaagttgg

SEQ ID NO: 5004549 - DNA, 19 bp, Homo sapiens
taatataaagttggatgcg

SEQ ID NO: 5004550 - DNA, 21 bp, Homo sapiens
taatgttgggtagaaagagat

SEQ ID NO: 5004551 - DNA, 19 bp, Homo sapiens
tacaaaataaagctgttct

SEQ ID NO: 5004552 - DNA, 17 bp, Homo sapiens
tacaaacatgtggttaa

SEQ ID NO: 5004553 - DNA, 22 bp, Homo sapiens
tacaaacctttagctgtgaatg

SEQ ID NO: 5004554 - DNA, 18 bp, Homo sapiens
tacacaccttatatttac

SEQ ID NO: 5004555 - DNA, 21 bp, Homo sapiens
tacacagaccctgcccacccc

SEQ ID NO: 5004556 - DNA, 14 bp, Homo sapiens
tacactcttctcca

SEQ ID NO: 5004557 - DNA, 16 bp, Homo sapiens
tacaggtgtgagcata

SEQ ID NO: 5004558 - DNA, 16 bp, Homo sapiens
taccaaatataaactt

SEQ ID NO: 5004559 - DNA, 17 bp, Homo sapiens
taccaaatataaacttg

SEQ ID NO: 5004560 - DNA, 23 bp, Homo sapiens
taccaaatataaacttgtgtatg

SEQ ID NO: 5004561 - DNA, 17 bp, Homo sapiens
taccccaaagtccaggc

SEQ ID NO: 5004562 - DNA, 13 bp, Homo sapiens
tacgtatgagacg

SEQ ID NO: 5004563 - DNA, 18 bp, Homo sapiens
tagaaagagatacagagg

SEQ ID NO: 5004564 - DNA, 22 bp, Homo sapiens
tagaactttgcatagcagctgc

SEQ ID NO: 5004565 - DNA, 12 bp, Homo sapiens
tagaagctcagg

SEQ ID NO: 5004566 - DNA, 18 bp, Homo sapiens
tagaatttggcccagaga

SEQ ID NO: 5004567 - DNA, 21 bp, Homo sapiens
tagaatttggcccagagaggt

SEQ ID NO: 5004568 - DNA, 20 bp, Homo sapiens
tagaggatgtggcaggggca

SEQ ID NO: 5004569 - DNA, 15 bp, Homo sapiens
tagctctttgagata

SEQ ID NO: 5004570 - DNA, 20 bp, Homo sapiens
tagcttggaaactggatgag

SEQ ID NO: 5004571 - DNA, 15 bp, Homo sapiens
taggtttctctgcct

SEQ ID NO: 5004572 - DNA, 16 bp, Homo sapiens
tagttaggtgtgccaa

SEQ ID NO: 5004573 - DNA, 20 bp, Homo sapiens
tagttaggtgtgccaaacta

SEQ ID NO: 5004574 - DNA, 14 bp, Homo sapiens
tataaacttgtgta

SEQ ID NO: 5004575 - DNA, 14 bp, Homo sapiens
tatatatataaaca

SEQ ID NO: 5004576 - DNA, 14 bp, Homo sapiens
tatatattttaatt

SEQ ID NO: 5004577 - DNA, 21 bp, Homo sapiens
tatatccatgatcacacagct

SEQ ID NO: 5004578 - DNA, 20 bp, Homo sapiens
tatattaggcatgttcaggg

SEQ ID NO: 5004579 - DNA, 23 bp, Homo sapiens
tatattaggcatgttcagggatg

SEQ ID NO: 5004580 - DNA, 17 bp, Homo sapiens
tatctgtgtgccctagg

SEQ ID NO: 5004581 - DNA, 21 bp, Homo sapiens
tatgagctggagctaaggcca

SEQ ID NO: 5004582 - DNA, 22 bp, Homo sapiens
tatgagctggagctaaggccag

SEQ ID NO: 5004583 - DNA, 16 bp, Homo sapiens
tatggcagtgtctttc

SEQ ID NO: 5004584 - DNA, 18 bp, Homo sapiens
tatgtttttgtgtatttg

SEQ ID NO: 5004585 - DNA, 19 bp, Homo sapiens
tatttgagttggccaagaa

SEQ ID NO: 5004586 - DNA, 20 bp, Homo sapiens
tattttccatgaaaatgcaa

SEQ ID NO: 5004587 - DNA, 22 bp, Homo sapiens
tattttgtaataaactctctag

SEQ ID NO: 5004588 - DNA, 17 bp, Homo sapiens
tatttttaattaaataa

SEQ ID NO: 5004589 - DNA, 16 bp, Homo sapiens
tcaaatgctaaatgca

SEQ ID NO: 5004590 - DNA, 22 bp, Homo sapiens
tcaacagcaggaggcacagcag

SEQ ID NO: 5004591 - DNA, 15 bp, Homo sapiens
tcaatattttccatg

SEQ ID NO: 5004592 - DNA, 16 bp, Homo sapiens
tcaatattttccatga

SEQ ID NO: 5004593 - DNA, 19 bp, Homo sapiens
tcaatggtttgcaaggaag

SEQ ID NO: 5004594 - DNA, 20 bp, Homo sapiens
tcaatttccaagagctgagg

SEQ ID NO: 5004595 - DNA, 13 bp, Homo sapiens
tcacaaaatgcaa

SEQ ID NO: 5004596 - DNA, 15 bp, Homo sapiens
tcacacccacctgct

SEQ ID NO: 5004597 - DNA, 16 bp, Homo sapiens
tcacacccacctgctg

SEQ ID NO: 5004598 - DNA, 18 bp, Homo sapiens
tcacacccacctgctgct

SEQ ID NO: 5004599 - DNA, 14 bp, Homo sapiens
tcacagcagtcaca

SEQ ID NO: 5004600 - DNA, 19 bp, Homo sapiens
tcacagcagtcacaggccc

SEQ ID NO: 5004601 - DNA, 21 bp, Homo sapiens
tcacagcagtcacaggcccag

SEQ ID NO: 5004602 - DNA, 18 bp, Homo sapiens
tcaccaattccacttcct

SEQ ID NO: 5004603 - DNA, 19 bp, Homo sapiens
tcaccatctttgaggtgag

SEQ ID NO: 5004604 - DNA, 19 bp, Homo sapiens
tcacctaagcaatcactgg

SEQ ID NO: 5004605 - DNA, 14 bp, Homo sapiens
tcacctcccagggc

SEQ ID NO: 5004606 - DNA, 15 bp, Homo sapiens
tcacctcccagggct

SEQ ID NO: 5004607 - DNA, 17 bp, Homo sapiens
tcacgctcaaggaagga

SEQ ID NO: 5004608 - DNA, 12 bp, Homo sapiens
tcactgagaaga

SEQ ID NO: 5004609 - DNA, 20 bp, Homo sapiens
tcactgagaagatggcactg

SEQ ID NO: 5004610 - DNA, 21 bp, Homo sapiens
tcactgagaagatggcactgt

SEQ ID NO: 5004611 - DNA, 20 bp, Homo sapiens
tcactggagtagttgctact

SEQ ID NO: 5004612 - DNA, 16 bp, Homo sapiens
tcactgggcccagagg

SEQ ID NO: 5004613 - DNA, 16 bp, Homo sapiens
tcactgtcagtcccac

SEQ ID NO: 5004614 - DNA, 21 bp, Homo sapiens
tcactgtcagtcccactgcac

SEQ ID NO: 5004615 - DNA, 12 bp, Homo sapiens
tcagagctcagg

SEQ ID NO: 5004616 - DNA, 20 bp, Homo sapiens
tcagagctgccctctcctgg

SEQ ID NO: 5004617 - DNA, 21 bp, Homo sapiens
tcaggcctcacctcccagggc

SEQ ID NO: 5004618 - DNA, 15 bp, Homo sapiens
tcaggcctctgagga

SEQ ID NO: 5004619 - DNA, 16 bp, Homo sapiens
tcaggcctctgaggag

SEQ ID NO: 5004620 - DNA, 20 bp, Homo sapiens
tcagggccaggtcctcacag

SEQ ID NO: 5004621 - DNA, 23 bp, Homo sapiens
tcagggccaggtcctcacagcag

SEQ ID NO: 5004622 - DNA, 17 bp, Homo sapiens
tcaggggtgctggggca

SEQ ID NO: 5004623 - DNA, 19 bp, Homo sapiens
tcaggggtgctggggcaga

SEQ ID NO: 5004624 - DNA, 15 bp, Homo sapiens
tcagttctgccttat

SEQ ID NO: 5004625 - DNA, 14 bp, Homo sapiens
tcatattgtttcct

SEQ ID NO: 5004626 - DNA, 17 bp, Homo sapiens
tcatgtaaattttgtat

SEQ ID NO: 5004627 - DNA, 18 bp, Homo sapiens
tcatgtgcctctgtcctt

SEQ ID NO: 5004628 - DNA, 13 bp, Homo sapiens
tcatgtgcctgga

SEQ ID NO: 5004629 - DNA, 14 bp, Homo sapiens
tcatgtgcctggaa

SEQ ID NO: 5004630 - DNA, 15 bp, Homo sapiens
tcatgtgcctggaaa

SEQ ID NO: 5004631 - DNA, 15 bp, Homo sapiens
tcattccatgactct

SEQ ID NO: 5004632 - DNA, 22 bp, Homo sapiens
tcattctcttgaaggtgctgcc

SEQ ID NO: 5004633 - DNA, 14 bp, Homo sapiens
tccaaacacaggca

SEQ ID NO: 5004634 - DNA, 12 bp, Homo sapiens
tccaagagctga

SEQ ID NO: 5004635 - DNA, 19 bp, Homo sapiens
tccacccacttgcctgtca

SEQ ID NO: 5004636 - DNA, 21 bp, Homo sapiens
tccaccccagccccactgccc

SEQ ID NO: 5004637 - DNA, 15 bp, Homo sapiens
tccacctccctgcaa

SEQ ID NO: 5004638 - DNA, 18 bp, Homo sapiens
tccactttcagtgaaagc

SEQ ID NO: 5004639 - DNA, 12 bp, Homo sapiens
tccagacaggag

SEQ ID NO: 5004640 - DNA, 18 bp, Homo sapiens
tccaggaaagatgtccca

SEQ ID NO: 5004641 - DNA, 22 bp, Homo sapiens
tccaggaaagatgtcccacagg

SEQ ID NO: 5004642 - DNA, 16 bp, Homo sapiens
tccaggcctgggtcac

SEQ ID NO: 5004643 - DNA, 13 bp, Homo sapiens
tccagggccagga

SEQ ID NO: 5004644 - DNA, 21 bp, Homo sapiens
tccagggcccatgtagctggc

SEQ ID NO: 5004645 - DNA, 20 bp, Homo sapiens
tccaggtctagaaggccagg

SEQ ID NO: 5004646 - DNA, 21 bp, Homo sapiens
tccaggtctagaaggccaggc

SEQ ID NO: 5004647 - DNA, 16 bp, Homo sapiens
tccatgaaaatgcaac

SEQ ID NO: 5004648 - DNA, 14 bp, Homo sapiens
tccatgactctgcc

SEQ ID NO: 5004649 - DNA, 15 bp, Homo sapiens
tccatgactctgcct

SEQ ID NO: 5004650 - DNA, 16 bp, Homo sapiens
tccatgactctgccta

SEQ ID NO: 5004651 - DNA, 17 bp, Homo sapiens
tccatgactctgcctaa

SEQ ID NO: 5004652 - DNA, 16 bp, Homo sapiens
tccattactaaagaca

SEQ ID NO: 5004653 - DNA, 16 bp, Homo sapiens
tccattccctccaccc

SEQ ID NO: 5004654 - DNA, 17 bp, Homo sapiens
tcccaaaatcaccgtac

SEQ ID NO: 5004655 - DNA, 18 bp, Homo sapiens
tcccagccagcagttcag

SEQ ID NO: 5004656 - DNA, 18 bp, Homo sapiens
tcccagggctacacagac

SEQ ID NO: 5004657 - DNA, 13 bp, Homo sapiens
tccccacctgctc

SEQ ID NO: 5004658 - DNA, 20 bp, Homo sapiens
tccccagccctccccacctg

SEQ ID NO: 5004659 - DNA, 15 bp, Homo sapiens
tcccctcctctgctt

SEQ ID NO: 5004660 - DNA, 14 bp, Homo sapiens
tccctattctgcca

SEQ ID NO: 5004661 - DNA, 14 bp, Homo sapiens
tccctccacctccc

SEQ ID NO: 5004662 - DNA, 17 bp, Homo sapiens
tccctccacctccctgc

SEQ ID NO: 5004663 - DNA, 14 bp, Homo sapiens
tccctccctccacc

SEQ ID NO: 5004664 - DNA, 11 bp, Homo sapiens
tccctgccaca

SEQ ID NO: 5004665 - DNA, 18 bp, Homo sapiens
tccctggaaggacatcca

SEQ ID NO: 5004666 - DNA, 14 bp, Homo sapiens
tccctggctgacct

SEQ ID NO: 5004667 - DNA, 14 bp, Homo sapiens
tcctaaccctgggc

SEQ ID NO: 5004668 - DNA, 16 bp, Homo sapiens
tcctaccaaatataaa

SEQ ID NO: 5004669 - DNA, 16 bp, Homo sapiens
tcctcacacccacctg

SEQ ID NO: 5004670 - DNA, 21 bp, Homo sapiens
tcctcacacccacctgctgct

SEQ ID NO: 5004671 - DNA, 23 bp, Homo sapiens
tcctcacacccacctgctgctgt

SEQ ID NO: 5004672 - DNA, 14 bp, Homo sapiens
tcctcacagcagtc

SEQ ID NO: 5004673 - DNA, 19 bp, Homo sapiens
tcctcagaaagtgcagcat

SEQ ID NO: 5004674 - DNA, 14 bp, Homo sapiens
tcctcagtcctgga

SEQ ID NO: 5004675 - DNA, 15 bp, Homo sapiens
tcctctgcttgccat

SEQ ID NO: 5004676 - DNA, 20 bp, Homo sapiens
tcctctgcttgccatccctc

SEQ ID NO: 5004677 - DNA, 22 bp, Homo sapiens
tcctctgcttgccatccctccc

SEQ ID NO: 5004678 - DNA, 15 bp, Homo sapiens
tcctgaaccagtcct

SEQ ID NO: 5004679 - DNA, 23 bp, Homo sapiens
tcctgaaccagtcctgctgcctg

SEQ ID NO: 5004680 - DNA, 24 bp, Homo sapiens
tcctgaaccagtcctgctgcctgg

SEQ ID NO: 5004681 - DNA, 13 bp, Homo sapiens
tcctgaactgtga

SEQ ID NO: 5004682 - DNA, 20 bp, Homo sapiens
tcctgatcctaaccctgggc

SEQ ID NO: 5004683 - DNA, 20 bp, Homo sapiens
tcctgccccaactgcaggaa

SEQ ID NO: 5004684 - DNA, 18 bp, Homo sapiens
tcctgctaagttaatgtt

SEQ ID NO: 5004685 - DNA, 12 bp, Homo sapiens
tcctgggcagct

SEQ ID NO: 5004686 - DNA, 22 bp, Homo sapiens
tcctgggcagctgcctcccctc

SEQ ID NO: 5004687 - DNA, 23 bp, Homo sapiens
tcctgggcagctgcctcccctcc

SEQ ID NO: 5004688 - DNA, 22 bp, Homo sapiens
tcctgggggtaaagccctcaga

SEQ ID NO: 5004689 - DNA, 19 bp, Homo sapiens
tccttaattcactcccaca

SEQ ID NO: 5004690 - DNA, 17 bp, Homo sapiens
tccttcaactctgtgag

SEQ ID NO: 5004691 - DNA, 15 bp, Homo sapiens
tccttccaccaagtt

SEQ ID NO: 5004692 - DNA, 18 bp, Homo sapiens
tccttcctcagtcctgga

SEQ ID NO: 5004693 - DNA, 19 bp, Homo sapiens
tcggctgtaaacagctctg

SEQ ID NO: 5004694 - DNA, 18 bp, Homo sapiens
tctactaggtctgctcct

SEQ ID NO: 5004695 - DNA, 15 bp, Homo sapiens
tctagaagctcaggt

SEQ ID NO: 5004696 - DNA, 23 bp, Homo sapiens
tctagaagctcaggttccctgcc

SEQ ID NO: 5004697 - DNA, 13 bp, Homo sapiens
tctcaaagctggg

SEQ ID NO: 5004698 - DNA, 16 bp, Homo sapiens
tctcaggggtgctggg

SEQ ID NO: 5004699 - DNA, 18 bp, Homo sapiens
tctcattcctgttctttc

SEQ ID NO: 5004700 - DNA, 20 bp, Homo sapiens
tctcctgggcagctgcctcc

SEQ ID NO: 5004701 - DNA, 19 bp, Homo sapiens
tctctgaggctctccaaat

SEQ ID NO: 5004702 - DNA, 11 bp, Homo sapiens
tctctgcctcc

SEQ ID NO: 5004703 - DNA, 14 bp, Homo sapiens
tctctgcctccagg

SEQ ID NO: 5004704 - DNA, 15 bp, Homo sapiens
tctctgcctccaggt

SEQ ID NO: 5004705 - DNA, 16 bp, Homo sapiens
tctctgcctccaggtt

SEQ ID NO: 5004706 - DNA, 21 bp, Homo sapiens
tctcttctcactttccttttc

SEQ ID NO: 5004707 - DNA, 21 bp, Homo sapiens
tctcttgaaggtgctgccacc

SEQ ID NO: 5004708 - DNA, 22 bp, Homo sapiens
tctcttgaaggtgctgccaccc

SEQ ID NO: 5004709 - DNA, 15 bp, Homo sapiens
tctctttcttatttt

SEQ ID NO: 5004710 - DNA, 23 bp, Homo sapiens
tctgaaggcgtcaacgtgcattt

SEQ ID NO: 5004711 - DNA, 20 bp, Homo sapiens
tctgaccaaaaccagagggc

SEQ ID NO: 5004712 - DNA, 21 bp, Homo sapiens
tctgagaacagacgttaccaa

SEQ ID NO: 5004713 - DNA, 13 bp, Homo sapiens
tctgaggagccca

SEQ ID NO: 5004714 - DNA, 15 bp, Homo sapiens
tctgaggagcccacg

SEQ ID NO: 5004715 - DNA, 21 bp, Homo sapiens
tctgccaatgccatgactgct

SEQ ID NO: 5004716 - DNA, 16 bp, Homo sapiens
tctgccatgggagagt

SEQ ID NO: 5004717 - DNA, 23 bp, Homo sapiens
tctgcctaaccatgggctcaggg

SEQ ID NO: 5004718 - DNA, 13 bp, Homo sapiens
tctgcctccaggt

SEQ ID NO: 5004719 - DNA, 19 bp, Homo sapiens
tctgcctccaggttgcctc

SEQ ID NO: 5004720 - DNA, 20 bp, Homo sapiens
tctgcctccaggttgcctca

SEQ ID NO: 5004721 - DNA, 19 bp, Homo sapiens
tctggaagtccccgggagc

SEQ ID NO: 5004722 - DNA, 20 bp, Homo sapiens
tctggaagtccccgggagcc

SEQ ID NO: 5004723 - DNA, 23 bp, Homo sapiens
tctggacaagaagagtcctttta

SEQ ID NO: 5004724 - DNA, 23 bp, Homo sapiens
tctggtgccagatcctcttctca

SEQ ID NO: 5004725 - DNA, 16 bp, Homo sapiens
tctgtggagatgccca

SEQ ID NO: 5004726 - DNA, 12 bp, Homo sapiens
tctgtgtgccct

SEQ ID NO: 5004727 - DNA, 23 bp, Homo sapiens
tctgtgtgggaaaatggcagaaa

SEQ ID NO: 5004728 - DNA, 14 bp, Homo sapiens
tcttacaaacatgt

SEQ ID NO: 5004729 - DNA, 13 bp, Homo sapiens
tcttattttgtaa

SEQ ID NO: 5004730 - DNA, 17 bp, Homo sapiens
tcttattttgtaataaa

SEQ ID NO: 5004731 - DNA, 19 bp, Homo sapiens
tcttccccagccctcccca

SEQ ID NO: 5004732 - DNA, 16 bp, Homo sapiens
tcttctcaaagctggg

SEQ ID NO: 5004733 - DNA, 14 bp, Homo sapiens
tcttctgttctcaa

SEQ ID NO: 5004734 - DNA, 17 bp, Homo sapiens
tcttgaaggtgctgcca

SEQ ID NO: 5004735 - DNA, 16 bp, Homo sapiens
tcttggccgactcagg

SEQ ID NO: 5004736 - DNA, 22 bp, Homo sapiens
tcttggccgactcagggaccta

SEQ ID NO: 5004737 - DNA, 19 bp, Homo sapiens
tctttcttattttgtaata

SEQ ID NO: 5004738 - DNA, 21 bp, Homo sapiens
tctttcttattttgtaataaa

SEQ ID NO: 5004739 - DNA, 22 bp, Homo sapiens
tctttgagataatacattccga

SEQ ID NO: 5004740 - DNA, 23 bp, Homo sapiens
tgaaaatgcaacaacatgtataa

SEQ ID NO: 5004741 - DNA, 23 bp, Homo sapiens
tgaacaccactttgtctctgaga

SEQ ID NO: 5004742 - DNA, 16 bp, Homo sapiens
tgaaccagtcctgctg

SEQ ID NO: 5004743 - DNA, 16 bp, Homo sapiens
tgaaggtttgatgcca

SEQ ID NO: 5004744 - DNA, 20 bp, Homo sapiens
tgaaggtttgatgccaaagc

SEQ ID NO: 5004745 - DNA, 23 bp, Homo sapiens
tgaaggtttgatgccaaagcaga

SEQ ID NO: 5004746 - DNA, 20 bp, Homo sapiens
tgaatggctgtgccccacct

SEQ ID NO: 5004747 - DNA, 21 bp, Homo sapiens
tgaatggctgtgccccacctg

SEQ ID NO: 5004748 - DNA, 16 bp, Homo sapiens
tgaccaaaaccagagg

SEQ ID NO: 5004749 - DNA, 18 bp, Homo sapiens
tgaccaaaaccagagggc

SEQ ID NO: 5004750 - DNA, 20 bp, Homo sapiens
tgaccaaaaccagagggcag

SEQ ID NO: 5004751 - DNA, 21 bp, Homo sapiens
tgaccaaaaccagagggcagt

SEQ ID NO: 5004752 - DNA, 12 bp, Homo sapiens
tgacctgctgtg

SEQ ID NO: 5004753 - DNA, 20 bp, Homo sapiens
tgacctggttgtccaggtct

SEQ ID NO: 5004754 - DNA, 21 bp, Homo sapiens
tgactctgcctaaccatgggc

SEQ ID NO: 5004755 - DNA, 15 bp, Homo sapiens
tgactgctcaggcct

SEQ ID NO: 5004756 - DNA, 16 bp, Homo sapiens
tgactgctcaggcctc

SEQ ID NO: 5004757 - DNA, 15 bp, Homo sapiens
tgagaagatggcact

SEQ ID NO: 5004758 - DNA, 16 bp, Homo sapiens
tgagaagatggcactg

SEQ ID NO: 5004759 - DNA, 21 bp, Homo sapiens
tgagaagatggcactgtccag

SEQ ID NO: 5004760 - DNA, 23 bp, Homo sapiens
tgagagagtgctgagaaggacac

SEQ ID NO: 5004761 - DNA, 16 bp, Homo sapiens
tgaggaacctcaaact

SEQ ID NO: 5004762 - DNA, 21 bp, Homo sapiens
tgagggtggggtgccccagct

SEQ ID NO: 5004763 - DNA, 18 bp, Homo sapiens
tgaggtcatagcagtgct

SEQ ID NO: 5004764 - DNA, 12 bp, Homo sapiens
tgatgccaaagc

SEQ ID NO: 5004765 - DNA, 15 bp, Homo sapiens
tgatgccaaagcaga

SEQ ID NO: 5004766 - DNA, 18 bp, Homo sapiens
tgatgccaaagcagacat

SEQ ID NO: 5004767 - DNA, 19 bp, Homo sapiens
tgatgggagtaggctccag

SEQ ID NO: 5004768 - DNA, 20 bp, Homo sapiens
tgatgggagtaggctccaga

SEQ ID NO: 5004769 - DNA, 23 bp, Homo sapiens
tgatgggagtaggctccagacag

SEQ ID NO: 5004770 - DNA, 18 bp, Homo sapiens
tgatgtgggtcaaggaat

SEQ ID NO: 5004771 - DNA, 21 bp, Homo sapiens
tgcaaaaggcctgtgatccag

SEQ ID NO: 5004772 - DNA, 15 bp, Homo sapiens
tgcaacaacatgtat

SEQ ID NO: 5004773 - DNA, 18 bp, Homo sapiens
tgcacccccctgtgcctg

SEQ ID NO: 5004774 - DNA, 15 bp, Homo sapiens
tgcaggaatgctgac

SEQ ID NO: 5004775 - DNA, 17 bp, Homo sapiens
tgcatagagccacgtat

SEQ ID NO: 5004776 - DNA, 11 bp, Homo sapiens
tgcatgaaaat

SEQ ID NO: 5004777 - DNA, 18 bp, Homo sapiens
tgcatgaaggtttctgaa

SEQ ID NO: 5004778 - DNA, 19 bp, Homo sapiens
tgcatgaaggtttctgaaa

SEQ ID NO: 5004779 - DNA, 14 bp, Homo sapiens
tgccaaagcagaca

SEQ ID NO: 5004780 - DNA, 20 bp, Homo sapiens
tgccaccttgggtctgtgtc

SEQ ID NO: 5004781 - DNA, 13 bp, Homo sapiens
tgccaggcaccat

SEQ ID NO: 5004782 - DNA, 19 bp, Homo sapiens
tgccatccctccctccacc

SEQ ID NO: 5004783 - DNA, 22 bp, Homo sapiens
tgccatgactgctcaggcctca

SEQ ID NO: 5004784 - DNA, 12 bp, Homo sapiens
tgccatgggaga

SEQ ID NO: 5004785 - DNA, 18 bp, Homo sapiens
tgccatgggagagtccag

SEQ ID NO: 5004786 - DNA, 14 bp, Homo sapiens
tgcccaccatcggg

SEQ ID NO: 5004787 - DNA, 16 bp, Homo sapiens
tgcccaccccatccct

SEQ ID NO: 5004788 - DNA, 19 bp, Homo sapiens
tgcccaccccatccctggc

SEQ ID NO: 5004789 - DNA, 15 bp, Homo sapiens
tgccctagggctcag

SEQ ID NO: 5004790 - DNA, 13 bp, Homo sapiens
tgccctccagggc

SEQ ID NO: 5004791 - DNA, 17 bp, Homo sapiens
tgccctccagggccagg

SEQ ID NO: 5004792 - DNA, 18 bp, Homo sapiens
tgccctccagggccagga

SEQ ID NO: 5004793 - DNA, 22 bp, Homo sapiens
tgccctccagggccaggattca

SEQ ID NO: 5004794 - DNA, 13 bp, Homo sapiens
tgccctctcctgg

SEQ ID NO: 5004795 - DNA, 17 bp, Homo sapiens
tgccctctcctgggcag

SEQ ID NO: 5004796 - DNA, 20 bp, Homo sapiens
tgccctctcctgggcagctg

SEQ ID NO: 5004797 - DNA, 22 bp, Homo sapiens
tgccctctcctgggcagctgcc

SEQ ID NO: 5004798 - DNA, 23 bp, Homo sapiens
tgccctctcctgggcagctgcct

SEQ ID NO: 5004799 - DNA, 15 bp, Homo sapiens
tgcctcaacagcagg

SEQ ID NO: 5004800 - DNA, 19 bp, Homo sapiens
tgcctcaacagcaggaggc

SEQ ID NO: 5004801 - DNA, 22 bp, Homo sapiens
tgcctcaacagcaggaggcaca

SEQ ID NO: 5004802 - DNA, 23 bp, Homo sapiens
tgcctcaacagcaggaggcacag

SEQ ID NO: 5004803 - DNA, 13 bp, Homo sapiens
tgcctcccctcct

SEQ ID NO: 5004804 - DNA, 13 bp, Homo sapiens
tgcctctgtcctt

SEQ ID NO: 5004805 - DNA, 15 bp, Homo sapiens
tgcctgatgggagta

SEQ ID NO: 5004806 - DNA, 22 bp, Homo sapiens
tgcctgatgggagtaggctcca

SEQ ID NO: 5004807 - DNA, 14 bp, Homo sapiens
tgcctgctgggcac

SEQ ID NO: 5004808 - DNA, 17 bp, Homo sapiens
tgcctgctgggcactgg

SEQ ID NO: 5004809 - DNA, 20 bp, Homo sapiens
tgcctgctgggcactgggca

SEQ ID NO: 5004810 - DNA, 14 bp, Homo sapiens
tgcctgtcacccca

SEQ ID NO: 5004811 - DNA, 15 bp, Homo sapiens
tgcctgtcaccccag

SEQ ID NO: 5004812 - DNA, 18 bp, Homo sapiens
tgccttatctcttctcac

SEQ ID NO: 5004813 - DNA, 19 bp, Homo sapiens
tgctatccagctattttta

SEQ ID NO: 5004814 - DNA, 21 bp, Homo sapiens
tgctcaccaattccacttcct

SEQ ID NO: 5004815 - DNA, 16 bp, Homo sapiens
tgctcattccatgact

SEQ ID NO: 5004816 - DNA, 21 bp, Homo sapiens
tgctcattccatgactctgcc

SEQ ID NO: 5004817 - DNA, 23 bp, Homo sapiens
tgctcctgaaccagtcctgctgc

SEQ ID NO: 5004818 - DNA, 13 bp, Homo sapiens
tgctgccatgccc

SEQ ID NO: 5004819 - DNA, 13 bp, Homo sapiens
tgctgcctggagt

SEQ ID NO: 5004820 - DNA, 18 bp, Homo sapiens
tgctgggccagtggcact

SEQ ID NO: 5004821 - DNA, 14 bp, Homo sapiens
tgctggggcagagt

SEQ ID NO: 5004822 - DNA, 19 bp, Homo sapiens
tgctggggcagagtggagc

SEQ ID NO: 5004823 - DNA, 15 bp, Homo sapiens
tgcttgccatccctc

SEQ ID NO: 5004824 - DNA, 16 bp, Homo sapiens
tgcttgccatccctcc

SEQ ID NO: 5004825 - DNA, 18 bp, Homo sapiens
tgctttaggttgcttcag

SEQ ID NO: 5004826 - DNA, 19 bp, Homo sapiens
tgctttagtacatggagct

SEQ ID NO: 5004827 - DNA, 23 bp, Homo sapiens
tgctttagtacatggagctcagg

SEQ ID NO: 5004828 - DNA, 13 bp, Homo sapiens
tggagaggcatgg

SEQ ID NO: 5004829 - DNA, 20 bp, Homo sapiens
tggagcccagggtgctggga

SEQ ID NO: 5004830 - DNA, 17 bp, Homo sapiens
tggagctaaggccagct

SEQ ID NO: 5004831 - DNA, 22 bp, Homo sapiens
tggaggactctagaagctcagg

SEQ ID NO: 5004832 - DNA, 16 bp, Homo sapiens
tggagtcagtagccag

SEQ ID NO: 5004833 - DNA, 20 bp, Homo sapiens
tggagtcagtagccagagtt

SEQ ID NO: 5004834 - DNA, 17 bp, Homo sapiens
tggagtcatgtgcctct

SEQ ID NO: 5004835 - DNA, 16 bp, Homo sapiens
tggcaagctgcaaaag

SEQ ID NO: 5004836 - DNA, 15 bp, Homo sapiens
tggcactgtggaact

SEQ ID NO: 5004837 - DNA, 22 bp, Homo sapiens
tggcagaaagatggagaggcat

SEQ ID NO: 5004838 - DNA, 22 bp, Homo sapiens
tggcagaatggggtgcatgaag

SEQ ID NO: 5004839 - DNA, 13 bp, Homo sapiens
tggcaggggcagt

SEQ ID NO: 5004840 - DNA, 14 bp, Homo sapiens
tggcaggggcagtg

SEQ ID NO: 5004841 - DNA, 21 bp, Homo sapiens
tggcaggggcagtggcctgga

SEQ ID NO: 5004842 - DNA, 23 bp, Homo sapiens
tggcaggggcagtggcctggatg

SEQ ID NO: 5004843 - DNA, 11 bp, Homo sapiens
tggcccagaga

SEQ ID NO: 5004844 - DNA, 14 bp, Homo sapiens
tggcccagagaggt

SEQ ID NO: 5004845 - DNA, 17 bp, Homo sapiens
tggccgactcagggacc

SEQ ID NO: 5004846 - DNA, 18 bp, Homo sapiens
tggccgactcagggacct

SEQ ID NO: 5004847 - DNA, 15 bp, Homo sapiens
tggcctggatgcaca

SEQ ID NO: 5004848 - DNA, 22 bp, Homo sapiens
tggcctggatgcacagtgcctg

SEQ ID NO: 5004849 - DNA, 11 bp, Homo sapiens
tgggacagaca

SEQ ID NO: 5004850 - DNA, 13 bp, Homo sapiens
tgggacagacagc

SEQ ID NO: 5004851 - DNA, 16 bp, Homo sapiens
tgggacagacagcagc

SEQ ID NO: 5004852 - DNA, 19 bp, Homo sapiens
tgggacagacagcagctgg

SEQ ID NO: 5004853 - DNA, 15 bp, Homo sapiens
tgggagtaggctcca

SEQ ID NO: 5004854 - DNA, 21 bp, Homo sapiens
tgggagtaggctccagacagg

SEQ ID NO: 5004855 - DNA, 22 bp, Homo sapiens
tgggagtaggctccagacagga

SEQ ID NO: 5004856 - DNA, 14 bp, Homo sapiens
tgggatgtttctgt

SEQ ID NO: 5004857 - DNA, 16 bp, Homo sapiens
tgggcactgggcacta

SEQ ID NO: 5004858 - DNA, 18 bp, Homo sapiens
tgggcactgggcactagc

SEQ ID NO: 5004859 - DNA, 15 bp, Homo sapiens
tgggcagctgcctcc

SEQ ID NO: 5004860 - DNA, 20 bp, Homo sapiens
tgggcagctgcctcccctcc

SEQ ID NO: 5004861 - DNA, 17 bp, Homo sapiens
tgggcccagaggagagg

SEQ ID NO: 5004862 - DNA, 23 bp, Homo sapiens
tgggcccagaggagaggagacag

SEQ ID NO: 5004863 - DNA, 12 bp, Homo sapiens
tgggctcagggc

SEQ ID NO: 5004864 - DNA, 13 bp, Homo sapiens
tgggctccctgga

SEQ ID NO: 5004865 - DNA, 17 bp, Homo sapiens
tgggctccctggaggac

SEQ ID NO: 5004866 - DNA, 22 bp, Homo sapiens
tgggctccctggaggactctag

SEQ ID NO: 5004867 - DNA, 16 bp, Homo sapiens
tggggcagagtggagc

SEQ ID NO: 5004868 - DNA, 20 bp, Homo sapiens
tggggcagagtggagcccag

SEQ ID NO: 5004869 - DNA, 19 bp, Homo sapiens
tggggtgccccagctagga

SEQ ID NO: 5004870 - DNA, 16 bp, Homo sapiens
tggtcaccatgaaact

SEQ ID NO: 5004871 - DNA, 16 bp, Homo sapiens
tggtcggcaagagtga

SEQ ID NO: 5004872 - DNA, 15 bp, Homo sapiens
tggtggtatctgagt

SEQ ID NO: 5004873 - DNA, 13 bp, Homo sapiens
tggttaatgccat

SEQ ID NO: 5004874 - DNA, 15 bp, Homo sapiens
tggttgtccaggtct

SEQ ID NO: 5004875 - DNA, 11 bp, Homo sapiens
tgtaaatatag

SEQ ID NO: 5004876 - DNA, 16 bp, Homo sapiens
tgtaataaactctcta

SEQ ID NO: 5004877 - DNA, 20 bp, Homo sapiens
tgtagcaaccttctgcattc

SEQ ID NO: 5004878 - DNA, 13 bp, Homo sapiens
tgtagctggcaag

SEQ ID NO: 5004879 - DNA, 15 bp, Homo sapiens
tgtagctggcaagct

SEQ ID NO: 5004880 - DNA, 17 bp, Homo sapiens
tgtaggtttctctgcct

SEQ ID NO: 5004881 - DNA, 15 bp, Homo sapiens
tgtataatattttta

SEQ ID NO: 5004882 - DNA, 22 bp, Homo sapiens
tgtcaccagctgccaaaatcgt

SEQ ID NO: 5004883 - DNA, 20 bp, Homo sapiens
tgtcacttgtaggtttctct

SEQ ID NO: 5004884 - DNA, 17 bp, Homo sapiens
tgtcagtcccactgcac

SEQ ID NO: 5004885 - DNA, 12 bp, Homo sapiens
tgtccagggccc

SEQ ID NO: 5004886 - DNA, 13 bp, Homo sapiens
tgtccagggccca

SEQ ID NO: 5004887 - DNA, 15 bp, Homo sapiens
tgtccagggcccatg

SEQ ID NO: 5004888 - DNA, 21 bp, Homo sapiens
tgtccaggtctagaaggccag

SEQ ID NO: 5004889 - DNA, 22 bp, Homo sapiens
tgtccaggtctagaaggccagg

SEQ ID NO: 5004890 - DNA, 13 bp, Homo sapiens
tgtcccacaggga

SEQ ID NO: 5004891 - DNA, 16 bp, Homo sapiens
tgtcccacagggacca

SEQ ID NO: 5004892 - DNA, 22 bp, Homo sapiens
tgtcccacagggaccacatcca

SEQ ID NO: 5004893 - DNA, 16 bp, Homo sapiens
tgtccctattctgcca

SEQ ID NO: 5004894 - DNA, 16 bp, Homo sapiens
tgtcctgaactgtgag

SEQ ID NO: 5004895 - DNA, 11 bp, Homo sapiens
tgtctctgagg

SEQ ID NO: 5004896 - DNA, 17 bp, Homo sapiens
tgtgatccaggaaagat

SEQ ID NO: 5004897 - DNA, 17 bp, Homo sapiens
tgtgcacttatttatga

SEQ ID NO: 5004898 - DNA, 17 bp, Homo sapiens
tgtgccctagggctcag

SEQ ID NO: 5004899 - DNA, 12 bp, Homo sapiens
tgtgcctgctgg

SEQ ID NO: 5004900 - DNA, 14 bp, Homo sapiens
tgtggaactgccac

SEQ ID NO: 5004901 - DNA, 16 bp, Homo sapiens
tgtggaactgccacct

SEQ ID NO: 5004902 - DNA, 14 bp, Homo sapiens
tgtggatgtcccta

SEQ ID NO: 5004903 - DNA, 19 bp, Homo sapiens
tgtggcaggggcagtggcc

SEQ ID NO: 5004904 - DNA, 20 bp, Homo sapiens
tgtggttaatgccatggaca

SEQ ID NO: 5004905 - DNA, 9 bp, Homo sapiens
tgtgtaaat

SEQ ID NO: 5004906 - DNA, 14 bp, Homo sapiens
tgtgtatgatccaa

SEQ ID NO: 5004907 - DNA, 23 bp, Homo sapiens
tgttctcattcctgttctttctt

SEQ ID NO: 5004908 - DNA, 20 bp, Homo sapiens
tgttctttggaaatacacag

SEQ ID NO: 5004909 - DNA, 14 bp, Homo sapiens
tgttgacatgtgct

SEQ ID NO: 5004910 - DNA, 22 bp, Homo sapiens
ttaaacaaatgtatgattacat

SEQ ID NO: 5004911 - DNA, 22 bp, Homo sapiens
ttaatatggggatgcagcatta

SEQ ID NO: 5004912 - DNA, 21 bp, Homo sapiens
ttagaactttgcatagcagct

SEQ ID NO: 5004913 - DNA, 20 bp, Homo sapiens
ttagcacatcactgagaaga

SEQ ID NO: 5004914 - DNA, 19 bp, Homo sapiens
ttatttcttaaacaaatgt

SEQ ID NO: 5004915 - DNA, 20 bp, Homo sapiens
ttcaatggtttgcaaggaag

SEQ ID NO: 5004916 - DNA, 15 bp, Homo sapiens
ttcaccatctttgag

SEQ ID NO: 5004917 - DNA, 20 bp, Homo sapiens
ttcacctttcccactttctt

SEQ ID NO: 5004918 - DNA, 15 bp, Homo sapiens
ttcagagctgccctc

SEQ ID NO: 5004919 - DNA, 18 bp, Homo sapiens
ttcagagctgccctctcc

SEQ ID NO: 5004920 - DNA, 11 bp, Homo sapiens
ttcaggcctct

SEQ ID NO: 5004921 - DNA, 13 bp, Homo sapiens
ttcattctcttga

SEQ ID NO: 5004922 - DNA, 14 bp, Homo sapiens
ttccacttcctgcc

SEQ ID NO: 5004923 - DNA, 14 bp, Homo sapiens
ttccacttctctag

SEQ ID NO: 5004924 - DNA, 22 bp, Homo sapiens
ttccccagacttctctttctta

SEQ ID NO: 5004925 - DNA, 23 bp, Homo sapiens
ttccccagccctccccacctgct

SEQ ID NO: 5004926 - DNA, 12 bp, Homo sapiens
ttccctgccaca

SEQ ID NO: 5004927 - DNA, 22 bp, Homo sapiens
ttcctcacacccacctgctgct

SEQ ID NO: 5004928 - DNA, 23 bp, Homo sapiens
ttcctcacacccacctgctgctg

SEQ ID NO: 5004929 - DNA, 15 bp, Homo sapiens
ttcctcagtcctgga

SEQ ID NO: 5004930 - DNA, 21 bp, Homo sapiens
ttccttttcttgtctctgagg

SEQ ID NO: 5004931 - DNA, 21 bp, Homo sapiens
ttcgatgggcccaattcttac

SEQ ID NO: 5004932 - DNA, 19 bp, Homo sapiens
ttctgaaaattaacactgc

SEQ ID NO: 5004933 - DNA, 17 bp, Homo sapiens
ttctgccatgggagagt

SEQ ID NO: 5004934 - DNA, 15 bp, Homo sapiens
ttcttattttgtaat

SEQ ID NO: 5004935 - DNA, 20 bp, Homo sapiens
ttcttattttgtaataaact

SEQ ID NO: 5004936 - DNA, 21 bp, Homo sapiens
ttcttattttgtaataaactc

SEQ ID NO: 5004937 - DNA, 22 bp, Homo sapiens
ttcttccttaattcactcccac

SEQ ID NO: 5004938 - DNA, 13 bp, Homo sapiens
ttcttgtctctga

SEQ ID NO: 5004939 - DNA, 19 bp, Homo sapiens
ttgaaggtttgatgccaaa

SEQ ID NO: 5004940 - DNA, 18 bp, Homo sapiens
ttgaagtggccagatgag

SEQ ID NO: 5004941 - DNA, 15 bp, Homo sapiens
ttgacagaacactgt

SEQ ID NO: 5004942 - DNA, 16 bp, Homo sapiens
ttgacagaacactgtc

SEQ ID NO: 5004943 - DNA, 19 bp, Homo sapiens
ttgacttgacagaacactg

SEQ ID NO: 5004944 - DNA, 19 bp, Homo sapiens
ttgagataatacattccga

SEQ ID NO: 5004945 - DNA, 12 bp, Homo sapiens
ttgatgccaaag

SEQ ID NO: 5004946 - DNA, 14 bp, Homo sapiens
ttgcatatatacat

SEQ ID NO: 5004947 - DNA, 16 bp, Homo sapiens
ttgcctcaacagcagg

SEQ ID NO: 5004948 - DNA, 21 bp, Homo sapiens
ttgcctcaacagcaggaggca

SEQ ID NO: 5004949 - DNA, 21 bp, Homo sapiens
ttgctggagtcatgtgcctct

SEQ ID NO: 5004950 - DNA, 13 bp, Homo sapiens
ttggtgttgacat

SEQ ID NO: 5004951 - DNA, 13 bp, Homo sapiens
ttgtaataaactc

SEQ ID NO: 5004952 - DNA, 16 bp, Homo sapiens
ttgtaataaactctct

SEQ ID NO: 5004953 - DNA, 19 bp, Homo sapiens
ttgtacacaccttatattt

SEQ ID NO: 5004954 - DNA, 18 bp, Homo sapiens
ttgtaggtttctctgcct

SEQ ID NO: 5004955 - DNA, 19 bp, Homo sapiens
ttgtaggtttctctgcctc

SEQ ID NO: 5004956 - DNA, 12 bp, Homo sapiens
ttgtctctgagg

SEQ ID NO: 5004957 - DNA, 22 bp, Homo sapiens
ttgtggaggagctcaggacact

SEQ ID NO: 5004958 - DNA, 13 bp, Homo sapiens
ttgttctcagggg

SEQ ID NO: 5004959 - DNA, 21 bp, Homo sapiens
tttacaccagttcctttcaat

SEQ ID NO: 5004960 - DNA, 21 bp, Homo sapiens
tttagcacatcactgagaaga

SEQ ID NO: 5004961 - DNA, 23 bp, Homo sapiens
tttagctgtgaatggctgtgccc

SEQ ID NO: 5004962 - DNA, 20 bp, Homo sapiens
tttatgccttttatttctta

SEQ ID NO: 5004963 - DNA, 21 bp, Homo sapiens
tttcaatggtttgcaaggaag

SEQ ID NO: 5004964 - DNA, 19 bp, Homo sapiens
tttcaatttccaagagctg

SEQ ID NO: 5004965 - DNA, 13 bp, Homo sapiens
tttccaagagctg

SEQ ID NO: 5004966 - DNA, 16 bp, Homo sapiens
tttccaagagctgagg

SEQ ID NO: 5004967 - DNA, 23 bp, Homo sapiens
tttccatgcaccctcatacacag

SEQ ID NO: 5004968 - DNA, 17 bp, Homo sapiens
tttcccactttcttcta

SEQ ID NO: 5004969 - DNA, 19 bp, Homo sapiens
tttcccactttcttctacc

SEQ ID NO: 5004970 - DNA, 17 bp, Homo sapiens
tttctctgcctccaggt

SEQ ID NO: 5004971 - DNA, 19 bp, Homo sapiens
tttctgaatttcattctct

SEQ ID NO: 5004972 - DNA, 17 bp, Homo sapiens
tttcttattttgtaata

SEQ ID NO: 5004973 - DNA, 23 bp, Homo sapiens
tttcttattttgtaataaactct

SEQ ID NO: 5004974 - DNA, 14 bp, Homo sapiens
tttcttgtctctga

SEQ ID NO: 5004975 - DNA, 19 bp, Homo sapiens
tttgaatataaacactata

SEQ ID NO: 5004976 - DNA, 18 bp, Homo sapiens
tttgatagtattgtgcat

SEQ ID NO: 5004977 - DNA, 22 bp, Homo sapiens
tttgctaactagcttggaaact

SEQ ID NO: 5004978 - DNA, 14 bp, Homo sapiens
tttgtaataaactc

SEQ ID NO: 5004979 - DNA, 17 bp, Homo sapiens
tttgtaataaactctct

SEQ ID NO: 5004980 - DNA, 13 bp, Homo sapiens
ttttaatttgata

SEQ ID NO: 5004981 - DNA, 18 bp, Homo sapiens
ttttccatgaaaatgcaa

SEQ ID NO: 5004982 - DNA, 17 bp, Homo sapiens
ttttctactttttttaa

SEQ ID NO: 5004983 - DNA, 18 bp, Homo sapiens
ttttcttgtctctgaggc

SEQ ID NO: 5004984 - DNA, 12 bp, Homo sapiens
ttttgcagatag

SEQ ID NO: 5004985 - DNA, 12 bp, Homo sapiens
ttttgcatgaaa

SEQ ID NO: 5004986 - DNA, 15 bp, Homo sapiens
tttttgtgtatttgt

SEQ ID NO: 5004987 - DNA, 20 bp, Homo sapiens
gtattgtttgggatcctatt

SEQ ID NO: 5004988 - DNA, 19 bp, Homo sapiens
gtattttataattctggga

SEQ ID NO: 5004989 - DNA, 20 bp, Homo sapiens
gtattttcttcacctctgct

SEQ ID NO: 5004990 - DNA, 22 bp, Homo sapiens
gtcaaatgcatacaagtttcat

SEQ ID NO: 5004991 - DNA, 23 bp, Homo sapiens
gtctagcctatgtggattttttc

SEQ ID NO: 5004992 - DNA, 14 bp, Homo sapiens
gtctcagtttcttg

SEQ ID NO: 5004993 - DNA, 12 bp, Homo sapiens
gtgcaatagaag

SEQ ID NO: 5004994 - DNA, 16 bp, Homo sapiens
gtggaacgaaaatgaa

SEQ ID NO: 5004995 - DNA, 15 bp, Homo sapiens
gtggagtcattctca

SEQ ID NO: 5004996 - DNA, 17 bp, Homo sapiens
gtggggaagtgatcttt

SEQ ID NO: 5004997 - DNA, 14 bp, Homo sapiens
gtgtccctaatgtg

SEQ ID NO: 5004998 - DNA, 20 bp, Homo sapiens
gtgttactaaaaaaaagatg

SEQ ID NO: 5004999 - DNA, 14 bp, Homo sapiens
gtgttcattgtttc

SEQ ID NO: 5005000 - DNA, 20 bp, Homo sapiens
gtgttttgaaagaatagaac

SEQ ID NO: 5005001 - DNA, 18 bp, Homo sapiens
gttacgtagcctaaggct

SEQ ID NO: 5005002 - DNA, 15 bp, Homo sapiens
gttcaaacatttacc

SEQ ID NO: 5005003 - DNA, 22 bp, Homo sapiens
gttcaacaaagaaacaaagatg

SEQ ID NO: 5005004 - DNA, 23 bp, Homo sapiens
gttcccatcctcttcttttagca

SEQ ID NO: 5005005 - DNA, 17 bp, Homo sapiens
gttcttgccactttttt

SEQ ID NO: 5005006 - DNA, 15 bp, Homo sapiens
gttgaacctatttct

SEQ ID NO: 5005007 - DNA, 18 bp, Homo sapiens
gttgaacctatttctctt

SEQ ID NO: 5005008 - DNA, 23 bp, Homo sapiens
gttgccatcctaccgtcttttcc

SEQ ID NO: 5005009 - DNA, 23 bp, Homo sapiens
gttgtgacaacttcctgagggat

SEQ ID NO: 5005010 - DNA, 21 bp, Homo sapiens
gtttacagtctatttgagact

SEQ ID NO: 5005011 - DNA, 14 bp, Homo sapiens
gtttctgtttaact

SEQ ID NO: 5005012 - DNA, 19 bp, Homo sapiens
gtttctgtttaacttctta

SEQ ID NO: 5005013 - DNA, 19 bp, Homo sapiens
gtttgggatcctattgaac

SEQ ID NO: 5005014 - DNA, 18 bp, Homo sapiens
gtttgtggctattaaaac

SEQ ID NO: 5005015 - DNA, 16 bp, Homo sapiens
gttttaactgtggata

SEQ ID NO: 5005016 - DNA, 19 bp, Homo sapiens
gttttcagcattgatattt

SEQ ID NO: 5005017 - DNA, 22 bp, Homo sapiens
gttttgcacagccaaatttaaa

SEQ ID NO: 5005018 - DNA, 15 bp, Homo sapiens
taaaaacaggcagct

SEQ ID NO: 5005019 - DNA, 23 bp, Homo sapiens
taaaaatggcagggggtggaatt

SEQ ID NO: 5005020 - DNA, 14 bp, Homo sapiens
taaaactcttttaa

SEQ ID NO: 5005021 - DNA, 18 bp, Homo sapiens
taaaataaatattgtctt

SEQ ID NO: 5005022 - DNA, 21 bp, Homo sapiens
taaaatctgatatgtattgtt

SEQ ID NO: 5005023 - DNA, 22 bp, Homo sapiens
taaaatctgatatgtattgttt

SEQ ID NO: 5005024 - DNA, 14 bp, Homo sapiens
taaactaaatgtgc

SEQ ID NO: 5005025 - DNA, 13 bp, Homo sapiens
taaatattgtctt

SEQ ID NO: 5005026 - DNA, 15 bp, Homo sapiens
taaatattgtctttt

SEQ ID NO: 5005027 - DNA, 16 bp, Homo sapiens
taaatattgtcttttt

SEQ ID NO: 5005028 - DNA, 18 bp, Homo sapiens
taaatggaaactgaaact

SEQ ID NO: 5005029 - DNA, 19 bp, Homo sapiens
taaatgtgcaatagaaggt

SEQ ID NO: 5005030 - DNA, 14 bp, Homo sapiens
taacaatgtatttt

SEQ ID NO: 5005031 - DNA, 21 bp, Homo sapiens
taacacagcattgtatatgtg

SEQ ID NO: 5005032 - DNA, 15 bp, Homo sapiens
taacaggccaaagag

SEQ ID NO: 5005033 - DNA, 17 bp, Homo sapiens
taactgccgtaatttaa

SEQ ID NO: 5005034 - DNA, 13 bp, Homo sapiens
taactttctgggt

SEQ ID NO: 5005035 - DNA, 13 bp, Homo sapiens
taagaaatagaat

SEQ ID NO: 5005036 - DNA, 20 bp, Homo sapiens
taatacaatgatgctatttg

SEQ ID NO: 5005037 - DNA, 18 bp, Homo sapiens
taatgtcaaacttgagtc

SEQ ID NO: 5005038 - DNA, 16 bp, Homo sapiens
taattagcatctcagg

SEQ ID NO: 5005039 - DNA, 19 bp, Homo sapiens
taattcttgcatattttgt

SEQ ID NO: 5005040 - DNA, 20 bp, Homo sapiens
taattgtgtggattctttaa

SEQ ID NO: 5005041 - DNA, 11 bp, Homo sapiens
taatttaactt

SEQ ID NO: 5005042 - DNA, 19 bp, Homo sapiens
taatttaactttctgggtt

SEQ ID NO: 5005043 - DNA, 17 bp, Homo sapiens
taatttgttttggatat

SEQ ID NO: 5005044 - DNA, 14 bp, Homo sapiens
tacccaaactgctt

SEQ ID NO: 5005045 - DNA, 16 bp, Homo sapiens
tactaaggacgttgtt

SEQ ID NO: 5005046 - DNA, 21 bp, Homo sapiens
tactcaagtagcatttactgt

SEQ ID NO: 5005047 - DNA, 13 bp, Homo sapiens
tactgaatctgct

SEQ ID NO: 5005048 - DNA, 16 bp, Homo sapiens
tactgcaaaaagaaaa

SEQ ID NO: 5005049 - DNA, 17 bp, Homo sapiens
tacttctgtaattgtgt

SEQ ID NO: 5005050 - DNA, 22 bp, Homo sapiens
tagagtttcaaccatgaagtct

SEQ ID NO: 5005051 - DNA, 15 bp, Homo sapiens
tagatgttctacttt

SEQ ID NO: 5005052 - DNA, 13 bp, Homo sapiens
tagcagtaaaata

SEQ ID NO: 5005053 - DNA, 16 bp, Homo sapiens
taggctcatttactgt

SEQ ID NO: 5005054 - DNA, 20 bp, Homo sapiens
taggtctagcctatgtggat

SEQ ID NO: 5005055 - DNA, 23 bp, Homo sapiens
tagtagatgttctactttgttct

SEQ ID NO: 5005056 - DNA, 16 bp, Homo sapiens
tataacagtgtttaaa

SEQ ID NO: 5005057 - DNA, 17 bp, Homo sapiens
tattaaatggaaactga

SEQ ID NO: 5005058 - DNA, 21 bp, Homo sapiens
tattaatacaatgatgctatt

SEQ ID NO: 5005059 - DNA, 17 bp, Homo sapiens
tattcgcttgagaaaaa

SEQ ID NO: 5005060 - DNA, 22 bp, Homo sapiens
tattcgcttgagaaaaaaagaa

SEQ ID NO: 5005061 - DNA, 17 bp, Homo sapiens
tattgggttccattctc

SEQ ID NO: 5005062 - DNA, 14 bp, Homo sapiens
tattgtctttttgt

SEQ ID NO: 5005063 - DNA, 13 bp, Homo sapiens
tatttctctttct

SEQ ID NO: 5005064 - DNA, 15 bp, Homo sapiens
tatttctctttcttt

SEQ ID NO: 5005065 - DNA, 18 bp, Homo sapiens
tatttgtataaaagtgtg

SEQ ID NO: 5005066 - DNA, 13 bp, Homo sapiens
tatttgtgcattt

SEQ ID NO: 5005067 - DNA, 16 bp, Homo sapiens
tcaacagtttccagtc

SEQ ID NO: 5005068 - DNA, 17 bp, Homo sapiens
tcaaccagggattgttt

SEQ ID NO: 5005069 - DNA, 22 bp, Homo sapiens
tcaaccagggattgtttctgtt

SEQ ID NO: 5005070 - DNA, 14 bp, Homo sapiens
tcaagagacatggt

SEQ ID NO: 5005071 - DNA, 15 bp, Homo sapiens
tcaataaactgaatt

SEQ ID NO: 5005072 - DNA, 16 bp, Homo sapiens
tcaatatgagtctcaa

SEQ ID NO: 5005073 - DNA, 23 bp, Homo sapiens
tcaattccaacactgatttcccc

SEQ ID NO: 5005074 - DNA, 13 bp, Homo sapiens
tcacctgcactaa

SEQ ID NO: 5005075 - DNA, 18 bp, Homo sapiens
tcaggaattcttggagaa

SEQ ID NO: 5005076 - DNA, 16 bp, Homo sapiens
tcaggacttgaaagaa

SEQ ID NO: 5005077 - DNA, 17 bp, Homo sapiens
tcagttaagtttttccc

SEQ ID NO: 5005078 - DNA, 20 bp, Homo sapiens
tcagttcttgccactttttt

SEQ ID NO: 5005079 - DNA, 21 bp, Homo sapiens
tcatcactttgacctaaatta

SEQ ID NO: 5005080 - DNA, 18 bp, Homo sapiens
tcatttttcagacctttt

SEQ ID NO: 5005081 - DNA, 15 bp, Homo sapiens
tccagatagtgtagc

SEQ ID NO: 5005082 - DNA, 19 bp, Homo sapiens
tccatttgttatctgggaa

SEQ ID NO: 5005083 - DNA, 18 bp, Homo sapiens
aagttgttcaaacattta

SEQ ID NO: 5005084 - DNA, 23 bp, Homo sapiens
aataaactgaatttttcttgcga

SEQ ID NO: 5005085 - DNA, 12 bp, Homo sapiens
aatacctgctca

SEQ ID NO: 5005086 - DNA, 13 bp, Homo sapiens
aatagaacacagt

SEQ ID NO: 5005087 - DNA, 18 bp, Homo sapiens
aatagatatgaaagctga

SEQ ID NO: 5005088 - DNA, 19 bp, Homo sapiens
aatagatatgaaagctgat

SEQ ID NO: 5005089 - DNA, 22 bp, Homo sapiens
aatagttgaacctatttctctt

SEQ ID NO: 5005090 - DNA, 18 bp, Homo sapiens
aatatttggttttcctgt

SEQ ID NO: 5005091 - DNA, 13 bp, Homo sapiens
aatcagaattaga

SEQ ID NO: 5005092 - DNA, 14 bp, Homo sapiens
aatcccagcaattt

SEQ ID NO: 5005093 - DNA, 21 bp, Homo sapiens
atatttgtgcattttctaaac

SEQ ID NO: 5005094 - DNA, 15 bp, Homo sapiens
atcagtgttggccat

SEQ ID NO: 5005095 - DNA, 13 bp, Homo sapiens
atccggaaagaag

SEQ ID NO: 5005096 - DNA, 19 bp, Homo sapiens
atctacttctgtaattgtg

SEQ ID NO: 5005097 - DNA, 20 bp, Homo sapiens
atctacttctgtaattgtgt

SEQ ID NO: 5005098 - DNA, 15 bp, Homo sapiens
atctatacttgcttt

SEQ ID NO: 5005099 - DNA, 18 bp, Homo sapiens
atctgctaccaaaacagt

SEQ ID NO: 5005100 - DNA, 15 bp, Homo sapiens
atctgggcactgaag

SEQ ID NO: 5005101 - DNA, 16 bp, Homo sapiens
atcttttgttcccatc

SEQ ID NO: 5005102 - DNA, 17 bp, Homo sapiens
atgacagtgttccccga

SEQ ID NO: 5005103 - DNA, 19 bp, Homo sapiens
atgattaattaaatagctt

SEQ ID NO: 5005104 - DNA, 19 bp, Homo sapiens
atgcctatggtggatccaa

SEQ ID NO: 5005105 - DNA, 21 bp, Homo sapiens
atgcctatggtggatccaaac

SEQ ID NO: 5005106 - DNA, 14 bp, Homo sapiens
atgctatttgcaat

SEQ ID NO: 5005107 - DNA, 14 bp, Homo sapiens
atggccaaatgttc

SEQ ID NO: 5005108 - DNA, 21 bp, Homo sapiens
atgggtccaggattcctcttt

SEQ ID NO: 5005109 - DNA, 13 bp, Homo sapiens
atgtgcaatagaa

SEQ ID NO: 5005110 - DNA, 20 bp, Homo sapiens
atgttctattttttgttttg

SEQ ID NO: 5005111 - DNA, 12 bp, Homo sapiens
atgtttctggat

SEQ ID NO: 5005112 - DNA, 14 bp, Homo sapiens
attacctgtggata

SEQ ID NO: 5005113 - DNA, 22 bp, Homo sapiens
attagaaattacctgtggatat

SEQ ID NO: 5005114 - DNA, 19 bp, Homo sapiens
attcaggacttgaaagaaa

SEQ ID NO: 5005115 - DNA, 12 bp, Homo sapiens
attcctttccag

SEQ ID NO: 5005116 - DNA, 14 bp, Homo sapiens
attcgcttgagaaa

SEQ ID NO: 5005117 - DNA, 12 bp, Homo sapiens
attctggagtca

SEQ ID NO: 5005118 - DNA, 13 bp, Homo sapiens
attgatatttgtg

SEQ ID NO: 5005119 - DNA, 16 bp, Homo sapiens
attgatatttgtgcat

SEQ ID NO: 5005120 - DNA, 18 bp, Homo sapiens
attgatatttgtgcattt

SEQ ID NO: 5005121 - DNA, 13 bp, Homo sapiens
atttaaaactgtt

SEQ ID NO: 5005122 - DNA, 12 bp, Homo sapiens
atttactgtttt

SEQ ID NO: 5005123 - DNA, 22 bp, Homo sapiens
atttattttttcttttctttac

SEQ ID NO: 5005124 - DNA, 23 bp, Homo sapiens
atttcagagtgactacacacagt

SEQ ID NO: 5005125 - DNA, 19 bp, Homo sapiens
atttcaggcattggatatt

SEQ ID NO: 5005126 - DNA, 23 bp, Homo sapiens
atttcccccaccccatttctctc

SEQ ID NO: 5005127 - DNA, 16 bp, Homo sapiens
atttccccttttgcat

SEQ ID NO: 5005128 - DNA, 16 bp, Homo sapiens
atttggttttcctgta

SEQ ID NO: 5005129 - DNA, 22 bp, Homo sapiens
atttgtaggggaactcatttgg

SEQ ID NO: 5005130 - DNA, 11 bp, Homo sapiens
attttgtttac

SEQ ID NO: 5005131 - DNA, 15 bp, Homo sapiens
atttttctttaactg

SEQ ID NO: 5005132 - DNA, 22 bp, Homo sapiens
caaaaatttctgtaaaacaggt

SEQ ID NO: 5005133 - DNA, 18 bp, Homo sapiens
caaaatggataaaatctg

SEQ ID NO: 5005134 - DNA, 22 bp, Homo sapiens
caaagaacatgtagaaaacaaa

SEQ ID NO: 5005135 - DNA, 15 bp, Homo sapiens
caaatgctaatgtca

SEQ ID NO: 5005136 - DNA, 15 bp, Homo sapiens
caacaaagaaacaaa

SEQ ID NO: 5005137 - DNA, 17 bp, Homo sapiens
caagtagcatttactgt

SEQ ID NO: 5005138 - DNA, 17 bp, Homo sapiens
caagttgttcaaacatt

SEQ ID NO: 5005139 - DNA, 13 bp, Homo sapiens
caataaactgaat

SEQ ID NO: 5005140 - DNA, 19 bp, Homo sapiens
caataaactgaatttttct

SEQ ID NO: 5005141 - DNA, 20 bp, Homo sapiens
cacacagactcatattactg

SEQ ID NO: 5005142 - DNA, 16 bp, Homo sapiens
cacctgcactaacaga

SEQ ID NO: 5005143 - DNA, 20 bp, Homo sapiens
cacgtcaaatgcatacaagt

SEQ ID NO: 5005144 - DNA, 12 bp, Homo sapiens
cactcacctgca

SEQ ID NO: 5005145 - DNA, 20 bp, Homo sapiens
cagaccttttaactcctcaa

SEQ ID NO: 5005146 - DNA, 19 bp, Homo sapiens
cagcattgatatttgtgca

SEQ ID NO: 5005147 - DNA, 16 bp, Homo sapiens
cagcattgtatatgtg

SEQ ID NO: 5005148 - DNA, 15 bp, Homo sapiens
cagcattttcctctg

SEQ ID NO: 5005149 - DNA, 14 bp, Homo sapiens
cagccaaatttaaa

SEQ ID NO: 5005150 - DNA, 16 bp, Homo sapiens
cagctcataagagcca

SEQ ID NO: 5005151 - DNA, 16 bp, Homo sapiens
caggacttgaaagaaa

SEQ ID NO: 5005152 - DNA, 15 bp, Homo sapiens
caggatggtaattct

SEQ ID NO: 5005153 - DNA, 22 bp, Homo sapiens
caggcagctcataagagccaca

SEQ ID NO: 5005154 - DNA, 23 bp, Homo sapiens
caggcagctcataagagccacag

SEQ ID NO: 5005155 - DNA, 18 bp, Homo sapiens
cagggattgtttctgttt

SEQ ID NO: 5005156 - DNA, 23 bp, Homo sapiens
caggtattttataattctgggaa

SEQ ID NO: 5005157 - DNA, 17 bp, Homo sapiens
cagtggatcacaaagtg

SEQ ID NO: 5005158 - DNA, 13 bp, Homo sapiens
cagtgtctgtgtt

SEQ ID NO: 5005159 - DNA, 23 bp, Homo sapiens
cagtgtctgtgttttgaaagaat

SEQ ID NO: 5005160 - DNA, 18 bp, Homo sapiens
cagtttccagtcatggcc

SEQ ID NO: 5005161 - DNA, 16 bp, Homo sapiens
cagttttaactgtgga

SEQ ID NO: 5005162 - DNA, 22 bp, Homo sapiens
cagttttaactgtggatattgt

SEQ ID NO: 5005163 - DNA, 23 bp, Homo sapiens
cagttttaactgtggatattgtt

SEQ ID NO: 5005164 - DNA, 18 bp, Homo sapiens
cataatgtttctggattt

SEQ ID NO: 5005165 - DNA, 23 bp, Homo sapiens
cataatgtttctggatttcatac

SEQ ID NO: 5005166 - DNA, 22 bp, Homo sapiens
catatattgggttccattctca

SEQ ID NO: 5005167 - DNA, 15 bp, Homo sapiens
catcactttgaccta

SEQ ID NO: 5005168 - DNA, 15 bp, Homo sapiens
catcctaccgtcttt

SEQ ID NO: 5005169 - DNA, 14 bp, Homo sapiens
catgacagcctcca

SEQ ID NO: 5005170 - DNA, 22 bp, Homo sapiens
catgcagtctgggagtggggaa

SEQ ID NO: 5005171 - DNA, 16 bp, Homo sapiens
catggtgccctggctt

SEQ ID NO: 5005172 - DNA, 14 bp, Homo sapiens
catgtagaaaacaa

SEQ ID NO: 5005173 - DNA, 17 bp, Homo sapiens
cattgaattataaaagc

SEQ ID NO: 5005174 - DNA, 22 bp, Homo sapiens
cattgatatttgtgcattttct

SEQ ID NO: 5005175 - DNA, 18 bp, Homo sapiens
cattggatattttttact

SEQ ID NO: 5005176 - DNA, 23 bp, Homo sapiens
cattggggtagttgtgtttcaac

SEQ ID NO: 5005177 - DNA, 14 bp, Homo sapiens
cattgtatatgtga

SEQ ID NO: 5005178 - DNA, 17 bp, Homo sapiens
cattgtttcgtaacaca

SEQ ID NO: 5005179 - DNA, 21 bp, Homo sapiens
catttcccccaccccatttct

SEQ ID NO: 5005180 - DNA, 15 bp, Homo sapiens
cattttcctctgctt

SEQ ID NO: 5005181 - DNA, 17 bp, Homo sapiens
ccaaactgatccagtat

SEQ ID NO: 5005182 - DNA, 19 bp, Homo sapiens
ccagaggcagcttctttgc

SEQ ID NO: 5005183 - DNA, 20 bp, Homo sapiens
ccagatagtgtagctgagga

SEQ ID NO: 5005184 - DNA, 19 bp, Homo sapiens
ccatgaagaggatgctgtg

SEQ ID NO: 5005185 - DNA, 19 bp, Homo sapiens
cccacaacccaaaaggttt

SEQ ID NO: 5005186 - DNA, 19 bp, Homo sapiens
cccagttgcactcaggtga

SEQ ID NO: 5005187 - DNA, 12 bp, Homo sapiens
ccccttttgcat

SEQ ID NO: 5005188 - DNA, 13 bp, Homo sapiens
cccttccaggggt

SEQ ID NO: 5005189 - DNA, 19 bp, Homo sapiens
cctaacatacctaagcaaa

SEQ ID NO: 5005190 - DNA, 13 bp, Homo sapiens
cctaatgtgttta

SEQ ID NO: 5005191 - DNA, 18 bp, Homo sapiens
cctacactcacctgcact

SEQ ID NO: 5005192 - DNA, 19 bp, Homo sapiens
cctacagttttaactgtgg

SEQ ID NO: 5005193 - DNA, 22 bp, Homo sapiens
cctacagttttaactgtggata

SEQ ID NO: 5005194 - DNA, 22 bp, Homo sapiens
cctcacacacagactcatatta

SEQ ID NO: 5005195 - DNA, 19 bp, Homo sapiens
cctcagttcttgccacttt

SEQ ID NO: 5005196 - DNA, 13 bp, Homo sapiens
cctcgggcctgct

SEQ ID NO: 5005197 - DNA, 23 bp, Homo sapiens
cctctccttcatgacagcctcca

SEQ ID NO: 5005198 - DNA, 17 bp, Homo sapiens
cctgcactaacagagtg

SEQ ID NO: 5005199 - DNA, 12 bp, Homo sapiens
aaaaaaaacagt

SEQ ID NO: 5005200 - DNA, 18 bp, Homo sapiens
aaaaaaacagtggatcac

SEQ ID NO: 5005201 - DNA, 11 bp, Homo sapiens
aaaaaagatga

SEQ ID NO: 5005202 - DNA, 14 bp, Homo sapiens
aaaatgaaagctac

SEQ ID NO: 5005203 - DNA, 17 bp, Homo sapiens
aaactacaaaaattaac

SEQ ID NO: 5005204 - DNA, 19 bp, Homo sapiens
aaactgttggaatggattt

SEQ ID NO: 5005205 - DNA, 12 bp, Homo sapiens
aaagcctgctca

SEQ ID NO: 5005206 - DNA, 16 bp, Homo sapiens
aaagcttcacagtacc

SEQ ID NO: 5005207 - DNA, 14 bp, Homo sapiens
aaagttattcttga

SEQ ID NO: 5005208 - DNA, 12 bp, Homo sapiens
aaatattgtctt

SEQ ID NO: 5005209 - DNA, 13 bp, Homo sapiens
aaatgaaagctac

SEQ ID NO: 5005210 - DNA, 19 bp, Homo sapiens
aaatgctaatgtcaaactt

SEQ ID NO: 5005211 - DNA, 18 bp, Homo sapiens
aaattacctgtggatatt

SEQ ID NO: 5005212 - DNA, 9 bp, Homo sapiens
aacaaaaca

SEQ ID NO: 5005213 - DNA, 11 bp, Homo sapiens
aacaaagaaac

SEQ ID NO: 5005214 - DNA, 15 bp, Homo sapiens
aacactgatttcccc

SEQ ID NO: 5005215 - DNA, 13 bp, Homo sapiens
aacatttttggta

SEQ ID NO: 5005216 - DNA, 16 bp, Homo sapiens
aaccagggattgtttc

SEQ ID NO: 5005217 - DNA, 20 bp, Homo sapiens
aaccttgaaaaaaaacagtg

SEQ ID NO: 5005218 - DNA, 20 bp, Homo sapiens
aacgctctaggtacgatgac

SEQ ID NO: 5005219 - DNA, 21 bp, Homo sapiens
aactaaatgtgcaatagaagg

SEQ ID NO: 5005220 - DNA, 14 bp, Homo sapiens
aactgtggatattg

SEQ ID NO: 5005221 - DNA, 19 bp, Homo sapiens
aactgttggaatggatttt

SEQ ID NO: 5005222 - DNA, 21 bp, Homo sapiens
aacttattaaatggaaactga

SEQ ID NO: 5005223 - DNA, 18 bp, Homo sapiens
aacttgagaactttattt

SEQ ID NO: 5005224 - DNA, 21 bp, Homo sapiens
aacttgagaactttatttcca

SEQ ID NO: 5005225 - DNA, 19 bp, Homo sapiens
aacttgtgtccctaatgtg

SEQ ID NO: 5005226 - DNA, 14 bp, Homo sapiens
aagaaacaaagatg

SEQ ID NO: 5005227 - DNA, 17 bp, Homo sapiens
aagaactttaaattgtg

SEQ ID NO: 5005228 - DNA, 19 bp, Homo sapiens
aagaagagcgagagatcaa

SEQ ID NO: 5005229 - DNA, 23 bp, Homo sapiens
aagaagagcgagagatcaaagat

SEQ ID NO: 5005230 - DNA, 11 bp, Homo sapiens
aagaatagaac

SEQ ID NO: 5005231 - DNA, 13 bp, Homo sapiens
aagacctttcaaa

SEQ ID NO: 5005232 - DNA, 17 bp, Homo sapiens
aagaggatgctgtgaaa

SEQ ID NO: 5005233 - DNA, 21 bp, Homo sapiens
aagagtgtggagtcattctca

SEQ ID NO: 5005234 - DNA, 20 bp, Homo sapiens
aagatactaaggacgttgtt

SEQ ID NO: 5005235 - DNA, 20 bp, Homo sapiens
aagatgttatggtgtttaga

SEQ ID NO: 5005236 - DNA, 20 bp, Homo sapiens
aagattcttcccattctcca

SEQ ID NO: 5005237 - DNA, 21 bp, Homo sapiens
aagattcttcccattctccat

SEQ ID NO: 5005238 - DNA, 22 bp, Homo sapiens
aagattcttcccattctccatt

SEQ ID NO: 5005239 - DNA, 23 bp, Homo sapiens
aagattcttcccattctccattt

SEQ ID NO: 5005240 - DNA, 14 bp, Homo sapiens
aagcaaaaagtgat

SEQ ID NO: 5005241 - DNA, 17 bp, Homo sapiens
aagtagcatttactgtg

SEQ ID NO: 5005242 - DNA, 23 bp, Homo sapiens
aagtttcattctccctttcacta

SEQ ID NO: 5005243 - DNA, 17 bp, Homo sapiens
aatatgagtctcaataa

SEQ ID NO: 5005244 - DNA, 21 bp, Homo sapiens
aatattgtctttttgtatgtc

SEQ ID NO: 5005245 - DNA, 20 bp, Homo sapiens
aatctgatatgtattgtttg

SEQ ID NO: 5005246 - DNA, 18 bp, Homo sapiens
aatggataaaatctgata

SEQ ID NO: 5005247 - DNA, 23 bp, Homo sapiens
aattactttggggctaatttaac

SEQ ID NO: 5005248 - DNA, 14 bp, Homo sapiens
aattataaaagcca

SEQ ID NO: 5005249 - DNA, 13 bp, Homo sapiens
aattataaatgac

SEQ ID NO: 5005250 - DNA, 17 bp, Homo sapiens
aattcaatttggattta

SEQ ID NO: 5005251 - DNA, 17 bp, Homo sapiens
aattcccaacaaacatt

SEQ ID NO: 5005252 - DNA, 20 bp, Homo sapiens
aattgtgttttaattgtaaa

SEQ ID NO: 5005253 - DNA, 23 bp, Homo sapiens
aatttggatttaaaagcctgctc

SEQ ID NO: 5005254 - DNA, 17 bp, Homo sapiens
aattttttataaaagtg

SEQ ID NO: 5005255 - DNA, 23 bp, Homo sapiens
acaaaaaaacctcttaatattct

SEQ ID NO: 5005256 - DNA, 18 bp, Homo sapiens
acaatgatgctatttgca

SEQ ID NO: 5005257 - DNA, 15 bp, Homo sapiens
acaatgtattttctt

SEQ ID NO: 5005258 - DNA, 17 bp, Homo sapiens
acacacagactcatatt

SEQ ID NO: 5005259 - DNA, 12 bp, Homo sapiens
acacacagtacg

SEQ ID NO: 5005260 - DNA, 15 bp, Homo sapiens
acacagactcatatt

SEQ ID NO: 5005261 - DNA, 21 bp, Homo sapiens
acactgatttccccttttgca

SEQ ID NO: 5005262 - DNA, 22 bp, Homo sapiens
acagcaaacaggtgctaatttg

SEQ ID NO: 5005263 - DNA, 15 bp, Homo sapiens
acagccaaatttaaa

SEQ ID NO: 5005264 - DNA, 15 bp, Homo sapiens
acagtggatcacaaa

SEQ ID NO: 5005265 - DNA, 21 bp, Homo sapiens
acagttttaactgtggatatt

SEQ ID NO: 5005266 - DNA, 22 bp, Homo sapiens
acattggtattcgcttgagaaa

SEQ ID NO: 5005267 - DNA, 15 bp, Homo sapiens
acatttaccaatcat

SEQ ID NO: 5005268 - DNA, 18 bp, Homo sapiens
accagggattgtttctgt

SEQ ID NO: 5005269 - DNA, 15 bp, Homo sapiens
accagtcatttttca

SEQ ID NO: 5005270 - DNA, 16 bp, Homo sapiens
accatttaaaaacagg

SEQ ID NO: 5005271 - DNA, 23 bp, Homo sapiens
accatttaaaaacaggcagctca

SEQ ID NO: 5005272 - DNA, 23 bp, Homo sapiens
accattttgttattgactaacag

SEQ ID NO: 5005273 - DNA, 12 bp, Homo sapiens
acctatccacac

SEQ ID NO: 5005274 - DNA, 11 bp, Homo sapiens
acctatttctc

SEQ ID NO: 5005275 - DNA, 15 bp, Homo sapiens
acctcgggcctgctg

SEQ ID NO: 5005276 - DNA, 16 bp, Homo sapiens
acctcttaatattctg

SEQ ID NO: 5005277 - DNA, 17 bp, Homo sapiens
acctgcactaacagagt

SEQ ID NO: 5005278 - DNA, 14 bp, Homo sapiens
acctgtggatattt

SEQ ID NO: 5005279 - DNA, 18 bp, Homo sapiens
acctttcaaagccatttt

SEQ ID NO: 5005280 - DNA, 14 bp, Homo sapiens
acgatgacagtgtt

SEQ ID NO: 5005281 - DNA, 15 bp, Homo sapiens
actaaaaaaaagatg

SEQ ID NO: 5005282 - DNA, 22 bp, Homo sapiens
actaattcttgcatattttgta

SEQ ID NO: 5005283 - DNA, 15 bp, Homo sapiens
actcaagtagcattt

SEQ ID NO: 5005284 - DNA, 13 bp, Homo sapiens
actcatattactg

SEQ ID NO: 5005285 - DNA, 17 bp, Homo sapiens
actcctcagttcttgcc

SEQ ID NO: 5005286 - DNA, 22 bp, Homo sapiens
actcctcagttcttgccacttt

SEQ ID NO: 5005287 - DNA, 12 bp, Homo sapiens
actgatttcaga

SEQ ID NO: 5005288 - DNA, 17 bp, Homo sapiens
actgatttccccttttg

SEQ ID NO: 5005289 - DNA, 15 bp, Homo sapiens
actgccgtaatttaa

SEQ ID NO: 5005290 - DNA, 15 bp, Homo sapiens
acttacatcatgtgt

SEQ ID NO: 5005291 - DNA, 21 bp, Homo sapiens
acttcccccaaatttaaagaa

SEQ ID NO: 5005292 - DNA, 24 bp, Homo sapiens
acttgaatgctagttatacttatt

SEQ ID NO: 5005293 - DNA, 20 bp, Homo sapiens
actttgacctaaattattta

SEQ ID NO: 5005294 - DNA, 22 bp, Homo sapiens
actttgacctaaattatttact

SEQ ID NO: 5005295 - DNA, 17 bp, Homo sapiens
actttggggctaattta

SEQ ID NO: 5005296 - DNA, 13 bp, Homo sapiens
agaaacaaagatg

SEQ ID NO: 5005297 - DNA, 18 bp, Homo sapiens
agaaattacctgtggata

SEQ ID NO: 5005298 - DNA, 19 bp, Homo sapiens
agaaattcaatttggattt

SEQ ID NO: 5005299 - DNA, 22 bp, Homo sapiens
agaaattcaatttggatttaaa

SEQ ID NO: 5005300 - DNA, 17 bp, Homo sapiens
agaacatgtagaaaaca

SEQ ID NO: 5005301 - DNA, 19 bp, Homo sapiens
agaacattggtattcgctt

SEQ ID NO: 5005302 - DNA, 21 bp, Homo sapiens
agaatagttgaacctatttct

SEQ ID NO: 5005303 - DNA, 23 bp, Homo sapiens
agaatagttgaacctatttctct

SEQ ID NO: 5005304 - DNA, 16 bp, Homo sapiens
agacctttcaaagcca

SEQ ID NO: 5005305 - DNA, 19 bp, Homo sapiens
agacctttcaaagccattt

SEQ ID NO: 5005306 - DNA, 19 bp, Homo sapiens
agaccttttaactcctcaa

SEQ ID NO: 5005307 - DNA, 13 bp, Homo sapiens
agactctgtctaa

SEQ ID NO: 5005308 - DNA, 15 bp, Homo sapiens
agagatcaaagatga

SEQ ID NO: 5005309 - DNA, 15 bp, Homo sapiens
agagcaagactctgt

SEQ ID NO: 5005310 - DNA, 17 bp, Homo sapiens
agagccacaggtcttta

SEQ ID NO: 5005311 - DNA, 19 bp, Homo sapiens
agagcgagagatcaaagat

SEQ ID NO: 5005312 - DNA, 14 bp, Homo sapiens
agaggcatttcccc

SEQ ID NO: 5005313 - DNA, 20 bp, Homo sapiens
agagtgtggagtcattctca

SEQ ID NO: 5005314 - DNA, 16 bp, Homo sapiens
agagtttcaaccatga

SEQ ID NO: 5005315 - DNA, 17 bp, Homo sapiens
agatgaatgtcctgaaa

SEQ ID NO: 5005316 - DNA, 16 bp, Homo sapiens
agatgtttatttcagg

SEQ ID NO: 5005317 - DNA, 15 bp, Homo sapiens
agattaattcctttc

SEQ ID NO: 5005318 - DNA, 20 bp, Homo sapiens
agcagaggataattagcatc

SEQ ID NO: 5005319 - DNA, 18 bp, Homo sapiens
agcattgatatttgtgca

SEQ ID NO: 5005320 - DNA, 22 bp, Homo sapiens
agcattgtaaaattatttcatg

SEQ ID NO: 5005321 - DNA, 13 bp, Homo sapiens
agcattttcctct

SEQ ID NO: 5005322 - DNA, 21 bp, Homo sapiens
agccaaggctctgtttatgct

SEQ ID NO: 5005323 - DNA, 22 bp, Homo sapiens
agcctatgtggattttttccta

SEQ ID NO: 5005324 - DNA, 22 bp, Homo sapiens
agcctccaccccacaacccaaa

SEQ ID NO: 5005325 - DNA, 10 bp, Homo sapiens
agcctgctca

SEQ ID NO: 5005326 - DNA, 18 bp, Homo sapiens
agcgggggcctaaaaaaa

SEQ ID NO: 5005327 - DNA, 20 bp, Homo sapiens
agctgatactttgacagtgt

SEQ ID NO: 5005328 - DNA, 18 bp, Homo sapiens
aggaacttgagaacttta

SEQ ID NO: 5005329 - DNA, 13 bp, Homo sapiens
aggacttgaaaga

SEQ ID NO: 5005330 - DNA, 16 bp, Homo sapiens
aggacttgaaagaaat

SEQ ID NO: 5005331 - DNA, 14 bp, Homo sapiens
aggatccggaaaga

SEQ ID NO: 5005332 - DNA, 21 bp, Homo sapiens
aggatggtaattcttattctt

SEQ ID NO: 5005333 - DNA, 15 bp, Homo sapiens
aggattcctcttttc

SEQ ID NO: 5005334 - DNA, 14 bp, Homo sapiens
aggctcatttactg

SEQ ID NO: 5005335 - DNA, 16 bp, Homo sapiens
aggctctgtttatgct

SEQ ID NO: 5005336 - DNA, 21 bp, Homo sapiens
aggtgcaacagacttgaatgc

SEQ ID NO: 5005337 - DNA, 17 bp, Homo sapiens
aggtgctaatttgtttt

SEQ ID NO: 5005338 - DNA, 20 bp, Homo sapiens
aggtgctaatttgttttgga

SEQ ID NO: 5005339 - DNA, 20 bp, Homo sapiens
aggtggaggttgcagtgagc

SEQ ID NO: 5005340 - DNA, 18 bp, Homo sapiens
aggttgcagtgagcagag

SEQ ID NO: 5005341 - DNA, 20 bp, Homo sapiens
agtaaaataaatattgtctt

SEQ ID NO: 5005342 - DNA, 16 bp, Homo sapiens
agtacgaacctacagt

SEQ ID NO: 5005343 - DNA, 17 bp, Homo sapiens
agtagatgttctacttt

SEQ ID NO: 5005344 - DNA, 14 bp, Homo sapiens
agtagcatttactg

SEQ ID NO: 5005345 - DNA, 16 bp, Homo sapiens
agtctcaataaactga

SEQ ID NO: 5005346 - DNA, 17 bp, Homo sapiens
agtctcaataaactgaa

SEQ ID NO: 5005347 - DNA, 20 bp, Homo sapiens
agtgatcttttgttcccatc

SEQ ID NO: 5005348 - DNA, 16 bp, Homo sapiens
agtggaacgaaaatga

SEQ ID NO: 5005349 - DNA, 16 bp, Homo sapiens
agtggatcacaaagtg

SEQ ID NO: 5005350 - DNA, 18 bp, Homo sapiens
agtgtgagtaatctgaga

SEQ ID NO: 5005351 - DNA, 18 bp, Homo sapiens
agttgtgacaacttcctg

SEQ ID NO: 5005352 - DNA, 20 bp, Homo sapiens
agttgtgacaacttcctgag

SEQ ID NO: 5005353 - DNA, 14 bp, Homo sapiens
agttgtgtttcaac

SEQ ID NO: 5005354 - DNA, 23 bp, Homo sapiens
agttgtgtttcaacggaaagtgc

SEQ ID NO: 5005355 - DNA, 15 bp, Homo sapiens
ataaattttttataa

SEQ ID NO: 5005356 - DNA, 13 bp, Homo sapiens
atacctaagcaaa

SEQ ID NO: 5005357 - DNA, 21 bp, Homo sapiens
atagttgaacctatttctctt

SEQ ID NO: 5005358 - DNA, 13 bp, Homo sapiens
atatgaaagctga

SEQ ID NO: 5005359 - DNA, 19 bp, Homo sapiens
atattgggttccattctca

SEQ ID NO: 5005360 - DNA, 17 bp, Homo sapiens
atattgtctttttgtat

SEQ ID NO: 5005361 - DNA, 19 bp, Homo sapiens
atatttggttttcctgtat

SEQ ID NO: 5005362 - DNA, 17 bp, Homo sapiens
atatttgtgcattttct

SEQ ID NO: 5005363 - DNA, 18 bp, Homo sapiens
atatttgtgcattttcta

SEQ ID NO: 5005364 - DNA, 14 bp, Homo sapiens
atcacaaagtggaa

SEQ ID NO: 5005365 - DNA, 24 bp, Homo sapiens
atcacaaagtggaacgaaaatgaa

SEQ ID NO: 5005366 - DNA, 16 bp, Homo sapiens
atcagtggatttccca

SEQ ID NO: 5005367 - DNA, 17 bp, Homo sapiens
atcagtggatttcccat

SEQ ID NO: 5005368 - DNA, 13 bp, Homo sapiens
atccagtataaga

SEQ ID NO: 5005369 - DNA, 18 bp, Homo sapiens
atctgatatgtattgttt

SEQ ID NO: 5005370 - DNA, 16 bp, Homo sapiens
atgaaaagtatattga

SEQ ID NO: 5005371 - DNA, 16 bp, Homo sapiens
atgatgctatttgcaa

SEQ ID NO: 5005372 - DNA, 17 bp, Homo sapiens
atgatgctatttgcaat

SEQ ID NO: 5005373 - DNA, 22 bp, Homo sapiens
atgattagaaattacctgtgga

SEQ ID NO: 5005374 - DNA, 23 bp, Homo sapiens
atgattagaaattacctgtggat

SEQ ID NO: 5005375 - DNA, 16 bp, Homo sapiens
atgcctatggtggatc

SEQ ID NO: 5005376 - DNA, 21 bp, Homo sapiens
atgctatttgcaattcctgct

SEQ ID NO: 5005377 - DNA, 19 bp, Homo sapiens
atggatttttctttaactg

SEQ ID NO: 5005378 - DNA, 24 bp, Homo sapiens
atggccaaatgttcaatatgagtc

SEQ ID NO: 5005379 - DNA, 19 bp, Homo sapiens
atgggtccaggattcctct

SEQ ID NO: 5005380 - DNA, 18 bp, Homo sapiens
atgtgcaatagaaggtga

SEQ ID NO: 5005381 - DNA, 14 bp, Homo sapiens
atgttaagttatat

SEQ ID NO: 5005382 - DNA, 20 bp, Homo sapiens
attaatacaatgatgctatt

SEQ ID NO: 5005383 - DNA, 16 bp, Homo sapiens
attacctgtggatatt

SEQ ID NO: 5005384 - DNA, 21 bp, Homo sapiens
attactttggggctaatttaa

SEQ ID NO: 5005385 - DNA, 23 bp, Homo sapiens
attactttggggctaatttaaca

SEQ ID NO: 5005386 - DNA, 20 bp, Homo sapiens
attcccttcgacagcatttt

SEQ ID NO: 5005387 - DNA, 12 bp, Homo sapiens
attcctcttttc

SEQ ID NO: 5005388 - DNA, 17 bp, Homo sapiens
attcctcttttctctgc

SEQ ID NO: 5005389 - DNA, 18 bp, Homo sapiens
attctccatttgttatct

SEQ ID NO: 5005390 - DNA, 19 bp, Homo sapiens
attctccatttgttatctg

SEQ ID NO: 5005391 - DNA, 22 bp, Homo sapiens
attggatattttttactttaga

SEQ ID NO: 5005392 - DNA, 15 bp, Homo sapiens
attgtaaaaatggca

SEQ ID NO: 5005393 - DNA, 19 bp, Homo sapiens
attgttacgtagcctaagg

SEQ ID NO: 5005394 - DNA, 15 bp, Homo sapiens
atttatggttgttaa

SEQ ID NO: 5005395 - DNA, 23 bp, Homo sapiens
atttatggttgttaaaaatgtca

SEQ ID NO: 5005396 - DNA, 21 bp, Homo sapiens
atttcccatcccctgtgggaa

SEQ ID NO: 5005397 - DNA, 21 bp, Homo sapiens
atttccccttttgcattctcc

SEQ ID NO: 5005398 - DNA, 22 bp, Homo sapiens
atttccccttttgcattctccc

SEQ ID NO: 5005399 - DNA, 16 bp, Homo sapiens
atttctctttctttac

SEQ ID NO: 5005400 - DNA, 18 bp, Homo sapiens
atttggatttaaaagcct

SEQ ID NO: 5005401 - DNA, 20 bp, Homo sapiens
atttggatttaaaagcctgc

SEQ ID NO: 5005402 - DNA, 14 bp, Homo sapiens
atttggttttcctg

SEQ ID NO: 5005403 - DNA, 16 bp, Homo sapiens
atttgtatatggtatt

SEQ ID NO: 5005404 - DNA, 15 bp, Homo sapiens
atttgttttggatat

SEQ ID NO: 5005405 - DNA, 16 bp, Homo sapiens
atttgttttggatata

SEQ ID NO: 5005406 - DNA, 15 bp, Homo sapiens
attttcctctgcttt

SEQ ID NO: 5005407 - DNA, 18 bp, Homo sapiens
attttcttcacctctgct

SEQ ID NO: 5005408 - DNA, 12 bp, Homo sapiens
attttgtttaca

SEQ ID NO: 5005409 - DNA, 20 bp, Homo sapiens
atttttcagaccttttaact

SEQ ID NO: 5005410 - DNA, 12 bp, Homo sapiens
atttttcttgcg

SEQ ID NO: 5005411 - DNA, 16 bp, Homo sapiens
atttttctttaactgc

SEQ ID NO: 5005412 - DNA, 23 bp, Homo sapiens
caaaaaaacctcttaatattctg

SEQ ID NO: 5005413 - DNA, 21 bp, Homo sapiens
caaaaatttctgtaaaacagg

SEQ ID NO: 5005414 - DNA, 20 bp, Homo sapiens
caaaatatattttgtttaca

SEQ ID NO: 5005415 - DNA, 17 bp, Homo sapiens
caaagaaacaaagatgt

SEQ ID NO: 5005416 - DNA, 15 bp, Homo sapiens
caaagtggaacgaaa

SEQ ID NO: 5005417 - DNA, 15 bp, Homo sapiens
caaattttatttgta

SEQ ID NO: 5005418 - DNA, 20 bp, Homo sapiens
caacaaagaaacaaagatgt

SEQ ID NO: 5005419 - DNA, 20 bp, Homo sapiens
caacagagactgaatagata

SEQ ID NO: 5005420 - DNA, 20 bp, Homo sapiens
caacggaaagtgctgtctta

SEQ ID NO: 5005421 - DNA, 16 bp, Homo sapiens
caagtagcatttactg

SEQ ID NO: 5005422 - DNA, 20 bp, Homo sapiens
caatcatattaatacaatga

SEQ ID NO: 5005423 - DNA, 14 bp, Homo sapiens
caatgactaattct

SEQ ID NO: 5005424 - DNA, 13 bp, Homo sapiens
caatgatgctatt

SEQ ID NO: 5005425 - DNA, 18 bp, Homo sapiens
caatgatgctatttgcaa

SEQ ID NO: 5005426 - DNA, 14 bp, Homo sapiens
caatgttaacattt

SEQ ID NO: 5005427 - DNA, 19 bp, Homo sapiens
cacagtacgaacctacagt

SEQ ID NO: 5005428 - DNA, 20 bp, Homo sapiens
cacatcacaagactatgcca

SEQ ID NO: 5005429 - DNA, 16 bp, Homo sapiens
caccagtcatttttca

SEQ ID NO: 5005430 - DNA, 22 bp, Homo sapiens
cacctctgctactcaagtagca

SEQ ID NO: 5005431 - DNA, 19 bp, Homo sapiens
cactaaaacacacaggtgc

SEQ ID NO: 5005432 - DNA, 23 bp, Homo sapiens
cactgatttccccttttgcattc

SEQ ID NO: 5005433 - DNA, 18 bp, Homo sapiens
cagcattgatatttgtgc

SEQ ID NO: 5005434 - DNA, 20 bp, Homo sapiens
cagcattgatatttgtgcat

SEQ ID NO: 5005435 - DNA, 21 bp, Homo sapiens
cagcattgatatttgtgcatt

SEQ ID NO: 5005436 - DNA, 22 bp, Homo sapiens
cagcattgatatttgtgcattt

SEQ ID NO: 5005437 - DNA, 21 bp, Homo sapiens
caggaattcttggagaaaatg

SEQ ID NO: 5005438 - DNA, 14 bp, Homo sapiens
caggatggtaattc

SEQ ID NO: 5005439 - DNA, 16 bp, Homo sapiens
caggattcctcttttc

SEQ ID NO: 5005440 - DNA, 17 bp, Homo sapiens
caggattcctcttttct

SEQ ID NO: 5005441 - DNA, 20 bp, Homo sapiens
caggattcctcttttctctg

SEQ ID NO: 5005442 - DNA, 21 bp, Homo sapiens
caggcagctcataagagccac

SEQ ID NO: 5005443 - DNA, 14 bp, Homo sapiens
caggtgaattgttt

SEQ ID NO: 5005444 - DNA, 18 bp, Homo sapiens
cagtttgtagtgccactg

SEQ ID NO: 5005445 - DNA, 13 bp, Homo sapiens
cagttttaactgt

SEQ ID NO: 5005446 - DNA, 19 bp, Homo sapiens
catcacgttagctgtccca

SEQ ID NO: 5005447 - DNA, 12 bp, Homo sapiens
catcattccctt

SEQ ID NO: 5005448 - DNA, 21 bp, Homo sapiens
catgaagaggatgctgtgaaa

SEQ ID NO: 5005449 - DNA, 18 bp, Homo sapiens
cattcaacagagactgaa

SEQ ID NO: 5005450 - DNA, 20 bp, Homo sapiens
cattcccttcgacagcattt

SEQ ID NO: 5005451 - DNA, 16 bp, Homo sapiens
cattgatatttgtgca

SEQ ID NO: 5005452 - DNA, 19 bp, Homo sapiens
cattgatatttgtgcattt

SEQ ID NO: 5005453 - DNA, 23 bp, Homo sapiens
cattgatatttgtgcattttcta

SEQ ID NO: 5005454 - DNA, 20 bp, Homo sapiens
catttcccccaccccatttc

SEQ ID NO: 5005455 - DNA, 10 bp, Homo sapiens
catttctctc

SEQ ID NO: 5005456 - DNA, 20 bp, Homo sapiens
cattttcctctgctttgaaa

SEQ ID NO: 5005457 - DNA, 20 bp, Homo sapiens
catttttgtactaactagca

SEQ ID NO: 5005458 - DNA, 13 bp, Homo sapiens
ccaaggctctgtt

SEQ ID NO: 5005459 - DNA, 15 bp, Homo sapiens
ccaatcatattaata

SEQ ID NO: 5005460 - DNA, 15 bp, Homo sapiens
ccaggattcctcttt

SEQ ID NO: 5005461 - DNA, 16 bp, Homo sapiens
ccatcctcttctttta

SEQ ID NO: 5005462 - DNA, 22 bp, Homo sapiens
ccatgatgacaactacagaaaa

SEQ ID NO: 5005463 - DNA, 23 bp, Homo sapiens
ccatgcctccccctagccatttt

SEQ ID NO: 5005464 - DNA, 21 bp, Homo sapiens
ccatgtgagggttttcagcat

SEQ ID NO: 5005465 - DNA, 19 bp, Homo sapiens
ccattctcacctatccaca

SEQ ID NO: 5005466 - DNA, 13 bp, Homo sapiens
ccattctccattt

SEQ ID NO: 5005467 - DNA, 17 bp, Homo sapiens
ccattctccatttgtta

SEQ ID NO: 5005468 - DNA, 18 bp, Homo sapiens
ccattttgttattgacta

SEQ ID NO: 5005469 - DNA, 22 bp, Homo sapiens
ccattttgttattgactaacag

SEQ ID NO: 5005470 - DNA, 23 bp, Homo sapiens
ccattttgttattgactaacagg

SEQ ID NO: 5005471 - DNA, 15 bp, Homo sapiens
ccatttttactgtta

SEQ ID NO: 5005472 - DNA, 19 bp, Homo sapiens
cccagctactcgggaagct

SEQ ID NO: 5005473 - DNA, 20 bp, Homo sapiens
cccatcctcttcttttagca

SEQ ID NO: 5005474 - DNA, 13 bp, Homo sapiens
ccccaccccattt

SEQ ID NO: 5005475 - DNA, 15 bp, Homo sapiens
ccctcactctctaca

SEQ ID NO: 5005476 - DNA, 12 bp, Homo sapiens
ccgtaatttaac

SEQ ID NO: 5005477 - DNA, 21 bp, Homo sapiens
cctacagttttaactgtggat

SEQ ID NO: 5005478 - DNA, 16 bp, Homo sapiens
cctagctgtgtgaata

SEQ ID NO: 5005479 - DNA, 22 bp, Homo sapiens
cctgcataatgtttctggattt

SEQ ID NO: 5005480 - DNA, 19 bp, Homo sapiens
cctgctcaatccctgagga

SEQ ID NO: 5005481 - DNA, 19 bp, Homo sapiens
cctgctcacgtcaaatgca

SEQ ID NO: 5005482 - DNA, 12 bp, Homo sapiens
cctgtggatatt

SEQ ID NO: 5005483 - DNA, 17 bp, Homo sapiens
ccttcatgacagcctcc

SEQ ID NO: 5005484 - DNA, 18 bp, Homo sapiens
ccttcatgacagcctcca

SEQ ID NO: 5005485 - DNA, 17 bp, Homo sapiens
ccttccttgtagccttt

SEQ ID NO: 5005486 - DNA, 17 bp, Homo sapiens
ccttgaaaaaaaacagt

SEQ ID NO: 5005487 - DNA, 18 bp, Homo sapiens
cggaaagaagagcgagag

SEQ ID NO: 5005488 - DNA, 20 bp, Homo sapiens
cggtggctcacgcctgtaat

SEQ ID NO: 5005489 - DNA, 17 bp, Homo sapiens
ctaacctcgggcctgct

SEQ ID NO: 5005490 - DNA, 16 bp, Homo sapiens
ctaaggctcctgtttt

SEQ ID NO: 5005491 - DNA, 11 bp, Homo sapiens
ctaatttaaca

SEQ ID NO: 5005492 - DNA, 16 bp, Homo sapiens
ctacaaaaattaactg

SEQ ID NO: 5005493 - DNA, 13 bp, Homo sapiens
ctacagaaaaacc

SEQ ID NO: 5005494 - DNA, 15 bp, Homo sapiens
ctacagttttaactg

SEQ ID NO: 5005495 - DNA, 19 bp, Homo sapiens
ctacagttttaactgtgga

SEQ ID NO: 5005496 - DNA, 14 bp, Homo sapiens
ctactgcaccattt

SEQ ID NO: 5005497 - DNA, 21 bp, Homo sapiens
ctagattgctaaggagctgat

SEQ ID NO: 5005498 - DNA, 22 bp, Homo sapiens
ctagcattgtaaaattatttca

SEQ ID NO: 5005499 - DNA, 23 bp, Homo sapiens
ctagttatacttatttgtatatg

SEQ ID NO: 5005500 - DNA, 12 bp, Homo sapiens
ctatttctcttt

SEQ ID NO: 5005501 - DNA, 17 bp, Homo sapiens
ctatttctctttcttta

SEQ ID NO: 5005502 - DNA, 11 bp, Homo sapiens
ctatttgcaat

SEQ ID NO: 5005503 - DNA, 14 bp, Homo sapiens
ctcaagtagcattt

SEQ ID NO: 5005504 - DNA, 21 bp, Homo sapiens
ctcaataaactgaatttttct

SEQ ID NO: 5005505 - DNA, 19 bp, Homo sapiens
ctcacctatccacacaaca

SEQ ID NO: 5005506 - DNA, 20 bp, Homo sapiens
ctcacctgcactaacagagt

SEQ ID NO: 5005507 - DNA, 15 bp, Homo sapiens
ctcctcagttcttgc

SEQ ID NO: 5005508 - DNA, 16 bp, Homo sapiens
ctctcctcacacacag

SEQ ID NO: 5005509 - DNA, 13 bp, Homo sapiens
ctctgaggaagct

SEQ ID NO: 5005510 - DNA, 13 bp, Homo sapiens
ctctgctttgaaa

SEQ ID NO: 5005511 - DNA, 19 bp, Homo sapiens
ctcttggaggtgtctgtat

SEQ ID NO: 5005512 - DNA, 21 bp, Homo sapiens
ctgaagggatatgtgaaacaa

SEQ ID NO: 5005513 - DNA, 15 bp, Homo sapiens
ctgaatctgctacca

SEQ ID NO: 5005514 - DNA, 17 bp, Homo sapiens
ctgaattatctatttca

SEQ ID NO: 5005515 - DNA, 19 bp, Homo sapiens
ctgaggaagctggggttca

SEQ ID NO: 5005516 - DNA, 14 bp, Homo sapiens
ctgaggactgattt

SEQ ID NO: 5005517 - DNA, 22 bp, Homo sapiens
ctgaggactgatttcagagtga

SEQ ID NO: 5005518 - DNA, 20 bp, Homo sapiens
ctgatactttgacagtgttt

SEQ ID NO: 5005519 - DNA, 13 bp, Homo sapiens
ctgatttcccctt

SEQ ID NO: 5005520 - DNA, 17 bp, Homo sapiens
ctgcactaacagagtgg

SEQ ID NO: 5005521 - DNA, 15 bp, Homo sapiens
ctgccgtaatttaac

SEQ ID NO: 5005522 - DNA, 19 bp, Homo sapiens
ctgggtgacagagcaagac

SEQ ID NO: 5005523 - DNA, 17 bp, Homo sapiens
ctgggttgcctttattt

SEQ ID NO: 5005524 - DNA, 18 bp, Homo sapiens
ctgtgaccttgagaagat

SEQ ID NO: 5005525 - DNA, 11 bp, Homo sapiens
ctgtgggaaat

SEQ ID NO: 5005526 - DNA, 16 bp, Homo sapiens
ctgtgttttgaaagaa

SEQ ID NO: 5005527 - DNA, 17 bp, Homo sapiens
ctgtgttttgaaagaat

SEQ ID NO: 5005528 - DNA, 17 bp, Homo sapiens
ctgtttcctagctgtgt

SEQ ID NO: 5005529 - DNA, 22 bp, Homo sapiens
cttcaaccagggattgtttctg

SEQ ID NO: 5005530 - DNA, 21 bp, Homo sapiens
cttcacgtagaacattggtat

SEQ ID NO: 5005531 - DNA, 14 bp, Homo sapiens
cttcgacagcattt

SEQ ID NO: 5005532 - DNA, 20 bp, Homo sapiens
cttctgtaattgtgtggatt

SEQ ID NO: 5005533 - DNA, 12 bp, Homo sapiens
cttcttttagca

SEQ ID NO: 5005534 - DNA, 20 bp, Homo sapiens
cttgaaaaaaaacagtggat

SEQ ID NO: 5005535 - DNA, 13 bp, Homo sapiens
cttgcatattttg

SEQ ID NO: 5005536 - DNA, 13 bp, Homo sapiens
ctttaaattgtgt

SEQ ID NO: 5005537 - DNA, 22 bp, Homo sapiens
ctttacaagatgggtccaggat

SEQ ID NO: 5005538 - DNA, 15 bp, Homo sapiens
ctttcaaagccattt

SEQ ID NO: 5005539 - DNA, 20 bp, Homo sapiens
ctttgaaagccccagaaatc

SEQ ID NO: 5005540 - DNA, 17 bp, Homo sapiens
ctttgccaagacctttc

SEQ ID NO: 5005541 - DNA, 14 bp, Homo sapiens
ctttgttctgctgt

SEQ ID NO: 5005542 - DNA, 20 bp, Homo sapiens
cttttaactcctcaattcca

SEQ ID NO: 5005543 - DNA, 18 bp, Homo sapiens
cttttgactttcattgga

SEQ ID NO: 5005544 - DNA, 15 bp, Homo sapiens
cttttgcattctccc

SEQ ID NO: 5005545 - DNA, 14 bp, Homo sapiens
cttttgttcccatc

SEQ ID NO: 5005546 - DNA, 22 bp, Homo sapiens
ctttttccaactcagaaattca

SEQ ID NO: 5005547 - DNA, 16 bp, Homo sapiens
gaaaaaaaacagtgga

SEQ ID NO: 5005548 - DNA, 13 bp, Homo sapiens
gaaaatgaaagct

SEQ ID NO: 5005549 - DNA, 13 bp, Homo sapiens
gaaagaatagaac

SEQ ID NO: 5005550 - DNA, 15 bp, Homo sapiens
gaaagccccagaaat

SEQ ID NO: 5005551 - DNA, 16 bp, Homo sapiens
gaaattacctgtggat

SEQ ID NO: 5005552 - DNA, 19 bp, Homo sapiens
gaaattacctgtggatatt

SEQ ID NO: 5005553 - DNA, 18 bp, Homo sapiens
gaacctacagttttaact

SEQ ID NO: 5005554 - DNA, 21 bp, Homo sapiens
gaacctacagttttaactgtg

SEQ ID NO: 5005555 - DNA, 23 bp, Homo sapiens
gaacctacagttttaactgtgga

SEQ ID NO: 5005556 - DNA, 16 bp, Homo sapiens
gaacctatttctcttt

SEQ ID NO: 5005557 - DNA, 21 bp, Homo sapiens
gaagagtgtggagtcattctc

SEQ ID NO: 5005558 - DNA, 13 bp, Homo sapiens
gaatacctgctca

SEQ ID NO: 5005559 - DNA, 19 bp, Homo sapiens
gaatagatatgaaagctga

SEQ ID NO: 5005560 - DNA, 12 bp, Homo sapiens
gaatgactcctt

SEQ ID NO: 5005561 - DNA, 13 bp, Homo sapiens
gaattataactgt

SEQ ID NO: 5005562 - DNA, 21 bp, Homo sapiens
gaattataactgtaaagatgt

SEQ ID NO: 5005563 - DNA, 12 bp, Homo sapiens
gactaattcttg

SEQ ID NO: 5005564 - DNA, 18 bp, Homo sapiens
gactaattcttgcatatt

SEQ ID NO: 5005565 - DNA, 14 bp, Homo sapiens
gagagatcaaagat

SEQ ID NO: 5005566 - DNA, 15 bp, Homo sapiens
gagatcaaagatgaa

SEQ ID NO: 5005567 - DNA, 19 bp, Homo sapiens
gagcgagagatcaaagatg

SEQ ID NO: 5005568 - DNA, 20 bp, Homo sapiens
gagggtggttcaacaaagaa

SEQ ID NO: 5005569 - DNA, 12 bp, Homo sapiens
gagtctcaataa

SEQ ID NO: 5005570 - DNA, 22 bp, Homo sapiens
gagtctcaataaactgaatttt

SEQ ID NO: 5005571 - DNA, 17 bp, Homo sapiens
gatccagtataagacta

SEQ ID NO: 5005572 - DNA, 14 bp, Homo sapiens
gatccggaaagaag

SEQ ID NO: 5005573 - DNA, 23 bp, Homo sapiens
gatctatacttgctttgtgttct

SEQ ID NO: 5005574 - DNA, 21 bp, Homo sapiens
gatgaaaagtatattgataac

SEQ ID NO: 5005575 - DNA, 23 bp, Homo sapiens
gatgaaaagtatattgataacct

SEQ ID NO: 5005576 - DNA, 13 bp, Homo sapiens
gatgctatttgca

SEQ ID NO: 5005577 - DNA, 13 bp, Homo sapiens
gatgctgtgaaat

SEQ ID NO: 5005578 - DNA, 21 bp, Homo sapiens
gatgttctactttgttctgct

SEQ ID NO: 5005579 - DNA, 15 bp, Homo sapiens
gattagaaattacct

SEQ ID NO: 5005580 - DNA, 22 bp, Homo sapiens
gatttccccttttgcattctcc

SEQ ID NO: 5005581 - DNA, 15 bp, Homo sapiens
gatttttctttaact

SEQ ID NO: 5005582 - DNA, 14 bp, Homo sapiens
gcagacgtccatca

SEQ ID NO: 5005583 - DNA, 20 bp, Homo sapiens
gcagctcataagagccacag

SEQ ID NO: 5005584 - DNA, 15 bp, Homo sapiens
gcaggcttcaaacta

SEQ ID NO: 5005585 - DNA, 20 bp, Homo sapiens
gcagtggaggtagaatgact

SEQ ID NO: 5005586 - DNA, 23 bp, Homo sapiens
gcatatattgggttccattctca

SEQ ID NO: 5005587 - DNA, 15 bp, Homo sapiens
gccacaggtctttat

SEQ ID NO: 5005588 - DNA, 23 bp, Homo sapiens
gccgtcctaacctcgggcctgct

SEQ ID NO: 5005589 - DNA, 15 bp, Homo sapiens
gcgcaccgaaaaact

SEQ ID NO: 5005590 - DNA, 20 bp, Homo sapiens
gcggtttactcactgctgca

SEQ ID NO: 5005591 - DNA, 12 bp, Homo sapiens
gcgtggctgact

SEQ ID NO: 5005592 - DNA, 20 bp, Homo sapiens
gctaatttgttttggatata

SEQ ID NO: 5005593 - DNA, 14 bp, Homo sapiens
gctaccaaaacagt

SEQ ID NO: 5005594 - DNA, 22 bp, Homo sapiens
gctagttatacttatttgtata

SEQ ID NO: 5005595 - DNA, 18 bp, Homo sapiens
gctattaaaactctttta

SEQ ID NO: 5005596 - DNA, 11 bp, Homo sapiens
gctgatttttt

SEQ ID NO: 5005597 - DNA, 21 bp, Homo sapiens
gctgtcttaaactaaatgtgc

SEQ ID NO: 5005598 - DNA, 15 bp, Homo sapiens
gctttggagaagagt

SEQ ID NO: 5005599 - DNA, 22 bp, Homo sapiens
ggaatggatttttctttaactg

SEQ ID NO: 5005600 - DNA, 20 bp, Homo sapiens
ggaggtggaggttgcagtga

SEQ ID NO: 5005601 - DNA, 22 bp, Homo sapiens
ggagtggggaagtgatcttttg

SEQ ID NO: 5005602 - DNA, 14 bp, Homo sapiens
ggataattagcatc

SEQ ID NO: 5005603 - DNA, 18 bp, Homo sapiens
ggatctatacttgctttg

SEQ ID NO: 5005604 - DNA, 15 bp, Homo sapiens
ggattcctcttttct

SEQ ID NO: 5005605 - DNA, 17 bp, Homo sapiens
ggatttaaaagcctgct

SEQ ID NO: 5005606 - DNA, 13 bp, Homo sapiens
ggcagcttctttg

SEQ ID NO: 5005607 - DNA, 22 bp, Homo sapiens
ggcatatattgggttccattct

SEQ ID NO: 5005608 - DNA, 15 bp, Homo sapiens
ggcctgcccagttgc

SEQ ID NO: 5005609 - DNA, 14 bp, Homo sapiens
ggctcctgttttgc

SEQ ID NO: 5005610 - DNA, 16 bp, Homo sapiens
gggaagggcctgccca

SEQ ID NO: 5005611 - DNA, 19 bp, Homo sapiens
gggagtggggaagtgatct

SEQ ID NO: 5005612 - DNA, 13 bp, Homo sapiens
gggctaatttaac

SEQ ID NO: 5005613 - DNA, 18 bp, Homo sapiens
gggtccaggattcctctt

SEQ ID NO: 5005614 - DNA, 15 bp, Homo sapiens
gggtttattcactga

SEQ ID NO: 5005615 - DNA, 12 bp, Homo sapiens
ggtctgtttgca

SEQ ID NO: 5005616 - DNA, 17 bp, Homo sapiens
ggtttacagtctatttg

SEQ ID NO: 5005617 - DNA, 19 bp, Homo sapiens
gtaaaataaatattgtctt

SEQ ID NO: 5005618 - DNA, 20 bp, Homo sapiens
gtaaaataaatattgtcttt

SEQ ID NO: 5005619 - DNA, 19 bp, Homo sapiens
gtaatctgagaaacaatga

SEQ ID NO: 5005620 - DNA, 12 bp, Homo sapiens
gtaatttaactt

SEQ ID NO: 5005621 - DNA, 15 bp, Homo sapiens
gtacgatgacagtgt

SEQ ID NO: 5005622 - DNA, 20 bp, Homo sapiens
gtagcatttactgtgtcttt

SEQ ID NO: 5005623 - DNA, 12 bp, Homo sapiens
gtatattcagga

SEQ ID NO: 5005624 - DNA, 21 bp, Homo sapiens
gtatcagtggatttcccatcc

SEQ ID NO: 5005625 - DNA, 19 bp, Homo sapiens
gtatttattttttcttttc

SEQ ID NO: 5005626 - DNA, 11 bp, Homo sapiens
gtcatggccaa

SEQ ID NO: 5005627 - DNA, 22 bp, Homo sapiens
gtcatggccaaatgttcaatat

SEQ ID NO: 5005628 - DNA, 18 bp, Homo sapiens
gtcgcgcaccgaaaaact

SEQ ID NO: 5005629 - DNA, 17 bp, Homo sapiens
gtctgtgttttgaaaga

SEQ ID NO: 5005630 - DNA, 17 bp, Homo sapiens
gtcttaaactaaatgtg

SEQ ID NO: 5005631 - DNA, 12 bp, Homo sapiens
gtgaaattccca

SEQ ID NO: 5005632 - DNA, 22 bp, Homo sapiens
gtgacagagcaagactctgtct

SEQ ID NO: 5005633 - DNA, 20 bp, Homo sapiens
gtgatcttttgttcccatcc

SEQ ID NO: 5005634 - DNA, 23 bp, Homo sapiens
gtggatcacaaagtggaacgaaa

SEQ ID NO: 5005635 - DNA, 19 bp, Homo sapiens
gtggatccaaactgatcca

SEQ ID NO: 5005636 - DNA, 21 bp, Homo sapiens
gtgttactaaaaaaaagatga

SEQ ID NO: 5005637 - DNA, 13 bp, Homo sapiens
gtgttctttgtgt

SEQ ID NO: 5005638 - DNA, 14 bp, Homo sapiens
gtgttttaattgta

SEQ ID NO: 5005639 - DNA, 15 bp, Homo sapiens
gtgttttgaaagaat

SEQ ID NO: 5005640 - DNA, 18 bp, Homo sapiens
gttcaatatgagtctcaa

SEQ ID NO: 5005641 - DNA, 15 bp, Homo sapiens
gttctctagaaagaa

SEQ ID NO: 5005642 - DNA, 17 bp, Homo sapiens
gttggaatggatttttc

SEQ ID NO: 5005643 - DNA, 22 bp, Homo sapiens
gttggaatggatttttctttaa

SEQ ID NO: 5005644 - DNA, 18 bp, Homo sapiens
gttgtactttggaattct

SEQ ID NO: 5005645 - DNA, 20 bp, Homo sapiens
gtttacaaaaatttctgtaa

SEQ ID NO: 5005646 - DNA, 14 bp, Homo sapiens
gtttctggatttca

SEQ ID NO: 5005647 - DNA, 17 bp, Homo sapiens
taaaataaatattgtct

SEQ ID NO: 5005648 - DNA, 20 bp, Homo sapiens
taaaatctgatatgtattgt

SEQ ID NO: 5005649 - DNA, 23 bp, Homo sapiens
taaaatctgatatgtattgtttg

SEQ ID NO: 5005650 - DNA, 20 bp, Homo sapiens
taaactgaatttttcttgcg

SEQ ID NO: 5005651 - DNA, 22 bp, Homo sapiens
taaactgaatttttcttgcgaa

SEQ ID NO: 5005652 - DNA, 19 bp, Homo sapiens
taaagttattcttgaagtc

SEQ ID NO: 5005653 - DNA, 17 bp, Homo sapiens
taaatagcttttgtgtc

SEQ ID NO: 5005654 - DNA, 16 bp, Homo sapiens
taaatggaaactgaaa

SEQ ID NO: 5005655 - DNA, 17 bp, Homo sapiens
taaggatccggaaagaa

SEQ ID NO: 5005656 - DNA, 18 bp, Homo sapiens
taaggatccggaaagaag

SEQ ID NO: 5005657 - DNA, 18 bp, Homo sapiens
taatcttatcaagagttg

SEQ ID NO: 5005658 - DNA, 14 bp, Homo sapiens
taattcttattctt

SEQ ID NO: 5005659 - DNA, 18 bp, Homo sapiens
taccatgcttcacaatgt

SEQ ID NO: 5005660 - DNA, 21 bp, Homo sapiens
tacctgctcacgtcaaatgca

SEQ ID NO: 5005661 - DNA, 19 bp, Homo sapiens
tactcaagtagcatttact

SEQ ID NO: 5005662 - DNA, 20 bp, Homo sapiens
tactgcaccatttaaaaaca

SEQ ID NO: 5005663 - DNA, 16 bp, Homo sapiens
tacttctgtaattgtg

SEQ ID NO: 5005664 - DNA, 21 bp, Homo sapiens
tactttagaagcctgcataat

SEQ ID NO: 5005665 - DNA, 17 bp, Homo sapiens
tactttggaattcttag

SEQ ID NO: 5005666 - DNA, 18 bp, Homo sapiens
tagaaattacctgtggat

SEQ ID NO: 5005667 - DNA, 17 bp, Homo sapiens
tagccatttttactgtt

SEQ ID NO: 5005668 - DNA, 19 bp, Homo sapiens
tagcttttgtgtcttacat

SEQ ID NO: 5005669 - DNA, 14 bp, Homo sapiens
taggatgtaaatct

SEQ ID NO: 5005670 - DNA, 19 bp, Homo sapiens
tagttatacttatttgtat

SEQ ID NO: 5005671 - DNA, 17 bp, Homo sapiens
tagttgaacctatttct

SEQ ID NO: 5005672 - DNA, 15 bp, Homo sapiens
tatcccctctactct

SEQ ID NO: 5005673 - DNA, 19 bp, Homo sapiens
tatgccattggggtagttg

SEQ ID NO: 5005674 - DNA, 19 bp, Homo sapiens
tattaaatggaaactgaaa

SEQ ID NO: 5005675 - DNA, 20 bp, Homo sapiens
tattcaggacttgaaagaaa

SEQ ID NO: 5005676 - DNA, 14 bp, Homo sapiens
tattcgcttgagaa

SEQ ID NO: 5005677 - DNA, 21 bp, Homo sapiens
tatttcaggcattggatattt

SEQ ID NO: 5005678 - DNA, 14 bp, Homo sapiens
tatttgcaattcct

SEQ ID NO: 5005679 - DNA, 22 bp, Homo sapiens
tatttgtaggggaactcatttg

SEQ ID NO: 5005680 - DNA, 16 bp, Homo sapiens
tattttgtaacttcca

SEQ ID NO: 5005681 - DNA, 19 bp, Homo sapiens
tcaacagtttccagtcatg

SEQ ID NO: 5005682 - DNA, 20 bp, Homo sapiens
tcaaccagggattgtttctg

SEQ ID NO: 5005683 - DNA, 13 bp, Homo sapiens
tcaagtagcattt

SEQ ID NO: 5005684 - DNA, 20 bp, Homo sapiens
tcacaaaatatattttgttt

SEQ ID NO: 5005685 - DNA, 18 bp, Homo sapiens
tcagttaagtttttccct

SEQ ID NO: 5005686 - DNA, 14 bp, Homo sapiens
tcatgacagcctcc

SEQ ID NO: 5005687 - DNA, 20 bp, Homo sapiens
tcattcccttcgacagcatt

SEQ ID NO: 5005688 - DNA, 21 bp, Homo sapiens
tcattcccttcgacagcattt

SEQ ID NO: 5005689 - DNA, 22 bp, Homo sapiens
tcattcccttcgacagcatttt

SEQ ID NO: 5005690 - DNA, 23 bp, Homo sapiens
tccacacaacatatccgtatata

SEQ ID NO: 5005691 - DNA, 16 bp, Homo sapiens
tccaccagtcattttt

SEQ ID NO: 5005692 - DNA, 21 bp, Homo sapiens
tccagtataagactactgaat

SEQ ID NO: 5005693 - DNA, 17 bp, Homo sapiens
tccagtcatggccaaat

SEQ ID NO: 5005694 - DNA, 21 bp, Homo sapiens
tccatgtgagggttttcagca

SEQ ID NO: 5005695 - DNA, 19 bp, Homo sapiens
tcccaacaaacattgatgc

SEQ ID NO: 5005696 - DNA, 19 bp, Homo sapiens
tcccccaccccatttctct

SEQ ID NO: 5005697 - DNA, 14 bp, Homo sapiens
tccccctagccatt

SEQ ID NO: 5005698 - DNA, 13 bp, Homo sapiens
tcctaccgtcttt

SEQ ID NO: 5005699 - DNA, 17 bp, Homo sapiens
tcctctgctttgaaagc

SEQ ID NO: 5005700 - DNA, 18 bp, Homo sapiens
tcctgtttcctagctgtg

SEQ ID NO: 5005701 - DNA, 17 bp, Homo sapiens
tcctgttttgcacagcc

SEQ ID NO: 5005702 - DNA, 15 bp, Homo sapiens
tccttgtagcctttt

SEQ ID NO: 5005703 - DNA, 19 bp, Homo sapiens
tccttgtagccttttgact

SEQ ID NO: 5005704 - DNA, 20 bp, Homo sapiens
tccttgtagccttttgactt

SEQ ID NO: 5005705 - DNA, 21 bp, Homo sapiens
tctaggtacgatgacagtgtt

SEQ ID NO: 5005706 - DNA, 14 bp, Homo sapiens
tctataaactataa

SEQ ID NO: 5005707 - DNA, 21 bp, Homo sapiens
tctataaactataacctctcc

SEQ ID NO: 5005708 - DNA, 15 bp, Homo sapiens
tctatacttgctttg

SEQ ID NO: 5005709 - DNA, 20 bp, Homo sapiens
tctcattgaattataaaagc

SEQ ID NO: 5005710 - DNA, 22 bp, Homo sapiens
tctccaccagtcatttttcaga

SEQ ID NO: 5005711 - DNA, 13 bp, Homo sapiens
tctctaacaatgt

SEQ ID NO: 5005712 - DNA, 18 bp, Homo sapiens
tctctacaggtttgggta

SEQ ID NO: 5005713 - DNA, 13 bp, Homo sapiens
tctctttctttac

SEQ ID NO: 5005714 - DNA, 21 bp, Homo sapiens
tctgctgttctctagaaagaa

SEQ ID NO: 5005715 - DNA, 15 bp, Homo sapiens
tctgggttgccttta

SEQ ID NO: 5005716 - DNA, 15 bp, Homo sapiens
tctgtctaaaaaaca

SEQ ID NO: 5005717 - DNA, 20 bp, Homo sapiens
tcttgcttggggaacttgtg

SEQ ID NO: 5005718 - DNA, 11 bp, Homo sapiens
tctttaactgc

SEQ ID NO: 5005719 - DNA, 21 bp, Homo sapiens
tctttgccaagacctttcaaa

SEQ ID NO: 5005720 - DNA, 15 bp, Homo sapiens
tgaaagccccagaaa

SEQ ID NO: 5005721 - DNA, 14 bp, Homo sapiens
tgaatacctgctca

SEQ ID NO: 5005722 - DNA, 15 bp, Homo sapiens
tgacaactacagaaa

SEQ ID NO: 5005723 - DNA, 14 bp, Homo sapiens
tgacagtgttttta

SEQ ID NO: 5005724 - DNA, 15 bp, Homo sapiens
tgactaattcttgca

SEQ ID NO: 5005725 - DNA, 22 bp, Homo sapiens
tgactaattcttgcatattttg

SEQ ID NO: 5005726 - DNA, 23 bp, Homo sapiens
tgagaagattcttcccattctcc

SEQ ID NO: 5005727 - DNA, 16 bp, Homo sapiens
tgagaggcatttcccc

SEQ ID NO: 5005728 - DNA, 16 bp, Homo sapiens
tgagattaattccttt

SEQ ID NO: 5005729 - DNA, 16 bp, Homo sapiens
tgatagtggtggagtt

SEQ ID NO: 5005730 - DNA, 17 bp, Homo sapiens
tgatatttgtgcatttt

SEQ ID NO: 5005731 - DNA, 19 bp, Homo sapiens
tgatatttgtgcattttct

SEQ ID NO: 5005732 - DNA, 20 bp, Homo sapiens
tgatgacaactacagaaaaa

SEQ ID NO: 5005733 - DNA, 13 bp, Homo sapiens
tgatgctatttgc

SEQ ID NO: 5005734 - DNA, 19 bp, Homo sapiens
tgattaattaaatagcttt

SEQ ID NO: 5005735 - DNA, 17 bp, Homo sapiens
tgattttttttaattac

SEQ ID NO: 5005736 - DNA, 16 bp, Homo sapiens
tgcaacagacttgaat

SEQ ID NO: 5005737 - DNA, 19 bp, Homo sapiens
tgccattggggtagttgtg

SEQ ID NO: 5005738 - DNA, 13 bp, Homo sapiens
tgctaatttgttt

SEQ ID NO: 5005739 - DNA, 19 bp, Homo sapiens
tgctactcaagtagcattt

SEQ ID NO: 5005740 - DNA, 13 bp, Homo sapiens
tgctatttgcaat

SEQ ID NO: 5005741 - DNA, 13 bp, Homo sapiens
tgctgtcttaaac

SEQ ID NO: 5005742 - DNA, 22 bp, Homo sapiens
tgcttccatggccgtgtagaag

SEQ ID NO: 5005743 - DNA, 23 bp, Homo sapiens
tgcttccatggccgtgtagaagc

SEQ ID NO: 5005744 - DNA, 22 bp, Homo sapiens
tggaaattaggatgtaaatctg

SEQ ID NO: 5005745 - DNA, 22 bp, Homo sapiens
tggaattcttagtcacaaaata

SEQ ID NO: 5005746 - DNA, 14 bp, Homo sapiens
tggagtcattctca

SEQ ID NO: 5005747 - DNA, 14 bp, Homo sapiens
tggatattgttacg

SEQ ID NO: 5005748 - DNA, 13 bp, Homo sapiens
tggatatttgtat

SEQ ID NO: 5005749 - DNA, 20 bp, Homo sapiens
tggatttaaaagcctgctca

SEQ ID NO: 5005750 - DNA, 22 bp, Homo sapiens
tggcagatgtaaagttattctt

SEQ ID NO: 5005751 - DNA, 18 bp, Homo sapiens
tggcttctctgaggaagc

SEQ ID NO: 5005752 - DNA, 15 bp, Homo sapiens
tgggaatacctgtgg

SEQ ID NO: 5005753 - DNA, 11 bp, Homo sapiens
tgtaaagatgt

SEQ ID NO: 5005754 - DNA, 20 bp, Homo sapiens
tgtaatcccagctactcggg

SEQ ID NO: 5005755 - DNA, 16 bp, Homo sapiens
tgtactaactagcatt

SEQ ID NO: 5005756 - DNA, 13 bp, Homo sapiens
tgtataaaagtgt

SEQ ID NO: 5005757 - DNA, 21 bp, Homo sapiens
tgtataaaagtgtgaaataaa

SEQ ID NO: 5005758 - DNA, 19 bp, Homo sapiens
tgtatcagtggatttccca

SEQ ID NO: 5005759 - DNA, 21 bp, Homo sapiens
tgtgaatacctgctcacgtca

SEQ ID NO: 5005760 - DNA, 14 bp, Homo sapiens
tgtggattctttaa

SEQ ID NO: 5005761 - DNA, 14 bp, Homo sapiens
tgtggtggttgtga

SEQ ID NO: 5005762 - DNA, 14 bp, Homo sapiens
tgtgtggattcttt

SEQ ID NO: 5005763 - DNA, 17 bp, Homo sapiens
tgttaacatttttggta

SEQ ID NO: 5005764 - DNA, 20 bp, Homo sapiens
tgttaacatttttggtagtc

SEQ ID NO: 5005765 - DNA, 16 bp, Homo sapiens
tgttacgtagcctaag

SEQ ID NO: 5005766 - DNA, 21 bp, Homo sapiens
tgtttacaaaaatttctgtaa

SEQ ID NO: 5005767 - DNA, 13 bp, Homo sapiens
tgttttaattgta

SEQ ID NO: 5005768 - DNA, 13 bp, Homo sapiens
ttaactgtggata

SEQ ID NO: 5005769 - DNA, 15 bp, Homo sapiens
ttaactgtggatatt

SEQ ID NO: 5005770 - DNA, 15 bp, Homo sapiens
ttaagaaatagaatt

SEQ ID NO: 5005771 - DNA, 19 bp, Homo sapiens
ttaattaaatagcttttgt

SEQ ID NO: 5005772 - DNA, 20 bp, Homo sapiens
ttaattaaatagcttttgtg

SEQ ID NO: 5005773 - DNA, 17 bp, Homo sapiens
ttactaaaaaaaagatg

SEQ ID NO: 5005774 - DNA, 18 bp, Homo sapiens
ttactaaaaaaaagatga

SEQ ID NO: 5005775 - DNA, 20 bp, Homo sapiens
ttactggtaggaacttgaga

SEQ ID NO: 5005776 - DNA, 24 bp, Homo sapiens
ttactggtaggaacttgagaactt

SEQ ID NO: 5005777 - DNA, 13 bp, Homo sapiens
ttactgtgtcttt

SEQ ID NO: 5005778 - DNA, 23 bp, Homo sapiens
ttagaagcctgcataatgtttct

SEQ ID NO: 5005779 - DNA, 23 bp, Homo sapiens
ttataaatgtaccagagagagtt

SEQ ID NO: 5005780 - DNA, 18 bp, Homo sapiens
ttataactgtaaagatgt

SEQ ID NO: 5005781 - DNA, 23 bp, Homo sapiens
ttatcaagagttgtgacaacttc

SEQ ID NO: 5005782 - DNA, 21 bp, Homo sapiens
ttcaacaaagaaacaaagatg

SEQ ID NO: 5005783 - DNA, 22 bp, Homo sapiens
ttcactgtgaccttgagaagat

SEQ ID NO: 5005784 - DNA, 23 bp, Homo sapiens
ttcatgattagaaattacctgtg

SEQ ID NO: 5005785 - DNA, 18 bp, Homo sapiens
ttcattctccctttcact

SEQ ID NO: 5005786 - DNA, 13 bp, Homo sapiens
ttccagtcatggc

SEQ ID NO: 5005787 - DNA, 23 bp, Homo sapiens
ttccatgtgagggttttcagcat

SEQ ID NO: 5005788 - DNA, 19 bp, Homo sapiens
ttccttgtagccttttgac

SEQ ID NO: 5005789 - DNA, 20 bp, Homo sapiens
ttccttgtagccttttgact

SEQ ID NO: 5005790 - DNA, 18 bp, Homo sapiens
ttcctttccaggtatttt

SEQ ID NO: 5005791 - DNA, 13 bp, Homo sapiens
ttcgtaacacagc

SEQ ID NO: 5005792 - DNA, 23 bp, Homo sapiens
ttctattttttgttttgtttcct

SEQ ID NO: 5005793 - DNA, 23 bp, Homo sapiens
ttctcattgaattataaaagcca

SEQ ID NO: 5005794 - DNA, 16 bp, Homo sapiens
ttctctttctttacaa

SEQ ID NO: 5005795 - DNA, 14 bp, Homo sapiens
ttcttgcatatttt

SEQ ID NO: 5005796 - DNA, 17 bp, Homo sapiens
ttcttgcatattttgta

SEQ ID NO: 5005797 - DNA, 20 bp, Homo sapiens
ttcttgcatattttgtaact

SEQ ID NO: 5005798 - DNA, 19 bp, Homo sapiens
ttgaaagccccagaaatca

SEQ ID NO: 5005799 - DNA, 22 bp, Homo sapiens
ttgagactcctcagttcttgcc

SEQ ID NO: 5005800 - DNA, 20 bp, Homo sapiens
ttgatatttgtgcattttct

SEQ ID NO: 5005801 - DNA, 18 bp, Homo sapiens
ttgcacagccaaatttaa

SEQ ID NO: 5005802 - DNA, 19 bp, Homo sapiens
ttggatttaaaagcctgct

SEQ ID NO: 5005803 - DNA, 18 bp, Homo sapiens
ttggggaagggcctgccc

SEQ ID NO: 5005804 - DNA, 13 bp, Homo sapiens
ttggttttcctgt

SEQ ID NO: 5005805 - DNA, 15 bp, Homo sapiens
ttggttttcctgtat

SEQ ID NO: 5005806 - DNA, 16 bp, Homo sapiens
ttgtagccttttgact

SEQ ID NO: 5005807 - DNA, 19 bp, Homo sapiens
ttgtagccttttgactttc

SEQ ID NO: 5005808 - DNA, 16 bp, Homo sapiens
ttgtgtccctaatgtg

SEQ ID NO: 5005809 - DNA, 13 bp, Homo sapiens
ttgttatctggga

SEQ ID NO: 5005810 - DNA, 21 bp, Homo sapiens
ttgttcccatcctcttctttt

SEQ ID NO: 5005811 - DNA, 23 bp, Homo sapiens
ttgtttcctcccctatctgtatt

SEQ ID NO: 5005812 - DNA, 14 bp, Homo sapiens
tttaaaagcctgct

SEQ ID NO: 5005813 - DNA, 12 bp, Homo sapiens
tttaaattgtgt

SEQ ID NO: 5005814 - DNA, 12 bp, Homo sapiens
tttaactgccgt

SEQ ID NO: 5005815 - DNA, 12 bp, Homo sapiens
tttaactgtgga

SEQ ID NO: 5005816 - DNA, 13 bp, Homo sapiens
tttaactgtggat

SEQ ID NO: 5005817 - DNA, 17 bp, Homo sapiens
tttaactgtggatattg

SEQ ID NO: 5005818 - DNA, 13 bp, Homo sapiens
tttacccttcagg

SEQ ID NO: 5005819 - DNA, 18 bp, Homo sapiens
tttactgttatcctattt

SEQ ID NO: 5005820 - DNA, 14 bp, Homo sapiens
tttagaagcctgca

SEQ ID NO: 5005821 - DNA, 13 bp, Homo sapiens
tttcagacctttt

SEQ ID NO: 5005822 - DNA, 22 bp, Homo sapiens
tttcagagtgactacacacagt

SEQ ID NO: 5005823 - DNA, 14 bp, Homo sapiens
tttcagcattgata

SEQ ID NO: 5005824 - DNA, 15 bp, Homo sapiens
tttcagcattgatat

SEQ ID NO: 5005825 - DNA, 14 bp, Homo sapiens
tttccccttttgca

SEQ ID NO: 5005826 - DNA, 13 bp, Homo sapiens
tttcgttcagtta

SEQ ID NO: 5005827 - DNA, 15 bp, Homo sapiens
tttctggatttcata

SEQ ID NO: 5005828 - DNA, 21 bp, Homo sapiens
tttgaaagaatagaacacagt

SEQ ID NO: 5005829 - DNA, 14 bp, Homo sapiens
tttgactttcattg

SEQ ID NO: 5005830 - DNA, 15 bp, Homo sapiens
tttgccaagaccttt

SEQ ID NO: 5005831 - DNA, 20 bp, Homo sapiens
tttggatttaaaagcctgct

SEQ ID NO: 5005832 - DNA, 18 bp, Homo sapiens
tttgtaggggaactcatt

SEQ ID NO: 5005833 - DNA, 14 bp, Homo sapiens
tttgttcccatcct

SEQ ID NO: 5005834 - DNA, 14 bp, Homo sapiens
ttttaactgtggat

SEQ ID NO: 5005835 - DNA, 13 bp, Homo sapiens
ttttcagcattga

SEQ ID NO: 5005836 - DNA, 20 bp, Homo sapiens
tttttggcgtggctgactta

SEQ ID NO: 5005837 - DNA, 13 bp, Homo sapiens
aaaaaaaagcttc

SEQ ID NO: 5005838 - DNA, 13 bp, Homo sapiens
aaaacacacaggt

SEQ ID NO: 5005839 - DNA, 13 bp, Homo sapiens
aaaacaggcagct

SEQ ID NO: 5005840 - DNA, 21 bp, Homo sapiens
aaaataaatattgtctttttg

SEQ ID NO: 5005841 - DNA, 19 bp, Homo sapiens
aaactgaatttttcttgcg

SEQ ID NO: 5005842 - DNA, 22 bp, Homo sapiens
aaactgatccagtataagacta

SEQ ID NO: 5005843 - DNA, 22 bp, Homo sapiens
aaagaagagcgagagatcaaag

SEQ ID NO: 5005844 - DNA, 14 bp, Homo sapiens
aaagccccagaaat

SEQ ID NO: 5005845 - DNA, 13 bp, Homo sapiens
aaagcctgctcaa

SEQ ID NO: 5005846 - DNA, 17 bp, Homo sapiens
aaagcttgagtaaaata

SEQ ID NO: 5005847 - DNA, 13 bp, Homo sapiens
aaagtggaacgaa

SEQ ID NO: 5005848 - DNA, 15 bp, Homo sapiens
aaattacctgtggat

SEQ ID NO: 5005849 - DNA, 22 bp, Homo sapiens
aaattagtaggctcatttactg

SEQ ID NO: 5005850 - DNA, 18 bp, Homo sapiens
aacaaacattgatgctga

SEQ ID NO: 5005851 - DNA, 21 bp, Homo sapiens
aacaatgactaattcttgcat

SEQ ID NO: 5005852 - DNA, 23 bp, Homo sapiens
aacactgatttccccttttgcat

SEQ ID NO: 5005853 - DNA, 14 bp, Homo sapiens
aacagtggatcaca

SEQ ID NO: 5005854 - DNA, 14 bp, Homo sapiens
aaccagaggcagct

SEQ ID NO: 5005855 - DNA, 15 bp, Homo sapiens
aacctatttctcttt

SEQ ID NO: 5005856 - DNA, 17 bp, Homo sapiens
aaccttgaaaaaaaaca

SEQ ID NO: 5005857 - DNA, 16 bp, Homo sapiens
aacgaaaatgaaagct

SEQ ID NO: 5005858 - DNA, 19 bp, Homo sapiens
aactacagaaaaaccagag

SEQ ID NO: 5005859 - DNA, 17 bp, Homo sapiens
aactactgcaccattta

SEQ ID NO: 5005860 - DNA, 17 bp, Homo sapiens
aactgccgtaatttaac

SEQ ID NO: 5005861 - DNA, 18 bp, Homo sapiens
aactgccgtaatttaact

SEQ ID NO: 5005862 - DNA, 11 bp, Homo sapiens
aactgtggata

SEQ ID NO: 5005863 - DNA, 13 bp, Homo sapiens
aactgtggatatt

SEQ ID NO: 5005864 - DNA, 22 bp, Homo sapiens
aacttgagaactttatttccaa

SEQ ID NO: 5005865 - DNA, 15 bp, Homo sapiens
aagaaacaaagatgt

SEQ ID NO: 5005866 - DNA, 22 bp, Homo sapiens
aagagccacaggtctttatgtt

SEQ ID NO: 5005867 - DNA, 22 bp, Homo sapiens
aagagtgtggagtcattctcat

SEQ ID NO: 5005868 - DNA, 19 bp, Homo sapiens
aagattcttcccattctcc

SEQ ID NO: 5005869 - DNA, 18 bp, Homo sapiens
aagctgattttttttaat

SEQ ID NO: 5005870 - DNA, 16 bp, Homo sapiens
aagctggggttcatga

SEQ ID NO: 5005871 - DNA, 22 bp, Homo sapiens
aagctggggttcatgacaatgg

SEQ ID NO: 5005872 - DNA, 17 bp, Homo sapiens
aaggatccggaaagaag

SEQ ID NO: 5005873 - DNA, 23 bp, Homo sapiens
aagggcctgcccagttgcactca

SEQ ID NO: 5005874 - DNA, 11 bp, Homo sapiens
aagtagcattt

SEQ ID NO: 5005875 - DNA, 16 bp, Homo sapiens
aagtagcatttactgt

SEQ ID NO: 5005876 - DNA, 20 bp, Homo sapiens
aagtggaacgaaaatgaaag

SEQ ID NO: 5005877 - DNA, 20 bp, Homo sapiens
aagttatgggaatacctgtg

SEQ ID NO: 5005878 - DNA, 21 bp, Homo sapiens
aataaatattgtctttttgta

SEQ ID NO: 5005879 - DNA, 23 bp, Homo sapiens
aataaatattgtctttttgtatg

SEQ ID NO: 5005880 - DNA, 14 bp, Homo sapiens
aatagaaggtgatg

SEQ ID NO: 5005881 - DNA, 16 bp, Homo sapiens
aatagaattataactg

SEQ ID NO: 5005882 - DNA, 10 bp, Homo sapiens
aatattctgg

SEQ ID NO: 5005883 - DNA, 13 bp, Homo sapiens
aatattgtctttt

SEQ ID NO: 5005884 - DNA, 19 bp, Homo sapiens
aatctgctaccaaaacagt

SEQ ID NO: 5005885 - DNA, 22 bp, Homo sapiens
aatcttatcaagagttgtgaca

SEQ ID NO: 5005886 - DNA, 18 bp, Homo sapiens
aatgaaagctactcatag

SEQ ID NO: 5005887 - DNA, 18 bp, Homo sapiens
aatgactaattcttgcat

SEQ ID NO: 5005888 - DNA, 20 bp, Homo sapiens
aatgactaattcttgcatat

SEQ ID NO: 5005889 - DNA, 17 bp, Homo sapiens
aatgagattaattcctt

SEQ ID NO: 5005890 - DNA, 19 bp, Homo sapiens
aatgatgctatttgcaatt

SEQ ID NO: 5005891 - DNA, 13 bp, Homo sapiens
aatgtattttctt

SEQ ID NO: 5005892 - DNA, 15 bp, Homo sapiens
aatgtgcaatagaag

SEQ ID NO: 5005893 - DNA, 16 bp, Homo sapiens
aatgttaacatttttg

SEQ ID NO: 5005894 - DNA, 22 bp, Homo sapiens
aattactttggggctaatttaa

SEQ ID NO: 5005895 - DNA, 20 bp, Homo sapiens
aattataactgtaaagatgt

SEQ ID NO: 5005896 - DNA, 22 bp, Homo sapiens
aattatttcatgattagaaatt

SEQ ID NO: 5005897 - DNA, 13 bp, Homo sapiens
aattcttgcatat

SEQ ID NO: 5005898 - DNA, 17 bp, Homo sapiens
aatttgttttggatata

SEQ ID NO: 5005899 - DNA, 12 bp, Homo sapiens
acaaaacaaaac

SEQ ID NO: 5005900 - DNA, 20 bp, Homo sapiens
acaaagaaacaaagatgtta

SEQ ID NO: 5005901 - DNA, 16 bp, Homo sapiens
acacagactcatatta

SEQ ID NO: 5005902 - DNA, 17 bp, Homo sapiens
acacagcattgtatatg

SEQ ID NO: 5005903 - DNA, 11 bp, Homo sapiens
acagaaaaacc

SEQ ID NO: 5005904 - DNA, 15 bp, Homo sapiens
acagagcaagactct

SEQ ID NO: 5005905 - DNA, 14 bp, Homo sapiens
acagagtggccgtc

SEQ ID NO: 5005906 - DNA, 15 bp, Homo sapiens
acagcaaacaggtgc

SEQ ID NO: 5005907 - DNA, 18 bp, Homo sapiens
acaggttataacagtgtt

SEQ ID NO: 5005908 - DNA, 13 bp, Homo sapiens
acagttttaactg

SEQ ID NO: 5005909 - DNA, 14 bp, Homo sapiens
acatcacaagacta

SEQ ID NO: 5005910 - DNA, 18 bp, Homo sapiens
acatgtagaaaacaaaat

SEQ ID NO: 5005911 - DNA, 16 bp, Homo sapiens
accaaaacagttaatc

SEQ ID NO: 5005912 - DNA, 15 bp, Homo sapiens
accagagagagttgt

SEQ ID NO: 5005913 - DNA, 13 bp, Homo sapiens
accagaggcagct

SEQ ID NO: 5005914 - DNA, 15 bp, Homo sapiens
accagcctgaccaaa

SEQ ID NO: 5005915 - DNA, 19 bp, Homo sapiens
accagggattgtttctgtt

SEQ ID NO: 5005916 - DNA, 14 bp, Homo sapiens
accagtcatttttc

SEQ ID NO: 5005917 - DNA, 16 bp, Homo sapiens
accagtcatttttcag

SEQ ID NO: 5005918 - DNA, 20 bp, Homo sapiens
accatgtttgtggctattaa

SEQ ID NO: 5005919 - DNA, 14 bp, Homo sapiens
accccatttctctc

SEQ ID NO: 5005920 - DNA, 15 bp, Homo sapiens
accccatttctctcc

SEQ ID NO: 5005921 - DNA, 19 bp, Homo sapiens
accgaaaaactaaaaataa

SEQ ID NO: 5005922 - DNA, 11 bp, Homo sapiens
acctacagttt

SEQ ID NO: 5005923 - DNA, 17 bp, Homo sapiens
acctacagttttaactg

SEQ ID NO: 5005924 - DNA, 22 bp, Homo sapiens
acctatttctctttctttacaa

SEQ ID NO: 5005925 - DNA, 16 bp, Homo sapiens
accttgaaaaaaaaca

SEQ ID NO: 5005926 - DNA, 18 bp, Homo sapiens
accttgaaaaaaaacagt

SEQ ID NO: 5005927 - DNA, 22 bp, Homo sapiens
accttgaaaaaaaacagtggat

SEQ ID NO: 5005928 - DNA, 19 bp, Homo sapiens
acgaacctacagttttaac

SEQ ID NO: 5005929 - DNA, 16 bp, Homo sapiens
actaaaaaaaagatga

SEQ ID NO: 5005930 - DNA, 18 bp, Homo sapiens
actacagaaaaaccagag

SEQ ID NO: 5005931 - DNA, 15 bp, Homo sapiens
actactgcaccattt

SEQ ID NO: 5005932 - DNA, 17 bp, Homo sapiens
actaggggacaaagcaa

SEQ ID NO: 5005933 - DNA, 15 bp, Homo sapiens
actcatattactggt

SEQ ID NO: 5005934 - DNA, 15 bp, Homo sapiens
actctaaaattataa

SEQ ID NO: 5005935 - DNA, 21 bp, Homo sapiens
actctaaaattataaatgaca

SEQ ID NO: 5005936 - DNA, 21 bp, Homo sapiens
actctgtctaaaaaacaaaac

SEQ ID NO: 5005937 - DNA, 20 bp, Homo sapiens
actgatttccccttttgcat

SEQ ID NO: 5005938 - DNA, 18 bp, Homo sapiens
actgcaccatttaaaaac

SEQ ID NO: 5005939 - DNA, 16 bp, Homo sapiens
actgccgtaatttaac

SEQ ID NO: 5005940 - DNA, 17 bp, Homo sapiens
actgccgtaatttaact

SEQ ID NO: 5005941 - DNA, 12 bp, Homo sapiens
actgttggaatg

SEQ ID NO: 5005942 - DNA, 11 bp, Homo sapiens
acttattaaat

SEQ ID NO: 5005943 - DNA, 11 bp, Homo sapiens
acttcccccaa

SEQ ID NO: 5005944 - DNA, 20 bp, Homo sapiens
acttcctgagggatctatac

SEQ ID NO: 5005945 - DNA, 15 bp, Homo sapiens
acttctgtaattgtg

SEQ ID NO: 5005946 - DNA, 22 bp, Homo sapiens
acttgtgtccctaatgtgttta

SEQ ID NO: 5005947 - DNA, 13 bp, Homo sapiens
actttaaattgtg

SEQ ID NO: 5005948 - DNA, 12 bp, Homo sapiens
actttatttcca

SEQ ID NO: 5005949 - DNA, 14 bp, Homo sapiens
actttcattggaaa

SEQ ID NO: 5005950 - DNA, 19 bp, Homo sapiens
agaaaaaccagaggcagct

SEQ ID NO: 5005951 - DNA, 19 bp, Homo sapiens
agaaattacctgtggatat

SEQ ID NO: 5005952 - DNA, 14 bp, Homo sapiens
agaacatgtagaaa

SEQ ID NO: 5005953 - DNA, 18 bp, Homo sapiens
agaacatgtagaaaacaa

SEQ ID NO: 5005954 - DNA, 21 bp, Homo sapiens
agaagcctgcataatgtttct

SEQ ID NO: 5005955 - DNA, 21 bp, Homo sapiens
agactctgtctaaaaaacaaa

SEQ ID NO: 5005956 - DNA, 22 bp, Homo sapiens
agagactgaatagatatgaaag

SEQ ID NO: 5005957 - DNA, 18 bp, Homo sapiens
agaggataattagcatct

SEQ ID NO: 5005958 - DNA, 18 bp, Homo sapiens
agaggatgctgtgaaatt

SEQ ID NO: 5005959 - DNA, 20 bp, Homo sapiens
agagttgtgacaacttcctg

SEQ ID NO: 5005960 - DNA, 15 bp, Homo sapiens
agatatgaaagctga

SEQ ID NO: 5005961 - DNA, 12 bp, Homo sapiens
agatcaaagatg

SEQ ID NO: 5005962 - DNA, 14 bp, Homo sapiens
agatgttctacttt

SEQ ID NO: 5005963 - DNA, 12 bp, Homo sapiens
agcattttcctc

SEQ ID NO: 5005964 - DNA, 14 bp, Homo sapiens
agcattttcctctg

SEQ ID NO: 5005965 - DNA, 17 bp, Homo sapiens
agcattttcctctgctt

SEQ ID NO: 5005966 - DNA, 21 bp, Homo sapiens
agcattttcctctgctttgaa

SEQ ID NO: 5005967 - DNA, 22 bp, Homo sapiens
agcattttcctctgctttgaaa

SEQ ID NO: 5005968 - DNA, 12 bp, Homo sapiens
agccaaatttaa

SEQ ID NO: 5005969 - DNA, 15 bp, Homo sapiens
agccatttttactgt

SEQ ID NO: 5005970 - DNA, 18 bp, Homo sapiens
agctcataagagccacag

SEQ ID NO: 5005971 - DNA, 19 bp, Homo sapiens
agctggggttcatgacaat

SEQ ID NO: 5005972 - DNA, 18 bp, Homo sapiens
agcttcacagtacccaaa

SEQ ID NO: 5005973 - DNA, 21 bp, Homo sapiens
aggaaagcttgagtaaaataa

SEQ ID NO: 5005974 - DNA, 18 bp, Homo sapiens
aggataattagcatctca

SEQ ID NO: 5005975 - DNA, 16 bp, Homo sapiens
aggatccggaaagaag

SEQ ID NO: 5005976 - DNA, 23 bp, Homo sapiens
aggcacctacactcacctgcact

SEQ ID NO: 5005977 - DNA, 18 bp, Homo sapiens
aggcaggtgaattgtttg

SEQ ID NO: 5005978 - DNA, 13 bp, Homo sapiens
aggcattggatat

SEQ ID NO: 5005979 - DNA, 21 bp, Homo sapiens
aggccaaagagtctccagttt

SEQ ID NO: 5005980 - DNA, 15 bp, Homo sapiens
aggctcatttactgt

SEQ ID NO: 5005981 - DNA, 22 bp, Homo sapiens
aggctcctgttttgcacagcca

SEQ ID NO: 5005982 - DNA, 18 bp, Homo sapiens
aggctctgtttatgcttt

SEQ ID NO: 5005983 - DNA, 18 bp, Homo sapiens
agggatctatacttgctt

SEQ ID NO: 5005984 - DNA, 11 bp, Homo sapiens
aggtctagcct

SEQ ID NO: 5005985 - DNA, 21 bp, Homo sapiens
agtatattgataaccttgaaa

SEQ ID NO: 5005986 - DNA, 15 bp, Homo sapiens
agtcatcattccctt

SEQ ID NO: 5005987 - DNA, 23 bp, Homo sapiens
agtgctgtcttaaactaaatgtg

SEQ ID NO: 5005988 - DNA, 24 bp, Homo sapiens
agtggaacgaaaatgaaagctact

SEQ ID NO: 5005989 - DNA, 16 bp, Homo sapiens
agtgtctgtgttttga

SEQ ID NO: 5005990 - DNA, 22 bp, Homo sapiens
agtgtctgtgttttgaaagaat

SEQ ID NO: 5005991 - DNA, 20 bp, Homo sapiens
agtgtggagtcattctcatt

SEQ ID NO: 5005992 - DNA, 19 bp, Homo sapiens
agttgaacctatttctctt

SEQ ID NO: 5005993 - DNA, 15 bp, Homo sapiens
agttgcactcaggtg

SEQ ID NO: 5005994 - DNA, 15 bp, Homo sapiens
agtttcaaccatgaa

SEQ ID NO: 5005995 - DNA, 17 bp, Homo sapiens
ataaaatctgatatgta

SEQ ID NO: 5005996 - DNA, 19 bp, Homo sapiens
ataattctgggaagcaaaa

SEQ ID NO: 5005997 - DNA, 19 bp, Homo sapiens
atactgtatattcaggact

SEQ ID NO: 5005998 - DNA, 18 bp, Homo sapiens
atacttatttgtatatgg

SEQ ID NO: 5005999 - DNA, 17 bp, Homo sapiens
atagcttttgtgtctta

SEQ ID NO: 5006000 - DNA, 19 bp, Homo sapiens
atagtgtagctgaggaggc

SEQ ID NO: 5006001 - DNA, 14 bp, Homo sapiens
atattgtctttttg

SEQ ID NO: 5006002 - DNA, 14 bp, Homo sapiens
atatttgtgcattt

SEQ ID NO: 5006003 - DNA, 15 bp, Homo sapiens
atcacaaagtggaac

SEQ ID NO: 5006004 - DNA, 15 bp, Homo sapiens
atcagtggatttccc

SEQ ID NO: 5006005 - DNA, 22 bp, Homo sapiens
atcattcccttcgacagcattt

SEQ ID NO: 5006006 - DNA, 15 bp, Homo sapiens
atccctgaggactga

SEQ ID NO: 5006007 - DNA, 22 bp, Homo sapiens
atccctgaggactgatttcaga

SEQ ID NO: 5006008 - DNA, 16 bp, Homo sapiens
atccgtatatatcccc

SEQ ID NO: 5006009 - DNA, 21 bp, Homo sapiens
atcctattgaaccatgtttgt

SEQ ID NO: 5006010 - DNA, 18 bp, Homo sapiens
atcctcttcttttagcag

SEQ ID NO: 5006011 - DNA, 19 bp, Homo sapiens
gctattaaaactcttttaa

SEQ ID NO: 5006012 - DNA, 17 bp, Homo sapiens
gctatttgcaattcctg

SEQ ID NO: 5006013 - DNA, 16 bp, Homo sapiens
gctcaatccctgagga

SEQ ID NO: 5006014 - DNA, 20 bp, Homo sapiens
gctcaatccctgaggactga

SEQ ID NO: 5006015 - DNA, 12 bp, Homo sapiens
gctcatttactg

SEQ ID NO: 5006016 - DNA, 18 bp, Homo sapiens
gctgtgtgaatacctgct

SEQ ID NO: 5006017 - DNA, 21 bp, Homo sapiens
gctttgaaagccccagaaatc

SEQ ID NO: 5006018 - DNA, 13 bp, Homo sapiens
ggaaatcttaaac

SEQ ID NO: 5006019 - DNA, 19 bp, Homo sapiens
ggaatggatttttctttaa

SEQ ID NO: 5006020 - DNA, 20 bp, Homo sapiens
ggaatggatttttctttaac

SEQ ID NO: 5006021 - DNA, 19 bp, Homo sapiens
ggaggtggaggttgcagtg

SEQ ID NO: 5006022 - DNA, 16 bp, Homo sapiens
ggaggtgtctgtatca

SEQ ID NO: 5006023 - DNA, 16 bp, Homo sapiens
ggatttaaaagcctgc

SEQ ID NO: 5006024 - DNA, 19 bp, Homo sapiens
ggatttaaaagcctgctca

SEQ ID NO: 5006025 - DNA, 23 bp, Homo sapiens
ggcactgaagggatatgtgaaac

SEQ ID NO: 5006026 - DNA, 13 bp, Homo sapiens
ggctaatttaaca

SEQ ID NO: 5006027 - DNA, 14 bp, Homo sapiens
ggggctaatttaac

SEQ ID NO: 5006028 - DNA, 20 bp, Homo sapiens
gggtccaggattcctctttt

SEQ ID NO: 5006029 - DNA, 23 bp, Homo sapiens
ggtattgactcaacagtttccag

SEQ ID NO: 5006030 - DNA, 19 bp, Homo sapiens
ggtccaggattcctctttt

SEQ ID NO: 5006031 - DNA, 15 bp, Homo sapiens
ggtggagttaatctt

SEQ ID NO: 5006032 - DNA, 23 bp, Homo sapiens
ggttcaacaaagaaacaaagatg

SEQ ID NO: 5006033 - DNA, 18 bp, Homo sapiens
ggtttactcactgctgca

SEQ ID NO: 5006034 - DNA, 19 bp, Homo sapiens
gtaaggatccggaaagaag

SEQ ID NO: 5006035 - DNA, 15 bp, Homo sapiens
gtaattcttattctt

SEQ ID NO: 5006036 - DNA, 21 bp, Homo sapiens
gtaattgtgtggattctttaa

SEQ ID NO: 5006037 - DNA, 23 bp, Homo sapiens
gtattgtttgggatcctattgaa

SEQ ID NO: 5006038 - DNA, 23 bp, Homo sapiens
gtcacaaagaacatgtagaaaac

SEQ ID NO: 5006039 - DNA, 20 bp, Homo sapiens
gtcatttttcagacctttta

SEQ ID NO: 5006040 - DNA, 17 bp, Homo sapiens
gtccaggattcctcttt

SEQ ID NO: 5006041 - DNA, 12 bp, Homo sapiens
gtctatttgaga

SEQ ID NO: 5006042 - DNA, 15 bp, Homo sapiens
gtctgtatcagtgga

SEQ ID NO: 5006043 - DNA, 22 bp, Homo sapiens
gtctgtatcagtggatttccca

SEQ ID NO: 5006044 - DNA, 22 bp, Homo sapiens
gtcttaaactaaatgtgcaata

SEQ ID NO: 5006045 - DNA, 23 bp, Homo sapiens
gtgaaattcccaacaaacattga

SEQ ID NO: 5006046 - DNA, 15 bp, Homo sapiens
gtgaatacctgctca

SEQ ID NO: 5006047 - DNA, 17 bp, Homo sapiens
gtgaattgtttgaacct

SEQ ID NO: 5006048 - DNA, 14 bp, Homo sapiens
gtggatattgttac

SEQ ID NO: 5006049 - DNA, 16 bp, Homo sapiens
gtggatatttgtataa

SEQ ID NO: 5006050 - DNA, 20 bp, Homo sapiens
gtggctattaaaactctttt

SEQ ID NO: 5006051 - DNA, 13 bp, Homo sapiens
gtggttgtgatcc

SEQ ID NO: 5006052 - DNA, 19 bp, Homo sapiens
gttcaatatgagtctcaat

SEQ ID NO: 5006053 - DNA, 12 bp, Homo sapiens
gttcatgacaat

SEQ ID NO: 5006054 - DNA, 15 bp, Homo sapiens
gttggaatggatttt

SEQ ID NO: 5006055 - DNA, 18 bp, Homo sapiens
gttggggaagggcctgcc

SEQ ID NO: 5006056 - DNA, 20 bp, Homo sapiens
gtttagatttatggttgtta

SEQ ID NO: 5006057 - DNA, 18 bp, Homo sapiens
gtttcaacggaaagtgct

SEQ ID NO: 5006058 - DNA, 22 bp, Homo sapiens
gtttgtagtgccactgttgttt

SEQ ID NO: 5006059 - DNA, 15 bp, Homo sapiens
gttttaactgtggat

SEQ ID NO: 5006060 - DNA, 23 bp, Homo sapiens
gttttaggtctagcctatgtgga

SEQ ID NO: 5006061 - DNA, 18 bp, Homo sapiens
gttttcctgtataggaat

SEQ ID NO: 5006062 - DNA, 15 bp, Homo sapiens
gttttgcacagccaa

SEQ ID NO: 5006063 - DNA, 15 bp, Homo sapiens
taaaaaaaagatgaa

SEQ ID NO: 5006064 - DNA, 21 bp, Homo sapiens
taaaacaggttataacagtgt

SEQ ID NO: 5006065 - DNA, 15 bp, Homo sapiens
taaaactacaaaaat

SEQ ID NO: 5006066 - DNA, 13 bp, Homo sapiens
taaaattatttca

SEQ ID NO: 5006067 - DNA, 14 bp, Homo sapiens
taaagttattcttg

SEQ ID NO: 5006068 - DNA, 20 bp, Homo sapiens
taaatattgtctttttgtat

SEQ ID NO: 5006069 - DNA, 23 bp, Homo sapiens
taaatattgtctttttgtatgtc

SEQ ID NO: 5006070 - DNA, 19 bp, Homo sapiens
taacaagaactttaaattg

SEQ ID NO: 5006071 - DNA, 16 bp, Homo sapiens
taacaatgtattttct

SEQ ID NO: 5006072 - DNA, 21 bp, Homo sapiens
taacattcaggaattcttgga

SEQ ID NO: 5006073 - DNA, 16 bp, Homo sapiens
taacctcgggcctgct

SEQ ID NO: 5006074 - DNA, 23 bp, Homo sapiens
taactgtaaagatgtttatttca

SEQ ID NO: 5006075 - DNA, 18 bp, Homo sapiens
taagcagtgtctgtgttt

SEQ ID NO: 5006076 - DNA, 13 bp, Homo sapiens
taatgtcaaactt

SEQ ID NO: 5006077 - DNA, 22 bp, Homo sapiens
taatgtttctggatttcatact

SEQ ID NO: 5006078 - DNA, 19 bp, Homo sapiens
taattcctttccaggtatt

SEQ ID NO: 5006079 - DNA, 12 bp, Homo sapiens
taattctgggaa

SEQ ID NO: 5006080 - DNA, 18 bp, Homo sapiens
tacaatgatgctatttgc

SEQ ID NO: 5006081 - DNA, 15 bp, Homo sapiens
tacagttttaactgt

SEQ ID NO: 5006082 - DNA, 17 bp, Homo sapiens
tacagttttaactgtgg

SEQ ID NO: 5006083 - DNA, 20 bp, Homo sapiens
tacagttttaactgtggata

SEQ ID NO: 5006084 - DNA, 22 bp, Homo sapiens
taccaatcatattaatacaatg

SEQ ID NO: 5006085 - DNA, 15 bp, Homo sapiens
tacccaaactgcttt

SEQ ID NO: 5006086 - DNA, 12 bp, Homo sapiens
tacctgtggata

SEQ ID NO: 5006087 - DNA, 22 bp, Homo sapiens
tacgaacctacagttttaactg

SEQ ID NO: 5006088 - DNA, 16 bp, Homo sapiens
tactgtaacattcagg

SEQ ID NO: 5006089 - DNA, 15 bp, Homo sapiens
tactgtatattcagg

SEQ ID NO: 5006090 - DNA, 23 bp, Homo sapiens
tactgtgtctttggtttgtgcta

SEQ ID NO: 5006091 - DNA, 20 bp, Homo sapiens
tacttctgtaattgtgtgga

SEQ ID NO: 5006092 - DNA, 20 bp, Homo sapiens
tactttgacagtgtttttag

SEQ ID NO: 5006093 - DNA, 22 bp, Homo sapiens
tactttgttctgctgttctcta

SEQ ID NO: 5006094 - DNA, 23 bp, Homo sapiens
tagaaagaatatttggttttcct

SEQ ID NO: 5006095 - DNA, 11 bp, Homo sapiens
tagatttatgg

SEQ ID NO: 5006096 - DNA, 16 bp, Homo sapiens
tagccatttttactgt

SEQ ID NO: 5006097 - DNA, 21 bp, Homo sapiens
tagcctaaggctcctgttttg

SEQ ID NO: 5006098 - DNA, 16 bp, Homo sapiens
taggaacttgagaact

SEQ ID NO: 5006099 - DNA, 20 bp, Homo sapiens
taggctcatttactgtttta

SEQ ID NO: 5006100 - DNA, 15 bp, Homo sapiens
tagttgtgtttcaac

SEQ ID NO: 5006101 - DNA, 22 bp, Homo sapiens
tatattcaggacttgaaagaaa

SEQ ID NO: 5006102 - DNA, 21 bp, Homo sapiens
tatggtatttattttttcttt

SEQ ID NO: 5006103 - DNA, 15 bp, Homo sapiens
tattaaaactctttt

SEQ ID NO: 5006104 - DNA, 16 bp, Homo sapiens
tatttctctttcttta

SEQ ID NO: 5006105 - DNA, 22 bp, Homo sapiens
tatttgtataaaagtgtgaaat

SEQ ID NO: 5006106 - DNA, 21 bp, Homo sapiens
tcaaactaggggacaaagcaa

SEQ ID NO: 5006107 - DNA, 21 bp, Homo sapiens
tcaacaaagaaacaaagatgt

SEQ ID NO: 5006108 - DNA, 21 bp, Homo sapiens
tcaacggaaagtgctgtctta

SEQ ID NO: 5006109 - DNA, 12 bp, Homo sapiens
tcaataaactga

SEQ ID NO: 5006110 - DNA, 17 bp, Homo sapiens
tcacaaagtggaacgaa

SEQ ID NO: 5006111 - DNA, 22 bp, Homo sapiens
tcagaattagagcatgggaggt

SEQ ID NO: 5006112 - DNA, 18 bp, Homo sapiens
tcagaccttttaactcct

SEQ ID NO: 5006113 - DNA, 20 bp, Homo sapiens
tcagagtgactacacacagt

SEQ ID NO: 5006114 - DNA, 17 bp, Homo sapiens
tcaggacttgaaagaaa

SEQ ID NO: 5006115 - DNA, 20 bp, Homo sapiens
tcaggcattggatatttttt

SEQ ID NO: 5006116 - DNA, 15 bp, Homo sapiens
tcagtggatttccca

SEQ ID NO: 5006117 - DNA, 14 bp, Homo sapiens
tccaccagtcattt

SEQ ID NO: 5006118 - DNA, 18 bp, Homo sapiens
tccaccagtcatttttca

SEQ ID NO: 5006119 - DNA, 15 bp, Homo sapiens
tccaggattcctctt

SEQ ID NO: 5006120 - DNA, 22 bp, Homo sapiens
tccaggattcctcttttctctg

SEQ ID NO: 5006121 - DNA, 19 bp, Homo sapiens
tccatcacgttagctgtcc

SEQ ID NO: 5006122 - DNA, 12 bp, Homo sapiens
tcccagcaattt

SEQ ID NO: 5006123 - DNA, 15 bp, Homo sapiens
tcccatcccctgtgg

SEQ ID NO: 5006124 - DNA, 16 bp, Homo sapiens
tcccattctccatttg

SEQ ID NO: 5006125 - DNA, 16 bp, Homo sapiens
tccccctagccatttt

SEQ ID NO: 5006126 - DNA, 23 bp, Homo sapiens
tccccgataccatgctgtaagga

SEQ ID NO: 5006127 - DNA, 15 bp, Homo sapiens
tccctgaggactgat

SEQ ID NO: 5006128 - DNA, 17 bp, Homo sapiens
tcccttcgacagcattt

SEQ ID NO: 5006129 - DNA, 17 bp, Homo sapiens
tcctagctgtgtgaata

SEQ ID NO: 5006130 - DNA, 14 bp, Homo sapiens
tcctatttagatgg

SEQ ID NO: 5006131 - DNA, 15 bp, Homo sapiens
tcctcttttctctgc

SEQ ID NO: 5006132 - DNA, 18 bp, Homo sapiens
tttaactcctcaattcca

SEQ ID NO: 5006133 - DNA, 15 bp, Homo sapiens
tttaactgtggatat

SEQ ID NO: 5006134 - DNA, 21 bp, Homo sapiens
tttaatctccaccagtcattt

SEQ ID NO: 5006135 - DNA, 15 bp, Homo sapiens
tttcaacggaaagtg

SEQ ID NO: 5006136 - DNA, 23 bp, Homo sapiens
tttcaacggaaagtgctgtctta

SEQ ID NO: 5006137 - DNA, 16 bp, Homo sapiens
tttcatgattagaaat

SEQ ID NO: 5006138 - DNA, 14 bp, Homo sapiens
tttcccttcatctg

SEQ ID NO: 5006139 - DNA, 15 bp, Homo sapiens
tttctaaacagagat

SEQ ID NO: 5006140 - DNA, 16 bp, Homo sapiens
tttctaaacagagatg

SEQ ID NO: 5006141 - DNA, 12 bp, Homo sapiens
tttctctttctt

SEQ ID NO: 5006142 - DNA, 14 bp, Homo sapiens
tttctctttcttta

SEQ ID NO: 5006143 - DNA, 20 bp, Homo sapiens
tttgaaagccccagaaatca

SEQ ID NO: 5006144 - DNA, 20 bp, Homo sapiens
tttgtataaaagtgtgaaat

SEQ ID NO: 5006145 - DNA, 20 bp, Homo sapiens
ttttgactttcattggaaat

SEQ ID NO: 5006146 - DNA, 17 bp, Homo sapiens
ttttgcacagccaaatt

SEQ ID NO: 5006147 - DNA, 22 bp, Homo sapiens
aaaagaaaatctttataaatgt

SEQ ID NO: 5006148 - DNA, 22 bp, Homo sapiens
aaaagccagcaggcttcaaact

SEQ ID NO: 5006149 - DNA, 11 bp, Homo sapiens
aaaagcctgct

SEQ ID NO: 5006150 - DNA, 23 bp, Homo sapiens
aaaataaatattgtctttttgta

SEQ ID NO: 5006151 - DNA, 21 bp, Homo sapiens
aaaatggcagggggtggaatt

SEQ ID NO: 5006152 - DNA, 22 bp, Homo sapiens
aaacaatgttaacatttttggt

SEQ ID NO: 5006153 - DNA, 20 bp, Homo sapiens
aaacatttaccaatcatatt

SEQ ID NO: 5006154 - DNA, 14 bp, Homo sapiens
aaactaaaaataat

SEQ ID NO: 5006155 - DNA, 20 bp, Homo sapiens
aaactaggggacaaagcaaa

SEQ ID NO: 5006156 - DNA, 16 bp, Homo sapiens
aaagcaaaaagtgatg

SEQ ID NO: 5006157 - DNA, 14 bp, Homo sapiens
aaagctgatttttt

SEQ ID NO: 5006158 - DNA, 17 bp, Homo sapiens
aaatattgtctttttgt

SEQ ID NO: 5006159 - DNA, 20 bp, Homo sapiens
aaatattgtctttttgtatg

SEQ ID NO: 5006160 - DNA, 14 bp, Homo sapiens
aaatgaaagctact

SEQ ID NO: 5006161 - DNA, 21 bp, Homo sapiens
aaatgctaatgtcaaacttga

SEQ ID NO: 5006162 - DNA, 16 bp, Homo sapiens
aacaatgtattttctt

SEQ ID NO: 5006163 - DNA, 21 bp, Homo sapiens
aacacacaggtgcaacagact

SEQ ID NO: 5006164 - DNA, 14 bp, Homo sapiens
aacactgatttccc

SEQ ID NO: 5006165 - DNA, 19 bp, Homo sapiens
aacagagactgaatagata

SEQ ID NO: 5006166 - DNA, 19 bp, Homo sapiens
aacaggttataacagtgtt

SEQ ID NO: 5006167 - DNA, 13 bp, Homo sapiens
aacagtgtttaaa

SEQ ID NO: 5006168 - DNA, 20 bp, Homo sapiens
aacctacagttttaactgtg

SEQ ID NO: 5006169 - DNA, 16 bp, Homo sapiens
aacctcgggcctgctg

SEQ ID NO: 5006170 - DNA, 13 bp, Homo sapiens
aaccttaagatac

SEQ ID NO: 5006171 - DNA, 16 bp, Homo sapiens
aactactgcaccattt

SEQ ID NO: 5006172 - DNA, 20 bp, Homo sapiens
aactactgcaccatttaaaa

SEQ ID NO: 5006173 - DNA, 13 bp, Homo sapiens
aactcttttaaca

SEQ ID NO: 5006174 - DNA, 16 bp, Homo sapiens
aactgccgtaatttaa

SEQ ID NO: 5006175 - DNA, 13 bp, Homo sapiens
aactttatttcca

SEQ ID NO: 5006176 - DNA, 15 bp, Homo sapiens
aagaaaatctttata

SEQ ID NO: 5006177 - DNA, 21 bp, Homo sapiens
cagtcatttttcagacctttt

SEQ ID NO: 5006178 - DNA, 16 bp, Homo sapiens
cagtctatttgagact

SEQ ID NO: 5006179 - DNA, 24 bp, Homo sapiens
cagtgttggccatgatgacaacta

SEQ ID NO: 5006180 - DNA, 21 bp, Homo sapiens
cagtgtttttagacctgtgtt

SEQ ID NO: 5006181 - DNA, 15 bp, Homo sapiens
cagttaagtttttcc

SEQ ID NO: 5006182 - DNA, 19 bp, Homo sapiens
cagttcttgccactttttt

SEQ ID NO: 5006183 - DNA, 15 bp, Homo sapiens
cagttttaactgtgg

SEQ ID NO: 5006184 - DNA, 18 bp, Homo sapiens
cagttttaactgtggata

SEQ ID NO: 5006185 - DNA, 20 bp, Homo sapiens
cagttttaactgtggatatt

SEQ ID NO: 5006186 - DNA, 21 bp, Homo sapiens
cataatgtttctggatttcat

SEQ ID NO: 5006187 - DNA, 22 bp, Homo sapiens
cataatgtttctggatttcata

SEQ ID NO: 5006188 - DNA, 17 bp, Homo sapiens
catactgtaacattcag

SEQ ID NO: 5006189 - DNA, 18 bp, Homo sapiens
catagcgggggcctaaaa

SEQ ID NO: 5006190 - DNA, 17 bp, Homo sapiens
catatccgtatatatcc

SEQ ID NO: 5006191 - DNA, 14 bp, Homo sapiens
catattttgtaact

SEQ ID NO: 5006192 - DNA, 15 bp, Homo sapiens
catcccctgtgggaa

SEQ ID NO: 5006193 - DNA, 22 bp, Homo sapiens
catctcaggttaagtgtgagta

SEQ ID NO: 5006194 - DNA, 18 bp, Homo sapiens
catgaagaggatgctgtg

SEQ ID NO: 5006195 - DNA, 21 bp, Homo sapiens
catgcctccccctagccattt

SEQ ID NO: 5006196 - DNA, 16 bp, Homo sapiens
catgcttcacaatgtt

SEQ ID NO: 5006197 - DNA, 20 bp, Homo sapiens
catggtattgactcaacagt

SEQ ID NO: 5006198 - DNA, 13 bp, Homo sapiens
cattcaggaattc

SEQ ID NO: 5006199 - DNA, 13 bp, Homo sapiens
cattctcattgaa

SEQ ID NO: 5006200 - DNA, 12 bp, Homo sapiens
cattggaaatta

SEQ ID NO: 5006201 - DNA, 11 bp, Homo sapiens
cattggatatt

SEQ ID NO: 5006202 - DNA, 15 bp, Homo sapiens
catttctctcctcac

SEQ ID NO: 5006203 - DNA, 17 bp, Homo sapiens
cattttcctctgctttg

SEQ ID NO: 5006204 - DNA, 12 bp, Homo sapiens
catttttactgt

SEQ ID NO: 5006205 - DNA, 21 bp, Homo sapiens
catttttcagaccttttaact

SEQ ID NO: 5006206 - DNA, 19 bp, Homo sapiens
ccaaaaggtttaagaaata

SEQ ID NO: 5006207 - DNA, 18 bp, Homo sapiens
ccagaggcagcttctttg

SEQ ID NO: 5006208 - DNA, 17 bp, Homo sapiens
ccagatagtgtagctga

SEQ ID NO: 5006209 - DNA, 17 bp, Homo sapiens
ccatatcaagagacatg

SEQ ID NO: 5006210 - DNA, 21 bp, Homo sapiens
ccatgaagaggatgctgtgaa

SEQ ID NO: 5006211 - DNA, 21 bp, Homo sapiens
ccatgtttgtggctattaaaa

SEQ ID NO: 5006212 - DNA, 11 bp, Homo sapiens
ccatttctctc

SEQ ID NO: 5006213 - DNA, 14 bp, Homo sapiens
ccatttgttatctg

SEQ ID NO: 5006214 - DNA, 19 bp, Homo sapiens
cccatcctcttcttttagc

SEQ ID NO: 5006215 - DNA, 14 bp, Homo sapiens
ccctatctgtattc

SEQ ID NO: 5006216 - DNA, 17 bp, Homo sapiens
cccttttgcattctccc

SEQ ID NO: 5006217 - DNA, 13 bp, Homo sapiens
ccgtaatttaact

SEQ ID NO: 5006218 - DNA, 22 bp, Homo sapiens
ccgtagtagatgttctactttg

SEQ ID NO: 5006219 - DNA, 22 bp, Homo sapiens
cctagctgtgtgaatacctgct

SEQ ID NO: 5006220 - DNA, 13 bp, Homo sapiens
cctatttctcttt

SEQ ID NO: 5006221 - DNA, 15 bp, Homo sapiens
cctatttctctttct

SEQ ID NO: 5006222 - DNA, 14 bp, Homo sapiens
cctcttttctctgc

SEQ ID NO: 5006223 - DNA, 23 bp, Homo sapiens
cctgaggactgatttcagagtga

SEQ ID NO: 5006224 - DNA, 22 bp, Homo sapiens
cctgagggatctatacttgctt

SEQ ID NO: 5006225 - DNA, 16 bp, Homo sapiens
cctgcccagttgcact

SEQ ID NO: 5006226 - DNA, 22 bp, Homo sapiens
cctgcccagttgcactcaggtg

SEQ ID NO: 5006227 - DNA, 18 bp, Homo sapiens
ccttccttgtagcctttt

SEQ ID NO: 5006228 - DNA, 16 bp, Homo sapiens
cgacagcattttcctc

SEQ ID NO: 5006229 - DNA, 12 bp, Homo sapiens
cgtaatttaact

SEQ ID NO: 5006230 - DNA, 14 bp, Homo sapiens
ctaaaaaaaagatg

SEQ ID NO: 5006231 - DNA, 15 bp, Homo sapiens
ctaaaaaaaagatga

SEQ ID NO: 5006232 - DNA, 11 bp, Homo sapiens
ctaaaaataat

SEQ ID NO: 5006233 - DNA, 18 bp, Homo sapiens
ctaaatgtgcaatagaag

SEQ ID NO: 5006234 - DNA, 17 bp, Homo sapiens
ctaattcttgcatattt

SEQ ID NO: 5006235 - DNA, 17 bp, Homo sapiens
ctacaggtttgggtaca

SEQ ID NO: 5006236 - DNA, 13 bp, Homo sapiens
ctactaaaactac

SEQ ID NO: 5006237 - DNA, 16 bp, Homo sapiens
ctagcctatgtggatt

SEQ ID NO: 5006238 - DNA, 20 bp, Homo sapiens
ctaggtacgatgacagtgtt

SEQ ID NO: 5006239 - DNA, 21 bp, Homo sapiens
ctatttgcaattcctgctcct

SEQ ID NO: 5006240 - DNA, 14 bp, Homo sapiens
ctcaacagtttcca

SEQ ID NO: 5006241 - DNA, 15 bp, Homo sapiens
ctcaagtagcattta

SEQ ID NO: 5006242 - DNA, 18 bp, Homo sapiens
ctcaagtagcatttactg

SEQ ID NO: 5006243 - DNA, 15 bp, Homo sapiens
ctcaatccctgagga

SEQ ID NO: 5006244 - DNA, 14 bp, Homo sapiens
ctcacgtcaaatgc

SEQ ID NO: 5006245 - DNA, 15 bp, Homo sapiens
ctcagtttcttgctt

SEQ ID NO: 5006246 - DNA, 17 bp, Homo sapiens
ctcattgaattataaaa

SEQ ID NO: 5006247 - DNA, 16 bp, Homo sapiens
ctccaccagtcatttt

SEQ ID NO: 5006248 - DNA, 14 bp, Homo sapiens
ctccttcccttcct

SEQ ID NO: 5006249 - DNA, 15 bp, Homo sapiens
ctctaaaattataaa

SEQ ID NO: 5006250 - DNA, 22 bp, Homo sapiens
ctctccttcatgacagcctcca

SEQ ID NO: 5006251 - DNA, 22 bp, Homo sapiens
ctctctactaaaactacaaaaa

SEQ ID NO: 5006252 - DNA, 23 bp, Homo sapiens
ctctctactaaaactacaaaaat

SEQ ID NO: 5006253 - DNA, 13 bp, Homo sapiens
ctctgtttatgct

SEQ ID NO: 5006254 - DNA, 12 bp, Homo sapiens
ctcttttctctg

SEQ ID NO: 5006255 - DNA, 19 bp, Homo sapiens
ctgaagggatatgtgaaac

SEQ ID NO: 5006256 - DNA, 18 bp, Homo sapiens
ctgatttccccttttgca

SEQ ID NO: 5006257 - DNA, 19 bp, Homo sapiens
ctgcaaatactgtatattc

SEQ ID NO: 5006258 - DNA, 22 bp, Homo sapiens
ctgcataatgtttctggatttc

SEQ ID NO: 5006259 - DNA, 20 bp, Homo sapiens
ctgctactcaagtagcattt

SEQ ID NO: 5006260 - DNA, 22 bp, Homo sapiens
ctgctttttccaactcagaaat

SEQ ID NO: 5006261 - DNA, 15 bp, Homo sapiens
ctgtaaaacaggtta

SEQ ID NO: 5006262 - DNA, 21 bp, Homo sapiens
ctgtaaagatgtttatttcag

SEQ ID NO: 5006263 - DNA, 15 bp, Homo sapiens
ctgtaacattcagga

SEQ ID NO: 5006264 - DNA, 21 bp, Homo sapiens
ctgtaaggatccggaaagaag

SEQ ID NO: 5006265 - DNA, 20 bp, Homo sapiens
ctgtatcagtggatttccca

SEQ ID NO: 5006266 - DNA, 14 bp, Homo sapiens
ctgtctaaaaaaca

SEQ ID NO: 5006267 - DNA, 19 bp, Homo sapiens
ctgtcttaaactaaatgtg

SEQ ID NO: 5006268 - DNA, 21 bp, Homo sapiens
ctgtcttaaactaaatgtgca

SEQ ID NO: 5006269 - DNA, 22 bp, Homo sapiens
ctgtgaaattcccaacaaacat

SEQ ID NO: 5006270 - DNA, 20 bp, Homo sapiens
ctgtgtctttggtttgtgct

SEQ ID NO: 5006271 - DNA, 23 bp, Homo sapiens
ctgtgttactaaaaaaaagatga

SEQ ID NO: 5006272 - DNA, 18 bp, Homo sapiens
ctgtgttttgaaagaata

SEQ ID NO: 5006273 - DNA, 22 bp, Homo sapiens
ctgtgttttgaaagaatagaac

SEQ ID NO: 5006274 - DNA, 18 bp, Homo sapiens
ctgtttgcatttgataca

SEQ ID NO: 5006275 - DNA, 22 bp, Homo sapiens
ctgtttgcatttgatacatttt

SEQ ID NO: 5006276 - DNA, 14 bp, Homo sapiens
cttaaactaaatgt

SEQ ID NO: 5006277 - DNA, 15 bp, Homo sapiens
cttaaactaaatgtg

SEQ ID NO: 5006278 - DNA, 19 bp, Homo sapiens
cttaatattctggagtcat

SEQ ID NO: 5006279 - DNA, 19 bp, Homo sapiens
cttatcaagagttgtgaca

SEQ ID NO: 5006280 - DNA, 16 bp, Homo sapiens
cttatttgtatatggt

SEQ ID NO: 5006281 - DNA, 18 bp, Homo sapiens
cttcaggttggtttaatc

SEQ ID NO: 5006282 - DNA, 14 bp, Homo sapiens
cttccatgtgaggg

SEQ ID NO: 5006283 - DNA, 14 bp, Homo sapiens
cttcccattctcca

SEQ ID NO: 5006284 - DNA, 21 bp, Homo sapiens
cttcgacagcattttcctctg

SEQ ID NO: 5006285 - DNA, 15 bp, Homo sapiens
cttctgtaattgtgt

SEQ ID NO: 5006286 - DNA, 11 bp, Homo sapiens
cttgaagtcag

SEQ ID NO: 5006287 - DNA, 17 bp, Homo sapiens
cttgagaagattcttcc

SEQ ID NO: 5006288 - DNA, 12 bp, Homo sapiens
cttgagtaaaat

SEQ ID NO: 5006289 - DNA, 13 bp, Homo sapiens
cttgagtaaaata

SEQ ID NO: 5006290 - DNA, 14 bp, Homo sapiens
cttgagtaaaataa

SEQ ID NO: 5006291 - DNA, 18 bp, Homo sapiens
cttgcttggggaacttgt

SEQ ID NO: 5006292 - DNA, 19 bp, Homo sapiens
cttgctttgtgttctttgt

SEQ ID NO: 5006293 - DNA, 15 bp, Homo sapiens
cttggaggtgtctgt

SEQ ID NO: 5006294 - DNA, 16 bp, Homo sapiens
cttgtagccttttgac

SEQ ID NO: 5006295 - DNA, 21 bp, Homo sapiens
ctttaactgccgtaatttaac

SEQ ID NO: 5006296 - DNA, 23 bp, Homo sapiens
ctttaactgccgtaatttaactt

SEQ ID NO: 5006297 - DNA, 12 bp, Homo sapiens
ctttatttccaa

SEQ ID NO: 5006298 - DNA, 17 bp, Homo sapiens
ctttcaaagccatttta

SEQ ID NO: 5006299 - DNA, 16 bp, Homo sapiens
gccactgttgttttgg

SEQ ID NO: 5006300 - DNA, 14 bp, Homo sapiens
gccatttttactgt

SEQ ID NO: 5006301 - DNA, 13 bp, Homo sapiens
gccgtaatttaac

SEQ ID NO: 5006302 - DNA, 14 bp, Homo sapiens
gccgtaatttaact

SEQ ID NO: 5006303 - DNA, 22 bp, Homo sapiens
gccgtagtagatgttctacttt

SEQ ID NO: 5006304 - DNA, 19 bp, Homo sapiens
gctctaggtacgatgacag

SEQ ID NO: 5006305 - DNA, 23 bp, Homo sapiens
gctgtaaggatccggaaagaaga

SEQ ID NO: 5006306 - DNA, 19 bp, Homo sapiens
ggaaagtgctgtcttaaac

SEQ ID NO: 5006307 - DNA, 20 bp, Homo sapiens
ggaacttattaaatggaaac

SEQ ID NO: 5006308 - DNA, 20 bp, Homo sapiens
ggaatgagattaattccttt

SEQ ID NO: 5006309 - DNA, 19 bp, Homo sapiens
ggataattagcatctcagg

SEQ ID NO: 5006310 - DNA, 13 bp, Homo sapiens
ggattcctctttt

SEQ ID NO: 5006311 - DNA, 18 bp, Homo sapiens
ggattcctcttttctctg

SEQ ID NO: 5006312 - DNA, 12 bp, Homo sapiens
ggattctttaaa

SEQ ID NO: 5006313 - DNA, 18 bp, Homo sapiens
ggatttaaaagcctgctc

SEQ ID NO: 5006314 - DNA, 21 bp, Homo sapiens
ggcacctacactcacctgcac

SEQ ID NO: 5006315 - DNA, 16 bp, Homo sapiens
ggccaaagagtctcca

SEQ ID NO: 5006316 - DNA, 12 bp, Homo sapiens
ggctaatttaac

SEQ ID NO: 5006317 - DNA, 15 bp, Homo sapiens
ggcttctctgaggaa

SEQ ID NO: 5006318 - DNA, 14 bp, Homo sapiens
gggcttttttcttt

SEQ ID NO: 5006319 - DNA, 18 bp, Homo sapiens
ggtattcgcttgagaaaa

SEQ ID NO: 5006320 - DNA, 17 bp, Homo sapiens
ggtattgactcaacagt

SEQ ID NO: 5006321 - DNA, 17 bp, Homo sapiens
ggtttaagaaatagaat

SEQ ID NO: 5006322 - DNA, 21 bp, Homo sapiens
gtaaagatgtttatttcaggc

SEQ ID NO: 5006323 - DNA, 18 bp, Homo sapiens
gtaaggatccggaaagaa

SEQ ID NO: 5006324 - DNA, 14 bp, Homo sapiens
gtaatctgagaaac

SEQ ID NO: 5006325 - DNA, 17 bp, Homo sapiens
gtaatctgagaaacaat

SEQ ID NO: 5006326 - DNA, 15 bp, Homo sapiens
gtaattgtgtggatt

SEQ ID NO: 5006327 - DNA, 16 bp, Homo sapiens
gtagatgttctacttt

SEQ ID NO: 5006328 - DNA, 16 bp, Homo sapiens
gtatatggtatttatt

SEQ ID NO: 5006329 - DNA, 21 bp, Homo sapiens
gtattcccaaaaattactttg

SEQ ID NO: 5006330 - DNA, 22 bp, Homo sapiens
gtcctaacctcgggcctgctgc

SEQ ID NO: 5006331 - DNA, 23 bp, Homo sapiens
gtctgtatcagtggatttcccat

SEQ ID NO: 5006332 - DNA, 22 bp, Homo sapiens
gtcttcaaccagggattgtttc

SEQ ID NO: 5006333 - DNA, 14 bp, Homo sapiens
gtgaattgtttgaa

SEQ ID NO: 5006334 - DNA, 13 bp, Homo sapiens
gtggattctttaa

SEQ ID NO: 5006335 - DNA, 14 bp, Homo sapiens
gtggcaacctgctt

SEQ ID NO: 5006336 - DNA, 17 bp, Homo sapiens
gtggctattaaaactct

SEQ ID NO: 5006337 - DNA, 19 bp, Homo sapiens
gtggctattaaaactcttt

SEQ ID NO: 5006338 - DNA, 23 bp, Homo sapiens
gtgtcaggatggtaattcttatt

SEQ ID NO: 5006339 - DNA, 16 bp, Homo sapiens
gtgttttaattgtaaa

SEQ ID NO: 5006340 - DNA, 22 bp, Homo sapiens
gttaagtttttcccttcatctg

SEQ ID NO: 5006341 - DNA, 13 bp, Homo sapiens
gttcaacaaagaa

SEQ ID NO: 5006342 - DNA, 23 bp, Homo sapiens
gttcaacaaagaaacaaagatgt

SEQ ID NO: 5006343 - DNA, 21 bp, Homo sapiens
gttcccatcctcttcttttag

SEQ ID NO: 5006344 - DNA, 12 bp, Homo sapiens
gttctctagaaa

SEQ ID NO: 5006345 - DNA, 14 bp, Homo sapiens
gttctctagaaaga

SEQ ID NO: 5006346 - DNA, 16 bp, Homo sapiens
gttgaacctatttctc

SEQ ID NO: 5006347 - DNA, 14 bp, Homo sapiens
gtttacagtctatt

SEQ ID NO: 5006348 - DNA, 16 bp, Homo sapiens
gtttacagtctatttg

SEQ ID NO: 5006349 - DNA, 15 bp, Homo sapiens
gtttgtggctattaa

SEQ ID NO: 5006350 - DNA, 22 bp, Homo sapiens
gttttaactgtggatattgtta

SEQ ID NO: 5006351 - DNA, 14 bp, Homo sapiens
taaaacacacaggt

SEQ ID NO: 5006352 - DNA, 12 bp, Homo sapiens
taaaagcctgct

SEQ ID NO: 5006353 - DNA, 14 bp, Homo sapiens
taaaagcctgctca

SEQ ID NO: 5006354 - DNA, 14 bp, Homo sapiens
taaaataaatattg

SEQ ID NO: 5006355 - DNA, 15 bp, Homo sapiens
taaaattatttcatg

SEQ ID NO: 5006356 - DNA, 13 bp, Homo sapiens
taaactaaatgtg

SEQ ID NO: 5006357 - DNA, 13 bp, Homo sapiens
taaagttattctt

SEQ ID NO: 5006358 - DNA, 17 bp, Homo sapiens
taaatattgtctttttg

SEQ ID NO: 5006359 - DNA, 22 bp, Homo sapiens
taaatggaaactgaaactactg

SEQ ID NO: 5006360 - DNA, 22 bp, Homo sapiens
taaatgtgcaatagaaggtgat

SEQ ID NO: 5006361 - DNA, 14 bp, Homo sapiens
taacagtgtttaaa

SEQ ID NO: 5006362 - DNA, 15 bp, Homo sapiens
cctggaggagcagag

SEQ ID NO: 5006363 - DNA, 13 bp, Homo sapiens
ccttttgcattct

SEQ ID NO: 5006364 - DNA, 23 bp, Homo sapiens
cgcaccgaaaaactaaaaataat

SEQ ID NO: 5006365 - DNA, 12 bp, Homo sapiens
cggaaagaagag

SEQ ID NO: 5006366 - DNA, 23 bp, Homo sapiens
cgtccatcacgttagctgtccca

SEQ ID NO: 5006367 - DNA, 18 bp, Homo sapiens
cgtcttttcctgtttcct

SEQ ID NO: 5006368 - DNA, 16 bp, Homo sapiens
ctaaaaaacaaaacaa

SEQ ID NO: 5006369 - DNA, 21 bp, Homo sapiens
ctaaatgtgcaatagaaggtg

SEQ ID NO: 5006370 - DNA, 14 bp, Homo sapiens
ctaaattatttact

SEQ ID NO: 5006371 - DNA, 23 bp, Homo sapiens
ctaaattatttactgcaaaaaga

SEQ ID NO: 5006372 - DNA, 19 bp, Homo sapiens
ctaatttgttttggatata

SEQ ID NO: 5006373 - DNA, 15 bp, Homo sapiens
ctacactcacctgca

SEQ ID NO: 5006374 - DNA, 17 bp, Homo sapiens
ctacagttttaactgtg

SEQ ID NO: 5006375 - DNA, 16 bp, Homo sapiens
ctaccgtcttttcctg

SEQ ID NO: 5006376 - DNA, 17 bp, Homo sapiens
ctactcaagtagcattt

SEQ ID NO: 5006377 - DNA, 16 bp, Homo sapiens
ctactcgggaagctga

SEQ ID NO: 5006378 - DNA, 17 bp, Homo sapiens
ctacttctgtaattgtg

SEQ ID NO: 5006379 - DNA, 18 bp, Homo sapiens
ctacttctgtaattgtgt

SEQ ID NO: 5006380 - DNA, 17 bp, Homo sapiens
tgagtcgcgcaccgaaa

SEQ ID NO: 5006381 - DNA, 18 bp, Homo sapiens
tgatctacttctgtaatt

SEQ ID NO: 5006382 - DNA, 20 bp, Homo sapiens
tgatgctatttgcaattcct

SEQ ID NO: 5006383 - DNA, 23 bp, Homo sapiens
tgatttccccttttgcattctcc

SEQ ID NO: 5006384 - DNA, 16 bp, Homo sapiens
tgcaatagaaggtgat

SEQ ID NO: 5006385 - DNA, 18 bp, Homo sapiens
tgcataatgtttctggat

SEQ ID NO: 5006386 - DNA, 24 bp, Homo sapiens
tgcatattttgtaacttccatgtg

SEQ ID NO: 5006387 - DNA, 12 bp, Homo sapiens
tgccactgttgt

SEQ ID NO: 5006388 - DNA, 21 bp, Homo sapiens
tgctaatgtcaaacttgagtc

SEQ ID NO: 5006389 - DNA, 14 bp, Homo sapiens
tgctgtcttaaact

SEQ ID NO: 5006390 - DNA, 23 bp, Homo sapiens
tgctttgaaagccccagaaatca

SEQ ID NO: 5006391 - DNA, 14 bp, Homo sapiens
tgctttttccaact

SEQ ID NO: 5006392 - DNA, 15 bp, Homo sapiens
tggaatggatttttc

SEQ ID NO: 5006393 - DNA, 15 bp, Homo sapiens
tggatcacaaagtgg

SEQ ID NO: 5006394 - DNA, 15 bp, Homo sapiens
tggatttttctttaa

SEQ ID NO: 5006395 - DNA, 22 bp, Homo sapiens
tgggaacttattaaatggaaac

SEQ ID NO: 5006396 - DNA, 20 bp, Homo sapiens
tgggaggtggaggttgcagt

SEQ ID NO: 5006397 - DNA, 15 bp, Homo sapiens
tgggttccattctca

SEQ ID NO: 5006398 - DNA, 16 bp, Homo sapiens
tggtattgactcaaca

SEQ ID NO: 5006399 - DNA, 19 bp, Homo sapiens
tgtaaggatccggaaagaa

SEQ ID NO: 5006400 - DNA, 16 bp, Homo sapiens
tgtaattgtgtggatt

SEQ ID NO: 5006401 - DNA, 15 bp, Homo sapiens
tgtagctgaggaggc

SEQ ID NO: 5006402 - DNA, 18 bp, Homo sapiens
tgtataaaagtgtgaaat

SEQ ID NO: 5006403 - DNA, 17 bp, Homo sapiens
tgtcaacatgaacaaat

SEQ ID NO: 5006404 - DNA, 13 bp, Homo sapiens
tgtctaaaaaaca

SEQ ID NO: 5006405 - DNA, 14 bp, Homo sapiens
tgtctaaaaaacaa

SEQ ID NO: 5006406 - DNA, 18 bp, Homo sapiens
tgtctaaaaaacaaaaca

SEQ ID NO: 5006407 - DNA, 18 bp, Homo sapiens
tgtcttaaactaaatgtg

SEQ ID NO: 5006408 - DNA, 19 bp, Homo sapiens
tgtgagtaatctgagaaac

SEQ ID NO: 5006409 - DNA, 16 bp, Homo sapiens
tgtggagtcattctca

SEQ ID NO: 5006410 - DNA, 20 bp, Homo sapiens
tgttactaaaaaaaagatga

SEQ ID NO: 5006411 - DNA, 20 bp, Homo sapiens
tgttggggaagggcctgccc

SEQ ID NO: 5006412 - DNA, 13 bp, Homo sapiens
ttaaaagcctgct

SEQ ID NO: 5006413 - DNA, 14 bp, Homo sapiens
ttaaactaaatgtg

SEQ ID NO: 5006414 - DNA, 15 bp, Homo sapiens
ttaaattgtgtttta

SEQ ID NO: 5006415 - DNA, 14 bp, Homo sapiens
ttaacaagaacttt

SEQ ID NO: 5006416 - DNA, 12 bp, Homo sapiens
ttaactgtggat

SEQ ID NO: 5006417 - DNA, 15 bp, Homo sapiens
ttaatcttatcaaga

SEQ ID NO: 5006418 - DNA, 12 bp, Homo sapiens
ttactcactgct

SEQ ID NO: 5006419 - DNA, 19 bp, Homo sapiens
ttagaaattacctgtggat

SEQ ID NO: 5006420 - DNA, 14 bp, Homo sapiens
ttagcagtaaaata

SEQ ID NO: 5006421 - DNA, 17 bp, Homo sapiens
ttataactgtaaagatg

SEQ ID NO: 5006422 - DNA, 15 bp, Homo sapiens
ttcatgacagcctcc

SEQ ID NO: 5006423 - DNA, 15 bp, Homo sapiens
ttcatgattagaaat

SEQ ID NO: 5006424 - DNA, 16 bp, Homo sapiens
ttccaacactgatttc

SEQ ID NO: 5006425 - DNA, 22 bp, Homo sapiens
ttccaacactgatttccccttt

SEQ ID NO: 5006426 - DNA, 13 bp, Homo sapiens
ttccccttttgca

SEQ ID NO: 5006427 - DNA, 19 bp, Homo sapiens
ttcccttcgacagcatttt

SEQ ID NO: 5006428 - DNA, 18 bp, Homo sapiens
ttccttgtagccttttga

SEQ ID NO: 5006429 - DNA, 15 bp, Homo sapiens
ttctattttttgttt

SEQ ID NO: 5006430 - DNA, 18 bp, Homo sapiens
ttctctgaggaagctggg

SEQ ID NO: 5006431 - DNA, 22 bp, Homo sapiens
ttctctttctttacaagatggg

SEQ ID NO: 5006432 - DNA, 13 bp, Homo sapiens
ttctgtaattgtg

SEQ ID NO: 5006433 - DNA, 13 bp, Homo sapiens
ttcttcccattct

SEQ ID NO: 5006434 - DNA, 12 bp, Homo sapiens
ttctttaactgc

SEQ ID NO: 5006435 - DNA, 13 bp, Homo sapiens
ttgaacctatttc

SEQ ID NO: 5006436 - DNA, 15 bp, Homo sapiens
ttgaacctatttctc

SEQ ID NO: 5006437 - DNA, 14 bp, Homo sapiens
ttgacagtgttttt

SEQ ID NO: 5006438 - DNA, 18 bp, Homo sapiens
ttgagaactttatttcca

SEQ ID NO: 5006439 - DNA, 18 bp, Homo sapiens
ttgagtaaaataaatatt

SEQ ID NO: 5006440 - DNA, 12 bp, Homo sapiens
ttgcattctccc

SEQ ID NO: 5006441 - DNA, 14 bp, Homo sapiens
ttgccaagaccttt

SEQ ID NO: 5006442 - DNA, 15 bp, Homo sapiens
ttgccaagacctttc

SEQ ID NO: 5006443 - DNA, 22 bp, Homo sapiens
ttgtgtcaacatgaacaaattt

SEQ ID NO: 5006444 - DNA, 16 bp, Homo sapiens
ttgtgtggattcttta

SEQ ID NO: 5006445 - DNA, 13 bp, Homo sapiens
ttgttcaaacatt

SEQ ID NO: 5006446 - DNA, 12 bp, Homo sapiens
ttgtttctgttt

SEQ ID NO: 5006447 - DNA, 22 bp, Homo sapiens
tttaaaactgttggaatggatt

SEQ ID NO: 5006448 - DNA, 13 bp, Homo sapiens
tttaaaagcctgc

SEQ ID NO: 5006449 - DNA, 21 bp, Homo sapiens
tttaactgccgtaatttaact

SEQ ID NO: 5006450 - DNA, 18 bp, Homo sapiens
tttaactgtggatattgt

SEQ ID NO: 5006451 - DNA, 16 bp, Homo sapiens
tttacagtctatttga

SEQ ID NO: 5006452 - DNA, 18 bp, Homo sapiens
tttacagtctatttgaga

SEQ ID NO: 5006453 - DNA, 18 bp, Homo sapiens
tttactttagaagcctgc

SEQ ID NO: 5006454 - DNA, 12 bp, Homo sapiens
tttcagaccttt

SEQ ID NO: 5006455 - DNA, 20 bp, Homo sapiens
tttcagcattgatatttgtg

SEQ ID NO: 5006456 - DNA, 19 bp, Homo sapiens
tttcaggcattggatattt

SEQ ID NO: 5006457 - DNA, 22 bp, Homo sapiens
tttcattggaaattaggatgta

SEQ ID NO: 5006458 - DNA, 13 bp, Homo sapiens
tttcctctgcttt

SEQ ID NO: 5006459 - DNA, 16 bp, Homo sapiens
tttcgtaacacagcat

SEQ ID NO: 5006460 - DNA, 23 bp, Homo sapiens
tttcttcacctctgctactcaag

SEQ ID NO: 5006461 - DNA, 14 bp, Homo sapiens
tttgatacattttt

SEQ ID NO: 5006462 - DNA, 14 bp, Homo sapiens
tttgtataaaagtg

SEQ ID NO: 5006463 - DNA, 15 bp, Homo sapiens
tttgtgcattttcta

SEQ ID NO: 5006464 - DNA, 23 bp, Homo sapiens
tttgttcccatcctcttctttta

SEQ ID NO: 5006465 - DNA, 18 bp, Homo sapiens
ttttctttaactgccgta

SEQ ID NO: 5006466 - DNA, 13 bp, Homo sapiens
tttttaatctcca

SEQ ID NO: 5006467 - DNA, 19 bp, Homo sapiens
gcctgcccagttgcactca

SEQ ID NO: 5006468 - DNA, 22 bp, Homo sapiens
gcctgggtgacagagcaagact

SEQ ID NO: 5006469 - DNA, 14 bp, Homo sapiens
gcctgtaatcccag

SEQ ID NO: 5006470 - DNA, 19 bp, Homo sapiens
gctatttgcaattcctgct

SEQ ID NO: 5006471 - DNA, 17 bp, Homo sapiens
gctcatttactgtttta

SEQ ID NO: 5006472 - DNA, 22 bp, Homo sapiens
gctcctgttttgcacagccaaa

SEQ ID NO: 5006473 - DNA, 18 bp, Homo sapiens
gctgaggaggcacctaca

SEQ ID NO: 5006474 - DNA, 20 bp, Homo sapiens
gctgtgtgaatacctgctca

SEQ ID NO: 5006475 - DNA, 13 bp, Homo sapiens
gcttctttgccaa

SEQ ID NO: 5006476 - DNA, 17 bp, Homo sapiens
gcttttgtgtcttacat

SEQ ID NO: 5006477 - DNA, 13 bp, Homo sapiens
ggaacttgagaac

SEQ ID NO: 5006478 - DNA, 14 bp, Homo sapiens
ggacgttgttttgg

SEQ ID NO: 5006479 - DNA, 17 bp, Homo sapiens
ggatccaaactgatcca

SEQ ID NO: 5006480 - DNA, 14 bp, Homo sapiens
ggcatttcccccac

SEQ ID NO: 5006481 - DNA, 15 bp, Homo sapiens
ggctcctgttttgca

SEQ ID NO: 5006482 - DNA, 16 bp, Homo sapiens
ggcttctctgaggaag

SEQ ID NO: 5006483 - DNA, 10 bp, Homo sapiens
ggttttcctg

SEQ ID NO: 5006484 - DNA, 17 bp, Homo sapiens
gtaattcttattctttc

SEQ ID NO: 5006485 - DNA, 23 bp, Homo sapiens
gtacgaacctacagttttaactg

SEQ ID NO: 5006486 - DNA, 14 bp, Homo sapiens
gtagcatttactgt

SEQ ID NO: 5006487 - DNA, 16 bp, Homo sapiens
gtagccttttgacttt

SEQ ID NO: 5006488 - DNA, 23 bp, Homo sapiens
gtatattcaggacttgaaagaaa

SEQ ID NO: 5006489 - DNA, 21 bp, Homo sapiens
gtattagagtttcaaccatga

SEQ ID NO: 5006490 - DNA, 22 bp, Homo sapiens
aatctccaccagtcatttttca

SEQ ID NO: 5006491 - DNA, 16 bp, Homo sapiens
aatctttataaatgta

SEQ ID NO: 5006492 - DNA, 14 bp, Homo sapiens
aatgcatacaagtt

SEQ ID NO: 5006493 - DNA, 17 bp, Homo sapiens
aatggatttttctttaa

SEQ ID NO: 5006494 - DNA, 20 bp, Homo sapiens
aatggatttttctttaactg

SEQ ID NO: 5006495 - DNA, 17 bp, Homo sapiens
aatgtgcaatagaaggt

SEQ ID NO: 5006496 - DNA, 16 bp, Homo sapiens
aatgtttctggatttc

SEQ ID NO: 5006497 - DNA, 21 bp, Homo sapiens
aattaccatgcttcacaatgt

SEQ ID NO: 5006498 - DNA, 22 bp, Homo sapiens
aattagtaggctcatttactgt

SEQ ID NO: 5006499 - DNA, 15 bp, Homo sapiens
aattcttattctttc

SEQ ID NO: 5006500 - DNA, 15 bp, Homo sapiens
aattgtgtggattct

SEQ ID NO: 5006501 - DNA, 19 bp, Homo sapiens
aattgtgtggattctttaa

SEQ ID NO: 5006502 - DNA, 20 bp, Homo sapiens
aatttaaagaagtatgggaa

SEQ ID NO: 5006503 - DNA, 15 bp, Homo sapiens
aatttttcttgcgaa

SEQ ID NO: 5006504 - DNA, 12 bp, Homo sapiens
acaaaacaaaaa

SEQ ID NO: 5006505 - DNA, 18 bp, Homo sapiens
acaaagaaacaaagatgt

SEQ ID NO: 5006506 - DNA, 19 bp, Homo sapiens
acaactacagaaaaaccag

SEQ ID NO: 5006507 - DNA, 20 bp, Homo sapiens
acaactacagaaaaaccaga

SEQ ID NO: 5006508 - DNA, 13 bp, Homo sapiens
acaatggcagatg

SEQ ID NO: 5006509 - DNA, 17 bp, Homo sapiens
acaatgttaacattttt

SEQ ID NO: 5006510 - DNA, 18 bp, Homo sapiens
acacagcattgtatatgt

SEQ ID NO: 5006511 - DNA, 20 bp, Homo sapiens
acacagcattgtatatgtga

SEQ ID NO: 5006512 - DNA, 22 bp, Homo sapiens
acactgatttccccttttgcat

SEQ ID NO: 5006513 - DNA, 14 bp, Homo sapiens
acagcattttcctc

SEQ ID NO: 5006514 - DNA, 14 bp, Homo sapiens
acagccaaatttaa

SEQ ID NO: 5006515 - DNA, 15 bp, Homo sapiens
acaggttataacagt

SEQ ID NO: 5006516 - DNA, 15 bp, Homo sapiens
acagtacccaaactg

SEQ ID NO: 5006517 - DNA, 18 bp, Homo sapiens
acagtggatcacaaagtg

SEQ ID NO: 5006518 - DNA, 16 bp, Homo sapiens
acagtttccagtcatg

SEQ ID NO: 5006519 - DNA, 22 bp, Homo sapiens
acagtttccagtcatggccaaa

SEQ ID NO: 5006520 - DNA, 19 bp, Homo sapiens
acagttttaactgtggata

SEQ ID NO: 5006521 - DNA, 16 bp, Homo sapiens
acatacctaagcaaac

SEQ ID NO: 5006522 - DNA, 23 bp, Homo sapiens
accatgaagtctctaacaatgta

SEQ ID NO: 5006523 - DNA, 14 bp, Homo sapiens
accatttaaaaaca

SEQ ID NO: 5006524 - DNA, 23 bp, Homo sapiens
acccatgcctccccctagccatt

SEQ ID NO: 5006525 - DNA, 19 bp, Homo sapiens
accccatttctctcctcac

SEQ ID NO: 5006526 - DNA, 16 bp, Homo sapiens
acctacagttttaact

SEQ ID NO: 5006527 - DNA, 14 bp, Homo sapiens
acctatttctcttt

SEQ ID NO: 5006528 - DNA, 18 bp, Homo sapiens
acctgcactaacagagtg

SEQ ID NO: 5006529 - DNA, 16 bp, Homo sapiens
acctgctcacgtcaaa

SEQ ID NO: 5006530 - DNA, 20 bp, Homo sapiens
acctgctcacgtcaaatgca

SEQ ID NO: 5006531 - DNA, 15 bp, Homo sapiens
acggaaagtgctgtc

SEQ ID NO: 5006532 - DNA, 20 bp, Homo sapiens
acgtccatcacgttagctgt

SEQ ID NO: 5006533 - DNA, 16 bp, Homo sapiens
actaaaactacaaaaa

SEQ ID NO: 5006534 - DNA, 14 bp, Homo sapiens
actaattcttgcat

SEQ ID NO: 5006535 - DNA, 16 bp, Homo sapiens
actcaagtagcattta

SEQ ID NO: 5006536 - DNA, 22 bp, Homo sapiens
actcacctgcactaacagagtg

SEQ ID NO: 5006537 - DNA, 13 bp, Homo sapiens
actcagaaattca

SEQ ID NO: 5006538 - DNA, 17 bp, Homo sapiens
actgaatttttcttgcg

SEQ ID NO: 5006539 - DNA, 15 bp, Homo sapiens
actgatttcagagtg

SEQ ID NO: 5006540 - DNA, 22 bp, Homo sapiens
actgcaaaaagaaaatctttat

SEQ ID NO: 5006541 - DNA, 20 bp, Homo sapiens
actggtaggaacttgagaac

SEQ ID NO: 5006542 - DNA, 15 bp, Homo sapiens
actgtaacattcagg

SEQ ID NO: 5006543 - DNA, 14 bp, Homo sapiens
actgtatattcagg

SEQ ID NO: 5006544 - DNA, 19 bp, Homo sapiens
actgttatcctatttagat

SEQ ID NO: 5006545 - DNA, 21 bp, Homo sapiens
actgttggaatggatttttct

SEQ ID NO: 5006546 - DNA, 22 bp, Homo sapiens
acttccatgtgagggttttcag

SEQ ID NO: 5006547 - DNA, 16 bp, Homo sapiens
acttcccccaaattta

SEQ ID NO: 5006548 - DNA, 12 bp, Homo sapiens
acttgaaagaaa

SEQ ID NO: 5006549 - DNA, 15 bp, Homo sapiens
actttagaagcctgc

SEQ ID NO: 5006550 - DNA, 21 bp, Homo sapiens
actttatttccaagttgttca

SEQ ID NO: 5006551 - DNA, 18 bp, Homo sapiens
actttgacagtgttttta

SEQ ID NO: 5006552 - DNA, 15 bp, Homo sapiens
agaaaatctttataa

SEQ ID NO: 5006553 - DNA, 17 bp, Homo sapiens
agaaacaaagatgttat

SEQ ID NO: 5006554 - DNA, 20 bp, Homo sapiens
agaaattacctgtggatatt

SEQ ID NO: 5006555 - DNA, 11 bp, Homo sapiens
agaacacagtt

SEQ ID NO: 5006556 - DNA, 19 bp, Homo sapiens
agaacatgtagaaaacaaa

SEQ ID NO: 5006557 - DNA, 15 bp, Homo sapiens
agaactttatttcca

SEQ ID NO: 5006558 - DNA, 24 bp, Homo sapiens
agaagagcgagagatcaaagatga

SEQ ID NO: 5006559 - DNA, 17 bp, Homo sapiens
agaatagaacacagttt

SEQ ID NO: 5006560 - DNA, 20 bp, Homo sapiens
agaatagttgaacctatttc

SEQ ID NO: 5006561 - DNA, 15 bp, Homo sapiens
agactcatattactg

SEQ ID NO: 5006562 - DNA, 22 bp, Homo sapiens
agactcatattactggtaggaa

SEQ ID NO: 5006563 - DNA, 17 bp, Homo sapiens
agactcctcagttcttg

SEQ ID NO: 5006564 - DNA, 18 bp, Homo sapiens
agactctgtctaaaaaac

SEQ ID NO: 5006565 - DNA, 20 bp, Homo sapiens
agactctgtctaaaaaacaa

SEQ ID NO: 5006566 - DNA, 24 bp, Homo sapiens
agactgaatagatatgaaagctga

SEQ ID NO: 5006567 - DNA, 14 bp, Homo sapiens
agagacatggtatt

SEQ ID NO: 5006568 - DNA, 14 bp, Homo sapiens
agagatcaaagatg

SEQ ID NO: 5006569 - DNA, 18 bp, Homo sapiens
agatactaaggacgttgt

SEQ ID NO: 5006570 - DNA, 19 bp, Homo sapiens
agatgtaaagttattcttg

SEQ ID NO: 5006571 - DNA, 15 bp, Homo sapiens
agatgttctactttg

SEQ ID NO: 5006572 - DNA, 19 bp, Homo sapiens
agattcttcccattctcca

SEQ ID NO: 5006573 - DNA, 22 bp, Homo sapiens
agattcttcccattctccattt

SEQ ID NO: 5006574 - DNA, 15 bp, Homo sapiens
agcattgatatttgt

SEQ ID NO: 5006575 - DNA, 19 bp, Homo sapiens
agcattgatatttgtgcat

SEQ ID NO: 5006576 - DNA, 21 bp, Homo sapiens
agcattgatatttgtgcattt

SEQ ID NO: 5006577 - DNA, 16 bp, Homo sapiens
agcatttactgtgtct

SEQ ID NO: 5006578 - DNA, 18 bp, Homo sapiens
agcattttcctctgcttt

SEQ ID NO: 5006579 - DNA, 19 bp, Homo sapiens
agccaaatttaaaactgtt

SEQ ID NO: 5006580 - DNA, 16 bp, Homo sapiens
agccaaggctctgttt

SEQ ID NO: 5006581 - DNA, 19 bp, Homo sapiens
agcctaaggctcctgtttt

SEQ ID NO: 5006582 - DNA, 19 bp, Homo sapiens
agctactcgggaagctgag

SEQ ID NO: 5006583 - DNA, 21 bp, Homo sapiens
agctgtgtgaatacctgctca

SEQ ID NO: 5006584 - DNA, 14 bp, Homo sapiens
agcttctttgccaa

SEQ ID NO: 5006585 - DNA, 19 bp, Homo sapiens
aggattcctcttttctctg

SEQ ID NO: 5006586 - DNA, 23 bp, Homo sapiens
aggcccccgggtgtgaagcacag

SEQ ID NO: 5006587 - DNA, 16 bp, Homo sapiens
aggctcctgttttgca

SEQ ID NO: 5006588 - DNA, 17 bp, Homo sapiens
agggattgtttctgttt

SEQ ID NO: 5006589 - DNA, 20 bp, Homo sapiens
agggtggttcaacaaagaaa

SEQ ID NO: 5006590 - DNA, 19 bp, Homo sapiens
aggtacgatgacagtgttc

SEQ ID NO: 5006591 - DNA, 13 bp, Homo sapiens
aggtgtctgtatc

SEQ ID NO: 5006592 - DNA, 19 bp, Homo sapiens
agtaaaataaatattgtct

SEQ ID NO: 5006593 - DNA, 22 bp, Homo sapiens
agtaaaataaatattgtctttt

SEQ ID NO: 5006594 - DNA, 20 bp, Homo sapiens
agtaatctgagaaacaatga

SEQ ID NO: 5006595 - DNA, 18 bp, Homo sapiens
agtacgaacctacagttt

SEQ ID NO: 5006596 - DNA, 22 bp, Homo sapiens
agtagcatttactgtgtctttg

SEQ ID NO: 5006597 - DNA, 17 bp, Homo sapiens
agtaggctcatttactg

SEQ ID NO: 5006598 - DNA, 18 bp, Homo sapiens
agtcacaaagaacatgta

SEQ ID NO: 5006599 - DNA, 23 bp, Homo sapiens
agtcactggtctgtttgcatttg

SEQ ID NO: 5006600 - DNA, 23 bp, Homo sapiens
ctagcattgtaaaattatttcat

SEQ ID NO: 5006601 - DNA, 23 bp, Homo sapiens
ctagctgtgtgaatacctgctca

SEQ ID NO: 5006602 - DNA, 16 bp, Homo sapiens
ctagttatacttattt

SEQ ID NO: 5006603 - DNA, 17 bp, Homo sapiens
ctatctgtattcccaaa

SEQ ID NO: 5006604 - DNA, 19 bp, Homo sapiens
ctatgtggattttttccta

SEQ ID NO: 5006605 - DNA, 14 bp, Homo sapiens
ctatttctctttct

SEQ ID NO: 5006606 - DNA, 16 bp, Homo sapiens
ctatttgagactcctc

SEQ ID NO: 5006607 - DNA, 18 bp, Homo sapiens
ctatttgcaattcctgct

SEQ ID NO: 5006608 - DNA, 20 bp, Homo sapiens
ctcaagtagcatttactgtg

SEQ ID NO: 5006609 - DNA, 20 bp, Homo sapiens
ctcaataaactgaatttttc

SEQ ID NO: 5006610 - DNA, 17 bp, Homo sapiens
ctcacctgcactaacag

SEQ ID NO: 5006611 - DNA, 21 bp, Homo sapiens
ctctaacaatgtattttcttc

SEQ ID NO: 5006612 - DNA, 16 bp, Homo sapiens
ctctactcttacttcc

SEQ ID NO: 5006613 - DNA, 17 bp, Homo sapiens
ctctagtgcggtttact

SEQ ID NO: 5006614 - DNA, 22 bp, Homo sapiens
ctgaatctgctaccaaaacagt

SEQ ID NO: 5006615 - DNA, 18 bp, Homo sapiens
ctgaattatctatttcat

SEQ ID NO: 5006616 - DNA, 16 bp, Homo sapiens
ctgaatttttcttgcg

SEQ ID NO: 5006617 - DNA, 17 bp, Homo sapiens
ctgacagtcatgcagtc

SEQ ID NO: 5006618 - DNA, 15 bp, Homo sapiens
ctgcataatgtttct

SEQ ID NO: 5006619 - DNA, 13 bp, Homo sapiens
ctgcccagttgca

SEQ ID NO: 5006620 - DNA, 18 bp, Homo sapiens
ctggagtcatcattccct

SEQ ID NO: 5006621 - DNA, 13 bp, Homo sapiens
ctggcttctctga

SEQ ID NO: 5006622 - DNA, 16 bp, Homo sapiens
ctgtaaagatgtttat

SEQ ID NO: 5006623 - DNA, 22 bp, Homo sapiens
ctgtaaagatgtttatttcagg

SEQ ID NO: 5006624 - DNA, 12 bp, Homo sapiens
ctgtaattgtgt

SEQ ID NO: 5006625 - DNA, 15 bp, Homo sapiens
ctgtatcagtggatt

SEQ ID NO: 5006626 - DNA, 14 bp, Homo sapiens
ctgtgaaattccca

SEQ ID NO: 5006627 - DNA, 18 bp, Homo sapiens
ctgtgtgaatacctgctc

SEQ ID NO: 5006628 - DNA, 19 bp, Homo sapiens
ctgtgtgaatacctgctca

SEQ ID NO: 5006629 - DNA, 22 bp, Homo sapiens
ctgtgttactaaaaaaaagatg

SEQ ID NO: 5006630 - DNA, 17 bp, Homo sapiens
ctgttatcctatttaga

SEQ ID NO: 5006631 - DNA, 23 bp, Homo sapiens
ctgttggaatggatttttcttta

SEQ ID NO: 5006632 - DNA, 15 bp, Homo sapiens
ctgtttatgcttttg

SEQ ID NO: 5006633 - DNA, 16 bp, Homo sapiens
ctgtttcctagctgtg

SEQ ID NO: 5006634 - DNA, 13 bp, Homo sapiens
cttcccattctcc

SEQ ID NO: 5006635 - DNA, 20 bp, Homo sapiens
cttccttgtagccttttgac

SEQ ID NO: 5006636 - DNA, 15 bp, Homo sapiens
cttcgacagcatttt

SEQ ID NO: 5006637 - DNA, 17 bp, Homo sapiens
cttcgacagcattttcc

SEQ ID NO: 5006638 - DNA, 16 bp, Homo sapiens
cttgaaaaaaaacagt

SEQ ID NO: 5006639 - DNA, 18 bp, Homo sapiens
cttgaaaaaaaacagtgg

SEQ ID NO: 5006640 - DNA, 13 bp, Homo sapiens
cttgaaagaaatg

SEQ ID NO: 5006641 - DNA, 16 bp, Homo sapiens
cttgagaaaaaaagaa

SEQ ID NO: 5006642 - DNA, 22 bp, Homo sapiens
cttgagaaaaaaagaatagttg

SEQ ID NO: 5006643 - DNA, 19 bp, Homo sapiens
cttgagaactttatttcca

SEQ ID NO: 5006644 - DNA, 17 bp, Homo sapiens
cttgctttgtgttcttt

SEQ ID NO: 5006645 - DNA, 18 bp, Homo sapiens
cttgctttgtgttctttg

SEQ ID NO: 5006646 - DNA, 14 bp, Homo sapiens
cttgtagccttttg

SEQ ID NO: 5006647 - DNA, 15 bp, Homo sapiens
ctttagaagcctgca

SEQ ID NO: 5006648 - DNA, 22 bp, Homo sapiens
ctttccatatcaagagacatgg

SEQ ID NO: 5006649 - DNA, 21 bp, Homo sapiens
ctttgacctaaattatttact

SEQ ID NO: 5006650 - DNA, 22 bp, Homo sapiens
ctttggagaagagtgtggagtc

SEQ ID NO: 5006651 - DNA, 21 bp, Homo sapiens
cttttaactcctcaattccaa

SEQ ID NO: 5006652 - DNA, 13 bp, Homo sapiens
cttttgcattctc

SEQ ID NO: 5006653 - DNA, 13 bp, Homo sapiens
cttttgtgtctta

SEQ ID NO: 5006654 - DNA, 18 bp, Homo sapiens
gaaaaaccagaggcagct

SEQ ID NO: 5006655 - DNA, 12 bp, Homo sapiens
gaaacaaagatg

SEQ ID NO: 5006656 - DNA, 17 bp, Homo sapiens
gaaattacctgtggata

SEQ ID NO: 5006657 - DNA, 18 bp, Homo sapiens
gaaattacctgtggatat

SEQ ID NO: 5006658 - DNA, 14 bp, Homo sapiens
gaactttatttcca

SEQ ID NO: 5006659 - DNA, 22 bp, Homo sapiens
gaagagcgagagatcaaagatg

SEQ ID NO: 5006660 - DNA, 22 bp, Homo sapiens
gaagattcttcccattctccat

SEQ ID NO: 5006661 - DNA, 13 bp, Homo sapiens
gaagttatgggaa

SEQ ID NO: 5006662 - DNA, 13 bp, Homo sapiens
gaatacctgtggt

SEQ ID NO: 5006663 - DNA, 19 bp, Homo sapiens
gaatatttggttttcctgt

SEQ ID NO: 5006664 - DNA, 16 bp, Homo sapiens
gacaatggcagatgta

SEQ ID NO: 5006665 - DNA, 16 bp, Homo sapiens
gacagcattttcctct

SEQ ID NO: 5006666 - DNA, 21 bp, Homo sapiens
gacagtgttccccgataccat

SEQ ID NO: 5006667 - DNA, 14 bp, Homo sapiens
gactgatttcagag

SEQ ID NO: 5006668 - DNA, 15 bp, Homo sapiens
gactttcattggaaa

SEQ ID NO: 5006669 - DNA, 13 bp, Homo sapiens
gagacatggtatt

SEQ ID NO: 5006670 - DNA, 20 bp, Homo sapiens
gagactcctcagttcttgcc

SEQ ID NO: 5006671 - DNA, 21 bp, Homo sapiens
gagagagttgttttaataact

SEQ ID NO: 5006672 - DNA, 15 bp, Homo sapiens
gagagatcaaagatg

SEQ ID NO: 5006673 - DNA, 13 bp, Homo sapiens
gagatcaaagatg

SEQ ID NO: 5006674 - DNA, 20 bp, Homo sapiens
gagcagagatcacaccactg

SEQ ID NO: 5006675 - DNA, 19 bp, Homo sapiens
gaggtggaggttgcagtga

SEQ ID NO: 5006676 - DNA, 22 bp, Homo sapiens
gagtaaaataaatattgtcttt

SEQ ID NO: 5006677 - DNA, 23 bp, Homo sapiens
gagtaaaataaatattgtctttt

SEQ ID NO: 5006678 - DNA, 22 bp, Homo sapiens
gagtcacaaagaacatgtagaa

SEQ ID NO: 5006679 - DNA, 16 bp, Homo sapiens
gagtgactacacacag

SEQ ID NO: 5006680 - DNA, 15 bp, Homo sapiens
gatcaaagatgaaaa

SEQ ID NO: 5006681 - DNA, 20 bp, Homo sapiens
gatctacttctgtaattgtg

SEQ ID NO: 5006682 - DNA, 15 bp, Homo sapiens
gatcttttgttccca

SEQ ID NO: 5006683 - DNA, 18 bp, Homo sapiens
gatcttttgttcccatcc

SEQ ID NO: 5006684 - DNA, 19 bp, Homo sapiens
gatgacaactacagaaaaa

SEQ ID NO: 5006685 - DNA, 13 bp, Homo sapiens
gatggtaattctt

SEQ ID NO: 5006686 - DNA, 15 bp, Homo sapiens
gattaattcctttcc

SEQ ID NO: 5006687 - DNA, 19 bp, Homo sapiens
gattcttcccattctccat

SEQ ID NO: 5006688 - DNA, 16 bp, Homo sapiens
gatttaaaagcctgct

SEQ ID NO: 5006689 - DNA, 23 bp, Homo sapiens
gcaaatgctaatgtcaaacttga

SEQ ID NO: 5006690 - DNA, 16 bp, Homo sapiens
gcaattcctgctccta

SEQ ID NO: 5006691 - DNA, 22 bp, Homo sapiens
gcactgaagggatatgtgaaac

SEQ ID NO: 5006692 - DNA, 20 bp, Homo sapiens
gcagatgtaaagttattctt

SEQ ID NO: 5006693 - DNA, 22 bp, Homo sapiens
gcagatgtaaagttattcttga

SEQ ID NO: 5006694 - DNA, 15 bp, Homo sapiens
gcaggtgaattgttt

SEQ ID NO: 5006695 - DNA, 13 bp, Homo sapiens
gcagtgagcagag

SEQ ID NO: 5006696 - DNA, 17 bp, Homo sapiens
gcatttactgtgtcttt

SEQ ID NO: 5006697 - DNA, 16 bp, Homo sapiens
gcattttctaaacaga

SEQ ID NO: 5006698 - DNA, 23 bp, Homo sapiens
gccacttttttttttaatctcca

SEQ ID NO: 5006699 - DNA, 15 bp, Homo sapiens
gccgtagtagatgtt

SEQ ID NO: 5006700 - DNA, 18 bp, Homo sapiens
gcctccccctagccattt

SEQ ID NO: 5006701 - DNA, 21 bp, Homo sapiens
gcctccccctagccattttta

SEQ ID NO: 5006702 - DNA, 14 bp, Homo sapiens
actttgacagtgtt

SEQ ID NO: 5006703 - DNA, 13 bp, Homo sapiens
actttgttctgct

SEQ ID NO: 5006704 - DNA, 16 bp, Homo sapiens
agaaatagaattataa

SEQ ID NO: 5006705 - DNA, 22 bp, Homo sapiens
agaagattcttcccattctcca

SEQ ID NO: 5006706 - DNA, 10 bp, Homo sapiens
agaagcctgc

SEQ ID NO: 5006707 - DNA, 11 bp, Homo sapiens
agaagcctgca

SEQ ID NO: 5006708 - DNA, 19 bp, Homo sapiens
agaatatttggttttcctg

SEQ ID NO: 5006709 - DNA, 11 bp, Homo sapiens
agactcctcag

SEQ ID NO: 5006710 - DNA, 21 bp, Homo sapiens
agactgaatagatatgaaagc

SEQ ID NO: 5006711 - DNA, 22 bp, Homo sapiens
agactgaatagatatgaaagct

SEQ ID NO: 5006712 - DNA, 23 bp, Homo sapiens
agagacatggtattgactcaaca

SEQ ID NO: 5006713 - DNA, 18 bp, Homo sapiens
agagcaagactctgtcta

SEQ ID NO: 5006714 - DNA, 21 bp, Homo sapiens
agagcaagactctgtctaaaa

SEQ ID NO: 5006715 - DNA, 20 bp, Homo sapiens
agagccacaggtctttatgt

SEQ ID NO: 5006716 - DNA, 17 bp, Homo sapiens
agaggcagcttctttgc

SEQ ID NO: 5006717 - DNA, 13 bp, Homo sapiens
agaggcatttccc

SEQ ID NO: 5006718 - DNA, 13 bp, Homo sapiens
agatcaaagatga

SEQ ID NO: 5006719 - DNA, 22 bp, Homo sapiens
agatgttctactttgttctgct

SEQ ID NO: 5006720 - DNA, 15 bp, Homo sapiens
agatgtttatttcag

SEQ ID NO: 5006721 - DNA, 23 bp, Homo sapiens
agattcttcccattctccatttg

SEQ ID NO: 5006722 - DNA, 13 bp, Homo sapiens
agcagtaaaatag

SEQ ID NO: 5006723 - DNA, 13 bp, Homo sapiens
agccaaatttaaa

SEQ ID NO: 5006724 - DNA, 18 bp, Homo sapiens
agcctaaggctcctgttt

SEQ ID NO: 5006725 - DNA, 18 bp, Homo sapiens
aggactgatttcagagtg

SEQ ID NO: 5006726 - DNA, 15 bp, Homo sapiens
aggagctgatacttt

SEQ ID NO: 5006727 - DNA, 18 bp, Homo sapiens
aggaggcacctacactca

SEQ ID NO: 5006728 - DNA, 16 bp, Homo sapiens
aggattcctcttttct

SEQ ID NO: 5006729 - DNA, 21 bp, Homo sapiens
aggcacctacactcacctgca

SEQ ID NO: 5006730 - DNA, 14 bp, Homo sapiens
aggcattggatatt

SEQ ID NO: 5006731 - DNA, 19 bp, Homo sapiens
agggatctatacttgcttt

SEQ ID NO: 5006732 - DNA, 23 bp, Homo sapiens
aggtgctaatttgttttggatat

SEQ ID NO: 5006733 - DNA, 19 bp, Homo sapiens
agtataagactactgaatc

SEQ ID NO: 5006734 - DNA, 13 bp, Homo sapiens
agtcatggccaaa

SEQ ID NO: 5006735 - DNA, 17 bp, Homo sapiens
agtgccactgttgtttt

SEQ ID NO: 5006736 - DNA, 19 bp, Homo sapiens
agtgcggtttactcactgc

SEQ ID NO: 5006737 - DNA, 15 bp, Homo sapiens
agtggatcacaaagt

SEQ ID NO: 5006738 - DNA, 15 bp, Homo sapiens
agtggatttcccatc

SEQ ID NO: 5006739 - DNA, 23 bp, Homo sapiens
agtgtggagtcattctcattgaa

SEQ ID NO: 5006740 - DNA, 20 bp, Homo sapiens
agttatacttatttgtatat

SEQ ID NO: 5006741 - DNA, 13 bp, Homo sapiens
agtttcttgcttg

SEQ ID NO: 5006742 - DNA, 18 bp, Homo sapiens
agttttaactgtggatat

SEQ ID NO: 5006743 - DNA, 18 bp, Homo sapiens
ataaatgtaccagagaga

SEQ ID NO: 5006744 - DNA, 16 bp, Homo sapiens
atacaatgatgctatt

SEQ ID NO: 5006745 - DNA, 13 bp, Homo sapiens
atagaaggtgatg

SEQ ID NO: 5006746 - DNA, 17 bp, Homo sapiens
atatattgggttccatt

SEQ ID NO: 5006747 - DNA, 16 bp, Homo sapiens
atatattttgtttaca

SEQ ID NO: 5006748 - DNA, 23 bp, Homo sapiens
atattctggagtcatcattccct

SEQ ID NO: 5006749 - DNA, 12 bp, Homo sapiens
atcaaagatgaa

SEQ ID NO: 5006750 - DNA, 21 bp, Homo sapiens
atcaagagttgtgacaacttc

SEQ ID NO: 5006751 - DNA, 18 bp, Homo sapiens
atcagtggatttcccatc

SEQ ID NO: 5006752 - DNA, 22 bp, Homo sapiens
atccctaggtcttgggagctct

SEQ ID NO: 5006753 - DNA, 18 bp, Homo sapiens
atccctgaggactgattt

SEQ ID NO: 5006754 - DNA, 13 bp, Homo sapiens
atcctcttctttt

SEQ ID NO: 5006755 - DNA, 23 bp, Homo sapiens
atctacttctgtaattgtgtgga

SEQ ID NO: 5006756 - DNA, 21 bp, Homo sapiens
atctcaggttaagtgtgagta

SEQ ID NO: 5006757 - DNA, 17 bp, Homo sapiens
atctccaccagtcattt

SEQ ID NO: 5006758 - DNA, 22 bp, Homo sapiens
atctccaccagtcatttttcag

SEQ ID NO: 5006759 - DNA, 14 bp, Homo sapiens
atctgatatgtatt

SEQ ID NO: 5006760 - DNA, 22 bp, Homo sapiens
atcttatcaagagttgtgacaa

SEQ ID NO: 5006761 - DNA, 20 bp, Homo sapiens
atgcctccccctagccattt

SEQ ID NO: 5006762 - DNA, 16 bp, Homo sapiens
atggaaactgaaacta

SEQ ID NO: 5006763 - DNA, 24 bp, Homo sapiens
atggcagggggtggaattattact

SEQ ID NO: 5006764 - DNA, 18 bp, Homo sapiens
atggccgtgtagaagcat

SEQ ID NO: 5006765 - DNA, 23 bp, Homo sapiens
atgtattgtttgggatcctattg

SEQ ID NO: 5006766 - DNA, 23 bp, Homo sapiens
atgtattttcttcacctctgcta

SEQ ID NO: 5006767 - DNA, 19 bp, Homo sapiens
attacctgtggatatttgt

SEQ ID NO: 5006768 - DNA, 15 bp, Homo sapiens
attataaatgacaac

SEQ ID NO: 5006769 - DNA, 16 bp, Homo sapiens
attccaacactgattt

SEQ ID NO: 5006770 - DNA, 23 bp, Homo sapiens
attcccttcgacagcattttcct

SEQ ID NO: 5006771 - DNA, 14 bp, Homo sapiens
attctccatttgtt

SEQ ID NO: 5006772 - DNA, 16 bp, Homo sapiens
attctccatttgttat

SEQ ID NO: 5006773 - DNA, 16 bp, Homo sapiens
attcttcccattctcc

SEQ ID NO: 5006774 - DNA, 17 bp, Homo sapiens
attcttcccattctcca

SEQ ID NO: 5006775 - DNA, 22 bp, Homo sapiens
attcttcccattctccatttgt

SEQ ID NO: 5006776 - DNA, 14 bp, Homo sapiens
attcttgaagtcag

SEQ ID NO: 5006777 - DNA, 12 bp, Homo sapiens
attcttgcatat

SEQ ID NO: 5006778 - DNA, 13 bp, Homo sapiens
attcttgcatatt

SEQ ID NO: 5006779 - DNA, 19 bp, Homo sapiens
attgataaccttgaaaaaa

SEQ ID NO: 5006780 - DNA, 19 bp, Homo sapiens
attgatatttgtgcatttt

SEQ ID NO: 5006781 - DNA, 22 bp, Homo sapiens
attgatatttgtgcattttcta

SEQ ID NO: 5006782 - DNA, 13 bp, Homo sapiens
attggggtagttg

SEQ ID NO: 5006783 - DNA, 12 bp, Homo sapiens
attgtttgaacc

SEQ ID NO: 5006784 - DNA, 21 bp, Homo sapiens
attgtttgggatcctattgaa

SEQ ID NO: 5006785 - DNA, 22 bp, Homo sapiens
atttaaaaacaggcagctcata

SEQ ID NO: 5006786 - DNA, 14 bp, Homo sapiens
atttaaaagcctgc

SEQ ID NO: 5006787 - DNA, 15 bp, Homo sapiens
atttaaaagcctgct

SEQ ID NO: 5006788 - DNA, 17 bp, Homo sapiens
atttattttttcttttc

SEQ ID NO: 5006789 - DNA, 23 bp, Homo sapiens
atttcatactgtaacattcagga

SEQ ID NO: 5006790 - DNA, 23 bp, Homo sapiens
atttggatttaaaagcctgctca

SEQ ID NO: 5006791 - DNA, 19 bp, Homo sapiens
atttgtaggggaactcatt

SEQ ID NO: 5006792 - DNA, 22 bp, Homo sapiens
attttatttgtaggggaactca

SEQ ID NO: 5006793 - DNA, 19 bp, Homo sapiens
attttcctctgctttgaaa

SEQ ID NO: 5006794 - DNA, 19 bp, Homo sapiens
attttgtaacttccatgtg

SEQ ID NO: 5006795 - DNA, 15 bp, Homo sapiens
caaaatggataaaat

SEQ ID NO: 5006796 - DNA, 20 bp, Homo sapiens
caaactaggggacaaagcaa

SEQ ID NO: 5006797 - DNA, 21 bp, Homo sapiens
caaagaacatgtagaaaacaa

SEQ ID NO: 5006798 - DNA, 12 bp, Homo sapiens
caaagatgaaaa

SEQ ID NO: 5006799 - DNA, 23 bp, Homo sapiens
caacactgatttccccttttgca

SEQ ID NO: 5006800 - DNA, 22 bp, Homo sapiens
caaccagggattgtttctgttt

SEQ ID NO: 5006801 - DNA, 19 bp, Homo sapiens
caatgatgctatttgcaat

SEQ ID NO: 5006802 - DNA, 23 bp, Homo sapiens
caatttggatttaaaagcctgct

SEQ ID NO: 5006803 - DNA, 16 bp, Homo sapiens
cacagcattgtatatg

SEQ ID NO: 5006804 - DNA, 19 bp, Homo sapiens
cacaggtgcaacagacttg

SEQ ID NO: 5006805 - DNA, 17 bp, Homo sapiens
caccatttaaaaacagg

SEQ ID NO: 5006806 - DNA, 15 bp, Homo sapiens
cacctgcactaacag

SEQ ID NO: 5006807 - DNA, 15 bp, Homo sapiens
cactgatttcccctt

SEQ ID NO: 5006808 - DNA, 20 bp, Homo sapiens
cactggtctgtttgcatttg

SEQ ID NO: 5006809 - DNA, 23 bp, Homo sapiens
cacttttttttttaatctccacc

SEQ ID NO: 5006810 - DNA, 13 bp, Homo sapiens
cagaaaaaccaga

SEQ ID NO: 5006811 - DNA, 16 bp, Homo sapiens
cagaaattcaatttgg

SEQ ID NO: 5006812 - DNA, 20 bp, Homo sapiens
cagaaattcaatttggattt

SEQ ID NO: 5006813 - DNA, 20 bp, Homo sapiens
cagatagtgtagctgaggag

SEQ ID NO: 5006814 - DNA, 17 bp, Homo sapiens
cagcattgatatttgtg

SEQ ID NO: 5006815 - DNA, 22 bp, Homo sapiens
cagccaaatttaaaactgttgg

SEQ ID NO: 5006816 - DNA, 14 bp, Homo sapiens
cagctcataagagc

SEQ ID NO: 5006817 - DNA, 15 bp, Homo sapiens
caggcattggatatt

SEQ ID NO: 5006818 - DNA, 22 bp, Homo sapiens
caggccaaagagtctccagttt

SEQ ID NO: 5006819 - DNA, 18 bp, Homo sapiens
caggtattttataattct

SEQ ID NO: 5006820 - DNA, 16 bp, Homo sapiens
caggttataacagtgt

SEQ ID NO: 5006821 - DNA, 14 bp, Homo sapiens
cagtaaaatagctg

SEQ ID NO: 5006822 - DNA, 20 bp, Homo sapiens
cagtaaaatagctgagggaa

SEQ ID NO: 5006823 - DNA, 17 bp, Homo sapiens
taactcctcaattccaa

SEQ ID NO: 5006824 - DNA, 15 bp, Homo sapiens
taactgtaaagatgt

SEQ ID NO: 5006825 - DNA, 17 bp, Homo sapiens
taacttccatgtgaggg

SEQ ID NO: 5006826 - DNA, 14 bp, Homo sapiens
taatcccagcaatt

SEQ ID NO: 5006827 - DNA, 14 bp, Homo sapiens
taatcccagctact

SEQ ID NO: 5006828 - DNA, 14 bp, Homo sapiens
taatctgagaaaca

SEQ ID NO: 5006829 - DNA, 15 bp, Homo sapiens
taattaaatagcttt

SEQ ID NO: 5006830 - DNA, 15 bp, Homo sapiens
taattcttgcatatt

SEQ ID NO: 5006831 - DNA, 14 bp, Homo sapiens
taattgtgtggatt

SEQ ID NO: 5006832 - DNA, 13 bp, Homo sapiens
tacagtctatttg

SEQ ID NO: 5006833 - DNA, 14 bp, Homo sapiens
tacagttttaactg

SEQ ID NO: 5006834 - DNA, 19 bp, Homo sapiens
tacagttttaactgtggat

SEQ ID NO: 5006835 - DNA, 21 bp, Homo sapiens
tacagttttaactgtggatat

SEQ ID NO: 5006836 - DNA, 13 bp, Homo sapiens
taccaatcatatt

SEQ ID NO: 5006837 - DNA, 21 bp, Homo sapiens
tacgtagcctaaggctcctgt

SEQ ID NO: 5006838 - DNA, 16 bp, Homo sapiens
tactaaaaaaaagatg

SEQ ID NO: 5006839 - DNA, 18 bp, Homo sapiens
tactaaaaaaaagatgaa

SEQ ID NO: 5006840 - DNA, 18 bp, Homo sapiens
tacttatttgtatatggt

SEQ ID NO: 5006841 - DNA, 22 bp, Homo sapiens
tacttctgtaattgtgtggatt

SEQ ID NO: 5006842 - DNA, 14 bp, Homo sapiens
tacttgctttgtgt

SEQ ID NO: 5006843 - DNA, 17 bp, Homo sapiens
tactttagaagcctgca

SEQ ID NO: 5006844 - DNA, 15 bp, Homo sapiens
tactttgacagtgtt

SEQ ID NO: 5006845 - DNA, 20 bp, Homo sapiens
tactttggggctaatttaac

SEQ ID NO: 5006846 - DNA, 14 bp, Homo sapiens
tactttgttctgct

SEQ ID NO: 5006847 - DNA, 16 bp, Homo sapiens
tagaaattacctgtgg

SEQ ID NO: 5006848 - DNA, 12 bp, Homo sapiens
tagaagcctgca

SEQ ID NO: 5006849 - DNA, 22 bp, Homo sapiens
tagaattataactgtaaagatg

SEQ ID NO: 5006850 - DNA, 15 bp, Homo sapiens
tagatatgaaagctg

SEQ ID NO: 5006851 - DNA, 24 bp, Homo sapiens
tagcattgtaaaattatttcatga

SEQ ID NO: 5006852 - DNA, 20 bp, Homo sapiens
tagcctaaggctcctgtttt

SEQ ID NO: 5006853 - DNA, 20 bp, Homo sapiens
tagcctatgtggattttttc

SEQ ID NO: 5006854 - DNA, 22 bp, Homo sapiens
tagctgtgtgaatacctgctca

SEQ ID NO: 5006855 - DNA, 16 bp, Homo sapiens
tagcttttgtgtctta

SEQ ID NO: 5006856 - DNA, 17 bp, Homo sapiens
taggctcatttactgtt

SEQ ID NO: 5006857 - DNA, 23 bp, Homo sapiens
tatacttgctttgtgttctttgt

SEQ ID NO: 5006858 - DNA, 17 bp, Homo sapiens
tatattttgtttacaaa

SEQ ID NO: 5006859 - DNA, 23 bp, Homo sapiens
tatgggaaatgagaggcatttcc

SEQ ID NO: 5006860 - DNA, 17 bp, Homo sapiens
tatggtggatccaaact

SEQ ID NO: 5006861 - DNA, 15 bp, Homo sapiens
tatgtgaaacaatgt

SEQ ID NO: 5006862 - DNA, 23 bp, Homo sapiens
tatgttgagtcgcgcaccgaaaa

SEQ ID NO: 5006863 - DNA, 18 bp, Homo sapiens
tattaaatggaaactgaa

SEQ ID NO: 5006864 - DNA, 20 bp, Homo sapiens
tattaaatggaaactgaaac

SEQ ID NO: 5006865 - DNA, 23 bp, Homo sapiens
tattaatacaatgatgctatttg

SEQ ID NO: 5006866 - DNA, 22 bp, Homo sapiens
tattgactaacaggccaaagag

SEQ ID NO: 5006867 - DNA, 22 bp, Homo sapiens
tattgttacgtagcctaaggct

SEQ ID NO: 5006868 - DNA, 17 bp, Homo sapiens
tatttgtgcattttcta

SEQ ID NO: 5006869 - DNA, 19 bp, Homo sapiens
tattttttcttttctttac

SEQ ID NO: 5006870 - DNA, 14 bp, Homo sapiens
tcaacaaagaaaca

SEQ ID NO: 5006871 - DNA, 20 bp, Homo sapiens
tcaacaaagaaacaaagatg

SEQ ID NO: 5006872 - DNA, 16 bp, Homo sapiens
tcaacagagactgaat

SEQ ID NO: 5006873 - DNA, 17 bp, Homo sapiens
tcaacagtttccagtca

SEQ ID NO: 5006874 - DNA, 23 bp, Homo sapiens
tcacacacagactcatattactg

SEQ ID NO: 5006875 - DNA, 12 bp, Homo sapiens
tcacctctgcta

SEQ ID NO: 5006876 - DNA, 18 bp, Homo sapiens
tcagcattgatatttgtg

SEQ ID NO: 5006877 - DNA, 16 bp, Homo sapiens
tcaggaattcttggag

SEQ ID NO: 5006878 - DNA, 23 bp, Homo sapiens
tcatgattagaaattacctgtgg

SEQ ID NO: 5006879 - DNA, 23 bp, Homo sapiens
tcattcccttcgacagcattttc

SEQ ID NO: 5006880 - DNA, 18 bp, Homo sapiens
tcattgaattataaaagc

SEQ ID NO: 5006881 - DNA, 20 bp, Homo sapiens
tcattgaattataaaagcca

SEQ ID NO: 5006882 - DNA, 11 bp, Homo sapiens
tcatttactgt

SEQ ID NO: 5006883 - DNA, 20 bp, Homo sapiens
tccaacactgatttcccctt

SEQ ID NO: 5006884 - DNA, 15 bp, Homo sapiens
tccaccagtcatttt

SEQ ID NO: 5006885 - DNA, 22 bp, Homo sapiens
tccagatagtgtagctgaggag

SEQ ID NO: 5006886 - DNA, 18 bp, Homo sapiens
tccaggattcctcttttc

SEQ ID NO: 5006887 - DNA, 22 bp, Homo sapiens
tccatggccgtgtagaagcatg

SEQ ID NO: 5006888 - DNA, 19 bp, Homo sapiens
tccattctcacctatccac

SEQ ID NO: 5006889 - DNA, 17 bp, Homo sapiens
tccatttgttatctggg

SEQ ID NO: 5006890 - DNA, 18 bp, Homo sapiens
tcccatcctcttctttta

SEQ ID NO: 5006891 - DNA, 19 bp, Homo sapiens
tcccattctccatttgtta

SEQ ID NO: 5006892 - DNA, 20 bp, Homo sapiens
tcccttccttgtagcctttt

SEQ ID NO: 5006893 - DNA, 20 bp, Homo sapiens
tcctcaattccaacactgat

SEQ ID NO: 5006894 - DNA, 15 bp, Homo sapiens
tcctcacacacagac

SEQ ID NO: 5006895 - DNA, 19 bp, Homo sapiens
tccttcatgacagcctcca

SEQ ID NO: 5006896 - DNA, 15 bp, Homo sapiens
tcggaaatcttaaac

SEQ ID NO: 5006897 - DNA, 23 bp, Homo sapiens
tctacaggtttgggtacaagtgg

SEQ ID NO: 5006898 - DNA, 21 bp, Homo sapiens
tctccttcatgacagcctcca

SEQ ID NO: 5006899 - DNA, 18 bp, Homo sapiens
tctctgccataaatgatt

SEQ ID NO: 5006900 - DNA, 22 bp, Homo sapiens
tctgctcaggagacctggagga

SEQ ID NO: 5006901 - DNA, 19 bp, Homo sapiens
tctgggagtggggaagtga

SEQ ID NO: 5006902 - DNA, 14 bp, Homo sapiens
tcttcccattctcc

SEQ ID NO: 5006903 - DNA, 15 bp, Homo sapiens
tctttatgttgagtc

SEQ ID NO: 5006904 - DNA, 12 bp, Homo sapiens
tcttttctttac

SEQ ID NO: 5006905 - DNA, 20 bp, Homo sapiens
tgaaaagggtgttgggaggg

SEQ ID NO: 5006906 - DNA, 21 bp, Homo sapiens
tgaaaagtatattgataacct

SEQ ID NO: 5006907 - DNA, 20 bp, Homo sapiens
tgaaagaatagaacacagtt

SEQ ID NO: 5006908 - DNA, 15 bp, Homo sapiens
tgaaagctactcata

SEQ ID NO: 5006909 - DNA, 16 bp, Homo sapiens
tgaacctatttctctt

SEQ ID NO: 5006910 - DNA, 17 bp, Homo sapiens
tgaagcacagacccctt

SEQ ID NO: 5006911 - DNA, 16 bp, Homo sapiens
tgaagggatatgtgaa

SEQ ID NO: 5006912 - DNA, 18 bp, Homo sapiens
tgaatagatatgaaagct

SEQ ID NO: 5006913 - DNA, 21 bp, Homo sapiens
tgaatagatatgaaagctgat

SEQ ID NO: 5006914 - DNA, 22 bp, Homo sapiens
tgacaactacagaaaaaccaga

SEQ ID NO: 5006915 - DNA, 22 bp, Homo sapiens
tgacagagcaagactctgtcta

SEQ ID NO: 5006916 - DNA, 20 bp, Homo sapiens
tgaccaaaatggtgaaacct

SEQ ID NO: 5006917 - DNA, 17 bp, Homo sapiens
tgactaacaggccaaag

SEQ ID NO: 5006918 - DNA, 17 bp, Homo sapiens
tgactaattcttgcata

SEQ ID NO: 5006919 - DNA, 15 bp, Homo sapiens
tgactttcattggaa

SEQ ID NO: 5006920 - DNA, 14 bp, Homo sapiens
tgagaaaaaaagaa

SEQ ID NO: 5006921 - DNA, 14 bp, Homo sapiens
tgagaggcatttcc

SEQ ID NO: 5006922 - DNA, 23 bp, Homo sapiens
tgagggatctatacttgctttgt

SEQ ID NO: 5006923 - DNA, 20 bp, Homo sapiens
tgatctacttctgtaattgt

SEQ ID NO: 5006924 - DNA, 23 bp, Homo sapiens
tgattagaaattacctgtggata

SEQ ID NO: 5006925 - DNA, 23 bp, Homo sapiens
tgcaaatactgtatattcaggac

SEQ ID NO: 5006926 - DNA, 19 bp, Homo sapiens
tgcaccatttaaaaacagg

SEQ ID NO: 5006927 - DNA, 16 bp, Homo sapiens
tgcactctagcctggg

SEQ ID NO: 5006928 - DNA, 11 bp, Homo sapiens
tgcattctccc

SEQ ID NO: 5006929 - DNA, 14 bp, Homo sapiens
tgccgtaatttaac

SEQ ID NO: 5006930 - DNA, 17 bp, Homo sapiens
tgctcacgtcaaatgca

SEQ ID NO: 5006931 - DNA, 14 bp, Homo sapiens
tgcttcacaatgtt

SEQ ID NO: 5006932 - DNA, 22 bp, Homo sapiens
tgctttgaaagccccagaaatc

SEQ ID NO: 5006933 - DNA, 21 bp, Homo sapiens
tgctttttccaactcagaaat

SEQ ID NO: 5006934 - DNA, 15 bp, Homo sapiens
tggagtcattctcat

SEQ ID NO: 5006935 - DNA, 11 bp, Homo sapiens
tggatatttgt

SEQ ID NO: 5006936 - DNA, 16 bp, Homo sapiens
tggatttaaaagcctg

SEQ ID NO: 5006937 - DNA, 13 bp, Homo sapiens
tggcaacctgctt

SEQ ID NO: 5006938 - DNA, 14 bp, Homo sapiens
tggcaacctgcttc

SEQ ID NO: 5006939 - DNA, 20 bp, Homo sapiens
tggctgacttacatcatgtg

SEQ ID NO: 5006940 - DNA, 16 bp, Homo sapiens
tggggaagggcctgcc

SEQ ID NO: 5006941 - DNA, 20 bp, Homo sapiens
tgggtccaggattcctcttt

SEQ ID NO: 5006942 - DNA, 17 bp, Homo sapiens
tggtaattcttattctt

SEQ ID NO: 5006943 - DNA, 14 bp, Homo sapiens
tggtgaaacctcct

SEQ ID NO: 5006944 - DNA, 13 bp, Homo sapiens
tggttttcctgta

SEQ ID NO: 5006945 - DNA, 13 bp, Homo sapiens
tgtaaatctgctc

SEQ ID NO: 5006946 - DNA, 19 bp, Homo sapiens
tgtaacttccatgtgaggg

SEQ ID NO: 5006947 - DNA, 20 bp, Homo sapiens
tgtaattgtgtggattcttt

SEQ ID NO: 5006948 - DNA, 21 bp, Homo sapiens
tgtaattgtgtggattcttta

SEQ ID NO: 5006949 - DNA, 11 bp, Homo sapiens
tgtagaaaaca

SEQ ID NO: 5006950 - DNA, 18 bp, Homo sapiens
tgtagccttttgactttc

SEQ ID NO: 5006951 - DNA, 22 bp, Homo sapiens
tgtattttcttcacctctgcta

SEQ ID NO: 5006952 - DNA, 20 bp, Homo sapiens
tgtctgtgttttgaaagaat

SEQ ID NO: 5006953 - DNA, 13 bp, Homo sapiens
tgtgaaattccca

SEQ ID NO: 5006954 - DNA, 20 bp, Homo sapiens
tgtgaagcaaactctaaaat

SEQ ID NO: 5006955 - DNA, 19 bp, Homo sapiens
tgtgaccttgagaagattc

SEQ ID NO: 5006956 - DNA, 13 bp, Homo sapiens
tgtgcaatagaag

SEQ ID NO: 5006957 - DNA, 16 bp, Homo sapiens
tgtgcaatagaaggtg

SEQ ID NO: 5006958 - DNA, 13 bp, Homo sapiens
tgtgcattttcta

SEQ ID NO: 5006959 - DNA, 21 bp, Homo sapiens
tgtgcattttctaaacagaga

SEQ ID NO: 5006960 - DNA, 16 bp, Homo sapiens
tgtgttttgaaagaat

SEQ ID NO: 5006961 - DNA, 14 bp, Homo sapiens
tgttaaaaatgtca

SEQ ID NO: 5006962 - DNA, 18 bp, Homo sapiens
tgttcccatcctcttctt

SEQ ID NO: 5006963 - DNA, 19 bp, Homo sapiens
tgttcccatcctcttcttt

SEQ ID NO: 5006964 - DNA, 16 bp, Homo sapiens
tgtttaacttcttata

SEQ ID NO: 5006965 - DNA, 14 bp, Homo sapiens
tgtttatgcttttg

SEQ ID NO: 5006966 - DNA, 16 bp, Homo sapiens
tgtttcctagctgtgt

SEQ ID NO: 5006967 - DNA, 17 bp, Homo sapiens
tgtttctggatttcata

SEQ ID NO: 5006968 - DNA, 18 bp, Homo sapiens
tgttttgcacagccaaat

SEQ ID NO: 5006969 - DNA, 23 bp, Homo sapiens
ttaaacgctctaggtacgatgac

SEQ ID NO: 5006970 - DNA, 19 bp, Homo sapiens
ttaaagaagtatgggaaat

SEQ ID NO: 5006971 - DNA, 15 bp, Homo sapiens
ttaaatagcttttgt

SEQ ID NO: 5006972 - DNA, 21 bp, Homo sapiens
ttaatacaatgatgctatttg

SEQ ID NO: 5006973 - DNA, 22 bp, Homo sapiens
ttaatctccaccagtcattttt

SEQ ID NO: 5006974 - DNA, 15 bp, Homo sapiens
ttaattaaatagctt

SEQ ID NO: 5006975 - DNA, 14 bp, Homo sapiens
ttaccaatcatatt

SEQ ID NO: 5006976 - DNA, 20 bp, Homo sapiens
ttacctgtggatatttgtat

SEQ ID NO: 5006977 - DNA, 14 bp, Homo sapiens
ttactgtgtctttg

SEQ ID NO: 5006978 - DNA, 21 bp, Homo sapiens
ttactttggggctaatttaac

SEQ ID NO: 5006979 - DNA, 23 bp, Homo sapiens
ttagaaattacctgtggatattt

SEQ ID NO: 5006980 - DNA, 16 bp, Homo sapiens
ttagcagtaaaatagc

SEQ ID NO: 5006981 - DNA, 16 bp, Homo sapiens
ttataaaagtgttcat

SEQ ID NO: 5006982 - DNA, 19 bp, Homo sapiens
ttatttcatgattagaaat

SEQ ID NO: 5006983 - DNA, 23 bp, Homo sapiens
ttatttttggcgtggctgactta

SEQ ID NO: 5006984 - DNA, 15 bp, Homo sapiens
ttcaaacatttacca

SEQ ID NO: 5006985 - DNA, 13 bp, Homo sapiens
ttcaaagccattt

SEQ ID NO: 5006986 - DNA, 14 bp, Homo sapiens
ttcaaagccatttt

SEQ ID NO: 5006987 - DNA, 18 bp, Homo sapiens
ttcaaccagggattgttt

SEQ ID NO: 5006988 - DNA, 22 bp, Homo sapiens
ttcaaccagggattgtttctgt

SEQ ID NO: 5006989 - DNA, 16 bp, Homo sapiens
ttcaaccatgaagtct

SEQ ID NO: 5006990 - DNA, 16 bp, Homo sapiens
ttcaacggaaagtgct

SEQ ID NO: 5006991 - DNA, 14 bp, Homo sapiens
ttcacgtagaacat

SEQ ID NO: 5006992 - DNA, 22 bp, Homo sapiens
ttcatactgtaacattcaggaa

SEQ ID NO: 5006993 - DNA, 16 bp, Homo sapiens
ttcatgacagcctcca

SEQ ID NO: 5006994 - DNA, 22 bp, Homo sapiens
ttccagtcatggccaaatgttc

SEQ ID NO: 5006995 - DNA, 22 bp, Homo sapiens
ttccatggccgtgtagaagcat

SEQ ID NO: 5006996 - DNA, 13 bp, Homo sapiens
ttccattctcacc

SEQ ID NO: 5006997 - DNA, 19 bp, Homo sapiens
ttcccatcctcttctttta

SEQ ID NO: 5006998 - DNA, 23 bp, Homo sapiens
ttcccccaaatttaaagaagtat

SEQ ID NO: 5006999 - DNA, 21 bp, Homo sapiens
ttcccccaccccatttctctc

SEQ ID NO: 5007000 - DNA, 18 bp, Homo sapiens
ttcctagctgtgtgaata

SEQ ID NO: 5007001 - DNA, 15 bp, Homo sapiens
ttcctctgctttgaa

SEQ ID NO: 5007002 - DNA, 16 bp, Homo sapiens
ttcctcttttctctgc

SEQ ID NO: 5007003 - DNA, 16 bp, Homo sapiens
ttccttgtagcctttt

SEQ ID NO: 5007004 - DNA, 23 bp, Homo sapiens
ttcgacagcattttcctctgctt

SEQ ID NO: 5007005 - DNA, 16 bp, Homo sapiens
ttcgcttgagaaaaaa

SEQ ID NO: 5007006 - DNA, 20 bp, Homo sapiens
ttctccctccttcccttcct

SEQ ID NO: 5007007 - DNA, 13 bp, Homo sapiens
ttctctgaggaag

SEQ ID NO: 5007008 - DNA, 14 bp, Homo sapiens
ttctgctgttctct

SEQ ID NO: 5007009 - DNA, 13 bp, Homo sapiens
ttctgggaagcaa

SEQ ID NO: 5007010 - DNA, 22 bp, Homo sapiens
ttcttataggaaagcttgagta

SEQ ID NO: 5007011 - DNA, 17 bp, Homo sapiens
ttcttcccattctccat

SEQ ID NO: 5007012 - DNA, 16 bp, Homo sapiens
ttgaacctatttctct

SEQ ID NO: 5007013 - DNA, 21 bp, Homo sapiens
ttgagaaaaaaagaatagttg

SEQ ID NO: 5007014 - DNA, 12 bp, Homo sapiens
ttgagtaaaata

SEQ ID NO: 5007015 - DNA, 14 bp, Homo sapiens
ttgagtaaaataaa

SEQ ID NO: 5007016 - DNA, 18 bp, Homo sapiens
ttgataaccttgaaaaaa

SEQ ID NO: 5007017 - DNA, 15 bp, Homo sapiens
ttgcaattcctgctc

SEQ ID NO: 5007018 - DNA, 19 bp, Homo sapiens
ttgcacagccaaatttaaa

SEQ ID NO: 5007019 - DNA, 15 bp, Homo sapiens
ttgctttgtgttctt

SEQ ID NO: 5007020 - DNA, 16 bp, Homo sapiens
ttgctttgtgttcttt

SEQ ID NO: 5007021 - DNA, 19 bp, Homo sapiens
ttggatattttttacttta

SEQ ID NO: 5007022 - DNA, 17 bp, Homo sapiens
ttgtaaaattatttcat

SEQ ID NO: 5007023 - DNA, 15 bp, Homo sapiens
ttgtagccttttgac

SEQ ID NO: 5007024 - DNA, 19 bp, Homo sapiens
ttgtagtgccactgttgtt

SEQ ID NO: 5007025 - DNA, 13 bp, Homo sapiens
ttgtgtggattct

SEQ ID NO: 5007026 - DNA, 15 bp, Homo sapiens
tttaaaactgttgga

SEQ ID NO: 5007027 - DNA, 18 bp, Homo sapiens
tttaaagtctcagtttct

SEQ ID NO: 5007028 - DNA, 14 bp, Homo sapiens
tttaagaaatagaa

SEQ ID NO: 5007029 - DNA, 19 bp, Homo sapiens
tttactgttatcctattta

SEQ ID NO: 5007030 - DNA, 19 bp, Homo sapiens
tttagcagtaaaatagctg

SEQ ID NO: 5007031 - DNA, 22 bp, Homo sapiens
tttataaaagtgttcattgttt

SEQ ID NO: 5007032 - DNA, 22 bp, Homo sapiens
tttcccccaccccatttctctc

SEQ ID NO: 5007033 - DNA, 17 bp, Homo sapiens
tttcctctgctttgaaa

SEQ ID NO: 5007034 - DNA, 16 bp, Homo sapiens
tttctctcctcacaca

SEQ ID NO: 5007035 - DNA, 12 bp, Homo sapiens
tttctttaactg

SEQ ID NO: 5007036 - DNA, 13 bp, Homo sapiens
tttctttaactgc

SEQ ID NO: 5007037 - DNA, 9 bp, Homo sapiens
tttcttttc

SEQ ID NO: 5007038 - DNA, 13 bp, Homo sapiens
tttgacagtgttt

SEQ ID NO: 5007039 - DNA, 13 bp, Homo sapiens
tttgcattctccc

SEQ ID NO: 5007040 - DNA, 20 bp, Homo sapiens
tttgtaggggaactcatttg

SEQ ID NO: 5007041 - DNA, 13 bp, Homo sapiens
tttgtgcattttc

SEQ ID NO: 5007042 - DNA, 13 bp, Homo sapiens
tttgtgttctttg

SEQ ID NO: 5007043 - DNA, 14 bp, Homo sapiens
ttttaccttcactg

SEQ ID NO: 5007044 - DNA, 14 bp, Homo sapiens
ttttctttaactgc

SEQ ID NO: 5007045 - DNA, 12 bp, Homo sapiens
ttttgaaagaat

SEQ ID NO: 5007046 - DNA, 18 bp, Homo sapiens
ttttgtaacttccatgtg

SEQ ID NO: 5007047 - DNA, 22 bp, Homo sapiens
ttttgttcccatcctcttcttt

SEQ ID NO: 5007048 - DNA, 23 bp, Homo sapiens
tttttcccttcatctgggcactg

SEQ ID NO: 5007049 - DNA, 21 bp, Homo sapiens
tttttcttttcggaaatctta

SEQ ID NO: 5007050 - DNA, 16 bp, Homo sapiens
cctatttctctttctt

SEQ ID NO: 5007051 - DNA, 14 bp, Homo sapiens
cctctgctttgaaa

SEQ ID NO: 5007052 - DNA, 19 bp, Homo sapiens
cctgaggactgatttcaga

SEQ ID NO: 5007053 - DNA, 15 bp, Homo sapiens
cctgcttccatggcc

SEQ ID NO: 5007054 - DNA, 15 bp, Homo sapiens
ccttcgacagcattt

SEQ ID NO: 5007055 - DNA, 16 bp, Homo sapiens
ccttcgacagcatttt

SEQ ID NO: 5007056 - DNA, 18 bp, Homo sapiens
ccttgagaagattcttcc

SEQ ID NO: 5007057 - DNA, 21 bp, Homo sapiens
cctttatttttggcgtggctg

SEQ ID NO: 5007058 - DNA, 16 bp, Homo sapiens
cctttcaaagccattt

SEQ ID NO: 5007059 - DNA, 16 bp, Homo sapiens
cgagagatcaaagatg

SEQ ID NO: 5007060 - DNA, 17 bp, Homo sapiens
cgagagatcaaagatga

SEQ ID NO: 5007061 - DNA, 13 bp, Homo sapiens
cgcttgagaaaaa

SEQ ID NO: 5007062 - DNA, 19 bp, Homo sapiens
ctaaaactacaaaaattaa

SEQ ID NO: 5007063 - DNA, 15 bp, Homo sapiens
ctaaattatttactg

SEQ ID NO: 5007064 - DNA, 23 bp, Homo sapiens
ctacagaaaaaccagaggcagct

SEQ ID NO: 5007065 - DNA, 18 bp, Homo sapiens
ctacagttttaactgtgg

SEQ ID NO: 5007066 - DNA, 20 bp, Homo sapiens
ctacagttttaactgtggat

SEQ ID NO: 5007067 - DNA, 18 bp, Homo sapiens
ctactcaagtagcattta

SEQ ID NO: 5007068 - DNA, 20 bp, Homo sapiens
ctactcaagtagcatttact

SEQ ID NO: 5007069 - DNA, 18 bp, Homo sapiens
ctactgcaccatttaaaa

SEQ ID NO: 5007070 - DNA, 18 bp, Homo sapiens
ctagaaagaatatttggt

SEQ ID NO: 5007071 - DNA, 14 bp, Homo sapiens
ctaggtacgatgac

SEQ ID NO: 5007072 - DNA, 19 bp, Homo sapiens
ctaggtacgatgacagtgt

SEQ ID NO: 5007073 - DNA, 19 bp, Homo sapiens
ctatacttgctttgtgttc

SEQ ID NO: 5007074 - DNA, 12 bp, Homo sapiens
ctatctgtattc

SEQ ID NO: 5007075 - DNA, 18 bp, Homo sapiens
ctatgtggattttttcct

SEQ ID NO: 5007076 - DNA, 17 bp, Homo sapiens
ctcagttcttgccactt

SEQ ID NO: 5007077 - DNA, 11 bp, Homo sapiens
ctcatttactg

SEQ ID NO: 5007078 - DNA, 16 bp, Homo sapiens
ctccccctagccattt

SEQ ID NO: 5007079 - DNA, 15 bp, Homo sapiens
ctccctttcactaaa

SEQ ID NO: 5007080 - DNA, 19 bp, Homo sapiens
ctcctgttttgcacagcca

SEQ ID NO: 5007081 - DNA, 19 bp, Homo sapiens
ctccttcatgacagcctcc

SEQ ID NO: 5007082 - DNA, 17 bp, Homo sapiens
ctctaaaattataaatg

SEQ ID NO: 5007083 - DNA, 23 bp, Homo sapiens
ctctaggtacgatgacagtgttc

SEQ ID NO: 5007084 - DNA, 15 bp, Homo sapiens
ctctgtttatgcttt

SEQ ID NO: 5007085 - DNA, 22 bp, Homo sapiens
ctcttcttttagcagtaaaata

SEQ ID NO: 5007086 - DNA, 15 bp, Homo sapiens
ctgaatagatatgaa

SEQ ID NO: 5007087 - DNA, 17 bp, Homo sapiens
ctgaatctgctaccaaa

SEQ ID NO: 5007088 - DNA, 15 bp, Homo sapiens
ctgatttcccctttt

SEQ ID NO: 5007089 - DNA, 19 bp, Homo sapiens
ctgatttccccttttgcat

SEQ ID NO: 5007090 - DNA, 14 bp, Homo sapiens
ctgcaaaaagaaaa

SEQ ID NO: 5007091 - DNA, 18 bp, Homo sapiens
ctgcaccatttaaaaaca

SEQ ID NO: 5007092 - DNA, 20 bp, Homo sapiens
ctgcactctagcctgggtga

SEQ ID NO: 5007093 - DNA, 23 bp, Homo sapiens
ctgctactcaagtagcatttact

SEQ ID NO: 5007094 - DNA, 18 bp, Homo sapiens
ctgctcacgtcaaatgca

SEQ ID NO: 5007095 - DNA, 12 bp, Homo sapiens
ctgtaaagatgt

SEQ ID NO: 5007096 - DNA, 18 bp, Homo sapiens
ctgtaatcccagcaattt

SEQ ID NO: 5007097 - DNA, 14 bp, Homo sapiens
ctgtatattcagga

SEQ ID NO: 5007098 - DNA, 18 bp, Homo sapiens
ctgtctaaaaaacaaaac

SEQ ID NO: 5007099 - DNA, 13 bp, Homo sapiens
ctgtgggaaatta

SEQ ID NO: 5007100 - DNA, 14 bp, Homo sapiens
cttaatattctgga

SEQ ID NO: 5007101 - DNA, 17 bp, Homo sapiens
cttataggaaagcttga

SEQ ID NO: 5007102 - DNA, 21 bp, Homo sapiens
cttataggaaagcttgagtaa

SEQ ID NO: 5007103 - DNA, 19 bp, Homo sapiens
cttattaaatggaaactga

SEQ ID NO: 5007104 - DNA, 21 bp, Homo sapiens
cttcaaactaggggacaaagc

SEQ ID NO: 5007105 - DNA, 14 bp, Homo sapiens
cttcaaccagggat

SEQ ID NO: 5007106 - DNA, 14 bp, Homo sapiens
cttcacctctgcta

SEQ ID NO: 5007107 - DNA, 19 bp, Homo sapiens
cttcactgtgaccttgaga

SEQ ID NO: 5007108 - DNA, 16 bp, Homo sapiens
cttcatgacagcctcc

SEQ ID NO: 5007109 - DNA, 17 bp, Homo sapiens
cttccttgtagcctttt

SEQ ID NO: 5007110 - DNA, 21 bp, Homo sapiens
cttccttgtagccttttgact

SEQ ID NO: 5007111 - DNA, 23 bp, Homo sapiens
cttcttttagcagtaaaatagct

SEQ ID NO: 5007112 - DNA, 14 bp, Homo sapiens
cttgaaaaaaaaca

SEQ ID NO: 5007113 - DNA, 15 bp, Homo sapiens
cttgagaaaaaaaga

SEQ ID NO: 5007114 - DNA, 21 bp, Homo sapiens
cttgagaagattcttcccatt

SEQ ID NO: 5007115 - DNA, 16 bp, Homo sapiens
cttgagtcacaaagaa

SEQ ID NO: 5007116 - DNA, 12 bp, Homo sapiens
cttgtagccttt

SEQ ID NO: 5007117 - DNA, 17 bp, Homo sapiens
cttgtagccttttgact

SEQ ID NO: 5007118 - DNA, 14 bp, Homo sapiens
ctttagaagcctgc

SEQ ID NO: 5007119 - DNA, 13 bp, Homo sapiens
ctttataaatgta

SEQ ID NO: 5007120 - DNA, 20 bp, Homo sapiens
ctttcactaaaacacacagg

SEQ ID NO: 5007121 - DNA, 19 bp, Homo sapiens
ctttgaaagccccagaaat

SEQ ID NO: 5007122 - DNA, 16 bp, Homo sapiens
ctttgccaagaccttt

SEQ ID NO: 5007123 - DNA, 20 bp, Homo sapiens
ctttgccaagacctttcaaa

SEQ ID NO: 5007124 - DNA, 19 bp, Homo sapiens
ctttgtgttctttgtgtca

SEQ ID NO: 5007125 - DNA, 20 bp, Homo sapiens
ctttgttctgctgttctcta

SEQ ID NO: 5007126 - DNA, 14 bp, Homo sapiens
cttttgcattctcc

SEQ ID NO: 5007127 - DNA, 20 bp, Homo sapiens
gaaaagtatattgataacct

SEQ ID NO: 5007128 - DNA, 19 bp, Homo sapiens
gaaaatctttataaatgta

SEQ ID NO: 5007129 - DNA, 14 bp, Homo sapiens
gaaattaggatgta

SEQ ID NO: 5007130 - DNA, 16 bp, Homo sapiens
gaaccatgtttgtggc

SEQ ID NO: 5007131 - DNA, 19 bp, Homo sapiens
gaacctacagttttaactg

SEQ ID NO: 5007132 - DNA, 20 bp, Homo sapiens
gaacttgtgtccctaatgtg

SEQ ID NO: 5007133 - DNA, 12 bp, Homo sapiens
gaagtatgggaa

SEQ ID NO: 5007134 - DNA, 23 bp, Homo sapiens
gaatagttgaacctatttctctt

SEQ ID NO: 5007135 - DNA, 20 bp, Homo sapiens
gaatgagattaattcctttc

SEQ ID NO: 5007136 - DNA, 21 bp, Homo sapiens
gaatggatttttctttaactg

SEQ ID NO: 5007137 - DNA, 16 bp, Homo sapiens
gaattataaaagccag

SEQ ID NO: 5007138 - DNA, 15 bp, Homo sapiens
gacaactacagaaaa

SEQ ID NO: 5007139 - DNA, 23 bp, Homo sapiens
gacagcattttcctctgctttga

SEQ ID NO: 5007140 - DNA, 16 bp, Homo sapiens
gactgatttcagagtg

SEQ ID NO: 5007141 - DNA, 13 bp, Homo sapiens
gacttgaaagaaa

SEQ ID NO: 5007142 - DNA, 16 bp, Homo sapiens
gagaactttatttcca

SEQ ID NO: 5007143 - DNA, 23 bp, Homo sapiens
gagaagattcttcccattctcca

SEQ ID NO: 5007144 - DNA, 20 bp, Homo sapiens
gagcgagagatcaaagatga

SEQ ID NO: 5007145 - DNA, 19 bp, Homo sapiens
gaggtagaatgactccttg

SEQ ID NO: 5007146 - DNA, 18 bp, Homo sapiens
gagtctcaataaactgaa

SEQ ID NO: 5007147 - DNA, 13 bp, Homo sapiens
gatatttgtgcat

SEQ ID NO: 5007148 - DNA, 16 bp, Homo sapiens
gatccagtataagact

SEQ ID NO: 5007149 - DNA, 14 bp, Homo sapiens
gatgctatttgcaa

SEQ ID NO: 5007150 - DNA, 19 bp, Homo sapiens
gatgctgtgaaattcccaa

SEQ ID NO: 5007151 - DNA, 23 bp, Homo sapiens
gatgttctactttgttctgctgt

SEQ ID NO: 5007152 - DNA, 22 bp, Homo sapiens
gatgttctattttttgttttgt

SEQ ID NO: 5007153 - DNA, 20 bp, Homo sapiens
gattagaaattacctgtgga

SEQ ID NO: 5007154 - DNA, 22 bp, Homo sapiens
gattagaaattacctgtggata

SEQ ID NO: 5007155 - DNA, 15 bp, Homo sapiens
gatttcatactgtaa

SEQ ID NO: 5007156 - DNA, 22 bp, Homo sapiens
gatttcccatcccctgtgggaa

SEQ ID NO: 5007157 - DNA, 17 bp, Homo sapiens
gatttccccttttgcat

SEQ ID NO: 5007158 - DNA, 19 bp, Homo sapiens
gatttccccttttgcattc

SEQ ID NO: 5007159 - DNA, 23 bp, Homo sapiens
gatttccccttttgcattctccc

SEQ ID NO: 5007160 - DNA, 20 bp, Homo sapiens
gcaccatttaaaaacaggca

SEQ ID NO: 5007161 - DNA, 20 bp, Homo sapiens
gcatacaagtttcattctcc

SEQ ID NO: 5007162 - DNA, 14 bp, Homo sapiens
gcatattttgtaac

SEQ ID NO: 5007163 - DNA, 18 bp, Homo sapiens
gcattggatattttttac

SEQ ID NO: 5007164 - DNA, 13 bp, Homo sapiens
gcattttcctctg

SEQ ID NO: 5007165 - DNA, 17 bp, Homo sapiens
gccaaggctctgtttat

SEQ ID NO: 5007166 - DNA, 23 bp, Homo sapiens
gccatgaagaggatgctgtgaaa

SEQ ID NO: 5007167 - DNA, 20 bp, Homo sapiens
gcctgggtgacagagcaaga

SEQ ID NO: 5007168 - DNA, 23 bp, Homo sapiens
gcctttatttttggcgtggctga

SEQ ID NO: 5007169 - DNA, 16 bp, Homo sapiens
gccttttgactttcat

SEQ ID NO: 5007170 - DNA, 19 bp, Homo sapiens
gcgagagatcaaagatgaa

SEQ ID NO: 5007171 - DNA, 20 bp, Homo sapiens
atcctcttcttttagcagta

SEQ ID NO: 5007172 - DNA, 15 bp, Homo sapiens
atctataaactataa

SEQ ID NO: 5007173 - DNA, 21 bp, Homo sapiens
atctgagaaacaatgactaat

SEQ ID NO: 5007174 - DNA, 19 bp, Homo sapiens
atcttaaaccttaagatac

SEQ ID NO: 5007175 - DNA, 15 bp, Homo sapiens
atctttataaatgta

SEQ ID NO: 5007176 - DNA, 22 bp, Homo sapiens
atcttttgttcccatcctcttc

SEQ ID NO: 5007177 - DNA, 17 bp, Homo sapiens
atgacaactacagaaaa

SEQ ID NO: 5007178 - DNA, 16 bp, Homo sapiens
atgactaattcttgca

SEQ ID NO: 5007179 - DNA, 17 bp, Homo sapiens
atgactaattcttgcat

SEQ ID NO: 5007180 - DNA, 17 bp, Homo sapiens
atgagattaattccttt

SEQ ID NO: 5007181 - DNA, 22 bp, Homo sapiens
atgagtctcaataaactgaatt

SEQ ID NO: 5007182 - DNA, 20 bp, Homo sapiens
atgatgacaactacagaaaa

SEQ ID NO: 5007183 - DNA, 14 bp, Homo sapiens
atgcatacaagttt

SEQ ID NO: 5007184 - DNA, 13 bp, Homo sapiens
atgctgtgaaatt

SEQ ID NO: 5007185 - DNA, 15 bp, Homo sapiens
atggatttttcttta

SEQ ID NO: 5007186 - DNA, 16 bp, Homo sapiens
atggatttttctttaa

SEQ ID NO: 5007187 - DNA, 20 bp, Homo sapiens
atggatttttctttaactgc

SEQ ID NO: 5007188 - DNA, 17 bp, Homo sapiens
atggcagggggtggaat

SEQ ID NO: 5007189 - DNA, 21 bp, Homo sapiens
atggccgtgtagaagcatggt

SEQ ID NO: 5007190 - DNA, 20 bp, Homo sapiens
atggtaattcttattctttc

SEQ ID NO: 5007191 - DNA, 17 bp, Homo sapiens
atgtggattttttccta

SEQ ID NO: 5007192 - DNA, 22 bp, Homo sapiens
atgtgttggggaagggcctgcc

SEQ ID NO: 5007193 - DNA, 22 bp, Homo sapiens
atgttgccatcctaccgtcttt

SEQ ID NO: 5007194 - DNA, 14 bp, Homo sapiens
atgtttatttcagg

SEQ ID NO: 5007195 - DNA, 11 bp, Homo sapiens
attaaatagct

SEQ ID NO: 5007196 - DNA, 15 bp, Homo sapiens
attacctgtggatat

SEQ ID NO: 5007197 - DNA, 12 bp, Homo sapiens
attataactgta

SEQ ID NO: 5007198 - DNA, 18 bp, Homo sapiens
attcaggacttgaaagaa

SEQ ID NO: 5007199 - DNA, 15 bp, Homo sapiens
attcctcttttctct

SEQ ID NO: 5007200 - DNA, 18 bp, Homo sapiens
attcttcccattctccat

SEQ ID NO: 5007201 - DNA, 11 bp, Homo sapiens
attggatattt

SEQ ID NO: 5007202 - DNA, 18 bp, Homo sapiens
attgggttccattctcac

SEQ ID NO: 5007203 - DNA, 20 bp, Homo sapiens
attgtaaaattatttcatga

SEQ ID NO: 5007204 - DNA, 15 bp, Homo sapiens
attgtctttttgtat

SEQ ID NO: 5007205 - DNA, 19 bp, Homo sapiens
attgtgtggattctttaaa

SEQ ID NO: 5007206 - DNA, 17 bp, Homo sapiens
atttaaaagcctgctca

SEQ ID NO: 5007207 - DNA, 15 bp, Homo sapiens
atttactgtgtcttt

SEQ ID NO: 5007208 - DNA, 15 bp, Homo sapiens
atttcatgattagaa

SEQ ID NO: 5007209 - DNA, 21 bp, Homo sapiens
atttcccccaccccatttctc

SEQ ID NO: 5007210 - DNA, 15 bp, Homo sapiens
atttccccttttgca

SEQ ID NO: 5007211 - DNA, 18 bp, Homo sapiens
atttctctttctttacaa

SEQ ID NO: 5007212 - DNA, 16 bp, Homo sapiens
atttgtgcattttcta

SEQ ID NO: 5007213 - DNA, 14 bp, Homo sapiens
attttataattctg

SEQ ID NO: 5007214 - DNA, 13 bp, Homo sapiens
caaaacaaaacaa

SEQ ID NO: 5007215 - DNA, 22 bp, Homo sapiens
caaaatatattttgtttacaaa

SEQ ID NO: 5007216 - DNA, 23 bp, Homo sapiens
caaaatggataaaatctgatatg

SEQ ID NO: 5007217 - DNA, 22 bp, Homo sapiens
caaactaggggacaaagcaaaa

SEQ ID NO: 5007218 - DNA, 16 bp, Homo sapiens
caaagaaacaaagatg

SEQ ID NO: 5007219 - DNA, 11 bp, Homo sapiens
caaagtggaac

SEQ ID NO: 5007220 - DNA, 14 bp, Homo sapiens
caaagtggaacgaa

SEQ ID NO: 5007221 - DNA, 18 bp, Homo sapiens
caaatactgtatattcag

SEQ ID NO: 5007222 - DNA, 21 bp, Homo sapiens
caaatgctaatgtcaaacttg

SEQ ID NO: 5007223 - DNA, 19 bp, Homo sapiens
caaatttaaaactgttgga

SEQ ID NO: 5007224 - DNA, 17 bp, Homo sapiens
caaattttatttgtagg

SEQ ID NO: 5007225 - DNA, 21 bp, Homo sapiens
caacactgatttccccttttg

SEQ ID NO: 5007226 - DNA, 15 bp, Homo sapiens
caacagcaaacaggt

SEQ ID NO: 5007227 - DNA, 17 bp, Homo sapiens
caacagcaaacaggtgc

SEQ ID NO: 5007228 - DNA, 17 bp, Homo sapiens
caactacagaaaaacca

SEQ ID NO: 5007229 - DNA, 22 bp, Homo sapiens
caagactctgtctaaaaaacaa

SEQ ID NO: 5007230 - DNA, 23 bp, Homo sapiens
caagactctgtctaaaaaacaaa

SEQ ID NO: 5007231 - DNA, 14 bp, Homo sapiens
caataaactgaatt

SEQ ID NO: 5007232 - DNA, 21 bp, Homo sapiens
caatgactaattcttgcatat

SEQ ID NO: 5007233 - DNA, 17 bp, Homo sapiens
caatgatgctatttgca

SEQ ID NO: 5007234 - DNA, 14 bp, Homo sapiens
caatggcagatgta

SEQ ID NO: 5007235 - DNA, 21 bp, Homo sapiens
caatttggatttaaaagcctg

SEQ ID NO: 5007236 - DNA, 22 bp, Homo sapiens
cacaaaatatattttgtttaca

SEQ ID NO: 5007237 - DNA, 14 bp, Homo sapiens
cacagactcatatt

SEQ ID NO: 5007238 - DNA, 16 bp, Homo sapiens
cacagccaaatttaaa

SEQ ID NO: 5007239 - DNA, 14 bp, Homo sapiens
caccgaaaaactaa

SEQ ID NO: 5007240 - DNA, 21 bp, Homo sapiens
cacctgcactaacagagtggc

SEQ ID NO: 5007241 - DNA, 23 bp, Homo sapiens
cacgcctgtaatcccagcaattt

SEQ ID NO: 5007242 - DNA, 14 bp, Homo sapiens
cactaacagagtgg

SEQ ID NO: 5007243 - DNA, 17 bp, Homo sapiens
cactgtgaccttgagaa

SEQ ID NO: 5007244 - DNA, 16 bp, Homo sapiens
cagactcatattactg

SEQ ID NO: 5007245 - DNA, 18 bp, Homo sapiens
cagatagtgtagctgagg

SEQ ID NO: 5007246 - DNA, 14 bp, Homo sapiens
cagcaaacaggtgc

SEQ ID NO: 5007247 - DNA, 13 bp, Homo sapiens
cagcattttcctc

SEQ ID NO: 5007248 - DNA, 23 bp, Homo sapiens
cagcattttcctctgctttgaaa

SEQ ID NO: 5007249 - DNA, 22 bp, Homo sapiens
caggattcctcttttctctgcc

SEQ ID NO: 5007250 - DNA, 19 bp, Homo sapiens
caggtattttataattctg

SEQ ID NO: 5007251 - DNA, 20 bp, Homo sapiens
caggtgctaatttgttttgg

SEQ ID NO: 5007252 - DNA, 15 bp, Homo sapiens
caggttataacagtg

SEQ ID NO: 5007253 - DNA, 17 bp, Homo sapiens
caggttataacagtgtt

SEQ ID NO: 5007254 - DNA, 20 bp, Homo sapiens
cagtcatttttcagaccttt

SEQ ID NO: 5007255 - DNA, 17 bp, Homo sapiens
cagtgagcagagatcac

SEQ ID NO: 5007256 - DNA, 12 bp, Homo sapiens
cagttttaactg

SEQ ID NO: 5007257 - DNA, 14 bp, Homo sapiens
cagttttaactgtg

SEQ ID NO: 5007258 - DNA, 23 bp, Homo sapiens
cataagagccacaggtctttatg

SEQ ID NO: 5007259 - DNA, 18 bp, Homo sapiens
catatattgggttccatt

SEQ ID NO: 5007260 - DNA, 14 bp, Homo sapiens
catattaatacaat

SEQ ID NO: 5007261 - DNA, 23 bp, Homo sapiens
catattaatacaatgatgctatt

SEQ ID NO: 5007262 - DNA, 17 bp, Homo sapiens
catcctccagatagtgt

SEQ ID NO: 5007263 - DNA, 13 bp, Homo sapiens
catgacagcctcc

SEQ ID NO: 5007264 - DNA, 21 bp, Homo sapiens
catgatgacaactacagaaaa

SEQ ID NO: 5007265 - DNA, 19 bp, Homo sapiens
cattcaggaattcttggag

SEQ ID NO: 5007266 - DNA, 12 bp, Homo sapiens
cattctccattt

SEQ ID NO: 5007267 - DNA, 17 bp, Homo sapiens
cattctccatttgttat

SEQ ID NO: 5007268 - DNA, 12 bp, Homo sapiens
cattgatgctga

SEQ ID NO: 5007269 - DNA, 17 bp, Homo sapiens
catttactgtgtctttg

SEQ ID NO: 5007270 - DNA, 14 bp, Homo sapiens
cattttcctctgct

SEQ ID NO: 5007271 - DNA, 23 bp, Homo sapiens
ccaaaaggtttaagaaatagaat

SEQ ID NO: 5007272 - DNA, 11 bp, Homo sapiens
ccaaatttaaa

SEQ ID NO: 5007273 - DNA, 18 bp, Homo sapiens
ccaaatttaaaactgttg

SEQ ID NO: 5007274 - DNA, 14 bp, Homo sapiens
ccaccagtcatttt

SEQ ID NO: 5007275 - DNA, 18 bp, Homo sapiens
ccaggattcctcttttct

SEQ ID NO: 5007276 - DNA, 18 bp, Homo sapiens
ccagttgcactcaggtga

SEQ ID NO: 5007277 - DNA, 15 bp, Homo sapiens
ccatttaaaaacagg

SEQ ID NO: 5007278 - DNA, 15 bp, Homo sapiens
ccatttctctcctca

SEQ ID NO: 5007279 - DNA, 20 bp, Homo sapiens
cccagttgcactcaggtgac

SEQ ID NO: 5007280 - DNA, 16 bp, Homo sapiens
cccatcccctgtggga

SEQ ID NO: 5007281 - DNA, 14 bp, Homo sapiens
cccctagccatttt

SEQ ID NO: 5007282 - DNA, 19 bp, Homo sapiens
cccctagccatttttactg

SEQ ID NO: 5007283 - DNA, 11 bp, Homo sapiens
ccggaaagaag

SEQ ID NO: 5007284 - DNA, 14 bp, Homo sapiens
ccgtaatttaactt

SEQ ID NO: 5007285 - DNA, 16 bp, Homo sapiens
ccgtcttttcctgttt

SEQ ID NO: 5007286 - DNA, 15 bp, Homo sapiens
cctaaattatttact

SEQ ID NO: 5007287 - DNA, 18 bp, Homo sapiens
cctaacctcgggcctgct

SEQ ID NO: 5007288 - DNA, 23 bp, Homo sapiens
cctaagcaaacccagtgtcagga

SEQ ID NO: 5007289 - DNA, 15 bp, Homo sapiens
cctacagttttaact

SEQ ID NO: 5007290 - DNA, 17 bp, Homo sapiens
cctacagttttaactgt

SEQ ID NO: 5007291 - DNA, 20 bp, Homo sapiens
cctacagttttaactgtgga

SEQ ID NO: 5007292 - DNA, 12 bp, Homo sapiens
cctatttctctt

SEQ ID NO: 5007293 - DNA, 21 bp, Homo sapiens
tcctgttttgcacagccaaat

SEQ ID NO: 5007294 - DNA, 22 bp, Homo sapiens
tcgacagcattttcctctgctt

SEQ ID NO: 5007295 - DNA, 18 bp, Homo sapiens
tctaaaattataaatgac

SEQ ID NO: 5007296 - DNA, 19 bp, Homo sapiens
tctaacaatgtattttctt

SEQ ID NO: 5007297 - DNA, 14 bp, Homo sapiens
tctcaataaactga

SEQ ID NO: 5007298 - DNA, 18 bp, Homo sapiens
tctctgaggaagctgggg

SEQ ID NO: 5007299 - DNA, 12 bp, Homo sapiens
tctctttcttta

SEQ ID NO: 5007300 - DNA, 13 bp, Homo sapiens
tctgtaattgtgt

SEQ ID NO: 5007301 - DNA, 14 bp, Homo sapiens
tctgtctaaaaaac

SEQ ID NO: 5007302 - DNA, 18 bp, Homo sapiens
tctgtgttttgaaagaat

SEQ ID NO: 5007303 - DNA, 16 bp, Homo sapiens
tctgtttatgcttttg

SEQ ID NO: 5007304 - DNA, 14 bp, Homo sapiens
tcttaatattctgg

SEQ ID NO: 5007305 - DNA, 23 bp, Homo sapiens
tcttatcaagagttgtgacaact

SEQ ID NO: 5007306 - DNA, 15 bp, Homo sapiens
tcttcccattctcca

SEQ ID NO: 5007307 - DNA, 19 bp, Homo sapiens
tcttcccattctccatttg

SEQ ID NO: 5007308 - DNA, 17 bp, Homo sapiens
tcttgcatattttgtaa

SEQ ID NO: 5007309 - DNA, 20 bp, Homo sapiens
tctttaactgccgtaattta

SEQ ID NO: 5007310 - DNA, 21 bp, Homo sapiens
tctttaactgccgtaatttaa

SEQ ID NO: 5007311 - DNA, 22 bp, Homo sapiens
tctttaactgccgtaatttaac

SEQ ID NO: 5007312 - DNA, 17 bp, Homo sapiens
tctttgtgtcaacatga

SEQ ID NO: 5007313 - DNA, 16 bp, Homo sapiens
tgaaagccccagaaat

SEQ ID NO: 5007314 - DNA, 17 bp, Homo sapiens
tgaaagccccagaaatc

SEQ ID NO: 5007315 - DNA, 15 bp, Homo sapiens
tgaatttttcttgcg

SEQ ID NO: 5007316 - DNA, 16 bp, Homo sapiens
tgacagtcatgcagtc

SEQ ID NO: 5007317 - DNA, 17 bp, Homo sapiens
tgacctaaattatttac

SEQ ID NO: 5007318 - DNA, 21 bp, Homo sapiens
tgactaacaggccaaagagtc

SEQ ID NO: 5007319 - DNA, 23 bp, Homo sapiens
tgactaattcttgcatattttgt

SEQ ID NO: 5007320 - DNA, 14 bp, Homo sapiens
tgagattaattcct

SEQ ID NO: 5007321 - DNA, 17 bp, Homo sapiens
tgaggactgatttcaga

SEQ ID NO: 5007322 - DNA, 22 bp, Homo sapiens
tgagtaaaataaatattgtctt

SEQ ID NO: 5007323 - DNA, 18 bp, Homo sapiens
tgagtctcaataaactga

SEQ ID NO: 5007324 - DNA, 14 bp, Homo sapiens
tgatacatttttgt

SEQ ID NO: 5007325 - DNA, 15 bp, Homo sapiens
tgatatgtattgttt

SEQ ID NO: 5007326 - DNA, 16 bp, Homo sapiens
tgatatttgtgcattt

SEQ ID NO: 5007327 - DNA, 21 bp, Homo sapiens
tgatctacttctgtaattgtg

SEQ ID NO: 5007328 - DNA, 17 bp, Homo sapiens
tgatttccccttttgca

SEQ ID NO: 5007329 - DNA, 17 bp, Homo sapiens
tgcactaacagagtggc

SEQ ID NO: 5007330 - DNA, 17 bp, Homo sapiens
tgcataatgtttctgga

SEQ ID NO: 5007331 - DNA, 21 bp, Homo sapiens
tgcattctccctccttccctt

SEQ ID NO: 5007332 - DNA, 16 bp, Homo sapiens
tgcatttgatacattt

SEQ ID NO: 5007333 - DNA, 20 bp, Homo sapiens
tgctaggcccccgggtgtga

SEQ ID NO: 5007334 - DNA, 20 bp, Homo sapiens
tgctcaggagacctggagga

SEQ ID NO: 5007335 - DNA, 21 bp, Homo sapiens
tgctgtcttaaactaaatgtg

SEQ ID NO: 5007336 - DNA, 17 bp, Homo sapiens
tgctgtgaaattcccaa

SEQ ID NO: 5007337 - DNA, 14 bp, Homo sapiens
tgctttgtgttctt

SEQ ID NO: 5007338 - DNA, 21 bp, Homo sapiens
tgcttttggggggcatatatt

SEQ ID NO: 5007339 - DNA, 13 bp, Homo sapiens
tggagaaaatggg

SEQ ID NO: 5007340 - DNA, 22 bp, Homo sapiens
tggagaaaatgggtttattcac

SEQ ID NO: 5007341 - DNA, 14 bp, Homo sapiens
tggatcacaaagtg

SEQ ID NO: 5007342 - DNA, 18 bp, Homo sapiens
tggatttaaaagcctgct

SEQ ID NO: 5007343 - DNA, 23 bp, Homo sapiens
tggatttcccatcccctgtggga

SEQ ID NO: 5007344 - DNA, 18 bp, Homo sapiens
tggatttttctttaactg

SEQ ID NO: 5007345 - DNA, 22 bp, Homo sapiens
tggccatgaagaggatgctgtg

SEQ ID NO: 5007346 - DNA, 17 bp, Homo sapiens
tggccatgatgacaact

SEQ ID NO: 5007347 - DNA, 15 bp, Homo sapiens
tggcttctctgagga

SEQ ID NO: 5007348 - DNA, 16 bp, Homo sapiens
tggcttctctgaggaa

SEQ ID NO: 5007349 - DNA, 12 bp, Homo sapiens
tgggcactgaag

SEQ ID NO: 5007350 - DNA, 19 bp, Homo sapiens
tggtattcgcttgagaaaa

SEQ ID NO: 5007351 - DNA, 21 bp, Homo sapiens
tgtaaagttattcttgaagtc

SEQ ID NO: 5007352 - DNA, 16 bp, Homo sapiens
tgtaaatctgctcagg

SEQ ID NO: 5007353 - DNA, 21 bp, Homo sapiens
tgtaaggatccggaaagaaga

SEQ ID NO: 5007354 - DNA, 19 bp, Homo sapiens
tgtaatcccagctactcgg

SEQ ID NO: 5007355 - DNA, 15 bp, Homo sapiens
tgtagaagcatggtg

SEQ ID NO: 5007356 - DNA, 20 bp, Homo sapiens
tgtcttaaactaaatgtgca

SEQ ID NO: 5007357 - DNA, 22 bp, Homo sapiens
tgtgaagcacagaccccttcca

SEQ ID NO: 5007358 - DNA, 16 bp, Homo sapiens
tgtgagtaatctgaga

SEQ ID NO: 5007359 - DNA, 14 bp, Homo sapiens
tgtgcattttctaa

SEQ ID NO: 5007360 - DNA, 19 bp, Homo sapiens
tgtgcattttctaaacaga

SEQ ID NO: 5007361 - DNA, 16 bp, Homo sapiens
tgtggattttttccta

SEQ ID NO: 5007362 - DNA, 22 bp, Homo sapiens
tgtggctattaaaactctttta

SEQ ID NO: 5007363 - DNA, 23 bp, Homo sapiens
tgtgttactaaaaaaaagatgaa

SEQ ID NO: 5007364 - DNA, 13 bp, Homo sapiens
tgttatcctattt

SEQ ID NO: 5007365 - DNA, 14 bp, Homo sapiens
tgttcaaacattta

SEQ ID NO: 5007366 - DNA, 15 bp, Homo sapiens
tgttctactttgttc

SEQ ID NO: 5007367 - DNA, 14 bp, Homo sapiens
tgttctgctgttct

SEQ ID NO: 5007368 - DNA, 18 bp, Homo sapiens
tgttctgctgttctctag

SEQ ID NO: 5007369 - DNA, 13 bp, Homo sapiens
tgtttatttcagg

SEQ ID NO: 5007370 - DNA, 16 bp, Homo sapiens
tgttttaataacttat

SEQ ID NO: 5007371 - DNA, 19 bp, Homo sapiens
ttaaatggaaactgaaact

SEQ ID NO: 5007372 - DNA, 19 bp, Homo sapiens
ttaactgccgtaatttaac

SEQ ID NO: 5007373 - DNA, 15 bp, Homo sapiens
ttaattcctttccag

SEQ ID NO: 5007374 - DNA, 15 bp, Homo sapiens
ttacagtctatttga

SEQ ID NO: 5007375 - DNA, 12 bp, Homo sapiens
ttacctgtggat

SEQ ID NO: 5007376 - DNA, 13 bp, Homo sapiens
ttacctgtggata

SEQ ID NO: 5007377 - DNA, 18 bp, Homo sapiens
ttactttagaagcctgca

SEQ ID NO: 5007378 - DNA, 13 bp, Homo sapiens
ttagaagcctgca

SEQ ID NO: 5007379 - DNA, 16 bp, Homo sapiens
ttagacctgtgttact

SEQ ID NO: 5007380 - DNA, 19 bp, Homo sapiens
ttagcagtaaaatagctga

SEQ ID NO: 5007381 - DNA, 12 bp, Homo sapiens
ttataaaagtgt

SEQ ID NO: 5007382 - DNA, 22 bp, Homo sapiens
ttatcaagagttgtgacaactt

SEQ ID NO: 5007383 - DNA, 12 bp, Homo sapiens
ttatgcttttgg

SEQ ID NO: 5007384 - DNA, 16 bp, Homo sapiens
ttattaaatggaaact

SEQ ID NO: 5007385 - DNA, 22 bp, Homo sapiens
ttcaacaaagaaacaaagatgt

SEQ ID NO: 5007386 - DNA, 13 bp, Homo sapiens
ttcacaatgttaa

SEQ ID NO: 5007387 - DNA, 19 bp, Homo sapiens
ttcacagtacccaaactgc

SEQ ID NO: 5007388 - DNA, 23 bp, Homo sapiens
ttcacagtacccaaactgctttt

SEQ ID NO: 5007389 - DNA, 15 bp, Homo sapiens
ttccagtcatggcca

SEQ ID NO: 5007390 - DNA, 13 bp, Homo sapiens
ttcctctgctttg

SEQ ID NO: 5007391 - DNA, 23 bp, Homo sapiens
ttcctgagggatctatacttgct

SEQ ID NO: 5007392 - DNA, 16 bp, Homo sapiens
ttcgacagcattttcc

SEQ ID NO: 5007393 - DNA, 14 bp, Homo sapiens
ttcgcttgagaaaa

SEQ ID NO: 5007394 - DNA, 14 bp, Homo sapiens
ttctaaacagagat

SEQ ID NO: 5007395 - DNA, 11 bp, Homo sapiens
ttctctttctt

SEQ ID NO: 5007396 - DNA, 12 bp, Homo sapiens
ttctgtttaact

SEQ ID NO: 5007397 - DNA, 19 bp, Homo sapiens
ttctttaactgccgtaatt

SEQ ID NO: 5007398 - DNA, 19 bp, Homo sapiens
ttctttgtgtcaacatgaa

SEQ ID NO: 5007399 - DNA, 14 bp, Homo sapiens
ttgaaagaatagaa

SEQ ID NO: 5007400 - DNA, 19 bp, Homo sapiens
ttgaacctatttctctttc

SEQ ID NO: 5007401 - DNA, 18 bp, Homo sapiens
ttgatatttgtgcatttt

SEQ ID NO: 5007402 - DNA, 21 bp, Homo sapiens
ttgatatttgtgcattttcta

SEQ ID NO: 5007403 - DNA, 17 bp, Homo sapiens
ttgatgctgacagtcat

SEQ ID NO: 5007404 - DNA, 18 bp, Homo sapiens
ttgcatattttgtaactt

SEQ ID NO: 5007405 - DNA, 17 bp, Homo sapiens
ttgccaagacctttcaa

SEQ ID NO: 5007406 - DNA, 21 bp, Homo sapiens
ttggatttaaaagcctgctca

SEQ ID NO: 5007407 - DNA, 16 bp, Homo sapiens
ttggggggcatatatt

SEQ ID NO: 5007408 - DNA, 16 bp, Homo sapiens
ttgggttccattctca

SEQ ID NO: 5007409 - DNA, 17 bp, Homo sapiens
ttgtggctattaaaact

SEQ ID NO: 5007410 - DNA, 13 bp, Homo sapiens
ttgtgttctttgt

SEQ ID NO: 5007411 - DNA, 15 bp, Homo sapiens
ttgttaaaaatgtca

SEQ ID NO: 5007412 - DNA, 16 bp, Homo sapiens
ttgttacgtagcctaa

SEQ ID NO: 5007413 - DNA, 19 bp, Homo sapiens
ttgttctgctgttctctag

SEQ ID NO: 5007414 - DNA, 11 bp, Homo sapiens
tttaaattgtg

SEQ ID NO: 5007415 - DNA, 22 bp, Homo sapiens
aagaagagcgagagatcaaaga

SEQ ID NO: 5007416 - DNA, 15 bp, Homo sapiens
aagagccacaggtct

SEQ ID NO: 5007417 - DNA, 18 bp, Homo sapiens
aagagcgagagatcaaag

SEQ ID NO: 5007418 - DNA, 21 bp, Homo sapiens
aagagcgagagatcaaagatg

SEQ ID NO: 5007419 - DNA, 23 bp, Homo sapiens
aagagcgagagatcaaagatgaa

SEQ ID NO: 5007420 - DNA, 14 bp, Homo sapiens
aagaggatgctgtg

SEQ ID NO: 5007421 - DNA, 23 bp, Homo sapiens
aagagtgtggagtcattctcatt

SEQ ID NO: 5007422 - DNA, 22 bp, Homo sapiens
aagatgggtccaggattcctct

SEQ ID NO: 5007423 - DNA, 15 bp, Homo sapiens
aagattcttcccatt

SEQ ID NO: 5007424 - DNA, 15 bp, Homo sapiens
aagggatatgtgaaa

SEQ ID NO: 5007425 - DNA, 15 bp, Homo sapiens
aagtatgggaaatga

SEQ ID NO: 5007426 - DNA, 17 bp, Homo sapiens
aagtctctaacaatgta

SEQ ID NO: 5007427 - DNA, 14 bp, Homo sapiens
aagtgttcattgtt

SEQ ID NO: 5007428 - DNA, 16 bp, Homo sapiens
aataaatattgtcttt

SEQ ID NO: 5007429 - DNA, 22 bp, Homo sapiens
aataaattttttataaaagtgt

SEQ ID NO: 5007430 - DNA, 13 bp, Homo sapiens
aatagaaggtgat

SEQ ID NO: 5007431 - DNA, 15 bp, Homo sapiens
aatagcttttgtgtc

SEQ ID NO: 5007432 - DNA, 19 bp, Homo sapiens
aatatattttgtttacaaa

SEQ ID NO: 5007433 - DNA, 19 bp, Homo sapiens
aatcatattaatacaatga

SEQ ID NO: 5007434 - DNA, 21 bp, Homo sapiens
aatctccaccagtcatttttc

SEQ ID NO: 5007435 - DNA, 17 bp, Homo sapiens
aatgactaattcttgca

SEQ ID NO: 5007436 - DNA, 17 bp, Homo sapiens
aatgagaggcatttccc

SEQ ID NO: 5007437 - DNA, 18 bp, Homo sapiens
aatgagattaattccttt

SEQ ID NO: 5007438 - DNA, 14 bp, Homo sapiens
aatggaaactgaaa

SEQ ID NO: 5007439 - DNA, 13 bp, Homo sapiens
aatggatttttct

SEQ ID NO: 5007440 - DNA, 18 bp, Homo sapiens
aatggatttttctttaac

SEQ ID NO: 5007441 - DNA, 23 bp, Homo sapiens
aatgtattttcttcacctctgct

SEQ ID NO: 5007442 - DNA, 14 bp, Homo sapiens
aattacctgtggat

SEQ ID NO: 5007443 - DNA, 21 bp, Homo sapiens
aattagtaggctcatttactg

SEQ ID NO: 5007444 - DNA, 17 bp, Homo sapiens
aattcttgcatattttg

SEQ ID NO: 5007445 - DNA, 23 bp, Homo sapiens
aatttatttttaccttcactgtg

SEQ ID NO: 5007446 - DNA, 12 bp, Homo sapiens
aatttggattta

SEQ ID NO: 5007447 - DNA, 17 bp, Homo sapiens
acaaagaaacaaagatg

SEQ ID NO: 5007448 - DNA, 15 bp, Homo sapiens
acaactacagaaaaa

SEQ ID NO: 5007449 - DNA, 18 bp, Homo sapiens
acaagtggcaacctgctt

SEQ ID NO: 5007450 - DNA, 20 bp, Homo sapiens
acaatgactaattcttgcat

SEQ ID NO: 5007451 - DNA, 20 bp, Homo sapiens
acaatgatgctatttgcaat

SEQ ID NO: 5007452 - DNA, 20 bp, Homo sapiens
acagagactgaatagatatg

SEQ ID NO: 5007453 - DNA, 15 bp, Homo sapiens
acagcattttcctct

SEQ ID NO: 5007454 - DNA, 18 bp, Homo sapiens
acagcattttcctctgct

SEQ ID NO: 5007455 - DNA, 19 bp, Homo sapiens
acagcattttcctctgctt

SEQ ID NO: 5007456 - DNA, 18 bp, Homo sapiens
acaggtgctaatttgttt

SEQ ID NO: 5007457 - DNA, 23 bp, Homo sapiens
acagtctatttgagactcctcag

SEQ ID NO: 5007458 - DNA, 17 bp, Homo sapiens
acagtggatcacaaagt

SEQ ID NO: 5007459 - DNA, 17 bp, Homo sapiens
acagttttaactgtgga

SEQ ID NO: 5007460 - DNA, 18 bp, Homo sapiens
acattcaacagagactga

SEQ ID NO: 5007461 - DNA, 19 bp, Homo sapiens
acattcaggaattcttgga

SEQ ID NO: 5007462 - DNA, 18 bp, Homo sapiens
acatttaccaatcatatt

SEQ ID NO: 5007463 - DNA, 18 bp, Homo sapiens
accactgcactctagcct

SEQ ID NO: 5007464 - DNA, 16 bp, Homo sapiens
accagggattgtttct

SEQ ID NO: 5007465 - DNA, 21 bp, Homo sapiens
accatttaaaaacaggcagct

SEQ ID NO: 5007466 - DNA, 18 bp, Homo sapiens
acctacagttttaactgt

SEQ ID NO: 5007467 - DNA, 19 bp, Homo sapiens
acctacagttttaactgtg

SEQ ID NO: 5007468 - DNA, 10 bp, Homo sapiens
acctgtggat

SEQ ID NO: 5007469 - DNA, 13 bp, Homo sapiens
acctgtggatatt

SEQ ID NO: 5007470 - DNA, 22 bp, Homo sapiens
accttcactgtgaccttgagaa

SEQ ID NO: 5007471 - DNA, 23 bp, Homo sapiens
accttgaaaaaaaacagtggatc

SEQ ID NO: 5007472 - DNA, 15 bp, Homo sapiens
acctttcaaagccat

SEQ ID NO: 5007473 - DNA, 17 bp, Homo sapiens
actaaaaaaaagatgaa

SEQ ID NO: 5007474 - DNA, 18 bp, Homo sapiens
actaacaggccaaagagt

SEQ ID NO: 5007475 - DNA, 13 bp, Homo sapiens
actacacacagta

SEQ ID NO: 5007476 - DNA, 22 bp, Homo sapiens
actcatattactggtaggaact

SEQ ID NO: 5007477 - DNA, 15 bp, Homo sapiens
actctgtctaaaaaa

SEQ ID NO: 5007478 - DNA, 12 bp, Homo sapiens
actgatttcccc

SEQ ID NO: 5007479 - DNA, 19 bp, Homo sapiens
actgatttccccttttgca

SEQ ID NO: 5007480 - DNA, 21 bp, Homo sapiens
actgatttccccttttgcatt

SEQ ID NO: 5007481 - DNA, 22 bp, Homo sapiens
actgatttccccttttgcattc

SEQ ID NO: 5007482 - DNA, 23 bp, Homo sapiens
actgatttccccttttgcattct

SEQ ID NO: 5007483 - DNA, 13 bp, Homo sapiens
actgtaaagatgt

SEQ ID NO: 5007484 - DNA, 15 bp, Homo sapiens
actgtggatattgtt

SEQ ID NO: 5007485 - DNA, 21 bp, Homo sapiens
acttctgtaattgtgtggatt

SEQ ID NO: 5007486 - DNA, 16 bp, Homo sapiens
actttagaagcctgca

SEQ ID NO: 5007487 - DNA, 18 bp, Homo sapiens
actttccatatcaagaga

SEQ ID NO: 5007488 - DNA, 18 bp, Homo sapiens
ctttggggctaatttaac

SEQ ID NO: 5007489 - DNA, 16 bp, Homo sapiens
cttttagcagtaaaat

SEQ ID NO: 5007490 - DNA, 12 bp, Homo sapiens
cttttctctgcc

SEQ ID NO: 5007491 - DNA, 17 bp, Homo sapiens
cttttgttcccatcctc

SEQ ID NO: 5007492 - DNA, 16 bp, Homo sapiens
gaaatagaattataac

SEQ ID NO: 5007493 - DNA, 20 bp, Homo sapiens
gaaatgagaggcatttcccc

SEQ ID NO: 5007494 - DNA, 15 bp, Homo sapiens
gaaattacctgtgga

SEQ ID NO: 5007495 - DNA, 20 bp, Homo sapiens
gaacatgtagaaaacaaaat

SEQ ID NO: 5007496 - DNA, 17 bp, Homo sapiens
gaacctatttctctttc

SEQ ID NO: 5007497 - DNA, 18 bp, Homo sapiens
gaacctatttctctttct

SEQ ID NO: 5007498 - DNA, 21 bp, Homo sapiens
gaacctatttctctttcttta

SEQ ID NO: 5007499 - DNA, 16 bp, Homo sapiens
gaacgaaaatgaaagc

SEQ ID NO: 5007500 - DNA, 21 bp, Homo sapiens
gaagattcttcccattctcca

SEQ ID NO: 5007501 - DNA, 22 bp, Homo sapiens
gaagcatggtgccctggcttct

SEQ ID NO: 5007502 - DNA, 22 bp, Homo sapiens
gaagctgaggcaggtgaattgt

SEQ ID NO: 5007503 - DNA, 17 bp, Homo sapiens
gaagctggggttcatga

SEQ ID NO: 5007504 - DNA, 18 bp, Homo sapiens
gaagggatatgtgaaaca

SEQ ID NO: 5007505 - DNA, 22 bp, Homo sapiens
gaagggcctgcccagttgcact

SEQ ID NO: 5007506 - DNA, 19 bp, Homo sapiens
gaaggtgatgttgccatcc

SEQ ID NO: 5007507 - DNA, 16 bp, Homo sapiens
gaatagatatgaaagc

SEQ ID NO: 5007508 - DNA, 14 bp, Homo sapiens
gaattataactgta

SEQ ID NO: 5007509 - DNA, 14 bp, Homo sapiens
gaatttttcttgcg

SEQ ID NO: 5007510 - DNA, 16 bp, Homo sapiens
gaatttttcttgcgaa

SEQ ID NO: 5007511 - DNA, 20 bp, Homo sapiens
gacagcattttcctctgctt

SEQ ID NO: 5007512 - DNA, 20 bp, Homo sapiens
gacagtgttccccgatacca

SEQ ID NO: 5007513 - DNA, 14 bp, Homo sapiens
gagatcaaagatga

SEQ ID NO: 5007514 - DNA, 20 bp, Homo sapiens
gagatcaaagatgaaaagta

SEQ ID NO: 5007515 - DNA, 22 bp, Homo sapiens
gagcagagatcacaccactgca

SEQ ID NO: 5007516 - DNA, 17 bp, Homo sapiens
gagcgagagatcaaaga

SEQ ID NO: 5007517 - DNA, 21 bp, Homo sapiens
gagctcttggaggtgtctgta

SEQ ID NO: 5007518 - DNA, 15 bp, Homo sapiens
gaggtagaatgactc

SEQ ID NO: 5007519 - DNA, 15 bp, Homo sapiens
gagtaatctgagaaa

SEQ ID NO: 5007520 - DNA, 16 bp, Homo sapiens
gataaccttgaaaaaa

SEQ ID NO: 5007521 - DNA, 19 bp, Homo sapiens
gataccatgctgtaaggat

SEQ ID NO: 5007522 - DNA, 13 bp, Homo sapiens
gatactaaggacg

SEQ ID NO: 5007523 - DNA, 15 bp, Homo sapiens
gatatgaaagctgat

SEQ ID NO: 5007524 - DNA, 15 bp, Homo sapiens
gatatgtgaaacaat

SEQ ID NO: 5007525 - DNA, 17 bp, Homo sapiens
gatatgtgaaacaatgt

SEQ ID NO: 5007526 - DNA, 12 bp, Homo sapiens
gatcaaagatga

SEQ ID NO: 5007527 - DNA, 18 bp, Homo sapiens
gatcaaagatgaaaagta

SEQ ID NO: 5007528 - DNA, 16 bp, Homo sapiens
gatctatacttgcttt

SEQ ID NO: 5007529 - DNA, 24 bp, Homo sapiens
gatcttttgttcccatcctcttct

SEQ ID NO: 5007530 - DNA, 18 bp, Homo sapiens
gatgacaactacagaaaa

SEQ ID NO: 5007531 - DNA, 18 bp, Homo sapiens
gatttaaaagcctgctca

SEQ ID NO: 5007532 - DNA, 20 bp, Homo sapiens
gatttcccatcccctgtggg

SEQ ID NO: 5007533 - DNA, 16 bp, Homo sapiens
gatttccccttttgca

SEQ ID NO: 5007534 - DNA, 13 bp, Homo sapiens
gatttttctttaa

SEQ ID NO: 5007535 - DNA, 14 bp, Homo sapiens
gcaacctgcttcca

SEQ ID NO: 5007536 - DNA, 17 bp, Homo sapiens
gcacagccaaatttaaa

SEQ ID NO: 5007537 - DNA, 18 bp, Homo sapiens
gcagtggaggtagaatga

SEQ ID NO: 5007538 - DNA, 18 bp, Homo sapiens
gcagtgtctgtgttttga

SEQ ID NO: 5007539 - DNA, 12 bp, Homo sapiens
gcattggatatt

SEQ ID NO: 5007540 - DNA, 18 bp, Homo sapiens
gcatttactgtgtctttg

SEQ ID NO: 5007541 - DNA, 15 bp, Homo sapiens
gcattttcctctgct

SEQ ID NO: 5007542 - DNA, 18 bp, Homo sapiens
gcattttcctctgctttg

SEQ ID NO: 5007543 - DNA, 21 bp, Homo sapiens
gcattttcctctgctttgaaa

SEQ ID NO: 5007544 - DNA, 21 bp, Homo sapiens
gccaaatttaaaactgttgga

SEQ ID NO: 5007545 - DNA, 12 bp, Homo sapiens
aaaaaaagatga

SEQ ID NO: 5007546 - DNA, 19 bp, Homo sapiens
aaaacagtggatcacaaag

SEQ ID NO: 5007547 - DNA, 12 bp, Homo sapiens
aaaactctttta

SEQ ID NO: 5007548 - DNA, 19 bp, Homo sapiens
aaaatgaaagctactcata

SEQ ID NO: 5007549 - DNA, 16 bp, Homo sapiens
aaacaaaacaaaacaa

SEQ ID NO: 5007550 - DNA, 12 bp, Homo sapiens
aaacaaagatgt

SEQ ID NO: 5007551 - DNA, 12 bp, Homo sapiens
aaacaggcagct

SEQ ID NO: 5007552 - DNA, 23 bp, Homo sapiens
aaacagtggatcacaaagtggaa

SEQ ID NO: 5007553 - DNA, 21 bp, Homo sapiens
aaacatttaccaatcatatta

SEQ ID NO: 5007554 - DNA, 15 bp, Homo sapiens
aaaccagaggcagct

SEQ ID NO: 5007555 - DNA, 16 bp, Homo sapiens
aaagccattttaggct

SEQ ID NO: 5007556 - DNA, 19 bp, Homo sapiens
aaagcttgagtaaaataaa

SEQ ID NO: 5007557 - DNA, 20 bp, Homo sapiens
aaaggtttaagaaatagaat

SEQ ID NO: 5007558 - DNA, 20 bp, Homo sapiens
aaagtggaacgaaaatgaaa

SEQ ID NO: 5007559 - DNA, 21 bp, Homo sapiens
aaagtgtgaaataaatttttt

SEQ ID NO: 5007560 - DNA, 21 bp, Homo sapiens
aaattaggatgtaaatctgct

SEQ ID NO: 5007561 - DNA, 20 bp, Homo sapiens
aaattcccaacaaacattga

SEQ ID NO: 5007562 - DNA, 18 bp, Homo sapiens
aaatttctgtaaaacagg

SEQ ID NO: 5007563 - DNA, 20 bp, Homo sapiens
aacaatgactaattcttgca

SEQ ID NO: 5007564 - DNA, 22 bp, Homo sapiens
aacactgatttccccttttgca

SEQ ID NO: 5007565 - DNA, 15 bp, Homo sapiens
aacatgaacaaattt

SEQ ID NO: 5007566 - DNA, 15 bp, Homo sapiens
aaccagggattgttt

SEQ ID NO: 5007567 - DNA, 19 bp, Homo sapiens
aaccagggattgtttctgt

SEQ ID NO: 5007568 - DNA, 20 bp, Homo sapiens
aaccatgaagtctctaacaa

SEQ ID NO: 5007569 - DNA, 12 bp, Homo sapiens
aacctatttctc

SEQ ID NO: 5007570 - DNA, 18 bp, Homo sapiens
aacctatttctctttctt

SEQ ID NO: 5007571 - DNA, 15 bp, Homo sapiens
aactagcattgtaaa

SEQ ID NO: 5007572 - DNA, 14 bp, Homo sapiens
aactcttttaacag

SEQ ID NO: 5007573 - DNA, 18 bp, Homo sapiens
aactgaatttttcttgcg

SEQ ID NO: 5007574 - DNA, 21 bp, Homo sapiens
aactgatccagtataagacta

SEQ ID NO: 5007575 - DNA, 14 bp, Homo sapiens
aactgtaaagatgt

SEQ ID NO: 5007576 - DNA, 18 bp, Homo sapiens
aactgtggatattgttac

SEQ ID NO: 5007577 - DNA, 22 bp, Homo sapiens
aacttcttataggaaagcttga

SEQ ID NO: 5007578 - DNA, 12 bp, Homo sapiens
aagaaatagaat

SEQ ID NO: 5007579 - DNA, 13 bp, Homo sapiens
aagaaatggtgaa

SEQ ID NO: 5007580 - DNA, 16 bp, Homo sapiens
aagatgttatggtgtt

SEQ ID NO: 5007581 - DNA, 21 bp, Homo sapiens
aagcaaactctaaaattataa

SEQ ID NO: 5007582 - DNA, 16 bp, Homo sapiens
aaggatccggaaagaa

SEQ ID NO: 5007583 - DNA, 21 bp, Homo sapiens
aagggtgttgggagggtggtt

SEQ ID NO: 5007584 - DNA, 20 bp, Homo sapiens
agtcattctcattgaattat

SEQ ID NO: 5007585 - DNA, 18 bp, Homo sapiens
agtgtggagtcattctca

SEQ ID NO: 5007586 - DNA, 17 bp, Homo sapiens
agttgaacctatttctc

SEQ ID NO: 5007587 - DNA, 13 bp, Homo sapiens
agttttaactgtg

SEQ ID NO: 5007588 - DNA, 20 bp, Homo sapiens
ataaatattgtctttttgta

SEQ ID NO: 5007589 - DNA, 21 bp, Homo sapiens
ataaatattgtctttttgtat

SEQ ID NO: 5007590 - DNA, 23 bp, Homo sapiens
ataaatattgtctttttgtatgt

SEQ ID NO: 5007591 - DNA, 21 bp, Homo sapiens
atacaatgatgctatttgcaa

SEQ ID NO: 5007592 - DNA, 22 bp, Homo sapiens
atacaatgatgctatttgcaat

SEQ ID NO: 5007593 - DNA, 12 bp, Homo sapiens
atacttgctttg

SEQ ID NO: 5007594 - DNA, 21 bp, Homo sapiens
atatattgggttccattctca

SEQ ID NO: 5007595 - DNA, 14 bp, Homo sapiens
atatcaagagacat

SEQ ID NO: 5007596 - DNA, 17 bp, Homo sapiens
atatgaaagctgatttt

SEQ ID NO: 5007597 - DNA, 16 bp, Homo sapiens
atatttggttttcctg

SEQ ID NO: 5007598 - DNA, 15 bp, Homo sapiens
tccccctagccattt

SEQ ID NO: 5007599 - DNA, 18 bp, Homo sapiens
tccccttttgcattctcc

SEQ ID NO: 5007600 - DNA, 14 bp, Homo sapiens
tccctaatgtgttt

SEQ ID NO: 5007601 - DNA, 20 bp, Homo sapiens
tccctgaggactgatttcag

SEQ ID NO: 5007602 - DNA, 21 bp, Homo sapiens
tccctgaggactgatttcaga

SEQ ID NO: 5007603 - DNA, 12 bp, Homo sapiens
tccggaaagaag

SEQ ID NO: 5007604 - DNA, 15 bp, Homo sapiens
tcctctgctttgaaa

SEQ ID NO: 5007605 - DNA, 14 bp, Homo sapiens
tcctttccaggtat

SEQ ID NO: 5007606 - DNA, 22 bp, Homo sapiens
tctcaggttaagtgtgagtaat

SEQ ID NO: 5007607 - DNA, 18 bp, Homo sapiens
tctctttctttacaagat

SEQ ID NO: 5007608 - DNA, 15 bp, Homo sapiens
tctgagaaacaatga

SEQ ID NO: 5007609 - DNA, 12 bp, Homo sapiens
tcttaaactaaa

SEQ ID NO: 5007610 - DNA, 18 bp, Homo sapiens
tcttaatattctggagtc

SEQ ID NO: 5007611 - DNA, 14 bp, Homo sapiens
tcttattctttcgt

SEQ ID NO: 5007612 - DNA, 21 bp, Homo sapiens
tcttattctttcgttcagtta

SEQ ID NO: 5007613 - DNA, 20 bp, Homo sapiens
tcttcaaccagggattgttt

SEQ ID NO: 5007614 - DNA, 13 bp, Homo sapiens
tcttcccattctc

SEQ ID NO: 5007615 - DNA, 21 bp, Homo sapiens
tcttcttttagcagtaaaata

SEQ ID NO: 5007616 - DNA, 16 bp, Homo sapiens
tgaaaaaaaacagtgg

SEQ ID NO: 5007617 - DNA, 16 bp, Homo sapiens
tgaaagctgatttttt

SEQ ID NO: 5007618 - DNA, 16 bp, Homo sapiens
tgaagaggatgctgtg

SEQ ID NO: 5007619 - DNA, 22 bp, Homo sapiens
tgaagcaaactctaaaattata

SEQ ID NO: 5007620 - DNA, 19 bp, Homo sapiens
tgaatgcctatggtggatc

SEQ ID NO: 5007621 - DNA, 15 bp, Homo sapiens
tgaattgtttgaacc

SEQ ID NO: 5007622 - DNA, 16 bp, Homo sapiens
tgacaactacagaaaa

SEQ ID NO: 5007623 - DNA, 17 bp, Homo sapiens
tgactttcattggaaat

SEQ ID NO: 5007624 - DNA, 17 bp, Homo sapiens
tgagaactttatttcca

SEQ ID NO: 5007625 - DNA, 22 bp, Homo sapiens
tgagaagattcttcccattctc

SEQ ID NO: 5007626 - DNA, 23 bp, Homo sapiens
tgagtcacaaagaacatgtagaa

SEQ ID NO: 5007627 - DNA, 14 bp, Homo sapiens
cagcccaccctgct

SEQ ID NO: 5007628 - DNA, 18 bp, Homo sapiens
cagctccccagcccacct

SEQ ID NO: 5007629 - DNA, 24 bp, Homo sapiens
cagctgtcccttgcttgcctgcag

SEQ ID NO: 5007630 - DNA, 21 bp, Homo sapiens
caggaacctgtcctaaggaac

SEQ ID NO: 5007631 - DNA, 12 bp, Homo sapiens
caggaggcaggc

SEQ ID NO: 5007632 - DNA, 14 bp, Homo sapiens
caggcatggccctg

SEQ ID NO: 5007633 - DNA, 16 bp, Homo sapiens
caggcatggccctggg

SEQ ID NO: 5007634 - DNA, 18 bp, Homo sapiens
caggcctgtggctccctt

SEQ ID NO: 5007635 - DNA, 17 bp, Homo sapiens
cagggaagccccacatg

SEQ ID NO: 5007636 - DNA, 23 bp, Homo sapiens
cagggaaggcctgacttctgctg

SEQ ID NO: 5007637 - DNA, 22 bp, Homo sapiens
cagggagacggtttccagggag

SEQ ID NO: 5007638 - DNA, 14 bp, Homo sapiens
cagggagcagggaa

SEQ ID NO: 5007639 - DNA, 21 bp, Homo sapiens
cagggaggggccggccctgtg

SEQ ID NO: 5007640 - DNA, 22 bp, Homo sapiens
cagggaggggccggccctgtgt

SEQ ID NO: 5007641 - DNA, 22 bp, Homo sapiens
cagggcaccatccagctcccca

SEQ ID NO: 5007642 - DNA, 18 bp, Homo sapiens
cagggccatggctcaggg

SEQ ID NO: 5007643 - DNA, 22 bp, Homo sapiens
cagggccatggctcagggtggt

SEQ ID NO: 5007644 - DNA, 16 bp, Homo sapiens
cagggggagaatgggt

SEQ ID NO: 5007645 - DNA, 13 bp, Homo sapiens
cagggtgggcctc

SEQ ID NO: 5007646 - DNA, 12 bp, Homo sapiens
caggtgcagagg

SEQ ID NO: 5007647 - DNA, 16 bp, Homo sapiens
cagtactttgtgcatt

SEQ ID NO: 5007648 - DNA, 20 bp, Homo sapiens
cagtctgaatgctgccacaa

SEQ ID NO: 5007649 - DNA, 13 bp, Homo sapiens
cagtcttcccagc

SEQ ID NO: 5007650 - DNA, 20 bp, Homo sapiens
cagtctttgccctgaatggt

SEQ ID NO: 5007651 - DNA, 15 bp, Homo sapiens
cagtgcagaatgtaa

SEQ ID NO: 5007652 - DNA, 14 bp, Homo sapiens
cagtgcagatggag

SEQ ID NO: 5007653 - DNA, 20 bp, Homo sapiens
cagtgcatggtggccagagg

SEQ ID NO: 5007654 - DNA, 14 bp, Homo sapiens
cagtgcctcacctt

SEQ ID NO: 5007655 - DNA, 14 bp, Homo sapiens
cagtgtctgtctga

SEQ ID NO: 5007656 - DNA, 22 bp, Homo sapiens
cagtgttttggactccatctct

SEQ ID NO: 5007657 - DNA, 23 bp, Homo sapiens
cataacttcctgtacttgaagtc

SEQ ID NO: 5007658 - DNA, 15 bp, Homo sapiens
catagcaacaggaaa

SEQ ID NO: 5007659 - DNA, 12 bp, Homo sapiens
catatttatcca

SEQ ID NO: 5007660 - DNA, 13 bp, Homo sapiens
catattttttgta

SEQ ID NO: 5007661 - DNA, 13 bp, Homo sapiens
catcacagggtgg

SEQ ID NO: 5007662 - DNA, 19 bp, Homo sapiens
catcacagggtgggcctcg

SEQ ID NO: 5007663 - DNA, 14 bp, Homo sapiens
catcattccctctc

SEQ ID NO: 5007664 - DNA, 20 bp, Homo sapiens
catcattccctctcatctca

SEQ ID NO: 5007665 - DNA, 15 bp, Homo sapiens
catccagctccccag

SEQ ID NO: 5007666 - DNA, 17 bp, Homo sapiens
catccgcgtgtgcctgt

SEQ ID NO: 5007667 - DNA, 16 bp, Homo sapiens
catccttcagtgaact

SEQ ID NO: 5007668 - DNA, 16 bp, Homo sapiens
catctctcatcctcca

SEQ ID NO: 5007669 - DNA, 17 bp, Homo sapiens
catctctcatcctccag

SEQ ID NO: 5007670 - DNA, 18 bp, Homo sapiens
catctgatgccgtgatcc

SEQ ID NO: 5007671 - DNA, 16 bp, Homo sapiens
catcttgcctccaggt

SEQ ID NO: 5007672 - DNA, 23 bp, Homo sapiens
catcttgcctccaggtgcagagg

SEQ ID NO: 5007673 - DNA, 15 bp, Homo sapiens
catgagactcagtgc

SEQ ID NO: 5007674 - DNA, 19 bp, Homo sapiens
catgagactcagtgcagat

SEQ ID NO: 5007675 - DNA, 15 bp, Homo sapiens
catgaggaaggaaca

SEQ ID NO: 5007676 - DNA, 15 bp, Homo sapiens
catgatttagcaagc

SEQ ID NO: 5007677 - DNA, 19 bp, Homo sapiens
catgatttagcaagcaact

SEQ ID NO: 5007678 - DNA, 14 bp, Homo sapiens
catgcaagcagagg

SEQ ID NO: 5007679 - DNA, 15 bp, Homo sapiens
catgcaagcagagga

SEQ ID NO: 5007680 - DNA, 19 bp, Homo sapiens
catgccaggaacctgtcct

SEQ ID NO: 5007681 - DNA, 14 bp, Homo sapiens
catgcttcatcatt

SEQ ID NO: 5007682 - DNA, 13 bp, Homo sapiens
catggtggccaga

SEQ ID NO: 5007683 - DNA, 22 bp, Homo sapiens
catgtatggaatcccactgtat

SEQ ID NO: 5007684 - DNA, 12 bp, Homo sapiens
catgtccaaaga

SEQ ID NO: 5007685 - DNA, 17 bp, Homo sapiens
catgtccaaagaggctg

SEQ ID NO: 5007686 - DNA, 21 bp, Homo sapiens
catgtccaaagaggctgcccc

SEQ ID NO: 5007687 - DNA, 19 bp, Homo sapiens
catgtccagcaccttgtgc

SEQ ID NO: 5007688 - DNA, 21 bp, Homo sapiens
catgtcgctagccagtgctcc

SEQ ID NO: 5007689 - DNA, 18 bp, Homo sapiens
catgtttttaacttttaa

SEQ ID NO: 5007690 - DNA, 15 bp, Homo sapiens
atgttattagatgtt

SEQ ID NO: 5007691 - DNA, 15 bp, Homo sapiens
atgtttttaactttt

SEQ ID NO: 5007692 - DNA, 22 bp, Homo sapiens
attagatgttacaagtttatat

SEQ ID NO: 5007693 - DNA, 16 bp, Homo sapiens
attatgcattatatca

SEQ ID NO: 5007694 - DNA, 16 bp, Homo sapiens
attccctctcatctca

SEQ ID NO: 5007695 - DNA, 22 bp, Homo sapiens
attccggaaactagtgtacatt

SEQ ID NO: 5007696 - DNA, 17 bp, Homo sapiens
attcctctcaccccact

SEQ ID NO: 5007697 - DNA, 18 bp, Homo sapiens
attcctctcaccccactc

SEQ ID NO: 5007698 - DNA, 20 bp, Homo sapiens
attcctctcaccccactcct

SEQ ID NO: 5007699 - DNA, 15 bp, Homo sapiens
attctgaggccctgc

SEQ ID NO: 5007700 - DNA, 17 bp, Homo sapiens
attctgaggccctgccc

SEQ ID NO: 5007701 - DNA, 21 bp, Homo sapiens
attctggttccctgctgcgct

SEQ ID NO: 5007702 - DNA, 17 bp, Homo sapiens
attgaattggaaagact

SEQ ID NO: 5007703 - DNA, 15 bp, Homo sapiens
attgccaagtcagat

SEQ ID NO: 5007704 - DNA, 18 bp, Homo sapiens
attgctgtgtgtcccagg

SEQ ID NO: 5007705 - DNA, 19 bp, Homo sapiens
attgctgtgtgtcccaggc

SEQ ID NO: 5007706 - DNA, 15 bp, Homo sapiens
atttaaaaaaaagaa

SEQ ID NO: 5007707 - DNA, 16 bp, Homo sapiens
atttaaaaaaaagaaa

SEQ ID NO: 5007708 - DNA, 18 bp, Homo sapiens
atttaaaaaaaagaaact

SEQ ID NO: 5007709 - DNA, 23 bp, Homo sapiens
atttaatttgtaaaacttctgct

SEQ ID NO: 5007710 - DNA, 21 bp, Homo sapiens
atttataaacagacaatatgt

SEQ ID NO: 5007711 - DNA, 23 bp, Homo sapiens
atttataaacagacaatatgtga

SEQ ID NO: 5007712 - DNA, 18 bp, Homo sapiens
atttatccaaaatgtgta

SEQ ID NO: 5007713 - DNA, 18 bp, Homo sapiens
atttatgggcccctggca

SEQ ID NO: 5007714 - DNA, 19 bp, Homo sapiens
atttatgggcccctggcac

SEQ ID NO: 5007715 - DNA, 14 bp, Homo sapiens
atttattgagtttt

SEQ ID NO: 5007716 - DNA, 21 bp, Homo sapiens
atttctataaatagatgctgt

SEQ ID NO: 5007717 - DNA, 18 bp, Homo sapiens
atttctccatcctgcaga

SEQ ID NO: 5007718 - DNA, 22 bp, Homo sapiens
atttggtatatactttgccact

SEQ ID NO: 5007719 - DNA, 19 bp, Homo sapiens
atttgtaaaacttctgctc

SEQ ID NO: 5007720 - DNA, 21 bp, Homo sapiens
atttgtaaaacttctgctcgt

SEQ ID NO: 5007721 - DNA, 19 bp, Homo sapiens
atttgtaaagctatttatg

SEQ ID NO: 5007722 - DNA, 17 bp, Homo sapiens
attttatgatcagtgtt

SEQ ID NO: 5007723 - DNA, 19 bp, Homo sapiens
attttgctggaattcctaa

SEQ ID NO: 5007724 - DNA, 15 bp, Homo sapiens
caaaaggtttattcc

SEQ ID NO: 5007725 - DNA, 14 bp, Homo sapiens
caaaatgtgtattt

SEQ ID NO: 5007726 - DNA, 13 bp, Homo sapiens
caaaccggcaggt

SEQ ID NO: 5007727 - DNA, 12 bp, Homo sapiens
caaagaggctgc

SEQ ID NO: 5007728 - DNA, 18 bp, Homo sapiens
caaagcacttaagtgtta

SEQ ID NO: 5007729 - DNA, 12 bp, Homo sapiens
caaagctgagcc

SEQ ID NO: 5007730 - DNA, 23 bp, Homo sapiens
caaagctgagcctgcagggaagc

SEQ ID NO: 5007731 - DNA, 18 bp, Homo sapiens
caaattgtgcagtacttt

SEQ ID NO: 5007732 - DNA, 14 bp, Homo sapiens
caacatccactgtt

SEQ ID NO: 5007733 - DNA, 15 bp, Homo sapiens
caacatgcactgatg

SEQ ID NO: 5007734 - DNA, 12 bp, Homo sapiens
caacatttatat

SEQ ID NO: 5007735 - DNA, 16 bp, Homo sapiens
caagaggtgggagggc

SEQ ID NO: 5007736 - DNA, 14 bp, Homo sapiens
caagcagaggacca

SEQ ID NO: 5007737 - DNA, 21 bp, Homo sapiens
caagcagaggaccagggcctt

SEQ ID NO: 5007738 - DNA, 14 bp, Homo sapiens
caagtttatatata

SEQ ID NO: 5007739 - DNA, 16 bp, Homo sapiens
caatatgtgagtgcct

SEQ ID NO: 5007740 - DNA, 20 bp, Homo sapiens
caatatgtgagtgccttttg

SEQ ID NO: 5007741 - DNA, 20 bp, Homo sapiens
cacaacccttctctgttggt

SEQ ID NO: 5007742 - DNA, 20 bp, Homo sapiens
cacactgtcatgcttcatca

SEQ ID NO: 5007743 - DNA, 21 bp, Homo sapiens
cacactgtcatgcttcatcat

SEQ ID NO: 5007744 - DNA, 23 bp, Homo sapiens
cacagagagggagagcagagaaa

SEQ ID NO: 5007745 - DNA, 16 bp, Homo sapiens
cacagggtgggcctcg

SEQ ID NO: 5007746 - DNA, 16 bp, Homo sapiens
cacagtcttcccagca

SEQ ID NO: 5007747 - DNA, 18 bp, Homo sapiens
cacatccgcgtgtgcctg

SEQ ID NO: 5007748 - DNA, 23 bp, Homo sapiens
cacatccgcgtgtgcctgtgtgc

SEQ ID NO: 5007749 - DNA, 12 bp, Homo sapiens
caccaaggaaac

SEQ ID NO: 5007750 - DNA, 17 bp, Homo sapiens
caccatccagctcccca

SEQ ID NO: 5007751 - DNA, 14 bp, Homo sapiens
caccattttgtaaa

SEQ ID NO: 5007752 - DNA, 12 bp, Homo sapiens
cacccaaagctg

SEQ ID NO: 5007753 - DNA, 12 bp, Homo sapiens
caccccactcct

SEQ ID NO: 5007754 - DNA, 14 bp, Homo sapiens
cacctgctcccagg

SEQ ID NO: 5007755 - DNA, 22 bp, Homo sapiens
ccaggtgcagaggtaccctggg

SEQ ID NO: 5007756 - DNA, 15 bp, Homo sapiens
ccagtgaagatattt

SEQ ID NO: 5007757 - DNA, 19 bp, Homo sapiens
ccagtgcatggtggccaga

SEQ ID NO: 5007758 - DNA, 19 bp, Homo sapiens
ccagtgcctcaccttccaa

SEQ ID NO: 5007759 - DNA, 19 bp, Homo sapiens
ccagtggatgccacagccc

SEQ ID NO: 5007760 - DNA, 13 bp, Homo sapiens
ccatcctgcagat

SEQ ID NO: 5007761 - DNA, 20 bp, Homo sapiens
ccatcctgcagatactttga

SEQ ID NO: 5007762 - DNA, 15 bp, Homo sapiens
ccatgccaggaacct

SEQ ID NO: 5007763 - DNA, 17 bp, Homo sapiens
ccatggctcagggtggt

SEQ ID NO: 5007764 - DNA, 20 bp, Homo sapiens
ccatgtccaaagaggctgcc

SEQ ID NO: 5007765 - DNA, 19 bp, Homo sapiens
ccatttcctcagcttatct

SEQ ID NO: 5007766 - DNA, 17 bp, Homo sapiens
cccaagctgattttatt

SEQ ID NO: 5007767 - DNA, 15 bp, Homo sapiens
cccacatgtccagca

SEQ ID NO: 5007768 - DNA, 13 bp, Homo sapiens
cccacccggtggg

SEQ ID NO: 5007769 - DNA, 15 bp, Homo sapiens
cccaccctgctgctg

SEQ ID NO: 5007770 - DNA, 12 bp, Homo sapiens
cccacctgctcc

SEQ ID NO: 5007771 - DNA, 14 bp, Homo sapiens
cccacctgctccca

SEQ ID NO: 5007772 - DNA, 17 bp, Homo sapiens
cccacctgctcccaggc

SEQ ID NO: 5007773 - DNA, 16 bp, Homo sapiens
cccagcccacctgctc

SEQ ID NO: 5007774 - DNA, 17 bp, Homo sapiens
cccagcccacctgctcc

SEQ ID NO: 5007775 - DNA, 16 bp, Homo sapiens
cccaggccccaggcct

SEQ ID NO: 5007776 - DNA, 19 bp, Homo sapiens
cccaggcctgtggctccct

SEQ ID NO: 5007777 - DNA, 22 bp, Homo sapiens
cccagggggtctcacccatgca

SEQ ID NO: 5007778 - DNA, 14 bp, Homo sapiens
cccagtgcatggtg

SEQ ID NO: 5007779 - DNA, 18 bp, Homo sapiens
cccagtgcatggtggcca

SEQ ID NO: 5007780 - DNA, 16 bp, Homo sapiens
cccagtgcctcacctt

SEQ ID NO: 5007781 - DNA, 23 bp, Homo sapiens
cccataacaattcccccatcctt

SEQ ID NO: 5007782 - DNA, 16 bp, Homo sapiens
cccatgcaagcagagg

SEQ ID NO: 5007783 - DNA, 21 bp, Homo sapiens
cccatgcaagcagaggaccag

SEQ ID NO: 5007784 - DNA, 16 bp, Homo sapiens
ccccaacatgcactga

SEQ ID NO: 5007785 - DNA, 19 bp, Homo sapiens
ccccagcccacctgctccc

SEQ ID NO: 5007786 - DNA, 22 bp, Homo sapiens
ccccagggggtctcacccatgc

SEQ ID NO: 5007787 - DNA, 11 bp, Homo sapiens
cccccatcctt

SEQ ID NO: 5007788 - DNA, 14 bp, Homo sapiens
cccccatccttcag

SEQ ID NO: 5007789 - DNA, 13 bp, Homo sapiens
ccccgctgctgtg

SEQ ID NO: 5007790 - DNA, 21 bp, Homo sapiens
ccccggcatgagactcagtgc

SEQ ID NO: 5007791 - DNA, 21 bp, Homo sapiens
cccctcccacacccaaagctg

SEQ ID NO: 5007792 - DNA, 12 bp, Homo sapiens
cccgacatggct

SEQ ID NO: 5007793 - DNA, 15 bp, Homo sapiens
cccgaccgggccagg

SEQ ID NO: 5007794 - DNA, 15 bp, Homo sapiens
cccgagtgactctgg

SEQ ID NO: 5007795 - DNA, 16 bp, Homo sapiens
cccgcgcagctgccta

SEQ ID NO: 5007796 - DNA, 12 bp, Homo sapiens
cccgctgctgtg

SEQ ID NO: 5007797 - DNA, 16 bp, Homo sapiens
cccgctgctgtgcaac

SEQ ID NO: 5007798 - DNA, 14 bp, Homo sapiens
cccgtggggcaggg

SEQ ID NO: 5007799 - DNA, 22 bp, Homo sapiens
cccgtggggcagggagctgggc

SEQ ID NO: 5007800 - DNA, 15 bp, Homo sapiens
ccctctcatctcagg

SEQ ID NO: 5007801 - DNA, 15 bp, Homo sapiens
ccctctcctccctct

SEQ ID NO: 5007802 - DNA, 21 bp, Homo sapiens
ccctgaaacctagtactgccc

SEQ ID NO: 5007803 - DNA, 10 bp, Homo sapiens
ccctgctgcg

SEQ ID NO: 5007804 - DNA, 17 bp, Homo sapiens
ccctgctgcgctgcttg

SEQ ID NO: 5007805 - DNA, 22 bp, Homo sapiens
ccctgggtgtccccgctgctgt

SEQ ID NO: 5007806 - DNA, 15 bp, Homo sapiens
ccctggtcggagagg

SEQ ID NO: 5007807 - DNA, 17 bp, Homo sapiens
ccctggtcggagaggga

SEQ ID NO: 5007808 - DNA, 11 bp, Homo sapiens
ccctgtgtgca

SEQ ID NO: 5007809 - DNA, 12 bp, Homo sapiens
cccttctctgtt

SEQ ID NO: 5007810 - DNA, 14 bp, Homo sapiens
cccttgctgtatgc

SEQ ID NO: 5007811 - DNA, 13 bp, Homo sapiens
ccgacatggctcc

SEQ ID NO: 5007812 - DNA, 14 bp, Homo sapiens
ccgaccgggccagg

SEQ ID NO: 5007813 - DNA, 14 bp, Homo sapiens
ccgcgcagctgcct

SEQ ID NO: 5007814 - DNA, 17 bp, Homo sapiens
ccgcggcccgcgcagct

SEQ ID NO: 5007815 - DNA, 17 bp, Homo sapiens
ccgcgtgtgcctgtgtg

SEQ ID NO: 5007816 - DNA, 22 bp, Homo sapiens
ccggcatgagactcagtgcaga

SEQ ID NO: 5007817 - DNA, 17 bp, Homo sapiens
accatccagctccccag

SEQ ID NO: 5007818 - DNA, 22 bp, Homo sapiens
accatttcctcagcttatctct

SEQ ID NO: 5007819 - DNA, 12 bp, Homo sapiens
acccagtgcaga

SEQ ID NO: 5007820 - DNA, 13 bp, Homo sapiens
acccattcagaga

SEQ ID NO: 5007821 - DNA, 16 bp, Homo sapiens
acccctgactcatcat

SEQ ID NO: 5007822 - DNA, 13 bp, Homo sapiens
acccctgtttctg

SEQ ID NO: 5007823 - DNA, 18 bp, Homo sapiens
accctgggggcacaggag

SEQ ID NO: 5007824 - DNA, 22 bp, Homo sapiens
accctgggggcacaggaggcag

SEQ ID NO: 5007825 - DNA, 18 bp, Homo sapiens
accgagaaggtttatccc

SEQ ID NO: 5007826 - DNA, 21 bp, Homo sapiens
accgaggggcctttgttctgg

SEQ ID NO: 5007827 - DNA, 17 bp, Homo sapiens
acctcctctcagtgttt

SEQ ID NO: 5007828 - DNA, 19 bp, Homo sapiens
acctctgacaactgtgaag

SEQ ID NO: 5007829 - DNA, 13 bp, Homo sapiens
acctgctcccagg

SEQ ID NO: 5007830 - DNA, 15 bp, Homo sapiens
acctgtttctctgcc

SEQ ID NO: 5007831 - DNA, 16 bp, Homo sapiens
accttccaacactcca

SEQ ID NO: 5007832 - DNA, 14 bp, Homo sapiens
acctttcaaagctt

SEQ ID NO: 5007833 - DNA, 16 bp, Homo sapiens
accttttgcatttctt

SEQ ID NO: 5007834 - DNA, 14 bp, Homo sapiens
acgcttttctttgt

SEQ ID NO: 5007835 - DNA, 21 bp, Homo sapiens
acggaggcctgcgaccctggg

SEQ ID NO: 5007836 - DNA, 23 bp, Homo sapiens
acggccaagaatgtacgtccagc

SEQ ID NO: 5007837 - DNA, 22 bp, Homo sapiens
acgtctgaagcttgactcccaa

SEQ ID NO: 5007838 - DNA, 20 bp, Homo sapiens
acgtgctccgtagctctgct

SEQ ID NO: 5007839 - DNA, 22 bp, Homo sapiens
acgttggttaaataaacttttt

SEQ ID NO: 5007840 - DNA, 20 bp, Homo sapiens
actcaacatttgtctggtct

SEQ ID NO: 5007841 - DNA, 21 bp, Homo sapiens
actccatctctcatcctccag

SEQ ID NO: 5007842 - DNA, 12 bp, Homo sapiens
actcctccctcc

SEQ ID NO: 5007843 - DNA, 23 bp, Homo sapiens
actcctgacgtctgaagcttgac

SEQ ID NO: 5007844 - DNA, 15 bp, Homo sapiens
actctaactctgaga

SEQ ID NO: 5007845 - DNA, 16 bp, Homo sapiens
actctaactctgagag

SEQ ID NO: 5007846 - DNA, 12 bp, Homo sapiens
ttccctgctgcg

SEQ ID NO: 5007847 - DNA, 12 bp, Homo sapiens
ttcctcagctta

SEQ ID NO: 5007848 - DNA, 15 bp, Homo sapiens
ttcgtgtactgcaaa

SEQ ID NO: 5007849 - DNA, 22 bp, Homo sapiens
ttctagagttttatagcctgga

SEQ ID NO: 5007850 - DNA, 17 bp, Homo sapiens
ttctataaatagatgct

SEQ ID NO: 5007851 - DNA, 16 bp, Homo sapiens
ttctcccaagctgatt

SEQ ID NO: 5007852 - DNA, 21 bp, Homo sapiens
ttctctgccgctacctccctc

SEQ ID NO: 5007853 - DNA, 16 bp, Homo sapiens
ttctgcagttctcatg

SEQ ID NO: 5007854 - DNA, 21 bp, Homo sapiens
ttctgctgaaagactcgagaa

SEQ ID NO: 5007855 - DNA, 18 bp, Homo sapiens
ttctggggcaggctgggc

SEQ ID NO: 5007856 - DNA, 20 bp, Homo sapiens
ttctggggggacccagtgca

SEQ ID NO: 5007857 - DNA, 23 bp, Homo sapiens
ttctggggggacccagtgcagaa

SEQ ID NO: 5007858 - DNA, 21 bp, Homo sapiens
ttctgtactgttactgggccc

SEQ ID NO: 5007859 - DNA, 23 bp, Homo sapiens
ttctgttttgtttggcaaggaaa

SEQ ID NO: 5007860 - DNA, 14 bp, Homo sapiens
ttcttacacactgt

SEQ ID NO: 5007861 - DNA, 16 bp, Homo sapiens
ttcttacgcaatgctt

SEQ ID NO: 5007862 - DNA, 16 bp, Homo sapiens
ttcttactgataattt

SEQ ID NO: 5007863 - DNA, 20 bp, Homo sapiens
ttcttatacgcttttctttg

SEQ ID NO: 5007864 - DNA, 16 bp, Homo sapiens
ttgaaaatgcaactct

SEQ ID NO: 5007865 - DNA, 19 bp, Homo sapiens
ttgaagtgcagctcatgtt

SEQ ID NO: 5007866 - DNA, 21 bp, Homo sapiens
ttgaagtgcagctcatgtttt

SEQ ID NO: 5007867 - DNA, 17 bp, Homo sapiens
ttgacctggactgaagt

SEQ ID NO: 5007868 - DNA, 18 bp, Homo sapiens
ttgacctggactgaagtt

SEQ ID NO: 5007869 - DNA, 21 bp, Homo sapiens
ttgcagaagagggtgtgtttg

SEQ ID NO: 5007870 - DNA, 22 bp, Homo sapiens
ggtgcagaggtaccctgggtgt

SEQ ID NO: 5007871 - DNA, 17 bp, Homo sapiens
ggtggccagaggtgtca

SEQ ID NO: 5007872 - DNA, 11 bp, Homo sapiens
ggtgggacccc

SEQ ID NO: 5007873 - DNA, 23 bp, Homo sapiens
gtaaagctatttatgggcccctg

SEQ ID NO: 5007874 - DNA, 17 bp, Homo sapiens
gtaatttaatttgtaaa

SEQ ID NO: 5007875 - DNA, 13 bp, Homo sapiens
gtaccctgggtgt

SEQ ID NO: 5007876 - DNA, 18 bp, Homo sapiens
gtacctcctctcagtgtt

SEQ ID NO: 5007877 - DNA, 19 bp, Homo sapiens
gtacctcctctcagtgttt

SEQ ID NO: 5007878 - DNA, 23 bp, Homo sapiens
gtaccttgcttcttactgataat

SEQ ID NO: 5007879 - DNA, 14 bp, Homo sapiens
gtactgcaaagtgt

SEQ ID NO: 5007880 - DNA, 19 bp, Homo sapiens
gtactgccccccatgagga

SEQ ID NO: 5007881 - DNA, 12 bp, Homo sapiens
gtagctctgctg

SEQ ID NO: 5007882 - DNA, 16 bp, Homo sapiens
gtatatactttgccac

SEQ ID NO: 5007883 - DNA, 17 bp, Homo sapiens
gtatatactttgccact

SEQ ID NO: 5007884 - DNA, 18 bp, Homo sapiens
gtatttaaaaaaaagaaa

SEQ ID NO: 5007885 - DNA, 20 bp, Homo sapiens
gtatttaaaaaaaagaaact

SEQ ID NO: 5007886 - DNA, 22 bp, Homo sapiens
gtatttaaaaaaaagaaacttt

SEQ ID NO: 5007887 - DNA, 22 bp, Homo sapiens
gtatttggtatatactttgcca

SEQ ID NO: 5007888 - DNA, 14 bp, Homo sapiens
gtattttcatacaa

SEQ ID NO: 5007889 - DNA, 22 bp, Homo sapiens
gtatttttatttttgcacaact

SEQ ID NO: 5007890 - DNA, 19 bp, Homo sapiens
gtcacaacccttctctgtt

SEQ ID NO: 5007891 - DNA, 13 bp, Homo sapiens
gtcaccaaggaaa

SEQ ID NO: 5007892 - DNA, 13 bp, Homo sapiens
gtccacagagagg

SEQ ID NO: 5007893 - DNA, 19 bp, Homo sapiens
gtccagcaccttgtgcctg

SEQ ID NO: 5007894 - DNA, 14 bp, Homo sapiens
gtccccgctgctgt

SEQ ID NO: 5007895 - DNA, 20 bp, Homo sapiens
gtccctagcagcccaccctg

SEQ ID NO: 5007896 - DNA, 21 bp, Homo sapiens
gtccctagcagcccaccctgc

SEQ ID NO: 5007897 - DNA, 21 bp, Homo sapiens
gtccctataataaaggctgag

SEQ ID NO: 5007898 - DNA, 11 bp, Homo sapiens
gtcccttgctg

SEQ ID NO: 5007899 - DNA, 18 bp, Homo sapiens
gtcctaaggaaccttcct

SEQ ID NO: 5007900 - DNA, 19 bp, Homo sapiens
gtcctaattcttctgtcct

SEQ ID NO: 5007901 - DNA, 16 bp, Homo sapiens
gtcctcagggagcagg

SEQ ID NO: 5007902 - DNA, 22 bp, Homo sapiens
gtctcttcttggggcccagtgc

SEQ ID NO: 5007903 - DNA, 22 bp, Homo sapiens
gtctgggcagctgtcccttgct

SEQ ID NO: 5007904 - DNA, 20 bp, Homo sapiens
gtctgtatagtgtctgtatt

SEQ ID NO: 5007905 - DNA, 21 bp, Homo sapiens
gtctgtgtgtgtgtgtgtgcg

SEQ ID NO: 5007906 - DNA, 13 bp, Homo sapiens
gtgacgctgctga

SEQ ID NO: 5007907 - DNA, 14 bp, Homo sapiens
gtgatctgctgctg

SEQ ID NO: 5007908 - DNA, 15 bp, Homo sapiens
gtgatctgctgctga

SEQ ID NO: 5007909 - DNA, 21 bp, Homo sapiens
gtgattttatgatcagtgttg

SEQ ID NO: 5007910 - DNA, 12 bp, Homo sapiens
gtgcagaatgta

SEQ ID NO: 5007911 - DNA, 13 bp, Homo sapiens
gtgcagaatgtaa

SEQ ID NO: 5007912 - DNA, 19 bp, Homo sapiens
gtgcagaggtaccctgggt

SEQ ID NO: 5007913 - DNA, 15 bp, Homo sapiens
gtgcagatggagaga

SEQ ID NO: 5007914 - DNA, 12 bp, Homo sapiens
gtgcctcacctt

SEQ ID NO: 5007915 - DNA, 14 bp, Homo sapiens
gtgcctgtgtgcgt

SEQ ID NO: 5007916 - DNA, 22 bp, Homo sapiens
gtgctgcagcaccgaggggcct

SEQ ID NO: 5007917 - DNA, 12 bp, Homo sapiens
gtggagggaggc

SEQ ID NO: 5007918 - DNA, 18 bp, Homo sapiens
gtggattctgaggccctg

SEQ ID NO: 5007919 - DNA, 13 bp, Homo sapiens
gtggccagaggtg

SEQ ID NO: 5007920 - DNA, 22 bp, Homo sapiens
gtggccctgaacctcattctgg

SEQ ID NO: 5007921 - DNA, 22 bp, Homo sapiens
gtggctcccttggtgccctcgc

SEQ ID NO: 5007922 - DNA, 14 bp, Homo sapiens
gtgggcctcggccc

SEQ ID NO: 5007923 - DNA, 15 bp, Homo sapiens
gtggggcagggagct

SEQ ID NO: 5007924 - DNA, 23 bp, Homo sapiens
gtgtatttaaaaaaaagaaactt

SEQ ID NO: 5007925 - DNA, 16 bp, Homo sapiens
gtgtcagtatccaggc

SEQ ID NO: 5007926 - DNA, 13 bp, Homo sapiens
gtgtcccaggcag

SEQ ID NO: 5007927 - DNA, 19 bp, Homo sapiens
gtgtcccaggcagggagac

SEQ ID NO: 5007928 - DNA, 12 bp, Homo sapiens
gtgtcttagcat

SEQ ID NO: 5007929 - DNA, 15 bp, Homo sapiens
gtgttagtggcaccg

SEQ ID NO: 5007930 - DNA, 21 bp, Homo sapiens
gtgttagtggcaccgcctccc

SEQ ID NO: 5007931 - DNA, 17 bp, Homo sapiens
gttacagagacctatgt

SEQ ID NO: 5007932 - DNA, 13 bp, Homo sapiens
gttagtggcaccg

SEQ ID NO: 5007933 - DNA, 14 bp, Homo sapiens
gttccctgctgcgc

SEQ ID NO: 5007934 - DNA, 19 bp, Homo sapiens
gttctggggggacccagtg

SEQ ID NO: 5007935 - DNA, 16 bp, Homo sapiens
gttgactttcctccca

SEQ ID NO: 5007936 - DNA, 15 bp, Homo sapiens
gttggaagaggaaca

SEQ ID NO: 5007937 - DNA, 20 bp, Homo sapiens
gttggtctgccttctgctga

SEQ ID NO: 5007938 - DNA, 16 bp, Homo sapiens
gtttaaaaagatgaaa

SEQ ID NO: 5007939 - DNA, 22 bp, Homo sapiens
gtttaaaaagatgaaaaagaat

SEQ ID NO: 5007940 - DNA, 15 bp, Homo sapiens
gtttacactgcacat

SEQ ID NO: 5007941 - DNA, 14 bp, Homo sapiens
gtttccagggaggg

SEQ ID NO: 5007942 - DNA, 21 bp, Homo sapiens
gtttggactgcagaagcaagg

SEQ ID NO: 5007943 - DNA, 20 bp, Homo sapiens
gttttaaccgcacatgcaca

SEQ ID NO: 5007944 - DNA, 22 bp, Homo sapiens
gtttttaacttttaatttaaaa

SEQ ID NO: 5007945 - DNA, 17 bp, Homo sapiens
gtttttacaagatgtat

SEQ ID NO: 5007946 - DNA, 13 bp, Homo sapiens
taaaaaaaagaaa

SEQ ID NO: 5007947 - DNA, 16 bp, Homo sapiens
taaaaaatcagaacaa

SEQ ID NO: 5007948 - DNA, 19 bp, Homo sapiens
taaaaagatgaaaaagaat

SEQ ID NO: 5007949 - DNA, 21 bp, Homo sapiens
taaaagttttttattatgcat

SEQ ID NO: 5007950 - DNA, 22 bp, Homo sapiens
taaaagttttttattatgcatt

SEQ ID NO: 5007951 - DNA, 13 bp, Homo sapiens
taaacagacaata

SEQ ID NO: 5007952 - DNA, 13 bp, Homo sapiens
taaactgttgctc

SEQ ID NO: 5007953 - DNA, 15 bp, Homo sapiens
taaagacacctggtt

SEQ ID NO: 5007954 - DNA, 20 bp, Homo sapiens
taaataaactgttgctcgtt

SEQ ID NO: 5007955 - DNA, 14 bp, Homo sapiens
taaataaacttttt

SEQ ID NO: 5007956 - DNA, 22 bp, Homo sapiens
taaatgaaacttaagaattgaa

SEQ ID NO: 5007957 - DNA, 22 bp, Homo sapiens
taactaattggaaggagagggg

SEQ ID NO: 5007958 - DNA, 22 bp, Homo sapiens
taactactatattgattgtcct

SEQ ID NO: 5007959 - DNA, 14 bp, Homo sapiens
taacttcctgtact

SEQ ID NO: 5007960 - DNA, 15 bp, Homo sapiens
taacttttaatttaa

SEQ ID NO: 5007961 - DNA, 17 bp, Homo sapiens
taagaaagtaatttaat

SEQ ID NO: 5007962 - DNA, 22 bp, Homo sapiens
taagaattgaattggaaagact

SEQ ID NO: 5007963 - DNA, 14 bp, Homo sapiens
taagtaaagacagc

SEQ ID NO: 5007964 - DNA, 19 bp, Homo sapiens
taagtccctataataaagg

SEQ ID NO: 5007965 - DNA, 13 bp, Homo sapiens
taataaaggctga

SEQ ID NO: 5007966 - DNA, 23 bp, Homo sapiens
taatttaatttgtaaaacttctg

SEQ ID NO: 5007967 - DNA, 16 bp, Homo sapiens
taatttgtaaaacttc

SEQ ID NO: 5007968 - DNA, 23 bp, Homo sapiens
taatttgtaaaacttctgctcgt

SEQ ID NO: 5007969 - DNA, 15 bp, Homo sapiens
tacaacggaggcctg

SEQ ID NO: 5007970 - DNA, 16 bp, Homo sapiens
tacaggtaactaattg

SEQ ID NO: 5007971 - DNA, 11 bp, Homo sapiens
tacatatatat

SEQ ID NO: 5007972 - DNA, 18 bp, Homo sapiens
tacatatatatatataac

SEQ ID NO: 5007973 - DNA, 16 bp, Homo sapiens
tacatattttttgtat

SEQ ID NO: 5007974 - DNA, 15 bp, Homo sapiens
tacatggtgtttgtg

SEQ ID NO: 5007975 - DNA, 21 bp, Homo sapiens
taccctgggtgtccccgctgc

SEQ ID NO: 5007976 - DNA, 20 bp, Homo sapiens
tacctctctgtcccttgctg

SEQ ID NO: 5007977 - DNA, 14 bp, Homo sapiens
tacctttcaaagct

SEQ ID NO: 5007978 - DNA, 13 bp, Homo sapiens
tactgaaagcctt

SEQ ID NO: 5007979 - DNA, 18 bp, Homo sapiens
tactgttactgggccctg

SEQ ID NO: 5007980 - DNA, 22 bp, Homo sapiens
tacttgaagtctaaaagcagaa

SEQ ID NO: 5007981 - DNA, 18 bp, Homo sapiens
tactttgaagtgcagctc

SEQ ID NO: 5007982 - DNA, 16 bp, Homo sapiens
tactttgccactgctg

SEQ ID NO: 5007983 - DNA, 17 bp, Homo sapiens
tactttgccactgctgt

SEQ ID NO: 5007984 - DNA, 19 bp, Homo sapiens
tagaaggttgacacagttg

SEQ ID NO: 5007985 - DNA, 21 bp, Homo sapiens
tagagggacggccaagaatgt

SEQ ID NO: 5007986 - DNA, 23 bp, Homo sapiens
tagagggacggccaagaatgtac

SEQ ID NO: 5007987 - DNA, 18 bp, Homo sapiens
tagagtaaatacaggtag

SEQ ID NO: 5007988 - DNA, 23 bp, Homo sapiens
tagccagtgctccaggcacccag

SEQ ID NO: 5007989 - DNA, 18 bp, Homo sapiens
tagtgtacatttctataa

SEQ ID NO: 5007990 - DNA, 21 bp, Homo sapiens
tagtgtacatttctataaata

SEQ ID NO: 5007991 - DNA, 23 bp, Homo sapiens
tagtgtacctcctctcagtgttt

SEQ ID NO: 5007992 - DNA, 20 bp, Homo sapiens
tataaacagacaatatgtga

SEQ ID NO: 5007993 - DNA, 18 bp, Homo sapiens
tatacaggcataaaatag

SEQ ID NO: 5007994 - DNA, 19 bp, Homo sapiens
tatacatatatatatataa

SEQ ID NO: 5007995 - DNA, 15 bp, Homo sapiens
tatacgcttttcttt

SEQ ID NO: 5007996 - DNA, 22 bp, Homo sapiens
tatagcatgaatgtttttagag

SEQ ID NO: 5007997 - DNA, 14 bp, Homo sapiens
tatagcctggactg

SEQ ID NO: 5007998 - DNA, 14 bp, Homo sapiens
tatataacatatat

SEQ ID NO: 5007999 - DNA, 16 bp, Homo sapiens
tatatataacatatat

SEQ ID NO: 5008000 - DNA, 11 bp, Homo sapiens
tatatatataa

SEQ ID NO: 5008001 - DNA, 14 bp, Homo sapiens
tatatatatataac

SEQ ID NO: 5008002 - DNA, 17 bp, Homo sapiens
tatatctatatatataa

SEQ ID NO: 5008003 - DNA, 15 bp, Homo sapiens
tatatttgttttatg

SEQ ID NO: 5008004 - DNA, 15 bp, Homo sapiens
tatcaaatctaccac

SEQ ID NO: 5008005 - DNA, 22 bp, Homo sapiens
tatccaaaatgtgtatttctta

SEQ ID NO: 5008006 - DNA, 17 bp, Homo sapiens
tatccaaatctgaagat

SEQ ID NO: 5008007 - DNA, 13 bp, Homo sapiens
tatgatcagtgtt

SEQ ID NO: 5008008 - DNA, 11 bp, Homo sapiens
tatgcaaaagg

SEQ ID NO: 5008009 - DNA, 15 bp, Homo sapiens
tatgctgatcatcgc

SEQ ID NO: 5008010 - DNA, 22 bp, Homo sapiens
tatgctgatcatcgccagaggt

SEQ ID NO: 5008011 - DNA, 23 bp, Homo sapiens
tatgtgagtgccttttgcagaag

SEQ ID NO: 5008012 - DNA, 19 bp, Homo sapiens
tattatgcattatatcaaa

SEQ ID NO: 5008013 - DNA, 15 bp, Homo sapiens
tattgatttttaaga

SEQ ID NO: 5008014 - DNA, 18 bp, Homo sapiens
tattgttcaaaaagatat

SEQ ID NO: 5008015 - DNA, 15 bp, Homo sapiens
tatttcgtgtactgc

SEQ ID NO: 5008016 - DNA, 19 bp, Homo sapiens
tatttcgtgtactgcaaag

SEQ ID NO: 5008017 - DNA, 15 bp, Homo sapiens
tatttctcatctgca

SEQ ID NO: 5008018 - DNA, 14 bp, Homo sapiens
tatttgtaaagcta

SEQ ID NO: 5008019 - DNA, 15 bp, Homo sapiens
tattttttggacttc

SEQ ID NO: 5008020 - DNA, 15 bp, Homo sapiens
tcaaaatatttctca

SEQ ID NO: 5008021 - DNA, 16 bp, Homo sapiens
tcaaaatatttctcat

SEQ ID NO: 5008022 - DNA, 15 bp, Homo sapiens
tcaaagagaattgta

SEQ ID NO: 5008023 - DNA, 16 bp, Homo sapiens
tcaaagagaattgtat

SEQ ID NO: 5008024 - DNA, 19 bp, Homo sapiens
tcaaagctcacaccaaatt

SEQ ID NO: 5008025 - DNA, 15 bp, Homo sapiens
atgttgtgtttttaa

SEQ ID NO: 5008026 - DNA, 22 bp, Homo sapiens
attattcctctcaccccactcc

SEQ ID NO: 5008027 - DNA, 23 bp, Homo sapiens
attccggaaactagtgtacattt

SEQ ID NO: 5008028 - DNA, 19 bp, Homo sapiens
attccgttgtctgtggatg

SEQ ID NO: 5008029 - DNA, 18 bp, Homo sapiens
attcctaacttttcaatg

SEQ ID NO: 5008030 - DNA, 19 bp, Homo sapiens
attcgaaggaacctgtgtt

SEQ ID NO: 5008031 - DNA, 18 bp, Homo sapiens
attctggttccctgctgc

SEQ ID NO: 5008032 - DNA, 19 bp, Homo sapiens
attctggttccctgctgcg

SEQ ID NO: 5008033 - DNA, 17 bp, Homo sapiens
attgatttttaagaaag

SEQ ID NO: 5008034 - DNA, 15 bp, Homo sapiens
attggaaggagaggg

SEQ ID NO: 5008035 - DNA, 21 bp, Homo sapiens
attgtgtatttaaaaaaaaga

SEQ ID NO: 5008036 - DNA, 15 bp, Homo sapiens
attgttgttttccat

SEQ ID NO: 5008037 - DNA, 19 bp, Homo sapiens
atttaaaaaaaagaaactt

SEQ ID NO: 5008038 - DNA, 22 bp, Homo sapiens
atttaaaaaaaagaaacttttc

SEQ ID NO: 5008039 - DNA, 20 bp, Homo sapiens
atttaatttgtaaaacttct

SEQ ID NO: 5008040 - DNA, 16 bp, Homo sapiens
atttacagggatttct

SEQ ID NO: 5008041 - DNA, 19 bp, Homo sapiens
atttatccaaaatgtgtat

SEQ ID NO: 5008042 - DNA, 13 bp, Homo sapiens
atttatgcacatt

SEQ ID NO: 5008043 - DNA, 16 bp, Homo sapiens
atttatgggcccctgg

SEQ ID NO: 5008044 - DNA, 21 bp, Homo sapiens
atttcctcagcttatctcttt

SEQ ID NO: 5008045 - DNA, 20 bp, Homo sapiens
atttcctttcataccttgaa

SEQ ID NO: 5008046 - DNA, 17 bp, Homo sapiens
atttcgtgtactgcaaa

SEQ ID NO: 5008047 - DNA, 14 bp, Homo sapiens
atttctataaatag

SEQ ID NO: 5008048 - DNA, 17 bp, Homo sapiens
atttgtaaaacttctgc

SEQ ID NO: 5008049 - DNA, 14 bp, Homo sapiens
atttgttttatgct

SEQ ID NO: 5008050 - DNA, 22 bp, Homo sapiens
attttaatgcagttgcttacta

SEQ ID NO: 5008051 - DNA, 17 bp, Homo sapiens
attttctcccaagctga

SEQ ID NO: 5008052 - DNA, 12 bp, Homo sapiens
atttttaagaaa

SEQ ID NO: 5008053 - DNA, 18 bp, Homo sapiens
atttttaagaaagtaatt

SEQ ID NO: 5008054 - DNA, 15 bp, Homo sapiens
atttttatttttgca

SEQ ID NO: 5008055 - DNA, 11 bp, Homo sapiens
caaaaggttta

SEQ ID NO: 5008056 - DNA, 15 bp, Homo sapiens
caaagaggctgcccc

SEQ ID NO: 5008057 - DNA, 23 bp, Homo sapiens
caaagaggctgcccctctcacca

SEQ ID NO: 5008058 - DNA, 14 bp, Homo sapiens
caaagctgagcctg

SEQ ID NO: 5008059 - DNA, 24 bp, Homo sapiens
caaagctgagcctgcagggaagcc

SEQ ID NO: 5008060 - DNA, 19 bp, Homo sapiens
caaagcttggagggaagcc

SEQ ID NO: 5008061 - DNA, 14 bp, Homo sapiens
caaatctgaagatt

SEQ ID NO: 5008062 - DNA, 20 bp, Homo sapiens
caaccaatttacactgccat

SEQ ID NO: 5008063 - DNA, 14 bp, Homo sapiens
caacccttctctgt

SEQ ID NO: 5008064 - DNA, 14 bp, Homo sapiens
caaccgagaaggtt

SEQ ID NO: 5008065 - DNA, 15 bp, Homo sapiens
caactaattttctcc

SEQ ID NO: 5008066 - DNA, 11 bp, Homo sapiens
caagaatgtac

SEQ ID NO: 5008067 - DNA, 15 bp, Homo sapiens
caagaggtgggaggg

SEQ ID NO: 5008068 - DNA, 18 bp, Homo sapiens
caagcagaggaccagggc

SEQ ID NO: 5008069 - DNA, 22 bp, Homo sapiens
caagcagaggaccagggccttt

SEQ ID NO: 5008070 - DNA, 14 bp, Homo sapiens
caagctgattttat

SEQ ID NO: 5008071 - DNA, 17 bp, Homo sapiens
caagctgattttattca

SEQ ID NO: 5008072 - DNA, 15 bp, Homo sapiens
caagtttatatatat

SEQ ID NO: 5008073 - DNA, 17 bp, Homo sapiens
caagttttcttccatga

SEQ ID NO: 5008074 - DNA, 17 bp, Homo sapiens
caatatgtgagtgcctt

SEQ ID NO: 5008075 - DNA, 22 bp, Homo sapiens
caatatgtgagtgccttttgca

SEQ ID NO: 5008076 - DNA, 19 bp, Homo sapiens
caattcccccatccttcag

SEQ ID NO: 5008077 - DNA, 19 bp, Homo sapiens
cacaacccttctctgttgg

SEQ ID NO: 5008078 - DNA, 19 bp, Homo sapiens
cacacacgctttcttatgc

SEQ ID NO: 5008079 - DNA, 15 bp, Homo sapiens
cacacccaaagctga

SEQ ID NO: 5008080 - DNA, 19 bp, Homo sapiens
cacacccaaagctgagcct

SEQ ID NO: 5008081 - DNA, 21 bp, Homo sapiens
cacagagctttggtctgtgtg

SEQ ID NO: 5008082 - DNA, 15 bp, Homo sapiens
cacagcccagcttgg

SEQ ID NO: 5008083 - DNA, 19 bp, Homo sapiens
cacaggaggcaggcatggc

SEQ ID NO: 5008084 - DNA, 21 bp, Homo sapiens
cacaggaggcaggcatggccc

SEQ ID NO: 5008085 - DNA, 22 bp, Homo sapiens
cacattgataaaagcattgttt

SEQ ID NO: 5008086 - DNA, 11 bp, Homo sapiens
caccaaggaaa

SEQ ID NO: 5008087 - DNA, 21 bp, Homo sapiens
caccaccaaatgccaagaaaa

SEQ ID NO: 5008088 - DNA, 13 bp, Homo sapiens
caccatccagctc

SEQ ID NO: 5008089 - DNA, 18 bp, Homo sapiens
caccatccagctccccag

SEQ ID NO: 5008090 - DNA, 21 bp, Homo sapiens
cacccaaaccggcaggtgcga

SEQ ID NO: 5008091 - DNA, 15 bp, Homo sapiens
cacccaaagctgagc

SEQ ID NO: 5008092 - DNA, 19 bp, Homo sapiens
cacccaaagctgagcctgc

SEQ ID NO: 5008093 - DNA, 16 bp, Homo sapiens
caccccactcctgtca

SEQ ID NO: 5008094 - DNA, 17 bp, Homo sapiens
caccccactcctgtcag

SEQ ID NO: 5008095 - DNA, 14 bp, Homo sapiens
caccctttccagga

SEQ ID NO: 5008096 - DNA, 16 bp, Homo sapiens
caccgaggggcctttg

SEQ ID NO: 5008097 - DNA, 22 bp, Homo sapiens
caccgcctccccacctccaggc

SEQ ID NO: 5008098 - DNA, 17 bp, Homo sapiens
caccttgtgcctggggt

SEQ ID NO: 5008099 - DNA, 18 bp, Homo sapiens
caccttgtgcctggggtg

SEQ ID NO: 5008100 - DNA, 17 bp, Homo sapiens
cacggtatttatagaga

SEQ ID NO: 5008101 - DNA, 18 bp, Homo sapiens
cactaacgtgtgtgtctt

SEQ ID NO: 5008102 - DNA, 12 bp, Homo sapiens
cactcctccctc

SEQ ID NO: 5008103 - DNA, 15 bp, Homo sapiens
cagaacaaaacttct

SEQ ID NO: 5008104 - DNA, 13 bp, Homo sapiens
cagaatgtaagtg

SEQ ID NO: 5008105 - DNA, 18 bp, Homo sapiens
cagaatgtaagtgggccc

SEQ ID NO: 5008106 - DNA, 21 bp, Homo sapiens
cagaatgtaagtgggcccacc

SEQ ID NO: 5008107 - DNA, 17 bp, Homo sapiens
cagacaatatgtgagtg

SEQ ID NO: 5008108 - DNA, 21 bp, Homo sapiens
cagagatggtgtgttctgcaa

SEQ ID NO: 5008109 - DNA, 20 bp, Homo sapiens
cagagctttggtctgtgtgt

SEQ ID NO: 5008110 - DNA, 15 bp, Homo sapiens
cagaggaccagggcc

SEQ ID NO: 5008111 - DNA, 14 bp, Homo sapiens
cagaggtaccctgg

SEQ ID NO: 5008112 - DNA, 15 bp, Homo sapiens
cagatactttgaagt

SEQ ID NO: 5008113 - DNA, 20 bp, Homo sapiens
cagatggtacggacttcctt

SEQ ID NO: 5008114 - DNA, 17 bp, Homo sapiens
cagcaccgaggggcctt

SEQ ID NO: 5008115 - DNA, 18 bp, Homo sapiens
cagcaccgaggggccttt

SEQ ID NO: 5008116 - DNA, 20 bp, Homo sapiens
cagcaccttgtgcctggggt

SEQ ID NO: 5008117 - DNA, 16 bp, Homo sapiens
cagcagcttctccagg

SEQ ID NO: 5008118 - DNA, 16 bp, Homo sapiens
cagccactccccggca

SEQ ID NO: 5008119 - DNA, 22 bp, Homo sapiens
cagcctcgttggaagaggaaca

SEQ ID NO: 5008120 - DNA, 23 bp, Homo sapiens
cagcctcgttggaagaggaacag

SEQ ID NO: 5008121 - DNA, 16 bp, Homo sapiens
cagctccccagcccac

SEQ ID NO: 5008122 - DNA, 20 bp, Homo sapiens
cagctccccagcccacctgc

SEQ ID NO: 5008123 - DNA, 15 bp, Homo sapiens
cagcttatctctttt

SEQ ID NO: 5008124 - DNA, 16 bp, Homo sapiens
cagcttatctctttta

SEQ ID NO: 5008125 - DNA, 22 bp, Homo sapiens
cagcttatctcttttatatttg

SEQ ID NO: 5008126 - DNA, 21 bp, Homo sapiens
caggagctgtcaccaaggaaa

SEQ ID NO: 5008127 - DNA, 23 bp, Homo sapiens
caggaggcaggcatggccctggg

SEQ ID NO: 5008128 - DNA, 18 bp, Homo sapiens
caggagttcaagaccagc

SEQ ID NO: 5008129 - DNA, 20 bp, Homo sapiens
caggcataaaatagagtaaa

SEQ ID NO: 5008130 - DNA, 18 bp, Homo sapiens
caggcatggccctgggcg

SEQ ID NO: 5008131 - DNA, 14 bp, Homo sapiens
caggccccaggcct

SEQ ID NO: 5008132 - DNA, 15 bp, Homo sapiens
caggcctgtggctcc

SEQ ID NO: 5008133 - DNA, 20 bp, Homo sapiens
caggctgggccatgtccaaa

SEQ ID NO: 5008134 - DNA, 23 bp, Homo sapiens
cagggaagccccacatgtccagc

SEQ ID NO: 5008135 - DNA, 18 bp, Homo sapiens
cagggaagctgtcctgga

SEQ ID NO: 5008136 - DNA, 17 bp, Homo sapiens
cagggaaggtgaaacag

SEQ ID NO: 5008137 - DNA, 21 bp, Homo sapiens
cagggagacggtttccaggga

SEQ ID NO: 5008138 - DNA, 16 bp, Homo sapiens
cagggagcagggaagg

SEQ ID NO: 5008139 - DNA, 21 bp, Homo sapiens
cagggagcagggaaggcctga

SEQ ID NO: 5008140 - DNA, 15 bp, Homo sapiens
cagggagctgggccc

SEQ ID NO: 5008141 - DNA, 22 bp, Homo sapiens
cagggagctgggcccgacatgg

SEQ ID NO: 5008142 - DNA, 12 bp, Homo sapiens
cagggaggggcc

SEQ ID NO: 5008143 - DNA, 16 bp, Homo sapiens
cagggaggggccggcc

SEQ ID NO: 5008144 - DNA, 23 bp, Homo sapiens
cagggcaccatccagctccccag

SEQ ID NO: 5008145 - DNA, 16 bp, Homo sapiens
cagggccatggctcag

SEQ ID NO: 5008146 - DNA, 17 bp, Homo sapiens
cagggccatggctcagg

SEQ ID NO: 5008147 - DNA, 11 bp, Homo sapiens
cagggcctttt

SEQ ID NO: 5008148 - DNA, 22 bp, Homo sapiens
cagggggatgccactcctccct

SEQ ID NO: 5008149 - DNA, 20 bp, Homo sapiens
cagggtgggcctcggcccct

SEQ ID NO: 5008150 - DNA, 23 bp, Homo sapiens
cagggtgggcctcggcccctccc

SEQ ID NO: 5008151 - DNA, 23 bp, Homo sapiens
caggtgcagaggtaccctgggtg

SEQ ID NO: 5008152 - DNA, 13 bp, Homo sapiens
cagtaccttgctt

SEQ ID NO: 5008153 - DNA, 18 bp, Homo sapiens
cagtctgaatgctgccac

SEQ ID NO: 5008154 - DNA, 12 bp, Homo sapiens
cagtgcagaatg

SEQ ID NO: 5008155 - DNA, 14 bp, Homo sapiens
cagtgcagaatgta

SEQ ID NO: 5008156 - DNA, 18 bp, Homo sapiens
cagtgcatggtggccaga

SEQ ID NO: 5008157 - DNA, 22 bp, Homo sapiens
cagtgcctcaccttccaacact

SEQ ID NO: 5008158 - DNA, 19 bp, Homo sapiens
cagtggttcaaatttcctt

SEQ ID NO: 5008159 - DNA, 20 bp, Homo sapiens
cagtgtgccagtttaaaaag

SEQ ID NO: 5008160 - DNA, 21 bp, Homo sapiens
cagttgtagggttacagagac

SEQ ID NO: 5008161 - DNA, 23 bp, Homo sapiens
cagttgtagggttacagagacct

SEQ ID NO: 5008162 - DNA, 16 bp, Homo sapiens
catatatacaggcata

SEQ ID NO: 5008163 - DNA, 22 bp, Homo sapiens
catatttatccaaaatgtgtat

SEQ ID NO: 5008164 - DNA, 14 bp, Homo sapiens
catcacagggtggg

SEQ ID NO: 5008165 - DNA, 18 bp, Homo sapiens
catcacagggtgggcctc

SEQ ID NO: 5008166 - DNA, 22 bp, Homo sapiens
catcacagggtgggcctcggcc

SEQ ID NO: 5008167 - DNA, 12 bp, Homo sapiens
catccactgtta

SEQ ID NO: 5008168 - DNA, 22 bp, Homo sapiens
catccagctccccagcccacct

SEQ ID NO: 5008169 - DNA, 23 bp, Homo sapiens
catccctgcttatttttaatttg

SEQ ID NO: 5008170 - DNA, 20 bp, Homo sapiens
catccgcgtgtgcctgtgtg

SEQ ID NO: 5008171 - DNA, 23 bp, Homo sapiens
catcctggatgaaagagccagac

SEQ ID NO: 5008172 - DNA, 13 bp, Homo sapiens
catccttcccttt

SEQ ID NO: 5008173 - DNA, 17 bp, Homo sapiens
catcttgtatacacata

SEQ ID NO: 5008174 - DNA, 18 bp, Homo sapiens
catgagactcagtgcaga

SEQ ID NO: 5008175 - DNA, 12 bp, Homo sapiens
catgatttagca

SEQ ID NO: 5008176 - DNA, 16 bp, Homo sapiens
catgatttagcaagca

SEQ ID NO: 5008177 - DNA, 17 bp, Homo sapiens
catgatttagcaagcaa

SEQ ID NO: 5008178 - DNA, 22 bp, Homo sapiens
catgcaagcagaggaccagggc

SEQ ID NO: 5008179 - DNA, 18 bp, Homo sapiens
catgcagagttgaagttt

SEQ ID NO: 5008180 - DNA, 23 bp, Homo sapiens
catgcttcatcattccctctcat

SEQ ID NO: 5008181 - DNA, 13 bp, Homo sapiens
catggccctgggc

SEQ ID NO: 5008182 - DNA, 14 bp, Homo sapiens
catggccctgggcg

SEQ ID NO: 5008183 - DNA, 16 bp, Homo sapiens
catggctccggcctct

SEQ ID NO: 5008184 - DNA, 16 bp, Homo sapiens
catgtaaaagcggaaa

SEQ ID NO: 5008185 - DNA, 19 bp, Homo sapiens
catgtaatgttaatgttat

SEQ ID NO: 5008186 - DNA, 18 bp, Homo sapiens
catgtccaaagaggctgc

SEQ ID NO: 5008187 - DNA, 20 bp, Homo sapiens
catgtccagcaccttgtgcc

SEQ ID NO: 5008188 - DNA, 23 bp, Homo sapiens
catgtccagcaccttgtgcctgg

SEQ ID NO: 5008189 - DNA, 22 bp, Homo sapiens
catgtcgctagccagtgctcca

SEQ ID NO: 5008190 - DNA, 14 bp, Homo sapiens
catgtttttaactt

SEQ ID NO: 5008191 - DNA, 21 bp, Homo sapiens
cattccctctcatctcaggta

SEQ ID NO: 5008192 - DNA, 22 bp, Homo sapiens
cattctggttccctgctgcgct

SEQ ID NO: 5008193 - DNA, 20 bp, Homo sapiens
cattgcagtttaagagcaga

SEQ ID NO: 5008194 - DNA, 22 bp, Homo sapiens
catttagatcctggtttcataa

SEQ ID NO: 5008195 - DNA, 20 bp, Homo sapiens
catttcctcagcttatctct

SEQ ID NO: 5008196 - DNA, 23 bp, Homo sapiens
catttgtggcagtcccttataat

SEQ ID NO: 5008197 - DNA, 20 bp, Homo sapiens
catttgtggtcctgaaggaa

SEQ ID NO: 5008198 - DNA, 16 bp, Homo sapiens
ccaaaccggcaggtgc

SEQ ID NO: 5008199 - DNA, 18 bp, Homo sapiens
ccaaaccggcaggtgcga

SEQ ID NO: 5008200 - DNA, 16 bp, Homo sapiens
ccaaagaggctgcccc

SEQ ID NO: 5008201 - DNA, 17 bp, Homo sapiens
ccaaagaggctgcccct

SEQ ID NO: 5008202 - DNA, 20 bp, Homo sapiens
ccaaagctgagcctgcaggg

SEQ ID NO: 5008203 - DNA, 21 bp, Homo sapiens
ccaaagctgagcctgcaggga

SEQ ID NO: 5008204 - DNA, 12 bp, Homo sapiens
ccaacacttcca

SEQ ID NO: 5008205 - DNA, 13 bp, Homo sapiens
ccaacacttccag

SEQ ID NO: 5008206 - DNA, 17 bp, Homo sapiens
ccaaggaaacgctacct

SEQ ID NO: 5008207 - DNA, 22 bp, Homo sapiens
ccaaggaaacgctacctctctg

SEQ ID NO: 5008208 - DNA, 21 bp, Homo sapiens
ccacaccccaacacttccagc

SEQ ID NO: 5008209 - DNA, 21 bp, Homo sapiens
ccacagagagggagagcagag

SEQ ID NO: 5008210 - DNA, 14 bp, Homo sapiens
ccacatgaaaccta

SEQ ID NO: 5008211 - DNA, 13 bp, Homo sapiens
ccacatgtccagc

SEQ ID NO: 5008212 - DNA, 21 bp, Homo sapiens
ccacggaggatccactcccag

SEQ ID NO: 5008213 - DNA, 22 bp, Homo sapiens
ccacgggacatcacagggtggg

SEQ ID NO: 5008214 - DNA, 11 bp, Homo sapiens
ccactcctccc

SEQ ID NO: 5008215 - DNA, 20 bp, Homo sapiens
ccactggtccccaacaatgt

SEQ ID NO: 5008216 - DNA, 21 bp, Homo sapiens
ccactgtatgatttataaaca

SEQ ID NO: 5008217 - DNA, 18 bp, Homo sapiens
ccacttccaggggaacct

SEQ ID NO: 5008218 - DNA, 19 bp, Homo sapiens
ccacttccaggggaacctg

SEQ ID NO: 5008219 - DNA, 21 bp, Homo sapiens
ccacttccaggggaacctgcc

SEQ ID NO: 5008220 - DNA, 15 bp, Homo sapiens
ccacttcccaccctg

SEQ ID NO: 5008221 - DNA, 11 bp, Homo sapiens
ccagactctgt

SEQ ID NO: 5008222 - DNA, 14 bp, Homo sapiens
ccagactctgtctc

SEQ ID NO: 5008223 - DNA, 12 bp, Homo sapiens
ccagaggtgctt

SEQ ID NO: 5008224 - DNA, 22 bp, Homo sapiens
ccagatggctggaaggggtcca

SEQ ID NO: 5008225 - DNA, 18 bp, Homo sapiens
ccagcaccttgtgcctgg

SEQ ID NO: 5008226 - DNA, 19 bp, Homo sapiens
ccagcaccttgtgcctggg

SEQ ID NO: 5008227 - DNA, 20 bp, Homo sapiens
ccagcaccttgtgcctgggg

SEQ ID NO: 5008228 - DNA, 19 bp, Homo sapiens
ccagcccacctgctcccag

SEQ ID NO: 5008229 - DNA, 20 bp, Homo sapiens
ccagcccacctgctcccagg

SEQ ID NO: 5008230 - DNA, 22 bp, Homo sapiens
ccagcctcgttggaagaggaac

SEQ ID NO: 5008231 - DNA, 12 bp, Homo sapiens
ccaggcagggag

SEQ ID NO: 5008232 - DNA, 14 bp, Homo sapiens
ccaggccccaggcc

SEQ ID NO: 5008233 - DNA, 19 bp, Homo sapiens
ccaggccctgcagcggtgg

SEQ ID NO: 5008234 - DNA, 23 bp, Homo sapiens
ccaggcctgggtgatctgctgct

SEQ ID NO: 5008235 - DNA, 19 bp, Homo sapiens
ccaggcctgtggctccctt

SEQ ID NO: 5008236 - DNA, 18 bp, Homo sapiens
ccaggctttgtacagagt

SEQ ID NO: 5008237 - DNA, 19 bp, Homo sapiens
ccagggcaccatccagctc

SEQ ID NO: 5008238 - DNA, 13 bp, Homo sapiens
ccaggggaacctg

SEQ ID NO: 5008239 - DNA, 17 bp, Homo sapiens
ccaggggaacctgccat

SEQ ID NO: 5008240 - DNA, 18 bp, Homo sapiens
ccagggggatgccactcc

SEQ ID NO: 5008241 - DNA, 13 bp, Homo sapiens
ccaggtgcagagg

SEQ ID NO: 5008242 - DNA, 14 bp, Homo sapiens
ccagtaccttgctt

SEQ ID NO: 5008243 - DNA, 18 bp, Homo sapiens
ccagtgcatggtggccag

SEQ ID NO: 5008244 - DNA, 13 bp, Homo sapiens
ccatccagctccc

SEQ ID NO: 5008245 - DNA, 14 bp, Homo sapiens
ccatccagctcccc

SEQ ID NO: 5008246 - DNA, 15 bp, Homo sapiens
ccatccttccctttg

SEQ ID NO: 5008247 - DNA, 18 bp, Homo sapiens
ccatctctcatcctccag

SEQ ID NO: 5008248 - DNA, 15 bp, Homo sapiens
ccatgatttagcaag

SEQ ID NO: 5008249 - DNA, 18 bp, Homo sapiens
ccatgatttagcaagcaa

SEQ ID NO: 5008250 - DNA, 17 bp, Homo sapiens
ccatgcaagcagaggac

SEQ ID NO: 5008251 - DNA, 23 bp, Homo sapiens
ccatgcaagcagaggaccagggc

SEQ ID NO: 5008252 - DNA, 16 bp, Homo sapiens
ccatggctcagggtgg

SEQ ID NO: 5008253 - DNA, 13 bp, Homo sapiens
ccatgtccaaaga

SEQ ID NO: 5008254 - DNA, 18 bp, Homo sapiens
ccatgtccaaagaggctg

SEQ ID NO: 5008255 - DNA, 23 bp, Homo sapiens
ccatgtccaaagaggctgcccct

SEQ ID NO: 5008256 - DNA, 14 bp, Homo sapiens
ccattattcctctc

SEQ ID NO: 5008257 - DNA, 15 bp, Homo sapiens
ccattattcctctca

SEQ ID NO: 5008258 - DNA, 22 bp, Homo sapiens
ccatttgtggtcctgaaggaaa

SEQ ID NO: 5008259 - DNA, 20 bp, Homo sapiens
ccattttgtaaatgaaactt

SEQ ID NO: 5008260 - DNA, 13 bp, Homo sapiens
cccaaagctgagc

SEQ ID NO: 5008261 - DNA, 21 bp, Homo sapiens
cccaagtttccatagcaacag

SEQ ID NO: 5008262 - DNA, 14 bp, Homo sapiens
cccacatgtccagc

SEQ ID NO: 5008263 - DNA, 17 bp, Homo sapiens
cccaccctgctgctggt

SEQ ID NO: 5008264 - DNA, 14 bp, Homo sapiens
cccacctccaggct

SEQ ID NO: 5008265 - DNA, 11 bp, Homo sapiens
cccactcctgt

SEQ ID NO: 5008266 - DNA, 12 bp, Homo sapiens
cccactgtatga

SEQ ID NO: 5008267 - DNA, 17 bp, Homo sapiens
cccactgtatgatttat

SEQ ID NO: 5008268 - DNA, 17 bp, Homo sapiens
cccacttcccaccctgc

SEQ ID NO: 5008269 - DNA, 23 bp, Homo sapiens
cccagatggctggaaggggtcca

SEQ ID NO: 5008270 - DNA, 11 bp, Homo sapiens
cccaggcaggg

SEQ ID NO: 5008271 - DNA, 12 bp, Homo sapiens
cccaggcaggga

SEQ ID NO: 5008272 - DNA, 17 bp, Homo sapiens
cccaggcagggagacgg

SEQ ID NO: 5008273 - DNA, 15 bp, Homo sapiens
cccagtgcagaatgt

SEQ ID NO: 5008274 - DNA, 17 bp, Homo sapiens
cccagtgcagaatgtaa

SEQ ID NO: 5008275 - DNA, 17 bp, Homo sapiens
cccatgcaagcagagga

SEQ ID NO: 5008276 - DNA, 18 bp, Homo sapiens
cccattcagagactgtcc

SEQ ID NO: 5008277 - DNA, 14 bp, Homo sapiens
ccccactcctgtca

SEQ ID NO: 5008278 - DNA, 15 bp, Homo sapiens
ccccatgaggaagga

SEQ ID NO: 5008279 - DNA, 12 bp, Homo sapiens
cccccagtgcct

SEQ ID NO: 5008280 - DNA, 22 bp, Homo sapiens
cccccagtgcctcaccttccaa

SEQ ID NO: 5008281 - DNA, 17 bp, Homo sapiens
cccccgtggggcaggga

SEQ ID NO: 5008282 - DNA, 13 bp, Homo sapiens
ccccgtggggcag

SEQ ID NO: 5008283 - DNA, 14 bp, Homo sapiens
cccctgactcatca

SEQ ID NO: 5008284 - DNA, 23 bp, Homo sapiens
cccggcatgagactcagtgcaga

SEQ ID NO: 5008285 - DNA, 19 bp, Homo sapiens
ccctagagccctctcctcc

SEQ ID NO: 5008286 - DNA, 21 bp, Homo sapiens
ccctagagccctctcctccct

SEQ ID NO: 5008287 - DNA, 19 bp, Homo sapiens
ccctagcagcccaccctgc

SEQ ID NO: 5008288 - DNA, 23 bp, Homo sapiens
ccctagcagcccaccctgctgct

SEQ ID NO: 5008289 - DNA, 21 bp, Homo sapiens
ccctccgaccacttccagggg

SEQ ID NO: 5008290 - DNA, 12 bp, Homo sapiens
ccctctcctccc

SEQ ID NO: 5008291 - DNA, 21 bp, Homo sapiens
ccctctccttgcccccagtgc

SEQ ID NO: 5008292 - DNA, 16 bp, Homo sapiens
ccctgagtctgggcag

SEQ ID NO: 5008293 - DNA, 15 bp, Homo sapiens
ccctgctgcgctgct

SEQ ID NO: 5008294 - DNA, 16 bp, Homo sapiens
ccctgctgcgctgctt

SEQ ID NO: 5008295 - DNA, 16 bp, Homo sapiens
ccctgctgctggtgca

SEQ ID NO: 5008296 - DNA, 19 bp, Homo sapiens
ccctgctgctggtgcacag

SEQ ID NO: 5008297 - DNA, 20 bp, Homo sapiens
ccctgggtgtccccgctgct

SEQ ID NO: 5008298 - DNA, 18 bp, Homo sapiens
cccttgcttgcctgcagg

SEQ ID NO: 5008299 - DNA, 22 bp, Homo sapiens
cccttgcttgcctgcagggcca

SEQ ID NO: 5008300 - DNA, 23 bp, Homo sapiens
ccctttggagatgctgagggtgt

SEQ ID NO: 5008301 - DNA, 19 bp, Homo sapiens
ccgcttgaaaagctagtgt

SEQ ID NO: 5008302 - DNA, 23 bp, Homo sapiens
ccgcttgaaaagctagtgtacct

SEQ ID NO: 5008303 - DNA, 13 bp, Homo sapiens
ccggccctgtgtg

SEQ ID NO: 5008304 - DNA, 17 bp, Homo sapiens
ccggccctgtgtgcagg

SEQ ID NO: 5008305 - DNA, 11 bp, Homo sapiens
ccgggccaggc

SEQ ID NO: 5008306 - DNA, 22 bp, Homo sapiens
ccggggctctgggtgctgccct

SEQ ID NO: 5008307 - DNA, 17 bp, Homo sapiens
ccgtagctctgctgctg

SEQ ID NO: 5008308 - DNA, 13 bp, Homo sapiens
ccgtggggcaggg

SEQ ID NO: 5008309 - DNA, 15 bp, Homo sapiens
cctaattcttctgtc

SEQ ID NO: 5008310 - DNA, 22 bp, Homo sapiens
cctacacactgtcatgcttcat

SEQ ID NO: 5008311 - DNA, 17 bp, Homo sapiens
cctagcagcccaccctg

SEQ ID NO: 5008312 - DNA, 22 bp, Homo sapiens
cctagcagcccaccctgctgct

SEQ ID NO: 5008313 - DNA, 13 bp, Homo sapiens
cctagtactgccc

SEQ ID NO: 5008314 - DNA, 19 bp, Homo sapiens
cctagtttcttacacactg

SEQ ID NO: 5008315 - DNA, 20 bp, Homo sapiens
cctcagggagcagggaaggc

SEQ ID NO: 5008316 - DNA, 11 bp, Homo sapiens
cctccaagcct

SEQ ID NO: 5008317 - DNA, 14 bp, Homo sapiens
cctccaggtgcaga

SEQ ID NO: 5008318 - DNA, 15 bp, Homo sapiens
cctccaggtgcagag

SEQ ID NO: 5008319 - DNA, 16 bp, Homo sapiens
cctccagtaccttgct

SEQ ID NO: 5008320 - DNA, 17 bp, Homo sapiens
cctccagtaccttgctt

SEQ ID NO: 5008321 - DNA, 18 bp, Homo sapiens
cctcccacacccaaagct

SEQ ID NO: 5008322 - DNA, 14 bp, Homo sapiens
cctccctctgtccc

SEQ ID NO: 5008323 - DNA, 20 bp, Homo sapiens
cctccgaccacttccagggg

SEQ ID NO: 5008324 - DNA, 20 bp, Homo sapiens
cctcctccagggtgatttta

SEQ ID NO: 5008325 - DNA, 16 bp, Homo sapiens
aattaatggaatcttc

SEQ ID NO: 5008326 - DNA, 17 bp, Homo sapiens
aattgaattggaaagac

SEQ ID NO: 5008327 - DNA, 11 bp, Homo sapiens
aattgactacc

SEQ ID NO: 5008328 - DNA, 13 bp, Homo sapiens
aattggaaagact

SEQ ID NO: 5008329 - DNA, 23 bp, Homo sapiens
aattgtgtatttaaaaaaaagaa

SEQ ID NO: 5008330 - DNA, 19 bp, Homo sapiens
aatttaatttgtaaaactt

SEQ ID NO: 5008331 - DNA, 16 bp, Homo sapiens
aatttgtaaaacttct

SEQ ID NO: 5008332 - DNA, 22 bp, Homo sapiens
aattttgctggaattcctaact

SEQ ID NO: 5008333 - DNA, 15 bp, Homo sapiens
acaaaaaaaatttta

SEQ ID NO: 5008334 - DNA, 21 bp, Homo sapiens
acaaccaatttacactgccat

SEQ ID NO: 5008335 - DNA, 17 bp, Homo sapiens
acaacccttctctgttg

SEQ ID NO: 5008336 - DNA, 22 bp, Homo sapiens
acaacggaggcctgcgaccctg

SEQ ID NO: 5008337 - DNA, 15 bp, Homo sapiens
acaattcttgaattc

SEQ ID NO: 5008338 - DNA, 13 bp, Homo sapiens
acacccaaagctg

SEQ ID NO: 5008339 - DNA, 22 bp, Homo sapiens
acactgaaatgaaatcttccca

SEQ ID NO: 5008340 - DNA, 19 bp, Homo sapiens
acacttcttacgcaatgct

SEQ ID NO: 5008341 - DNA, 11 bp, Homo sapiens
acagagaccta

SEQ ID NO: 5008342 - DNA, 13 bp, Homo sapiens
acaggaggcaggc

SEQ ID NO: 5008343 - DNA, 15 bp, Homo sapiens
acagggtgggcctcg

SEQ ID NO: 5008344 - DNA, 17 bp, Homo sapiens
acaggtaactaattgga

SEQ ID NO: 5008345 - DNA, 15 bp, Homo sapiens
acatatatatatata

SEQ ID NO: 5008346 - DNA, 17 bp, Homo sapiens
acatatatatatataac

SEQ ID NO: 5008347 - DNA, 14 bp, Homo sapiens
acatatgacttgat

SEQ ID NO: 5008348 - DNA, 23 bp, Homo sapiens
acatattttttgtatatttgttt

SEQ ID NO: 5008349 - DNA, 18 bp, Homo sapiens
acatcacagggtgggcct

SEQ ID NO: 5008350 - DNA, 21 bp, Homo sapiens
acatccgcgtgtgcctgtgtg

SEQ ID NO: 5008351 - DNA, 23 bp, Homo sapiens
acatccgcgtgtgcctgtgtgcg

SEQ ID NO: 5008352 - DNA, 20 bp, Homo sapiens
acatgaaacctacacactgt

SEQ ID NO: 5008353 - DNA, 15 bp, Homo sapiens
acatgtcaatctgtc

SEQ ID NO: 5008354 - DNA, 22 bp, Homo sapiens
acatgtcctaattcttctgtcc

SEQ ID NO: 5008355 - DNA, 20 bp, Homo sapiens
acattcgaaggaacctgtgt

SEQ ID NO: 5008356 - DNA, 21 bp, Homo sapiens
acatttttccgtttgcttttg

SEQ ID NO: 5008357 - DNA, 20 bp, Homo sapiens
accaaggaaacgctacctct

SEQ ID NO: 5008358 - DNA, 22 bp, Homo sapiens
accacgggacatcacagggtgg

SEQ ID NO: 5008359 - DNA, 14 bp, Homo sapiens
accacttccagggg

SEQ ID NO: 5008360 - DNA, 20 bp, Homo sapiens
accacttccaggggaacctg

SEQ ID NO: 5008361 - DNA, 16 bp, Homo sapiens
accagggccttttctg

SEQ ID NO: 5008362 - DNA, 21 bp, Homo sapiens
accagggccttttctggcacc

SEQ ID NO: 5008363 - DNA, 13 bp, Homo sapiens
accatccagctcc

SEQ ID NO: 5008364 - DNA, 14 bp, Homo sapiens
accatccagctccc

SEQ ID NO: 5008365 - DNA, 17 bp, Homo sapiens
acccaaagctgagcctg

SEQ ID NO: 5008366 - DNA, 18 bp, Homo sapiens
acccatgcaagcagagga

SEQ ID NO: 5008367 - DNA, 22 bp, Homo sapiens
acccatgcaagcagaggaccag

SEQ ID NO: 5008368 - DNA, 12 bp, Homo sapiens
accccactcctg

SEQ ID NO: 5008369 - DNA, 14 bp, Homo sapiens
accccactcctgtc

SEQ ID NO: 5008370 - DNA, 16 bp, Homo sapiens
accctgctgctggtgc

SEQ ID NO: 5008371 - DNA, 19 bp, Homo sapiens
accctgctgctggtgcaca

SEQ ID NO: 5008372 - DNA, 16 bp, Homo sapiens
accctgggggcacagg

SEQ ID NO: 5008373 - DNA, 15 bp, Homo sapiens
accgaggggcctttg

SEQ ID NO: 5008374 - DNA, 17 bp, Homo sapiens
accgcacatgcacacac

SEQ ID NO: 5008375 - DNA, 20 bp, Homo sapiens
accgcctccccacctccagg

SEQ ID NO: 5008376 - DNA, 16 bp, Homo sapiens
acctacacactgtcat

SEQ ID NO: 5008377 - DNA, 22 bp, Homo sapiens
acctcagttgaaaatgcaactc

SEQ ID NO: 5008378 - DNA, 19 bp, Homo sapiens
acctctctgtcccttgctg

SEQ ID NO: 5008379 - DNA, 19 bp, Homo sapiens
acctgaagatgggagcctt

SEQ ID NO: 5008380 - DNA, 21 bp, Homo sapiens
acctgcatttgtatgtgtccc

SEQ ID NO: 5008381 - DNA, 16 bp, Homo sapiens
acctgccatgccagga

SEQ ID NO: 5008382 - DNA, 14 bp, Homo sapiens
acctgctcccaggc

SEQ ID NO: 5008383 - DNA, 16 bp, Homo sapiens
acctgctcccaggccc

SEQ ID NO: 5008384 - DNA, 23 bp, Homo sapiens
acctggcggtgtataccaggcag

SEQ ID NO: 5008385 - DNA, 20 bp, Homo sapiens
acctgtatatttgtaaagct

SEQ ID NO: 5008386 - DNA, 22 bp, Homo sapiens
acctgtcctaaggaaccttcct

SEQ ID NO: 5008387 - DNA, 22 bp, Homo sapiens
accttcagatccttttattctc

SEQ ID NO: 5008388 - DNA, 13 bp, Homo sapiens
accttccaacact

SEQ ID NO: 5008389 - DNA, 22 bp, Homo sapiens
accttgcttcttactgataatt

SEQ ID NO: 5008390 - DNA, 14 bp, Homo sapiens
accttgtgcctggg

SEQ ID NO: 5008391 - DNA, 15 bp, Homo sapiens
acgctacctctctgt

SEQ ID NO: 5008392 - DNA, 20 bp, Homo sapiens
acggaggcctgcgaccctgg

SEQ ID NO: 5008393 - DNA, 14 bp, Homo sapiens
acggtttccaggga

SEQ ID NO: 5008394 - DNA, 15 bp, Homo sapiens
acggtttccagggag

SEQ ID NO: 5008395 - DNA, 20 bp, Homo sapiens
acgtctgaagcttgactccc

SEQ ID NO: 5008396 - DNA, 23 bp, Homo sapiens
acgtgctccgtagctctgctgct

SEQ ID NO: 5008397 - DNA, 24 bp, Homo sapiens
acgtgctccgtagctctgctgctg

SEQ ID NO: 5008398 - DNA, 15 bp, Homo sapiens
acgttggttaaataa

SEQ ID NO: 5008399 - DNA, 23 bp, Homo sapiens
actaagtccctataataaaggct

SEQ ID NO: 5008400 - DNA, 12 bp, Homo sapiens
actaattggaag

SEQ ID NO: 5008401 - DNA, 19 bp, Homo sapiens
actaattggaaggagaggg

SEQ ID NO: 5008402 - DNA, 19 bp, Homo sapiens
actacttccatccctgctt

SEQ ID NO: 5008403 - DNA, 18 bp, Homo sapiens
actatattgattgtcctt

SEQ ID NO: 5008404 - DNA, 15 bp, Homo sapiens
actatgtatatacat

SEQ ID NO: 5008405 - DNA, 12 bp, Homo sapiens
actcagtgcaga

SEQ ID NO: 5008406 - DNA, 11 bp, Homo sapiens
actccatctct

SEQ ID NO: 5008407 - DNA, 14 bp, Homo sapiens
actctgagagctgt

SEQ ID NO: 5008408 - DNA, 13 bp, Homo sapiens
actgatgttgtgt

SEQ ID NO: 5008409 - DNA, 16 bp, Homo sapiens
actgcaggaaaaccct

SEQ ID NO: 5008410 - DNA, 22 bp, Homo sapiens
actgccccccatgaggaaggaa

SEQ ID NO: 5008411 - DNA, 19 bp, Homo sapiens
actgctacctttcaaagct

SEQ ID NO: 5008412 - DNA, 14 bp, Homo sapiens
actgggccctgagt

SEQ ID NO: 5008413 - DNA, 15 bp, Homo sapiens
actgggtctgcgatg

SEQ ID NO: 5008414 - DNA, 15 bp, Homo sapiens
actgtcatgcttcat

SEQ ID NO: 5008415 - DNA, 16 bp, Homo sapiens
actgttactgggccct

SEQ ID NO: 5008416 - DNA, 18 bp, Homo sapiens
actgttactgggccctga

SEQ ID NO: 5008417 - DNA, 13 bp, Homo sapiens
actgttgaaagga

SEQ ID NO: 5008418 - DNA, 16 bp, Homo sapiens
acttaaaaaatcagaa

SEQ ID NO: 5008419 - DNA, 16 bp, Homo sapiens
acttcaaagcaagctg

SEQ ID NO: 5008420 - DNA, 21 bp, Homo sapiens
acttcagggaaggtgaaacag

SEQ ID NO: 5008421 - DNA, 18 bp, Homo sapiens
acttccaggggaacctgc

SEQ ID NO: 5008422 - DNA, 20 bp, Homo sapiens
acttccatccctgcttattt

SEQ ID NO: 5008423 - DNA, 13 bp, Homo sapiens
acttcccaccctg

SEQ ID NO: 5008424 - DNA, 14 bp, Homo sapiens
acttcccaccctgc

SEQ ID NO: 5008425 - DNA, 12 bp, Homo sapiens
acttcctgtact

SEQ ID NO: 5008426 - DNA, 17 bp, Homo sapiens
acttctcaaagagaatt

SEQ ID NO: 5008427 - DNA, 14 bp, Homo sapiens
acttctgctggcat

SEQ ID NO: 5008428 - DNA, 21 bp, Homo sapiens
actttccgaaaaataaagaca

SEQ ID NO: 5008429 - DNA, 11 bp, Homo sapiens
acttttgagga

SEQ ID NO: 5008430 - DNA, 13 bp, Homo sapiens
agaacaaaacttc

SEQ ID NO: 5008431 - DNA, 15 bp, Homo sapiens
agaagagggtgtgtt

SEQ ID NO: 5008432 - DNA, 13 bp, Homo sapiens
agaagccctgatg

SEQ ID NO: 5008433 - DNA, 17 bp, Homo sapiens
agaaggttgacacagtt

SEQ ID NO: 5008434 - DNA, 17 bp, Homo sapiens
agaataaaaacttttga

SEQ ID NO: 5008435 - DNA, 21 bp, Homo sapiens
agaattgaattggaaagactt

SEQ ID NO: 5008436 - DNA, 16 bp, Homo sapiens
agaatttggggcagga

SEQ ID NO: 5008437 - DNA, 22 bp, Homo sapiens
agacatttttccgtttgctttt

SEQ ID NO: 5008438 - DNA, 16 bp, Homo sapiens
agacggtttccaggga

SEQ ID NO: 5008439 - DNA, 19 bp, Homo sapiens
agacggtttccagggaggg

SEQ ID NO: 5008440 - DNA, 15 bp, Homo sapiens
agactctagggtcca

SEQ ID NO: 5008441 - DNA, 16 bp, Homo sapiens
agactttatgtagttt

SEQ ID NO: 5008442 - DNA, 17 bp, Homo sapiens
agactttatgtagtttt

SEQ ID NO: 5008443 - DNA, 20 bp, Homo sapiens
agagcagaacagatctttta

SEQ ID NO: 5008444 - DNA, 18 bp, Homo sapiens
agagccctctcctccctc

SEQ ID NO: 5008445 - DNA, 18 bp, Homo sapiens
agaggctgcccctctcac

SEQ ID NO: 5008446 - DNA, 15 bp, Homo sapiens
agaggggaggtcact

SEQ ID NO: 5008447 - DNA, 16 bp, Homo sapiens
agaggtgcttcaccct

SEQ ID NO: 5008448 - DNA, 21 bp, Homo sapiens
agatggctggaaggggtccag

SEQ ID NO: 5008449 - DNA, 23 bp, Homo sapiens
agatgttacaagtttatatatat

SEQ ID NO: 5008450 - DNA, 18 bp, Homo sapiens
agcaagggggtgatgtag

SEQ ID NO: 5008451 - DNA, 20 bp, Homo sapiens
agcaaggtgggtggaaacta

SEQ ID NO: 5008452 - DNA, 12 bp, Homo sapiens
agcaatctgcct

SEQ ID NO: 5008453 - DNA, 17 bp, Homo sapiens
agcaccgaggggccttt

SEQ ID NO: 5008454 - DNA, 18 bp, Homo sapiens
agcaccgaggggcctttg

SEQ ID NO: 5008455 - DNA, 14 bp, Homo sapiens
agcagaggaccagg

SEQ ID NO: 5008456 - DNA, 16 bp, Homo sapiens
agcagaggaccagggc

SEQ ID NO: 5008457 - DNA, 17 bp, Homo sapiens
agcagaggaccagggcc

SEQ ID NO: 5008458 - DNA, 19 bp, Homo sapiens
agcagatggtttccacatt

SEQ ID NO: 5008459 - DNA, 22 bp, Homo sapiens
agcagcatcctcctctctggcc

SEQ ID NO: 5008460 - DNA, 16 bp, Homo sapiens
agcagcccaccctgct

SEQ ID NO: 5008461 - DNA, 13 bp, Homo sapiens
agcagcttctcca

SEQ ID NO: 5008462 - DNA, 15 bp, Homo sapiens
agcagcttctccagg

SEQ ID NO: 5008463 - DNA, 14 bp, Homo sapiens
agcagggaaggcct

SEQ ID NO: 5008464 - DNA, 17 bp, Homo sapiens
agcagggaaggcctgac

SEQ ID NO: 5008465 - DNA, 16 bp, Homo sapiens
agcatttagctggcca

SEQ ID NO: 5008466 - DNA, 17 bp, Homo sapiens
agccactccccggcatg

SEQ ID NO: 5008467 - DNA, 16 bp, Homo sapiens
agccagactctgtctc

SEQ ID NO: 5008468 - DNA, 13 bp, Homo sapiens
agcccaccctgct

SEQ ID NO: 5008469 - DNA, 19 bp, Homo sapiens
agcccacctgctcccaggc

SEQ ID NO: 5008470 - DNA, 16 bp, Homo sapiens
agcccagggcaccatc

SEQ ID NO: 5008471 - DNA, 19 bp, Homo sapiens
agcccagggcaccatccag

SEQ ID NO: 5008472 - DNA, 18 bp, Homo sapiens
agcccatccttccctttg

SEQ ID NO: 5008473 - DNA, 17 bp, Homo sapiens
agcctcgttttgatgcc

SEQ ID NO: 5008474 - DNA, 19 bp, Homo sapiens
agctagtgtacctcctctc

SEQ ID NO: 5008475 - DNA, 17 bp, Homo sapiens
agctatcgaacttcaca

SEQ ID NO: 5008476 - DNA, 17 bp, Homo sapiens
agctccccagcccacct

SEQ ID NO: 5008477 - DNA, 16 bp, Homo sapiens
agctgagcctgcaggg

SEQ ID NO: 5008478 - DNA, 15 bp, Homo sapiens
agctgattttattca

SEQ ID NO: 5008479 - DNA, 12 bp, Homo sapiens
agctggcctgag

SEQ ID NO: 5008480 - DNA, 16 bp, Homo sapiens
agctgggcccgacatg

SEQ ID NO: 5008481 - DNA, 21 bp, Homo sapiens
agctgggcccgacatggctcc

SEQ ID NO: 5008482 - DNA, 17 bp, Homo sapiens
agctgtcaccaaggaaa

SEQ ID NO: 5008483 - DNA, 18 bp, Homo sapiens
agctgtcaccaaggaaac

SEQ ID NO: 5008484 - DNA, 20 bp, Homo sapiens
agctgtcacttttgctccga

SEQ ID NO: 5008485 - DNA, 11 bp, Homo sapiens
agcttatctct

SEQ ID NO: 5008486 - DNA, 21 bp, Homo sapiens
agcttctccaggaagcccagg

SEQ ID NO: 5008487 - DNA, 13 bp, Homo sapiens
agcttgactccca

SEQ ID NO: 5008488 - DNA, 16 bp, Homo sapiens
aggaaacgctacctct

SEQ ID NO: 5008489 - DNA, 13 bp, Homo sapiens
aggaccagggcct

SEQ ID NO: 5008490 - DNA, 20 bp, Homo sapiens
aggaccagggccttttctgg

SEQ ID NO: 5008491 - DNA, 20 bp, Homo sapiens
aggagctgtcaccaaggaaa

SEQ ID NO: 5008492 - DNA, 14 bp, Homo sapiens
aggcaggcatggcc

SEQ ID NO: 5008493 - DNA, 17 bp, Homo sapiens
aggcaggcatggccctg

SEQ ID NO: 5008494 - DNA, 12 bp, Homo sapiens
aggcatggccct

SEQ ID NO: 5008495 - DNA, 23 bp, Homo sapiens
aggccaagtccgcagaagccctg

SEQ ID NO: 5008496 - DNA, 17 bp, Homo sapiens
aggcctgacttctgctg

SEQ ID NO: 5008497 - DNA, 19 bp, Homo sapiens
aggcctgcgaccctggggg

SEQ ID NO: 5008498 - DNA, 20 bp, Homo sapiens
aggcctgggctggttggaga

SEQ ID NO: 5008499 - DNA, 22 bp, Homo sapiens
aggcctgggtgatctgctgctg

SEQ ID NO: 5008500 - DNA, 17 bp, Homo sapiens
aggcctgtggctccctt

SEQ ID NO: 5008501 - DNA, 22 bp, Homo sapiens
aggctgggccatgtccaaagag

SEQ ID NO: 5008502 - DNA, 21 bp, Homo sapiens
aggctggtacaacggaggcct

SEQ ID NO: 5008503 - DNA, 22 bp, Homo sapiens
aggctttcccacttcccaccct

SEQ ID NO: 5008504 - DNA, 12 bp, Homo sapiens
agggaaggcctg

SEQ ID NO: 5008505 - DNA, 15 bp, Homo sapiens
agggaatcctcctcc

SEQ ID NO: 5008506 - DNA, 20 bp, Homo sapiens
agggacggccaagaatgtac

SEQ ID NO: 5008507 - DNA, 20 bp, Homo sapiens
agggagacggtttccaggga

SEQ ID NO: 5008508 - DNA, 15 bp, Homo sapiens
agggaggccccaggg

SEQ ID NO: 5008509 - DNA, 16 bp, Homo sapiens
agggaggccccagggg

SEQ ID NO: 5008510 - DNA, 18 bp, Homo sapiens
agggaggggccggccctg

SEQ ID NO: 5008511 - DNA, 18 bp, Homo sapiens
agggcaccatccagctcc

SEQ ID NO: 5008512 - DNA, 15 bp, Homo sapiens
agggccttttctggc

SEQ ID NO: 5008513 - DNA, 19 bp, Homo sapiens
agggccttttctggcaccg

SEQ ID NO: 5008514 - DNA, 20 bp, Homo sapiens
agggccttttctggcaccgc

SEQ ID NO: 5008515 - DNA, 13 bp, Homo sapiens
aggggccggccct

SEQ ID NO: 5008516 - DNA, 14 bp, Homo sapiens
aggggtccctagca

SEQ ID NO: 5008517 - DNA, 23 bp, Homo sapiens
aggggtccctagcagcccaccct

SEQ ID NO: 5008518 - DNA, 20 bp, Homo sapiens
agggtgtgtttgaaatcatc

SEQ ID NO: 5008519 - DNA, 13 bp, Homo sapiens
aggtaccctgggt

SEQ ID NO: 5008520 - DNA, 14 bp, Homo sapiens
aggtaccctgggtg

SEQ ID NO: 5008521 - DNA, 20 bp, Homo sapiens
aggtcacaacccttctctgt

SEQ ID NO: 5008522 - DNA, 12 bp, Homo sapiens
aggtgcagaggt

SEQ ID NO: 5008523 - DNA, 18 bp, Homo sapiens
agtaatttaatttgtaaa

SEQ ID NO: 5008524 - DNA, 22 bp, Homo sapiens
agtaatttaatttgtaaaactt

SEQ ID NO: 5008525 - DNA, 12 bp, Homo sapiens
agtaccttgctt

SEQ ID NO: 5008526 - DNA, 16 bp, Homo sapiens
agtactttgtgcattc

SEQ ID NO: 5008527 - DNA, 11 bp, Homo sapiens
agtatccaggc

SEQ ID NO: 5008528 - DNA, 14 bp, Homo sapiens
agtattataaattg

SEQ ID NO: 5008529 - DNA, 21 bp, Homo sapiens
agtattataaattgtgtattt

SEQ ID NO: 5008530 - DNA, 18 bp, Homo sapiens
agtcagccaggagctgtc

SEQ ID NO: 5008531 - DNA, 20 bp, Homo sapiens
agtccctataataaaggctg

SEQ ID NO: 5008532 - DNA, 13 bp, Homo sapiens
agtgcagaatgta

SEQ ID NO: 5008533 - DNA, 16 bp, Homo sapiens
agtgcatatttatcca

SEQ ID NO: 5008534 - DNA, 15 bp, Homo sapiens
agtgcctcaccttcc

SEQ ID NO: 5008535 - DNA, 19 bp, Homo sapiens
agtgccttttgcagaagag

SEQ ID NO: 5008536 - DNA, 22 bp, Homo sapiens
agtgccttttgcagaagagggt

SEQ ID NO: 5008537 - DNA, 18 bp, Homo sapiens
agtggcaccgcctcccca

SEQ ID NO: 5008538 - DNA, 15 bp, Homo sapiens
agtgtacctcctctc

SEQ ID NO: 5008539 - DNA, 22 bp, Homo sapiens
agtgtacctcctctcagtgttt

SEQ ID NO: 5008540 - DNA, 13 bp, Homo sapiens
agtgtctgtattt

SEQ ID NO: 5008541 - DNA, 17 bp, Homo sapiens
agtgtgccagtttaaaa

SEQ ID NO: 5008542 - DNA, 15 bp, Homo sapiens
agtgttttggactcc

SEQ ID NO: 5008543 - DNA, 19 bp, Homo sapiens
agtgttttggactccatct

SEQ ID NO: 5008544 - DNA, 22 bp, Homo sapiens
agtttttctgttttgtttggca

SEQ ID NO: 5008545 - DNA, 11 bp, Homo sapiens
ataacatatat

SEQ ID NO: 5008546 - DNA, 13 bp, Homo sapiens
ataactcaacatt

SEQ ID NO: 5008547 - DNA, 12 bp, Homo sapiens
ataacttcctgt

SEQ ID NO: 5008548 - DNA, 13 bp, Homo sapiens
ataataaaggctg

SEQ ID NO: 5008549 - DNA, 21 bp, Homo sapiens
ataatgttttgggaaacactg

SEQ ID NO: 5008550 - DNA, 22 bp, Homo sapiens
ataattttgctggaattcctaa

SEQ ID NO: 5008551 - DNA, 14 bp, Homo sapiens
ataccaggcagtgt

SEQ ID NO: 5008552 - DNA, 14 bp, Homo sapiens
atactttgccactg

SEQ ID NO: 5008553 - DNA, 15 bp, Homo sapiens
atactttgccactgc

SEQ ID NO: 5008554 - DNA, 18 bp, Homo sapiens
atagatgctgtgtatatg

SEQ ID NO: 5008555 - DNA, 11 bp, Homo sapiens
atagcctggac

SEQ ID NO: 5008556 - DNA, 16 bp, Homo sapiens
atataacatatatgga

SEQ ID NO: 5008557 - DNA, 14 bp, Homo sapiens
atatacatatatat

SEQ ID NO: 5008558 - DNA, 17 bp, Homo sapiens
atatactttgccactgc

SEQ ID NO: 5008559 - DNA, 18 bp, Homo sapiens
atatataacatatatgga

SEQ ID NO: 5008560 - DNA, 16 bp, Homo sapiens
atatatataacatata

SEQ ID NO: 5008561 - DNA, 11 bp, Homo sapiens
atatatataat

SEQ ID NO: 5008562 - DNA, 15 bp, Homo sapiens
atatatgcactatgt

SEQ ID NO: 5008563 - DNA, 14 bp, Homo sapiens
atatcatatgtata

SEQ ID NO: 5008564 - DNA, 17 bp, Homo sapiens
atatctatatatataat

SEQ ID NO: 5008565 - DNA, 14 bp, Homo sapiens
atatggtatatata

SEQ ID NO: 5008566 - DNA, 13 bp, Homo sapiens
atatttctcatct

SEQ ID NO: 5008567 - DNA, 20 bp, Homo sapiens
atatttgttttatgctactg

SEQ ID NO: 5008568 - DNA, 19 bp, Homo sapiens
atattttaatgcagttgct

SEQ ID NO: 5008569 - DNA, 17 bp, Homo sapiens
atcaacaacatccactg

SEQ ID NO: 5008570 - DNA, 21 bp, Homo sapiens
atcacagggtgggcctcggcc

SEQ ID NO: 5008571 - DNA, 16 bp, Homo sapiens
atcatcgccagaggtg

SEQ ID NO: 5008572 - DNA, 24 bp, Homo sapiens
atcatcggagtcagccaggagctg

SEQ ID NO: 5008573 - DNA, 22 bp, Homo sapiens
atcatggtagagaatctctccc

SEQ ID NO: 5008574 - DNA, 13 bp, Homo sapiens
atcattccctctc

SEQ ID NO: 5008575 - DNA, 17 bp, Homo sapiens
atccaaaatgtgtattt

SEQ ID NO: 5008576 - DNA, 16 bp, Homo sapiens
atccgcgtgtgcctgt

SEQ ID NO: 5008577 - DNA, 19 bp, Homo sapiens
atcctccagtaccttgctt

SEQ ID NO: 5008578 - DNA, 20 bp, Homo sapiens
atcctccagtaccttgcttc

SEQ ID NO: 5008579 - DNA, 16 bp, Homo sapiens
atccttccctttggag

SEQ ID NO: 5008580 - DNA, 21 bp, Homo sapiens
atccttccctttggagatgct

SEQ ID NO: 5008581 - DNA, 17 bp, Homo sapiens
atctcaggcttctgcag

SEQ ID NO: 5008582 - DNA, 11 bp, Homo sapiens
atctcttttat

SEQ ID NO: 5008583 - DNA, 12 bp, Homo sapiens
atgaaaaagaat

SEQ ID NO: 5008584 - DNA, 16 bp, Homo sapiens
atgaaatcttcccagt

SEQ ID NO: 5008585 - DNA, 20 bp, Homo sapiens
atgacgtgctccgtagctct

SEQ ID NO: 5008586 - DNA, 16 bp, Homo sapiens
atgagactcagtgcag

SEQ ID NO: 5008587 - DNA, 15 bp, Homo sapiens
atgagactctagggt

SEQ ID NO: 5008588 - DNA, 17 bp, Homo sapiens
atgagactctagggtcc

SEQ ID NO: 5008589 - DNA, 15 bp, Homo sapiens
atgatttagcaagca

SEQ ID NO: 5008590 - DNA, 17 bp, Homo sapiens
atgatttagcaagcaac

SEQ ID NO: 5008591 - DNA, 22 bp, Homo sapiens
atgatttagcaagcaactaatt

SEQ ID NO: 5008592 - DNA, 20 bp, Homo sapiens
atgatttataaacagacaat

SEQ ID NO: 5008593 - DNA, 21 bp, Homo sapiens
atgcaactctaactctgagag

SEQ ID NO: 5008594 - DNA, 14 bp, Homo sapiens
atgcaagcagagga

SEQ ID NO: 5008595 - DNA, 17 bp, Homo sapiens
atgcaagcagaggacca

SEQ ID NO: 5008596 - DNA, 14 bp, Homo sapiens
atgcactatgtata

SEQ ID NO: 5008597 - DNA, 23 bp, Homo sapiens
atgcctagtttcttacacactgt

SEQ ID NO: 5008598 - DNA, 18 bp, Homo sapiens
atgctactgaactgaaag

SEQ ID NO: 5008599 - DNA, 13 bp, Homo sapiens
atgctgagggtgt

SEQ ID NO: 5008600 - DNA, 17 bp, Homo sapiens
atgctgagggtgtttct

SEQ ID NO: 5008601 - DNA, 23 bp, Homo sapiens
atgctgagggtgtttcttcctgc

SEQ ID NO: 5008602 - DNA, 19 bp, Homo sapiens
atgctgatcatcgccagag

SEQ ID NO: 5008603 - DNA, 22 bp, Homo sapiens
atgctgatcatcgccagaggtg

SEQ ID NO: 5008604 - DNA, 24 bp, Homo sapiens
atgctgatcatcgccagaggtgct

SEQ ID NO: 5008605 - DNA, 16 bp, Homo sapiens
atgcttctagagtttt

SEQ ID NO: 5008606 - DNA, 16 bp, Homo sapiens
atggcaggtgcctgta

SEQ ID NO: 5008607 - DNA, 13 bp, Homo sapiens
atggccctgggcg

SEQ ID NO: 5008608 - DNA, 12 bp, Homo sapiens
atggtatatata

SEQ ID NO: 5008609 - DNA, 16 bp, Homo sapiens
atggtatatatacata

SEQ ID NO: 5008610 - DNA, 17 bp, Homo sapiens
atggtcattgcagttta

SEQ ID NO: 5008611 - DNA, 15 bp, Homo sapiens
atggtgtgttctgca

SEQ ID NO: 5008612 - DNA, 14 bp, Homo sapiens
atgtaagtgggccc

SEQ ID NO: 5008613 - DNA, 18 bp, Homo sapiens
atgtaatgttaatgttat

SEQ ID NO: 5008614 - DNA, 20 bp, Homo sapiens
atgtagcccatccttccctt

SEQ ID NO: 5008615 - DNA, 19 bp, Homo sapiens
atgtatatatatatatgca

SEQ ID NO: 5008616 - DNA, 16 bp, Homo sapiens
atgtccaaagaggctg

SEQ ID NO: 5008617 - DNA, 20 bp, Homo sapiens
atgtccaaagaggctgcccc

SEQ ID NO: 5008618 - DNA, 22 bp, Homo sapiens
atgtccagcaccttgtgcctgg

SEQ ID NO: 5008619 - DNA, 19 bp, Homo sapiens
atgtgaggggtccctagca

SEQ ID NO: 5008620 - DNA, 18 bp, Homo sapiens
atgtgagtgccttttgca

SEQ ID NO: 5008621 - DNA, 22 bp, Homo sapiens
atgtgagtgccttttgcagaag

SEQ ID NO: 5008622 - DNA, 14 bp, Homo sapiens
atgtgtatttctta

SEQ ID NO: 5008623 - DNA, 17 bp, Homo sapiens
atgttacaagtttatat

SEQ ID NO: 5008624 - DNA, 19 bp, Homo sapiens
atgttatatcatatgtata

SEQ ID NO: 5008625 - DNA, 17 bp, Homo sapiens
atgttgtaatatttctt

SEQ ID NO: 5008626 - DNA, 23 bp, Homo sapiens
atgttgtattgatttttaagaaa

SEQ ID NO: 5008627 - DNA, 16 bp, Homo sapiens
agacctatgtaagaat

SEQ ID NO: 5008628 - DNA, 18 bp, Homo sapiens
agactcagtgcagatgga

SEQ ID NO: 5008629 - DNA, 20 bp, Homo sapiens
agacttctcaaagagaattg

SEQ ID NO: 5008630 - DNA, 17 bp, Homo sapiens
agagaattgtatgtaac

SEQ ID NO: 5008631 - DNA, 14 bp, Homo sapiens
agagactgaaatta

SEQ ID NO: 5008632 - DNA, 21 bp, Homo sapiens
agaggaacagcactggggagt

SEQ ID NO: 5008633 - DNA, 14 bp, Homo sapiens
agaggaccagggcc

SEQ ID NO: 5008634 - DNA, 16 bp, Homo sapiens
agaggctgcccctctc

SEQ ID NO: 5008635 - DNA, 20 bp, Homo sapiens
agagggacggccaagaatgt

SEQ ID NO: 5008636 - DNA, 22 bp, Homo sapiens
agagggacggccaagaatgtac

SEQ ID NO: 5008637 - DNA, 17 bp, Homo sapiens
agaggtaccctgggtgt

SEQ ID NO: 5008638 - DNA, 17 bp, Homo sapiens
agaggtgggagggccct

SEQ ID NO: 5008639 - DNA, 14 bp, Homo sapiens
agatactttgaagt

SEQ ID NO: 5008640 - DNA, 19 bp, Homo sapiens
agatactttgaagtgcagc

SEQ ID NO: 5008641 - DNA, 18 bp, Homo sapiens
agatattgttgttttcca

SEQ ID NO: 5008642 - DNA, 23 bp, Homo sapiens
agatctaacgtgttccagtgtct

SEQ ID NO: 5008643 - DNA, 23 bp, Homo sapiens
agcaagccagccaatagaatggg

SEQ ID NO: 5008644 - DNA, 14 bp, Homo sapiens
agcaccgaggggcc

SEQ ID NO: 5008645 - DNA, 15 bp, Homo sapiens
agcaccttgtgcctg

SEQ ID NO: 5008646 - DNA, 15 bp, Homo sapiens
agcacttaagtgtta

SEQ ID NO: 5008647 - DNA, 13 bp, Homo sapiens
agcagaggaccag

SEQ ID NO: 5008648 - DNA, 18 bp, Homo sapiens
agcagaggaccagggcct

SEQ ID NO: 5008649 - DNA, 13 bp, Homo sapiens
agcagcccaccct

SEQ ID NO: 5008650 - DNA, 20 bp, Homo sapiens
agcagcccaccctgctgctg

SEQ ID NO: 5008651 - DNA, 12 bp, Homo sapiens
agcagggaaggc

SEQ ID NO: 5008652 - DNA, 14 bp, Homo sapiens
agcatgaatgtttt

SEQ ID NO: 5008653 - DNA, 16 bp, Homo sapiens
agcattctgcaacatt

SEQ ID NO: 5008654 - DNA, 18 bp, Homo sapiens
agcattgtttgtgatatt

SEQ ID NO: 5008655 - DNA, 14 bp, Homo sapiens
agccaccctgggct

SEQ ID NO: 5008656 - DNA, 14 bp, Homo sapiens
agccaggagctgtc

SEQ ID NO: 5008657 - DNA, 15 bp, Homo sapiens
agccaggagctgtca

SEQ ID NO: 5008658 - DNA, 17 bp, Homo sapiens
agcccacctgctcccag

SEQ ID NO: 5008659 - DNA, 21 bp, Homo sapiens
agcccagcttggccctttcct

SEQ ID NO: 5008660 - DNA, 23 bp, Homo sapiens
agcccagcttggccctttccttc

SEQ ID NO: 5008661 - DNA, 21 bp, Homo sapiens
agccctctcctccctctgtcc

SEQ ID NO: 5008662 - DNA, 21 bp, Homo sapiens
agcctcgttggaagaggaaca

SEQ ID NO: 5008663 - DNA, 14 bp, Homo sapiens
agccttagggaagc

SEQ ID NO: 5008664 - DNA, 22 bp, Homo sapiens
agccttagggaagctggcctga

SEQ ID NO: 5008665 - DNA, 19 bp, Homo sapiens
agccttcttgatgtatttc

SEQ ID NO: 5008666 - DNA, 19 bp, Homo sapiens
agcctttaccttttatgca

SEQ ID NO: 5008667 - DNA, 17 bp, Homo sapiens
agcgacccattcagaga

SEQ ID NO: 5008668 - DNA, 16 bp, Homo sapiens
agctagtgtacctcct

SEQ ID NO: 5008669 - DNA, 17 bp, Homo sapiens
agctatttatgggcccc

SEQ ID NO: 5008670 - DNA, 16 bp, Homo sapiens
agctcatgtttttaac

SEQ ID NO: 5008671 - DNA, 22 bp, Homo sapiens
agctccccagcccacctgctcc

SEQ ID NO: 5008672 - DNA, 14 bp, Homo sapiens
agctctgctgctga

SEQ ID NO: 5008673 - DNA, 17 bp, Homo sapiens
agctgagcctgcaggga

SEQ ID NO: 5008674 - DNA, 21 bp, Homo sapiens
agctggcctgagaggggaagc

SEQ ID NO: 5008675 - DNA, 11 bp, Homo sapiens
agctgggcccg

SEQ ID NO: 5008676 - DNA, 14 bp, Homo sapiens
agctgtcctggagg

SEQ ID NO: 5008677 - DNA, 15 bp, Homo sapiens
agctgtcctggaggt

SEQ ID NO: 5008678 - DNA, 13 bp, Homo sapiens
agcttatctcttt

SEQ ID NO: 5008679 - DNA, 17 bp, Homo sapiens
agcttggccctttcctt

SEQ ID NO: 5008680 - DNA, 17 bp, Homo sapiens
agctttggtctgtgtgt

SEQ ID NO: 5008681 - DNA, 13 bp, Homo sapiens
aggaacctgtcct

SEQ ID NO: 5008682 - DNA, 19 bp, Homo sapiens
aggaaccttccttcctgct

SEQ ID NO: 5008683 - DNA, 20 bp, Homo sapiens
aggaggcaggcatggccctg

SEQ ID NO: 5008684 - DNA, 15 bp, Homo sapiens
aggcaggcatggccc

SEQ ID NO: 5008685 - DNA, 18 bp, Homo sapiens
aggcaggcatggccctgg

SEQ ID NO: 5008686 - DNA, 19 bp, Homo sapiens
aggcaggcatggccctggg

SEQ ID NO: 5008687 - DNA, 20 bp, Homo sapiens
aggcaggcatggccctgggc

SEQ ID NO: 5008688 - DNA, 23 bp, Homo sapiens
aggcagggagacggtttccaggg

SEQ ID NO: 5008689 - DNA, 15 bp, Homo sapiens
aggcatggccctggg

SEQ ID NO: 5008690 - DNA, 12 bp, Homo sapiens
aggccctgccca

SEQ ID NO: 5008691 - DNA, 16 bp, Homo sapiens
aggcctgacttctgct

SEQ ID NO: 5008692 - DNA, 19 bp, Homo sapiens
aggcctgacttctgctggc

SEQ ID NO: 5008693 - DNA, 17 bp, Homo sapiens
aggcctgcgaccctggg

SEQ ID NO: 5008694 - DNA, 20 bp, Homo sapiens
aggcctgcgaccctgggggc

SEQ ID NO: 5008695 - DNA, 21 bp, Homo sapiens
aggcctgcgaccctgggggca

SEQ ID NO: 5008696 - DNA, 12 bp, Homo sapiens
aggctgcccctc

SEQ ID NO: 5008697 - DNA, 18 bp, Homo sapiens
aggctgggccatgtccaa

SEQ ID NO: 5008698 - DNA, 20 bp, Homo sapiens
aggctgggccatgtccaaag

SEQ ID NO: 5008699 - DNA, 14 bp, Homo sapiens
aggcttctgcagtt

SEQ ID NO: 5008700 - DNA, 18 bp, Homo sapiens
aggctttcccacttccca

SEQ ID NO: 5008701 - DNA, 16 bp, Homo sapiens
agggaagctggcctga

SEQ ID NO: 5008702 - DNA, 17 bp, Homo sapiens
agggaagctgtcctgga

SEQ ID NO: 5008703 - DNA, 13 bp, Homo sapiens
agggaaggcctga

SEQ ID NO: 5008704 - DNA, 16 bp, Homo sapiens
agggaaggcctgactt

SEQ ID NO: 5008705 - DNA, 19 bp, Homo sapiens
agggagcagggaaggcctg

SEQ ID NO: 5008706 - DNA, 11 bp, Homo sapiens
agggaggcccc

SEQ ID NO: 5008707 - DNA, 19 bp, Homo sapiens
agggaggggccggccctgt

SEQ ID NO: 5008708 - DNA, 23 bp, Homo sapiens
agggccactggtccccaacaatg

SEQ ID NO: 5008709 - DNA, 19 bp, Homo sapiens
agggctggggatgcgcctg

SEQ ID NO: 5008710 - DNA, 16 bp, Homo sapiens
agggggatgccactcc

SEQ ID NO: 5008711 - DNA, 19 bp, Homo sapiens
agggtctgtttggactgca

SEQ ID NO: 5008712 - DNA, 23 bp, Homo sapiens
agggtgattttatgatcagtgtt

SEQ ID NO: 5008713 - DNA, 23 bp, Homo sapiens
agggtggtctcttcttggggccc

SEQ ID NO: 5008714 - DNA, 12 bp, Homo sapiens
aggtaccctggg

SEQ ID NO: 5008715 - DNA, 12 bp, Homo sapiens
aggtcagtgttt

SEQ ID NO: 5008716 - DNA, 11 bp, Homo sapiens
aggtgcagagg

SEQ ID NO: 5008717 - DNA, 15 bp, Homo sapiens
agtactttgtgcatt

SEQ ID NO: 5008718 - DNA, 15 bp, Homo sapiens
agtcatgggagagta

SEQ ID NO: 5008719 - DNA, 19 bp, Homo sapiens
agtccctataataaaggct

SEQ ID NO: 5008720 - DNA, 18 bp, Homo sapiens
agtccgcagaagccctga

SEQ ID NO: 5008721 - DNA, 15 bp, Homo sapiens
agtctagcattctgc

SEQ ID NO: 5008722 - DNA, 17 bp, Homo sapiens
agtctgaatgctgccac

SEQ ID NO: 5008723 - DNA, 19 bp, Homo sapiens
agtctttgccctgaatggt

SEQ ID NO: 5008724 - DNA, 14 bp, Homo sapiens
agtgcagaatgtaa

SEQ ID NO: 5008725 - DNA, 20 bp, Homo sapiens
agtgcagaatgtaagtgggc

SEQ ID NO: 5008726 - DNA, 22 bp, Homo sapiens
agtgcagaatgtaagtgggccc

SEQ ID NO: 5008727 - DNA, 18 bp, Homo sapiens
cccatgcaagcagaggac

SEQ ID NO: 5008728 - DNA, 12 bp, Homo sapiens
ccccactcctgt

SEQ ID NO: 5008729 - DNA, 13 bp, Homo sapiens
ccccactcctgtc

SEQ ID NO: 5008730 - DNA, 23 bp, Homo sapiens
ccccaggccctgcagcggtggtt

SEQ ID NO: 5008731 - DNA, 16 bp, Homo sapiens
ccccgagtgactctgg

SEQ ID NO: 5008732 - DNA, 23 bp, Homo sapiens
ccccggcatgagactcagtgcag

SEQ ID NO: 5008733 - DNA, 12 bp, Homo sapiens
cccctctcacca

SEQ ID NO: 5008734 - DNA, 16 bp, Homo sapiens
cccgccgatagaggga

SEQ ID NO: 5008735 - DNA, 17 bp, Homo sapiens
cccgcgcagctgcctag

SEQ ID NO: 5008736 - DNA, 20 bp, Homo sapiens
ccctagcagcccaccctgct

SEQ ID NO: 5008737 - DNA, 13 bp, Homo sapiens
ccctcgcctcctc

SEQ ID NO: 5008738 - DNA, 16 bp, Homo sapiens
ccctcgcctcctcctc

SEQ ID NO: 5008739 - DNA, 13 bp, Homo sapiens
ccctctcaccaaa

SEQ ID NO: 5008740 - DNA, 20 bp, Homo sapiens
ccctctcatctcaggtagaa

SEQ ID NO: 5008741 - DNA, 17 bp, Homo sapiens
ccctctccttgccccca

SEQ ID NO: 5008742 - DNA, 15 bp, Homo sapiens
ccctgagtctgggca

SEQ ID NO: 5008743 - DNA, 20 bp, Homo sapiens
ccctgatgtgtcctcaggga

SEQ ID NO: 5008744 - DNA, 18 bp, Homo sapiens
ccctgcagcggtggttgt

SEQ ID NO: 5008745 - DNA, 21 bp, Homo sapiens
ccctgcagcggtggttgtcac

SEQ ID NO: 5008746 - DNA, 12 bp, Homo sapiens
ccctgctgcgct

SEQ ID NO: 5008747 - DNA, 15 bp, Homo sapiens
ccctgctgctggtgc

SEQ ID NO: 5008748 - DNA, 23 bp, Homo sapiens
ccctgggtgtccccgctgctgtg

SEQ ID NO: 5008749 - DNA, 23 bp, Homo sapiens
cccttgcttgcctgcagggccat

SEQ ID NO: 5008750 - DNA, 13 bp, Homo sapiens
ccgagaaggttta

SEQ ID NO: 5008751 - DNA, 14 bp, Homo sapiens
ccgaggggcctttg

SEQ ID NO: 5008752 - DNA, 14 bp, Homo sapiens
ccgagtgactctgg

SEQ ID NO: 5008753 - DNA, 17 bp, Homo sapiens
ccgatagagggacggcc

SEQ ID NO: 5008754 - DNA, 18 bp, Homo sapiens
ccgatagagggacggcca

SEQ ID NO: 5008755 - DNA, 19 bp, Homo sapiens
ccgatgttattagatgtta

SEQ ID NO: 5008756 - DNA, 14 bp, Homo sapiens
ccgcagaagccctg

SEQ ID NO: 5008757 - DNA, 15 bp, Homo sapiens
ccgcgcagctgccta

SEQ ID NO: 5008758 - DNA, 21 bp, Homo sapiens
ccgcggcccgcgcagctgcct

SEQ ID NO: 5008759 - DNA, 16 bp, Homo sapiens
ccgctacctccctccc

SEQ ID NO: 5008760 - DNA, 14 bp, Homo sapiens
ccgctgctgtgcaa

SEQ ID NO: 5008761 - DNA, 23 bp, Homo sapiens
ccggagctggaggatcccctcca

SEQ ID NO: 5008762 - DNA, 20 bp, Homo sapiens
ccggcatgagactcagtgca

SEQ ID NO: 5008763 - DNA, 21 bp, Homo sapiens
ccggcatgagactcagtgcag

SEQ ID NO: 5008764 - DNA, 23 bp, Homo sapiens
ccggcatgagactcagtgcagat

SEQ ID NO: 5008765 - DNA, 15 bp, Homo sapiens
ccggccctgtgtgca

SEQ ID NO: 5008766 - DNA, 23 bp, Homo sapiens
ccgtggggcagggagctgggccc

SEQ ID NO: 5008767 - DNA, 14 bp, Homo sapiens
ccgttcacatgtgt

SEQ ID NO: 5008768 - DNA, 13 bp, Homo sapiens
cctaaggaacctt

SEQ ID NO: 5008769 - DNA, 16 bp, Homo sapiens
cctaaggaaccttcct

SEQ ID NO: 5008770 - DNA, 15 bp, Homo sapiens
cctagcagcccaccc

SEQ ID NO: 5008771 - DNA, 20 bp, Homo sapiens
cctagcagcccaccctgctg

SEQ ID NO: 5008772 - DNA, 23 bp, Homo sapiens
cctagcagcccaccctgctgctg

SEQ ID NO: 5008773 - DNA, 15 bp, Homo sapiens
cctataataaaggct

SEQ ID NO: 5008774 - DNA, 19 bp, Homo sapiens
cctcagggagcagggaagg

SEQ ID NO: 5008775 - DNA, 21 bp, Homo sapiens
cctcagggagcagggaaggcc

SEQ ID NO: 5008776 - DNA, 22 bp, Homo sapiens
cctcagggagcagggaaggcct

SEQ ID NO: 5008777 - DNA, 20 bp, Homo sapiens
cctcagttgaaaatgcaact

SEQ ID NO: 5008778 - DNA, 21 bp, Homo sapiens
cctcattctggttccctgctg

SEQ ID NO: 5008779 - DNA, 19 bp, Homo sapiens
cctcccacacccaaagctg

SEQ ID NO: 5008780 - DNA, 16 bp, Homo sapiens
cctcctcctcctgccc

SEQ ID NO: 5008781 - DNA, 12 bp, Homo sapiens
cctcctcctgcc

SEQ ID NO: 5008782 - DNA, 13 bp, Homo sapiens
cctcctcctgccc

SEQ ID NO: 5008783 - DNA, 13 bp, Homo sapiens
cctcctgccctcc

SEQ ID NO: 5008784 - DNA, 20 bp, Homo sapiens
cctcgttggaagaggaacag

SEQ ID NO: 5008785 - DNA, 17 bp, Homo sapiens
cctctcaccccactcct

SEQ ID NO: 5008786 - DNA, 13 bp, Homo sapiens
cctctcagtgttt

SEQ ID NO: 5008787 - DNA, 22 bp, Homo sapiens
cctctccttgcccccagtgcct

SEQ ID NO: 5008788 - DNA, 14 bp, Homo sapiens
cctctctggccttg

SEQ ID NO: 5008789 - DNA, 15 bp, Homo sapiens
cctctctggccttgc

SEQ ID NO: 5008790 - DNA, 17 bp, Homo sapiens
cctctctgtcccttgct

SEQ ID NO: 5008791 - DNA, 12 bp, Homo sapiens
cctgcagggcca

SEQ ID NO: 5008792 - DNA, 17 bp, Homo sapiens
cctgcagggccatggct

SEQ ID NO: 5008793 - DNA, 19 bp, Homo sapiens
cctgcagggccatggctca

SEQ ID NO: 5008794 - DNA, 20 bp, Homo sapiens
cctgcagggccatggctcag

SEQ ID NO: 5008795 - DNA, 19 bp, Homo sapiens
cctgccatgccaggaacct

SEQ ID NO: 5008796 - DNA, 18 bp, Homo sapiens
cctgccccggagctggag

SEQ ID NO: 5008797 - DNA, 13 bp, Homo sapiens
cctgccctcctct

SEQ ID NO: 5008798 - DNA, 16 bp, Homo sapiens
cctgccctcctctccc

SEQ ID NO: 5008799 - DNA, 16 bp, Homo sapiens
cctgcgaccctggggg

SEQ ID NO: 5008800 - DNA, 21 bp, Homo sapiens
cctgcgaccctgggggcacag

SEQ ID NO: 5008801 - DNA, 16 bp, Homo sapiens
cctgctcccaggcccc

SEQ ID NO: 5008802 - DNA, 14 bp, Homo sapiens
cctgctgcgctgct

SEQ ID NO: 5008803 - DNA, 18 bp, Homo sapiens
cctgctgcgctgcttggt

SEQ ID NO: 5008804 - DNA, 18 bp, Homo sapiens
cctgctgctggtgcacag

SEQ ID NO: 5008805 - DNA, 14 bp, Homo sapiens
cctggactgctacc

SEQ ID NO: 5008806 - DNA, 14 bp, Homo sapiens
cctgggctggttgg

SEQ ID NO: 5008807 - DNA, 18 bp, Homo sapiens
cctggggtgttagtggca

SEQ ID NO: 5008808 - DNA, 21 bp, Homo sapiens
cctggtttcataacttcctgt

SEQ ID NO: 5008809 - DNA, 12 bp, Homo sapiens
cctgtgtgcagg

SEQ ID NO: 5008810 - DNA, 11 bp, Homo sapiens
ccttctgctga

SEQ ID NO: 5008811 - DNA, 17 bp, Homo sapiens
ccttgcccccagtgcct

SEQ ID NO: 5008812 - DNA, 21 bp, Homo sapiens
ccttgcttgcctgcagggcca

SEQ ID NO: 5008813 - DNA, 14 bp, Homo sapiens
ccttgtgcctgggg

SEQ ID NO: 5008814 - DNA, 15 bp, Homo sapiens
cctttaaaaaagaaa

SEQ ID NO: 5008815 - DNA, 22 bp, Homo sapiens
cctttaggatctcaggcttctg

SEQ ID NO: 5008816 - DNA, 15 bp, Homo sapiens
ccttttgcatttctt

SEQ ID NO: 5008817 - DNA, 14 bp, Homo sapiens
cgaccgggccaggc

SEQ ID NO: 5008818 - DNA, 22 bp, Homo sapiens
cgaggggcctttgttctggggg

SEQ ID NO: 5008819 - DNA, 13 bp, Homo sapiens
cgatgttgtattg

SEQ ID NO: 5008820 - DNA, 15 bp, Homo sapiens
cgatgttgtattgat

SEQ ID NO: 5008821 - DNA, 12 bp, Homo sapiens
cgcagctgccta

SEQ ID NO: 5008822 - DNA, 15 bp, Homo sapiens
cgcctcctcctcctg

SEQ ID NO: 5008823 - DNA, 12 bp, Homo sapiens
cgctacctccct

SEQ ID NO: 5008824 - DNA, 17 bp, Homo sapiens
cgctacctctctgtccc

SEQ ID NO: 5008825 - DNA, 20 bp, Homo sapiens
cgcttatcaactaatgattt

SEQ ID NO: 5008826 - DNA, 19 bp, Homo sapiens
cggagggctggggatgcgc

SEQ ID NO: 5008827 - DNA, 23 bp, Homo sapiens
ggcacaggaggcaggcatggccc

SEQ ID NO: 5008828 - DNA, 17 bp, Homo sapiens
ggcaggcatggccctgg

SEQ ID NO: 5008829 - DNA, 12 bp, Homo sapiens
ggcaggctgggc

SEQ ID NO: 5008830 - DNA, 11 bp, Homo sapiens
ggcagtccctt

SEQ ID NO: 5008831 - DNA, 16 bp, Homo sapiens
ggccacatggcggaga

SEQ ID NO: 5008832 - DNA, 14 bp, Homo sapiens
ggccatggctcagg

SEQ ID NO: 5008833 - DNA, 15 bp, Homo sapiens
ggccatgtccaaaga

SEQ ID NO: 5008834 - DNA, 18 bp, Homo sapiens
ggcccacccggtgggacc

SEQ ID NO: 5008835 - DNA, 18 bp, Homo sapiens
ggcccagtgcatggtggc

SEQ ID NO: 5008836 - DNA, 21 bp, Homo sapiens
ggcccagtgcatggtggccag

SEQ ID NO: 5008837 - DNA, 22 bp, Homo sapiens
ggcccagtgcatggtggccaga

SEQ ID NO: 5008838 - DNA, 23 bp, Homo sapiens
ggccccaggcctgtggctccctt

SEQ ID NO: 5008839 - DNA, 14 bp, Homo sapiens
ggcccctcccacac

SEQ ID NO: 5008840 - DNA, 22 bp, Homo sapiens
ggcccctcccacacccaaagct

SEQ ID NO: 5008841 - DNA, 23 bp, Homo sapiens
ggcccctcccacacccaaagctg

SEQ ID NO: 5008842 - DNA, 18 bp, Homo sapiens
ggccctgagtctgggcag

SEQ ID NO: 5008843 - DNA, 19 bp, Homo sapiens
ggccctgagtctgggcagc

SEQ ID NO: 5008844 - DNA, 19 bp, Homo sapiens
ggccctttccttccagatc

SEQ ID NO: 5008845 - DNA, 18 bp, Homo sapiens
ggcctgcgaccctggggg

SEQ ID NO: 5008846 - DNA, 15 bp, Homo sapiens
ggcgtggagggaggc

SEQ ID NO: 5008847 - DNA, 18 bp, Homo sapiens
ggcgtggagggaggcccc

SEQ ID NO: 5008848 - DNA, 22 bp, Homo sapiens
ggctgacatgaagctgttgtgt

SEQ ID NO: 5008849 - DNA, 20 bp, Homo sapiens
ggctgggccatgtccaaaga

SEQ ID NO: 5008850 - DNA, 22 bp, Homo sapiens
ggctttcccacttcccaccctg

SEQ ID NO: 5008851 - DNA, 18 bp, Homo sapiens
gggacatcacagggtggg

SEQ ID NO: 5008852 - DNA, 22 bp, Homo sapiens
gggacatcacagggtgggcctc

SEQ ID NO: 5008853 - DNA, 18 bp, Homo sapiens
gggagacggtttccaggg

SEQ ID NO: 5008854 - DNA, 21 bp, Homo sapiens
gggagacggtttccagggagg

SEQ ID NO: 5008855 - DNA, 15 bp, Homo sapiens
gggagcagggaaggc

SEQ ID NO: 5008856 - DNA, 12 bp, Homo sapiens
gggcaggctggg

SEQ ID NO: 5008857 - DNA, 18 bp, Homo sapiens
gggcagggagctgggccc

SEQ ID NO: 5008858 - DNA, 19 bp, Homo sapiens
gggcagggagctgggcccg

SEQ ID NO: 5008859 - DNA, 13 bp, Homo sapiens
gggccatggctca

SEQ ID NO: 5008860 - DNA, 19 bp, Homo sapiens
gggccatggctcagggtgg

SEQ ID NO: 5008861 - DNA, 14 bp, Homo sapiens
gggccatgtccaaa

SEQ ID NO: 5008862 - DNA, 15 bp, Homo sapiens
gggccatgtccaaag

SEQ ID NO: 5008863 - DNA, 21 bp, Homo sapiens
gggccatgtccaaagaggctg

SEQ ID NO: 5008864 - DNA, 23 bp, Homo sapiens
gggccatgtccaaagaggctgcc

SEQ ID NO: 5008865 - DNA, 15 bp, Homo sapiens
gggcccctggcactc

SEQ ID NO: 5008866 - DNA, 13 bp, Homo sapiens
gggcgtggaggga

SEQ ID NO: 5008867 - DNA, 17 bp, Homo sapiens
gggctggttggagaagg

SEQ ID NO: 5008868 - DNA, 21 bp, Homo sapiens
ggggacccagtgcagaatgta

SEQ ID NO: 5008869 - DNA, 21 bp, Homo sapiens
ggggacttctggggacagaca

SEQ ID NO: 5008870 - DNA, 13 bp, Homo sapiens
ggggcacaggagg

SEQ ID NO: 5008871 - DNA, 12 bp, Homo sapiens
ggggcccagtgc

SEQ ID NO: 5008872 - DNA, 14 bp, Homo sapiens
ggggcccagtgcat

SEQ ID NO: 5008873 - DNA, 20 bp, Homo sapiens
ggggctctgggtgctgccct

SEQ ID NO: 5008874 - DNA, 18 bp, Homo sapiens
gggggtctcacccatgca

SEQ ID NO: 5008875 - DNA, 17 bp, Homo sapiens
ggggtctcacccatgca

SEQ ID NO: 5008876 - DNA, 19 bp, Homo sapiens
gggtccagtggatgccaca

SEQ ID NO: 5008877 - DNA, 17 bp, Homo sapiens
gggtccctagcagccca

SEQ ID NO: 5008878 - DNA, 17 bp, Homo sapiens
gggtctgcgatgcagcg

SEQ ID NO: 5008879 - DNA, 22 bp, Homo sapiens
gggtggtctcttcttggggccc

SEQ ID NO: 5008880 - DNA, 18 bp, Homo sapiens
gggtgttgtatggggagg

SEQ ID NO: 5008881 - DNA, 17 bp, Homo sapiens
ggtaactaattggaagg

SEQ ID NO: 5008882 - DNA, 16 bp, Homo sapiens
ggtacaacggaggcct

SEQ ID NO: 5008883 - DNA, 14 bp, Homo sapiens
ggtccttctccaca

SEQ ID NO: 5008884 - DNA, 21 bp, Homo sapiens
ggtctcttcttggggcccagt

SEQ ID NO: 5008885 - DNA, 18 bp, Homo sapiens
ggtgatgtagcccatcct

SEQ ID NO: 5008886 - DNA, 19 bp, Homo sapiens
ggtgcagaggtaccctggg

SEQ ID NO: 5008887 - DNA, 21 bp, Homo sapiens
ggtgcctgttatatatttact

SEQ ID NO: 5008888 - DNA, 21 bp, Homo sapiens
ggtgtcacccaaaccggcagg

SEQ ID NO: 5008889 - DNA, 16 bp, Homo sapiens
ggttacagagacctat

SEQ ID NO: 5008890 - DNA, 21 bp, Homo sapiens
ggttccctgctgcgctgcttg

SEQ ID NO: 5008891 - DNA, 12 bp, Homo sapiens
ggtttccaggga

SEQ ID NO: 5008892 - DNA, 15 bp, Homo sapiens
gtaaaacttctgctc

SEQ ID NO: 5008893 - DNA, 16 bp, Homo sapiens
gtaaaacttctgctcg

SEQ ID NO: 5008894 - DNA, 18 bp, Homo sapiens
gtaaatgaaacttaagaa

SEQ ID NO: 5008895 - DNA, 14 bp, Homo sapiens
gtaagtgggcccac

SEQ ID NO: 5008896 - DNA, 20 bp, Homo sapiens
gtaatgttaatgttatatca

SEQ ID NO: 5008897 - DNA, 23 bp, Homo sapiens
gtaatttaatttgtaaaacttct

SEQ ID NO: 5008898 - DNA, 11 bp, Homo sapiens
gtaccttgctt

SEQ ID NO: 5008899 - DNA, 23 bp, Homo sapiens
gtactgccccccatgaggaagga

SEQ ID NO: 5008900 - DNA, 18 bp, Homo sapiens
gtactgttactgggccct

SEQ ID NO: 5008901 - DNA, 13 bp, Homo sapiens
gtagctctgctgc

SEQ ID NO: 5008902 - DNA, 14 bp, Homo sapiens
gtagctctgctgct

SEQ ID NO: 5008903 - DNA, 20 bp, Homo sapiens
gtagtttttatatgttgtaa

SEQ ID NO: 5008904 - DNA, 18 bp, Homo sapiens
gtatatttgttttatgct

SEQ ID NO: 5008905 - DNA, 23 bp, Homo sapiens
gtatatttgttttatgctactga

SEQ ID NO: 5008906 - DNA, 23 bp, Homo sapiens
gtatgatttataaacagacaata

SEQ ID NO: 5008907 - DNA, 17 bp, Homo sapiens
gtattgatttttaagaa

SEQ ID NO: 5008908 - DNA, 22 bp, Homo sapiens
gtatttcttatacgcttttctt

SEQ ID NO: 5008909 - DNA, 17 bp, Homo sapiens
gtcacaacccttctctg

SEQ ID NO: 5008910 - DNA, 21 bp, Homo sapiens
gtcacccaaaccggcaggtgc

SEQ ID NO: 5008911 - DNA, 23 bp, Homo sapiens
gtcagagttgactttcctcccat

SEQ ID NO: 5008912 - DNA, 14 bp, Homo sapiens
gtcagtatccaggc

SEQ ID NO: 5008913 - DNA, 23 bp, Homo sapiens
gtcatgggagagtacaccctttc

SEQ ID NO: 5008914 - DNA, 18 bp, Homo sapiens
gtcattgcagtttaagag

SEQ ID NO: 5008915 - DNA, 23 bp, Homo sapiens
gtccagcaccttgtgcctggggt

SEQ ID NO: 5008916 - DNA, 14 bp, Homo sapiens
gtccagcctgcccc

SEQ ID NO: 5008917 - DNA, 22 bp, Homo sapiens
gtccagcctgccccggagctgg

SEQ ID NO: 5008918 - DNA, 15 bp, Homo sapiens
gtccccgctgctgtg

SEQ ID NO: 5008919 - DNA, 15 bp, Homo sapiens
gtcccgaatccacag

SEQ ID NO: 5008920 - DNA, 23 bp, Homo sapiens
gtccctctccttgcccccagtgc

SEQ ID NO: 5008921 - DNA, 20 bp, Homo sapiens
gtcccttgcttgcctgcagg

SEQ ID NO: 5008922 - DNA, 22 bp, Homo sapiens
gtcccttgcttgcctgcagggc

SEQ ID NO: 5008923 - DNA, 19 bp, Homo sapiens
gtccgttcacatgtgtggt

SEQ ID NO: 5008924 - DNA, 22 bp, Homo sapiens
gtcctcagggagcagggaaggc

SEQ ID NO: 5008925 - DNA, 23 bp, Homo sapiens
gtctcacccatgcaagcagagga

SEQ ID NO: 5008926 - DNA, 23 bp, Homo sapiens
tgcctggggtgttagtggcaccg

SEQ ID NO: 5008927 - DNA, 13 bp, Homo sapiens
tgcctgtaatcct

SEQ ID NO: 5008928 - DNA, 12 bp, Homo sapiens
tgcctgtgtgcg

SEQ ID NO: 5008929 - DNA, 13 bp, Homo sapiens
tgccttctgctga

SEQ ID NO: 5008930 - DNA, 14 bp, Homo sapiens
tgccttctgctgaa

SEQ ID NO: 5008931 - DNA, 16 bp, Homo sapiens
tgccttctgctgaaag

SEQ ID NO: 5008932 - DNA, 16 bp, Homo sapiens
tgccttttgcagaaga

SEQ ID NO: 5008933 - DNA, 19 bp, Homo sapiens
tgccttttgcagaagaggg

SEQ ID NO: 5008934 - DNA, 16 bp, Homo sapiens
tgctccgtagctctgc

SEQ ID NO: 5008935 - DNA, 17 bp, Homo sapiens
tgctccgtagctctgct

SEQ ID NO: 5008936 - DNA, 21 bp, Homo sapiens
tgctccgtagctctgctgctg

SEQ ID NO: 5008937 - DNA, 16 bp, Homo sapiens
tgctcgtttacactgc

SEQ ID NO: 5008938 - DNA, 13 bp, Homo sapiens
tgctctaggaaga

SEQ ID NO: 5008939 - DNA, 23 bp, Homo sapiens
tgctgagggtgtttcttcctgca

SEQ ID NO: 5008940 - DNA, 13 bp, Homo sapiens
tgctgcgctgctt

SEQ ID NO: 5008941 - DNA, 19 bp, Homo sapiens
tgctgtgtatatggtatat

SEQ ID NO: 5008942 - DNA, 23 bp, Homo sapiens
tgctgtgtatatggtatatatac

SEQ ID NO: 5008943 - DNA, 23 bp, Homo sapiens
tgctgtgtgtcccaggcagggag

SEQ ID NO: 5008944 - DNA, 18 bp, Homo sapiens
tgcttgcctgcagggcca

SEQ ID NO: 5008945 - DNA, 20 bp, Homo sapiens
tgcttgcctgcagggccatg

SEQ ID NO: 5008946 - DNA, 22 bp, Homo sapiens
tggaaagacttctcaaagagaa

SEQ ID NO: 5008947 - DNA, 14 bp, Homo sapiens
tggaaggagagggg

SEQ ID NO: 5008948 - DNA, 18 bp, Homo sapiens
tggaatcccactgtatga

SEQ ID NO: 5008949 - DNA, 23 bp, Homo sapiens
tggacctgtatatttgtaaagct

SEQ ID NO: 5008950 - DNA, 19 bp, Homo sapiens
tggagatgggtgattctct

SEQ ID NO: 5008951 - DNA, 14 bp, Homo sapiens
tggagggaggcccc

SEQ ID NO: 5008952 - DNA, 19 bp, Homo sapiens
tggagggaggccccagggg

SEQ ID NO: 5008953 - DNA, 18 bp, Homo sapiens
tggatggtcattgcagtt

SEQ ID NO: 5008954 - DNA, 11 bp, Homo sapiens
tggcaaggaaa

SEQ ID NO: 5008955 - DNA, 21 bp, Homo sapiens
tggccctgggcggggcgtggg

SEQ ID NO: 5008956 - DNA, 18 bp, Homo sapiens
tggccctttccttccaga

SEQ ID NO: 5008957 - DNA, 15 bp, Homo sapiens
tggcctgagagggga

SEQ ID NO: 5008958 - DNA, 14 bp, Homo sapiens
tggctcagggtggt

SEQ ID NO: 5008959 - DNA, 14 bp, Homo sapiens
tggctccggcctct

SEQ ID NO: 5008960 - DNA, 18 bp, Homo sapiens
tggctgacatgaagctgt

SEQ ID NO: 5008961 - DNA, 17 bp, Homo sapiens
tggcttgggcagggtct

SEQ ID NO: 5008962 - DNA, 22 bp, Homo sapiens
tgggacccccgtggggcaggga

SEQ ID NO: 5008963 - DNA, 14 bp, Homo sapiens
tgggccatgtccaa

SEQ ID NO: 5008964 - DNA, 15 bp, Homo sapiens
tgggcctcggcccct

SEQ ID NO: 5008965 - DNA, 21 bp, Homo sapiens
tggggacttctggggacagac

SEQ ID NO: 5008966 - DNA, 17 bp, Homo sapiens
tggggcaggctgggcca

SEQ ID NO: 5008967 - DNA, 18 bp, Homo sapiens
tggggcaggctgggccat

SEQ ID NO: 5008968 - DNA, 20 bp, Homo sapiens
tggggcaggctgggccatgt

SEQ ID NO: 5008969 - DNA, 12 bp, Homo sapiens
tggggcagggag

SEQ ID NO: 5008970 - DNA, 14 bp, Homo sapiens
tggggcccagtgca

SEQ ID NO: 5008971 - DNA, 15 bp, Homo sapiens
tggtacaacggaggc

SEQ ID NO: 5008972 - DNA, 20 bp, Homo sapiens
tggtacaacggaggcctgcg

SEQ ID NO: 5008973 - DNA, 15 bp, Homo sapiens
tggtacatggtgttt

SEQ ID NO: 5008974 - DNA, 19 bp, Homo sapiens
tggtccccaacaatgtgag

SEQ ID NO: 5008975 - DNA, 19 bp, Homo sapiens
tggtctcttcttggggccc

SEQ ID NO: 5008976 - DNA, 17 bp, Homo sapiens
tggtctgccttctgctg

SEQ ID NO: 5008977 - DNA, 14 bp, Homo sapiens
tggtgccctcgcct

SEQ ID NO: 5008978 - DNA, 12 bp, Homo sapiens
tggttaaataaa

SEQ ID NO: 5008979 - DNA, 20 bp, Homo sapiens
tggttacgttggttaaataa

SEQ ID NO: 5008980 - DNA, 12 bp, Homo sapiens
tgtaaaacttct

SEQ ID NO: 5008981 - DNA, 14 bp, Homo sapiens
tgtaaatgaaactt

SEQ ID NO: 5008982 - DNA, 18 bp, Homo sapiens
tgtaagaattcagaagac

SEQ ID NO: 5008983 - DNA, 18 bp, Homo sapiens
tgtacatttctataaata

SEQ ID NO: 5008984 - DNA, 15 bp, Homo sapiens
tgtacctcctctcag

SEQ ID NO: 5008985 - DNA, 15 bp, Homo sapiens
tgtactgttactggg

SEQ ID NO: 5008986 - DNA, 18 bp, Homo sapiens
tgtactgttactgggccc

SEQ ID NO: 5008987 - DNA, 15 bp, Homo sapiens
tgtatgctgatcatc

SEQ ID NO: 5008988 - DNA, 23 bp, Homo sapiens
tgtatttaaaaaaaagaaacttt

SEQ ID NO: 5008989 - DNA, 18 bp, Homo sapiens
tgtatttcttatacgctt

SEQ ID NO: 5008990 - DNA, 14 bp, Homo sapiens
tgtcagtatccagg

SEQ ID NO: 5008991 - DNA, 15 bp, Homo sapiens
tgtcagtatccaggc

SEQ ID NO: 5008992 - DNA, 17 bp, Homo sapiens
tgtcatgcttcatcatt

SEQ ID NO: 5008993 - DNA, 20 bp, Homo sapiens
tgtccaaagaggctgcccct

SEQ ID NO: 5008994 - DNA, 21 bp, Homo sapiens
tgtccaaagaggctgcccctc

SEQ ID NO: 5008995 - DNA, 15 bp, Homo sapiens
tgtccagcaccttgt

SEQ ID NO: 5008996 - DNA, 19 bp, Homo sapiens
tgtccagcaccttgtgcct

SEQ ID NO: 5008997 - DNA, 22 bp, Homo sapiens
tgtccagcaccttgtgcctggg

SEQ ID NO: 5008998 - DNA, 14 bp, Homo sapiens
tgtcccaggcaggg

SEQ ID NO: 5008999 - DNA, 20 bp, Homo sapiens
tgtccctctccttgccccca

SEQ ID NO: 5009000 - DNA, 23 bp, Homo sapiens
tgtcccttgcttgcctgcagggc

SEQ ID NO: 5009001 - DNA, 16 bp, Homo sapiens
tgtcctaaggaacctt

SEQ ID NO: 5009002 - DNA, 14 bp, Homo sapiens
tgtcctaattcttc

SEQ ID NO: 5009003 - DNA, 18 bp, Homo sapiens
tgtcctaattcttctgtc

SEQ ID NO: 5009004 - DNA, 12 bp, Homo sapiens
tgtcctcaggga

SEQ ID NO: 5009005 - DNA, 19 bp, Homo sapiens
tgtcctcagggagcaggga

SEQ ID NO: 5009006 - DNA, 18 bp, Homo sapiens
tgtctgaggtgacttaaa

SEQ ID NO: 5009007 - DNA, 13 bp, Homo sapiens
tgtctgtctgagg

SEQ ID NO: 5009008 - DNA, 21 bp, Homo sapiens
tgtgagtgccttttgcagaag

SEQ ID NO: 5009009 - DNA, 10 bp, Homo sapiens
tgtgcacatc

SEQ ID NO: 5009010 - DNA, 23 bp, Homo sapiens
tgtgcacatccgcgtgtgcctgt

SEQ ID NO: 5009011 - DNA, 13 bp, Homo sapiens
tgtgcctgtgtgc

SEQ ID NO: 5009012 - DNA, 16 bp, Homo sapiens
tgtggtacatggtgtt

SEQ ID NO: 5009013 - DNA, 19 bp, Homo sapiens
tgtgtgtcccaggcaggga

SEQ ID NO: 5009014 - DNA, 12 bp, Homo sapiens
tgtgtgtgtgca

SEQ ID NO: 5009015 - DNA, 12 bp, Homo sapiens
tgtgttctgcaa

SEQ ID NO: 5009016 - DNA, 15 bp, Homo sapiens
tgtgtttttaacatg

SEQ ID NO: 5009017 - DNA, 22 bp, Homo sapiens
tgttatatatttactcagtctt

SEQ ID NO: 5009018 - DNA, 15 bp, Homo sapiens
tgttatatcatatgt

SEQ ID NO: 5009019 - DNA, 17 bp, Homo sapiens
tgttatatcatatgtat

SEQ ID NO: 5009020 - DNA, 14 bp, Homo sapiens
tgttattagatgtt

SEQ ID NO: 5009021 - DNA, 16 bp, Homo sapiens
tgttcccacaccccaa

SEQ ID NO: 5009022 - DNA, 21 bp, Homo sapiens
tgttctggggggacccagtgc

SEQ ID NO: 5009023 - DNA, 22 bp, Homo sapiens
tgttctggggggacccagtgca

SEQ ID NO: 5009024 - DNA, 15 bp, Homo sapiens
tgttgctctaggaag

SEQ ID NO: 5009025 - DNA, 12 bp, Homo sapiens
tgttggtctgcc

SEQ ID NO: 5009026 - DNA, 14 bp, Homo sapiens
tttgtaaagctatt

SEQ ID NO: 5009027 - DNA, 17 bp, Homo sapiens
tttgtaaatgaaactta

SEQ ID NO: 5009028 - DNA, 21 bp, Homo sapiens
tttgtaaatgaaacttaagaa

SEQ ID NO: 5009029 - DNA, 21 bp, Homo sapiens
tttgtaggagaaactcccatg

SEQ ID NO: 5009030 - DNA, 23 bp, Homo sapiens
ttttagaggactattacatattt

SEQ ID NO: 5009031 - DNA, 20 bp, Homo sapiens
ttttatagcctggactgcta

SEQ ID NO: 5009032 - DNA, 21 bp, Homo sapiens
ttttgtaaatgaaacttaaga

SEQ ID NO: 5009033 - DNA, 13 bp, Homo sapiens
tttttactgccct

SEQ ID NO: 5009034 - DNA, 15 bp, Homo sapiens
tttttattatgcatt

SEQ ID NO: 5009035 - DNA, 12 bp, Homo sapiens
tttttggacttc

SEQ ID NO: 5009036 - DNA, 12 bp, Homo sapiens
tttttttccatt

SEQ ID NO: 5009037 - DNA, 12 bp, Homo sapiens
cctcctcctcct

SEQ ID NO: 5009038 - DNA, 13 bp, Homo sapiens
cctcctcctcctg

SEQ ID NO: 5009039 - DNA, 16 bp, Homo sapiens
cctcctcctgccctcc

SEQ ID NO: 5009040 - DNA, 23 bp, Homo sapiens
cctccttccccgagtgactctgg

SEQ ID NO: 5009041 - DNA, 14 bp, Homo sapiens
cctcgcctcctcct

SEQ ID NO: 5009042 - DNA, 19 bp, Homo sapiens
cctcgcctcctcctcctgc

SEQ ID NO: 5009043 - DNA, 18 bp, Homo sapiens
cctcggcccctcccacac

SEQ ID NO: 5009044 - DNA, 14 bp, Homo sapiens
cctctcaccccact

SEQ ID NO: 5009045 - DNA, 15 bp, Homo sapiens
cctctcaccccactc

SEQ ID NO: 5009046 - DNA, 18 bp, Homo sapiens
cctctcaccccactcctg

SEQ ID NO: 5009047 - DNA, 19 bp, Homo sapiens
cctctcaccccactcctgt

SEQ ID NO: 5009048 - DNA, 14 bp, Homo sapiens
cctctcctccctct

SEQ ID NO: 5009049 - DNA, 20 bp, Homo sapiens
cctctccttgcccccagtgc

SEQ ID NO: 5009050 - DNA, 21 bp, Homo sapiens
cctctccttgcccccagtgcc

SEQ ID NO: 5009051 - DNA, 12 bp, Homo sapiens
cctctctgtccc

SEQ ID NO: 5009052 - DNA, 13 bp, Homo sapiens
cctctctgtccct

SEQ ID NO: 5009053 - DNA, 20 bp, Homo sapiens
cctctgtccctctccttgcc

SEQ ID NO: 5009054 - DNA, 16 bp, Homo sapiens
cctgactcatcatttg

SEQ ID NO: 5009055 - DNA, 13 bp, Homo sapiens
cctgactggtgct

SEQ ID NO: 5009056 - DNA, 13 bp, Homo sapiens
cctgagccaagga

SEQ ID NO: 5009057 - DNA, 17 bp, Homo sapiens
cctgagtctgggcagct

SEQ ID NO: 5009058 - DNA, 19 bp, Homo sapiens
cctgatgtgtcctcaggga

SEQ ID NO: 5009059 - DNA, 14 bp, Homo sapiens
cctgcgaccctggg

SEQ ID NO: 5009060 - DNA, 12 bp, Homo sapiens
cctgctcccagg

SEQ ID NO: 5009061 - DNA, 13 bp, Homo sapiens
cctgctcccaggc

SEQ ID NO: 5009062 - DNA, 22 bp, Homo sapiens
cctgctcccaggccccaggcct

SEQ ID NO: 5009063 - DNA, 14 bp, Homo sapiens
cctgctgctggtgc

SEQ ID NO: 5009064 - DNA, 19 bp, Homo sapiens
cctgctgctggtgcacagc

SEQ ID NO: 5009065 - DNA, 15 bp, Homo sapiens
cctggactgctacct

SEQ ID NO: 5009066 - DNA, 22 bp, Homo sapiens
cctggcggtgtataccaggcag

SEQ ID NO: 5009067 - DNA, 17 bp, Homo sapiens
cctgggctggttggaga

SEQ ID NO: 5009068 - DNA, 18 bp, Homo sapiens
cctgggggcacaggaggc

SEQ ID NO: 5009069 - DNA, 23 bp, Homo sapiens
cctgggggcacaggaggcaggca

SEQ ID NO: 5009070 - DNA, 18 bp, Homo sapiens
cctgggtactgaaagcct

SEQ ID NO: 5009071 - DNA, 18 bp, Homo sapiens
cctgggtgatctgctgct

SEQ ID NO: 5009072 - DNA, 20 bp, Homo sapiens
cctgggtgtccccgctgctg

SEQ ID NO: 5009073 - DNA, 19 bp, Homo sapiens
cctgtatatttgtaaagct

SEQ ID NO: 5009074 - DNA, 21 bp, Homo sapiens
cctgtggctcccttggtgccc

SEQ ID NO: 5009075 - DNA, 16 bp, Homo sapiens
cctgtgtgcaggttcc

SEQ ID NO: 5009076 - DNA, 13 bp, Homo sapiens
atgaagctgttgt

SEQ ID NO: 5009077 - DNA, 21 bp, Homo sapiens
atgacattttttttaactact

SEQ ID NO: 5009078 - DNA, 18 bp, Homo sapiens
atgagactctagggtcca

SEQ ID NO: 5009079 - DNA, 21 bp, Homo sapiens
atgagtggaaattaagacttt

SEQ ID NO: 5009080 - DNA, 14 bp, Homo sapiens
atgcaaaaggttta

SEQ ID NO: 5009081 - DNA, 17 bp, Homo sapiens
atgcaactctaactctg

SEQ ID NO: 5009082 - DNA, 20 bp, Homo sapiens
atgcaactctaactctgaga

SEQ ID NO: 5009083 - DNA, 22 bp, Homo sapiens
atgcaagcagaggaccagggcc

SEQ ID NO: 5009084 - DNA, 23 bp, Homo sapiens
atgcaagcagaggaccagggcct

SEQ ID NO: 5009085 - DNA, 16 bp, Homo sapiens
atgcagcggcgtgagg

SEQ ID NO: 5009086 - DNA, 18 bp, Homo sapiens
atgcattatatcaaatct

SEQ ID NO: 5009087 - DNA, 22 bp, Homo sapiens
atgccaagaaaagggctgacat

SEQ ID NO: 5009088 - DNA, 16 bp, Homo sapiens
atgccactcctccctc

SEQ ID NO: 5009089 - DNA, 12 bp, Homo sapiens
atgctgatcatc

SEQ ID NO: 5009090 - DNA, 23 bp, Homo sapiens
atgctgtgtatatggtatatata

SEQ ID NO: 5009091 - DNA, 19 bp, Homo sapiens
atgcttcatcattccctct

SEQ ID NO: 5009092 - DNA, 20 bp, Homo sapiens
atgcttcatcattccctctc

SEQ ID NO: 5009093 - DNA, 21 bp, Homo sapiens
atggaatcccactgtatgatt

SEQ ID NO: 5009094 - DNA, 13 bp, Homo sapiens
atggctcagggtg

SEQ ID NO: 5009095 - DNA, 17 bp, Homo sapiens
atggggaggcaagtgtg

SEQ ID NO: 5009096 - DNA, 21 bp, Homo sapiens
atgggtgttgtatggggaggc

SEQ ID NO: 5009097 - DNA, 14 bp, Homo sapiens
atggtatatataca

SEQ ID NO: 5009098 - DNA, 17 bp, Homo sapiens
atggtatatatacatat

SEQ ID NO: 5009099 - DNA, 22 bp, Homo sapiens
atgtatggaatcccactgtatg

SEQ ID NO: 5009100 - DNA, 15 bp, Homo sapiens
atgtccaaagaggct

SEQ ID NO: 5009101 - DNA, 19 bp, Homo sapiens
atgtccaaagaggctgccc

SEQ ID NO: 5009102 - DNA, 21 bp, Homo sapiens
atgtccaaagaggctgcccct

SEQ ID NO: 5009103 - DNA, 19 bp, Homo sapiens
atgtcctaattcttctgtc

SEQ ID NO: 5009104 - DNA, 17 bp, Homo sapiens
atgtgtcctcagggagc

SEQ ID NO: 5009105 - DNA, 18 bp, Homo sapiens
atgtgtcctcagggagca

SEQ ID NO: 5009106 - DNA, 20 bp, Homo sapiens
atgttacaagtttatatata

SEQ ID NO: 5009107 - DNA, 16 bp, Homo sapiens
atgttatatcatatgt

SEQ ID NO: 5009108 - DNA, 18 bp, Homo sapiens
atgttatatcatatgtat

SEQ ID NO: 5009109 - DNA, 19 bp, Homo sapiens
acacactgtcatgcttcat

SEQ ID NO: 5009110 - DNA, 16 bp, Homo sapiens
acaccattttgtaaat

SEQ ID NO: 5009111 - DNA, 20 bp, Homo sapiens
acaccattttgtaaatgaaa

SEQ ID NO: 5009112 - DNA, 14 bp, Homo sapiens
acacccaaagctga

SEQ ID NO: 5009113 - DNA, 19 bp, Homo sapiens
acacccaaagctgagcctg

SEQ ID NO: 5009114 - DNA, 17 bp, Homo sapiens
acactgtcatgcttcat

SEQ ID NO: 5009115 - DNA, 20 bp, Homo sapiens
acacttcttacgcaatgctt

SEQ ID NO: 5009116 - DNA, 22 bp, Homo sapiens
acagagctgtcacttttgctcc

SEQ ID NO: 5009117 - DNA, 16 bp, Homo sapiens
acagagtgcttttctg

SEQ ID NO: 5009118 - DNA, 17 bp, Homo sapiens
acagccttcttgatgta

SEQ ID NO: 5009119 - DNA, 21 bp, Homo sapiens
acaggcataaaatagagtaaa

SEQ ID NO: 5009120 - DNA, 14 bp, Homo sapiens
acagggtgggcctc

SEQ ID NO: 5009121 - DNA, 16 bp, Homo sapiens
acatatagaatgcaga

SEQ ID NO: 5009122 - DNA, 19 bp, Homo sapiens
acatcacagggtgggcctc

SEQ ID NO: 5009123 - DNA, 22 bp, Homo sapiens
acatccgcgtgtgcctgtgtgc

SEQ ID NO: 5009124 - DNA, 13 bp, Homo sapiens
acatgaagctgtt

SEQ ID NO: 5009125 - DNA, 19 bp, Homo sapiens
acatgaagctgttgtgtga

SEQ ID NO: 5009126 - DNA, 22 bp, Homo sapiens
acatggctccggcctctgcctt

SEQ ID NO: 5009127 - DNA, 20 bp, Homo sapiens
acatgtcctaattcttctgt

SEQ ID NO: 5009128 - DNA, 23 bp, Homo sapiens
acatttagatcctggtttcataa

SEQ ID NO: 5009129 - DNA, 12 bp, Homo sapiens
acatttctataa

SEQ ID NO: 5009130 - DNA, 11 bp, Homo sapiens
accaaggaaac

SEQ ID NO: 5009131 - DNA, 15 bp, Homo sapiens
accacagagctgtca

SEQ ID NO: 5009132 - DNA, 20 bp, Homo sapiens
accagcctggccaacatggt

SEQ ID NO: 5009133 - DNA, 14 bp, Homo sapiens
accaggcagtgtgc

SEQ ID NO: 5009134 - DNA, 16 bp, Homo sapiens
accagggaagctgtcc

SEQ ID NO: 5009135 - DNA, 13 bp, Homo sapiens
accagggcctttt

SEQ ID NO: 5009136 - DNA, 23 bp, Homo sapiens
accagggccttttctggcaccgc

SEQ ID NO: 5009137 - DNA, 15 bp, Homo sapiens
accagtgacgctgct

SEQ ID NO: 5009138 - DNA, 21 bp, Homo sapiens
accattttgtaaatgaaactt

SEQ ID NO: 5009139 - DNA, 22 bp, Homo sapiens
accattttgtaaatgaaactta

SEQ ID NO: 5009140 - DNA, 11 bp, Homo sapiens
acccaaagctg

SEQ ID NO: 5009141 - DNA, 16 bp, Homo sapiens
acccaaagctgagcct

SEQ ID NO: 5009142 - DNA, 18 bp, Homo sapiens
acccaaagctgagcctgc

SEQ ID NO: 5009143 - DNA, 16 bp, Homo sapiens
acccagagctgtattt

SEQ ID NO: 5009144 - DNA, 9 bp, Homo sapiens
acccagtgc

SEQ ID NO: 5009145 - DNA, 17 bp, Homo sapiens
acccagtgcagaatgta

SEQ ID NO: 5009146 - DNA, 11 bp, Homo sapiens
accccactcct

SEQ ID NO: 5009147 - DNA, 20 bp, Homo sapiens
acccccgtggggcagggagc

SEQ ID NO: 5009148 - DNA, 17 bp, Homo sapiens
accctgagttttgtttt

SEQ ID NO: 5009149 - DNA, 10 bp, Homo sapiens
accctgcccc

SEQ ID NO: 5009150 - DNA, 17 bp, Homo sapiens
accctgcccctcagaga

SEQ ID NO: 5009151 - DNA, 14 bp, Homo sapiens
accctgggggcaca

SEQ ID NO: 5009152 - DNA, 23 bp, Homo sapiens
accctgggtgtccccgctgctgt

SEQ ID NO: 5009153 - DNA, 14 bp, Homo sapiens
accgaggggccttt

SEQ ID NO: 5009154 - DNA, 21 bp, Homo sapiens
accgcctccccacctccaggc

SEQ ID NO: 5009155 - DNA, 12 bp, Homo sapiens
accggcaggtgc

SEQ ID NO: 5009156 - DNA, 14 bp, Homo sapiens
acctagtactgccc

SEQ ID NO: 5009157 - DNA, 15 bp, Homo sapiens
acctcattctggttc

SEQ ID NO: 5009158 - DNA, 14 bp, Homo sapiens
acctccaggctttc

SEQ ID NO: 5009159 - DNA, 11 bp, Homo sapiens
acctccctccc

SEQ ID NO: 5009160 - DNA, 12 bp, Homo sapiens
acctctctgtcc

SEQ ID NO: 5009161 - DNA, 14 bp, Homo sapiens
acctctctgtccct

SEQ ID NO: 5009162 - DNA, 22 bp, Homo sapiens
acctctctgtcccttgctgtat

SEQ ID NO: 5009163 - DNA, 19 bp, Homo sapiens
accttcagatccttttatt

SEQ ID NO: 5009164 - DNA, 22 bp, Homo sapiens
acgatgttgtattgatttttaa

SEQ ID NO: 5009165 - DNA, 20 bp, Homo sapiens
acgctacctctctgtccctt

SEQ ID NO: 5009166 - DNA, 21 bp, Homo sapiens
acgtgctccgtagctctgctg

SEQ ID NO: 5009167 - DNA, 22 bp, Homo sapiens
acgtgctccgtagctctgctgc

SEQ ID NO: 5009168 - DNA, 22 bp, Homo sapiens
acgtgttccagtgtctgtctga

SEQ ID NO: 5009169 - DNA, 14 bp, Homo sapiens
actagtgacagctt

SEQ ID NO: 5009170 - DNA, 15 bp, Homo sapiens
actagtgacagcttg

SEQ ID NO: 5009171 - DNA, 16 bp, Homo sapiens
actagtgacagcttgt

SEQ ID NO: 5009172 - DNA, 19 bp, Homo sapiens
actatattgattgtccttt

SEQ ID NO: 5009173 - DNA, 17 bp, Homo sapiens
actattatctaaaagaa

SEQ ID NO: 5009174 - DNA, 13 bp, Homo sapiens
actcatcatttgt

SEQ ID NO: 5009175 - DNA, 16 bp, Homo sapiens
actccatctctcatcc

SEQ ID NO: 5009176 - DNA, 19 bp, Homo sapiens
actcctgacgtctgaagct

SEQ ID NO: 5009177 - DNA, 21 bp, Homo sapiens
actcctgacgtctgaagcttg

SEQ ID NO: 5009178 - DNA, 22 bp, Homo sapiens
actctaactctgagagctgttt

SEQ ID NO: 5009179 - DNA, 18 bp, Homo sapiens
actgcaggaaaaccctta

SEQ ID NO: 5009180 - DNA, 19 bp, Homo sapiens
actgccccccatgaggaag

SEQ ID NO: 5009181 - DNA, 20 bp, Homo sapiens
actgctacctttcaaagctt

SEQ ID NO: 5009182 - DNA, 17 bp, Homo sapiens
actgtcaaaatatttct

SEQ ID NO: 5009183 - DNA, 21 bp, Homo sapiens
actgtcaaaatatttctcatc

SEQ ID NO: 5009184 - DNA, 21 bp, Homo sapiens
acttaaaaaatcagaacaaaa

SEQ ID NO: 5009185 - DNA, 16 bp, Homo sapiens
acttccatccctgctt

SEQ ID NO: 5009186 - DNA, 17 bp, Homo sapiens
acttcccaccctgcccc

SEQ ID NO: 5009187 - DNA, 10 bp, Homo sapiens
acttctgctc

SEQ ID NO: 5009188 - DNA, 19 bp, Homo sapiens
acttgaccgggagacagag

SEQ ID NO: 5009189 - DNA, 14 bp, Homo sapiens
acttgtaaaaccac

SEQ ID NO: 5009190 - DNA, 16 bp, Homo sapiens
actttgaagtgcagct

SEQ ID NO: 5009191 - DNA, 14 bp, Homo sapiens
actttgccactgct

SEQ ID NO: 5009192 - DNA, 18 bp, Homo sapiens
actttgtgcattctggat

SEQ ID NO: 5009193 - DNA, 19 bp, Homo sapiens
agaaaccacagtcttccca

SEQ ID NO: 5009194 - DNA, 22 bp, Homo sapiens
agaaaccacagtcttcccagca

SEQ ID NO: 5009195 - DNA, 12 bp, Homo sapiens
agaaacttttct

SEQ ID NO: 5009196 - DNA, 13 bp, Homo sapiens
agaaagtaattta

SEQ ID NO: 5009197 - DNA, 14 bp, Homo sapiens
agaaagtaatttaa

SEQ ID NO: 5009198 - DNA, 18 bp, Homo sapiens
agaaagtaatttaatttg

SEQ ID NO: 5009199 - DNA, 21 bp, Homo sapiens
agaaagtaatttaatttgtaa

SEQ ID NO: 5009200 - DNA, 12 bp, Homo sapiens
agaacaaaactt

SEQ ID NO: 5009201 - DNA, 17 bp, Homo sapiens
agaagagggtgtgtttg

SEQ ID NO: 5009202 - DNA, 20 bp, Homo sapiens
agaagcctcgttttgatgcc

SEQ ID NO: 5009203 - DNA, 15 bp, Homo sapiens
agaataaaaactttt

SEQ ID NO: 5009204 - DNA, 20 bp, Homo sapiens
agaataaaaacttttgagga

SEQ ID NO: 5009205 - DNA, 21 bp, Homo sapiens
agaatgtacgtccagcctgcc

SEQ ID NO: 5009206 - DNA, 18 bp, Homo sapiens
agacaatatgtgagtgcc

SEQ ID NO: 5009207 - DNA, 20 bp, Homo sapiens
agacaatatgtgagtgcctt

SEQ ID NO: 5009208 - DNA, 21 bp, Homo sapiens
agacaatatgtgagtgccttt

SEQ ID NO: 5009209 - DNA, 17 bp, Homo sapiens
caaagctgagcctgcag

SEQ ID NO: 5009210 - DNA, 22 bp, Homo sapiens
caaagtgtatgcagtattcttg

SEQ ID NO: 5009211 - DNA, 15 bp, Homo sapiens
caacaacatccactg

SEQ ID NO: 5009212 - DNA, 24 bp, Homo sapiens
caacacttccagcatttagctggc

SEQ ID NO: 5009213 - DNA, 15 bp, Homo sapiens
caacccttctctgtt

SEQ ID NO: 5009214 - DNA, 23 bp, Homo sapiens
caacggtctcctgactggtgctg

SEQ ID NO: 5009215 - DNA, 18 bp, Homo sapiens
caactctaactctgagag

SEQ ID NO: 5009216 - DNA, 20 bp, Homo sapiens
caagaatgtacgtccagcct

SEQ ID NO: 5009217 - DNA, 14 bp, Homo sapiens
caagcaactaattt

SEQ ID NO: 5009218 - DNA, 16 bp, Homo sapiens
caagcaactaattttc

SEQ ID NO: 5009219 - DNA, 19 bp, Homo sapiens
caagcagaggaccagggcc

SEQ ID NO: 5009220 - DNA, 16 bp, Homo sapiens
caagtccgcagaagcc

SEQ ID NO: 5009221 - DNA, 19 bp, Homo sapiens
caagtccgcagaagccctg

SEQ ID NO: 5009222 - DNA, 16 bp, Homo sapiens
caagtttccatagcaa

SEQ ID NO: 5009223 - DNA, 17 bp, Homo sapiens
caagtttccatagcaac

SEQ ID NO: 5009224 - DNA, 21 bp, Homo sapiens
caagttttcttccatgatttt

SEQ ID NO: 5009225 - DNA, 12 bp, Homo sapiens
caatagaatggg

SEQ ID NO: 5009226 - DNA, 11 bp, Homo sapiens
caatgactact

SEQ ID NO: 5009227 - DNA, 21 bp, Homo sapiens
caatgagactctagggtccag

SEQ ID NO: 5009228 - DNA, 18 bp, Homo sapiens
caatgcttctagagtttt

SEQ ID NO: 5009229 - DNA, 15 bp, Homo sapiens
caatgcttctgttga

SEQ ID NO: 5009230 - DNA, 21 bp, Homo sapiens
caatggtgtcagtatccaggc

SEQ ID NO: 5009231 - DNA, 20 bp, Homo sapiens
caatgtgaggggtccctagc

SEQ ID NO: 5009232 - DNA, 21 bp, Homo sapiens
cacaccattttgtaaatgaaa

SEQ ID NO: 5009233 - DNA, 14 bp, Homo sapiens
cacacccaaagctg

SEQ ID NO: 5009234 - DNA, 18 bp, Homo sapiens
cacactgtcatgcttcat

SEQ ID NO: 5009235 - DNA, 18 bp, Homo sapiens
cacagagagggagagcag

SEQ ID NO: 5009236 - DNA, 22 bp, Homo sapiens
cacatccgcgtgtgcctgtgtg

SEQ ID NO: 5009237 - DNA, 21 bp, Homo sapiens
cacatgaaacctacacactgt

SEQ ID NO: 5009238 - DNA, 16 bp, Homo sapiens
cacatgtccagcacct

SEQ ID NO: 5009239 - DNA, 12 bp, Homo sapiens
cacatgtgtggt

SEQ ID NO: 5009240 - DNA, 23 bp, Homo sapiens
caccaagcccgaccgggccaggc

SEQ ID NO: 5009241 - DNA, 18 bp, Homo sapiens
cacccaaagctgagcctg

SEQ ID NO: 5009242 - DNA, 22 bp, Homo sapiens
cacccaaagctgagcctgcagg

SEQ ID NO: 5009243 - DNA, 19 bp, Homo sapiens
cacccatgcaagcagagga

SEQ ID NO: 5009244 - DNA, 17 bp, Homo sapiens
caccccaacacttccag

SEQ ID NO: 5009245 - DNA, 14 bp, Homo sapiens
caccccactcctgt

SEQ ID NO: 5009246 - DNA, 21 bp, Homo sapiens
cacccggtgggacccccgtgg

SEQ ID NO: 5009247 - DNA, 17 bp, Homo sapiens
caccctgcccctcagag

SEQ ID NO: 5009248 - DNA, 17 bp, Homo sapiens
caccctgctgctggtgc

SEQ ID NO: 5009249 - DNA, 14 bp, Homo sapiens
caccgaggggcctt

SEQ ID NO: 5009250 - DNA, 19 bp, Homo sapiens
caccgcctccccacctcca

SEQ ID NO: 5009251 - DNA, 13 bp, Homo sapiens
cacctgctcccag

SEQ ID NO: 5009252 - DNA, 14 bp, Homo sapiens
caccttccaacact

SEQ ID NO: 5009253 - DNA, 18 bp, Homo sapiens
caccttccaacactccat

SEQ ID NO: 5009254 - DNA, 13 bp, Homo sapiens
caccttgtgcctg

SEQ ID NO: 5009255 - DNA, 13 bp, Homo sapiens
cactcccaggatg

SEQ ID NO: 5009256 - DNA, 23 bp, Homo sapiens
cactgaaatgaaatcttcccagt

SEQ ID NO: 5009257 - DNA, 13 bp, Homo sapiens
cactgctgtattt

SEQ ID NO: 5009258 - DNA, 14 bp, Homo sapiens
cacttccaggggaa

SEQ ID NO: 5009259 - DNA, 17 bp, Homo sapiens
cacttccaggggaacct

SEQ ID NO: 5009260 - DNA, 14 bp, Homo sapiens
cacttcccaccctg

SEQ ID NO: 5009261 - DNA, 19 bp, Homo sapiens
cacttgaccgggagacaga

SEQ ID NO: 5009262 - DNA, 13 bp, Homo sapiens
cagaacaaaactt

SEQ ID NO: 5009263 - DNA, 16 bp, Homo sapiens
cagaacaaaacttcta

SEQ ID NO: 5009264 - DNA, 23 bp, Homo sapiens
cagaagagggtgtgtttgaaatc

SEQ ID NO: 5009265 - DNA, 23 bp, Homo sapiens
cagaatgtaagtgggcccacccg

SEQ ID NO: 5009266 - DNA, 17 bp, Homo sapiens
cagacaaggtgcctgtt

SEQ ID NO: 5009267 - DNA, 22 bp, Homo sapiens
cagacaatatgtgagtgccttt

SEQ ID NO: 5009268 - DNA, 21 bp, Homo sapiens
cagagactgtccctgaaacct

SEQ ID NO: 5009269 - DNA, 13 bp, Homo sapiens
cagaggtaccctg

SEQ ID NO: 5009270 - DNA, 15 bp, Homo sapiens
cagaggtaccctggg

SEQ ID NO: 5009271 - DNA, 16 bp, Homo sapiens
cagaggtaccctgggt

SEQ ID NO: 5009272 - DNA, 21 bp, Homo sapiens
cagaggtgcttcaccctgagt

SEQ ID NO: 5009273 - DNA, 21 bp, Homo sapiens
cagatactttgaagtgcagct

SEQ ID NO: 5009274 - DNA, 23 bp, Homo sapiens
cagatactttgaagtgcagctca

SEQ ID NO: 5009275 - DNA, 15 bp, Homo sapiens
cagcaccttgtgcct

SEQ ID NO: 5009276 - DNA, 19 bp, Homo sapiens
cagcaccttgtgcctgggg

SEQ ID NO: 5009277 - DNA, 13 bp, Homo sapiens
cagcagcttctcc

SEQ ID NO: 5009278 - DNA, 18 bp, Homo sapiens
cagccaggagctgtcacc

SEQ ID NO: 5009279 - DNA, 18 bp, Homo sapiens
cagcccaccctgctgctg

SEQ ID NO: 5009280 - DNA, 13 bp, Homo sapiens
cagcccacctgct

SEQ ID NO: 5009281 - DNA, 17 bp, Homo sapiens
cagcccacctgctccca

SEQ ID NO: 5009282 - DNA, 18 bp, Homo sapiens
cagcccacctgctcccag

SEQ ID NO: 5009283 - DNA, 18 bp, Homo sapiens
cagcctcgttggaagagg

SEQ ID NO: 5009284 - DNA, 24 bp, Homo sapiens
cagctatcgaacttcacaactagg

SEQ ID NO: 5009285 - DNA, 19 bp, Homo sapiens
cagcttatctcttttatat

SEQ ID NO: 5009286 - DNA, 23 bp, Homo sapiens
cagcttatctcttttatatttgt

SEQ ID NO: 5009287 - DNA, 17 bp, Homo sapiens
cagcttggccctttcct

SEQ ID NO: 5009288 - DNA, 19 bp, Homo sapiens
caggagctgtcaccaagga

SEQ ID NO: 5009289 - DNA, 22 bp, Homo sapiens
caggagctgtcaccaaggaaac

SEQ ID NO: 5009290 - DNA, 15 bp, Homo sapiens
caggaggcaggcatg

SEQ ID NO: 5009291 - DNA, 18 bp, Homo sapiens
caggaggcaggcatggcc

SEQ ID NO: 5009292 - DNA, 12 bp, Homo sapiens
caggcagggaga

SEQ ID NO: 5009293 - DNA, 20 bp, Homo sapiens
caggccccaggcctgtggct

SEQ ID NO: 5009294 - DNA, 10 bp, Homo sapiens
caggctgggc

SEQ ID NO: 5009295 - DNA, 11 bp, Homo sapiens
caggctgggcc

SEQ ID NO: 5009296 - DNA, 17 bp, Homo sapiens
caggctgggccatgtcc

SEQ ID NO: 5009297 - DNA, 23 bp, Homo sapiens
caggctgggccatgtccaaagag

SEQ ID NO: 5009298 - DNA, 19 bp, Homo sapiens
caggctttgtacagagtgc

SEQ ID NO: 5009299 - DNA, 22 bp, Homo sapiens
cagggaagccccacatgtccag

SEQ ID NO: 5009300 - DNA, 17 bp, Homo sapiens
cagggaagctgtcctgg

SEQ ID NO: 5009301 - DNA, 16 bp, Homo sapiens
cagggaaggtgaaaca

SEQ ID NO: 5009302 - DNA, 19 bp, Homo sapiens
cagggcaccatccagctcc

SEQ ID NO: 5009303 - DNA, 15 bp, Homo sapiens
caggggaacctgcca

SEQ ID NO: 5009304 - DNA, 22 bp, Homo sapiens
cagggtggtctcttcttggggc

SEQ ID NO: 5009305 - DNA, 19 bp, Homo sapiens
caggtaactaattggaagg

SEQ ID NO: 5009306 - DNA, 22 bp, Homo sapiens
caggtagaaggttgacacagtt

SEQ ID NO: 5009307 - DNA, 13 bp, Homo sapiens
caggtgcagaggt

SEQ ID NO: 5009308 - DNA, 16 bp, Homo sapiens
cagtctgaatgctgcc

SEQ ID NO: 5009309 - DNA, 15 bp, Homo sapiens
ctgcagaagcaaggg

SEQ ID NO: 5009310 - DNA, 22 bp, Homo sapiens
ctgcagcaccgaggggcctttg

SEQ ID NO: 5009311 - DNA, 23 bp, Homo sapiens
ctgcagggccatggctcagggtg

SEQ ID NO: 5009312 - DNA, 22 bp, Homo sapiens
ctgccatgccaggaacctgtcc

SEQ ID NO: 5009313 - DNA, 23 bp, Homo sapiens
ctgcccggagcagcagcttctcc

SEQ ID NO: 5009314 - DNA, 17 bp, Homo sapiens
ctgccctcctctcccct

SEQ ID NO: 5009315 - DNA, 18 bp, Homo sapiens
ctgccctttcaaagcact

SEQ ID NO: 5009316 - DNA, 14 bp, Homo sapiens
ctgccttctgctga

SEQ ID NO: 5009317 - DNA, 21 bp, Homo sapiens
ctgcgaccctgggggcacagg

SEQ ID NO: 5009318 - DNA, 19 bp, Homo sapiens
ctgctacctttcaaagctt

SEQ ID NO: 5009319 - DNA, 17 bp, Homo sapiens
ctgctgtatttttattt

SEQ ID NO: 5009320 - DNA, 11 bp, Homo sapiens
ctgctgtgcaa

SEQ ID NO: 5009321 - DNA, 15 bp, Homo sapiens
ctggacctgtatatt

SEQ ID NO: 5009322 - DNA, 14 bp, Homo sapiens
ctggatgaaagagc

SEQ ID NO: 5009323 - DNA, 19 bp, Homo sapiens
ctggcactcttgttcccac

SEQ ID NO: 5009324 - DNA, 23 bp, Homo sapiens
ctggcatcaagaggtgggagggc

SEQ ID NO: 5009325 - DNA, 19 bp, Homo sapiens
ctggcctgagaggggaagc

SEQ ID NO: 5009326 - DNA, 19 bp, Homo sapiens
ctgggccatgtccaaagag

SEQ ID NO: 5009327 - DNA, 20 bp, Homo sapiens
ctgggcccgacatggctccg

SEQ ID NO: 5009328 - DNA, 11 bp, Homo sapiens
ctgggccctga

SEQ ID NO: 5009329 - DNA, 13 bp, Homo sapiens
ctgggccctgagt

SEQ ID NO: 5009330 - DNA, 19 bp, Homo sapiens
ctgggctggttggagaagg

SEQ ID NO: 5009331 - DNA, 15 bp, Homo sapiens
ctggggcaggctggg

SEQ ID NO: 5009332 - DNA, 18 bp, Homo sapiens
ctggggcaggctgggcca

SEQ ID NO: 5009333 - DNA, 13 bp, Homo sapiens
ctgggggcacagg

SEQ ID NO: 5009334 - DNA, 17 bp, Homo sapiens
ctggggggacccagtgc

SEQ ID NO: 5009335 - DNA, 18 bp, Homo sapiens
ctggggggacccagtgca

SEQ ID NO: 5009336 - DNA, 21 bp, Homo sapiens
ctggggggacccagtgcagaa

SEQ ID NO: 5009337 - DNA, 20 bp, Homo sapiens
ctggggtgttagtggcaccg

SEQ ID NO: 5009338 - DNA, 17 bp, Homo sapiens
ctgggtactgaaagcct

SEQ ID NO: 5009339 - DNA, 18 bp, Homo sapiens
ctgggtactgaaagcctt

SEQ ID NO: 5009340 - DNA, 14 bp, Homo sapiens
ctggtcggagaggg

SEQ ID NO: 5009341 - DNA, 15 bp, Homo sapiens
ctggtcggagaggga

SEQ ID NO: 5009342 - DNA, 17 bp, Homo sapiens
ctggttccctgctgcgc

SEQ ID NO: 5009343 - DNA, 18 bp, Homo sapiens
ctgtactgttactgggcc

SEQ ID NO: 5009344 - DNA, 22 bp, Homo sapiens
ctgtactgttactgggccctga

SEQ ID NO: 5009345 - DNA, 22 bp, Homo sapiens
ctgtacttgaagtctaaaagca

SEQ ID NO: 5009346 - DNA, 16 bp, Homo sapiens
ctgtatatttgtaaag

SEQ ID NO: 5009347 - DNA, 22 bp, Homo sapiens
ctgtatgctgatcatcgccaga

SEQ ID NO: 5009348 - DNA, 13 bp, Homo sapiens
ctgtccctctcct

SEQ ID NO: 5009349 - DNA, 15 bp, Homo sapiens
ctgtccctgaaacct

SEQ ID NO: 5009350 - DNA, 17 bp, Homo sapiens
ctgtcccttgcttgcct

SEQ ID NO: 5009351 - DNA, 21 bp, Homo sapiens
ctgtccgttcacatgtgtggt

SEQ ID NO: 5009352 - DNA, 20 bp, Homo sapiens
ctgtcctaaggaaccttcct

SEQ ID NO: 5009353 - DNA, 14 bp, Homo sapiens
ctgtgacctctgac

SEQ ID NO: 5009354 - DNA, 21 bp, Homo sapiens
ctgtgtatatggtatatatac

SEQ ID NO: 5009355 - DNA, 16 bp, Homo sapiens
ctgtgtgtcccaggca

SEQ ID NO: 5009356 - DNA, 22 bp, Homo sapiens
ctgtgtgtcccaggcagggaga

SEQ ID NO: 5009357 - DNA, 23 bp, Homo sapiens
ctgtgtgtgtgtgtgtgcgtgtg

SEQ ID NO: 5009358 - DNA, 20 bp, Homo sapiens
ctgttactgggccctgagtc

SEQ ID NO: 5009359 - DNA, 22 bp, Homo sapiens
ctgttggtctgccttctgctga

SEQ ID NO: 5009360 - DNA, 23 bp, Homo sapiens
ctgttggtctgccttctgctgaa

SEQ ID NO: 5009361 - DNA, 21 bp, Homo sapiens
ctgtttctctgccgctacctc

SEQ ID NO: 5009362 - DNA, 14 bp, Homo sapiens
ctgtttgtttcata

SEQ ID NO: 5009363 - DNA, 17 bp, Homo sapiens
ctgttttgtttggcaag

SEQ ID NO: 5009364 - DNA, 22 bp, Homo sapiens
ctgttttgtttggcaaggaaag

SEQ ID NO: 5009365 - DNA, 13 bp, Homo sapiens
cttaagaattgaa

SEQ ID NO: 5009366 - DNA, 19 bp, Homo sapiens
cttaccagtgacgctgctg

SEQ ID NO: 5009367 - DNA, 20 bp, Homo sapiens
cttagggaagctggcctgag

SEQ ID NO: 5009368 - DNA, 20 bp, Homo sapiens
cttcagggaaggtgaaacag

SEQ ID NO: 5009369 - DNA, 18 bp, Homo sapiens
cttcatcattccctctca

SEQ ID NO: 5009370 - DNA, 19 bp, Homo sapiens
cttcatcattccctctcat

SEQ ID NO: 5009371 - DNA, 15 bp, Homo sapiens
cttccaacactccat

SEQ ID NO: 5009372 - DNA, 19 bp, Homo sapiens
cttcccaccctgcccctca

SEQ ID NO: 5009373 - DNA, 19 bp, Homo sapiens
cttccccgagtgactctgg

SEQ ID NO: 5009374 - DNA, 17 bp, Homo sapiens
cttctgcagttctcatg

SEQ ID NO: 5009375 - DNA, 17 bp, Homo sapiens
cttctgggagcaggaac

SEQ ID NO: 5009376 - DNA, 15 bp, Homo sapiens
cttctggggacagac

SEQ ID NO: 5009377 - DNA, 19 bp, Homo sapiens
cttctggggcaggctgggc

SEQ ID NO: 5009378 - DNA, 16 bp, Homo sapiens
cttcttacgcaatgct

SEQ ID NO: 5009379 - DNA, 18 bp, Homo sapiens
cttcttggggcccagtgc

SEQ ID NO: 5009380 - DNA, 17 bp, Homo sapiens
cttgaattccttgggga

SEQ ID NO: 5009381 - DNA, 21 bp, Homo sapiens
cttgactcccaagtttccata

SEQ ID NO: 5009382 - DNA, 14 bp, Homo sapiens
cttgcccccagtgc

SEQ ID NO: 5009383 - DNA, 15 bp, Homo sapiens
cttgcctccaggtgc

SEQ ID NO: 5009384 - DNA, 17 bp, Homo sapiens
cttgcctgcagggccat

SEQ ID NO: 5009385 - DNA, 19 bp, Homo sapiens
cttgctgtatgctgatcat

SEQ ID NO: 5009386 - DNA, 15 bp, Homo sapiens
cttgcttcttactga

SEQ ID NO: 5009387 - DNA, 12 bp, Homo sapiens
cttgcttgcctg

SEQ ID NO: 5009388 - DNA, 19 bp, Homo sapiens
cttgcttgcctgcagggcc

SEQ ID NO: 5009389 - DNA, 14 bp, Homo sapiens
cttggccctttcct

SEQ ID NO: 5009390 - DNA, 15 bp, Homo sapiens
cttggccctttcctt

SEQ ID NO: 5009391 - DNA, 20 bp, Homo sapiens
cttggccctttccttccaga

SEQ ID NO: 5009392 - DNA, 12 bp, Homo sapiens
cttggggcccag

SEQ ID NO: 5009393 - DNA, 15 bp, Homo sapiens
cttggggcccagtgc

SEQ ID NO: 5009394 - DNA, 23 bp, Homo sapiens
ctttaaaaaagaaaagtgcatat

SEQ ID NO: 5009395 - DNA, 19 bp, Homo sapiens
ctttatgtagtttttatat

SEQ ID NO: 5009396 - DNA, 20 bp, Homo sapiens
ctttatgtagtttttatatg

SEQ ID NO: 5009397 - DNA, 20 bp, Homo sapiens
ctttgtggattctgaggccc

SEQ ID NO: 5009398 - DNA, 11 bp, Homo sapiens
cttttaattta

SEQ ID NO: 5009399 - DNA, 14 bp, Homo sapiens
cttttatatttgta

SEQ ID NO: 5009400 - DNA, 15 bp, Homo sapiens
cttttattctccaga

SEQ ID NO: 5009401 - DNA, 18 bp, Homo sapiens
cttttattctccagaata

SEQ ID NO: 5009402 - DNA, 15 bp, Homo sapiens
cttttcaatgacatt

SEQ ID NO: 5009403 - DNA, 14 bp, Homo sapiens
cttttgcagaagag

SEQ ID NO: 5009404 - DNA, 23 bp, Homo sapiens
cttttgcagaagagggtgtgttt

SEQ ID NO: 5009405 - DNA, 17 bp, Homo sapiens
cttttgtgtgaattgac

SEQ ID NO: 5009406 - DNA, 17 bp, Homo sapiens
ctttttcaggagaatta

SEQ ID NO: 5009407 - DNA, 22 bp, Homo sapiens
gaaaagctagtgtacctcctct

SEQ ID NO: 5009408 - DNA, 23 bp, Homo sapiens
gaaacactgaaatgaaatcttcc

SEQ ID NO: 5009409 - DNA, 13 bp, Homo sapiens
gaaacgctacctc

SEQ ID NO: 5009410 - DNA, 18 bp, Homo sapiens
gaaacgctacctctctgt

SEQ ID NO: 5009411 - DNA, 18 bp, Homo sapiens
gaaactcccatgtatgga

SEQ ID NO: 5009412 - DNA, 15 bp, Homo sapiens
gaaagacttctcaaa

SEQ ID NO: 5009413 - DNA, 15 bp, Homo sapiens
gaaaggagaatttga

SEQ ID NO: 5009414 - DNA, 15 bp, Homo sapiens
gaaatcttcccagta

SEQ ID NO: 5009415 - DNA, 15 bp, Homo sapiens
gaaccttccttcctg

SEQ ID NO: 5009416 - DNA, 17 bp, Homo sapiens
gaagaggaaaaggctgg

SEQ ID NO: 5009417 - DNA, 22 bp, Homo sapiens
gaagctggcctgagaggggaag

SEQ ID NO: 5009418 - DNA, 13 bp, Homo sapiens
gaaggcctgactt

SEQ ID NO: 5009419 - DNA, 22 bp, Homo sapiens
gaataatgttttgggaaacact

SEQ ID NO: 5009420 - DNA, 16 bp, Homo sapiens
gaatcccactgtatga

SEQ ID NO: 5009421 - DNA, 10 bp, Homo sapiens
gaatcctcct

SEQ ID NO: 5009422 - DNA, 21 bp, Homo sapiens
gaatgtttaaagatcatgaca

SEQ ID NO: 5009423 - DNA, 23 bp, Homo sapiens
gaattcagaagacccctgactca

SEQ ID NO: 5009424 - DNA, 22 bp, Homo sapiens
gaatttggggcaggaaatactt

SEQ ID NO: 5009425 - DNA, 20 bp, Homo sapiens
gacaactgtgaagccaccct

SEQ ID NO: 5009426 - DNA, 19 bp, Homo sapiens
gacaatatgtgagtgcctt

SEQ ID NO: 5009427 - DNA, 18 bp, Homo sapiens
gacagctacacagagctt

SEQ ID NO: 5009428 - DNA, 22 bp, Homo sapiens
gacatagaatctgtgacctctg

SEQ ID NO: 5009429 - DNA, 16 bp, Homo sapiens
gacatcacagggtggg

SEQ ID NO: 5009430 - DNA, 19 bp, Homo sapiens
gacatggctccggcctctg

SEQ ID NO: 5009431 - DNA, 20 bp, Homo sapiens
gacatggctccggcctctgc

SEQ ID NO: 5009432 - DNA, 10 bp, Homo sapiens
gacccagtgc

SEQ ID NO: 5009433 - DNA, 15 bp, Homo sapiens
gacccccgtggggca

SEQ ID NO: 5009434 - DNA, 18 bp, Homo sapiens
gaccctgggggcacagga

SEQ ID NO: 5009435 - DNA, 16 bp, Homo sapiens
gaccgggagacagagg

SEQ ID NO: 5009436 - DNA, 12 bp, Homo sapiens
gaccgggccagg

SEQ ID NO: 5009437 - DNA, 17 bp, Homo sapiens
gacgccacggagggctg

SEQ ID NO: 5009438 - DNA, 16 bp, Homo sapiens
gacggccaagaatgta

SEQ ID NO: 5009439 - DNA, 22 bp, Homo sapiens
gacggtttccagggaggggccg

SEQ ID NO: 5009440 - DNA, 22 bp, Homo sapiens
gacgtgctccgtagctctgctg

SEQ ID NO: 5009441 - DNA, 21 bp, Homo sapiens
gacgttgacctggactgaagt

SEQ ID NO: 5009442 - DNA, 14 bp, Homo sapiens
gactcagtgcagat

SEQ ID NO: 5009443 - DNA, 20 bp, Homo sapiens
gactcagtgcagatggagag

SEQ ID NO: 5009444 - DNA, 21 bp, Homo sapiens
gactcccaagtttccatagca

SEQ ID NO: 5009445 - DNA, 18 bp, Homo sapiens
gactgttgaaaggagaat

SEQ ID NO: 5009446 - DNA, 12 bp, Homo sapiens
gacttcaaagca

SEQ ID NO: 5009447 - DNA, 13 bp, Homo sapiens
gagactcagtgca

SEQ ID NO: 5009448 - DNA, 20 bp, Homo sapiens
gagactctagggtccagtgg

SEQ ID NO: 5009449 - DNA, 22 bp, Homo sapiens
gagactgtccctgaaacctagt

SEQ ID NO: 5009450 - DNA, 17 bp, Homo sapiens
gagagaagcaagccagc

SEQ ID NO: 5009451 - DNA, 19 bp, Homo sapiens
gagagctgtttttgacagc

SEQ ID NO: 5009452 - DNA, 14 bp, Homo sapiens
gagcagggaaggcc

SEQ ID NO: 5009453 - DNA, 18 bp, Homo sapiens
gagcagggaaggcctgac

SEQ ID NO: 5009454 - DNA, 19 bp, Homo sapiens
gagcatgtaaaagcggaaa

SEQ ID NO: 5009455 - DNA, 11 bp, Homo sapiens
gagccctctcc

SEQ ID NO: 5009456 - DNA, 13 bp, Homo sapiens
gagccctctcctc

SEQ ID NO: 5009457 - DNA, 16 bp, Homo sapiens
gagccctctcctccct

SEQ ID NO: 5009458 - DNA, 17 bp, Homo sapiens
gagcgccatcatgtctt

SEQ ID NO: 5009459 - DNA, 16 bp, Homo sapiens
gagctgggcccgacat

SEQ ID NO: 5009460 - DNA, 18 bp, Homo sapiens
gagctgtcaccaaggaaa

SEQ ID NO: 5009461 - DNA, 13 bp, Homo sapiens
gaggaccagggcc

SEQ ID NO: 5009462 - DNA, 14 bp, Homo sapiens
gaggccccaggggg

SEQ ID NO: 5009463 - DNA, 16 bp, Homo sapiens
gaggcctgcgaccctg

SEQ ID NO: 5009464 - DNA, 15 bp, Homo sapiens
gagggacggccaaga

SEQ ID NO: 5009465 - DNA, 20 bp, Homo sapiens
gaggggtccctagcagccca

SEQ ID NO: 5009466 - DNA, 14 bp, Homo sapiens
gagtcagccaggag

SEQ ID NO: 5009467 - DNA, 18 bp, Homo sapiens
gatatttcgtgtactgca

SEQ ID NO: 5009468 - DNA, 19 bp, Homo sapiens
gatgccactcctccctccg

SEQ ID NO: 5009469 - DNA, 20 bp, Homo sapiens
gatgccattcttccttgcaa

SEQ ID NO: 5009470 - DNA, 13 bp, Homo sapiens
gatgtgtcctcag

SEQ ID NO: 5009471 - DNA, 22 bp, Homo sapiens
gatgttctgggctaatatactt

SEQ ID NO: 5009472 - DNA, 23 bp, Homo sapiens
gattctcttgatgccaccttcag

SEQ ID NO: 5009473 - DNA, 18 bp, Homo sapiens
gatttttaagaaagtaat

SEQ ID NO: 5009474 - DNA, 10 bp, Homo sapiens
gcaaggaaag

SEQ ID NO: 5009475 - DNA, 19 bp, Homo sapiens
gcaatctgcctgtatctct

SEQ ID NO: 5009476 - DNA, 23 bp, Homo sapiens
gcaatggtgtcagtatccaggct

SEQ ID NO: 5009477 - DNA, 21 bp, Homo sapiens
gcacaggaggcaggcatggcc

SEQ ID NO: 5009478 - DNA, 23 bp, Homo sapiens
gcacatccgcgtgtgcctgtgtg

SEQ ID NO: 5009479 - DNA, 17 bp, Homo sapiens
gcaccatccagctcccc

SEQ ID NO: 5009480 - DNA, 18 bp, Homo sapiens
gcactcttgttcccacac

SEQ ID NO: 5009481 - DNA, 18 bp, Homo sapiens
gcactgaggtttttttgc

SEQ ID NO: 5009482 - DNA, 20 bp, Homo sapiens
gcactgatgttgtgttttta

SEQ ID NO: 5009483 - DNA, 18 bp, Homo sapiens
gcagaaaataaaggaagc

SEQ ID NO: 5009484 - DNA, 14 bp, Homo sapiens
gcagaggtaccctg

SEQ ID NO: 5009485 - DNA, 16 bp, Homo sapiens
gcagcaccgaggggcc

SEQ ID NO: 5009486 - DNA, 16 bp, Homo sapiens
gcagcggcgtgaggcc

SEQ ID NO: 5009487 - DNA, 16 bp, Homo sapiens
gcaggcatggccctgg

SEQ ID NO: 5009488 - DNA, 12 bp, Homo sapiens
gcaggctgggcc

SEQ ID NO: 5009489 - DNA, 15 bp, Homo sapiens
gcaggctgggccatg

SEQ ID NO: 5009490 - DNA, 18 bp, Homo sapiens
gcagggaagccccacatg

SEQ ID NO: 5009491 - DNA, 15 bp, Homo sapiens
gcagggaaggcctga

SEQ ID NO: 5009492 - DNA, 16 bp, Homo sapiens
gcagggccatggctca

SEQ ID NO: 5009493 - DNA, 15 bp, Homo sapiens
gcagtattcttgcac

SEQ ID NO: 5009494 - DNA, 21 bp, Homo sapiens
gcatatttatccaaaatgtgt

SEQ ID NO: 5009495 - DNA, 16 bp, Homo sapiens
gcatcttgcctccagg

SEQ ID NO: 5009496 - DNA, 14 bp, Homo sapiens
gcatggccctgggc

SEQ ID NO: 5009497 - DNA, 20 bp, Homo sapiens
gccaagaaaagggctgacat

SEQ ID NO: 5009498 - DNA, 12 bp, Homo sapiens
gccaagaatgta

SEQ ID NO: 5009499 - DNA, 13 bp, Homo sapiens
gccaagaatgtac

SEQ ID NO: 5009500 - DNA, 20 bp, Homo sapiens
gccaagggacgttgacctgg

SEQ ID NO: 5009501 - DNA, 22 bp, Homo sapiens
gccactccccggcatgagactc

SEQ ID NO: 5009502 - DNA, 13 bp, Homo sapiens
gccagaggtgctt

SEQ ID NO: 5009503 - DNA, 15 bp, Homo sapiens
gccaggaacctgtcc

SEQ ID NO: 5009504 - DNA, 17 bp, Homo sapiens
gccaggcaggtccacag

SEQ ID NO: 5009505 - DNA, 20 bp, Homo sapiens
gccaggcctgggtgatctgc

SEQ ID NO: 5009506 - DNA, 16 bp, Homo sapiens
gccatgccaggaacct

SEQ ID NO: 5009507 - DNA, 15 bp, Homo sapiens
gccatgtccaaagag

SEQ ID NO: 5009508 - DNA, 23 bp, Homo sapiens
tctcacccatgcaagcagaggac

SEQ ID NO: 5009509 - DNA, 19 bp, Homo sapiens
tctcaccccactcctgtca

SEQ ID NO: 5009510 - DNA, 12 bp, Homo sapiens
tctcagtgtttt

SEQ ID NO: 5009511 - DNA, 19 bp, Homo sapiens
tctcagtgttttggactcc

SEQ ID NO: 5009512 - DNA, 23 bp, Homo sapiens
tctcagtgttttggactccatct

SEQ ID NO: 5009513 - DNA, 21 bp, Homo sapiens
tctcatgactcctacttttca

SEQ ID NO: 5009514 - DNA, 20 bp, Homo sapiens
tctcattccgttgtctgtgg

SEQ ID NO: 5009515 - DNA, 21 bp, Homo sapiens
tctcccaagctgattttattc

SEQ ID NO: 5009516 - DNA, 13 bp, Homo sapiens
tctcctgactggt

SEQ ID NO: 5009517 - DNA, 14 bp, Homo sapiens
tctctacaaaaata

SEQ ID NO: 5009518 - DNA, 20 bp, Homo sapiens
tctctgtcccttgctgtatg

SEQ ID NO: 5009519 - DNA, 15 bp, Homo sapiens
tctctgttggtctgc

SEQ ID NO: 5009520 - DNA, 22 bp, Homo sapiens
tctctgttggtctgccttctgc

SEQ ID NO: 5009521 - DNA, 23 bp, Homo sapiens
tctctgttggtctgccttctgct

SEQ ID NO: 5009522 - DNA, 21 bp, Homo sapiens
tctgacaactgtgaagccacc

SEQ ID NO: 5009523 - DNA, 20 bp, Homo sapiens
tctgacagtttttctgtttt

SEQ ID NO: 5009524 - DNA, 15 bp, Homo sapiens
tctgagagctgtttt

SEQ ID NO: 5009525 - DNA, 18 bp, Homo sapiens
tctgaggtgacttaaaaa

SEQ ID NO: 5009526 - DNA, 16 bp, Homo sapiens
tctgccttctgctgaa

SEQ ID NO: 5009527 - DNA, 15 bp, Homo sapiens
tctggatttggtgct

SEQ ID NO: 5009528 - DNA, 19 bp, Homo sapiens
tctggggcaggctgggcca

SEQ ID NO: 5009529 - DNA, 20 bp, Homo sapiens
tctggggcaggctgggccat

SEQ ID NO: 5009530 - DNA, 18 bp, Homo sapiens
tctggggggacccagtgc

SEQ ID NO: 5009531 - DNA, 20 bp, Homo sapiens
tctggggggacccagtgcag

SEQ ID NO: 5009532 - DNA, 16 bp, Homo sapiens
tctgtcccttgctgta

SEQ ID NO: 5009533 - DNA, 17 bp, Homo sapiens
tctgtcccttgctgtat

SEQ ID NO: 5009534 - DNA, 18 bp, Homo sapiens
tctgttggtctgccttct

SEQ ID NO: 5009535 - DNA, 20 bp, Homo sapiens
tctgttggtctgccttctgc

SEQ ID NO: 5009536 - DNA, 23 bp, Homo sapiens
tctgttttgtttggcaaggaaag

SEQ ID NO: 5009537 - DNA, 16 bp, Homo sapiens
tcttataactcaacat

SEQ ID NO: 5009538 - DNA, 20 bp, Homo sapiens
tcttctggggcaggctgggc

SEQ ID NO: 5009539 - DNA, 14 bp, Homo sapiens
tcttgatgtatttc

SEQ ID NO: 5009540 - DNA, 18 bp, Homo sapiens
tcttgcctccaggtgcag

SEQ ID NO: 5009541 - DNA, 13 bp, Homo sapiens
tcttttatatttg

SEQ ID NO: 5009542 - DNA, 11 bp, Homo sapiens
tgaaaaagaat

SEQ ID NO: 5009543 - DNA, 23 bp, Homo sapiens
tgaaaaagaataaaaacttttga

SEQ ID NO: 5009544 - DNA, 21 bp, Homo sapiens
tgaaataaagacccaggggga

SEQ ID NO: 5009545 - DNA, 17 bp, Homo sapiens
tgaacctcattctggtt

SEQ ID NO: 5009546 - DNA, 15 bp, Homo sapiens
tgaagatgggagcct

SEQ ID NO: 5009547 - DNA, 14 bp, Homo sapiens
tgaagccaccctgg

SEQ ID NO: 5009548 - DNA, 16 bp, Homo sapiens
tgaagctgttgtgtga

SEQ ID NO: 5009549 - DNA, 19 bp, Homo sapiens
tgaagctgttgtgtgaggt

SEQ ID NO: 5009550 - DNA, 13 bp, Homo sapiens
tgaatcaaaacaa

SEQ ID NO: 5009551 - DNA, 16 bp, Homo sapiens
tgaattggaaagactt

SEQ ID NO: 5009552 - DNA, 19 bp, Homo sapiens
tgacaaccgagaaggttta

SEQ ID NO: 5009553 - DNA, 17 bp, Homo sapiens
tgacagtttttctgttt

SEQ ID NO: 5009554 - DNA, 15 bp, Homo sapiens
tgacatgaagctgtt

SEQ ID NO: 5009555 - DNA, 16 bp, Homo sapiens
tgacctgtttctctgc

SEQ ID NO: 5009556 - DNA, 14 bp, Homo sapiens
tgacgtctgaagct

SEQ ID NO: 5009557 - DNA, 23 bp, Homo sapiens
tgacgtgctccgtagctctgctg

SEQ ID NO: 5009558 - DNA, 18 bp, Homo sapiens
tgacttaaaaaatcagaa

SEQ ID NO: 5009559 - DNA, 22 bp, Homo sapiens
tgacttcagggaaggtgaaaca

SEQ ID NO: 5009560 - DNA, 16 bp, Homo sapiens
tgagactcagtgcaga

SEQ ID NO: 5009561 - DNA, 21 bp, Homo sapiens
tgagactctagggtccagtgg

SEQ ID NO: 5009562 - DNA, 15 bp, Homo sapiens
tgagcctgcagggaa

SEQ ID NO: 5009563 - DNA, 17 bp, Homo sapiens
tgagcctgcagggaagc

SEQ ID NO: 5009564 - DNA, 14 bp, Homo sapiens
tgaggccctgccca

SEQ ID NO: 5009565 - DNA, 11 bp, Homo sapiens
tgatcagtgtt

SEQ ID NO: 5009566 - DNA, 15 bp, Homo sapiens
tgatcatcgccagag

SEQ ID NO: 5009567 - DNA, 16 bp, Homo sapiens
tgatcatcgccagagg

SEQ ID NO: 5009568 - DNA, 18 bp, Homo sapiens
tgatcatcgccagaggtg

SEQ ID NO: 5009569 - DNA, 15 bp, Homo sapiens
tgatgccgtgatcct

SEQ ID NO: 5009570 - DNA, 15 bp, Homo sapiens
tgatttagcaagcaa

SEQ ID NO: 5009571 - DNA, 22 bp, Homo sapiens
tgatttttaagaaagtaattta

SEQ ID NO: 5009572 - DNA, 20 bp, Homo sapiens
tgcaacggtctcctgactgg

SEQ ID NO: 5009573 - DNA, 21 bp, Homo sapiens
tgcaacggtctcctgactggt

SEQ ID NO: 5009574 - DNA, 22 bp, Homo sapiens
tgcaacggtctcctgactggtg

SEQ ID NO: 5009575 - DNA, 19 bp, Homo sapiens
tgcaactctaactctgaga

SEQ ID NO: 5009576 - DNA, 15 bp, Homo sapiens
tgcaagcagaggacc

SEQ ID NO: 5009577 - DNA, 17 bp, Homo sapiens
tgcaagcagaggaccag

SEQ ID NO: 5009578 - DNA, 14 bp, Homo sapiens
tgcacaacttttga

SEQ ID NO: 5009579 - DNA, 20 bp, Homo sapiens
tgcacaacttttgagagtat

SEQ ID NO: 5009580 - DNA, 18 bp, Homo sapiens
tgcacaccattttgtaaa

SEQ ID NO: 5009581 - DNA, 22 bp, Homo sapiens
tgcacatccgcgtgtgcctgtg

SEQ ID NO: 5009582 - DNA, 14 bp, Homo sapiens
tgcactgatgttgt

SEQ ID NO: 5009583 - DNA, 12 bp, Homo sapiens
tgcagaatgtaa

SEQ ID NO: 5009584 - DNA, 19 bp, Homo sapiens
tgcagaatgtaagtgggcc

SEQ ID NO: 5009585 - DNA, 21 bp, Homo sapiens
tgcagaatgtaagtgggccca

SEQ ID NO: 5009586 - DNA, 15 bp, Homo sapiens
tgcagaggtaccctg

SEQ ID NO: 5009587 - DNA, 17 bp, Homo sapiens
tgcagaggtaccctggg

SEQ ID NO: 5009588 - DNA, 15 bp, Homo sapiens
tgcagagttgaagtt

SEQ ID NO: 5009589 - DNA, 16 bp, Homo sapiens
tgcagagttgaagttt

SEQ ID NO: 5009590 - DNA, 21 bp, Homo sapiens
tgcagcaccgaggggcctttg

SEQ ID NO: 5009591 - DNA, 10 bp, Homo sapiens
tgcagggcca

SEQ ID NO: 5009592 - DNA, 19 bp, Homo sapiens
tgcagggccatggctcagg

SEQ ID NO: 5009593 - DNA, 18 bp, Homo sapiens
tgcagtttaagagcagaa

SEQ ID NO: 5009594 - DNA, 22 bp, Homo sapiens
tgcattatatcaaatctaccac

SEQ ID NO: 5009595 - DNA, 16 bp, Homo sapiens
tgcattctggatttta

SEQ ID NO: 5009596 - DNA, 14 bp, Homo sapiens
tgccaccatacctc

SEQ ID NO: 5009597 - DNA, 16 bp, Homo sapiens
tgccactcctccctcc

SEQ ID NO: 5009598 - DNA, 17 bp, Homo sapiens
tgccactcctccctccg

SEQ ID NO: 5009599 - DNA, 20 bp, Homo sapiens
tgcccaatgagactctaggg

SEQ ID NO: 5009600 - DNA, 12 bp, Homo sapiens
tgcccctctcac

SEQ ID NO: 5009601 - DNA, 15 bp, Homo sapiens
tgcccctctcaccaa

SEQ ID NO: 5009602 - DNA, 15 bp, Homo sapiens
tgccctcgcctcctc

SEQ ID NO: 5009603 - DNA, 16 bp, Homo sapiens
tgccctcgcctcctcc

SEQ ID NO: 5009604 - DNA, 21 bp, Homo sapiens
tgccctcgcctcctcctcctg

SEQ ID NO: 5009605 - DNA, 21 bp, Homo sapiens
tgcctccaggtgcagaggtac

SEQ ID NO: 5009606 - DNA, 23 bp, Homo sapiens
tgcctgcagggccatggctcagg

SEQ ID NO: 5009607 - DNA, 19 bp, Homo sapiens
tgcctggggtgttagtggc

SEQ ID NO: 5009608 - DNA, 13 bp, Homo sapiens
aaaaaatctatcc

SEQ ID NO: 5009609 - DNA, 14 bp, Homo sapiens
aaaaacttttgagg

SEQ ID NO: 5009610 - DNA, 16 bp, Homo sapiens
aaaaagaaacttttct

SEQ ID NO: 5009611 - DNA, 15 bp, Homo sapiens
aaaacttctgctcgt

SEQ ID NO: 5009612 - DNA, 17 bp, Homo sapiens
aaaagaaacttttctga

SEQ ID NO: 5009613 - DNA, 16 bp, Homo sapiens
aaaagaataaaaactt

SEQ ID NO: 5009614 - DNA, 17 bp, Homo sapiens
aaaagaataaaaacttt

SEQ ID NO: 5009615 - DNA, 23 bp, Homo sapiens
aaaagatattgttgttttccatg

SEQ ID NO: 5009616 - DNA, 15 bp, Homo sapiens
aaaagatgaaaaaga

SEQ ID NO: 5009617 - DNA, 13 bp, Homo sapiens
aaaatcagaacaa

SEQ ID NO: 5009618 - DNA, 21 bp, Homo sapiens
aaacgctacctctctgtccct

SEQ ID NO: 5009619 - DNA, 14 bp, Homo sapiens
aaacttctgctcgt

SEQ ID NO: 5009620 - DNA, 12 bp, Homo sapiens
aaagaaactttt

SEQ ID NO: 5009621 - DNA, 17 bp, Homo sapiens
aaagactcgagaaccaa

SEQ ID NO: 5009622 - DNA, 23 bp, Homo sapiens
aaagacttctcaaagagaattgt

SEQ ID NO: 5009623 - DNA, 20 bp, Homo sapiens
aaagaggctgcccctctcac

SEQ ID NO: 5009624 - DNA, 19 bp, Homo sapiens
aaagatgaaaaagaataaa

SEQ ID NO: 5009625 - DNA, 11 bp, Homo sapiens
aaagtttttta

SEQ ID NO: 5009626 - DNA, 14 bp, Homo sapiens
aaataaactgttgc

SEQ ID NO: 5009627 - DNA, 17 bp, Homo sapiens
aaataaactttttttag

SEQ ID NO: 5009628 - DNA, 15 bp, Homo sapiens
aaatagatgctgtgt

SEQ ID NO: 5009629 - DNA, 19 bp, Homo sapiens
aaatcagaacaaaacttct

SEQ ID NO: 5009630 - DNA, 13 bp, Homo sapiens
aaattaagacttt

SEQ ID NO: 5009631 - DNA, 23 bp, Homo sapiens
aacacccccataacaattccccc

SEQ ID NO: 5009632 - DNA, 16 bp, Homo sapiens
aacactgaaatgaaat

SEQ ID NO: 5009633 - DNA, 20 bp, Homo sapiens
aacattctgtgggatatatt

SEQ ID NO: 5009634 - DNA, 13 bp, Homo sapiens
aacccttctctgt

SEQ ID NO: 5009635 - DNA, 15 bp, Homo sapiens
aacccttctctgttg

SEQ ID NO: 5009636 - DNA, 14 bp, Homo sapiens
aacctcattctggt

SEQ ID NO: 5009637 - DNA, 15 bp, Homo sapiens
aacctgtcctaagga

SEQ ID NO: 5009638 - DNA, 15 bp, Homo sapiens
aacgctacctctctg

SEQ ID NO: 5009639 - DNA, 19 bp, Homo sapiens
aacggaggcctgcgaccct

SEQ ID NO: 5009640 - DNA, 23 bp, Homo sapiens
aactcctgacgtctgaagcttga

SEQ ID NO: 5009641 - DNA, 17 bp, Homo sapiens
aactggacctgtatatt

SEQ ID NO: 5009642 - DNA, 15 bp, Homo sapiens
aacttaagaattgaa

SEQ ID NO: 5009643 - DNA, 16 bp, Homo sapiens
aacttcacaactaggc

SEQ ID NO: 5009644 - DNA, 11 bp, Homo sapiens
aacttctgctc

SEQ ID NO: 5009645 - DNA, 14 bp, Homo sapiens
aacttttaatttaa

SEQ ID NO: 5009646 - DNA, 22 bp, Homo sapiens
aagaaaagtgcatatttatcca

SEQ ID NO: 5009647 - DNA, 19 bp, Homo sapiens
aagaaagtaatttaatttg

SEQ ID NO: 5009648 - DNA, 20 bp, Homo sapiens
aagaatttggggcaggaaat

SEQ ID NO: 5009649 - DNA, 13 bp, Homo sapiens
aagcaactaattt

SEQ ID NO: 5009650 - DNA, 19 bp, Homo sapiens
aagcagaaaataaaggaag

SEQ ID NO: 5009651 - DNA, 18 bp, Homo sapiens
aagcagaggaccagggcc

SEQ ID NO: 5009652 - DNA, 19 bp, Homo sapiens
aagcagaggaccagggcct

SEQ ID NO: 5009653 - DNA, 16 bp, Homo sapiens
aagccccacatgtcca

SEQ ID NO: 5009654 - DNA, 23 bp, Homo sapiens
aagcccgaccgggccaggcctgg

SEQ ID NO: 5009655 - DNA, 21 bp, Homo sapiens
aagcggccctaagggagtgtc

SEQ ID NO: 5009656 - DNA, 17 bp, Homo sapiens
aagctatttatgggccc

SEQ ID NO: 5009657 - DNA, 13 bp, Homo sapiens
aagctggcctgag

SEQ ID NO: 5009658 - DNA, 12 bp, Homo sapiens
aagcttgactcc

SEQ ID NO: 5009659 - DNA, 17 bp, Homo sapiens
aaggaacagcaatggtg

SEQ ID NO: 5009660 - DNA, 22 bp, Homo sapiens
aaggatcaacaacatccactgt

SEQ ID NO: 5009661 - DNA, 16 bp, Homo sapiens
aaggggagaagggaat

SEQ ID NO: 5009662 - DNA, 23 bp, Homo sapiens
aaggtcacaacccttctctgttg

SEQ ID NO: 5009663 - DNA, 12 bp, Homo sapiens
aaggtgaaacag

SEQ ID NO: 5009664 - DNA, 12 bp, Homo sapiens
aagtaatttaat

SEQ ID NO: 5009665 - DNA, 20 bp, Homo sapiens
aagtccctataataaaggct

SEQ ID NO: 5009666 - DNA, 14 bp, Homo sapiens
aagtgcagctcatg

SEQ ID NO: 5009667 - DNA, 17 bp, Homo sapiens
aagtgcagctcatgttt

SEQ ID NO: 5009668 - DNA, 23 bp, Homo sapiens
aagttagtgcttgttctaagatt

SEQ ID NO: 5009669 - DNA, 16 bp, Homo sapiens
aataaaaacttttgag

SEQ ID NO: 5009670 - DNA, 21 bp, Homo sapiens
aatatgtgagtgccttttgca

SEQ ID NO: 5009671 - DNA, 16 bp, Homo sapiens
aatcagaacaaaactt

SEQ ID NO: 5009672 - DNA, 24 bp, Homo sapiens
aatcatcggagtcagccaggagct

SEQ ID NO: 5009673 - DNA, 12 bp, Homo sapiens
aatgaaatcttc

SEQ ID NO: 5009674 - DNA, 19 bp, Homo sapiens
aatgagactctagggtcca

SEQ ID NO: 5009675 - DNA, 15 bp, Homo sapiens
aatgtaagtgggccc

SEQ ID NO: 5009676 - DNA, 17 bp, Homo sapiens
agggtctgtttggactg

SEQ ID NO: 5009677 - DNA, 20 bp, Homo sapiens
agggttacagagacctatgt

SEQ ID NO: 5009678 - DNA, 20 bp, Homo sapiens
aggtaccctgggtgtccccg

SEQ ID NO: 5009679 - DNA, 22 bp, Homo sapiens
aggtcacaacccttctctgttg

SEQ ID NO: 5009680 - DNA, 18 bp, Homo sapiens
aggtgaggagcagagcag

SEQ ID NO: 5009681 - DNA, 21 bp, Homo sapiens
aggtgcagaggtaccctgggt

SEQ ID NO: 5009682 - DNA, 16 bp, Homo sapiens
aggttccgatgttatt

SEQ ID NO: 5009683 - DNA, 13 bp, Homo sapiens
agtaccttgcttc

SEQ ID NO: 5009684 - DNA, 13 bp, Homo sapiens
agtactttgtgca

SEQ ID NO: 5009685 - DNA, 23 bp, Homo sapiens
agtatccaggctttgtacagagt

SEQ ID NO: 5009686 - DNA, 18 bp, Homo sapiens
agtccctataataaaggc

SEQ ID NO: 5009687 - DNA, 21 bp, Homo sapiens
agtccctataataaaggctga

SEQ ID NO: 5009688 - DNA, 15 bp, Homo sapiens
agtccgcagaagccc

SEQ ID NO: 5009689 - DNA, 16 bp, Homo sapiens
agtctagcattctgca

SEQ ID NO: 5009690 - DNA, 16 bp, Homo sapiens
agtctgaatgctgcca

SEQ ID NO: 5009691 - DNA, 17 bp, Homo sapiens
agtcttcccagcaatta

SEQ ID NO: 5009692 - DNA, 16 bp, Homo sapiens
agtgcatggtggccag

SEQ ID NO: 5009693 - DNA, 17 bp, Homo sapiens
agtgcatggtggccaga

SEQ ID NO: 5009694 - DNA, 20 bp, Homo sapiens
agtgccttttgcagaagagg

SEQ ID NO: 5009695 - DNA, 13 bp, Homo sapiens
agtggttcaaatt

SEQ ID NO: 5009696 - DNA, 20 bp, Homo sapiens
agtgtgccagtttaaaaaga

SEQ ID NO: 5009697 - DNA, 22 bp, Homo sapiens
agtgtgccagtttaaaaagatg

SEQ ID NO: 5009698 - DNA, 15 bp, Homo sapiens
agtgtggggggtcct

SEQ ID NO: 5009699 - DNA, 18 bp, Homo sapiens
agtgttttggactccatc

SEQ ID NO: 5009700 - DNA, 23 bp, Homo sapiens
agtgttttggactccatctctca

SEQ ID NO: 5009701 - DNA, 18 bp, Homo sapiens
agttgaaaatgcaactct

SEQ ID NO: 5009702 - DNA, 23 bp, Homo sapiens
agttttgttttaaaactggacct

SEQ ID NO: 5009703 - DNA, 16 bp, Homo sapiens
ataaactttttttaga

SEQ ID NO: 5009704 - DNA, 20 bp, Homo sapiens
ataacatatatggaagagga

SEQ ID NO: 5009705 - DNA, 16 bp, Homo sapiens
ataagtaaagacagct

SEQ ID NO: 5009706 - DNA, 14 bp, Homo sapiens
ataatgttttggga

SEQ ID NO: 5009707 - DNA, 13 bp, Homo sapiens
atacatatatata

SEQ ID NO: 5009708 - DNA, 17 bp, Homo sapiens
atactgggtctgcgatg

SEQ ID NO: 5009709 - DNA, 16 bp, Homo sapiens
atactttgccactgct

SEQ ID NO: 5009710 - DNA, 18 bp, Homo sapiens
atactttgccactgctgt

SEQ ID NO: 5009711 - DNA, 13 bp, Homo sapiens
atataacatatat

SEQ ID NO: 5009712 - DNA, 14 bp, Homo sapiens
atatactttgccac

SEQ ID NO: 5009713 - DNA, 14 bp, Homo sapiens
atatagactgttga

SEQ ID NO: 5009714 - DNA, 14 bp, Homo sapiens
atatatacatatat

SEQ ID NO: 5009715 - DNA, 21 bp, Homo sapiens
atatatatctatatatataat

SEQ ID NO: 5009716 - DNA, 19 bp, Homo sapiens
atatatgcactatgtatat

SEQ ID NO: 5009717 - DNA, 15 bp, Homo sapiens
atatatggaagagga

SEQ ID NO: 5009718 - DNA, 13 bp, Homo sapiens
atatcatatgtat

SEQ ID NO: 5009719 - DNA, 18 bp, Homo sapiens
atatctatatatataatt

SEQ ID NO: 5009720 - DNA, 18 bp, Homo sapiens
atatggtatatatacata

SEQ ID NO: 5009721 - DNA, 19 bp, Homo sapiens
atatggtatatatacatat

SEQ ID NO: 5009722 - DNA, 21 bp, Homo sapiens
atatgttgtaatatttcttca

SEQ ID NO: 5009723 - DNA, 16 bp, Homo sapiens
atatttgtaaagctat

SEQ ID NO: 5009724 - DNA, 20 bp, Homo sapiens
atcaaatctaccactgtatg

SEQ ID NO: 5009725 - DNA, 18 bp, Homo sapiens
atcagaacaaaacttcta

SEQ ID NO: 5009726 - DNA, 21 bp, Homo sapiens
atcagtgttgttgctctagga

SEQ ID NO: 5009727 - DNA, 22 bp, Homo sapiens
atcatcgccagaggtgcttcac

SEQ ID NO: 5009728 - DNA, 22 bp, Homo sapiens
atcattccctctcatctcaggt

SEQ ID NO: 5009729 - DNA, 21 bp, Homo sapiens
atccagagtcatgggagagta

SEQ ID NO: 5009730 - DNA, 15 bp, Homo sapiens
atccgcgtgtgcctg

SEQ ID NO: 5009731 - DNA, 13 bp, Homo sapiens
atcctcctccagg

SEQ ID NO: 5009732 - DNA, 22 bp, Homo sapiens
atcctgcagatactttgaagtg

SEQ ID NO: 5009733 - DNA, 16 bp, Homo sapiens
atcctggagaagcctc

SEQ ID NO: 5009734 - DNA, 17 bp, Homo sapiens
atccttccctttggaga

SEQ ID NO: 5009735 - DNA, 19 bp, Homo sapiens
atcgccagaggtgcttcac

SEQ ID NO: 5009736 - DNA, 20 bp, Homo sapiens
atcgccagaggtgcttcacc

SEQ ID NO: 5009737 - DNA, 15 bp, Homo sapiens
atcgtacctattgca

SEQ ID NO: 5009738 - DNA, 21 bp, Homo sapiens
atctctcatcctccagtacct

SEQ ID NO: 5009739 - DNA, 16 bp, Homo sapiens
atcttgtatacacata

SEQ ID NO: 5009740 - DNA, 15 bp, Homo sapiens
atgaaacttaagaat

SEQ ID NO: 5009741 - DNA, 16 bp, Homo sapiens
atgaaacttaagaatt

SEQ ID NO: 5009742 - DNA, 22 bp, Homo sapiens
atgaaacttaagaattgaattg

SEQ ID NO: 5009743 - DNA, 21 bp, Homo sapiens
ctaagacacctgaaccctcca

SEQ ID NO: 5009744 - DNA, 14 bp, Homo sapiens
ctaaggaaccttcc

SEQ ID NO: 5009745 - DNA, 23 bp, Homo sapiens
ctaagtccctataataaaggctg

SEQ ID NO: 5009746 - DNA, 20 bp, Homo sapiens
ctaatatacttgtaaaacca

SEQ ID NO: 5009747 - DNA, 18 bp, Homo sapiens
ctaattggaaggagaggg

SEQ ID NO: 5009748 - DNA, 12 bp, Homo sapiens
ctacaaccaatt

SEQ ID NO: 5009749 - DNA, 13 bp, Homo sapiens
ctacctctctgtc

SEQ ID NO: 5009750 - DNA, 16 bp, Homo sapiens
ctacctctctgtccct

SEQ ID NO: 5009751 - DNA, 18 bp, Homo sapiens
ctagagccctctcctccc

SEQ ID NO: 5009752 - DNA, 20 bp, Homo sapiens
ctagagccctctcctccctc

SEQ ID NO: 5009753 - DNA, 19 bp, Homo sapiens
ctagcagcccaccctgctg

SEQ ID NO: 5009754 - DNA, 20 bp, Homo sapiens
ctagcagcccaccctgctgc

SEQ ID NO: 5009755 - DNA, 18 bp, Homo sapiens
ctagtttcttacacactg

SEQ ID NO: 5009756 - DNA, 19 bp, Homo sapiens
ctagtttcttacacactgt

SEQ ID NO: 5009757 - DNA, 18 bp, Homo sapiens
ctatattgattgtccttt

SEQ ID NO: 5009758 - DNA, 21 bp, Homo sapiens
ctatgtaagaattcagaagac

SEQ ID NO: 5009759 - DNA, 14 bp, Homo sapiens
ctatgtatatacat

SEQ ID NO: 5009760 - DNA, 15 bp, Homo sapiens
ctatttatttgaggt

SEQ ID NO: 5009761 - DNA, 21 bp, Homo sapiens
ctcacccatgcaagcagagga

SEQ ID NO: 5009762 - DNA, 22 bp, Homo sapiens
ctcacccatgcaagcagaggac

SEQ ID NO: 5009763 - DNA, 12 bp, Homo sapiens
ctcaccccactc

SEQ ID NO: 5009764 - DNA, 14 bp, Homo sapiens
ctcaccccactcct

SEQ ID NO: 5009765 - DNA, 17 bp, Homo sapiens
ctcaccccactcctgtc

SEQ ID NO: 5009766 - DNA, 20 bp, Homo sapiens
ctcagcttatctcttttata

SEQ ID NO: 5009767 - DNA, 23 bp, Homo sapiens
ctcagggagcagggaaggcctga

SEQ ID NO: 5009768 - DNA, 15 bp, Homo sapiens
ctcagggtggtctct

SEQ ID NO: 5009769 - DNA, 17 bp, Homo sapiens
ctcaggtagaaggttga

SEQ ID NO: 5009770 - DNA, 23 bp, Homo sapiens
ctcaggtagaaggttgacacagt

SEQ ID NO: 5009771 - DNA, 11 bp, Homo sapiens
ctcagtgcaga

SEQ ID NO: 5009772 - DNA, 22 bp, Homo sapiens
ctcagtgttttggactccatct

SEQ ID NO: 5009773 - DNA, 14 bp, Homo sapiens
ctcatcatttgtgg

SEQ ID NO: 5009774 - DNA, 22 bp, Homo sapiens
ctcatcctccagtaccttgctt

SEQ ID NO: 5009775 - DNA, 12 bp, Homo sapiens
ctcatgcctgta

SEQ ID NO: 5009776 - DNA, 14 bp, Homo sapiens
ctcatgtttttaac

SEQ ID NO: 5009777 - DNA, 19 bp, Homo sapiens
ctccaggaagcccagggca

SEQ ID NO: 5009778 - DNA, 15 bp, Homo sapiens
ctccaggctttccca

SEQ ID NO: 5009779 - DNA, 14 bp, Homo sapiens
ctccaggtgcagag

SEQ ID NO: 5009780 - DNA, 19 bp, Homo sapiens
ctccatctctcatcctcca

SEQ ID NO: 5009781 - DNA, 21 bp, Homo sapiens
ctccatctctcatcctccagt

SEQ ID NO: 5009782 - DNA, 18 bp, Homo sapiens
ctccattattcctctcac

SEQ ID NO: 5009783 - DNA, 22 bp, Homo sapiens
ctcccacacccaaagctgagcc

SEQ ID NO: 5009784 - DNA, 17 bp, Homo sapiens
ctcccaggatgacgtgc

SEQ ID NO: 5009785 - DNA, 17 bp, Homo sapiens
ctccccagcccacctgc

SEQ ID NO: 5009786 - DNA, 17 bp, Homo sapiens
ctccctctgtccctctc

SEQ ID NO: 5009787 - DNA, 14 bp, Homo sapiens
ctcccttggtgccc

SEQ ID NO: 5009788 - DNA, 17 bp, Homo sapiens
ctccgtagctctgctgc

SEQ ID NO: 5009789 - DNA, 21 bp, Homo sapiens
ctccgtagctctgctgctgat

SEQ ID NO: 5009790 - DNA, 21 bp, Homo sapiens
ctcctccagggtgattttatg

SEQ ID NO: 5009791 - DNA, 13 bp, Homo sapiens
ctcctcctcctgc

SEQ ID NO: 5009792 - DNA, 15 bp, Homo sapiens
ctcctcctcctgccc

SEQ ID NO: 5009793 - DNA, 11 bp, Homo sapiens
ctcctcctgcc

SEQ ID NO: 5009794 - DNA, 15 bp, Homo sapiens
ctcctctcagtgttt

SEQ ID NO: 5009795 - DNA, 15 bp, Homo sapiens
ctcctgactggtgct

SEQ ID NO: 5009796 - DNA, 14 bp, Homo sapiens
ctcctgccctcctc

SEQ ID NO: 5009797 - DNA, 18 bp, Homo sapiens
ctcctgccctcctctccc

SEQ ID NO: 5009798 - DNA, 19 bp, Homo sapiens
ctccttgcccccagtgcct

SEQ ID NO: 5009799 - DNA, 22 bp, Homo sapiens
ctcgagaaccaaccagggaagc

SEQ ID NO: 5009800 - DNA, 18 bp, Homo sapiens
ctcgtttacactgcacat

SEQ ID NO: 5009801 - DNA, 21 bp, Homo sapiens
ctctaggaagacatttttccg

SEQ ID NO: 5009802 - DNA, 17 bp, Homo sapiens
ctctcaccccactcctg

SEQ ID NO: 5009803 - DNA, 19 bp, Homo sapiens
ctctcaccccactcctgtc

SEQ ID NO: 5009804 - DNA, 20 bp, Homo sapiens
ctctcaccccactcctgtca

SEQ ID NO: 5009805 - DNA, 21 bp, Homo sapiens
ctctgacaactgtgaagccac

SEQ ID NO: 5009806 - DNA, 22 bp, Homo sapiens
ctctgcctttgcaccacgggac

SEQ ID NO: 5009807 - DNA, 14 bp, Homo sapiens
ctctgggtgctgcc

SEQ ID NO: 5009808 - DNA, 23 bp, Homo sapiens
ctctgttggtctgccttctgctg

SEQ ID NO: 5009809 - DNA, 21 bp, Homo sapiens
ctcttctggggcaggctgggc

SEQ ID NO: 5009810 - DNA, 16 bp, Homo sapiens
ctcttcttggggccca

SEQ ID NO: 5009811 - DNA, 17 bp, Homo sapiens
ctgaaatgaaatcttcc

SEQ ID NO: 5009812 - DNA, 15 bp, Homo sapiens
ctgaagatgggagcc

SEQ ID NO: 5009813 - DNA, 21 bp, Homo sapiens
ctgaagcttgactcccaagtt

SEQ ID NO: 5009814 - DNA, 23 bp, Homo sapiens
ctgacatgaagctgttgtgtgag

SEQ ID NO: 5009815 - DNA, 21 bp, Homo sapiens
ctgacattttctttcatgggc

SEQ ID NO: 5009816 - DNA, 23 bp, Homo sapiens
ctgacgtctgaagcttgactccc

SEQ ID NO: 5009817 - DNA, 23 bp, Homo sapiens
ctgagacgccacggagggctggg

SEQ ID NO: 5009818 - DNA, 23 bp, Homo sapiens
ctgagagctgtttttgacagcct

SEQ ID NO: 5009819 - DNA, 14 bp, Homo sapiens
ctgagaggggaagc

SEQ ID NO: 5009820 - DNA, 14 bp, Homo sapiens
ctgagcctgcaggg

SEQ ID NO: 5009821 - DNA, 23 bp, Homo sapiens
ctgattttattcaatatggttac

SEQ ID NO: 5009822 - DNA, 14 bp, Homo sapiens
ctgcaacatttata

SEQ ID NO: 5009823 - DNA, 19 bp, Homo sapiens
ctgcagcaccgaggggcct

SEQ ID NO: 5009824 - DNA, 20 bp, Homo sapiens
ctgcagggccatggctcagg

SEQ ID NO: 5009825 - DNA, 21 bp, Homo sapiens
ctgcagggccatggctcaggg

SEQ ID NO: 5009826 - DNA, 14 bp, Homo sapiens
ctgccatgccagga

SEQ ID NO: 5009827 - DNA, 15 bp, Homo sapiens
ctgccctcctctccc

SEQ ID NO: 5009828 - DNA, 13 bp, Homo sapiens
ctgccgctacctc

SEQ ID NO: 5009829 - DNA, 17 bp, Homo sapiens
ctgccgctacctccctc

SEQ ID NO: 5009830 - DNA, 18 bp, Homo sapiens
ctgccgctacctccctcc

SEQ ID NO: 5009831 - DNA, 13 bp, Homo sapiens
ctgccttctgctg

SEQ ID NO: 5009832 - DNA, 15 bp, Homo sapiens
ctgccttctgctgaa

SEQ ID NO: 5009833 - DNA, 14 bp, Homo sapiens
ctgcctttgcacca

SEQ ID NO: 5009834 - DNA, 14 bp, Homo sapiens
ctgcgaccctgggg

SEQ ID NO: 5009835 - DNA, 15 bp, Homo sapiens
ctgcgaccctggggg

SEQ ID NO: 5009836 - DNA, 18 bp, Homo sapiens
ctgctacctttcaaagct

SEQ ID NO: 5009837 - DNA, 14 bp, Homo sapiens
ctgctcccaggccc

SEQ ID NO: 5009838 - DNA, 15 bp, Homo sapiens
ctgctggtgcacagc

SEQ ID NO: 5009839 - DNA, 15 bp, Homo sapiens
ctgctgtatttttat

SEQ ID NO: 5009840 - DNA, 20 bp, Homo sapiens
ctgctgtatttttatttttg

SEQ ID NO: 5009841 - DNA, 22 bp, Homo sapiens
ctgctgtatttttatttttgca

SEQ ID NO: 5009842 - DNA, 14 bp, Homo sapiens
ctgctgtgcaacgg

SEQ ID NO: 5009843 - DNA, 16 bp, Homo sapiens
ctggacctgtatattt

SEQ ID NO: 5009844 - DNA, 12 bp, Homo sapiens
ctggatgaaaga

SEQ ID NO: 5009845 - DNA, 17 bp, Homo sapiens
ctggatgaaagagccag

SEQ ID NO: 5009846 - DNA, 21 bp, Homo sapiens
ctggccggggctctgggtgct

SEQ ID NO: 5009847 - DNA, 14 bp, Homo sapiens
ctgggcagcagcat

SEQ ID NO: 5009848 - DNA, 16 bp, Homo sapiens
ctgggcagctgtccct

SEQ ID NO: 5009849 - DNA, 17 bp, Homo sapiens
ctgggccatgtccaaag

SEQ ID NO: 5009850 - DNA, 18 bp, Homo sapiens
ctgggccatgtccaaaga

SEQ ID NO: 5009851 - DNA, 23 bp, Homo sapiens
ctgggccatgtccaaagaggctg

SEQ ID NO: 5009852 - DNA, 22 bp, Homo sapiens
ctgggccctgagtctgggcagc

SEQ ID NO: 5009853 - DNA, 12 bp, Homo sapiens
ctggggatgcgc

SEQ ID NO: 5009854 - DNA, 12 bp, Homo sapiens
ctggggcaggct

SEQ ID NO: 5009855 - DNA, 17 bp, Homo sapiens
ctggggcaggctgggcc

SEQ ID NO: 5009856 - DNA, 19 bp, Homo sapiens
ctgggggcacaggaggcag

SEQ ID NO: 5009857 - DNA, 14 bp, Homo sapiens
ctggggggacccag

SEQ ID NO: 5009858 - DNA, 16 bp, Homo sapiens
ctggggggacccagtg

SEQ ID NO: 5009859 - DNA, 19 bp, Homo sapiens
ctggggggacccagtgcag

SEQ ID NO: 5009860 - DNA, 17 bp, Homo sapiens
ctgggtgatctgctgct

SEQ ID NO: 5009861 - DNA, 21 bp, Homo sapiens
ctgggtgtccccgctgctgtg

SEQ ID NO: 5009862 - DNA, 16 bp, Homo sapiens
ctggtacaacggaggc

SEQ ID NO: 5009863 - DNA, 18 bp, Homo sapiens
ctggtacaacggaggcct

SEQ ID NO: 5009864 - DNA, 19 bp, Homo sapiens
ctggtacaacggaggcctg

SEQ ID NO: 5009865 - DNA, 17 bp, Homo sapiens
ctggtgctgcagcaccg

SEQ ID NO: 5009866 - DNA, 18 bp, Homo sapiens
ctggttccctgctgcgct

SEQ ID NO: 5009867 - DNA, 22 bp, Homo sapiens
ctggttccctgctgcgctgctt

SEQ ID NO: 5009868 - DNA, 19 bp, Homo sapiens
ctggttggagaaggtcaca

SEQ ID NO: 5009869 - DNA, 19 bp, Homo sapiens
ctgtaatcccagcactttg

SEQ ID NO: 5009870 - DNA, 12 bp, Homo sapiens
ctgtatgattta

SEQ ID NO: 5009871 - DNA, 16 bp, Homo sapiens
ctgtatgctgatcatc

SEQ ID NO: 5009872 - DNA, 21 bp, Homo sapiens
ctgtatttttatttttgcaca

SEQ ID NO: 5009873 - DNA, 11 bp, Homo sapiens
ctgtccctctc

SEQ ID NO: 5009874 - DNA, 17 bp, Homo sapiens
ctgtccctctccttgcc

SEQ ID NO: 5009875 - DNA, 18 bp, Homo sapiens
ctgtccctctccttgccc

SEQ ID NO: 5009876 - DNA, 14 bp, Homo sapiens
ctgtcccttgctgt

SEQ ID NO: 5009877 - DNA, 18 bp, Homo sapiens
ctgtcccttgctgtatgc

SEQ ID NO: 5009878 - DNA, 23 bp, Homo sapiens
ctgtcccttgcttgcctgcaggg

SEQ ID NO: 5009879 - DNA, 13 bp, Homo sapiens
ctgtcctggaggt

SEQ ID NO: 5009880 - DNA, 19 bp, Homo sapiens
ctgtctgtatagtgtctgt

SEQ ID NO: 5009881 - DNA, 13 bp, Homo sapiens
ctgtgaagccacc

SEQ ID NO: 5009882 - DNA, 20 bp, Homo sapiens
ctgtgaagccaccctgggct

SEQ ID NO: 5009883 - DNA, 9 bp, Homo sapiens
ctgtgtgca

SEQ ID NO: 5009884 - DNA, 20 bp, Homo sapiens
tgtagtttttatatgttgta

SEQ ID NO: 5009885 - DNA, 21 bp, Homo sapiens
tgtatatggtatatatacata

SEQ ID NO: 5009886 - DNA, 16 bp, Homo sapiens
tgtatatttgtaaagc

SEQ ID NO: 5009887 - DNA, 22 bp, Homo sapiens
tgtatatttgtaaagctattta

SEQ ID NO: 5009888 - DNA, 14 bp, Homo sapiens
tgtatgctgatcat

SEQ ID NO: 5009889 - DNA, 13 bp, Homo sapiens
tgtatggggaggc

SEQ ID NO: 5009890 - DNA, 19 bp, Homo sapiens
tgtatgtaacgatgttgta

SEQ ID NO: 5009891 - DNA, 21 bp, Homo sapiens
tgtatttctccatcctgcaga

SEQ ID NO: 5009892 - DNA, 18 bp, Homo sapiens
tgtatttttatttttgca

SEQ ID NO: 5009893 - DNA, 16 bp, Homo sapiens
tgtcacaccctgactt

SEQ ID NO: 5009894 - DNA, 15 bp, Homo sapiens
tgtcaccaaggaaac

SEQ ID NO: 5009895 - DNA, 23 bp, Homo sapiens
tgtcacccaaaccggcaggtgcg

SEQ ID NO: 5009896 - DNA, 22 bp, Homo sapiens
tgtcatgcttcatcattccctc

SEQ ID NO: 5009897 - DNA, 18 bp, Homo sapiens
tgtccccgctgctgtgca

SEQ ID NO: 5009898 - DNA, 15 bp, Homo sapiens
tgtccctgaaaccta

SEQ ID NO: 5009899 - DNA, 23 bp, Homo sapiens
tgtcctcagggagcagggaaggc

SEQ ID NO: 5009900 - DNA, 19 bp, Homo sapiens
tgtcctttaaaaaagaaaa

SEQ ID NO: 5009901 - DNA, 20 bp, Homo sapiens
tgtctgaggtgacttaaaaa

SEQ ID NO: 5009902 - DNA, 12 bp, Homo sapiens
tgtgaagccacc

SEQ ID NO: 5009903 - DNA, 17 bp, Homo sapiens
tgtgagtgccttttgca

SEQ ID NO: 5009904 - DNA, 21 bp, Homo sapiens
tgtgcaacggtctcctgactg

SEQ ID NO: 5009905 - DNA, 19 bp, Homo sapiens
tgtgcagtactttgtgcat

SEQ ID NO: 5009906 - DNA, 12 bp, Homo sapiens
tgtgcctggggt

SEQ ID NO: 5009907 - DNA, 17 bp, Homo sapiens
tgtggattctgaggccc

SEQ ID NO: 5009908 - DNA, 19 bp, Homo sapiens
tgtggcagtcccttataat

SEQ ID NO: 5009909 - DNA, 19 bp, Homo sapiens
tgtggtacatggtgtttgt

SEQ ID NO: 5009910 - DNA, 21 bp, Homo sapiens
tgtgtatttaaaaaaaagaaa

SEQ ID NO: 5009911 - DNA, 16 bp, Homo sapiens
tgtgtatttcttatac

SEQ ID NO: 5009912 - DNA, 14 bp, Homo sapiens
tgtgtcccaggcag

SEQ ID NO: 5009913 - DNA, 13 bp, Homo sapiens
tgtgtgtgcgtgt

SEQ ID NO: 5009914 - DNA, 16 bp, Homo sapiens
tgtgtgtgtgtgtgcg

SEQ ID NO: 5009915 - DNA, 16 bp, Homo sapiens
tgtgtttgaaatcatc

SEQ ID NO: 5009916 - DNA, 14 bp, Homo sapiens
tgttagtggcaccg

SEQ ID NO: 5009917 - DNA, 16 bp, Homo sapiens
tgttcaaaaagatatt

SEQ ID NO: 5009918 - DNA, 18 bp, Homo sapiens
tgttccaatgtcaatgtg

SEQ ID NO: 5009919 - DNA, 23 bp, Homo sapiens
tgttctggggggacccagtgcag

SEQ ID NO: 5009920 - DNA, 23 bp, Homo sapiens
tgttttccatgatttagcaagca

SEQ ID NO: 5009921 - DNA, 13 bp, Homo sapiens
ttaaaaaaaagaa

SEQ ID NO: 5009922 - DNA, 14 bp, Homo sapiens
ttaaaaaatcagaa

SEQ ID NO: 5009923 - DNA, 14 bp, Homo sapiens
ttaaaactggacct

SEQ ID NO: 5009924 - DNA, 17 bp, Homo sapiens
ttaacttttaatttaaa

SEQ ID NO: 5009925 - DNA, 15 bp, Homo sapiens
ttaagaaagtaattt

SEQ ID NO: 5009926 - DNA, 18 bp, Homo sapiens
ttaagaaagtaatttaat

SEQ ID NO: 5009927 - DNA, 18 bp, Homo sapiens
ttaatttgtaaaacttct

SEQ ID NO: 5009928 - DNA, 20 bp, Homo sapiens
ttaatttgtaaaacttctgc

SEQ ID NO: 5009929 - DNA, 17 bp, Homo sapiens
ttacaagtttatatata

SEQ ID NO: 5009930 - DNA, 14 bp, Homo sapiens
ttactgataatttt

SEQ ID NO: 5009931 - DNA, 14 bp, Homo sapiens
ttactgggccctga

SEQ ID NO: 5009932 - DNA, 14 bp, Homo sapiens
ttactgtcaaaata

SEQ ID NO: 5009933 - DNA, 11 bp, Homo sapiens
ttagcaagcaa

SEQ ID NO: 5009934 - DNA, 16 bp, Homo sapiens
ttagcaagcaactaat

SEQ ID NO: 5009935 - DNA, 23 bp, Homo sapiens
ttagcaagcaactaattttctcc

SEQ ID NO: 5009936 - DNA, 14 bp, Homo sapiens
ttagctcttcccac

SEQ ID NO: 5009937 - DNA, 21 bp, Homo sapiens
ttataaacagacaatatgtga

SEQ ID NO: 5009938 - DNA, 14 bp, Homo sapiens
ttatacgcttttct

SEQ ID NO: 5009939 - DNA, 15 bp, Homo sapiens
ttatatcatatgtat

SEQ ID NO: 5009940 - DNA, 16 bp, Homo sapiens
ttatatcatatgtata

SEQ ID NO: 5009941 - DNA, 18 bp, Homo sapiens
ttatccaaaatgtgtatt

SEQ ID NO: 5009942 - DNA, 22 bp, Homo sapiens
ttatccaaaatgtgtatttctt

SEQ ID NO: 5009943 - DNA, 21 bp, Homo sapiens
ttatgtagtttttatatgttg

SEQ ID NO: 5009944 - DNA, 14 bp, Homo sapiens
ttattatgcattat

SEQ ID NO: 5009945 - DNA, 17 bp, Homo sapiens
ttatttcctttgtcctt

SEQ ID NO: 5009946 - DNA, 17 bp, Homo sapiens
ttatttgaggtcagtgt

SEQ ID NO: 5009947 - DNA, 19 bp, Homo sapiens
ttatttgaggtcagtgttt

SEQ ID NO: 5009948 - DNA, 22 bp, Homo sapiens
ttatttttgcacaacttttgag

SEQ ID NO: 5009949 - DNA, 19 bp, Homo sapiens
ttcagggaaggtgaaacag

SEQ ID NO: 5009950 - DNA, 22 bp, Homo sapiens
ttcagttggttcgttctgtact

SEQ ID NO: 5009951 - DNA, 19 bp, Homo sapiens
ttcatcattccctctcatc

SEQ ID NO: 5009952 - DNA, 15 bp, Homo sapiens
ttccaggggaacctg

SEQ ID NO: 5009953 - DNA, 13 bp, Homo sapiens
ttccatagcaaca

SEQ ID NO: 5009954 - DNA, 15 bp, Homo sapiens
ttccatagcaacagg

SEQ ID NO: 5009955 - DNA, 18 bp, Homo sapiens
ttccatgatttagcaagc

SEQ ID NO: 5009956 - DNA, 11 bp, Homo sapiens
ttcccaccctg

SEQ ID NO: 5009957 - DNA, 21 bp, Homo sapiens
tgagtctgggcagctgtccct

SEQ ID NO: 5009958 - DNA, 19 bp, Homo sapiens
tgagtgccttttgcagaag

SEQ ID NO: 5009959 - DNA, 12 bp, Homo sapiens
tgatcagtgttg

SEQ ID NO: 5009960 - DNA, 18 bp, Homo sapiens
tgatcagtgttgttgctc

SEQ ID NO: 5009961 - DNA, 20 bp, Homo sapiens
tgatcatcgccagaggtgct

SEQ ID NO: 5009962 - DNA, 14 bp, Homo sapiens
tgatctgctgctga

SEQ ID NO: 5009963 - DNA, 19 bp, Homo sapiens
tgatcttctgggagcagga

SEQ ID NO: 5009964 - DNA, 20 bp, Homo sapiens
tgatcttctgggagcaggaa

SEQ ID NO: 5009965 - DNA, 14 bp, Homo sapiens
tgatttagcaagca

SEQ ID NO: 5009966 - DNA, 23 bp, Homo sapiens
tgatttataaacagacaatatgt

SEQ ID NO: 5009967 - DNA, 12 bp, Homo sapiens
tgattttatgat

SEQ ID NO: 5009968 - DNA, 18 bp, Homo sapiens
tgattttatgatcagtgt

SEQ ID NO: 5009969 - DNA, 23 bp, Homo sapiens
tgatttttaagaaagtaatttaa

SEQ ID NO: 5009970 - DNA, 16 bp, Homo sapiens
tgcaagcagaggacca

SEQ ID NO: 5009971 - DNA, 15 bp, Homo sapiens
tgcaatatgcctagt

SEQ ID NO: 5009972 - DNA, 17 bp, Homo sapiens
tgcacaccattttgtaa

SEQ ID NO: 5009973 - DNA, 20 bp, Homo sapiens
tgcacagccactccccggca

SEQ ID NO: 5009974 - DNA, 16 bp, Homo sapiens
tgcactgaggtttttt

SEQ ID NO: 5009975 - DNA, 15 bp, Homo sapiens
tgcagaagagggtgt

SEQ ID NO: 5009976 - DNA, 17 bp, Homo sapiens
tgcagcaccgaggggcc

SEQ ID NO: 5009977 - DNA, 17 bp, Homo sapiens
tgcagcggcgtgaggcc

SEQ ID NO: 5009978 - DNA, 14 bp, Homo sapiens
tgcagctcatgttt

SEQ ID NO: 5009979 - DNA, 17 bp, Homo sapiens
tgcagtactttgtgcat

SEQ ID NO: 5009980 - DNA, 18 bp, Homo sapiens
tgcagtattcttgcactg

SEQ ID NO: 5009981 - DNA, 13 bp, Homo sapiens
tgcatggtggcca

SEQ ID NO: 5009982 - DNA, 21 bp, Homo sapiens
tgccaagaaaagggctgacat

SEQ ID NO: 5009983 - DNA, 16 bp, Homo sapiens
tgccaccatacctcct

SEQ ID NO: 5009984 - DNA, 14 bp, Homo sapiens
tgccactcctccct

SEQ ID NO: 5009985 - DNA, 17 bp, Homo sapiens
tgccactgctgtatttt

SEQ ID NO: 5009986 - DNA, 21 bp, Homo sapiens
tgccactgctgtatttttatt

SEQ ID NO: 5009987 - DNA, 14 bp, Homo sapiens
tgccaggaacctgt

SEQ ID NO: 5009988 - DNA, 21 bp, Homo sapiens
tgccaggaacctgtcctaagg

SEQ ID NO: 5009989 - DNA, 18 bp, Homo sapiens
tgccagtttaaaaagatg

SEQ ID NO: 5009990 - DNA, 14 bp, Homo sapiens
tgcccctcagagac

SEQ ID NO: 5009991 - DNA, 22 bp, Homo sapiens
tgccctcgcctcctcctcctgc

SEQ ID NO: 5009992 - DNA, 15 bp, Homo sapiens
tgcctcaccttccaa

SEQ ID NO: 5009993 - DNA, 13 bp, Homo sapiens
tgcctgcagggcc

SEQ ID NO: 5009994 - DNA, 22 bp, Homo sapiens
tgcctgcagggccatggctcag

SEQ ID NO: 5009995 - DNA, 15 bp, Homo sapiens
tgccttttgcagaag

SEQ ID NO: 5009996 - DNA, 17 bp, Homo sapiens
tgccttttgcagaagag

SEQ ID NO: 5009997 - DNA, 22 bp, Homo sapiens
tgccttttgcagaagagggtgt

SEQ ID NO: 5009998 - DNA, 15 bp, Homo sapiens
tgcgaccctgggggc

SEQ ID NO: 5009999 - DNA, 19 bp, Homo sapiens
tgcgaccctgggggcacag

SEQ ID NO: 5010000 - DNA, 22 bp, Homo sapiens
tgcgcatcttgcctccaggtgc

SEQ ID NO: 5010001 - DNA, 20 bp, Homo sapiens
tgctccgtagctctgctgct

SEQ ID NO: 5010002 - DNA, 15 bp, Homo sapiens
tgctctaggaagaca

SEQ ID NO: 5010003 - DNA, 19 bp, Homo sapiens
tgctctaggaagacatttt

SEQ ID NO: 5010004 - DNA, 12 bp, Homo sapiens
tgctgaaagact

SEQ ID NO: 5010005 - DNA, 23 bp, Homo sapiens
tgctgagacgccacggagggctg

SEQ ID NO: 5010006 - DNA, 12 bp, Homo sapiens
tgctgagggtgt

SEQ ID NO: 5010007 - DNA, 22 bp, Homo sapiens
tgctgagggtgtttcttcctgc

SEQ ID NO: 5010008 - DNA, 23 bp, Homo sapiens
tgctgcagcaccgaggggccttt

SEQ ID NO: 5010009 - DNA, 12 bp, Homo sapiens
tgctgctggtgc

SEQ ID NO: 5010010 - DNA, 18 bp, Homo sapiens
tgctggcatcaagaggtg

SEQ ID NO: 5010011 - DNA, 22 bp, Homo sapiens
tgctgtatgctgatcatcgcca

SEQ ID NO: 5010012 - DNA, 21 bp, Homo sapiens
tgctgtgtgtcccaggcaggg

SEQ ID NO: 5010013 - DNA, 21 bp, Homo sapiens
tgcttggtgtgacccacggag

SEQ ID NO: 5010014 - DNA, 23 bp, Homo sapiens
tgcttttgttccaatgtcaatgt

SEQ ID NO: 5010015 - DNA, 14 bp, Homo sapiens
tggaaagacttctc

SEQ ID NO: 5010016 - DNA, 23 bp, Homo sapiens
tggaagaggaacagcactgggga

SEQ ID NO: 5010017 - DNA, 19 bp, Homo sapiens
tggactgcagaagcaaggg

SEQ ID NO: 5010018 - DNA, 18 bp, Homo sapiens
tggagatgctgagggtgt

SEQ ID NO: 5010019 - DNA, 23 bp, Homo sapiens
tggaggtccctggtcggagaggg

SEQ ID NO: 5010020 - DNA, 23 bp, Homo sapiens
tggatgaaagagccagactctgt

SEQ ID NO: 5010021 - DNA, 20 bp, Homo sapiens
tggatgccacagcccagctt

SEQ ID NO: 5010022 - DNA, 20 bp, Homo sapiens
tggattctgaggccctgccc

SEQ ID NO: 5010023 - DNA, 12 bp, Homo sapiens
tggcaaggaaag

SEQ ID NO: 5010024 - DNA, 23 bp, Homo sapiens
tggcaccgcctccccacctccag

SEQ ID NO: 5010025 - DNA, 20 bp, Homo sapiens
tggcaggtgcctgtaatcct

SEQ ID NO: 5010026 - DNA, 22 bp, Homo sapiens
tggcatcaagaggtgggagggc

SEQ ID NO: 5010027 - DNA, 21 bp, Homo sapiens
actcttttgatggtggccctg

SEQ ID NO: 5010028 - DNA, 20 bp, Homo sapiens
actgaaagccttagggaagc

SEQ ID NO: 5010029 - DNA, 14 bp, Homo sapiens
actgaggttttttt

SEQ ID NO: 5010030 - DNA, 18 bp, Homo sapiens
actgatgttgtgttttta

SEQ ID NO: 5010031 - DNA, 17 bp, Homo sapiens
actgggccctgagtctg

SEQ ID NO: 5010032 - DNA, 15 bp, Homo sapiens
actgttactgggccc

SEQ ID NO: 5010033 - DNA, 13 bp, Homo sapiens
acttaagaattga

SEQ ID NO: 5010034 - DNA, 20 bp, Homo sapiens
acttcagggaaggtgaaaca

SEQ ID NO: 5010035 - DNA, 21 bp, Homo sapiens
acttgtgctttcagttagcct

SEQ ID NO: 5010036 - DNA, 14 bp, Homo sapiens
actttcctcccatt

SEQ ID NO: 5010037 - DNA, 22 bp, Homo sapiens
actttgaagtgcagctcatgtt

SEQ ID NO: 5010038 - DNA, 23 bp, Homo sapiens
actttgaagtgcagctcatgttt

SEQ ID NO: 5010039 - DNA, 18 bp, Homo sapiens
actttgccactgctgtat

SEQ ID NO: 5010040 - DNA, 19 bp, Homo sapiens
actttgccactgctgtatt

SEQ ID NO: 5010041 - DNA, 20 bp, Homo sapiens
actttgccactgctgtattt

SEQ ID NO: 5010042 - DNA, 12 bp, Homo sapiens
acttttaattta

SEQ ID NO: 5010043 - DNA, 21 bp, Homo sapiens
agaaaagtgcatatttatcca

SEQ ID NO: 5010044 - DNA, 16 bp, Homo sapiens
agaaaccacagtcttc

SEQ ID NO: 5010045 - DNA, 17 bp, Homo sapiens
agaaagtaatttaattt

SEQ ID NO: 5010046 - DNA, 14 bp, Homo sapiens
agaacaaaacttct

SEQ ID NO: 5010047 - DNA, 15 bp, Homo sapiens
agaacaaaacttcta

SEQ ID NO: 5010048 - DNA, 21 bp, Homo sapiens
agaaccaaccagggaagctgt

SEQ ID NO: 5010049 - DNA, 18 bp, Homo sapiens
agaagggaatcctcctcc

SEQ ID NO: 5010050 - DNA, 15 bp, Homo sapiens
agaattgaattggaa

SEQ ID NO: 5010051 - DNA, 16 bp, Homo sapiens
agaattgaattggaaa

SEQ ID NO: 5010052 - DNA, 17 bp, Homo sapiens
agaattgaattggaaag

SEQ ID NO: 5010053 - DNA, 16 bp, Homo sapiens
agactcagtgcagatg

SEQ ID NO: 5010054 - DNA, 21 bp, Homo sapiens
agacttctcaaagagaattgt

SEQ ID NO: 5010055 - DNA, 21 bp, Homo sapiens
agagacagctacacagagctt

SEQ ID NO: 5010056 - DNA, 12 bp, Homo sapiens
agagccctctcc

SEQ ID NO: 5010057 - DNA, 17 bp, Homo sapiens
agaggaccagggccttt

SEQ ID NO: 5010058 - DNA, 12 bp, Homo sapiens
agaggctgcccc

SEQ ID NO: 5010059 - DNA, 14 bp, Homo sapiens
agaggctgcccctc

SEQ ID NO: 5010060 - DNA, 20 bp, Homo sapiens
agaggctgcccctctcacca

SEQ ID NO: 5010061 - DNA, 18 bp, Homo sapiens
agagggacatagaatctg

SEQ ID NO: 5010062 - DNA, 14 bp, Homo sapiens
agaggtaccctggg

SEQ ID NO: 5010063 - DNA, 15 bp, Homo sapiens
agaggtaccctgggt

SEQ ID NO: 5010064 - DNA, 14 bp, Homo sapiens
agaggtgggagggc

SEQ ID NO: 5010065 - DNA, 15 bp, Homo sapiens
agaggttgcagtgag

SEQ ID NO: 5010066 - DNA, 18 bp, Homo sapiens
agatccttttattctcca

SEQ ID NO: 5010067 - DNA, 14 bp, Homo sapiens
agatgaaaaagaat

SEQ ID NO: 5010068 - DNA, 16 bp, Homo sapiens
agatgctgtgtatatg

SEQ ID NO: 5010069 - DNA, 18 bp, Homo sapiens
agatgctgtgtatatggt

SEQ ID NO: 5010070 - DNA, 15 bp, Homo sapiens
agcaactaattttct

SEQ ID NO: 5010071 - DNA, 17 bp, Homo sapiens
agcaactaattttctcc

SEQ ID NO: 5010072 - DNA, 15 bp, Homo sapiens
agcaagcaactaatt

SEQ ID NO: 5010073 - DNA, 15 bp, Homo sapiens
agcaagttttcttcc

SEQ ID NO: 5010074 - DNA, 23 bp, Homo sapiens
agcaatggtgtcagtatccaggc

SEQ ID NO: 5010075 - DNA, 17 bp, Homo sapiens
agcaccttgtgcctggg

SEQ ID NO: 5010076 - DNA, 18 bp, Homo sapiens
agcaccttgtgcctgggg

SEQ ID NO: 5010077 - DNA, 19 bp, Homo sapiens
agcaccttgtgcctggggt

SEQ ID NO: 5010078 - DNA, 14 bp, Homo sapiens
agcacttaagtgtt

SEQ ID NO: 5010079 - DNA, 14 bp, Homo sapiens
agcagcccaccctg

SEQ ID NO: 5010080 - DNA, 15 bp, Homo sapiens
agcagggaaggcctg

SEQ ID NO: 5010081 - DNA, 16 bp, Homo sapiens
agcagggaaggcctga

SEQ ID NO: 5010082 - DNA, 21 bp, Homo sapiens
agcatgtaatgttaatgttat

SEQ ID NO: 5010083 - DNA, 14 bp, Homo sapiens
agcccaccctgctg

SEQ ID NO: 5010084 - DNA, 19 bp, Homo sapiens
agcccaccctgctgctggt

SEQ ID NO: 5010085 - DNA, 22 bp, Homo sapiens
agcccaccctgctgctggtgca

SEQ ID NO: 5010086 - DNA, 14 bp, Homo sapiens
agcccacctgctcc

SEQ ID NO: 5010087 - DNA, 18 bp, Homo sapiens
agcccacctgctcccagg

SEQ ID NO: 5010088 - DNA, 17 bp, Homo sapiens
agccccacatgtccagc

SEQ ID NO: 5010089 - DNA, 19 bp, Homo sapiens
agcctgcagggaagcccca

SEQ ID NO: 5010090 - DNA, 23 bp, Homo sapiens
agcctgcagggaagccccacatg

SEQ ID NO: 5010091 - DNA, 14 bp, Homo sapiens
agcctggccaacat

SEQ ID NO: 5010092 - DNA, 15 bp, Homo sapiens
agccttagggaagct

SEQ ID NO: 5010093 - DNA, 20 bp, Homo sapiens
agccttagggaagctggcct

SEQ ID NO: 5010094 - DNA, 12 bp, Homo sapiens
agctacttggca

SEQ ID NO: 5010095 - DNA, 21 bp, Homo sapiens
agctagtgtacctcctctcag

SEQ ID NO: 5010096 - DNA, 15 bp, Homo sapiens
tcaaatctaccactg

SEQ ID NO: 5010097 - DNA, 20 bp, Homo sapiens
tcaaatctaccactgtatga

SEQ ID NO: 5010098 - DNA, 17 bp, Homo sapiens
tcaacaacatccactgt

SEQ ID NO: 5010099 - DNA, 17 bp, Homo sapiens
tcacagggtgggcctcg

SEQ ID NO: 5010100 - DNA, 13 bp, Homo sapiens
tcacagtaaccca

SEQ ID NO: 5010101 - DNA, 13 bp, Homo sapiens
tcaccaaggaaac

SEQ ID NO: 5010102 - DNA, 12 bp, Homo sapiens
tcaccccactcc

SEQ ID NO: 5010103 - DNA, 13 bp, Homo sapiens
tcaccccactcct

SEQ ID NO: 5010104 - DNA, 21 bp, Homo sapiens
tcacttttgctccgaagctac

SEQ ID NO: 5010105 - DNA, 17 bp, Homo sapiens
tcagaacaaaacttcta

SEQ ID NO: 5010106 - DNA, 23 bp, Homo sapiens
tcagagttgactttcctcccatt

SEQ ID NO: 5010107 - DNA, 13 bp, Homo sapiens
tcagcttatctct

SEQ ID NO: 5010108 - DNA, 15 bp, Homo sapiens
tcaggagttcaagac

SEQ ID NO: 5010109 - DNA, 23 bp, Homo sapiens
tcagggagcagggaaggcctgac

SEQ ID NO: 5010110 - DNA, 20 bp, Homo sapiens
tcagtgttttggactccatc

SEQ ID NO: 5010111 - DNA, 20 bp, Homo sapiens
tcagttgaaaatgcaactct

SEQ ID NO: 5010112 - DNA, 17 bp, Homo sapiens
tcataacttcctgtact

SEQ ID NO: 5010113 - DNA, 16 bp, Homo sapiens
tcatctcaggtagaag

SEQ ID NO: 5010114 - DNA, 23 bp, Homo sapiens
tcatgcctgtaatcccagcactt

SEQ ID NO: 5010115 - DNA, 18 bp, Homo sapiens
tcatgggcaccaacctgc

SEQ ID NO: 5010116 - DNA, 19 bp, Homo sapiens
tccaaaatgtgtatttctt

SEQ ID NO: 5010117 - DNA, 14 bp, Homo sapiens
tccaaagaggctgc

SEQ ID NO: 5010118 - DNA, 14 bp, Homo sapiens
tccactcccaggat

SEQ ID NO: 5010119 - DNA, 14 bp, Homo sapiens
tccactgttagcac

SEQ ID NO: 5010120 - DNA, 14 bp, Homo sapiens
tccagcaccttgtg

SEQ ID NO: 5010121 - DNA, 21 bp, Homo sapiens
tccagcaccttgtgcctgggg

SEQ ID NO: 5010122 - DNA, 22 bp, Homo sapiens
tccagcaccttgtgcctggggt

SEQ ID NO: 5010123 - DNA, 20 bp, Homo sapiens
tccaggctttgtacagagtg

SEQ ID NO: 5010124 - DNA, 15 bp, Homo sapiens
tccaggtgcagaggt

SEQ ID NO: 5010125 - DNA, 15 bp, Homo sapiens
tccagtaccttgctt

SEQ ID NO: 5010126 - DNA, 15 bp, Homo sapiens
tccagtgtctgtctg

SEQ ID NO: 5010127 - DNA, 16 bp, Homo sapiens
tccagtgtctgtctga

SEQ ID NO: 5010128 - DNA, 15 bp, Homo sapiens
tccatagcaacagga

SEQ ID NO: 5010129 - DNA, 14 bp, Homo sapiens
tccatcctgcagat

SEQ ID NO: 5010130 - DNA, 23 bp, Homo sapiens
tcccaagtttccatagcaacagg

SEQ ID NO: 5010131 - DNA, 17 bp, Homo sapiens
tcccacacccaaagctg

SEQ ID NO: 5010132 - DNA, 13 bp, Homo sapiens
tcccactgtatga

SEQ ID NO: 5010133 - DNA, 16 bp, Homo sapiens
tcccacttcccaccct

SEQ ID NO: 5010134 - DNA, 14 bp, Homo sapiens
tcccagcgctgctg

SEQ ID NO: 5010135 - DNA, 15 bp, Homo sapiens
tcccaggcagggaga

SEQ ID NO: 5010136 - DNA, 14 bp, Homo sapiens
tccccacctccagg

SEQ ID NO: 5010137 - DNA, 21 bp, Homo sapiens
tccccagcccacctgctccca

SEQ ID NO: 5010138 - DNA, 22 bp, Homo sapiens
tccccagcccacctgctcccag

SEQ ID NO: 5010139 - DNA, 15 bp, Homo sapiens
tccccgtctcattcc

SEQ ID NO: 5010140 - DNA, 17 bp, Homo sapiens
tcccctagagccctctc

SEQ ID NO: 5010141 - DNA, 23 bp, Homo sapiens
tcccgcatcaaggtcagcatgag

SEQ ID NO: 5010142 - DNA, 19 bp, Homo sapiens
tccctccggcttgacctgt

SEQ ID NO: 5010143 - DNA, 17 bp, Homo sapiens
tccctctcatctcaggt

SEQ ID NO: 5010144 - DNA, 13 bp, Homo sapiens
tccctctccttgc

SEQ ID NO: 5010145 - DNA, 19 bp, Homo sapiens
tccctctccttgcccccag

SEQ ID NO: 5010146 - DNA, 23 bp, Homo sapiens
tcccttgcttgcctgcagggcca

SEQ ID NO: 5010147 - DNA, 23 bp, Homo sapiens
tcccttggtgccctcgcctcctc

SEQ ID NO: 5010148 - DNA, 18 bp, Homo sapiens
tccgaccacttccagggg

SEQ ID NO: 5010149 - DNA, 14 bp, Homo sapiens
tccggcctctgcct

SEQ ID NO: 5010150 - DNA, 19 bp, Homo sapiens
tccggcctctgcctttgca

SEQ ID NO: 5010151 - DNA, 19 bp, Homo sapiens
tccgtagctctgctgctga

SEQ ID NO: 5010152 - DNA, 20 bp, Homo sapiens
tccgtagctctgctgctgat

SEQ ID NO: 5010153 - DNA, 13 bp, Homo sapiens
tcctaaggaacct

SEQ ID NO: 5010154 - DNA, 18 bp, Homo sapiens
tcctaattcttctgtcct

SEQ ID NO: 5010155 - DNA, 17 bp, Homo sapiens
tcctccagggtgatttt

SEQ ID NO: 5010156 - DNA, 19 bp, Homo sapiens
tcctccctctgtccctctc

SEQ ID NO: 5010157 - DNA, 13 bp, Homo sapiens
tcctcctccaggg

SEQ ID NO: 5010158 - DNA, 15 bp, Homo sapiens
tcctcctccagggtg

SEQ ID NO: 5010159 - DNA, 16 bp, Homo sapiens
tcctcctcctgccctc

SEQ ID NO: 5010160 - DNA, 19 bp, Homo sapiens
tcctctcaccccactcctg

SEQ ID NO: 5010161 - DNA, 16 bp, Homo sapiens
tcctggagaagcctcg

SEQ ID NO: 5010162 - DNA, 21 bp, Homo sapiens
tccttccccgagtgactctgg

SEQ ID NO: 5010163 - DNA, 12 bp, Homo sapiens
tccttgccccca

SEQ ID NO: 5010164 - DNA, 14 bp, Homo sapiens
tcgaacttcacaac

SEQ ID NO: 5010165 - DNA, 13 bp, Homo sapiens
tcgcctcctcctc

SEQ ID NO: 5010166 - DNA, 16 bp, Homo sapiens
tcgcctcctcctcctg

SEQ ID NO: 5010167 - DNA, 19 bp, Homo sapiens
tcgcctcctcctcctgccc

SEQ ID NO: 5010168 - DNA, 17 bp, Homo sapiens
tcgttaaaaagttgttt

SEQ ID NO: 5010169 - DNA, 21 bp, Homo sapiens
tcgttctgtactgttactggg

SEQ ID NO: 5010170 - DNA, 21 bp, Homo sapiens
tctcatcctccagtaccttgc

SEQ ID NO: 5010171 - DNA, 19 bp, Homo sapiens
tctccaggaagcccagggc

SEQ ID NO: 5010172 - DNA, 15 bp, Homo sapiens
tctccatcctgcaga

SEQ ID NO: 5010173 - DNA, 23 bp, Homo sapiens
tctctcatcctccagtaccttgc

SEQ ID NO: 5010174 - DNA, 16 bp, Homo sapiens
tctctgccgctacctc

SEQ ID NO: 5010175 - DNA, 17 bp, Homo sapiens
tctctgtcccttgctgt

SEQ ID NO: 5010176 - DNA, 18 bp, Homo sapiens
tctctgtcccttgctgta

SEQ ID NO: 5010177 - DNA, 16 bp, Homo sapiens
tctgaagcttgactcc

SEQ ID NO: 5010178 - DNA, 14 bp, Homo sapiens
tctgaggccctgcc

SEQ ID NO: 5010179 - DNA, 18 bp, Homo sapiens
tctgccgctacctccctc

SEQ ID NO: 5010180 - DNA, 19 bp, Homo sapiens
tctgccttctgctgaaaga

SEQ ID NO: 5010181 - DNA, 14 bp, Homo sapiens
tctgcgatgcagcg

SEQ ID NO: 5010182 - DNA, 14 bp, Homo sapiens
tctgctgaaagact

SEQ ID NO: 5010183 - DNA, 23 bp, Homo sapiens
tctgctggcatcaagaggtggga

SEQ ID NO: 5010184 - DNA, 23 bp, Homo sapiens
tctggccttgccccaggccctgc

SEQ ID NO: 5010185 - DNA, 16 bp, Homo sapiens
tctggttccctgctgc

SEQ ID NO: 5010186 - DNA, 20 bp, Homo sapiens
tctggttccctgctgcgctg

SEQ ID NO: 5010187 - DNA, 23 bp, Homo sapiens
tctgtactgttactgggccctga

SEQ ID NO: 5010188 - DNA, 14 bp, Homo sapiens
tctgtcccttgctg

SEQ ID NO: 5010189 - DNA, 20 bp, Homo sapiens
tctgtccgttcacatgtgtg

SEQ ID NO: 5010190 - DNA, 14 bp, Homo sapiens
tctgtctgaggtga

SEQ ID NO: 5010191 - DNA, 18 bp, Homo sapiens
tctgtggatggtcattgc

SEQ ID NO: 5010192 - DNA, 22 bp, Homo sapiens
tctgttggtctgccttctgctg

SEQ ID NO: 5010193 - DNA, 21 bp, Homo sapiens
tctgtttggactgcagaagca

SEQ ID NO: 5010194 - DNA, 19 bp, Homo sapiens
tcttaacagtggttcaaat

SEQ ID NO: 5010195 - DNA, 16 bp, Homo sapiens
tcttacacactgtctg

SEQ ID NO: 5010196 - DNA, 15 bp, Homo sapiens
aacactgaaatgaaa

SEQ ID NO: 5010197 - DNA, 14 bp, Homo sapiens
aacagatcttttac

SEQ ID NO: 5010198 - DNA, 12 bp, Homo sapiens
aacatccactgt

SEQ ID NO: 5010199 - DNA, 16 bp, Homo sapiens
aacatgcactgatgtt

SEQ ID NO: 5010200 - DNA, 16 bp, Homo sapiens
aacccagagctgtatt

SEQ ID NO: 5010201 - DNA, 18 bp, Homo sapiens
aacctacacactgtcatg

SEQ ID NO: 5010202 - DNA, 19 bp, Homo sapiens
aaccttccttcctgcttga

SEQ ID NO: 5010203 - DNA, 23 bp, Homo sapiens
aacggaggcctgcgaccctgggg

SEQ ID NO: 5010204 - DNA, 14 bp, Homo sapiens
aactcaacatttgt

SEQ ID NO: 5010205 - DNA, 15 bp, Homo sapiens
aactcaacatttgtc

SEQ ID NO: 5010206 - DNA, 13 bp, Homo sapiens
aacttaagaattg

SEQ ID NO: 5010207 - DNA, 15 bp, Homo sapiens
aagaaaagtgcatat

SEQ ID NO: 5010208 - DNA, 20 bp, Homo sapiens
aagaataaaaacttttgagg

SEQ ID NO: 5010209 - DNA, 14 bp, Homo sapiens
aagacacctggttg

SEQ ID NO: 5010210 - DNA, 17 bp, Homo sapiens
aagagaattgtatgtaa

SEQ ID NO: 5010211 - DNA, 23 bp, Homo sapiens
aagaggctgcccctctcaccaaa

SEQ ID NO: 5010212 - DNA, 17 bp, Homo sapiens
aagaggtgggagggccc

SEQ ID NO: 5010213 - DNA, 19 bp, Homo sapiens
aagatattgttgttttcca

SEQ ID NO: 5010214 - DNA, 20 bp, Homo sapiens
aagatattgttgttttccat

SEQ ID NO: 5010215 - DNA, 15 bp, Homo sapiens
aagatgaaaaagaat

SEQ ID NO: 5010216 - DNA, 13 bp, Homo sapiens
aagcagaggacca

SEQ ID NO: 5010217 - DNA, 14 bp, Homo sapiens
aagccttagggaag

SEQ ID NO: 5010218 - DNA, 18 bp, Homo sapiens
aagctatttatgggcccc

SEQ ID NO: 5010219 - DNA, 13 bp, Homo sapiens
aagctgagcctgc

SEQ ID NO: 5010220 - DNA, 15 bp, Homo sapiens
aagctgagcctgcag

SEQ ID NO: 5010221 - DNA, 13 bp, Homo sapiens
aagctgattttat

SEQ ID NO: 5010222 - DNA, 16 bp, Homo sapiens
aaggaaacgctacctc

SEQ ID NO: 5010223 - DNA, 12 bp, Homo sapiens
aaggaaccttcc

SEQ ID NO: 5010224 - DNA, 12 bp, Homo sapiens
aagggaatcctc

SEQ ID NO: 5010225 - DNA, 22 bp, Homo sapiens
aagtccctataataaaggctga

SEQ ID NO: 5010226 - DNA, 18 bp, Homo sapiens
aagtccgcagaagccctg

SEQ ID NO: 5010227 - DNA, 19 bp, Homo sapiens
aagtccgcagaagccctga

SEQ ID NO: 5010228 - DNA, 15 bp, Homo sapiens
aagtgggcccacccg

SEQ ID NO: 5010229 - DNA, 19 bp, Homo sapiens
aagtgggcccacccggtgg

SEQ ID NO: 5010230 - DNA, 16 bp, Homo sapiens
aagtgtatgcagtatt

SEQ ID NO: 5010231 - DNA, 17 bp, Homo sapiens
aagtgtatgcagtattc

SEQ ID NO: 5010232 - DNA, 17 bp, Homo sapiens
aagtgtgggctgggcgt

SEQ ID NO: 5010233 - DNA, 15 bp, Homo sapiens
aagtttacagagatg

SEQ ID NO: 5010234 - DNA, 20 bp, Homo sapiens
aagtttccatagcaacagga

SEQ ID NO: 5010235 - DNA, 17 bp, Homo sapiens
aatacattcgaaggaac

SEQ ID NO: 5010236 - DNA, 21 bp, Homo sapiens
aatataccttttgcatttctt

SEQ ID NO: 5010237 - DNA, 17 bp, Homo sapiens
aatcagaacaaaacttc

SEQ ID NO: 5010238 - DNA, 20 bp, Homo sapiens
aatggtgtcagtatccaggc

SEQ ID NO: 5010239 - DNA, 17 bp, Homo sapiens
aatgttatatcatatgt

SEQ ID NO: 5010240 - DNA, 22 bp, Homo sapiens
aattgtgtatttaaaaaaaaga

SEQ ID NO: 5010241 - DNA, 15 bp, Homo sapiens
aatttacactgccat

SEQ ID NO: 5010242 - DNA, 21 bp, Homo sapiens
aatttgaaaaatgcataataa

SEQ ID NO: 5010243 - DNA, 20 bp, Homo sapiens
aattttgctggaattcctaa

SEQ ID NO: 5010244 - DNA, 16 bp, Homo sapiens
acaaaaaaaattttag

SEQ ID NO: 5010245 - DNA, 22 bp, Homo sapiens
acaaaaaaaattttagctcttc

SEQ ID NO: 5010246 - DNA, 15 bp, Homo sapiens
acaacatccactgtt

SEQ ID NO: 5010247 - DNA, 16 bp, Homo sapiens
acaagtttatatatat

SEQ ID NO: 5010248 - DNA, 20 bp, Homo sapiens
acactccattattcctctca

SEQ ID NO: 5010249 - DNA, 21 bp, Homo sapiens
acactgtcatgcttcatcatt

SEQ ID NO: 5010250 - DNA, 24 bp, Homo sapiens
acagagagggagagcagagaaaga

SEQ ID NO: 5010251 - DNA, 22 bp, Homo sapiens
acagagatggtgtgttctgcaa

SEQ ID NO: 5010252 - DNA, 16 bp, Homo sapiens
acagaggttgcagtga

SEQ ID NO: 5010253 - DNA, 14 bp, Homo sapiens
acagcactggggag

SEQ ID NO: 5010254 - DNA, 14 bp, Homo sapiens
acagccagggggat

SEQ ID NO: 5010255 - DNA, 13 bp, Homo sapiens
acagggcttgtcc

SEQ ID NO: 5010256 - DNA, 14 bp, Homo sapiens
acatcacagggtgg

SEQ ID NO: 5010257 - DNA, 18 bp, Homo sapiens
acatgaaacctacacact

SEQ ID NO: 5010258 - DNA, 20 bp, Homo sapiens
acatgtccagcaccttgtgc

SEQ ID NO: 5010259 - DNA, 23 bp, Homo sapiens
acatgtccagcaccttgtgcctg

SEQ ID NO: 5010260 - DNA, 17 bp, Homo sapiens
acattgccaagtcagat

SEQ ID NO: 5010261 - DNA, 14 bp, Homo sapiens
acatttatatagac

SEQ ID NO: 5010262 - DNA, 19 bp, Homo sapiens
acatttttccgtttgcttt

SEQ ID NO: 5010263 - DNA, 18 bp, Homo sapiens
accaatttacactgccat

SEQ ID NO: 5010264 - DNA, 23 bp, Homo sapiens
accacttccaggggaacctgcca

SEQ ID NO: 5010265 - DNA, 18 bp, Homo sapiens
accataaatgaatcatca

SEQ ID NO: 5010266 - DNA, 12 bp, Homo sapiens
accatccagctc

SEQ ID NO: 5010267 - DNA, 11 bp, Homo sapiens
aaaaaaagaaa

SEQ ID NO: 5010268 - DNA, 13 bp, Homo sapiens
aaaaaaagaaact

SEQ ID NO: 5010269 - DNA, 12 bp, Homo sapiens
aaaaacttttga

SEQ ID NO: 5010270 - DNA, 18 bp, Homo sapiens
aaaaatcagaacaaaact

SEQ ID NO: 5010271 - DNA, 17 bp, Homo sapiens
tgttagcacattgataa

SEQ ID NO: 5010272 - DNA, 20 bp, Homo sapiens
tgttctgcaatatgcctagt

SEQ ID NO: 5010273 - DNA, 19 bp, Homo sapiens
tgttggtctgccttctgct

SEQ ID NO: 5010274 - DNA, 22 bp, Homo sapiens
tgttgttttccatgatttagca

SEQ ID NO: 5010275 - DNA, 13 bp, Homo sapiens
tgtttcttcctgc

SEQ ID NO: 5010276 - DNA, 17 bp, Homo sapiens
tgtttggcaaggaaagg

SEQ ID NO: 5010277 - DNA, 11 bp, Homo sapiens
tgttttatgct

SEQ ID NO: 5010278 - DNA, 14 bp, Homo sapiens
tgttttatgctact

SEQ ID NO: 5010279 - DNA, 22 bp, Homo sapiens
tgtttttttctttttttataaa

SEQ ID NO: 5010280 - DNA, 16 bp, Homo sapiens
ttaaaaaaaagaaact

SEQ ID NO: 5010281 - DNA, 13 bp, Homo sapiens
ttaaaaagatgaa

SEQ ID NO: 5010282 - DNA, 19 bp, Homo sapiens
ttaaaaagatgaaaaagaa

SEQ ID NO: 5010283 - DNA, 18 bp, Homo sapiens
ttaaagatcatgacatat

SEQ ID NO: 5010284 - DNA, 19 bp, Homo sapiens
ttaactactatattgattg

SEQ ID NO: 5010285 - DNA, 23 bp, Homo sapiens
ttaagagcagaacagatctttta

SEQ ID NO: 5010286 - DNA, 22 bp, Homo sapiens
ttaatgcagttgcttactaaag

SEQ ID NO: 5010287 - DNA, 14 bp, Homo sapiens
ttacgggtacctga

SEQ ID NO: 5010288 - DNA, 18 bp, Homo sapiens
ttagctggccacatggcg

SEQ ID NO: 5010289 - DNA, 23 bp, Homo sapiens
ttataaacagacaatatgtgagt

SEQ ID NO: 5010290 - DNA, 19 bp, Homo sapiens
ttataaataaactgttgct

SEQ ID NO: 5010291 - DNA, 22 bp, Homo sapiens
ttatacagatagagttccatat

SEQ ID NO: 5010292 - DNA, 18 bp, Homo sapiens
ttatatgttgtaatattt

SEQ ID NO: 5010293 - DNA, 15 bp, Homo sapiens
ttatatttgtaggag

SEQ ID NO: 5010294 - DNA, 15 bp, Homo sapiens
ttatccaaaatgtgt

SEQ ID NO: 5010295 - DNA, 20 bp, Homo sapiens
ttatctcttttatatttgta

SEQ ID NO: 5010296 - DNA, 17 bp, Homo sapiens
ttatgctactgaactga

SEQ ID NO: 5010297 - DNA, 19 bp, Homo sapiens
ttatgctactgaactgaaa

SEQ ID NO: 5010298 - DNA, 16 bp, Homo sapiens
ttcataacttcctgta

SEQ ID NO: 5010299 - DNA, 18 bp, Homo sapiens
ttccaggggaacctgcca

SEQ ID NO: 5010300 - DNA, 13 bp, Homo sapiens
ttccagtgtctgt

SEQ ID NO: 5010301 - DNA, 17 bp, Homo sapiens
tcgtttacactgcacat

SEQ ID NO: 5010302 - DNA, 22 bp, Homo sapiens
tcgtttacactgcacattgaat

SEQ ID NO: 5010303 - DNA, 16 bp, Homo sapiens
tctaattgctgtgtgt

SEQ ID NO: 5010304 - DNA, 16 bp, Homo sapiens
tctcaaagagaattgt

SEQ ID NO: 5010305 - DNA, 16 bp, Homo sapiens
tctcaccccactcctg

SEQ ID NO: 5010306 - DNA, 15 bp, Homo sapiens
tctcaggcttctgca

SEQ ID NO: 5010307 - DNA, 15 bp, Homo sapiens
tctcagtgttttgga

SEQ ID NO: 5010308 - DNA, 14 bp, Homo sapiens
tctcatcctccagt

SEQ ID NO: 5010309 - DNA, 14 bp, Homo sapiens
tctcattccgttgt

SEQ ID NO: 5010310 - DNA, 18 bp, Homo sapiens
tctcattccgttgtctgt

SEQ ID NO: 5010311 - DNA, 15 bp, Homo sapiens
tctcctgactggtgc

SEQ ID NO: 5010312 - DNA, 22 bp, Homo sapiens
tctctgccgctacctccctccc

SEQ ID NO: 5010313 - DNA, 15 bp, Homo sapiens
tctctgtcccttgct

SEQ ID NO: 5010314 - DNA, 16 bp, Homo sapiens
tctctgtcccttgctg

SEQ ID NO: 5010315 - DNA, 20 bp, Homo sapiens
tctcttttatatttgtagga

SEQ ID NO: 5010316 - DNA, 14 bp, Homo sapiens
tctgaagcttgact

SEQ ID NO: 5010317 - DNA, 17 bp, Homo sapiens
tctgaagcttgactccc

SEQ ID NO: 5010318 - DNA, 18 bp, Homo sapiens
tctgaagcttgactccca

SEQ ID NO: 5010319 - DNA, 22 bp, Homo sapiens
tctgaagcttgactcccaagtt

SEQ ID NO: 5010320 - DNA, 13 bp, Homo sapiens
tctgaatgctgcc

SEQ ID NO: 5010321 - DNA, 19 bp, Homo sapiens
tctgacaactgtgaagcca

SEQ ID NO: 5010322 - DNA, 17 bp, Homo sapiens
tctgacagtttttctgt

SEQ ID NO: 5010323 - DNA, 23 bp, Homo sapiens
tctgctgaaagactcgagaacca

SEQ ID NO: 5010324 - DNA, 12 bp, Homo sapiens
tctgctgctgat

SEQ ID NO: 5010325 - DNA, 22 bp, Homo sapiens
tctggcttgggcagggtctgtt

SEQ ID NO: 5010326 - DNA, 18 bp, Homo sapiens
tctggggcaggctgggcc

SEQ ID NO: 5010327 - DNA, 19 bp, Homo sapiens
tctggggggacccagtgca

SEQ ID NO: 5010328 - DNA, 21 bp, Homo sapiens
tctggggggacccagtgcaga

SEQ ID NO: 5010329 - DNA, 14 bp, Homo sapiens
tctgggtgctgccc

SEQ ID NO: 5010330 - DNA, 15 bp, Homo sapiens
tctgggtgctgccct

SEQ ID NO: 5010331 - DNA, 19 bp, Homo sapiens
tctggttccctgctgcgct

SEQ ID NO: 5010332 - DNA, 12 bp, Homo sapiens
tctgtccctctc

SEQ ID NO: 5010333 - DNA, 13 bp, Homo sapiens
tctgtccctctcc

SEQ ID NO: 5010334 - DNA, 18 bp, Homo sapiens
tctgtccctctccttgcc

SEQ ID NO: 5010335 - DNA, 15 bp, Homo sapiens
tctgtcccttgctgt

SEQ ID NO: 5010336 - DNA, 16 bp, Homo sapiens
tctgtcctgagaagca

SEQ ID NO: 5010337 - DNA, 23 bp, Homo sapiens
tctgttggtctgccttctgctga

SEQ ID NO: 5010338 - DNA, 19 bp, Homo sapiens
tctgtttggactgcagaag

SEQ ID NO: 5010339 - DNA, 17 bp, Homo sapiens
tcttacacactgtctgt

SEQ ID NO: 5010340 - DNA, 14 bp, Homo sapiens
tcttactgataatt

SEQ ID NO: 5010341 - DNA, 19 bp, Homo sapiens
tcttatacgcttttctttg

SEQ ID NO: 5010342 - DNA, 18 bp, Homo sapiens
tcttctggggcaggctgg

SEQ ID NO: 5010343 - DNA, 21 bp, Homo sapiens
tcttctggggcaggctgggcc

SEQ ID NO: 5010344 - DNA, 22 bp, Homo sapiens
tcttctggggcaggctgggcca

SEQ ID NO: 5010345 - DNA, 21 bp, Homo sapiens
tcttcttggggcccagtgcat

SEQ ID NO: 5010346 - DNA, 14 bp, Homo sapiens
tcttgcactgaggt

SEQ ID NO: 5010347 - DNA, 14 bp, Homo sapiens
tcttgcctccaggt

SEQ ID NO: 5010348 - DNA, 15 bp, Homo sapiens
tcttgcctccaggtg

SEQ ID NO: 5010349 - DNA, 17 bp, Homo sapiens
tcttggggcccagtgca

SEQ ID NO: 5010350 - DNA, 15 bp, Homo sapiens
tctttgttataccat

SEQ ID NO: 5010351 - DNA, 14 bp, Homo sapiens
tgaaacttaagaat

SEQ ID NO: 5010352 - DNA, 19 bp, Homo sapiens
tgaaagactcgagaaccaa

SEQ ID NO: 5010353 - DNA, 22 bp, Homo sapiens
tgaaattacgggtacctgaaga

SEQ ID NO: 5010354 - DNA, 15 bp, Homo sapiens
tgaagctgttgtgtg

SEQ ID NO: 5010355 - DNA, 15 bp, Homo sapiens
tgaagcttgactccc

SEQ ID NO: 5010356 - DNA, 13 bp, Homo sapiens
tgaagtgcagctc

SEQ ID NO: 5010357 - DNA, 14 bp, Homo sapiens
tgaagtgcagctca

SEQ ID NO: 5010358 - DNA, 15 bp, Homo sapiens
tgaattggaaagact

SEQ ID NO: 5010359 - DNA, 16 bp, Homo sapiens
tgacaactgtgaagcc

SEQ ID NO: 5010360 - DNA, 13 bp, Homo sapiens
tgacagccttctt

SEQ ID NO: 5010361 - DNA, 15 bp, Homo sapiens
tgacctgtttctctg

SEQ ID NO: 5010362 - DNA, 15 bp, Homo sapiens
tgactcatcatttgt

SEQ ID NO: 5010363 - DNA, 15 bp, Homo sapiens
tgactttcctcccat

SEQ ID NO: 5010364 - DNA, 18 bp, Homo sapiens
tgagactcagtgcagatg

SEQ ID NO: 5010365 - DNA, 22 bp, Homo sapiens
tgagactctagggtccagtgga

SEQ ID NO: 5010366 - DNA, 16 bp, Homo sapiens
tgagaggggaagcggc

SEQ ID NO: 5010367 - DNA, 14 bp, Homo sapiens
tgaggcctgggctg

SEQ ID NO: 5010368 - DNA, 12 bp, Homo sapiens
tgaggtcagtgt

SEQ ID NO: 5010369 - DNA, 15 bp, Homo sapiens
tgaggtcagtgtttg

SEQ ID NO: 5010370 - DNA, 17 bp, Homo sapiens
tgagtgccttttgcaga

SEQ ID NO: 5010371 - DNA, 22 bp, Homo sapiens
tgagtgccttttgcagaagagg

SEQ ID NO: 5010372 - DNA, 19 bp, Homo sapiens
tgagtttttacaagatgta

SEQ ID NO: 5010373 - DNA, 21 bp, Homo sapiens
tgataaaagcattgtttgtga

SEQ ID NO: 5010374 - DNA, 13 bp, Homo sapiens
tgataattttgct

SEQ ID NO: 5010375 - DNA, 17 bp, Homo sapiens
tgatactgggtctgcga

SEQ ID NO: 5010376 - DNA, 21 bp, Homo sapiens
tgatgccaccttcagatcctt

SEQ ID NO: 5010377 - DNA, 12 bp, Homo sapiens
tgatggtggccc

SEQ ID NO: 5010378 - DNA, 21 bp, Homo sapiens
tgattgtcctttaaaaaagaa

SEQ ID NO: 5010379 - DNA, 16 bp, Homo sapiens
tgatttagcaagcaac

SEQ ID NO: 5010380 - DNA, 22 bp, Homo sapiens
tgatttagcaagcaactaattt

SEQ ID NO: 5010381 - DNA, 20 bp, Homo sapiens
tgcaactctaactctgagag

SEQ ID NO: 5010382 - DNA, 21 bp, Homo sapiens
tgcaagcagaggaccagggcc

SEQ ID NO: 5010383 - DNA, 23 bp, Homo sapiens
tgcacaccattttgtaaatgaaa

SEQ ID NO: 5010384 - DNA, 21 bp, Homo sapiens
tgcacatccgcgtgtgcctgt

SEQ ID NO: 5010385 - DNA, 15 bp, Homo sapiens
tgcactgatgttgtg

SEQ ID NO: 5010386 - DNA, 20 bp, Homo sapiens
tgcagaagagggtgtgtttg

SEQ ID NO: 5010387 - DNA, 11 bp, Homo sapiens
tgcagaatgta

SEQ ID NO: 5010388 - DNA, 19 bp, Homo sapiens
tgcagatactttgaagtgc

SEQ ID NO: 5010389 - DNA, 22 bp, Homo sapiens
tgcagatactttgaagtgcagc

SEQ ID NO: 5010390 - DNA, 20 bp, Homo sapiens
tgcagcaccgaggggccttt

SEQ ID NO: 5010391 - DNA, 19 bp, Homo sapiens
tgcagtttaagagcagaac

SEQ ID NO: 5010392 - DNA, 22 bp, Homo sapiens
tgcatatttatccaaaatgtgt

SEQ ID NO: 5010393 - DNA, 14 bp, Homo sapiens
tgcatggtggccag

SEQ ID NO: 5010394 - DNA, 15 bp, Homo sapiens
tgcatggtggccaga

SEQ ID NO: 5010395 - DNA, 17 bp, Homo sapiens
tgccacaaccagccagg

SEQ ID NO: 5010396 - DNA, 22 bp, Homo sapiens
tgccactgctgtatttttattt

SEQ ID NO: 5010397 - DNA, 21 bp, Homo sapiens
tgcccaatgagactctagggt

SEQ ID NO: 5010398 - DNA, 13 bp, Homo sapiens
tgccccggagctg

SEQ ID NO: 5010399 - DNA, 14 bp, Homo sapiens
tgcccctctcacca

SEQ ID NO: 5010400 - DNA, 15 bp, Homo sapiens
tgccctcctctcccc

SEQ ID NO: 5010401 - DNA, 17 bp, Homo sapiens
tgccctcgcctcctcct

SEQ ID NO: 5010402 - DNA, 16 bp, Homo sapiens
tgccgctacctccctc

SEQ ID NO: 5010403 - DNA, 18 bp, Homo sapiens
tgccgctacctccctccc

SEQ ID NO: 5010404 - DNA, 14 bp, Homo sapiens
tgcctcaccttcca

SEQ ID NO: 5010405 - DNA, 14 bp, Homo sapiens
tgcctccaggtgca

SEQ ID NO: 5010406 - DNA, 16 bp, Homo sapiens
tgcctccaggtgcaga

SEQ ID NO: 5010407 - DNA, 17 bp, Homo sapiens
tgcctccaggtgcagag

SEQ ID NO: 5010408 - DNA, 17 bp, Homo sapiens
tgcctgcagggccatgg

SEQ ID NO: 5010409 - DNA, 13 bp, Homo sapiens
tgcgaccctgggg

SEQ ID NO: 5010410 - DNA, 14 bp, Homo sapiens
tgcgaccctggggg

SEQ ID NO: 5010411 - DNA, 17 bp, Homo sapiens
tgctacctttcaaagct

SEQ ID NO: 5010412 - DNA, 17 bp, Homo sapiens
tgctactgaactgaaag

SEQ ID NO: 5010413 - DNA, 20 bp, Homo sapiens
tgctcccaggccccaggcct

SEQ ID NO: 5010414 - DNA, 19 bp, Homo sapiens
tgctccgtagctctgctgc

SEQ ID NO: 5010415 - DNA, 19 bp, Homo sapiens
tgctcgtttacactgcaca

SEQ ID NO: 5010416 - DNA, 13 bp, Homo sapiens
tgctgaaagactc

SEQ ID NO: 5010417 - DNA, 20 bp, Homo sapiens
tgctgatactgggtctgcga

SEQ ID NO: 5010418 - DNA, 19 bp, Homo sapiens
tgctgatcatcgccagagg

SEQ ID NO: 5010419 - DNA, 21 bp, Homo sapiens
tgctgatcatcgccagaggtg

SEQ ID NO: 5010420 - DNA, 20 bp, Homo sapiens
tgctgccacaaccagccagg

SEQ ID NO: 5010421 - DNA, 22 bp, Homo sapiens
tgctgctgatactgggtctgcg

SEQ ID NO: 5010422 - DNA, 16 bp, Homo sapiens
tgctgctggtgcacag

SEQ ID NO: 5010423 - DNA, 18 bp, Homo sapiens
tgctgctggtgcacagcc

SEQ ID NO: 5010424 - DNA, 13 bp, Homo sapiens
tgctgtgtatatg

SEQ ID NO: 5010425 - DNA, 18 bp, Homo sapiens
tgctgtgtgtcccaggca

SEQ ID NO: 5010426 - DNA, 17 bp, Homo sapiens
tgcttcatcattccctc

SEQ ID NO: 5010427 - DNA, 23 bp, Homo sapiens
tgcttcatcattccctctcatct

SEQ ID NO: 5010428 - DNA, 12 bp, Homo sapiens
tggaaagacttc

SEQ ID NO: 5010429 - DNA, 18 bp, Homo sapiens
tggaaagacttctcaaag

SEQ ID NO: 5010430 - DNA, 14 bp, Homo sapiens
tggactgcagaagc

SEQ ID NO: 5010431 - DNA, 14 bp, Homo sapiens
tggacttcaaagca

SEQ ID NO: 5010432 - DNA, 21 bp, Homo sapiens
tggaggatcccctccaagcct

SEQ ID NO: 5010433 - DNA, 12 bp, Homo sapiens
tggagggaagcc

SEQ ID NO: 5010434 - DNA, 22 bp, Homo sapiens
gcttatctcttttatatttgta

SEQ ID NO: 5010435 - DNA, 19 bp, Homo sapiens
gcttcatcattccctctca

SEQ ID NO: 5010436 - DNA, 20 bp, Homo sapiens
gcttctccaggaagcccagg

SEQ ID NO: 5010437 - DNA, 14 bp, Homo sapiens
gcttgcctgcaggg

SEQ ID NO: 5010438 - DNA, 14 bp, Homo sapiens
gcttggtgtgaccc

SEQ ID NO: 5010439 - DNA, 15 bp, Homo sapiens
gctttcccacttccc

SEQ ID NO: 5010440 - DNA, 21 bp, Homo sapiens
gctttcccacttcccaccctg

SEQ ID NO: 5010441 - DNA, 18 bp, Homo sapiens
gcttttgttccaatgtca

SEQ ID NO: 5010442 - DNA, 16 bp, Homo sapiens
ggaaaaggctggtaca

SEQ ID NO: 5010443 - DNA, 23 bp, Homo sapiens
ggaaacactgaaatgaaatcttc

SEQ ID NO: 5010444 - DNA, 16 bp, Homo sapiens
ggaaccttccttcctg

SEQ ID NO: 5010445 - DNA, 13 bp, Homo sapiens
ggaagccccacat

SEQ ID NO: 5010446 - DNA, 15 bp, Homo sapiens
ggaagctggcctgag

SEQ ID NO: 5010447 - DNA, 13 bp, Homo sapiens
ggaagctgtcctg

SEQ ID NO: 5010448 - DNA, 14 bp, Homo sapiens
ggaaggtgaaacag

SEQ ID NO: 5010449 - DNA, 16 bp, Homo sapiens
ggacccccgtggggca

SEQ ID NO: 5010450 - DNA, 22 bp, Homo sapiens
ggacccccgtggggcagggagc

SEQ ID NO: 5010451 - DNA, 18 bp, Homo sapiens
ggactattacatattttt

SEQ ID NO: 5010452 - DNA, 17 bp, Homo sapiens
ggagcagcagcttctcc

SEQ ID NO: 5010453 - DNA, 16 bp, Homo sapiens
ggagcagggaaggcct

SEQ ID NO: 5010454 - DNA, 17 bp, Homo sapiens
ggagcagggaaggcctg

SEQ ID NO: 5010455 - DNA, 20 bp, Homo sapiens
ggaggcctgcgaccctgggg

SEQ ID NO: 5010456 - DNA, 21 bp, Homo sapiens
ggaggcctgcgaccctggggg

SEQ ID NO: 5010457 - DNA, 19 bp, Homo sapiens
ggatcaacaacatccactg

SEQ ID NO: 5010458 - DNA, 12 bp, Homo sapiens
ggcacaggaggc

SEQ ID NO: 5010459 - DNA, 15 bp, Homo sapiens
ggcaccatccagctc

SEQ ID NO: 5010460 - DNA, 15 bp, Homo sapiens
ggcaggcatggccct

SEQ ID NO: 5010461 - DNA, 20 bp, Homo sapiens
ggcaggcatggccctgggcg

SEQ ID NO: 5010462 - DNA, 21 bp, Homo sapiens
ggcatgagactcagtgcagat

SEQ ID NO: 5010463 - DNA, 15 bp, Homo sapiens
ggcccagtgcatggt

SEQ ID NO: 5010464 - DNA, 13 bp, Homo sapiens
ggcccctggcact

SEQ ID NO: 5010465 - DNA, 13 bp, Homo sapiens
ggcccgacatggc

SEQ ID NO: 5010466 - DNA, 22 bp, Homo sapiens
ggccctccgaccacttccaggg

SEQ ID NO: 5010467 - DNA, 12 bp, Homo sapiens
ggccggccctgt

SEQ ID NO: 5010468 - DNA, 22 bp, Homo sapiens
ggccggggctctgggtgctgcc

SEQ ID NO: 5010469 - DNA, 18 bp, Homo sapiens
gtgccttttgcagaagag

SEQ ID NO: 5010470 - DNA, 20 bp, Homo sapiens
gtgcgcatcttgcctccagg

SEQ ID NO: 5010471 - DNA, 17 bp, Homo sapiens
gtgctccgtagctctgc

SEQ ID NO: 5010472 - DNA, 14 bp, Homo sapiens
gtgctgcagcaccg

SEQ ID NO: 5010473 - DNA, 20 bp, Homo sapiens
gtggaaattaagactttatg

SEQ ID NO: 5010474 - DNA, 21 bp, Homo sapiens
gtggatgccacagcccagctt

SEQ ID NO: 5010475 - DNA, 14 bp, Homo sapiens
gtggccctgaacct

SEQ ID NO: 5010476 - DNA, 22 bp, Homo sapiens
gtgggcccacccggtgggaccc

SEQ ID NO: 5010477 - DNA, 13 bp, Homo sapiens
gtggggcagggag

SEQ ID NO: 5010478 - DNA, 23 bp, Homo sapiens
gtggtctcttcttggggcccagt

SEQ ID NO: 5010479 - DNA, 12 bp, Homo sapiens
gtgtacaggtac

SEQ ID NO: 5010480 - DNA, 21 bp, Homo sapiens
gtgtacctcctctcagtgttt

SEQ ID NO: 5010481 - DNA, 18 bp, Homo sapiens
gtgtatttaaaaaaaaga

SEQ ID NO: 5010482 - DNA, 19 bp, Homo sapiens
gtgtccccgctgctgtgca

SEQ ID NO: 5010483 - DNA, 18 bp, Homo sapiens
gtgtgtcccaggcaggga

SEQ ID NO: 5010484 - DNA, 15 bp, Homo sapiens
gtgtgtgtgtgtgca

SEQ ID NO: 5010485 - DNA, 15 bp, Homo sapiens
gttaatgttatatca

SEQ ID NO: 5010486 - DNA, 23 bp, Homo sapiens
gttaatgttatatcatatgtata

SEQ ID NO: 5010487 - DNA, 19 bp, Homo sapiens
gttacgttggttaaataaa

SEQ ID NO: 5010488 - DNA, 14 bp, Homo sapiens
gttactgggccctg

SEQ ID NO: 5010489 - DNA, 22 bp, Homo sapiens
gttcgaggactacaaccaattt

SEQ ID NO: 5010490 - DNA, 20 bp, Homo sapiens
gttctggggggacccagtgc

SEQ ID NO: 5010491 - DNA, 21 bp, Homo sapiens
gttctggggggacccagtgca

SEQ ID NO: 5010492 - DNA, 22 bp, Homo sapiens
gttgaaaatgcaactctaactc

SEQ ID NO: 5010493 - DNA, 19 bp, Homo sapiens
gttggtctgccttctgctg

SEQ ID NO: 5010494 - DNA, 20 bp, Homo sapiens
gtttaaaaagatgaaaaaga

SEQ ID NO: 5010495 - DNA, 21 bp, Homo sapiens
gtttccatagcaacaggaaaa

SEQ ID NO: 5010496 - DNA, 14 bp, Homo sapiens
gtttggcaaggaaa

SEQ ID NO: 5010497 - DNA, 18 bp, Homo sapiens
gttttaaaactggacctg

SEQ ID NO: 5010498 - DNA, 18 bp, Homo sapiens
gttttccatgatttagca

SEQ ID NO: 5010499 - DNA, 17 bp, Homo sapiens
taaaaaaaagaaacttt

SEQ ID NO: 5010500 - DNA, 23 bp, Homo sapiens
taaaaaatcagaacaaaacttct

SEQ ID NO: 5010501 - DNA, 14 bp, Homo sapiens
taaaaacacaaaaa

SEQ ID NO: 5010502 - DNA, 18 bp, Homo sapiens
taaaaagatgaaaaagaa

SEQ ID NO: 5010503 - DNA, 20 bp, Homo sapiens
taaaaagatgaaaaagaata

SEQ ID NO: 5010504 - DNA, 22 bp, Homo sapiens
taaaagcagaaaataaaggaag

SEQ ID NO: 5010505 - DNA, 19 bp, Homo sapiens
taaagacccagggggagaa

SEQ ID NO: 5010506 - DNA, 17 bp, Homo sapiens
taaatgaaacttaagaa

SEQ ID NO: 5010507 - DNA, 18 bp, Homo sapiens
taaatgaaacttaagaat

SEQ ID NO: 5010508 - DNA, 21 bp, Homo sapiens
taaatgaaacttaagaattga

SEQ ID NO: 5010509 - DNA, 20 bp, Homo sapiens
taacttttcaatgacatttt

SEQ ID NO: 5010510 - DNA, 18 bp, Homo sapiens
taagaacaaaagcgaccc

SEQ ID NO: 5010511 - DNA, 18 bp, Homo sapiens
taatgttatatcatatgt

SEQ ID NO: 5010512 - DNA, 15 bp, Homo sapiens
taattcttctgtcct

SEQ ID NO: 5010513 - DNA, 17 bp, Homo sapiens
taatttaaaaacacaaa

SEQ ID NO: 5010514 - DNA, 20 bp, Homo sapiens
taatttaatttgtaaaactt

SEQ ID NO: 5010515 - DNA, 22 bp, Homo sapiens
taatttgtaaaacttctgctcg

SEQ ID NO: 5010516 - DNA, 16 bp, Homo sapiens
tacaagtttatatata

SEQ ID NO: 5010517 - DNA, 15 bp, Homo sapiens
tacaccctttccagg

SEQ ID NO: 5010518 - DNA, 17 bp, Homo sapiens
tacagggatttctgttt

SEQ ID NO: 5010519 - DNA, 19 bp, Homo sapiens
tacaggtaactaattggaa

SEQ ID NO: 5010520 - DNA, 17 bp, Homo sapiens
tacatgcatacaaagag

SEQ ID NO: 5010521 - DNA, 23 bp, Homo sapiens
taccatttcctcagcttatctct

SEQ ID NO: 5010522 - DNA, 11 bp, Homo sapiens
taccctgggtg

SEQ ID NO: 5010523 - DNA, 11 bp, Homo sapiens
tacctccctcc

SEQ ID NO: 5010524 - DNA, 21 bp, Homo sapiens
tacctccctccccgtctcatt

SEQ ID NO: 5010525 - DNA, 15 bp, Homo sapiens
tacctcctctcagtg

SEQ ID NO: 5010526 - DNA, 14 bp, Homo sapiens
tacctctctgtccc

SEQ ID NO: 5010527 - DNA, 21 bp, Homo sapiens
tacctctctgtcccttgctgt

SEQ ID NO: 5010528 - DNA, 17 bp, Homo sapiens
tactgaactgaaaggat

SEQ ID NO: 5010529 - DNA, 13 bp, Homo sapiens
tactgccctttca

SEQ ID NO: 5010530 - DNA, 23 bp, Homo sapiens
tactgggccctgagtctgggcag

SEQ ID NO: 5010531 - DNA, 17 bp, Homo sapiens
tactgttactgggccct

SEQ ID NO: 5010532 - DNA, 17 bp, Homo sapiens
tagagccctctcctccc

SEQ ID NO: 5010533 - DNA, 15 bp, Homo sapiens
tagcaagcaactaat

SEQ ID NO: 5010534 - DNA, 20 bp, Homo sapiens
tagcaagcaactaattttct

SEQ ID NO: 5010535 - DNA, 15 bp, Homo sapiens
tagcaatctgcctgt

SEQ ID NO: 5010536 - DNA, 14 bp, Homo sapiens
tagcagatggtttc

SEQ ID NO: 5010537 - DNA, 21 bp, Homo sapiens
tagcagatggtttccacattt

SEQ ID NO: 5010538 - DNA, 13 bp, Homo sapiens
tagcatgaatgtt

SEQ ID NO: 5010539 - DNA, 16 bp, Homo sapiens
tagcatgaatgttttt

SEQ ID NO: 5010540 - DNA, 18 bp, Homo sapiens
tagcattctgcaacattt

SEQ ID NO: 5010541 - DNA, 22 bp, Homo sapiens
tagtgtacctcctctcagtgtt

SEQ ID NO: 5010542 - DNA, 18 bp, Homo sapiens
tataccatttcctcagct

SEQ ID NO: 5010543 - DNA, 16 bp, Homo sapiens
tatacttgtaaaacca

SEQ ID NO: 5010544 - DNA, 19 bp, Homo sapiens
tatactttgccactgctgt

SEQ ID NO: 5010545 - DNA, 17 bp, Homo sapiens
tatataacatatatgga

SEQ ID NO: 5010546 - DNA, 18 bp, Homo sapiens
tatataacatatatggaa

SEQ ID NO: 5010547 - DNA, 15 bp, Homo sapiens
tatatatacatatat

SEQ ID NO: 5010548 - DNA, 13 bp, Homo sapiens
tatatatatataa

SEQ ID NO: 5010549 - DNA, 17 bp, Homo sapiens
tatatggaagaggaaaa

SEQ ID NO: 5010550 - DNA, 17 bp, Homo sapiens
tatatttgtaaagctat

SEQ ID NO: 5010551 - DNA, 15 bp, Homo sapiens
tatgcagtattcttg

SEQ ID NO: 5010552 - DNA, 17 bp, Homo sapiens
tatggtatatatacata

SEQ ID NO: 5010553 - DNA, 16 bp, Homo sapiens
tatgtgagtgcctttt

SEQ ID NO: 5010554 - DNA, 21 bp, Homo sapiens
tattgacaaccgagaaggttt

SEQ ID NO: 5010555 - DNA, 20 bp, Homo sapiens
tatttaaaaaaaagaaactt

SEQ ID NO: 5010556 - DNA, 14 bp, Homo sapiens
tatttatttgaggt

SEQ ID NO: 5010557 - DNA, 18 bp, Homo sapiens
tatttcttatacgctttt

SEQ ID NO: 5010558 - DNA, 16 bp, Homo sapiens
tatttgaggtcagtgt

SEQ ID NO: 5010559 - DNA, 14 bp, Homo sapiens
tcaaagagaattgt

SEQ ID NO: 5010560 - DNA, 22 bp, Homo sapiens
tcaaattgtgcagtactttgtg

SEQ ID NO: 5010561 - DNA, 20 bp, Homo sapiens
tcacaacccttctctgttgg

SEQ ID NO: 5010562 - DNA, 15 bp, Homo sapiens
tcacagggtgggcct

SEQ ID NO: 5010563 - DNA, 12 bp, Homo sapiens
tcaccaaggaaa

SEQ ID NO: 5010564 - DNA, 19 bp, Homo sapiens
tcacccatgcaagcagagg

SEQ ID NO: 5010565 - DNA, 20 bp, Homo sapiens
tcacccatgcaagcagagga

SEQ ID NO: 5010566 - DNA, 14 bp, Homo sapiens
tcaccccactcctg

SEQ ID NO: 5010567 - DNA, 17 bp, Homo sapiens
tcaccccactcctgtca

SEQ ID NO: 5010568 - DNA, 14 bp, Homo sapiens
tcagaacaaaactt

SEQ ID NO: 5010569 - DNA, 21 bp, Homo sapiens
tcagagttgactttcctccca

SEQ ID NO: 5010570 - DNA, 19 bp, Homo sapiens
tcagcttatctcttttata

SEQ ID NO: 5010571 - DNA, 20 bp, Homo sapiens
tcagcttatctcttttatat

SEQ ID NO: 5010572 - DNA, 18 bp, Homo sapiens
tcaggagaattagatttc

SEQ ID NO: 5010573 - DNA, 21 bp, Homo sapiens
tcagggagcagggaaggcctg

SEQ ID NO: 5010574 - DNA, 23 bp, Homo sapiens
tcagtgttttggactccatctct

SEQ ID NO: 5010575 - DNA, 20 bp, Homo sapiens
tcatcatggaggtcatacat

SEQ ID NO: 5010576 - DNA, 13 bp, Homo sapiens
tcatcctccagta

SEQ ID NO: 5010577 - DNA, 21 bp, Homo sapiens
tcatcgccagaggtgcttcac

SEQ ID NO: 5010578 - DNA, 21 bp, Homo sapiens
tcattctggttccctgctgcg

SEQ ID NO: 5010579 - DNA, 18 bp, Homo sapiens
tccaaagaggctgcccct

SEQ ID NO: 5010580 - DNA, 19 bp, Homo sapiens
tccaaagaggctgcccctc

SEQ ID NO: 5010581 - DNA, 22 bp, Homo sapiens
tccacagagagggagagcagag

SEQ ID NO: 5010582 - DNA, 14 bp, Homo sapiens
tccacgtttgtgcc

SEQ ID NO: 5010583 - DNA, 15 bp, Homo sapiens
tccagcaccttgtgc

SEQ ID NO: 5010584 - DNA, 13 bp, Homo sapiens
tccagctccccag

SEQ ID NO: 5010585 - DNA, 22 bp, Homo sapiens
tccagctccccagcccacctgc

SEQ ID NO: 5010586 - DNA, 22 bp, Homo sapiens
tccagggaggggccggccctgt

SEQ ID NO: 5010587 - DNA, 14 bp, Homo sapiens
tccaggtgcagagg

SEQ ID NO: 5010588 - DNA, 17 bp, Homo sapiens
tccatgatttagcaagc

SEQ ID NO: 5010589 - DNA, 22 bp, Homo sapiens
tccatgatttagcaagcaacta

SEQ ID NO: 5010590 - DNA, 22 bp, Homo sapiens
tccattattcctctcaccccac

SEQ ID NO: 5010591 - DNA, 21 bp, Homo sapiens
tcccaagtttccatagcaaca

SEQ ID NO: 5010592 - DNA, 22 bp, Homo sapiens
tcccaagtttccatagcaacag

SEQ ID NO: 5010593 - DNA, 13 bp, Homo sapiens
tcccacaccccaa

SEQ ID NO: 5010594 - DNA, 17 bp, Homo sapiens
tcccaggccccaggcct

SEQ ID NO: 5010595 - DNA, 17 bp, Homo sapiens
tccccacctccaggctt

SEQ ID NO: 5010596 - DNA, 19 bp, Homo sapiens
tccccagcccacctgctcc

SEQ ID NO: 5010597 - DNA, 20 bp, Homo sapiens
tccccagcccacctgctccc

SEQ ID NO: 5010598 - DNA, 13 bp, Homo sapiens
tcccccatccttc

SEQ ID NO: 5010599 - DNA, 15 bp, Homo sapiens
tcccccatccttcag

SEQ ID NO: 5010600 - DNA, 23 bp, Homo sapiens
tcccctagagccctctcctccct

SEQ ID NO: 5010601 - DNA, 20 bp, Homo sapiens
tcccgtcacccctgtttctg

SEQ ID NO: 5010602 - DNA, 16 bp, Homo sapiens
tccctataataaaggc

SEQ ID NO: 5010603 - DNA, 17 bp, Homo sapiens
tccctataataaaggct

SEQ ID NO: 5010604 - DNA, 19 bp, Homo sapiens
tccctataataaaggctga

SEQ ID NO: 5010605 - DNA, 11 bp, Homo sapiens
tccctccaact

SEQ ID NO: 5010606 - DNA, 18 bp, Homo sapiens
tccctgctgcgctgcttg

SEQ ID NO: 5010607 - DNA, 17 bp, Homo sapiens
tccctggtcggagaggg

SEQ ID NO: 5010608 - DNA, 14 bp, Homo sapiens
tcccttgcttgcct

SEQ ID NO: 5010609 - DNA, 19 bp, Homo sapiens
tccgcgtgtgcctgtgtgc

SEQ ID NO: 5010610 - DNA, 19 bp, Homo sapiens
tccggaaactagtgtacat

SEQ ID NO: 5010611 - DNA, 18 bp, Homo sapiens
tccggcctctgcctttgc

SEQ ID NO: 5010612 - DNA, 15 bp, Homo sapiens
tccgtagctctgctg

SEQ ID NO: 5010613 - DNA, 18 bp, Homo sapiens
tccgtagctctgctgctg

SEQ ID NO: 5010614 - DNA, 14 bp, Homo sapiens
tcctaacttttcaa

SEQ ID NO: 5010615 - DNA, 16 bp, Homo sapiens
tcctatttatttgagg

SEQ ID NO: 5010616 - DNA, 22 bp, Homo sapiens
tcctccagggtgattttatgat

SEQ ID NO: 5010617 - DNA, 17 bp, Homo sapiens
tcctccagtaccttgct

SEQ ID NO: 5010618 - DNA, 18 bp, Homo sapiens
tcctccagtaccttgctt

SEQ ID NO: 5010619 - DNA, 12 bp, Homo sapiens
tcctcctccagg

SEQ ID NO: 5010620 - DNA, 14 bp, Homo sapiens
tcctcctcctgccc

SEQ ID NO: 5010621 - DNA, 18 bp, Homo sapiens
tcctctcaccccactcct

SEQ ID NO: 5010622 - DNA, 22 bp, Homo sapiens
tcctctcaccccactcctgtca

SEQ ID NO: 5010623 - DNA, 23 bp, Homo sapiens
tcctctcccctagagccctctcc

SEQ ID NO: 5010624 - DNA, 15 bp, Homo sapiens
tcctgactggtgctg

SEQ ID NO: 5010625 - DNA, 22 bp, Homo sapiens
tcctgcagatactttgaagtgc

SEQ ID NO: 5010626 - DNA, 13 bp, Homo sapiens
tcctgccctcctc

SEQ ID NO: 5010627 - DNA, 15 bp, Homo sapiens
tcctgccctcctctc

SEQ ID NO: 5010628 - DNA, 14 bp, Homo sapiens
tcctggatgaaaga

SEQ ID NO: 5010629 - DNA, 22 bp, Homo sapiens
tcctggtttcataacttcctgt

SEQ ID NO: 5010630 - DNA, 18 bp, Homo sapiens
tcctttaaaaaagaaaag

SEQ ID NO: 5010631 - DNA, 12 bp, Homo sapiens
tcgcctcctcct

SEQ ID NO: 5010632 - DNA, 15 bp, Homo sapiens
tcgtgtactgcaaag

SEQ ID NO: 5010633 - DNA, 16 bp, Homo sapiens
tcgttaaaaagttgtt

SEQ ID NO: 5010634 - DNA, 12 bp, Homo sapiens
aaaaagaaactt

SEQ ID NO: 5010635 - DNA, 10 bp, Homo sapiens
aaaacttctg

SEQ ID NO: 5010636 - DNA, 22 bp, Homo sapiens
aaaagaaaccttccaatgcttc

SEQ ID NO: 5010637 - DNA, 20 bp, Homo sapiens
aaaagcgacccattcagaga

SEQ ID NO: 5010638 - DNA, 20 bp, Homo sapiens
aaaagttttttattatgcat

SEQ ID NO: 5010639 - DNA, 14 bp, Homo sapiens
aaaatcagaacaaa

SEQ ID NO: 5010640 - DNA, 15 bp, Homo sapiens
aaaatcttctgatga

SEQ ID NO: 5010641 - DNA, 15 bp, Homo sapiens
aaacacaaaaaaaat

SEQ ID NO: 5010642 - DNA, 16 bp, Homo sapiens
aaacactgaaatgaaa

SEQ ID NO: 5010643 - DNA, 14 bp, Homo sapiens
aaacagacaatatg

SEQ ID NO: 5010644 - DNA, 18 bp, Homo sapiens
aaacctacacactgtcat

SEQ ID NO: 5010645 - DNA, 18 bp, Homo sapiens
aaacgctacctctctgtc

SEQ ID NO: 5010646 - DNA, 11 bp, Homo sapiens
aaacttctgct

SEQ ID NO: 5010647 - DNA, 16 bp, Homo sapiens
aaagacccagggggag

SEQ ID NO: 5010648 - DNA, 20 bp, Homo sapiens
aaagacttctcaaagagaat

SEQ ID NO: 5010649 - DNA, 14 bp, Homo sapiens
aaagaggctgcccc

SEQ ID NO: 5010650 - DNA, 22 bp, Homo sapiens
aaagaggctgcccctctcacca

SEQ ID NO: 5010651 - DNA, 16 bp, Homo sapiens
aaagatgaaaaagaat

SEQ ID NO: 5010652 - DNA, 14 bp, Homo sapiens
aaagcacttaagtg

SEQ ID NO: 5010653 - DNA, 23 bp, Homo sapiens
aaagctagtgtacctcctctcag

SEQ ID NO: 5010654 - DNA, 13 bp, Homo sapiens
aaagctgagcctg

SEQ ID NO: 5010655 - DNA, 15 bp, Homo sapiens
aaagctgagcctgca

SEQ ID NO: 5010656 - DNA, 19 bp, Homo sapiens
aaagtaatttaatttgtaa

SEQ ID NO: 5010657 - DNA, 18 bp, Homo sapiens
aaagtgcatatttatcca

SEQ ID NO: 5010658 - DNA, 14 bp, Homo sapiens
aaatgaaatcttcc

SEQ ID NO: 5010659 - DNA, 22 bp, Homo sapiens
aaatgaaatcttcccagtatta

SEQ ID NO: 5010660 - DNA, 17 bp, Homo sapiens
aacaaacgagcaggcat

SEQ ID NO: 5010661 - DNA, 12 bp, Homo sapiens
aacacaaaaaaa

SEQ ID NO: 5010662 - DNA, 21 bp, Homo sapiens
aacagacaatatgtgagtgcc

SEQ ID NO: 5010663 - DNA, 12 bp, Homo sapiens
aacatatatgga

SEQ ID NO: 5010664 - DNA, 14 bp, Homo sapiens
aacatgcactgatg

SEQ ID NO: 5010665 - DNA, 19 bp, Homo sapiens
aacatgcactgatgttgtg

SEQ ID NO: 5010666 - DNA, 18 bp, Homo sapiens
aaccagggaagctgtcct

SEQ ID NO: 5010667 - DNA, 17 bp, Homo sapiens
aacccttctctgttggt

SEQ ID NO: 5010668 - DNA, 17 bp, Homo sapiens
aacctagtactgccccc

SEQ ID NO: 5010669 - DNA, 14 bp, Homo sapiens
aactagtgtacatt

SEQ ID NO: 5010670 - DNA, 11 bp, Homo sapiens
aacttaagaat

SEQ ID NO: 5010671 - DNA, 17 bp, Homo sapiens
aacttttcaatgacatt

SEQ ID NO: 5010672 - DNA, 20 bp, Homo sapiens
aagaaaagtgcatatttatc

SEQ ID NO: 5010673 - DNA, 10 bp, Homo sapiens
aagaaacttt

SEQ ID NO: 5010674 - DNA, 18 bp, Homo sapiens
aagaataaaaacttttga

SEQ ID NO: 5010675 - DNA, 16 bp, Homo sapiens
aagaatgtacgtccag

SEQ ID NO: 5010676 - DNA, 17 bp, Homo sapiens
aagaatttggggcagga

SEQ ID NO: 5010677 - DNA, 22 bp, Homo sapiens
aagacttctcaaagagaattgt

SEQ ID NO: 5010678 - DNA, 20 bp, Homo sapiens
aagaggaacagcactgggga

SEQ ID NO: 5010679 - DNA, 17 bp, Homo sapiens
aagaggctgcccctctc

SEQ ID NO: 5010680 - DNA, 22 bp, Homo sapiens
aagaggctgcccctctcaccaa

SEQ ID NO: 5010681 - DNA, 15 bp, Homo sapiens
aagaggtgggagggc

SEQ ID NO: 5010682 - DNA, 17 bp, Homo sapiens
aagattactgaaatata

SEQ ID NO: 5010683 - DNA, 15 bp, Homo sapiens
aagcaagggggtgat

SEQ ID NO: 5010684 - DNA, 20 bp, Homo sapiens
aagcagaaaataaaggaagc

SEQ ID NO: 5010685 - DNA, 13 bp, Homo sapiens
aagccccacatgt

SEQ ID NO: 5010686 - DNA, 20 bp, Homo sapiens
aagcggccctaagggagtgt

SEQ ID NO: 5010687 - DNA, 20 bp, Homo sapiens
aagctagtgtacctcctctc

SEQ ID NO: 5010688 - DNA, 21 bp, Homo sapiens
aagctagtgtacctcctctca

SEQ ID NO: 5010689 - DNA, 22 bp, Homo sapiens
aagctatttatgggcccctggc

SEQ ID NO: 5010690 - DNA, 14 bp, Homo sapiens
aagctgattttatt

SEQ ID NO: 5010691 - DNA, 17 bp, Homo sapiens
aagcttgactcccaagt

SEQ ID NO: 5010692 - DNA, 18 bp, Homo sapiens
aagcttgactcccaagtt

SEQ ID NO: 5010693 - DNA, 13 bp, Homo sapiens
aaggaaccttcct

SEQ ID NO: 5010694 - DNA, 23 bp, Homo sapiens
aaggaaccttccttcctgcttga

SEQ ID NO: 5010695 - DNA, 19 bp, Homo sapiens
aagtccctataataaaggc

SEQ ID NO: 5010696 - DNA, 13 bp, Homo sapiens
aagtgggcccacc

SEQ ID NO: 5010697 - DNA, 13 bp, Homo sapiens
aagtttatatata

SEQ ID NO: 5010698 - DNA, 18 bp, Homo sapiens
aataaaaacttttgagga

SEQ ID NO: 5010699 - DNA, 12 bp, Homo sapiens
aatatttcttca

SEQ ID NO: 5010700 - DNA, 23 bp, Homo sapiens
aatcacttgaccgggagacagag

SEQ ID NO: 5010701 - DNA, 18 bp, Homo sapiens
aatcagaacaaaacttct

SEQ ID NO: 5010702 - DNA, 19 bp, Homo sapiens
aatcagaacaaaacttcta

SEQ ID NO: 5010703 - DNA, 9 bp, Homo sapiens
aatcctcct

SEQ ID NO: 5010704 - DNA, 18 bp, Homo sapiens
aatctctccctcctcagt

SEQ ID NO: 5010705 - DNA, 15 bp, Homo sapiens
aatctgcctgtatct

SEQ ID NO: 5010706 - DNA, 18 bp, Homo sapiens
aatctgcctgtatctctc

SEQ ID NO: 5010707 - DNA, 15 bp, Homo sapiens
aatgaaacttaagaa

SEQ ID NO: 5010708 - DNA, 18 bp, Homo sapiens
aatgtacgtccagcctgc

SEQ ID NO: 5010709 - DNA, 18 bp, Homo sapiens
aatgttttgggaaacact

SEQ ID NO: 5010710 - DNA, 14 bp, Homo sapiens
aattcccccatcct

SEQ ID NO: 5010711 - DNA, 13 bp, Homo sapiens
aattcctaacttt

SEQ ID NO: 5010712 - DNA, 23 bp, Homo sapiens
aattgaattggaaagacttctca

SEQ ID NO: 5010713 - DNA, 16 bp, Homo sapiens
aattggaaggagaggg

SEQ ID NO: 5010714 - DNA, 22 bp, Homo sapiens
aatttaatttgtaaaacttctg

SEQ ID NO: 5010715 - DNA, 24 bp, Homo sapiens
aatttaatttgtaaaacttctgct

SEQ ID NO: 5010716 - DNA, 21 bp, Homo sapiens
aatttcaccaccaaatgccaa

SEQ ID NO: 5010717 - DNA, 19 bp, Homo sapiens
aatttgggaaaataaatac

SEQ ID NO: 5010718 - DNA, 17 bp, Homo sapiens
aatttgtaaaacttctg

SEQ ID NO: 5010719 - DNA, 11 bp, Homo sapiens
acaaaacttct

SEQ ID NO: 5010720 - DNA, 19 bp, Homo sapiens
acaacccttctctgttggt

SEQ ID NO: 5010721 - DNA, 13 bp, Homo sapiens
acaacggaggcct

SEQ ID NO: 5010722 - DNA, 23 bp, Homo sapiens
agtgcagaatgtaagtgggccca

SEQ ID NO: 5010723 - DNA, 15 bp, Homo sapiens
agtgcagctcatgtt

SEQ ID NO: 5010724 - DNA, 16 bp, Homo sapiens
agtgcttttctgttta

SEQ ID NO: 5010725 - DNA, 20 bp, Homo sapiens
agtgtacatttctataaata

SEQ ID NO: 5010726 - DNA, 17 bp, Homo sapiens
agtgtctgtctgaggtg

SEQ ID NO: 5010727 - DNA, 20 bp, Homo sapiens
agtgttttggactccatctc

SEQ ID NO: 5010728 - DNA, 16 bp, Homo sapiens
agttgactttcctccc

SEQ ID NO: 5010729 - DNA, 17 bp, Homo sapiens
agtttccatagcaacag

SEQ ID NO: 5010730 - DNA, 20 bp, Homo sapiens
agtttccatagcaacaggaa

SEQ ID NO: 5010731 - DNA, 17 bp, Homo sapiens
agtttttacaagatgta

SEQ ID NO: 5010732 - DNA, 17 bp, Homo sapiens
ataaactttttttagat

SEQ ID NO: 5010733 - DNA, 16 bp, Homo sapiens
ataaagacccaggggg

SEQ ID NO: 5010734 - DNA, 21 bp, Homo sapiens
ataaatagatgctgtgtatat

SEQ ID NO: 5010735 - DNA, 20 bp, Homo sapiens
ataatgttttgggaaacact

SEQ ID NO: 5010736 - DNA, 17 bp, Homo sapiens
ataccatttcctcagct

SEQ ID NO: 5010737 - DNA, 13 bp, Homo sapiens
atactttgaagtg

SEQ ID NO: 5010738 - DNA, 18 bp, Homo sapiens
atagcctggactgctacc

SEQ ID NO: 5010739 - DNA, 23 bp, Homo sapiens
atagttggaggtgattccagtga

SEQ ID NO: 5010740 - DNA, 15 bp, Homo sapiens
atatctatatatata

SEQ ID NO: 5010741 - DNA, 15 bp, Homo sapiens
atatggtatatatac

SEQ ID NO: 5010742 - DNA, 21 bp, Homo sapiens
atatgtatatatatatatgca

SEQ ID NO: 5010743 - DNA, 20 bp, Homo sapiens
atatgtgagtgccttttgca

SEQ ID NO: 5010744 - DNA, 16 bp, Homo sapiens
atattgattgtccttt

SEQ ID NO: 5010745 - DNA, 15 bp, Homo sapiens
atatttatccaaaat

SEQ ID NO: 5010746 - DNA, 15 bp, Homo sapiens
atatttgtaaagcta

SEQ ID NO: 5010747 - DNA, 17 bp, Homo sapiens
atcacagggtgggcctc

SEQ ID NO: 5010748 - DNA, 10 bp, Homo sapiens
atcagtgttg

SEQ ID NO: 5010749 - DNA, 13 bp, Homo sapiens
atcatcgccagag

SEQ ID NO: 5010750 - DNA, 20 bp, Homo sapiens
atcatcgccagaggtgcttc

SEQ ID NO: 5010751 - DNA, 19 bp, Homo sapiens
atccaaaatgtgtatttct

SEQ ID NO: 5010752 - DNA, 13 bp, Homo sapiens
atccagctcccca

SEQ ID NO: 5010753 - DNA, 15 bp, Homo sapiens
atcctcctccagggt

SEQ ID NO: 5010754 - DNA, 14 bp, Homo sapiens
atcctggtttcata

SEQ ID NO: 5010755 - DNA, 18 bp, Homo sapiens
atcggagtcagccaggag

SEQ ID NO: 5010756 - DNA, 21 bp, Homo sapiens
atctaacgtgttccagtgtct

SEQ ID NO: 5010757 - DNA, 16 bp, Homo sapiens
atctctcatcctccag

SEQ ID NO: 5010758 - DNA, 17 bp, Homo sapiens
atctctcatcctccagt

SEQ ID NO: 5010759 - DNA, 12 bp, Homo sapiens
atctcttttata

SEQ ID NO: 5010760 - DNA, 19 bp, Homo sapiens
atctcttttatatttgtag

SEQ ID NO: 5010761 - DNA, 20 bp, Homo sapiens
atctcttttatatttgtagg

SEQ ID NO: 5010762 - DNA, 16 bp, Homo sapiens
atctgtgacctctgac

SEQ ID NO: 5010763 - DNA, 18 bp, Homo sapiens
atctgtgacctctgacaa

SEQ ID NO: 5010764 - DNA, 15 bp, Homo sapiens
atcttgcctccaggt

SEQ ID NO: 5010765 - DNA, 23 bp, Homo sapiens
atgaaaaagaataaaaacttttg

SEQ ID NO: 5010766 - DNA, 22 bp, Homo sapiens
atgaaataaagacccaggggga

SEQ ID NO: 5010767 - DNA, 14 bp, Homo sapiens
atgccactcctccc

SEQ ID NO: 5010768 - DNA, 14 bp, Homo sapiens
atgctgatcatcgc

SEQ ID NO: 5010769 - DNA, 14 bp, Homo sapiens
atggctcagggtgg

SEQ ID NO: 5010770 - DNA, 14 bp, Homo sapiens
atgggcccctggca

SEQ ID NO: 5010771 - DNA, 14 bp, Homo sapiens
atggtggccctgaa

SEQ ID NO: 5010772 - DNA, 19 bp, Homo sapiens
atgtaagaattcagaagac

SEQ ID NO: 5010773 - DNA, 18 bp, Homo sapiens
atgtaagtgggcccaccc

SEQ ID NO: 5010774 - DNA, 18 bp, Homo sapiens
atgtacgtccagcctgcc

SEQ ID NO: 5010775 - DNA, 13 bp, Homo sapiens
atgtagcccatcc

SEQ ID NO: 5010776 - DNA, 21 bp, Homo sapiens
atgtagtttttatatgttgta

SEQ ID NO: 5010777 - DNA, 18 bp, Homo sapiens
atgtccaaagaggctgcc

SEQ ID NO: 5010778 - DNA, 21 bp, Homo sapiens
atgtccagcaccttgtgcctg

SEQ ID NO: 5010779 - DNA, 20 bp, Homo sapiens
atgtgagtgccttttgcaga

SEQ ID NO: 5010780 - DNA, 23 bp, Homo sapiens
atgtgagtgccttttgcagaaga

SEQ ID NO: 5010781 - DNA, 16 bp, Homo sapiens
atgtgtatttcttata

SEQ ID NO: 5010782 - DNA, 14 bp, Homo sapiens
atgttgtaatattt

SEQ ID NO: 5010783 - DNA, 18 bp, Homo sapiens
atgttttgggaaacactg

SEQ ID NO: 5010784 - DNA, 14 bp, Homo sapiens
attataaattgtgt

SEQ ID NO: 5010785 - DNA, 14 bp, Homo sapiens
attcccccatcctt

SEQ ID NO: 5010786 - DNA, 19 bp, Homo sapiens
attcctctcaccccactcc

SEQ ID NO: 5010787 - DNA, 23 bp, Homo sapiens
attcctctcaccccactcctgtc

SEQ ID NO: 5010788 - DNA, 18 bp, Homo sapiens
attcttataactcaacat

SEQ ID NO: 5010789 - DNA, 15 bp, Homo sapiens
attcttctgtcctga

SEQ ID NO: 5010790 - DNA, 13 bp, Homo sapiens
attgaattggaaa

SEQ ID NO: 5010791 - DNA, 19 bp, Homo sapiens
attgacaaccgagaaggtt

SEQ ID NO: 5010792 - DNA, 14 bp, Homo sapiens
attgatttttaaga

SEQ ID NO: 5010793 - DNA, 15 bp, Homo sapiens
attgatttttaagaa

SEQ ID NO: 5010794 - DNA, 20 bp, Homo sapiens
attgatttttaagaaagtaa

SEQ ID NO: 5010795 - DNA, 17 bp, Homo sapiens
attgctgtgtgtcccag

SEQ ID NO: 5010796 - DNA, 16 bp, Homo sapiens
attggaaagacttctc

SEQ ID NO: 5010797 - DNA, 20 bp, Homo sapiens
attgtgcagtactttgtgca

SEQ ID NO: 5010798 - DNA, 11 bp, Homo sapiens
atttaatttgt

SEQ ID NO: 5010799 - DNA, 14 bp, Homo sapiens
atttacactgccat

SEQ ID NO: 5010800 - DNA, 15 bp, Homo sapiens
atttagcaagcaact

SEQ ID NO: 5010801 - DNA, 15 bp, Homo sapiens
atttataaacagaca

SEQ ID NO: 5010802 - DNA, 17 bp, Homo sapiens
atttatccaaaatgtgt

SEQ ID NO: 5010803 - DNA, 15 bp, Homo sapiens
atttatgggcccctg

SEQ ID NO: 5010804 - DNA, 13 bp, Homo sapiens
atttatttgaggt

SEQ ID NO: 5010805 - DNA, 19 bp, Homo sapiens
atttatttgaggtcagtgt

SEQ ID NO: 5010806 - DNA, 21 bp, Homo sapiens
atttatttgaggtcagtgttt

SEQ ID NO: 5010807 - DNA, 16 bp, Homo sapiens
atttgaggtcagtgtt

SEQ ID NO: 5010808 - DNA, 20 bp, Homo sapiens
atttggtatatactttgcca

SEQ ID NO: 5010809 - DNA, 23 bp, Homo sapiens
atttggtatatactttgccactg

SEQ ID NO: 5010810 - DNA, 16 bp, Homo sapiens
atttgtaaaacttctg

SEQ ID NO: 5010811 - DNA, 18 bp, Homo sapiens
atttgtaaaacttctgct

SEQ ID NO: 5010812 - DNA, 14 bp, Homo sapiens
atttgtaggagaaa

SEQ ID NO: 5010813 - DNA, 18 bp, Homo sapiens
attttatgatcagtgttg

SEQ ID NO: 5010814 - DNA, 15 bp, Homo sapiens
atttttaagaaagta

SEQ ID NO: 5010815 - DNA, 19 bp, Homo sapiens
atttttaagaaagtaattt

SEQ ID NO: 5010816 - DNA, 18 bp, Homo sapiens
atttttatttttgcacaa

SEQ ID NO: 5010817 - DNA, 17 bp, Homo sapiens
atttttccgtttgcttt

SEQ ID NO: 5010818 - DNA, 16 bp, Homo sapiens
atttttgcacaacttt

SEQ ID NO: 5010819 - DNA, 16 bp, Homo sapiens
caaaatgtgtatttct

SEQ ID NO: 5010820 - DNA, 14 bp, Homo sapiens
caaagagaattgta

SEQ ID NO: 5010821 - DNA, 16 bp, Homo sapiens
caaagaggctgcccct

SEQ ID NO: 5010822 - DNA, 22 bp, Homo sapiens
cagtgaactaagtccctataat

SEQ ID NO: 5010823 - DNA, 14 bp, Homo sapiens
cagtgacgctgctg

SEQ ID NO: 5010824 - DNA, 22 bp, Homo sapiens
cagtgcagaatgtaagtgggcc

SEQ ID NO: 5010825 - DNA, 17 bp, Homo sapiens
cagtgcatggtggccag

SEQ ID NO: 5010826 - DNA, 21 bp, Homo sapiens
cagtgcatggtggccagaggt

SEQ ID NO: 5010827 - DNA, 15 bp, Homo sapiens
cagtgcctcaccttc

SEQ ID NO: 5010828 - DNA, 17 bp, Homo sapiens
cagtgcctcaccttcca

SEQ ID NO: 5010829 - DNA, 17 bp, Homo sapiens
cagtgtctgtctgaggt

SEQ ID NO: 5010830 - DNA, 23 bp, Homo sapiens
cagtgttgttgctctaggaagac

SEQ ID NO: 5010831 - DNA, 17 bp, Homo sapiens
cagtttaaaaagatgaa

SEQ ID NO: 5010832 - DNA, 18 bp, Homo sapiens
cagtttaaaaagatgaaa

SEQ ID NO: 5010833 - DNA, 19 bp, Homo sapiens
cataacaattcccccatcc

SEQ ID NO: 5010834 - DNA, 13 bp, Homo sapiens
cataacttcctgt

SEQ ID NO: 5010835 - DNA, 14 bp, Homo sapiens
catagaatctgtga

SEQ ID NO: 5010836 - DNA, 11 bp, Homo sapiens
catatatatat

SEQ ID NO: 5010837 - DNA, 15 bp, Homo sapiens
catatgacttgatct

SEQ ID NO: 5010838 - DNA, 21 bp, Homo sapiens
catatttatccaaaatgtgta

SEQ ID NO: 5010839 - DNA, 22 bp, Homo sapiens
catattttttgtatatttgttt

SEQ ID NO: 5010840 - DNA, 16 bp, Homo sapiens
catcattccctctcat

SEQ ID NO: 5010841 - DNA, 19 bp, Homo sapiens
catccctgcttatttttaa

SEQ ID NO: 5010842 - DNA, 16 bp, Homo sapiens
catccgcgtgtgcctg

SEQ ID NO: 5010843 - DNA, 23 bp, Homo sapiens
catcctgcagatactttgaagtg

SEQ ID NO: 5010844 - DNA, 20 bp, Homo sapiens
catcgccagaggtgcttcac

SEQ ID NO: 5010845 - DNA, 22 bp, Homo sapiens
catcttgcctccaggtgcagag

SEQ ID NO: 5010846 - DNA, 14 bp, Homo sapiens
catgatttagcaag

SEQ ID NO: 5010847 - DNA, 18 bp, Homo sapiens
catgatttagcaagcaac

SEQ ID NO: 5010848 - DNA, 17 bp, Homo sapiens
catgcaagcagaggacc

SEQ ID NO: 5010849 - DNA, 11 bp, Homo sapiens
catgcacacac

SEQ ID NO: 5010850 - DNA, 15 bp, Homo sapiens
catgcactgatgttg

SEQ ID NO: 5010851 - DNA, 23 bp, Homo sapiens
catgtaatgttaatgttatatca

SEQ ID NO: 5010852 - DNA, 13 bp, Homo sapiens
catgtccaaagag

SEQ ID NO: 5010853 - DNA, 14 bp, Homo sapiens
catgtccaaagagg

SEQ ID NO: 5010854 - DNA, 16 bp, Homo sapiens
catgtccaaagaggct

SEQ ID NO: 5010855 - DNA, 19 bp, Homo sapiens
catgtcctaattcttctgt

SEQ ID NO: 5010856 - DNA, 21 bp, Homo sapiens
catgtgtggtacatggtgttt

SEQ ID NO: 5010857 - DNA, 17 bp, Homo sapiens
catgtttttaactttta

SEQ ID NO: 5010858 - DNA, 21 bp, Homo sapiens
cattctggttccctgctgcgc

SEQ ID NO: 5010859 - DNA, 19 bp, Homo sapiens
catttttccgtttgctttt

SEQ ID NO: 5010860 - DNA, 13 bp, Homo sapiens
ccaaaccggcagg

SEQ ID NO: 5010861 - DNA, 12 bp, Homo sapiens
ccaaagaggctg

SEQ ID NO: 5010862 - DNA, 22 bp, Homo sapiens
ccaaagaggctgcccctctcac

SEQ ID NO: 5010863 - DNA, 14 bp, Homo sapiens
ccaaagctgagcct

SEQ ID NO: 5010864 - DNA, 18 bp, Homo sapiens
ccaagaatgtacgtccag

SEQ ID NO: 5010865 - DNA, 21 bp, Homo sapiens
ccaagaatgtacgtccagcct

SEQ ID NO: 5010866 - DNA, 21 bp, Homo sapiens
ccaagtccgcagaagccctga

SEQ ID NO: 5010867 - DNA, 20 bp, Homo sapiens
ccaagtttccatagcaacag

SEQ ID NO: 5010868 - DNA, 18 bp, Homo sapiens
ccacatggcggagagttt

SEQ ID NO: 5010869 - DNA, 14 bp, Homo sapiens
ccaccctgctgctg

SEQ ID NO: 5010870 - DNA, 18 bp, Homo sapiens
ccaccctgctgctggtgc

SEQ ID NO: 5010871 - DNA, 21 bp, Homo sapiens
ccacctccaggctttcccact

SEQ ID NO: 5010872 - DNA, 14 bp, Homo sapiens
ccacctgctcccag

SEQ ID NO: 5010873 - DNA, 15 bp, Homo sapiens
ccacctgctcccagg

SEQ ID NO: 5010874 - DNA, 16 bp, Homo sapiens
ccacctgctcccaggc

SEQ ID NO: 5010875 - DNA, 20 bp, Homo sapiens
ccacgggacatcacagggtg

SEQ ID NO: 5010876 - DNA, 13 bp, Homo sapiens
ccacttccagggg

SEQ ID NO: 5010877 - DNA, 13 bp, Homo sapiens
ccagatcctgggt

SEQ ID NO: 5010878 - DNA, 17 bp, Homo sapiens
ccagcatttagctggcc

SEQ ID NO: 5010879 - DNA, 18 bp, Homo sapiens
ccagcatttagctggcca

SEQ ID NO: 5010880 - DNA, 19 bp, Homo sapiens
ccagcatttagctggccac

SEQ ID NO: 5010881 - DNA, 14 bp, Homo sapiens
ccagcccacctgct

SEQ ID NO: 5010882 - DNA, 17 bp, Homo sapiens
ccagcccacctgctccc

SEQ ID NO: 5010883 - DNA, 15 bp, Homo sapiens
ccagcgctgctggtc

SEQ ID NO: 5010884 - DNA, 19 bp, Homo sapiens
ccaggcacccagctttgtc

SEQ ID NO: 5010885 - DNA, 10 bp, Homo sapiens
ccaggcaggg

SEQ ID NO: 5010886 - DNA, 13 bp, Homo sapiens
ccaggcagggaga

SEQ ID NO: 5010887 - DNA, 19 bp, Homo sapiens
ccaggcctgggtgatctgc

SEQ ID NO: 5010888 - DNA, 21 bp, Homo sapiens
ccagggaagctgtcctggagg

SEQ ID NO: 5010889 - DNA, 12 bp, Homo sapiens
ccaggggaacct

SEQ ID NO: 5010890 - DNA, 24 bp, Homo sapiens
ccaggggaacctgccatgccagga

SEQ ID NO: 5010891 - DNA, 18 bp, Homo sapiens
ccagggggtctcacccat

SEQ ID NO: 5010892 - DNA, 14 bp, Homo sapiens
ccaggtgcagaggt

SEQ ID NO: 5010893 - DNA, 13 bp, Homo sapiens
ccagtgacgctgc

SEQ ID NO: 5010894 - DNA, 16 bp, Homo sapiens
ccagtgcagaatgtaa

SEQ ID NO: 5010895 - DNA, 20 bp, Homo sapiens
ccagtgctccaggcacccag

SEQ ID NO: 5010896 - DNA, 21 bp, Homo sapiens
ccagtggatgccacagcccag

SEQ ID NO: 5010897 - DNA, 14 bp, Homo sapiens
ccatagcaacagga

SEQ ID NO: 5010898 - DNA, 21 bp, Homo sapiens
ccatcctgcagatactttgaa

SEQ ID NO: 5010899 - DNA, 17 bp, Homo sapiens
ccatgaggaaggaacag

SEQ ID NO: 5010900 - DNA, 16 bp, Homo sapiens
ccatgatttagcaagc

SEQ ID NO: 5010901 - DNA, 17 bp, Homo sapiens
ccatgatttagcaagca

SEQ ID NO: 5010902 - DNA, 19 bp, Homo sapiens
ccatgatttagcaagcaac

SEQ ID NO: 5010903 - DNA, 15 bp, Homo sapiens
ccatgcaagcagagg

SEQ ID NO: 5010904 - DNA, 16 bp, Homo sapiens
ccatgcaagcagagga

SEQ ID NO: 5010905 - DNA, 19 bp, Homo sapiens
ccatgcaagcagaggacca

SEQ ID NO: 5010906 - DNA, 14 bp, Homo sapiens
ccatgccaggaacc

SEQ ID NO: 5010907 - DNA, 14 bp, Homo sapiens
ccatgtccaaagag

SEQ ID NO: 5010908 - DNA, 22 bp, Homo sapiens
ccattttgtaaatgaaacttaa

SEQ ID NO: 5010909 - DNA, 16 bp, Homo sapiens
cccaaagctgagcctg

SEQ ID NO: 5010910 - DNA, 16 bp, Homo sapiens
cccacacccaaagctg

SEQ ID NO: 5010911 - DNA, 15 bp, Homo sapiens
cccacctgctcccag

SEQ ID NO: 5010912 - DNA, 12 bp, Homo sapiens
cccactcctgtc

SEQ ID NO: 5010913 - DNA, 12 bp, Homo sapiens
cccagcccacct

SEQ ID NO: 5010914 - DNA, 19 bp, Homo sapiens
cccagcccacctgctccca

SEQ ID NO: 5010915 - DNA, 20 bp, Homo sapiens
cccagggcaccatccagctc

SEQ ID NO: 5010916 - DNA, 12 bp, Homo sapiens
cccagtgcagaa

SEQ ID NO: 5010917 - DNA, 19 bp, Homo sapiens
cccagtgcatggtggccag

SEQ ID NO: 5010918 - DNA, 20 bp, Homo sapiens
cccagtgcatggtggccaga

SEQ ID NO: 5010919 - DNA, 22 bp, Homo sapiens
cccagtgcatggtggccagagg

SEQ ID NO: 5010920 - DNA, 15 bp, Homo sapiens
cccagtgcctcacct

SEQ ID NO: 5010921 - DNA, 22 bp, Homo sapiens
cccataacaattcccccatcct

SEQ ID NO: 5010922 - DNA, 18 bp, Homo sapiens
cggcatgagactcagtgc

SEQ ID NO: 5010923 - DNA, 20 bp, Homo sapiens
cggcatgagactcagtgcag

SEQ ID NO: 5010924 - DNA, 21 bp, Homo sapiens
cggcatgagactcagtgcaga

SEQ ID NO: 5010925 - DNA, 19 bp, Homo sapiens
cggcccgcgcagctgccta

SEQ ID NO: 5010926 - DNA, 12 bp, Homo sapiens
cggccctaaggg

SEQ ID NO: 5010927 - DNA, 13 bp, Homo sapiens
cggcctctgcctt

SEQ ID NO: 5010928 - DNA, 21 bp, Homo sapiens
cgggacatcacagggtgggcc

SEQ ID NO: 5010929 - DNA, 22 bp, Homo sapiens
cgggacatcacagggtgggcct

SEQ ID NO: 5010930 - DNA, 23 bp, Homo sapiens
cgggacatcacagggtgggcctc

SEQ ID NO: 5010931 - DNA, 21 bp, Homo sapiens
cggggctctgggtgctgccct

SEQ ID NO: 5010932 - DNA, 20 bp, Homo sapiens
cggtttccagggaggggccg

SEQ ID NO: 5010933 - DNA, 14 bp, Homo sapiens
cgtagctctgctgc

SEQ ID NO: 5010934 - DNA, 16 bp, Homo sapiens
cgtagctctgctgctg

SEQ ID NO: 5010935 - DNA, 18 bp, Homo sapiens
cgtagctctgctgctgat

SEQ ID NO: 5010936 - DNA, 15 bp, Homo sapiens
cgtctgaagcttgac

SEQ ID NO: 5010937 - DNA, 21 bp, Homo sapiens
cgtctgaagcttgactcccaa

SEQ ID NO: 5010938 - DNA, 13 bp, Homo sapiens
cgtgaggcctggg

SEQ ID NO: 5010939 - DNA, 22 bp, Homo sapiens
cgtgctccgtagctctgctgct

SEQ ID NO: 5010940 - DNA, 15 bp, Homo sapiens
cgtggagggaggccc

SEQ ID NO: 5010941 - DNA, 20 bp, Homo sapiens
cgtggagggaggccccaggg

SEQ ID NO: 5010942 - DNA, 16 bp, Homo sapiens
cgtggggcagggagct

SEQ ID NO: 5010943 - DNA, 21 bp, Homo sapiens
cgtgtcccttcccagcgctgc

SEQ ID NO: 5010944 - DNA, 15 bp, Homo sapiens
cgtgtgcctgtgtgc

SEQ ID NO: 5010945 - DNA, 22 bp, Homo sapiens
cgtgtgtgtgtgtgtgtgtgca

SEQ ID NO: 5010946 - DNA, 16 bp, Homo sapiens
cgtttacactgcacat

SEQ ID NO: 5010947 - DNA, 14 bp, Homo sapiens
ctaactctgagagc

SEQ ID NO: 5010948 - DNA, 19 bp, Homo sapiens
ctaattggaaggagagggg

SEQ ID NO: 5010949 - DNA, 22 bp, Homo sapiens
ctacacactgtcatgcttcatc

SEQ ID NO: 5010950 - DNA, 11 bp, Homo sapiens
ctacctccctc

SEQ ID NO: 5010951 - DNA, 13 bp, Homo sapiens
ctagagccctctc

SEQ ID NO: 5010952 - DNA, 18 bp, Homo sapiens
ctagagttttatagcctg

SEQ ID NO: 5010953 - DNA, 23 bp, Homo sapiens
ctagcagcccaccctgctgctgg

SEQ ID NO: 5010954 - DNA, 16 bp, Homo sapiens
ctagtgacagcttgtg

SEQ ID NO: 5010955 - DNA, 19 bp, Homo sapiens
ctagtgtacctcctctcag

SEQ ID NO: 5010956 - DNA, 21 bp, Homo sapiens
ctagtgtacctcctctcagtg

SEQ ID NO: 5010957 - DNA, 23 bp, Homo sapiens
ctagtgtacctcctctcagtgtt

SEQ ID NO: 5010958 - DNA, 21 bp, Homo sapiens
ctagtttcttacacactgtct

SEQ ID NO: 5010959 - DNA, 15 bp, Homo sapiens
ctataataaaggctg

SEQ ID NO: 5010960 - DNA, 13 bp, Homo sapiens
ctatatatataat

SEQ ID NO: 5010961 - DNA, 14 bp, Homo sapiens
ctatgtttgcactt

SEQ ID NO: 5010962 - DNA, 13 bp, Homo sapiens
ctattatccagag

SEQ ID NO: 5010963 - DNA, 15 bp, Homo sapiens
ctcaccccactcctg

SEQ ID NO: 5010964 - DNA, 18 bp, Homo sapiens
ctcaccccactcctgtca

SEQ ID NO: 5010965 - DNA, 21 bp, Homo sapiens
ctcagggagcagggaaggcct

SEQ ID NO: 5010966 - DNA, 16 bp, Homo sapiens
ctcagggtggtctctt

SEQ ID NO: 5010967 - DNA, 12 bp, Homo sapiens
ctcagtgttttg

SEQ ID NO: 5010968 - DNA, 17 bp, Homo sapiens
ctcagtgttttggactc

SEQ ID NO: 5010969 - DNA, 23 bp, Homo sapiens
ctcatcctccagtaccttgcttc

SEQ ID NO: 5010970 - DNA, 22 bp, Homo sapiens
ctcattctggttccctgctgcg

SEQ ID NO: 5010971 - DNA, 17 bp, Homo sapiens
ctccaggaagcccaggg

SEQ ID NO: 5010972 - DNA, 16 bp, Homo sapiens
ctccaggtgcagaggt

SEQ ID NO: 5010973 - DNA, 16 bp, Homo sapiens
ctccagtaccttgctt

SEQ ID NO: 5010974 - DNA, 20 bp, Homo sapiens
ctccattattcctctcaccc

SEQ ID NO: 5010975 - DNA, 21 bp, Homo sapiens
ctcccacacccaaagctgagc

SEQ ID NO: 5010976 - DNA, 22 bp, Homo sapiens
ctcccaggatgacgtgctccgt

SEQ ID NO: 5010977 - DNA, 18 bp, Homo sapiens
ctcccaggccccaggcct

SEQ ID NO: 5010978 - DNA, 14 bp, Homo sapiens
ctcccatgtatgga

SEQ ID NO: 5010979 - DNA, 20 bp, Homo sapiens
ctccccagcccacctgctcc

SEQ ID NO: 5010980 - DNA, 23 bp, Homo sapiens
ctcccctagagccctctcctccc

SEQ ID NO: 5010981 - DNA, 16 bp, Homo sapiens
ctccctccccgtctca

SEQ ID NO: 5010982 - DNA, 17 bp, Homo sapiens
ctccctccggcttgacc

SEQ ID NO: 5010983 - DNA, 14 bp, Homo sapiens
ctccctctgtccct

SEQ ID NO: 5010984 - DNA, 18 bp, Homo sapiens
ctcccttggtgccctcgc

SEQ ID NO: 5010985 - DNA, 19 bp, Homo sapiens
ctccggcctctgcctttgc

SEQ ID NO: 5010986 - DNA, 15 bp, Homo sapiens
ctccgtagctctgct

SEQ ID NO: 5010987 - DNA, 17 bp, Homo sapiens
ctcctacttttcatcct

SEQ ID NO: 5010988 - DNA, 17 bp, Homo sapiens
ctcctccctctgtccct

SEQ ID NO: 5010989 - DNA, 14 bp, Homo sapiens
ctcctcctcctgcc

SEQ ID NO: 5010990 - DNA, 14 bp, Homo sapiens
ctccttgcccccag

SEQ ID NO: 5010991 - DNA, 15 bp, Homo sapiens
ctcgcctcctcctcc

SEQ ID NO: 5010992 - DNA, 18 bp, Homo sapiens
ctcgcctcctcctcctgc

SEQ ID NO: 5010993 - DNA, 19 bp, Homo sapiens
ctcgcctcctcctcctgcc

SEQ ID NO: 5010994 - DNA, 20 bp, Homo sapiens
ctcgcctcctcctcctgccc

SEQ ID NO: 5010995 - DNA, 19 bp, Homo sapiens
ctctaactctgagagctgt

SEQ ID NO: 5010996 - DNA, 13 bp, Homo sapiens
ctctcaccccact

SEQ ID NO: 5010997 - DNA, 14 bp, Homo sapiens
ctctcaccccactc

SEQ ID NO: 5010998 - DNA, 18 bp, Homo sapiens
ctctcagtgttttggact

SEQ ID NO: 5010999 - DNA, 18 bp, Homo sapiens
ctctcccctagagccctc

SEQ ID NO: 5011000 - DNA, 18 bp, Homo sapiens
ctctccttgcccccagtg

SEQ ID NO: 5011001 - DNA, 15 bp, Homo sapiens
ctctgccgctacctc

SEQ ID NO: 5011002 - DNA, 19 bp, Homo sapiens
ctctgccgctacctccctc

SEQ ID NO: 5011003 - DNA, 12 bp, Homo sapiens
ctctgctgctga

SEQ ID NO: 5011004 - DNA, 20 bp, Homo sapiens
ctctggccttgccccaggcc

SEQ ID NO: 5011005 - DNA, 14 bp, Homo sapiens
ctctgtccctctcc

SEQ ID NO: 5011006 - DNA, 21 bp, Homo sapiens
ctctgttggtctgccttctgc

SEQ ID NO: 5011007 - DNA, 19 bp, Homo sapiens
ctcttctggggcaggctgg

SEQ ID NO: 5011008 - DNA, 22 bp, Homo sapiens
ctcttcttggggcccagtgcat

SEQ ID NO: 5011009 - DNA, 20 bp, Homo sapiens
ctcttgatgccaccttcaga

SEQ ID NO: 5011010 - DNA, 23 bp, Homo sapiens
ctcttttatatttgtaggagaaa

SEQ ID NO: 5011011 - DNA, 17 bp, Homo sapiens
ctgaagatgggagcctt

SEQ ID NO: 5011012 - DNA, 14 bp, Homo sapiens
ctgaagcttgactc

SEQ ID NO: 5011013 - DNA, 14 bp, Homo sapiens
ctgacagtttttct

SEQ ID NO: 5011014 - DNA, 16 bp, Homo sapiens
ctgactggtgctgcag

SEQ ID NO: 5011015 - DNA, 16 bp, Homo sapiens
ctgaggccctgcccaa

SEQ ID NO: 5011016 - DNA, 16 bp, Homo sapiens
ctgaggctgcatctgc

SEQ ID NO: 5011017 - DNA, 14 bp, Homo sapiens
ctgagtctgggcag

SEQ ID NO: 5011018 - DNA, 22 bp, Homo sapiens
ctgagtctgggcagctgtccct

SEQ ID NO: 5011019 - DNA, 19 bp, Homo sapiens
ctgatactgggtctgcgat

SEQ ID NO: 5011020 - DNA, 20 bp, Homo sapiens
ctgatgccgtgatcctgagc

SEQ ID NO: 5011021 - DNA, 19 bp, Homo sapiens
ctgcaaagtgtatgcagta

SEQ ID NO: 5011022 - DNA, 22 bp, Homo sapiens
gccatgtccaaagaggctgccc

SEQ ID NO: 5011023 - DNA, 16 bp, Homo sapiens
gcccaccctgctgctg

SEQ ID NO: 5011024 - DNA, 19 bp, Homo sapiens
gcccaccctgctgctggtg

SEQ ID NO: 5011025 - DNA, 22 bp, Homo sapiens
gcccaccctgctgctggtgcac

SEQ ID NO: 5011026 - DNA, 20 bp, Homo sapiens
gcccacctgctcccaggccc

SEQ ID NO: 5011027 - DNA, 20 bp, Homo sapiens
gcccagtgcatggtggccag

SEQ ID NO: 5011028 - DNA, 13 bp, Homo sapiens
gcccatccttccc

SEQ ID NO: 5011029 - DNA, 16 bp, Homo sapiens
gcccccagtgcctcac

SEQ ID NO: 5011030 - DNA, 20 bp, Homo sapiens
gcccccagtgcctcaccttc

SEQ ID NO: 5011031 - DNA, 14 bp, Homo sapiens
gcccgcgcagctgc

SEQ ID NO: 5011032 - DNA, 22 bp, Homo sapiens
gcccggagcagcagcttctcca

SEQ ID NO: 5011033 - DNA, 14 bp, Homo sapiens
gccctaagggagtg

SEQ ID NO: 5011034 - DNA, 20 bp, Homo sapiens
gccctcgcctcctcctcctg

SEQ ID NO: 5011035 - DNA, 17 bp, Homo sapiens
gccctgagtctgggcag

SEQ ID NO: 5011036 - DNA, 14 bp, Homo sapiens
gccgatagagggac

SEQ ID NO: 5011037 - DNA, 21 bp, Homo sapiens
gccgatagagggacggccaag

SEQ ID NO: 5011038 - DNA, 16 bp, Homo sapiens
gccgctacctccctcc

SEQ ID NO: 5011039 - DNA, 15 bp, Homo sapiens
gccggccctgtgtgc

SEQ ID NO: 5011040 - DNA, 20 bp, Homo sapiens
gccggggctctgggtgctgc

SEQ ID NO: 5011041 - DNA, 23 bp, Homo sapiens
gccggggctctgggtgctgccct

SEQ ID NO: 5011042 - DNA, 24 bp, Homo sapiens
gccggggctctgggtgctgccctg

SEQ ID NO: 5011043 - DNA, 22 bp, Homo sapiens
gcctagtttcttacacactgtc

SEQ ID NO: 5011044 - DNA, 14 bp, Homo sapiens
gcctcaccttccaa

SEQ ID NO: 5011045 - DNA, 17 bp, Homo sapiens
gcctccaggtgcagagg

SEQ ID NO: 5011046 - DNA, 17 bp, Homo sapiens
gcctccccacctccagg

SEQ ID NO: 5011047 - DNA, 18 bp, Homo sapiens
gcctccccacctccaggc

SEQ ID NO: 5011048 - DNA, 18 bp, Homo sapiens
gcctcctcctcctgccct

SEQ ID NO: 5011049 - DNA, 15 bp, Homo sapiens
gcctgcagggaagcc

SEQ ID NO: 5011050 - DNA, 22 bp, Homo sapiens
gcctgcagggaagccccacatg

SEQ ID NO: 5011051 - DNA, 14 bp, Homo sapiens
gcctgcagggccat

SEQ ID NO: 5011052 - DNA, 15 bp, Homo sapiens
gcctgcgaccctggg

SEQ ID NO: 5011053 - DNA, 16 bp, Homo sapiens
gcctgcgaccctgggg

SEQ ID NO: 5011054 - DNA, 21 bp, Homo sapiens
gcctgcgtccgtttcgcgctg

SEQ ID NO: 5011055 - DNA, 20 bp, Homo sapiens
gcctgggtgatctgctgctg

SEQ ID NO: 5011056 - DNA, 21 bp, Homo sapiens
gcctgggtgatctgctgctga

SEQ ID NO: 5011057 - DNA, 10 bp, Homo sapiens
gccttctgct

SEQ ID NO: 5011058 - DNA, 13 bp, Homo sapiens
gcgcagctgccta

SEQ ID NO: 5011059 - DNA, 13 bp, Homo sapiens
gcgcctgcgtccg

SEQ ID NO: 5011060 - DNA, 16 bp, Homo sapiens
gcggcccgcgcagctg

SEQ ID NO: 5011061 - DNA, 20 bp, Homo sapiens
gcggcccgcgcagctgccta

SEQ ID NO: 5011062 - DNA, 17 bp, Homo sapiens
gcgtggagggaggcccc

SEQ ID NO: 5011063 - DNA, 20 bp, Homo sapiens
gcgtggagggaggccccagg

SEQ ID NO: 5011064 - DNA, 17 bp, Homo sapiens
gcgtgtgcctgtgtgcg

SEQ ID NO: 5011065 - DNA, 14 bp, Homo sapiens
gctacagaaaccac

SEQ ID NO: 5011066 - DNA, 14 bp, Homo sapiens
gctacctccctccc

SEQ ID NO: 5011067 - DNA, 17 bp, Homo sapiens
gctccgtagctctgctg

SEQ ID NO: 5011068 - DNA, 17 bp, Homo sapiens
gctgacatgaagctgtt

SEQ ID NO: 5011069 - DNA, 23 bp, Homo sapiens
gctgagacgccacggagggctgg

SEQ ID NO: 5011070 - DNA, 16 bp, Homo sapiens
gctgagcctgcaggga

SEQ ID NO: 5011071 - DNA, 19 bp, Homo sapiens
gctgatactgggtctgcga

SEQ ID NO: 5011072 - DNA, 18 bp, Homo sapiens
gctgatcatcgccagagg

SEQ ID NO: 5011073 - DNA, 13 bp, Homo sapiens
gctgcccctctca

SEQ ID NO: 5011074 - DNA, 15 bp, Homo sapiens
gctgccctgcgccct

SEQ ID NO: 5011075 - DNA, 15 bp, Homo sapiens
gctgctggtgcacag

SEQ ID NO: 5011076 - DNA, 19 bp, Homo sapiens
gctgggccatgtccaaaga

SEQ ID NO: 5011077 - DNA, 20 bp, Homo sapiens
gctgggccatgtccaaagag

SEQ ID NO: 5011078 - DNA, 20 bp, Homo sapiens
gctgggcccgacatggctcc

SEQ ID NO: 5011079 - DNA, 22 bp, Homo sapiens
gctgggcccgacatggctccgg

SEQ ID NO: 5011080 - DNA, 17 bp, Homo sapiens
gctggtacaacggaggc

SEQ ID NO: 5011081 - DNA, 20 bp, Homo sapiens
gctggtgcacagccactccc

SEQ ID NO: 5011082 - DNA, 14 bp, Homo sapiens
gctgtatttttatt

SEQ ID NO: 5011083 - DNA, 17 bp, Homo sapiens
gctgtatttttattttt

SEQ ID NO: 5011084 - DNA, 23 bp, Homo sapiens
gctgtgtgtcccaggcagggaga

SEQ ID NO: 5011085 - DNA, 18 bp, Homo sapiens
gcttatttttaatttggg

SEQ ID NO: 5011086 - DNA, 17 bp, Homo sapiens
gcttcatcattccctct

SEQ ID NO: 5011087 - DNA, 18 bp, Homo sapiens
gcttcttactgataattt

SEQ ID NO: 5011088 - DNA, 17 bp, Homo sapiens
gcttgactcccaagttt

SEQ ID NO: 5011089 - DNA, 17 bp, Homo sapiens
gcttgcctgcagggcca

SEQ ID NO: 5011090 - DNA, 15 bp, Homo sapiens
gcttggccctttcct

SEQ ID NO: 5011091 - DNA, 23 bp, Homo sapiens
ggaaacgctacctctctgtccct

SEQ ID NO: 5011092 - DNA, 17 bp, Homo sapiens
ggaacagcactggggag

SEQ ID NO: 5011093 - DNA, 22 bp, Homo sapiens
ggaacctgtcctaaggaacctt

SEQ ID NO: 5011094 - DNA, 19 bp, Homo sapiens
ggaaccttccttcctgctt

SEQ ID NO: 5011095 - DNA, 21 bp, Homo sapiens
ggaaccttccttcctgcttga

SEQ ID NO: 5011096 - DNA, 21 bp, Homo sapiens
ggaagcggccctaagggagtg

SEQ ID NO: 5011097 - DNA, 12 bp, Homo sapiens
ggaaggcctgac

SEQ ID NO: 5011098 - DNA, 20 bp, Homo sapiens
ggaaggcctgacttctgctg

SEQ ID NO: 5011099 - DNA, 14 bp, Homo sapiens
ggaatcctcctcca

SEQ ID NO: 5011100 - DNA, 16 bp, Homo sapiens
ggaatcctcctccagg

SEQ ID NO: 5011101 - DNA, 17 bp, Homo sapiens
ggacatagaatctgtga

SEQ ID NO: 5011102 - DNA, 13 bp, Homo sapiens
ggacccagtgcag

SEQ ID NO: 5011103 - DNA, 16 bp, Homo sapiens
ggacccagtgcagaat

SEQ ID NO: 5011104 - DNA, 12 bp, Homo sapiens
ggacggccaaga

SEQ ID NO: 5011105 - DNA, 17 bp, Homo sapiens
ggacggccaagaatgta

SEQ ID NO: 5011106 - DNA, 11 bp, Homo sapiens
ggactccatct

SEQ ID NO: 5011107 - DNA, 22 bp, Homo sapiens
ggactgctacctttcaaagctt

SEQ ID NO: 5011108 - DNA, 19 bp, Homo sapiens
ggacttcaaagcaagctgg

SEQ ID NO: 5011109 - DNA, 20 bp, Homo sapiens
ggagagggacatagaatctg

SEQ ID NO: 5011110 - DNA, 13 bp, Homo sapiens
ggagcagggaagg

SEQ ID NO: 5011111 - DNA, 19 bp, Homo sapiens
ggagcagggaaggcctgac

SEQ ID NO: 5011112 - DNA, 15 bp, Homo sapiens
ggaggccccaggggg

SEQ ID NO: 5011113 - DNA, 19 bp, Homo sapiens
ggaggcctgcgaccctggg

SEQ ID NO: 5011114 - DNA, 11 bp, Homo sapiens
ggagggaggcc

SEQ ID NO: 5011115 - DNA, 13 bp, Homo sapiens
ggagggaggcccc

SEQ ID NO: 5011116 - DNA, 22 bp, Homo sapiens
ggaggtccctggtcggagaggg

SEQ ID NO: 5011117 - DNA, 17 bp, Homo sapiens
ggaggtgattccagtga

SEQ ID NO: 5011118 - DNA, 15 bp, Homo sapiens
ggagtcagccaggag

SEQ ID NO: 5011119 - DNA, 20 bp, Homo sapiens
ggattctgaggccctgccca

SEQ ID NO: 5011120 - DNA, 21 bp, Homo sapiens
ggattctgaggccctgcccaa

SEQ ID NO: 5011121 - DNA, 18 bp, Homo sapiens
ggattttttactgccctt

SEQ ID NO: 5011122 - DNA, 14 bp, Homo sapiens
gtctgccttctgct

SEQ ID NO: 5011123 - DNA, 16 bp, Homo sapiens
gtctgccttctgctga

SEQ ID NO: 5011124 - DNA, 22 bp, Homo sapiens
gtctgcgatgcagcggcgtgag

SEQ ID NO: 5011125 - DNA, 20 bp, Homo sapiens
gtctgtatttggtatatact

SEQ ID NO: 5011126 - DNA, 21 bp, Homo sapiens
gtgaacgtccacatgaaacct

SEQ ID NO: 5011127 - DNA, 19 bp, Homo sapiens
gtgacttaaaaaatcagaa

SEQ ID NO: 5011128 - DNA, 12 bp, Homo sapiens
gtgagtgccttt

SEQ ID NO: 5011129 - DNA, 17 bp, Homo sapiens
gtgagtgccttttgcag

SEQ ID NO: 5011130 - DNA, 22 bp, Homo sapiens
gtgcagaatgtaagtgggccca

SEQ ID NO: 5011131 - DNA, 15 bp, Homo sapiens
gtgcagaggtaccct

SEQ ID NO: 5011132 - DNA, 15 bp, Homo sapiens
gtgcagctcatgttt

SEQ ID NO: 5011133 - DNA, 16 bp, Homo sapiens
gtgcatggtggccaga

SEQ ID NO: 5011134 - DNA, 18 bp, Homo sapiens
gtgccctcgcctcctcct

SEQ ID NO: 5011135 - DNA, 21 bp, Homo sapiens
gtgccttttgcagaagagggt

SEQ ID NO: 5011136 - DNA, 23 bp, Homo sapiens
gtgccttttgcagaagagggtgt

SEQ ID NO: 5011137 - DNA, 18 bp, Homo sapiens
gtgcgcatcttgcctcca

SEQ ID NO: 5011138 - DNA, 20 bp, Homo sapiens
gtgctccgtagctctgctgc

SEQ ID NO: 5011139 - DNA, 15 bp, Homo sapiens
gtggagggaggcccc

SEQ ID NO: 5011140 - DNA, 14 bp, Homo sapiens
gtggggcagggagc

SEQ ID NO: 5011141 - DNA, 20 bp, Homo sapiens
gtggtctcttcttggggccc

SEQ ID NO: 5011142 - DNA, 21 bp, Homo sapiens
gtggtctcttcttggggccca

SEQ ID NO: 5011143 - DNA, 21 bp, Homo sapiens
gtgtatttaaaaaaaagaaac

SEQ ID NO: 5011144 - DNA, 19 bp, Homo sapiens
gtgtatttcttatacgctt

SEQ ID NO: 5011145 - DNA, 19 bp, Homo sapiens
gtgtcacccaaaccggcag

SEQ ID NO: 5011146 - DNA, 14 bp, Homo sapiens
gtgtgtcccaggca

SEQ ID NO: 5011147 - DNA, 14 bp, Homo sapiens
gtgttagtggcacc

SEQ ID NO: 5011148 - DNA, 20 bp, Homo sapiens
gtgttccagtgtctgtctga

SEQ ID NO: 5011149 - DNA, 14 bp, Homo sapiens
gtgtttgtttttgc

SEQ ID NO: 5011150 - DNA, 17 bp, Homo sapiens
gtgtttgtttttgcaca

SEQ ID NO: 5011151 - DNA, 13 bp, Homo sapiens
gttacagagacct

SEQ ID NO: 5011152 - DNA, 17 bp, Homo sapiens
gttactgggccctgagt

SEQ ID NO: 5011153 - DNA, 13 bp, Homo sapiens
gttattagatgtt

SEQ ID NO: 5011154 - DNA, 14 bp, Homo sapiens
gttcaaaaagatat

SEQ ID NO: 5011155 - DNA, 23 bp, Homo sapiens
gttcagtctgaatgctgccacaa

SEQ ID NO: 5011156 - DNA, 13 bp, Homo sapiens
gttccctgctgcg

SEQ ID NO: 5011157 - DNA, 19 bp, Homo sapiens
gttccctgctgcgctgctt

SEQ ID NO: 5011158 - DNA, 14 bp, Homo sapiens
gttctcatgactcc

SEQ ID NO: 5011159 - DNA, 14 bp, Homo sapiens
gttctggggggacc

SEQ ID NO: 5011160 - DNA, 19 bp, Homo sapiens
gttgacacagttgtagggt

SEQ ID NO: 5011161 - DNA, 20 bp, Homo sapiens
gttgctctaggaagacattt

SEQ ID NO: 5011162 - DNA, 20 bp, Homo sapiens
gttggttaaataaacttttt

SEQ ID NO: 5011163 - DNA, 20 bp, Homo sapiens
gttgtattgatttttaagaa

SEQ ID NO: 5011164 - DNA, 23 bp, Homo sapiens
gttgtattgatttttaagaaagt

SEQ ID NO: 5011165 - DNA, 13 bp, Homo sapiens
gtttccatttgtg

SEQ ID NO: 5011166 - DNA, 14 bp, Homo sapiens
gtttcttacacact

SEQ ID NO: 5011167 - DNA, 15 bp, Homo sapiens
gtttggcaaggaaag

SEQ ID NO: 5011168 - DNA, 23 bp, Homo sapiens
gtttgtttcatatatacaggcat

SEQ ID NO: 5011169 - DNA, 14 bp, Homo sapiens
gttttatgctactg

SEQ ID NO: 5011170 - DNA, 18 bp, Homo sapiens
gttttatgctactgaact

SEQ ID NO: 5011171 - DNA, 19 bp, Homo sapiens
gttttccatgatttagcaa

SEQ ID NO: 5011172 - DNA, 16 bp, Homo sapiens
gttttggactccatct

SEQ ID NO: 5011173 - DNA, 15 bp, Homo sapiens
gtttttgacagcctt

SEQ ID NO: 5011174 - DNA, 14 bp, Homo sapiens
taaaaaaaagaaac

SEQ ID NO: 5011175 - DNA, 20 bp, Homo sapiens
taaaaacacaaaaaaaattt

SEQ ID NO: 5011176 - DNA, 14 bp, Homo sapiens
taaaaacttttgag

SEQ ID NO: 5011177 - DNA, 16 bp, Homo sapiens
taaaaacttttgagga

SEQ ID NO: 5011178 - DNA, 13 bp, Homo sapiens
taaaacttctgct

SEQ ID NO: 5011179 - DNA, 14 bp, Homo sapiens
taaaacttctgctc

SEQ ID NO: 5011180 - DNA, 14 bp, Homo sapiens
taaaagcattgttt

SEQ ID NO: 5011181 - DNA, 21 bp, Homo sapiens
taaaatcttctgatgagttct

SEQ ID NO: 5011182 - DNA, 21 bp, Homo sapiens
taaagacccagggggagaatg

SEQ ID NO: 5011183 - DNA, 15 bp, Homo sapiens
taaattgtgtattta

SEQ ID NO: 5011184 - DNA, 13 bp, Homo sapiens
taacgatgttgta

SEQ ID NO: 5011185 - DNA, 14 bp, Homo sapiens
taacgatgttgtat

SEQ ID NO: 5011186 - DNA, 18 bp, Homo sapiens
taacgtgttccagtgtct

SEQ ID NO: 5011187 - DNA, 24 bp, Homo sapiens
taacgtgttccagtgtctgtctga

SEQ ID NO: 5011188 - DNA, 12 bp, Homo sapiens
taactctgagag

SEQ ID NO: 5011189 - DNA, 16 bp, Homo sapiens
taactctgagagctgt

SEQ ID NO: 5011190 - DNA, 15 bp, Homo sapiens
taagtgggcccaccc

SEQ ID NO: 5011191 - DNA, 20 bp, Homo sapiens
taataaaatcttctgatgag

SEQ ID NO: 5011192 - DNA, 17 bp, Homo sapiens
taatgcagttgcttact

SEQ ID NO: 5011193 - DNA, 14 bp, Homo sapiens
taattgctgtgtgt

SEQ ID NO: 5011194 - DNA, 22 bp, Homo sapiens
taattgctgtgtgtcccaggca

SEQ ID NO: 5011195 - DNA, 21 bp, Homo sapiens
taatttgggaaaataaataca

SEQ ID NO: 5011196 - DNA, 21 bp, Homo sapiens
taatttgtaaaacttctgctc

SEQ ID NO: 5011197 - DNA, 21 bp, Homo sapiens
tacaaagaggtgtacaggtac

SEQ ID NO: 5011198 - DNA, 17 bp, Homo sapiens
tacaagtttatatatat

SEQ ID NO: 5011199 - DNA, 20 bp, Homo sapiens
tacacactgtcatgcttcat

SEQ ID NO: 5011200 - DNA, 22 bp, Homo sapiens
tacattcgaaggaacctgtgtt

SEQ ID NO: 5011201 - DNA, 17 bp, Homo sapiens
taccagtgacgctgctg

SEQ ID NO: 5011202 - DNA, 18 bp, Homo sapiens
tacccacatgtacagaca

SEQ ID NO: 5011203 - DNA, 12 bp, Homo sapiens
taccctgggtgt

SEQ ID NO: 5011204 - DNA, 13 bp, Homo sapiens
tacctcctctcag

SEQ ID NO: 5011205 - DNA, 17 bp, Homo sapiens
tacctcctctcagtgtt

SEQ ID NO: 5011206 - DNA, 15 bp, Homo sapiens
tacctctctgtccct

SEQ ID NO: 5011207 - DNA, 12 bp, Homo sapiens
tacgcttttctt

SEQ ID NO: 5011208 - DNA, 17 bp, Homo sapiens
tacgcttttctttgtta

SEQ ID NO: 5011209 - DNA, 14 bp, Homo sapiens
tactgaactgaaag

SEQ ID NO: 5011210 - DNA, 13 bp, Homo sapiens
tactgcaaagtgt

SEQ ID NO: 5011211 - DNA, 12 bp, Homo sapiens
tactgccctttc

SEQ ID NO: 5011212 - DNA, 13 bp, Homo sapiens
tactgttactggg

SEQ ID NO: 5011213 - DNA, 15 bp, Homo sapiens
tactttgtgcattct

SEQ ID NO: 5011214 - DNA, 19 bp, Homo sapiens
tagaatctgtgacctctga

SEQ ID NO: 5011215 - DNA, 22 bp, Homo sapiens
tagagggacggccaagaatgta

SEQ ID NO: 5011216 - DNA, 23 bp, Homo sapiens
tagcaatctgcctgtatctctca

SEQ ID NO: 5011217 - DNA, 12 bp, Homo sapiens
tagcagatggtt

SEQ ID NO: 5011218 - DNA, 15 bp, Homo sapiens
tagcagcccaccctg

SEQ ID NO: 5011219 - DNA, 21 bp, Homo sapiens
tagcagcccaccctgctgctg

SEQ ID NO: 5011220 - DNA, 16 bp, Homo sapiens
tagccagtgctccagg

SEQ ID NO: 5011221 - DNA, 18 bp, Homo sapiens
tagcctcaattctccatt

SEQ ID NO: 5011222 - DNA, 14 bp, Homo sapiens
tagcctggactgct

SEQ ID NO: 5011223 - DNA, 17 bp, Homo sapiens
tagctcttcccactttt

SEQ ID NO: 5011224 - DNA, 17 bp, Homo sapiens
tagtctagcattctgca

SEQ ID NO: 5011225 - DNA, 19 bp, Homo sapiens
tagtgatcaaattgtgcag

SEQ ID NO: 5011226 - DNA, 23 bp, Homo sapiens
tagtgtacatttctataaataga

SEQ ID NO: 5011227 - DNA, 15 bp, Homo sapiens
tagtttttatatgtt

SEQ ID NO: 5011228 - DNA, 17 bp, Homo sapiens
tataaattgtgtattta

SEQ ID NO: 5011229 - DNA, 15 bp, Homo sapiens
tatactttgccactg

SEQ ID NO: 5011230 - DNA, 16 bp, Homo sapiens
tatactttgccactgc

SEQ ID NO: 5011231 - DNA, 15 bp, Homo sapiens
tatatcatatgtata

SEQ ID NO: 5011232 - DNA, 18 bp, Homo sapiens
tatatggtatatatacat

SEQ ID NO: 5011233 - DNA, 15 bp, Homo sapiens
tatatttgtaaagct

SEQ ID NO: 5011234 - DNA, 17 bp, Homo sapiens
tatatttgtaggagaaa

SEQ ID NO: 5011235 - DNA, 18 bp, Homo sapiens
tatccaaaatgtgtattt

SEQ ID NO: 5011236 - DNA, 20 bp, Homo sapiens
tatccaaatctgaagattgc

SEQ ID NO: 5011237 - DNA, 16 bp, Homo sapiens
tatctcttttatattt

SEQ ID NO: 5011238 - DNA, 17 bp, Homo sapiens
tatgatcagtgttgttg

SEQ ID NO: 5011239 - DNA, 17 bp, Homo sapiens
tatgatttataaacaga

SEQ ID NO: 5011240 - DNA, 16 bp, Homo sapiens
tatgcattatatcaaa

SEQ ID NO: 5011241 - DNA, 20 bp, Homo sapiens
tatgctgatcatcgccagag

SEQ ID NO: 5011242 - DNA, 21 bp, Homo sapiens
tatgtaagaattcagaagacc

SEQ ID NO: 5011243 - DNA, 15 bp, Homo sapiens
tattaatactggtat

SEQ ID NO: 5011244 - DNA, 12 bp, Homo sapiens
tattatccagag

SEQ ID NO: 5011245 - DNA, 16 bp, Homo sapiens
tattgatttttaagaa

SEQ ID NO: 5011246 - DNA, 17 bp, Homo sapiens
tattgttcaaaaagata

SEQ ID NO: 5011247 - DNA, 17 bp, Homo sapiens
tatttaaaaaaaagaaa

SEQ ID NO: 5011248 - DNA, 23 bp, Homo sapiens
tatttctcatctgcactatgttt

SEQ ID NO: 5011249 - DNA, 17 bp, Homo sapiens
tatttgaggtcagtgtt

SEQ ID NO: 5011250 - DNA, 13 bp, Homo sapiens
tatttgtaaagct

SEQ ID NO: 5011251 - DNA, 14 bp, Homo sapiens
tatttttatttttg

SEQ ID NO: 5011252 - DNA, 18 bp, Homo sapiens
tcaaagcacttaagtgtt

SEQ ID NO: 5011253 - DNA, 18 bp, Homo sapiens
tcacaacccttctctgtt

SEQ ID NO: 5011254 - DNA, 12 bp, Homo sapiens
tcacagggtggg

SEQ ID NO: 5011255 - DNA, 16 bp, Homo sapiens
tcacagggtgggcctc

SEQ ID NO: 5011256 - DNA, 19 bp, Homo sapiens
tcactattatctaaaagaa

SEQ ID NO: 5011257 - DNA, 15 bp, Homo sapiens
tcagaacaaaacttc

SEQ ID NO: 5011258 - DNA, 18 bp, Homo sapiens
tcagtgttgttgctctag

SEQ ID NO: 5011259 - DNA, 15 bp, Homo sapiens
tcatcattccctctc

SEQ ID NO: 5011260 - DNA, 14 bp, Homo sapiens
tcatcgccagaggt

SEQ ID NO: 5011261 - DNA, 22 bp, Homo sapiens
tcatcggagtcagccaggagct

SEQ ID NO: 5011262 - DNA, 15 bp, Homo sapiens
tcatgtttttaactt

SEQ ID NO: 5011263 - DNA, 18 bp, Homo sapiens
tcattccctctcatctca

SEQ ID NO: 5011264 - DNA, 16 bp, Homo sapiens
tcattccgttgtctgt

SEQ ID NO: 5011265 - DNA, 21 bp, Homo sapiens
tcatttgtggcagtcccttat

SEQ ID NO: 5011266 - DNA, 13 bp, Homo sapiens
tccaaagaggctg

SEQ ID NO: 5011267 - DNA, 15 bp, Homo sapiens
tccaaagaggctgcc

SEQ ID NO: 5011268 - DNA, 16 bp, Homo sapiens
tccaactgcaggaaaa

SEQ ID NO: 5011269 - DNA, 23 bp, Homo sapiens
tccacagagagggagagcagaga

SEQ ID NO: 5011270 - DNA, 18 bp, Homo sapiens
tccactgttagcacattg

SEQ ID NO: 5011271 - DNA, 18 bp, Homo sapiens
tccagcaccttgtgcctg

SEQ ID NO: 5011272 - DNA, 19 bp, Homo sapiens
tccagcaccttgtgcctgg

SEQ ID NO: 5011273 - DNA, 21 bp, Homo sapiens
tccagcatttagctggccaca

SEQ ID NO: 5011274 - DNA, 18 bp, Homo sapiens
tccaggctttcccacttc

SEQ ID NO: 5011275 - DNA, 11 bp, Homo sapiens
tccagggaggg

SEQ ID NO: 5011276 - DNA, 14 bp, Homo sapiens
tccaggggaacctg

SEQ ID NO: 5011277 - DNA, 22 bp, Homo sapiens
tccagtaccttgcttcttactg

SEQ ID NO: 5011278 - DNA, 13 bp, Homo sapiens
tccatcctgcaga

SEQ ID NO: 5011279 - DNA, 14 bp, Homo sapiens
tccatctctcatcc

SEQ ID NO: 5011280 - DNA, 18 bp, Homo sapiens
tccatctctcatcctcca

SEQ ID NO: 5011281 - DNA, 16 bp, Homo sapiens
tccatgatttagcaag

SEQ ID NO: 5011282 - DNA, 20 bp, Homo sapiens
tccatgatttagcaagcaac

SEQ ID NO: 5011283 - DNA, 17 bp, Homo sapiens
tcccaagctgattttat

SEQ ID NO: 5011284 - DNA, 19 bp, Homo sapiens
tcccaagtttccatagcaa

SEQ ID NO: 5011285 - DNA, 18 bp, Homo sapiens
tcccactgtatgatttat

SEQ ID NO: 5011286 - DNA, 15 bp, Homo sapiens
tcccagcgctgctgg

SEQ ID NO: 5011287 - DNA, 13 bp, Homo sapiens
tccccagcccacc

SEQ ID NO: 5011288 - DNA, 16 bp, Homo sapiens
tccccagcccacctgc

SEQ ID NO: 5011289 - DNA, 23 bp, Homo sapiens
tccccagcccacctgctcccagg

SEQ ID NO: 5011290 - DNA, 16 bp, Homo sapiens
tccccgctgctgtgca

SEQ ID NO: 5011291 - DNA, 15 bp, Homo sapiens
tccctagcagcccac

SEQ ID NO: 5011292 - DNA, 17 bp, Homo sapiens
tccctagcagcccaccc

SEQ ID NO: 5011293 - DNA, 18 bp, Homo sapiens
tccctataataaaggctg

SEQ ID NO: 5011294 - DNA, 20 bp, Homo sapiens
tccctataataaaggctgag

SEQ ID NO: 5011295 - DNA, 14 bp, Homo sapiens
tccctctcatctca

SEQ ID NO: 5011296 - DNA, 18 bp, Homo sapiens
tccctctccttgccccca

SEQ ID NO: 5011297 - DNA, 24 bp, Homo sapiens
tccctctccttgcccccagtgcct

SEQ ID NO: 5011298 - DNA, 15 bp, Homo sapiens
tccctgctgcgctgc

SEQ ID NO: 5011299 - DNA, 16 bp, Homo sapiens
tccctggtcggagagg

SEQ ID NO: 5011300 - DNA, 17 bp, Homo sapiens
tcccttcccagcgctgc

SEQ ID NO: 5011301 - DNA, 20 bp, Homo sapiens
tcccttgcttgcctgcaggg

SEQ ID NO: 5011302 - DNA, 21 bp, Homo sapiens
tcccttgcttgcctgcagggc

SEQ ID NO: 5011303 - DNA, 14 bp, Homo sapiens
tccgcgtgtgcctg

SEQ ID NO: 5011304 - DNA, 21 bp, Homo sapiens
tccggcttgacctgtttctct

SEQ ID NO: 5011305 - DNA, 14 bp, Homo sapiens
tccgtagctctgct

SEQ ID NO: 5011306 - DNA, 16 bp, Homo sapiens
tccgtagctctgctgc

SEQ ID NO: 5011307 - DNA, 16 bp, Homo sapiens
tccgttcacatgtgtg

SEQ ID NO: 5011308 - DNA, 21 bp, Homo sapiens
tcctcagggagcagggaaggc

SEQ ID NO: 5011309 - DNA, 14 bp, Homo sapiens
tcctcctccagggt

SEQ ID NO: 5011310 - DNA, 13 bp, Homo sapiens
tcctcctcctgcc

SEQ ID NO: 5011311 - DNA, 14 bp, Homo sapiens
tcctcctgccctcc

SEQ ID NO: 5011312 - DNA, 16 bp, Homo sapiens
tcctctcaccccactc

SEQ ID NO: 5011313 - DNA, 14 bp, Homo sapiens
tcctctcagtgttt

SEQ ID NO: 5011314 - DNA, 11 bp, Homo sapiens
tcctctcccct

SEQ ID NO: 5011315 - DNA, 18 bp, Homo sapiens
tcctgacgtctgaagctt

SEQ ID NO: 5011316 - DNA, 14 bp, Homo sapiens
tcctgactggtgct

SEQ ID NO: 5011317 - DNA, 23 bp, Homo sapiens
tcctggtttcataacttcctgta

SEQ ID NO: 5011318 - DNA, 18 bp, Homo sapiens
tcgaacttcacaactagg

SEQ ID NO: 5011319 - DNA, 17 bp, Homo sapiens
tctaaaagcagaaaata

SEQ ID NO: 5011320 - DNA, 15 bp, Homo sapiens
tctaggaagacattt

SEQ ID NO: 5011321 - DNA, 18 bp, Homo sapiens
tctatccaaatctgaaga

SEQ ID NO: 5011322 - DNA, 14 bp, Homo sapiens
tctattatccagag

SEQ ID NO: 5011323 - DNA, 16 bp, Homo sapiens
tgtttgaaatcatcgg

SEQ ID NO: 5011324 - DNA, 19 bp, Homo sapiens
tgttttggactccatctct

SEQ ID NO: 5011325 - DNA, 19 bp, Homo sapiens
tgtttttaacatgtcaatc

SEQ ID NO: 5011326 - DNA, 18 bp, Homo sapiens
ttaaaaaaaagaaacttt

SEQ ID NO: 5011327 - DNA, 22 bp, Homo sapiens
ttaaaaaatcagaacaaaactt

SEQ ID NO: 5011328 - DNA, 16 bp, Homo sapiens
ttaaaactggacctgt

SEQ ID NO: 5011329 - DNA, 13 bp, Homo sapiens
ttaaaatctgttc

SEQ ID NO: 5011330 - DNA, 16 bp, Homo sapiens
ttaagaaagtaattta

SEQ ID NO: 5011331 - DNA, 21 bp, Homo sapiens
ttaagaaagtaatttaatttg

SEQ ID NO: 5011332 - DNA, 21 bp, Homo sapiens
ttaatttgtaaaacttctgct

SEQ ID NO: 5011333 - DNA, 22 bp, Homo sapiens
ttaatttgtaaaacttctgctc

SEQ ID NO: 5011334 - DNA, 14 bp, Homo sapiens
ttacactgccatct

SEQ ID NO: 5011335 - DNA, 21 bp, Homo sapiens
ttactgccctttcaaagcact

SEQ ID NO: 5011336 - DNA, 12 bp, Homo sapiens
ttagtggcaccg

SEQ ID NO: 5011337 - DNA, 13 bp, Homo sapiens
ttagtggcaccgc

SEQ ID NO: 5011338 - DNA, 20 bp, Homo sapiens
ttatacagatagagttccat

SEQ ID NO: 5011339 - DNA, 20 bp, Homo sapiens
ttatagcctggactgctacc

SEQ ID NO: 5011340 - DNA, 16 bp, Homo sapiens
ttatccaaaatgtgta

SEQ ID NO: 5011341 - DNA, 21 bp, Homo sapiens
ttatccaaaatgtgtatttct

SEQ ID NO: 5011342 - DNA, 19 bp, Homo sapiens
ttatctcttttatatttgt

SEQ ID NO: 5011343 - DNA, 15 bp, Homo sapiens
ttatgatcagtgttg

SEQ ID NO: 5011344 - DNA, 15 bp, Homo sapiens
ttatgggcccctggc

SEQ ID NO: 5011345 - DNA, 22 bp, Homo sapiens
ttattcctctcaccccactcct

SEQ ID NO: 5011346 - DNA, 20 bp, Homo sapiens
ttatttttgcacaacttttg

SEQ ID NO: 5011347 - DNA, 14 bp, Homo sapiens
ttcaaaaagatatt

SEQ ID NO: 5011348 - DNA, 11 bp, Homo sapiens
ttcaaagcact

SEQ ID NO: 5011349 - DNA, 19 bp, Homo sapiens
ttcaaagcacttaagtgtt

SEQ ID NO: 5011350 - DNA, 22 bp, Homo sapiens
ttcaccaccaaatgccaagaaa

SEQ ID NO: 5011351 - DNA, 20 bp, Homo sapiens
ttcagtctgaatgctgccac

SEQ ID NO: 5011352 - DNA, 15 bp, Homo sapiens
ttccaatgcttctgt

SEQ ID NO: 5011353 - DNA, 21 bp, Homo sapiens
ttccagcatttagctggccac

SEQ ID NO: 5011354 - DNA, 15 bp, Homo sapiens
ttccagggaggggcc

SEQ ID NO: 5011355 - DNA, 21 bp, Homo sapiens
ttccatgatttagcaagcaac

SEQ ID NO: 5011356 - DNA, 22 bp, Homo sapiens
ttccatgatttagcaagcaact

SEQ ID NO: 5011357 - DNA, 17 bp, Homo sapiens
ttccctttggagatgct

SEQ ID NO: 5011358 - DNA, 22 bp, Homo sapiens
ttcctaacttttcaatgacatt

SEQ ID NO: 5011359 - DNA, 18 bp, Homo sapiens
ttcgaaggaacctgtgtt

SEQ ID NO: 5011360 - DNA, 16 bp, Homo sapiens
ttcgtgtactgcaaag

SEQ ID NO: 5011361 - DNA, 22 bp, Homo sapiens
ttctcaaagagaattgtatgta

SEQ ID NO: 5011362 - DNA, 19 bp, Homo sapiens
ttctctgttggtctgcctt

SEQ ID NO: 5011363 - DNA, 17 bp, Homo sapiens
ttctgctggcatcaaga

SEQ ID NO: 5011364 - DNA, 17 bp, Homo sapiens
ttctggggcaggctggg

SEQ ID NO: 5011365 - DNA, 15 bp, Homo sapiens
ttctgtactgttact

SEQ ID NO: 5011366 - DNA, 18 bp, Homo sapiens
ttcttacacactgtctgt

SEQ ID NO: 5011367 - DNA, 20 bp, Homo sapiens
ttcttactgataattttgct

SEQ ID NO: 5011368 - DNA, 16 bp, Homo sapiens
ttcttatacgcttttc

SEQ ID NO: 5011369 - DNA, 20 bp, Homo sapiens
ttcttctgtcctgagaagca

SEQ ID NO: 5011370 - DNA, 17 bp, Homo sapiens
ttcttggggcccagtgc

SEQ ID NO: 5011371 - DNA, 18 bp, Homo sapiens
ttcttggggcccagtgca

SEQ ID NO: 5011372 - DNA, 14 bp, Homo sapiens
ttgaagtgcagctc

SEQ ID NO: 5011373 - DNA, 15 bp, Homo sapiens
ttgaagtgcagctca

SEQ ID NO: 5011374 - DNA, 12 bp, Homo sapiens
ttgacagccttc

SEQ ID NO: 5011375 - DNA, 14 bp, Homo sapiens
ttgatttttaagaa

SEQ ID NO: 5011376 - DNA, 21 bp, Homo sapiens
ttgatttttaagaaagtaatt

SEQ ID NO: 5011377 - DNA, 19 bp, Homo sapiens
ttgcacaccattttgtaaa

SEQ ID NO: 5011378 - DNA, 15 bp, Homo sapiens
ttgcagaagagggtg

SEQ ID NO: 5011379 - DNA, 14 bp, Homo sapiens
ttgccactgctgta

SEQ ID NO: 5011380 - DNA, 15 bp, Homo sapiens
ttgcccccagtgcct

SEQ ID NO: 5011381 - DNA, 21 bp, Homo sapiens
ttgctgtatgctgatcatcgc

SEQ ID NO: 5011382 - DNA, 20 bp, Homo sapiens
ttgctgtgtgtcccaggcag

SEQ ID NO: 5011383 - DNA, 18 bp, Homo sapiens
ttgcttcttactgataat

SEQ ID NO: 5011384 - DNA, 19 bp, Homo sapiens
ttgcttgcctgcagggcca

SEQ ID NO: 5011385 - DNA, 11 bp, Homo sapiens
ttggaaagact

SEQ ID NO: 5011386 - DNA, 20 bp, Homo sapiens
ttggacttcaaagcaagctg

SEQ ID NO: 5011387 - DNA, 15 bp, Homo sapiens
ttggtctgccttctg

SEQ ID NO: 5011388 - DNA, 17 bp, Homo sapiens
ttggtctgccttctgct

SEQ ID NO: 5011389 - DNA, 20 bp, Homo sapiens
ttggtctgccttctgctgaa

SEQ ID NO: 5011390 - DNA, 18 bp, Homo sapiens
ttggtgccctcgcctcct

SEQ ID NO: 5011391 - DNA, 19 bp, Homo sapiens
ttggtgccctcgcctcctc

SEQ ID NO: 5011392 - DNA, 13 bp, Homo sapiens
ttgtaaaacttct

SEQ ID NO: 5011393 - DNA, 15 bp, Homo sapiens
ttgtaaaacttctgc

SEQ ID NO: 5011394 - DNA, 19 bp, Homo sapiens
ttgtattgatttttaagaa

SEQ ID NO: 5011395 - DNA, 17 bp, Homo sapiens
ttgtttggcaaggaaag

SEQ ID NO: 5011396 - DNA, 13 bp, Homo sapiens
ttgttttgtattg

SEQ ID NO: 5011397 - DNA, 15 bp, Homo sapiens
tttaaaaaaaagaaa

SEQ ID NO: 5011398 - DNA, 17 bp, Homo sapiens
tttaaaaaaaagaaact

SEQ ID NO: 5011399 - DNA, 12 bp, Homo sapiens
tttaacttttaa

SEQ ID NO: 5011400 - DNA, 22 bp, Homo sapiens
tttaagaaagtaatttaatttg

SEQ ID NO: 5011401 - DNA, 13 bp, Homo sapiens
tttaatttgtaaa

SEQ ID NO: 5011402 - DNA, 13 bp, Homo sapiens
tttagctggccac

SEQ ID NO: 5011403 - DNA, 21 bp, Homo sapiens
tttaggatctcaggcttctgc

SEQ ID NO: 5011404 - DNA, 12 bp, Homo sapiens
tttataaacaga

SEQ ID NO: 5011405 - DNA, 18 bp, Homo sapiens
tttataaacagacaatat

SEQ ID NO: 5011406 - DNA, 23 bp, Homo sapiens
tttataaacagacaatatgtgag

SEQ ID NO: 5011407 - DNA, 20 bp, Homo sapiens
tttataaataaactgttgct

SEQ ID NO: 5011408 - DNA, 16 bp, Homo sapiens
tttatccaaaatgtgt

SEQ ID NO: 5011409 - DNA, 21 bp, Homo sapiens
tttatgatcagtgttgttgct

SEQ ID NO: 5011410 - DNA, 16 bp, Homo sapiens
tttatgcaaaaggttt

SEQ ID NO: 5011411 - DNA, 18 bp, Homo sapiens
tttatgggcccctggcac

SEQ ID NO: 5011412 - DNA, 17 bp, Homo sapiens
tttattatgcattatat

SEQ ID NO: 5011413 - DNA, 13 bp, Homo sapiens
tttatttgaggtc

SEQ ID NO: 5011414 - DNA, 13 bp, Homo sapiens
tttatttttgcac

SEQ ID NO: 5011415 - DNA, 17 bp, Homo sapiens
tttatttttgcacaact

SEQ ID NO: 5011416 - DNA, 20 bp, Homo sapiens
tttcaaagcacttaagtgtt

SEQ ID NO: 5011417 - DNA, 19 bp, Homo sapiens
tttctgaatgcctacctgg

SEQ ID NO: 5011418 - DNA, 13 bp, Homo sapiens
tttgacagccttc

SEQ ID NO: 5011419 - DNA, 14 bp, Homo sapiens
tttgaggtcagtgt

SEQ ID NO: 5011420 - DNA, 17 bp, Homo sapiens
tttgcagaagagggtgt

SEQ ID NO: 5011421 - DNA, 14 bp, Homo sapiens
tttgcatttctttc

SEQ ID NO: 5011422 - DNA, 14 bp, Homo sapiens
tttggcaaggaaag

SEQ ID NO: 5011423 - DNA, 14 bp, Homo sapiens
ccggccctgtgtgc

SEQ ID NO: 5011424 - DNA, 15 bp, Homo sapiens
ccgtagctctgctgc

SEQ ID NO: 5011425 - DNA, 15 bp, Homo sapiens
ccgtggggcagggag

SEQ ID NO: 5011426 - DNA, 22 bp, Homo sapiens
ccgtggggcagggagctgggcc

SEQ ID NO: 5011427 - DNA, 18 bp, Homo sapiens
ccgtttcgcgctggccgg

SEQ ID NO: 5011428 - DNA, 14 bp, Homo sapiens
cctacacactgtca

SEQ ID NO: 5011429 - DNA, 17 bp, Homo sapiens
cctagagccctctcctc

SEQ ID NO: 5011430 - DNA, 14 bp, Homo sapiens
cctataataaaggc

SEQ ID NO: 5011431 - DNA, 16 bp, Homo sapiens
cctataataaaggctg

SEQ ID NO: 5011432 - DNA, 22 bp, Homo sapiens
cctatgtaagaattcagaagac

SEQ ID NO: 5011433 - DNA, 13 bp, Homo sapiens
cctatttatttga

SEQ ID NO: 5011434 - DNA, 13 bp, Homo sapiens
cctcaattctcca

SEQ ID NO: 5011435 - DNA, 23 bp, Homo sapiens
cctcagggagcagggaaggcctg

SEQ ID NO: 5011436 - DNA, 22 bp, Homo sapiens
cctcagttgaaaatgcaactct

SEQ ID NO: 5011437 - DNA, 17 bp, Homo sapiens
cctccaggtgcagaggt

SEQ ID NO: 5011438 - DNA, 18 bp, Homo sapiens
cctccaggtgcagaggta

SEQ ID NO: 5011439 - DNA, 17 bp, Homo sapiens
cctccccgtctcattcc

SEQ ID NO: 5011440 - DNA, 23 bp, Homo sapiens
cctccctctgtccctctccttgc

SEQ ID NO: 5011441 - DNA, 22 bp, Homo sapiens
cctccgaccacttccaggggaa

SEQ ID NO: 5011442 - DNA, 12 bp, Homo sapiens
cctcctccaggg

SEQ ID NO: 5011443 - DNA, 14 bp, Homo sapiens
cctcctcctcctgc

SEQ ID NO: 5011444 - DNA, 15 bp, Homo sapiens
cctcctcctcctgcc

SEQ ID NO: 5011445 - DNA, 13 bp, Homo sapiens
cctcctctcagtg

SEQ ID NO: 5011446 - DNA, 14 bp, Homo sapiens
cctcctgccctcct

SEQ ID NO: 5011447 - DNA, 20 bp, Homo sapiens
cctcctgccctcctctcccc

SEQ ID NO: 5011448 - DNA, 15 bp, Homo sapiens
cctcgttggaagagg

SEQ ID NO: 5011449 - DNA, 23 bp, Homo sapiens
cctctgcctttgcaccacgggac

SEQ ID NO: 5011450 - DNA, 18 bp, Homo sapiens
cctctgtccctctccttg

SEQ ID NO: 5011451 - DNA, 20 bp, Homo sapiens
cctgaaacctagtactgccc

SEQ ID NO: 5011452 - DNA, 21 bp, Homo sapiens
cctgaatgtttaaagatcatg

SEQ ID NO: 5011453 - DNA, 20 bp, Homo sapiens
cctgacgtctgaagcttgac

SEQ ID NO: 5011454 - DNA, 15 bp, Homo sapiens
cctgagaggggaagc

SEQ ID NO: 5011455 - DNA, 16 bp, Homo sapiens
cctgagtctgggcagc

SEQ ID NO: 5011456 - DNA, 21 bp, Homo sapiens
cctgatgtgtcctcagggagc

SEQ ID NO: 5011457 - DNA, 21 bp, Homo sapiens
cctgcagatactttgaagtgc

SEQ ID NO: 5011458 - DNA, 11 bp, Homo sapiens
cctgctcccag

SEQ ID NO: 5011459 - DNA, 15 bp, Homo sapiens
cctgctcccaggccc

SEQ ID NO: 5011460 - DNA, 12 bp, Homo sapiens
cctgctgcgctg

SEQ ID NO: 5011461 - DNA, 15 bp, Homo sapiens
cctgctgcgctgctt

SEQ ID NO: 5011462 - DNA, 16 bp, Homo sapiens
cattccgttgtctgtg

SEQ ID NO: 5011463 - DNA, 20 bp, Homo sapiens
cattcgaaggaacctgtgtt

SEQ ID NO: 5011464 - DNA, 20 bp, Homo sapiens
cattctggttccctgctgcg

SEQ ID NO: 5011465 - DNA, 15 bp, Homo sapiens
cattgccaagtcaga

SEQ ID NO: 5011466 - DNA, 14 bp, Homo sapiens
catttagctggcca

SEQ ID NO: 5011467 - DNA, 14 bp, Homo sapiens
catttatgcacatt

SEQ ID NO: 5011468 - DNA, 14 bp, Homo sapiens
catttctataaata

SEQ ID NO: 5011469 - DNA, 18 bp, Homo sapiens
catttgtggcagtccctt

SEQ ID NO: 5011470 - DNA, 13 bp, Homo sapiens
ccaaagaggctgc

SEQ ID NO: 5011471 - DNA, 14 bp, Homo sapiens
ccaaagaggctgcc

SEQ ID NO: 5011472 - DNA, 21 bp, Homo sapiens
ccaaagaggctgcccctctca

SEQ ID NO: 5011473 - DNA, 15 bp, Homo sapiens
ccaaagctgagcctg

SEQ ID NO: 5011474 - DNA, 17 bp, Homo sapiens
ccaacatgcactgatgt

SEQ ID NO: 5011475 - DNA, 23 bp, Homo sapiens
ccaaggaggtgaggagcagagca

SEQ ID NO: 5011476 - DNA, 21 bp, Homo sapiens
ccaagggacgttgacctggac

SEQ ID NO: 5011477 - DNA, 16 bp, Homo sapiens
ccaagtttccatagca

SEQ ID NO: 5011478 - DNA, 17 bp, Homo sapiens
ccaagtttccatagcaa

SEQ ID NO: 5011479 - DNA, 23 bp, Homo sapiens
ccaatgagactctagggtccagt

SEQ ID NO: 5011480 - DNA, 15 bp, Homo sapiens
ccacacccaaagctg

SEQ ID NO: 5011481 - DNA, 15 bp, Homo sapiens
ccaccctgctgctgg

SEQ ID NO: 5011482 - DNA, 21 bp, Homo sapiens
ccaccctgctgctggtgcaca

SEQ ID NO: 5011483 - DNA, 18 bp, Homo sapiens
ccaccctgggctacagaa

SEQ ID NO: 5011484 - DNA, 12 bp, Homo sapiens
ccactcccagga

SEQ ID NO: 5011485 - DNA, 14 bp, Homo sapiens
ccactcctccctcc

SEQ ID NO: 5011486 - DNA, 16 bp, Homo sapiens
ccagagtcatgggaga

SEQ ID NO: 5011487 - DNA, 12 bp, Homo sapiens
ccagatcctggg

SEQ ID NO: 5011488 - DNA, 15 bp, Homo sapiens
ccagcaccttgtgcc

SEQ ID NO: 5011489 - DNA, 16 bp, Homo sapiens
ccagcaccttgtgcct

SEQ ID NO: 5011490 - DNA, 16 bp, Homo sapiens
ccagcatttagctggc

SEQ ID NO: 5011491 - DNA, 21 bp, Homo sapiens
ccagccaggcaggtccacaga

SEQ ID NO: 5011492 - DNA, 23 bp, Homo sapiens
ccaggagctgtcaccaaggaaac

SEQ ID NO: 5011493 - DNA, 16 bp, Homo sapiens
ccaggcctgtggctcc

SEQ ID NO: 5011494 - DNA, 14 bp, Homo sapiens
ccagggaggggccg

SEQ ID NO: 5011495 - DNA, 23 bp, Homo sapiens
ccagggaggggccggccctgtgt

SEQ ID NO: 5011496 - DNA, 20 bp, Homo sapiens
ccagggccttttctggcacc

SEQ ID NO: 5011497 - DNA, 21 bp, Homo sapiens
ccagggccttttctggcaccg

SEQ ID NO: 5011498 - DNA, 16 bp, Homo sapiens
ccaggggaacctgcca

SEQ ID NO: 5011499 - DNA, 20 bp, Homo sapiens
ccaggtgcagaggtaccctg

SEQ ID NO: 5011500 - DNA, 15 bp, Homo sapiens
cacctgctcccaggc

SEQ ID NO: 5011501 - DNA, 17 bp, Homo sapiens
cacctgctcccaggccc

SEQ ID NO: 5011502 - DNA, 22 bp, Homo sapiens
cacctgctcccaggccccaggc

SEQ ID NO: 5011503 - DNA, 11 bp, Homo sapiens
cacctggttgc

SEQ ID NO: 5011504 - DNA, 15 bp, Homo sapiens
caccttgtgcctggg

SEQ ID NO: 5011505 - DNA, 16 bp, Homo sapiens
caccttgtgcctgggg

SEQ ID NO: 5011506 - DNA, 18 bp, Homo sapiens
cacgggacatcacagggt

SEQ ID NO: 5011507 - DNA, 22 bp, Homo sapiens
cacggtatttatagagagagac

SEQ ID NO: 5011508 - DNA, 17 bp, Homo sapiens
cactccattattcctct

SEQ ID NO: 5011509 - DNA, 13 bp, Homo sapiens
cactcctccctcc

SEQ ID NO: 5011510 - DNA, 14 bp, Homo sapiens
cactcctccctccg

SEQ ID NO: 5011511 - DNA, 17 bp, Homo sapiens
cactcttgttcccacac

SEQ ID NO: 5011512 - DNA, 12 bp, Homo sapiens
cactcttttgat

SEQ ID NO: 5011513 - DNA, 22 bp, Homo sapiens
cactggtccccaacaatgtgag

SEQ ID NO: 5011514 - DNA, 15 bp, Homo sapiens
cactgtatgagtgga

SEQ ID NO: 5011515 - DNA, 22 bp, Homo sapiens
cactgtatgatttataaacaga

SEQ ID NO: 5011516 - DNA, 16 bp, Homo sapiens
cactgtcatgcttcat

SEQ ID NO: 5011517 - DNA, 20 bp, Homo sapiens
cacttccaggggaacctgcc

SEQ ID NO: 5011518 - DNA, 16 bp, Homo sapiens
cacttcccaccctgcc

SEQ ID NO: 5011519 - DNA, 20 bp, Homo sapiens
cacttgaccgggagacagag

SEQ ID NO: 5011520 - DNA, 23 bp, Homo sapiens
cagaagccctgatgtgtcctcag

SEQ ID NO: 5011521 - DNA, 22 bp, Homo sapiens
cagaatgtaagtgggcccaccc

SEQ ID NO: 5011522 - DNA, 15 bp, Homo sapiens
cagagctttggtctg

SEQ ID NO: 5011523 - DNA, 17 bp, Homo sapiens
cagaggtaccctgggtg

SEQ ID NO: 5011524 - DNA, 14 bp, Homo sapiens
cagaggtgcttcac

SEQ ID NO: 5011525 - DNA, 22 bp, Homo sapiens
cagatggtttccacatttagat

SEQ ID NO: 5011526 - DNA, 15 bp, Homo sapiens
cagcaccgaggggcc

SEQ ID NO: 5011527 - DNA, 16 bp, Homo sapiens
cagcaccttgtgcctg

SEQ ID NO: 5011528 - DNA, 17 bp, Homo sapiens
cagcaccttgtgcctgg

SEQ ID NO: 5011529 - DNA, 14 bp, Homo sapiens
cagcagcttctcca

SEQ ID NO: 5011530 - DNA, 15 bp, Homo sapiens
cagcagcttctccag

SEQ ID NO: 5011531 - DNA, 17 bp, Homo sapiens
cagcagcttctccagga

SEQ ID NO: 5011532 - DNA, 15 bp, Homo sapiens
cagcatgaggacaga

SEQ ID NO: 5011533 - DNA, 21 bp, Homo sapiens
cagcatttagctggccacatg

SEQ ID NO: 5011534 - DNA, 12 bp, Homo sapiens
cagcccaccctg

SEQ ID NO: 5011535 - DNA, 15 bp, Homo sapiens
cctgctgctggtgca

SEQ ID NO: 5011536 - DNA, 22 bp, Homo sapiens
cctggaggtccctggtcggaga

SEQ ID NO: 5011537 - DNA, 19 bp, Homo sapiens
cctgggctacagaaaccac

SEQ ID NO: 5011538 - DNA, 20 bp, Homo sapiens
cctgggctggttggagaagg

SEQ ID NO: 5011539 - DNA, 15 bp, Homo sapiens
cctgggggcacagga

SEQ ID NO: 5011540 - DNA, 20 bp, Homo sapiens
cctggggtgttagtggcacc

SEQ ID NO: 5011541 - DNA, 14 bp, Homo sapiens
cctgggtgtccccg

SEQ ID NO: 5011542 - DNA, 20 bp, Homo sapiens
cctgtatatttgtaaagcta

SEQ ID NO: 5011543 - DNA, 18 bp, Homo sapiens
cctgtcctaaggaacctt

SEQ ID NO: 5011544 - DNA, 13 bp, Homo sapiens
cctgtggctccct

SEQ ID NO: 5011545 - DNA, 10 bp, Homo sapiens
cctgtgtgca

SEQ ID NO: 5011546 - DNA, 13 bp, Homo sapiens
cctgtgtgcaggt

SEQ ID NO: 5011547 - DNA, 13 bp, Homo sapiens
cctgtttctctgc

SEQ ID NO: 5011548 - DNA, 14 bp, Homo sapiens
cctgtttctggcac

SEQ ID NO: 5011549 - DNA, 18 bp, Homo sapiens
ccttagggaagctggcct

SEQ ID NO: 5011550 - DNA, 21 bp, Homo sapiens
ccttagggaagctggcctgag

SEQ ID NO: 5011551 - DNA, 18 bp, Homo sapiens
ccttccaatgcttctgtt

SEQ ID NO: 5011552 - DNA, 20 bp, Homo sapiens
ccttccccgagtgactctgg

SEQ ID NO: 5011553 - DNA, 14 bp, Homo sapiens
ccttctctgttggt

SEQ ID NO: 5011554 - DNA, 17 bp, Homo sapiens
ccttctgctgaaagact

SEQ ID NO: 5011555 - DNA, 17 bp, Homo sapiens
ccttgccccaggccctg

SEQ ID NO: 5011556 - DNA, 18 bp, Homo sapiens
ccttgccccaggccctgc

SEQ ID NO: 5011557 - DNA, 14 bp, Homo sapiens
ccttgcccccagtg

SEQ ID NO: 5011558 - DNA, 18 bp, Homo sapiens
ccttgcttgcctgcaggg

SEQ ID NO: 5011559 - DNA, 14 bp, Homo sapiens
ccttggtgccctcg

SEQ ID NO: 5011560 - DNA, 11 bp, Homo sapiens
ccttgtgcctg

SEQ ID NO: 5011561 - DNA, 15 bp, Homo sapiens
cctttaggatctcag

SEQ ID NO: 5011562 - DNA, 21 bp, Homo sapiens
cctttcaaagcacttaagtgt

SEQ ID NO: 5011563 - DNA, 12 bp, Homo sapiens
cctttcaaagct

SEQ ID NO: 5011564 - DNA, 20 bp, Homo sapiens
cctttggagatgctgagggt

SEQ ID NO: 5011565 - DNA, 15 bp, Homo sapiens
cctttgttctggggg

SEQ ID NO: 5011566 - DNA, 15 bp, Homo sapiens
ccttttgcagaagag

SEQ ID NO: 5011567 - DNA, 19 bp, Homo sapiens
ccttttgcagaagagggtg

SEQ ID NO: 5011568 - DNA, 14 bp, Homo sapiens
cgaccacttccagg

SEQ ID NO: 5011569 - DNA, 12 bp, Homo sapiens
cgaccctggggg

SEQ ID NO: 5011570 - DNA, 17 bp, Homo sapiens
cgaccctgggggcacag

SEQ ID NO: 5011571 - DNA, 17 bp, Homo sapiens
cgatgttattagatgtt

SEQ ID NO: 5011572 - DNA, 17 bp, Homo sapiens
cgcatcttgcctccagg

SEQ ID NO: 5011573 - DNA, 17 bp, Homo sapiens
cgcctccccacctccag

SEQ ID NO: 5011574 - DNA, 11 bp, Homo sapiens
cgcctcctcct

SEQ ID NO: 5011575 - DNA, 13 bp, Homo sapiens
cgctacctccctc

SEQ ID NO: 5011576 - DNA, 15 bp, Homo sapiens
cgctacctccctccc

SEQ ID NO: 5011577 - DNA, 15 bp, Homo sapiens
cgctacctctctgtc

SEQ ID NO: 5011578 - DNA, 24 bp, Homo sapiens
cgctgcttggtgtgacccacggag

SEQ ID NO: 5011579 - DNA, 19 bp, Homo sapiens
cggaaactagtgtacattt

SEQ ID NO: 5011580 - DNA, 18 bp, Homo sapiens
cggaggcctgcgaccctg

SEQ ID NO: 5011581 - DNA, 22 bp, Homo sapiens
cggaggcctgcgaccctggggg

SEQ ID NO: 5011582 - DNA, 19 bp, Homo sapiens
cggagtcagccaggagctg

SEQ ID NO: 5011583 - DNA, 14 bp, Homo sapiens
cggccaagaatgta

SEQ ID NO: 5011584 - DNA, 17 bp, Homo sapiens
cggcctctgcctttgca

SEQ ID NO: 5011585 - DNA, 22 bp, Homo sapiens
cgggagacagaggttgcagtga

SEQ ID NO: 5011586 - DNA, 16 bp, Homo sapiens
cggtctcctgactggt

SEQ ID NO: 5011587 - DNA, 17 bp, Homo sapiens
cgtagctctgctgctga

SEQ ID NO: 5011588 - DNA, 13 bp, Homo sapiens
cgtccagcctgcc

SEQ ID NO: 5011589 - DNA, 18 bp, Homo sapiens
cgtctgaagcttgactcc

SEQ ID NO: 5011590 - DNA, 13 bp, Homo sapiens
cgtggagggaggc

SEQ ID NO: 5011591 - DNA, 19 bp, Homo sapiens
cgtggagggaggccccagg

SEQ ID NO: 5011592 - DNA, 15 bp, Homo sapiens
cgtggggcagggagc

SEQ ID NO: 5011593 - DNA, 23 bp, Homo sapiens
cgtggggcagggagctgggcccg

SEQ ID NO: 5011594 - DNA, 19 bp, Homo sapiens
ctaacttttcaatgacatt

SEQ ID NO: 5011595 - DNA, 20 bp, Homo sapiens
agctccccagcccacctgct

SEQ ID NO: 5011596 - DNA, 11 bp, Homo sapiens
agctctgctgc

SEQ ID NO: 5011597 - DNA, 14 bp, Homo sapiens
agctgagcctgcag

SEQ ID NO: 5011598 - DNA, 13 bp, Homo sapiens
agctgattttatt

SEQ ID NO: 5011599 - DNA, 14 bp, Homo sapiens
agcttatctctttt

SEQ ID NO: 5011600 - DNA, 22 bp, Homo sapiens
agcttatctcttttatatttgt

SEQ ID NO: 5011601 - DNA, 23 bp, Homo sapiens
agcttatctcttttatatttgta

SEQ ID NO: 5011602 - DNA, 18 bp, Homo sapiens
aggaaaggggagaaggga

SEQ ID NO: 5011603 - DNA, 20 bp, Homo sapiens
aggaaccttccttcctgctt

SEQ ID NO: 5011604 - DNA, 22 bp, Homo sapiens
aggaaccttccttcctgcttga

SEQ ID NO: 5011605 - DNA, 15 bp, Homo sapiens
aggaccagggccttt

SEQ ID NO: 5011606 - DNA, 22 bp, Homo sapiens
aggactattacatattttttgt

SEQ ID NO: 5011607 - DNA, 21 bp, Homo sapiens
aggagctgtcaccaaggaaac

SEQ ID NO: 5011608 - DNA, 18 bp, Homo sapiens
aggatcccctccaagcct

SEQ ID NO: 5011609 - DNA, 16 bp, Homo sapiens
aggcatggccctgggc

SEQ ID NO: 5011610 - DNA, 18 bp, Homo sapiens
aggcctgcgaccctgggg

SEQ ID NO: 5011611 - DNA, 21 bp, Homo sapiens
aggcctgggtgatctgctgct

SEQ ID NO: 5011612 - DNA, 10 bp, Homo sapiens
aggctgggcc

SEQ ID NO: 5011613 - DNA, 21 bp, Homo sapiens
aggctgggccatgtccaaaga

SEQ ID NO: 5011614 - DNA, 23 bp, Homo sapiens
aggctttcccacttcccaccctg

SEQ ID NO: 5011615 - DNA, 23 bp, Homo sapiens
agggaagctggcctgagagggga

SEQ ID NO: 5011616 - DNA, 14 bp, Homo sapiens
agggaaggtgaaac

SEQ ID NO: 5011617 - DNA, 18 bp, Homo sapiens
agggaatcctcctccagg

SEQ ID NO: 5011618 - DNA, 17 bp, Homo sapiens
agggacatagaatctgt

SEQ ID NO: 5011619 - DNA, 19 bp, Homo sapiens
agggacggccaagaatgta

SEQ ID NO: 5011620 - DNA, 14 bp, Homo sapiens
agggagctgggccc

SEQ ID NO: 5011621 - DNA, 14 bp, Homo sapiens
agggccatggctca

SEQ ID NO: 5011622 - DNA, 18 bp, Homo sapiens
agggctggggatgcgcct

SEQ ID NO: 5011623 - DNA, 14 bp, Homo sapiens
aggggaacctgcca

SEQ ID NO: 5011624 - DNA, 14 bp, Homo sapiens
aggggccggccctg

SEQ ID NO: 5011625 - DNA, 23 bp, Homo sapiens
agggggatgccactcctccctcc

SEQ ID NO: 5011626 - DNA, 19 bp, Homo sapiens
aaaactggacctgtatatt

SEQ ID NO: 5011627 - DNA, 18 bp, Homo sapiens
aaaagatgaaaaagaata

SEQ ID NO: 5011628 - DNA, 21 bp, Homo sapiens
aaaagctagtgtacctcctct

SEQ ID NO: 5011629 - DNA, 19 bp, Homo sapiens
aaaattttagctcttccca

SEQ ID NO: 5011630 - DNA, 16 bp, Homo sapiens
aaacagacaatatgtg

SEQ ID NO: 5011631 - DNA, 22 bp, Homo sapiens
aaacagacaatatgtgagtgcc

SEQ ID NO: 5011632 - DNA, 12 bp, Homo sapiens
aaacgctacctc

SEQ ID NO: 5011633 - DNA, 12 bp, Homo sapiens
aaacttctgctc

SEQ ID NO: 5011634 - DNA, 16 bp, Homo sapiens
aaagaaacttttctga

SEQ ID NO: 5011635 - DNA, 15 bp, Homo sapiens
aaagacccaggggga

SEQ ID NO: 5011636 - DNA, 12 bp, Homo sapiens
aaagagaattgt

SEQ ID NO: 5011637 - DNA, 21 bp, Homo sapiens
aaagagccagactctgtctca

SEQ ID NO: 5011638 - DNA, 18 bp, Homo sapiens
aaagaggctgcccctctc

SEQ ID NO: 5011639 - DNA, 23 bp, Homo sapiens
aaagaggctgcccctctcaccaa

SEQ ID NO: 5011640 - DNA, 21 bp, Homo sapiens
aaagatattgttgttttccat

SEQ ID NO: 5011641 - DNA, 22 bp, Homo sapiens
aaagatattgttgttttccatg

SEQ ID NO: 5011642 - DNA, 15 bp, Homo sapiens
aaagccttagggaag

SEQ ID NO: 5011643 - DNA, 20 bp, Homo sapiens
aaagctagtgtacctcctct

SEQ ID NO: 5011644 - DNA, 18 bp, Homo sapiens
aaagctatttatgggccc

SEQ ID NO: 5011645 - DNA, 22 bp, Homo sapiens
aaaggatcaacaacatccactg

SEQ ID NO: 5011646 - DNA, 22 bp, Homo sapiens
aaatagatgctgtgtatatggt

SEQ ID NO: 5011647 - DNA, 17 bp, Homo sapiens
aaatctaccactgtatg

SEQ ID NO: 5011648 - DNA, 15 bp, Homo sapiens
aaatctgaagattgc

SEQ ID NO: 5011649 - DNA, 21 bp, Homo sapiens
aaattcttctaattgctgtgt

SEQ ID NO: 5011650 - DNA, 23 bp, Homo sapiens
aaattgtgcagtactttgtgcat

SEQ ID NO: 5011651 - DNA, 12 bp, Homo sapiens
aacaaaacttct

SEQ ID NO: 5011652 - DNA, 19 bp, Homo sapiens
aacacaaaaaaaattttag

SEQ ID NO: 5011653 - DNA, 18 bp, Homo sapiens
ctgtgtgtcccaggcagg

SEQ ID NO: 5011654 - DNA, 21 bp, Homo sapiens
ctgtgtgtgtgtgtgtgcgtg

SEQ ID NO: 5011655 - DNA, 14 bp, Homo sapiens
ctgttactgggccc

SEQ ID NO: 5011656 - DNA, 15 bp, Homo sapiens
ctgttactgggccct

SEQ ID NO: 5011657 - DNA, 15 bp, Homo sapiens
ctgttatatatttac

SEQ ID NO: 5011658 - DNA, 13 bp, Homo sapiens
ctgttggtctgcc

SEQ ID NO: 5011659 - DNA, 20 bp, Homo sapiens
ctgttggtctgccttctgct

SEQ ID NO: 5011660 - DNA, 12 bp, Homo sapiens
ctgtttggactg

SEQ ID NO: 5011661 - DNA, 13 bp, Homo sapiens
cttagggaagctg

SEQ ID NO: 5011662 - DNA, 17 bp, Homo sapiens
cttagggaagctggcct

SEQ ID NO: 5011663 - DNA, 21 bp, Homo sapiens
cttatctcttttatatttgta

SEQ ID NO: 5011664 - DNA, 22 bp, Homo sapiens
cttcagatccttttattctcca

SEQ ID NO: 5011665 - DNA, 17 bp, Homo sapiens
cttcatcattccctctc

SEQ ID NO: 5011666 - DNA, 13 bp, Homo sapiens
cttccagcattta

SEQ ID NO: 5011667 - DNA, 19 bp, Homo sapiens
cttccaggggaacctgcca

SEQ ID NO: 5011668 - DNA, 17 bp, Homo sapiens
cttccccgagtgactct

SEQ ID NO: 5011669 - DNA, 15 bp, Homo sapiens
cttctaattgctgtg

SEQ ID NO: 5011670 - DNA, 15 bp, Homo sapiens
cttctcaaagagaat

SEQ ID NO: 5011671 - DNA, 19 bp, Homo sapiens
cttctcaaagagaattgta

SEQ ID NO: 5011672 - DNA, 18 bp, Homo sapiens
cttctctgttggtctgcc

SEQ ID NO: 5011673 - DNA, 19 bp, Homo sapiens
cttctctgttggtctgcct

SEQ ID NO: 5011674 - DNA, 13 bp, Homo sapiens
cttctgctgaaag

SEQ ID NO: 5011675 - DNA, 15 bp, Homo sapiens
cttctggggcaggct

SEQ ID NO: 5011676 - DNA, 20 bp, Homo sapiens
cttctggggcaggctgggcc

SEQ ID NO: 5011677 - DNA, 22 bp, Homo sapiens
cttctggggcaggctgggccat

SEQ ID NO: 5011678 - DNA, 21 bp, Homo sapiens
cttcttgatgtatttctccat

SEQ ID NO: 5011679 - DNA, 21 bp, Homo sapiens
cttcttggggcccagtgcatg

SEQ ID NO: 5011680 - DNA, 23 bp, Homo sapiens
cttcttggggcccagtgcatggt

SEQ ID NO: 5011681 - DNA, 18 bp, Homo sapiens
cttgacctgtttctctgc

SEQ ID NO: 5011682 - DNA, 16 bp, Homo sapiens
cttgcccccagtgcct

SEQ ID NO: 5011683 - DNA, 14 bp, Homo sapiens
cttgcctccaggtg

SEQ ID NO: 5011684 - DNA, 19 bp, Homo sapiens
cttgcctccaggtgcagag

SEQ ID NO: 5011685 - DNA, 21 bp, Homo sapiens
cttgcctccaggtgcagaggt

SEQ ID NO: 5011686 - DNA, 23 bp, Homo sapiens
cttgcctccaggtgcagaggtac

SEQ ID NO: 5011687 - DNA, 14 bp, Homo sapiens
cttgcctgcagggc

SEQ ID NO: 5011688 - DNA, 20 bp, Homo sapiens
cttgcctgcagggccatggc

SEQ ID NO: 5011689 - DNA, 19 bp, Homo sapiens
cttggggcccagtgcatgg

SEQ ID NO: 5011690 - DNA, 18 bp, Homo sapiens
cttggtgccctcgcctcc

SEQ ID NO: 5011691 - DNA, 14 bp, Homo sapiens
cttgtgcctggggt

SEQ ID NO: 5011692 - DNA, 14 bp, Homo sapiens
ctttcagttagcct

SEQ ID NO: 5011693 - DNA, 18 bp, Homo sapiens
ctttgaagtgcagctcat

SEQ ID NO: 5011694 - DNA, 16 bp, Homo sapiens
ctttgccactgctgta

SEQ ID NO: 5011695 - DNA, 14 bp, Homo sapiens
ctttgtgcattctg

SEQ ID NO: 5011696 - DNA, 13 bp, Homo sapiens
cttttatatttgt

SEQ ID NO: 5011697 - DNA, 12 bp, Homo sapiens
cttttctggcac

SEQ ID NO: 5011698 - DNA, 15 bp, Homo sapiens
cttttctttgttata

SEQ ID NO: 5011699 - DNA, 19 bp, Homo sapiens
cttttgtgtgaattgacta

SEQ ID NO: 5011700 - DNA, 18 bp, Homo sapiens
gaaaaagaataaaaactt

SEQ ID NO: 5011701 - DNA, 19 bp, Homo sapiens
gaaaagtgcatatttatcc

SEQ ID NO: 5011702 - DNA, 20 bp, Homo sapiens
gaaaagtgcatatttatcca

SEQ ID NO: 5011703 - DNA, 13 bp, Homo sapiens
gaaaatgcaactc

SEQ ID NO: 5011704 - DNA, 20 bp, Homo sapiens
gaaaccacagtcttcccagc

SEQ ID NO: 5011705 - DNA, 21 bp, Homo sapiens
gaaaccacagtcttcccagca

SEQ ID NO: 5011706 - DNA, 20 bp, Homo sapiens
gaaaccttccaatgcttctg

SEQ ID NO: 5011707 - DNA, 20 bp, Homo sapiens
gaaacgctacctctctgtcc

SEQ ID NO: 5011708 - DNA, 19 bp, Homo sapiens
gaaagacttctcaaagaga

SEQ ID NO: 5011709 - DNA, 13 bp, Homo sapiens
gaaagtaatttaa

SEQ ID NO: 5011710 - DNA, 23 bp, Homo sapiens
gaaattcttataactcaacattt

SEQ ID NO: 5011711 - DNA, 18 bp, Homo sapiens
gaagagggtgtgtttgaa

SEQ ID NO: 5011712 - DNA, 14 bp, Homo sapiens
gaagccaccctggg

SEQ ID NO: 5011713 - DNA, 17 bp, Homo sapiens
gaagccccacatgtcca

SEQ ID NO: 5011714 - DNA, 23 bp, Homo sapiens
gaagccccacatgtccagcacct

SEQ ID NO: 5011715 - DNA, 20 bp, Homo sapiens
gaagcggccctaagggagtg

SEQ ID NO: 5011716 - DNA, 16 bp, Homo sapiens
gaagctgtcctggagg

SEQ ID NO: 5011717 - DNA, 16 bp, Homo sapiens
gaagctgttgtgtgag

SEQ ID NO: 5011718 - DNA, 20 bp, Homo sapiens
gaaggcctgacttctgctgg

SEQ ID NO: 5011719 - DNA, 19 bp, Homo sapiens
gaagggaatcctcctccag

SEQ ID NO: 5011720 - DNA, 20 bp, Homo sapiens
gaagggaatcctcctccagg

SEQ ID NO: 5011721 - DNA, 12 bp, Homo sapiens
gaaggtgaaaca

SEQ ID NO: 5011722 - DNA, 21 bp, Homo sapiens
gaatcaaaacaaacgagcagg

SEQ ID NO: 5011723 - DNA, 17 bp, Homo sapiens
gaatcccactgtatgat

SEQ ID NO: 5011724 - DNA, 14 bp, Homo sapiens
gaatgtacgtccag

SEQ ID NO: 5011725 - DNA, 17 bp, Homo sapiens
gaattagatttctatag

SEQ ID NO: 5011726 - DNA, 18 bp, Homo sapiens
gaattggaaagacttctc

SEQ ID NO: 5011727 - DNA, 21 bp, Homo sapiens
gaattggaaagacttctcaaa

SEQ ID NO: 5011728 - DNA, 20 bp, Homo sapiens
gacattttctttcatgggca

SEQ ID NO: 5011729 - DNA, 23 bp, Homo sapiens
gacatttttccgtttgcttttgt

SEQ ID NO: 5011730 - DNA, 15 bp, Homo sapiens
gaccacttccagggg

SEQ ID NO: 5011731 - DNA, 23 bp, Homo sapiens
gaccacttccaggggaacctgcc

SEQ ID NO: 5011732 - DNA, 13 bp, Homo sapiens
gacccagggggag

SEQ ID NO: 5011733 - DNA, 17 bp, Homo sapiens
gaccctgggggcacagg

SEQ ID NO: 5011734 - DNA, 20 bp, Homo sapiens
gacctctgacaactgtgaag

SEQ ID NO: 5011735 - DNA, 18 bp, Homo sapiens
gacggtttccagggaggg

SEQ ID NO: 5011736 - DNA, 14 bp, Homo sapiens
gactcatcatttgt

SEQ ID NO: 5011737 - DNA, 21 bp, Homo sapiens
gactccatctctcatcctcca

SEQ ID NO: 5011738 - DNA, 16 bp, Homo sapiens
gacttctcaaagagaa

SEQ ID NO: 5011739 - DNA, 17 bp, Homo sapiens
gactttatgtagttttt

SEQ ID NO: 5011740 - DNA, 14 bp, Homo sapiens
gagaaccaaccagg

SEQ ID NO: 5011741 - DNA, 19 bp, Homo sapiens
gagaaccaaccagggaagc

SEQ ID NO: 5011742 - DNA, 20 bp, Homo sapiens
gagaagggaatcctcctcca

SEQ ID NO: 5011743 - DNA, 19 bp, Homo sapiens
gagagggagagcagagaaa

SEQ ID NO: 5011744 - DNA, 22 bp, Homo sapiens
gagatcgtacctattgcactcc

SEQ ID NO: 5011745 - DNA, 16 bp, Homo sapiens
gagatgctgagggtgt

SEQ ID NO: 5011746 - DNA, 15 bp, Homo sapiens
gagcagagcaggcaa

SEQ ID NO: 5011747 - DNA, 17 bp, Homo sapiens
gagcagggaaggcctga

SEQ ID NO: 5011748 - DNA, 23 bp, Homo sapiens
gagctgggcccgacatggctccg

SEQ ID NO: 5011749 - DNA, 17 bp, Homo sapiens
gagctgtcaccaaggaa

SEQ ID NO: 5011750 - DNA, 19 bp, Homo sapiens
gaggaaggaacagcaatgg

SEQ ID NO: 5011751 - DNA, 14 bp, Homo sapiens
gaggaccagggcct

SEQ ID NO: 5011752 - DNA, 15 bp, Homo sapiens
gaggctgcccctctc

SEQ ID NO: 5011753 - DNA, 18 bp, Homo sapiens
gaggctgcccctctcacc

SEQ ID NO: 5011754 - DNA, 15 bp, Homo sapiens
gagggacatagaatc

SEQ ID NO: 5011755 - DNA, 20 bp, Homo sapiens
gagggacatagaatctgtga

SEQ ID NO: 5011756 - DNA, 20 bp, Homo sapiens
gagggacggccaagaatgta

SEQ ID NO: 5011757 - DNA, 12 bp, Homo sapiens
gagggaggcccc

SEQ ID NO: 5011758 - DNA, 16 bp, Homo sapiens
gagggaggccccaggg

SEQ ID NO: 5011759 - DNA, 17 bp, Homo sapiens
gaggggccggccctgtg

SEQ ID NO: 5011760 - DNA, 21 bp, Homo sapiens
gaggggccggccctgtgtgca

SEQ ID NO: 5011761 - DNA, 13 bp, Homo sapiens
gaggtaccctggg

SEQ ID NO: 5011762 - DNA, 12 bp, Homo sapiens
gaggtgcttcac

SEQ ID NO: 5011763 - DNA, 14 bp, Homo sapiens
gaggtgggagggcc

SEQ ID NO: 5011764 - DNA, 15 bp, Homo sapiens
gaggtttttttgctt

SEQ ID NO: 5011765 - DNA, 16 bp, Homo sapiens
gagtaaatacaggtag

SEQ ID NO: 5011766 - DNA, 21 bp, Homo sapiens
gagtacaccctttccaggaat

SEQ ID NO: 5011767 - DNA, 16 bp, Homo sapiens
gagtcagccaggagct

SEQ ID NO: 5011768 - DNA, 12 bp, Homo sapiens
gagtgactctgg

SEQ ID NO: 5011769 - DNA, 14 bp, Homo sapiens
gagtgccttttgca

SEQ ID NO: 5011770 - DNA, 20 bp, Homo sapiens
gatactttgaagtgcagctc

SEQ ID NO: 5011771 - DNA, 18 bp, Homo sapiens
gatattgttgttttccat

SEQ ID NO: 5011772 - DNA, 19 bp, Homo sapiens
gatcaacaacatccactgt

SEQ ID NO: 5011773 - DNA, 11 bp, Homo sapiens
gatcagtgttg

SEQ ID NO: 5011774 - DNA, 16 bp, Homo sapiens
gatcatcgccagaggt

SEQ ID NO: 5011775 - DNA, 14 bp, Homo sapiens
gatccactcccagg

SEQ ID NO: 5011776 - DNA, 15 bp, Homo sapiens
gatccactcccagga

SEQ ID NO: 5011777 - DNA, 14 bp, Homo sapiens
gatccttttattct

SEQ ID NO: 5011778 - DNA, 19 bp, Homo sapiens
gatccttttattctccaga

SEQ ID NO: 5011779 - DNA, 23 bp, Homo sapiens
gatgcagcggcgtgaggcctggg

SEQ ID NO: 5011780 - DNA, 15 bp, Homo sapiens
gatgccactcctccc

SEQ ID NO: 5011781 - DNA, 17 bp, Homo sapiens
gatgctgtgtatatggt

SEQ ID NO: 5011782 - DNA, 19 bp, Homo sapiens
gatggctggaaggggtcca

SEQ ID NO: 5011783 - DNA, 18 bp, Homo sapiens
gatgtgtcctcagggagc

SEQ ID NO: 5011784 - DNA, 21 bp, Homo sapiens
gatgttacaagtttatatata

SEQ ID NO: 5011785 - DNA, 22 bp, Homo sapiens
gattactgaaatataccttttg

SEQ ID NO: 5011786 - DNA, 20 bp, Homo sapiens
gattgtcctttaaaaaagaa

SEQ ID NO: 5011787 - DNA, 20 bp, Homo sapiens
gatttagcaagcaactaatt

SEQ ID NO: 5011788 - DNA, 14 bp, Homo sapiens
gatttataaacaga

SEQ ID NO: 5011789 - DNA, 21 bp, Homo sapiens
gattttattcaatatggttac

SEQ ID NO: 5011790 - DNA, 12 bp, Homo sapiens
gcaagcagagga

SEQ ID NO: 5011791 - DNA, 13 bp, Homo sapiens
gcaagcagaggac

SEQ ID NO: 5011792 - DNA, 16 bp, Homo sapiens
gcaagcagaggaccag

SEQ ID NO: 5011793 - DNA, 9 bp, Homo sapiens
gcaaggaaa

SEQ ID NO: 5011794 - DNA, 19 bp, Homo sapiens
gcaaggttaagcaaggtgg

SEQ ID NO: 5011795 - DNA, 22 bp, Homo sapiens
gcaatggtgtcagtatccaggc

SEQ ID NO: 5011796 - DNA, 16 bp, Homo sapiens
gcacaggaggcaggca

SEQ ID NO: 5011797 - DNA, 20 bp, Homo sapiens
gcacatccgcgtgtgcctgt

SEQ ID NO: 5011798 - DNA, 16 bp, Homo sapiens
gcaccacccctgggca

SEQ ID NO: 5011799 - DNA, 20 bp, Homo sapiens
gcacccgcggcccgcgcagc

SEQ ID NO: 5011800 - DNA, 14 bp, Homo sapiens
gcaccttgtgcctg

SEQ ID NO: 5011801 - DNA, 15 bp, Homo sapiens
gcaccttgtgcctgg

SEQ ID NO: 5011802 - DNA, 17 bp, Homo sapiens
gcactgatgttgtgttt

SEQ ID NO: 5011803 - DNA, 18 bp, Homo sapiens
gcactgatgttgtgtttt

SEQ ID NO: 5011804 - DNA, 15 bp, Homo sapiens
gcagaagccctgatg

SEQ ID NO: 5011805 - DNA, 14 bp, Homo sapiens
gcagaggaccaggg

SEQ ID NO: 5011806 - DNA, 16 bp, Homo sapiens
gcagaggaccagggcc

SEQ ID NO: 5011807 - DNA, 17 bp, Homo sapiens
gcagaggtaccctgggt

SEQ ID NO: 5011808 - DNA, 14 bp, Homo sapiens
gcagatactttgaa

SEQ ID NO: 5011809 - DNA, 20 bp, Homo sapiens
gcagcaccgaggggcctttg

SEQ ID NO: 5011810 - DNA, 14 bp, Homo sapiens
gcagcagcttctcc

SEQ ID NO: 5011811 - DNA, 13 bp, Homo sapiens
gcagcccaccctg

SEQ ID NO: 5011812 - DNA, 20 bp, Homo sapiens
gcagcccaccctgctgctgg

SEQ ID NO: 5011813 - DNA, 15 bp, Homo sapiens
gcagctgtcccttgc

SEQ ID NO: 5011814 - DNA, 13 bp, Homo sapiens
gcaggcatttctg

SEQ ID NO: 5011815 - DNA, 14 bp, Homo sapiens
gcaggctgggccat

SEQ ID NO: 5011816 - DNA, 23 bp, Homo sapiens
gcagggaagccccacatgtccag

SEQ ID NO: 5011817 - DNA, 14 bp, Homo sapiens
gcagggaaggcctg

SEQ ID NO: 5011818 - DNA, 16 bp, Homo sapiens
gcagggaaggcctgac

SEQ ID NO: 5011819 - DNA, 16 bp, Homo sapiens
gcagggagctgggccc

SEQ ID NO: 5011820 - DNA, 13 bp, Homo sapiens
gcagggccatggc

SEQ ID NO: 5011821 - DNA, 19 bp, Homo sapiens
gcagggtctgtttggactg

SEQ ID NO: 5011822 - DNA, 21 bp, Homo sapiens
gcatcaaggtcagcatgagga

SEQ ID NO: 5011823 - DNA, 21 bp, Homo sapiens
gcatgagactcagtgcagatg

SEQ ID NO: 5011824 - DNA, 14 bp, Homo sapiens
gcatggtggccaga

SEQ ID NO: 5011825 - DNA, 17 bp, Homo sapiens
gcatgtaaaagcggaaa

SEQ ID NO: 5011826 - DNA, 17 bp, Homo sapiens
gcattgaactctacaac

SEQ ID NO: 5011827 - DNA, 16 bp, Homo sapiens
gcatttagctggccac

SEQ ID NO: 5011828 - DNA, 12 bp, Homo sapiens
gccactcctccc

SEQ ID NO: 5011829 - DNA, 16 bp, Homo sapiens
gccactcctccctccg

SEQ ID NO: 5011830 - DNA, 14 bp, Homo sapiens
gccactgctgtatt

SEQ ID NO: 5011831 - DNA, 15 bp, Homo sapiens
gccagaggtgcttca

SEQ ID NO: 5011832 - DNA, 16 bp, Homo sapiens
gccagaggtgcttcac

SEQ ID NO: 5011833 - DNA, 19 bp, Homo sapiens
gccagaggtgcttcaccct

SEQ ID NO: 5011834 - DNA, 16 bp, Homo sapiens
gccagtgctccaggca

SEQ ID NO: 5011835 - DNA, 14 bp, Homo sapiens
gccatgtccaaaga

SEQ ID NO: 5011836 - DNA, 19 bp, Homo sapiens
gccatgtccaaagaggctg

SEQ ID NO: 5011837 - DNA, 20 bp, Homo sapiens
gcccaccctgctgctggtgc

SEQ ID NO: 5011838 - DNA, 17 bp, Homo sapiens
gcccacctgctcccagg

SEQ ID NO: 5011839 - DNA, 18 bp, Homo sapiens
gcccacctgctcccaggc

SEQ ID NO: 5011840 - DNA, 18 bp, Homo sapiens
gcccagggcaccatccag

SEQ ID NO: 5011841 - DNA, 14 bp, Homo sapiens
gcccagtgcatggt

SEQ ID NO: 5011842 - DNA, 21 bp, Homo sapiens
gcccagtgcatggtggccaga

SEQ ID NO: 5011843 - DNA, 12 bp, Homo sapiens
gcccatccttcc

SEQ ID NO: 5011844 - DNA, 15 bp, Homo sapiens
gccccacatgtccag

SEQ ID NO: 5011845 - DNA, 14 bp, Homo sapiens
gccccaggccctgc

SEQ ID NO: 5011846 - DNA, 19 bp, Homo sapiens
gccccaggcctgtggctcc

SEQ ID NO: 5011847 - DNA, 13 bp, Homo sapiens
gcccccagtgcct

SEQ ID NO: 5011848 - DNA, 15 bp, Homo sapiens
gcccctcagagactg

SEQ ID NO: 5011849 - DNA, 22 bp, Homo sapiens
gcccctcccacacccaaagctg

SEQ ID NO: 5011850 - DNA, 14 bp, Homo sapiens
gcccctctcaccaa

SEQ ID NO: 5011851 - DNA, 13 bp, Homo sapiens
gcccctggcactc

SEQ ID NO: 5011852 - DNA, 24 bp, Homo sapiens
gcccgacatggctccggcctctgc

SEQ ID NO: 5011853 - DNA, 21 bp, Homo sapiens
gcccgaccgggccaggcctgg

SEQ ID NO: 5011854 - DNA, 16 bp, Homo sapiens
gcccgcgcagctgcct

SEQ ID NO: 5011855 - DNA, 17 bp, Homo sapiens
gcccgcgcagctgccta

SEQ ID NO: 5011856 - DNA, 21 bp, Homo sapiens
gccctcgcctcctcctcctgc

SEQ ID NO: 5011857 - DNA, 22 bp, Homo sapiens
gccctcgcctcctcctcctgcc

SEQ ID NO: 5011858 - DNA, 14 bp, Homo sapiens
gccctgtgtgcagg

SEQ ID NO: 5011859 - DNA, 15 bp, Homo sapiens
gccgctacctccctc

SEQ ID NO: 5011860 - DNA, 14 bp, Homo sapiens
gccggccctgtgtg

SEQ ID NO: 5011861 - DNA, 16 bp, Homo sapiens
gccggccctgtgtgca

SEQ ID NO: 5011862 - DNA, 15 bp, Homo sapiens
gcctccaggtgcaga

SEQ ID NO: 5011863 - DNA, 14 bp, Homo sapiens
gcctcctcctcctg

SEQ ID NO: 5011864 - DNA, 15 bp, Homo sapiens
gcctcctcctcctgc

SEQ ID NO: 5011865 - DNA, 13 bp, Homo sapiens
gcctcggcccctc

SEQ ID NO: 5011866 - DNA, 18 bp, Homo sapiens
gcctcggcccctcccaca

SEQ ID NO: 5011867 - DNA, 16 bp, Homo sapiens
gcctgacttctgctgg

SEQ ID NO: 5011868 - DNA, 13 bp, Homo sapiens
gcctgcagggcca

SEQ ID NO: 5011869 - DNA, 21 bp, Homo sapiens
gcctgcagggccatggctcag

SEQ ID NO: 5011870 - DNA, 23 bp, Homo sapiens
gcctgcgaccctgggggcacagg

SEQ ID NO: 5011871 - DNA, 22 bp, Homo sapiens
gcctggggtgttagtggcaccg

SEQ ID NO: 5011872 - DNA, 19 bp, Homo sapiens
gccttgccccaggccctgc

SEQ ID NO: 5011873 - DNA, 20 bp, Homo sapiens
gccttggctgacatgaagct

SEQ ID NO: 5011874 - DNA, 14 bp, Homo sapiens
gcctttgttctggg

SEQ ID NO: 5011875 - DNA, 15 bp, Homo sapiens
gccttttctggcacc

SEQ ID NO: 5011876 - DNA, 19 bp, Homo sapiens
gcgaccctgggggcacagg

SEQ ID NO: 5011877 - DNA, 18 bp, Homo sapiens
gcgcatcttgcctccagg

SEQ ID NO: 5011878 - DNA, 17 bp, Homo sapiens
gcggcccgcgcagctgc

SEQ ID NO: 5011879 - DNA, 16 bp, Homo sapiens
gcgtgaggcctgggct

SEQ ID NO: 5011880 - DNA, 21 bp, Homo sapiens
gcgtgcgcatcttgcctccag

SEQ ID NO: 5011881 - DNA, 14 bp, Homo sapiens
gcgtggagggaggc

SEQ ID NO: 5011882 - DNA, 21 bp, Homo sapiens
gcgtggagggaggccccaggg

SEQ ID NO: 5011883 - DNA, 21 bp, Homo sapiens
gctacagaaaccacagtcttc

SEQ ID NO: 5011884 - DNA, 15 bp, Homo sapiens
gctacctctctgtcc

SEQ ID NO: 5011885 - DNA, 17 bp, Homo sapiens
gctacctttcaaagctt

SEQ ID NO: 5011886 - DNA, 17 bp, Homo sapiens
gctagtgtacctcctct

SEQ ID NO: 5011887 - DNA, 22 bp, Homo sapiens
gctagtgtacctcctctcagtg

SEQ ID NO: 5011888 - DNA, 17 bp, Homo sapiens
gctatttatgggcccct

SEQ ID NO: 5011889 - DNA, 22 bp, Homo sapiens
gctatttatgggcccctggcac

SEQ ID NO: 5011890 - DNA, 13 bp, Homo sapiens
gctcatgttttta

SEQ ID NO: 5011891 - DNA, 18 bp, Homo sapiens
gctccccagcccacctgc

SEQ ID NO: 5011892 - DNA, 21 bp, Homo sapiens
gctccccagcccacctgctcc

SEQ ID NO: 5011893 - DNA, 21 bp, Homo sapiens
gctccggcctctgcctttgca

SEQ ID NO: 5011894 - DNA, 19 bp, Homo sapiens
gctccgtagctctgctgct

SEQ ID NO: 5011895 - DNA, 19 bp, Homo sapiens
gctcgtttacactgcacat

SEQ ID NO: 5011896 - DNA, 11 bp, Homo sapiens
gctctgctgct

SEQ ID NO: 5011897 - DNA, 12 bp, Homo sapiens
gctgaaagactc

SEQ ID NO: 5011898 - DNA, 12 bp, Homo sapiens
gctgagcctgca

SEQ ID NO: 5011899 - DNA, 20 bp, Homo sapiens
gctgagcctgcagggaagcc

SEQ ID NO: 5011900 - DNA, 20 bp, Homo sapiens
gctgcagcaccgaggggcct

SEQ ID NO: 5011901 - DNA, 14 bp, Homo sapiens
gctgcccctctcac

SEQ ID NO: 5011902 - DNA, 15 bp, Homo sapiens
gctgcccctctcacc

SEQ ID NO: 5011903 - DNA, 17 bp, Homo sapiens
gctgctggtgcacagcc

SEQ ID NO: 5011904 - DNA, 21 bp, Homo sapiens
gctgggcccgacatggctccg

SEQ ID NO: 5011905 - DNA, 16 bp, Homo sapiens
gctgtcaccaaggaaa

SEQ ID NO: 5011906 - DNA, 17 bp, Homo sapiens
gctgtcaccaaggaaac

SEQ ID NO: 5011907 - DNA, 22 bp, Homo sapiens
gctgtcccttgcttgcctgcag

SEQ ID NO: 5011908 - DNA, 21 bp, Homo sapiens
gctgtgtatatggtatatata

SEQ ID NO: 5011909 - DNA, 16 bp, Homo sapiens
gctgtgtgtcccaggc

SEQ ID NO: 5011910 - DNA, 15 bp, Homo sapiens
gcttatctcttttat

SEQ ID NO: 5011911 - DNA, 22 bp, Homo sapiens
gcttctccaggaagcccagggc

SEQ ID NO: 5011912 - DNA, 23 bp, Homo sapiens
gcttctccaggaagcccagggca

SEQ ID NO: 5011913 - DNA, 17 bp, Homo sapiens
gcttctgttgatctcag

SEQ ID NO: 5011914 - DNA, 16 bp, Homo sapiens
gcttgcctgcagggcc

SEQ ID NO: 5011915 - DNA, 20 bp, Homo sapiens
ggaaccttccttcctgcttg

SEQ ID NO: 5011916 - DNA, 15 bp, Homo sapiens
ggaagacatttttcc

SEQ ID NO: 5011917 - DNA, 18 bp, Homo sapiens
ggaagaggaaaaggctgg

SEQ ID NO: 5011918 - DNA, 16 bp, Homo sapiens
ggaagctgtcctggag

SEQ ID NO: 5011919 - DNA, 12 bp, Homo sapiens
ggaaggagaggg

SEQ ID NO: 5011920 - DNA, 19 bp, Homo sapiens
ggaatcctcctccagggtg

SEQ ID NO: 5011921 - DNA, 21 bp, Homo sapiens
ggacatcacagggtgggcctc

SEQ ID NO: 5011922 - DNA, 12 bp, Homo sapiens
ggaccagggcct

SEQ ID NO: 5011923 - DNA, 11 bp, Homo sapiens
ggacccagtgc

SEQ ID NO: 5011924 - DNA, 23 bp, Homo sapiens
ggactgctacctttcaaagcttg

SEQ ID NO: 5011925 - DNA, 21 bp, Homo sapiens
ggagacggtttccagggaggg

SEQ ID NO: 5011926 - DNA, 12 bp, Homo sapiens
ggagagacagct

SEQ ID NO: 5011927 - DNA, 13 bp, Homo sapiens
ggagcaggaacaa

SEQ ID NO: 5011928 - DNA, 18 bp, Homo sapiens
ggagctgtcaccaaggaa

SEQ ID NO: 5011929 - DNA, 18 bp, Homo sapiens
ggatgccactcctccctc

SEQ ID NO: 5011930 - DNA, 20 bp, Homo sapiens
ggatgccactcctccctccg

SEQ ID NO: 5011931 - DNA, 10 bp, Homo sapiens
ggcaaggaaa

SEQ ID NO: 5011932 - DNA, 11 bp, Homo sapiens
ggcaaggaaag

SEQ ID NO: 5011933 - DNA, 22 bp, Homo sapiens
ggcaaggaaaggggagaaggga

SEQ ID NO: 5011934 - DNA, 16 bp, Homo sapiens
ggcacaggaggcaggc

SEQ ID NO: 5011935 - DNA, 10 bp, Homo sapiens
ggcaggctgg

SEQ ID NO: 5011936 - DNA, 15 bp, Homo sapiens
ggcaggctgggccat

SEQ ID NO: 5011937 - DNA, 17 bp, Homo sapiens
ggcagggagctgggccc

SEQ ID NO: 5011938 - DNA, 16 bp, Homo sapiens
ggcatggccctgggcg

SEQ ID NO: 5011939 - DNA, 21 bp, Homo sapiens
ggccaagaatgtacgtccagc

SEQ ID NO: 5011940 - DNA, 16 bp, Homo sapiens
ggccaagtccgcagaa

SEQ ID NO: 5011941 - DNA, 23 bp, Homo sapiens
ggccaagtccgcagaagccctga

SEQ ID NO: 5011942 - DNA, 12 bp, Homo sapiens
ggccacatggcg

SEQ ID NO: 5011943 - DNA, 13 bp, Homo sapiens
ggccatgtccaaa

SEQ ID NO: 5011944 - DNA, 16 bp, Homo sapiens
ggccatgtccaaagag

SEQ ID NO: 5011945 - DNA, 22 bp, Homo sapiens
ggccatgtccaaagaggctgcc

SEQ ID NO: 5011946 - DNA, 23 bp, Homo sapiens
ggccatgtccaaagaggctgccc

SEQ ID NO: 5011947 - DNA, 20 bp, Homo sapiens
ggcccacccggtgggacccc

SEQ ID NO: 5011948 - DNA, 13 bp, Homo sapiens
ggcccgcgcagct

SEQ ID NO: 5011949 - DNA, 16 bp, Homo sapiens
ggcccgcgcagctgcc

SEQ ID NO: 5011950 - DNA, 17 bp, Homo sapiens
ggcccgcgcagctgcct

SEQ ID NO: 5011951 - DNA, 15 bp, Homo sapiens
ggccggccctgtgtg

SEQ ID NO: 5011952 - DNA, 19 bp, Homo sapiens
ggcctgggtgatctgctgc

SEQ ID NO: 5011953 - DNA, 19 bp, Homo sapiens
ggccttgccccaggccctg

SEQ ID NO: 5011954 - DNA, 20 bp, Homo sapiens
ggccttgccccaggccctgc

SEQ ID NO: 5011955 - DNA, 18 bp, Homo sapiens
ggcgtgaggcctgggctg

SEQ ID NO: 5011956 - DNA, 17 bp, Homo sapiens
ggcgtggagggaggccc

SEQ ID NO: 5011957 - DNA, 14 bp, Homo sapiens
ggctccggcctctg

SEQ ID NO: 5011958 - DNA, 15 bp, Homo sapiens
ggctccggcctctgc

SEQ ID NO: 5011959 - DNA, 17 bp, Homo sapiens
ggctccggcctctgcct

SEQ ID NO: 5011960 - DNA, 13 bp, Homo sapiens
ggctgcccctctc

SEQ ID NO: 5011961 - DNA, 15 bp, Homo sapiens
ggctgcccctctcac

SEQ ID NO: 5011962 - DNA, 16 bp, Homo sapiens
ggctggaaggggtcca

SEQ ID NO: 5011963 - DNA, 11 bp, Homo sapiens
ggctgggccat

SEQ ID NO: 5011964 - DNA, 17 bp, Homo sapiens
ggctgggccatgtccaa

SEQ ID NO: 5011965 - DNA, 19 bp, Homo sapiens
gggaaacactgaaatgaaa

SEQ ID NO: 5011966 - DNA, 15 bp, Homo sapiens
gggaagctggcctga

SEQ ID NO: 5011967 - DNA, 16 bp, Homo sapiens
gggaagctggcctgag

SEQ ID NO: 5011968 - DNA, 13 bp, Homo sapiens
gggaaggcctgac

SEQ ID NO: 5011969 - DNA, 22 bp, Homo sapiens
gggagacggtttccagggaggg

SEQ ID NO: 5011970 - DNA, 19 bp, Homo sapiens
gggagctgggcccgacatg

SEQ ID NO: 5011971 - DNA, 18 bp, Homo sapiens
gggaggcaagtgtggggg

SEQ ID NO: 5011972 - DNA, 17 bp, Homo sapiens
gggaggggccggccctg

SEQ ID NO: 5011973 - DNA, 22 bp, Homo sapiens
gggattttttactgccctttca

SEQ ID NO: 5011974 - DNA, 15 bp, Homo sapiens
gggcagctgtccctt

SEQ ID NO: 5011975 - DNA, 11 bp, Homo sapiens
gggcagggagc

SEQ ID NO: 5011976 - DNA, 20 bp, Homo sapiens
gggcagggagctgggcccga

SEQ ID NO: 5011977 - DNA, 18 bp, Homo sapiens
gggcccgacatggctccg

SEQ ID NO: 5011978 - DNA, 12 bp, Homo sapiens
gggccggccctg

SEQ ID NO: 5011979 - DNA, 18 bp, Homo sapiens
gggccttttctggcaccg

SEQ ID NO: 5011980 - DNA, 21 bp, Homo sapiens
gggctacagaaaccacagtct

SEQ ID NO: 5011981 - DNA, 15 bp, Homo sapiens
gggctcatgcctgta

SEQ ID NO: 5011982 - DNA, 15 bp, Homo sapiens
gggctctgggtgctg

SEQ ID NO: 5011983 - DNA, 21 bp, Homo sapiens
ggggaacctgccatgccagga

SEQ ID NO: 5011984 - DNA, 22 bp, Homo sapiens
ggggaacctgccatgccaggaa

SEQ ID NO: 5011985 - DNA, 14 bp, Homo sapiens
ggggcaggctgggc

SEQ ID NO: 5011986 - DNA, 16 bp, Homo sapiens
ggggcaggctgggcca

SEQ ID NO: 5011987 - DNA, 17 bp, Homo sapiens
ggggcagggagctgggc

SEQ ID NO: 5011988 - DNA, 19 bp, Homo sapiens
ggggcagggagctgggccc

SEQ ID NO: 5011989 - DNA, 20 bp, Homo sapiens
ggggccggccctgtgtgcag

SEQ ID NO: 5011990 - DNA, 19 bp, Homo sapiens
ggggcgtggagggaggccc

SEQ ID NO: 5011991 - DNA, 16 bp, Homo sapiens
ggggtccctagcagcc

SEQ ID NO: 5011992 - DNA, 23 bp, Homo sapiens
gggtgattttatgatcagtgttg

SEQ ID NO: 5011993 - DNA, 13 bp, Homo sapiens
ggtatatatacat

SEQ ID NO: 5011994 - DNA, 22 bp, Homo sapiens
ggtccagcctcgttggaagagg

SEQ ID NO: 5011995 - DNA, 18 bp, Homo sapiens
ggtccagtggatgccaca

SEQ ID NO: 5011996 - DNA, 13 bp, Homo sapiens
ggtctcacccatg

SEQ ID NO: 5011997 - DNA, 20 bp, Homo sapiens
ggtctcttcttggggcccag

SEQ ID NO: 5011998 - DNA, 15 bp, Homo sapiens
ggtctgccttctgct

SEQ ID NO: 5011999 - DNA, 17 bp, Homo sapiens
ggtctgccttctgctga

SEQ ID NO: 5012000 - DNA, 11 bp, Homo sapiens
ggtgcagaggt

SEQ ID NO: 5012001 - DNA, 16 bp, Homo sapiens
tggccacatggcggag

SEQ ID NO: 5012002 - DNA, 18 bp, Homo sapiens
tggccagaggtgtcaccc

SEQ ID NO: 5012003 - DNA, 12 bp, Homo sapiens
tggccctgggcg

SEQ ID NO: 5012004 - DNA, 13 bp, Homo sapiens
tggccctttcctt

SEQ ID NO: 5012005 - DNA, 14 bp, Homo sapiens
tggcggagagtttt

SEQ ID NO: 5012006 - DNA, 13 bp, Homo sapiens
tggctggaagggg

SEQ ID NO: 5012007 - DNA, 18 bp, Homo sapiens
tggctggaaggggtccag

SEQ ID NO: 5012008 - DNA, 17 bp, Homo sapiens
tgggacccccgtggggc

SEQ ID NO: 5012009 - DNA, 19 bp, Homo sapiens
tgggcagctgtcccttgct

SEQ ID NO: 5012010 - DNA, 17 bp, Homo sapiens
tgggccatgtccaaaga

SEQ ID NO: 5012011 - DNA, 24 bp, Homo sapiens
tgggccatgtccaaagaggctgcc

SEQ ID NO: 5012012 - DNA, 21 bp, Homo sapiens
tgggccctgagtctgggcagc

SEQ ID NO: 5012013 - DNA, 14 bp, Homo sapiens
tggggcaggctggg

SEQ ID NO: 5012014 - DNA, 12 bp, Homo sapiens
tggggcccagtg

SEQ ID NO: 5012015 - DNA, 19 bp, Homo sapiens
tggggcccagtgcatggtg

SEQ ID NO: 5012016 - DNA, 16 bp, Homo sapiens
tgggggcacaggaggc

SEQ ID NO: 5012017 - DNA, 16 bp, Homo sapiens
tggtacaacggaggcc

SEQ ID NO: 5012018 - DNA, 20 bp, Homo sapiens
tggtatatactttgccactg

SEQ ID NO: 5012019 - DNA, 14 bp, Homo sapiens
tggtatatatacat

SEQ ID NO: 5012020 - DNA, 18 bp, Homo sapiens
tggtctgccttctgctga

SEQ ID NO: 5012021 - DNA, 20 bp, Homo sapiens
tggtgctggaaccagctctc

SEQ ID NO: 5012022 - DNA, 13 bp, Homo sapiens
tgtaaaacttctg

SEQ ID NO: 5012023 - DNA, 17 bp, Homo sapiens
tgtaaaacttctgctcg

SEQ ID NO: 5012024 - DNA, 18 bp, Homo sapiens
tgtaaatgaaacttaaga

SEQ ID NO: 5012025 - DNA, 19 bp, Homo sapiens
tgtacagagtgcttttctg

SEQ ID NO: 5012026 - DNA, 17 bp, Homo sapiens
tgtacatttctataaat

SEQ ID NO: 5012027 - DNA, 17 bp, Homo sapiens
tgtacgtccagcctgcc

SEQ ID NO: 5012028 - DNA, 16 bp, Homo sapiens
tgtagggttacagaga

SEQ ID NO: 5012029 - DNA, 15 bp, Homo sapiens
ttgccccaggccctg

SEQ ID NO: 5012030 - DNA, 15 bp, Homo sapiens
ttgcctgcagggcca

SEQ ID NO: 5012031 - DNA, 19 bp, Homo sapiens
ttgctgtgtgtcccaggca

SEQ ID NO: 5012032 - DNA, 15 bp, Homo sapiens
ttgcttcttactgat

SEQ ID NO: 5012033 - DNA, 14 bp, Homo sapiens
ttggaaggagaggg

SEQ ID NO: 5012034 - DNA, 22 bp, Homo sapiens
ttggagatgctgagggtgtttc

SEQ ID NO: 5012035 - DNA, 14 bp, Homo sapiens
ttggccctttcctt

SEQ ID NO: 5012036 - DNA, 19 bp, Homo sapiens
ttggccctttccttccaga

SEQ ID NO: 5012037 - DNA, 19 bp, Homo sapiens
ttggtctgccttctgctga

SEQ ID NO: 5012038 - DNA, 17 bp, Homo sapiens
ttgtaaaacttctgctc

SEQ ID NO: 5012039 - DNA, 18 bp, Homo sapiens
ttgtaaaacttctgctcg

SEQ ID NO: 5012040 - DNA, 18 bp, Homo sapiens
ttgtaaatgaaacttaag

SEQ ID NO: 5012041 - DNA, 16 bp, Homo sapiens
ttgtttggcaaggaaa

SEQ ID NO: 5012042 - DNA, 14 bp, Homo sapiens
ttgttttaaaactg

SEQ ID NO: 5012043 - DNA, 17 bp, Homo sapiens
tttaagaaagtaattta

SEQ ID NO: 5012044 - DNA, 12 bp, Homo sapiens
tttactttggcc

SEQ ID NO: 5012045 - DNA, 18 bp, Homo sapiens
tttatccaaaatgtgtat

SEQ ID NO: 5012046 - DNA, 20 bp, Homo sapiens
tttatccaaaatgtgtattt

SEQ ID NO: 5012047 - DNA, 22 bp, Homo sapiens
tttatccaaaatgtgtatttct

SEQ ID NO: 5012048 - DNA, 18 bp, Homo sapiens
tttatgcaaaaggtttat

SEQ ID NO: 5012049 - DNA, 21 bp, Homo sapiens
tttatgctactgaactgaaag

SEQ ID NO: 5012050 - DNA, 16 bp, Homo sapiens
tttattatgcattata

SEQ ID NO: 5012051 - DNA, 15 bp, Homo sapiens
tttatttttgcacaa

SEQ ID NO: 5012052 - DNA, 18 bp, Homo sapiens
tttatttttgcacaactt

SEQ ID NO: 5012053 - DNA, 17 bp, Homo sapiens
tttattttttggacttc

SEQ ID NO: 5012054 - DNA, 14 bp, Homo sapiens
tttcaatgacattt

SEQ ID NO: 5012055 - DNA, 19 bp, Homo sapiens
tttccatagcaacaggaaa

SEQ ID NO: 5012056 - DNA, 19 bp, Homo sapiens
tttcctcagcttatctctt

SEQ ID NO: 5012057 - DNA, 15 bp, Homo sapiens
tttctcccaagctga

SEQ ID NO: 5012058 - DNA, 23 bp, Homo sapiens
tttctctgccgctacctccctcc

SEQ ID NO: 5012059 - DNA, 12 bp, Homo sapiens
tttctggcaccg

SEQ ID NO: 5012060 - DNA, 13 bp, Homo sapiens
tttgtgcattctg

SEQ ID NO: 5012061 - DNA, 17 bp, Homo sapiens
tttgttataccatttcc

SEQ ID NO: 5012062 - DNA, 15 bp, Homo sapiens
ttttaaaactggacc

SEQ ID NO: 5012063 - DNA, 20 bp, Homo sapiens
ttttaaaactggacctgtat

SEQ ID NO: 5012064 - DNA, 17 bp, Homo sapiens
ttttatagcctggactg

SEQ ID NO: 5012065 - DNA, 12 bp, Homo sapiens
ttttatatttgt

SEQ ID NO: 5012066 - DNA, 13 bp, Homo sapiens
ttttatgatcagt

SEQ ID NO: 5012067 - DNA, 22 bp, Homo sapiens
ttttctcccaagctgattttat

SEQ ID NO: 5012068 - DNA, 17 bp, Homo sapiens
ttttggactccatctct

SEQ ID NO: 5012069 - DNA, 19 bp, Homo sapiens
ttttgtaaatgaaacttaa

SEQ ID NO: 5012070 - DNA, 20 bp, Homo sapiens
ttttgttccaatgtcaatgt

SEQ ID NO: 5012071 - DNA, 22 bp, Homo sapiens
ttttgttttaaaactggacctg

SEQ ID NO: 5012072 - DNA, 13 bp, Homo sapiens
tttttaagaaagt

SEQ ID NO: 5012073 - DNA, 21 bp, Homo sapiens
tttttaagaaagtaatttaat

SEQ ID NO: 5012074 - DNA, 18 bp, Homo sapiens
tttttggacttcaaagca

SEQ ID NO: 5012075 - DNA, 18 bp, Homo sapiens
tcttacacactgtctgta

SEQ ID NO: 5012076 - DNA, 16 bp, Homo sapiens
tcttactgataatttt

SEQ ID NO: 5012077 - DNA, 16 bp, Homo sapiens
tcttatacgcttttct

SEQ ID NO: 5012078 - DNA, 20 bp, Homo sapiens
tcttatacgcttttctttgt

SEQ ID NO: 5012079 - DNA, 19 bp, Homo sapiens
tcttcttggggcccagtgc

SEQ ID NO: 5012080 - DNA, 19 bp, Homo sapiens
tcttgcctccaggtgcaga

SEQ ID NO: 5012081 - DNA, 16 bp, Homo sapiens
tgaaacctacacactg

SEQ ID NO: 5012082 - DNA, 18 bp, Homo sapiens
tgaaagagccagactctg

SEQ ID NO: 5012083 - DNA, 22 bp, Homo sapiens
tgaaagagccagactctgtctc

SEQ ID NO: 5012084 - DNA, 17 bp, Homo sapiens
tgaaagccttagggaag

SEQ ID NO: 5012085 - DNA, 14 bp, Homo sapiens
tgaaatcttcccag

SEQ ID NO: 5012086 - DNA, 15 bp, Homo sapiens
tgaaatcttcccagt

SEQ ID NO: 5012087 - DNA, 16 bp, Homo sapiens
tgaacgtccacatgaa

SEQ ID NO: 5012088 - DNA, 14 bp, Homo sapiens
tgaagcttgactcc

SEQ ID NO: 5012089 - DNA, 16 bp, Homo sapiens
tgaaggaaattcttat

SEQ ID NO: 5012090 - DNA, 18 bp, Homo sapiens
tgaagtgcagctcatgtt

SEQ ID NO: 5012091 - DNA, 22 bp, Homo sapiens
tgacaactgtgaagccaccctg

SEQ ID NO: 5012092 - DNA, 21 bp, Homo sapiens
tgacctctgacaactgtgaag

SEQ ID NO: 5012093 - DNA, 17 bp, Homo sapiens
tgacctggactgaagtt

SEQ ID NO: 5012094 - DNA, 12 bp, Homo sapiens
tgacgctgctga

SEQ ID NO: 5012095 - DNA, 21 bp, Homo sapiens
tgacgtgctccgtagctctgc

SEQ ID NO: 5012096 - DNA, 15 bp, Homo sapiens
tgactggtgctgcag

SEQ ID NO: 5012097 - DNA, 23 bp, Homo sapiens
tgacttcagggaaggtgaaacag

SEQ ID NO: 5012098 - DNA, 21 bp, Homo sapiens
tgacttctgctggcatcaaga

SEQ ID NO: 5012099 - DNA, 17 bp, Homo sapiens
tgagactcagtgcagat

SEQ ID NO: 5012100 - DNA, 20 bp, Homo sapiens
tgagagctgtttttgacagc

SEQ ID NO: 5012101 - DNA, 12 bp, Homo sapiens
tgagaggggaag

SEQ ID NO: 5012102 - DNA, 20 bp, Homo sapiens
tgagagtatagcatgaatgt

SEQ ID NO: 5012103 - DNA, 13 bp, Homo sapiens
tgagcctgcaggg

SEQ ID NO: 5012104 - DNA, 22 bp, Homo sapiens
tgaggggtccctagcagcccac

SEQ ID NO: 5012105 - DNA, 20 bp, Homo sapiens
ccttagggaagctggcctga

SEQ ID NO: 5012106 - DNA, 20 bp, Homo sapiens
ccttcagtgaactaagtccc

SEQ ID NO: 5012107 - DNA, 21 bp, Homo sapiens
ccttcagtgaactaagtccct

SEQ ID NO: 5012108 - DNA, 14 bp, Homo sapiens
ccttgccccaggcc

SEQ ID NO: 5012109 - DNA, 15 bp, Homo sapiens
ccttgcccccagtgc

SEQ ID NO: 5012110 - DNA, 19 bp, Homo sapiens
ccttgcccccagtgcctca

SEQ ID NO: 5012111 - DNA, 21 bp, Homo sapiens
ccttgctgtatgctgatcatc

SEQ ID NO: 5012112 - DNA, 22 bp, Homo sapiens
ccttggtgccctcgcctcctcc

SEQ ID NO: 5012113 - DNA, 12 bp, Homo sapiens
ccttgtgcctgg

SEQ ID NO: 5012114 - DNA, 13 bp, Homo sapiens
ccttgtgcctggg

SEQ ID NO: 5012115 - DNA, 15 bp, Homo sapiens
ccttgtgcctggggt

SEQ ID NO: 5012116 - DNA, 15 bp, Homo sapiens
cctttggagatgctg

SEQ ID NO: 5012117 - DNA, 13 bp, Homo sapiens
cctttgttctggg

SEQ ID NO: 5012118 - DNA, 14 bp, Homo sapiens
cgaacttcacaact

SEQ ID NO: 5012119 - DNA, 23 bp, Homo sapiens
cgacatggctccggcctctgcct

SEQ ID NO: 5012120 - DNA, 23 bp, Homo sapiens
cgaccctgggggcacaggaggca

SEQ ID NO: 5012121 - DNA, 13 bp, Homo sapiens
cgcagaagccctg

SEQ ID NO: 5012122 - DNA, 16 bp, Homo sapiens
cgcatcttgcctccag

SEQ ID NO: 5012123 - DNA, 17 bp, Homo sapiens
cgccagaggtgcttcac

SEQ ID NO: 5012124 - DNA, 20 bp, Homo sapiens
cgccgatagagggacggcca

SEQ ID NO: 5012125 - DNA, 12 bp, Homo sapiens
cgcgcagctgcc

SEQ ID NO: 5012126 - DNA, 14 bp, Homo sapiens
cgctacctccctcc

SEQ ID NO: 5012127 - DNA, 20 bp, Homo sapiens
cggaggcctgcgaccctggg

SEQ ID NO: 5012128 - DNA, 21 bp, Homo sapiens
cggaggcctgcgaccctgggg

SEQ ID NO: 5012129 - DNA, 18 bp, Homo sapiens
cggcccgcgcagctgcct

SEQ ID NO: 5012130 - DNA, 15 bp, Homo sapiens
cggccctgtgtgcag

SEQ ID NO: 5012131 - DNA, 13 bp, Homo sapiens
cggtttccaggga

SEQ ID NO: 5012132 - DNA, 19 bp, Homo sapiens
cgtgctccgtagctctgct

SEQ ID NO: 5012133 - DNA, 20 bp, Homo sapiens
cgtgctccgtagctctgctg

SEQ ID NO: 5012134 - DNA, 21 bp, Homo sapiens
cgtgctccgtagctctgctgc

SEQ ID NO: 5012135 - DNA, 22 bp, Homo sapiens
cgtggggcagggagctgggccc

SEQ ID NO: 5012136 - DNA, 20 bp, Homo sapiens
cgttctgtactgttactggg

SEQ ID NO: 5012137 - DNA, 15 bp, Homo sapiens
cgttggttaaataaa

SEQ ID NO: 5012138 - DNA, 17 bp, Homo sapiens
cgttgtctgtggatggt

SEQ ID NO: 5012139 - DNA, 16 bp, Homo sapiens
ctaattcttctgtcct

SEQ ID NO: 5012140 - DNA, 20 bp, Homo sapiens
ctaattttctcccaagctga

SEQ ID NO: 5012141 - DNA, 23 bp, Homo sapiens
ctacctccctccccgtctcattc

SEQ ID NO: 5012142 - DNA, 20 bp, Homo sapiens
ctacctctctgtcccttgct

SEQ ID NO: 5012143 - DNA, 19 bp, Homo sapiens
ctagccagtgctccaggca

SEQ ID NO: 5012144 - DNA, 16 bp, Homo sapiens
ctataataaaggctga

SEQ ID NO: 5012145 - DNA, 13 bp, Homo sapiens
ctcacaccaaatt

SEQ ID NO: 5012146 - DNA, 18 bp, Homo sapiens
ctcagggagcagggaagg

SEQ ID NO: 5012147 - DNA, 10 bp, Homo sapiens
ctcagtgcag

SEQ ID NO: 5012148 - DNA, 15 bp, Homo sapiens
ctcagtgcagatgga

SEQ ID NO: 5012149 - DNA, 13 bp, Homo sapiens
ctcatcctccagt

SEQ ID NO: 5012150 - DNA, 12 bp, Homo sapiens
ctcatctcaggt

SEQ ID NO: 5012151 - DNA, 20 bp, Homo sapiens
ctcatgtttttaacttttaa

SEQ ID NO: 5012152 - DNA, 18 bp, Homo sapiens
ctccaggaagcccagggc

SEQ ID NO: 5012153 - DNA, 15 bp, Homo sapiens
ctccagggtgatttt

SEQ ID NO: 5012154 - DNA, 13 bp, Homo sapiens
ctccaggtgcaga

SEQ ID NO: 5012155 - DNA, 18 bp, Homo sapiens
ctccaggtgcagaggtac

SEQ ID NO: 5012156 - DNA, 17 bp, Homo sapiens
ctcccaagctgatttta

SEQ ID NO: 5012157 - DNA, 19 bp, Homo sapiens
ctcccaagtttccatagca

SEQ ID NO: 5012158 - DNA, 18 bp, Homo sapiens
ctcccacacccaaagctg

SEQ ID NO: 5012159 - DNA, 16 bp, Homo sapiens
ctcccaggccccaggc

SEQ ID NO: 5012160 - DNA, 16 bp, Homo sapiens
ctccccagcccacctg

SEQ ID NO: 5012161 - DNA, 18 bp, Homo sapiens
ctccccagcccacctgct

SEQ ID NO: 5012162 - DNA, 23 bp, Homo sapiens
ctccccggcatgagactcagtgc

SEQ ID NO: 5012163 - DNA, 22 bp, Homo sapiens
ctccctctgtccctctccttgc

SEQ ID NO: 5012164 - DNA, 16 bp, Homo sapiens
ctcccttggtgccctc

SEQ ID NO: 5012165 - DNA, 17 bp, Homo sapiens
ctcccttggtgccctcg

SEQ ID NO: 5012166 - DNA, 18 bp, Homo sapiens
ctccggcttgacctgttt

SEQ ID NO: 5012167 - DNA, 16 bp, Homo sapiens
ctccgtagctctgctg

SEQ ID NO: 5012168 - DNA, 12 bp, Homo sapiens
ctcctcctgccc

SEQ ID NO: 5012169 - DNA, 10 bp, Homo sapiens
ctcctctccc

SEQ ID NO: 5012170 - DNA, 20 bp, Homo sapiens
ctcctgacgtctgaagcttg

SEQ ID NO: 5012171 - DNA, 16 bp, Homo sapiens
ctcctgactggtgctg

SEQ ID NO: 5012172 - DNA, 12 bp, Homo sapiens
ctcctgccctcc

SEQ ID NO: 5012173 - DNA, 13 bp, Homo sapiens
ctcctgccctcct

SEQ ID NO: 5012174 - DNA, 17 bp, Homo sapiens
ctccttgcccccagtgc

SEQ ID NO: 5012175 - DNA, 12 bp, Homo sapiens
ctcgcctcctcc

SEQ ID NO: 5012176 - DNA, 13 bp, Homo sapiens
ctcgcctcctcct

SEQ ID NO: 5012177 - DNA, 14 bp, Homo sapiens
ctcgcctcctcctc

SEQ ID NO: 5012178 - DNA, 17 bp, Homo sapiens
ctcgcctcctcctcctg

SEQ ID NO: 5012179 - DNA, 15 bp, Homo sapiens
ctcggcccctcccac

SEQ ID NO: 5012180 - DNA, 18 bp, Homo sapiens
ctcgttggaagaggaaca

SEQ ID NO: 5012181 - DNA, 13 bp, Homo sapiens
ctctcagtgtttt

SEQ ID NO: 5012182 - DNA, 19 bp, Homo sapiens
ctctcatcctccagtacct

SEQ ID NO: 5012183 - DNA, 13 bp, Homo sapiens
ctctcatctcagg

SEQ ID NO: 5012184 - DNA, 21 bp, Homo sapiens
ctctccttgcccccagtgcct

SEQ ID NO: 5012185 - DNA, 18 bp, Homo sapiens
ctctctgtcccttgctgt

SEQ ID NO: 5012186 - DNA, 13 bp, Homo sapiens
ctctgctgctgat

SEQ ID NO: 5012187 - DNA, 16 bp, Homo sapiens
ctctgggtgctgccct

SEQ ID NO: 5012188 - DNA, 13 bp, Homo sapiens
ctctgtccctctc

SEQ ID NO: 5012189 - DNA, 16 bp, Homo sapiens
ctctgtccctctcctt

SEQ ID NO: 5012190 - DNA, 16 bp, Homo sapiens
ctctgtcccttgctgt

SEQ ID NO: 5012191 - DNA, 16 bp, Homo sapiens
ctctgttggtctgcct

SEQ ID NO: 5012192 - DNA, 18 bp, Homo sapiens
ctctgttggtctgccttc

SEQ ID NO: 5012193 - DNA, 22 bp, Homo sapiens
ctctgttggtctgccttctgct

SEQ ID NO: 5012194 - DNA, 16 bp, Homo sapiens
ctcttttatatttgta

SEQ ID NO: 5012195 - DNA, 20 bp, Homo sapiens
ctgaaacctagtactgcccc

SEQ ID NO: 5012196 - DNA, 15 bp, Homo sapiens
ctgaagcttgactcc

SEQ ID NO: 5012197 - DNA, 22 bp, Homo sapiens
ctgaatgtttaaagatcatgac

SEQ ID NO: 5012198 - DNA, 15 bp, Homo sapiens
ctgacagtttttctg

SEQ ID NO: 5012199 - DNA, 16 bp, Homo sapiens
ctgacagtttttctgt

SEQ ID NO: 5012200 - DNA, 22 bp, Homo sapiens
ctgacgtctgaagcttgactcc

SEQ ID NO: 5012201 - DNA, 16 bp, Homo sapiens
ctgactcatcatttgt

SEQ ID NO: 5012202 - DNA, 13 bp, Homo sapiens
ctgagagctgttt

SEQ ID NO: 5012203 - DNA, 15 bp, Homo sapiens
ctgagcctgcaggga

SEQ ID NO: 5012204 - DNA, 18 bp, Homo sapiens
ctgagcctgcagggaagc

SEQ ID NO: 5012205 - DNA, 14 bp, Homo sapiens
ctgaggctgcatct

SEQ ID NO: 5012206 - DNA, 19 bp, Homo sapiens
ctgagggtgtttcttcctg

SEQ ID NO: 5012207 - DNA, 20 bp, Homo sapiens
ctgagggtgtttcttcctgc

SEQ ID NO: 5012208 - DNA, 15 bp, Homo sapiens
ctgagttttgttttg

SEQ ID NO: 5012209 - DNA, 18 bp, Homo sapiens
ctgatcatcgccagaggt

SEQ ID NO: 5012210 - DNA, 20 bp, Homo sapiens
ctgatgtgtcctcagggagc

SEQ ID NO: 5012211 - DNA, 11 bp, Homo sapiens
ctgcagggcca

SEQ ID NO: 5012212 - DNA, 19 bp, Homo sapiens
ctgcagggccatggctcag

SEQ ID NO: 5012213 - DNA, 20 bp, Homo sapiens
ctgcagttctcatgactcct

SEQ ID NO: 5012214 - DNA, 17 bp, Homo sapiens
ctgccatgccaggaacc

SEQ ID NO: 5012215 - DNA, 13 bp, Homo sapiens
ctgcccctctcac

SEQ ID NO: 5012216 - DNA, 11 bp, Homo sapiens
ctgccctcctc

SEQ ID NO: 5012217 - DNA, 16 bp, Homo sapiens
ctgccctcctctcccc

SEQ ID NO: 5012218 - DNA, 18 bp, Homo sapiens
ctgccttctgctgaaaga

SEQ ID NO: 5012219 - DNA, 20 bp, Homo sapiens
ctgcctttgcaccacgggac

SEQ ID NO: 5012220 - DNA, 14 bp, Homo sapiens
ctgcgctgcttggt

SEQ ID NO: 5012221 - DNA, 16 bp, Homo sapiens
ctgcgctgcttggtgt

SEQ ID NO: 5012222 - DNA, 20 bp, Homo sapiens
ctgctacctttcaaagcttg

SEQ ID NO: 5012223 - DNA, 12 bp, Homo sapiens
ctgctcccaggc

SEQ ID NO: 5012224 - DNA, 19 bp, Homo sapiens
ctgctcccaggccccaggc

SEQ ID NO: 5012225 - DNA, 21 bp, Homo sapiens
ctgctcgtttacactgcacat

SEQ ID NO: 5012226 - DNA, 22 bp, Homo sapiens
ctgctgaaagactcgagaacca

SEQ ID NO: 5012227 - DNA, 15 bp, Homo sapiens
ctgctggcatcaaga

SEQ ID NO: 5012228 - DNA, 23 bp, Homo sapiens
ctggaattcctaacttttcaatg

SEQ ID NO: 5012229 - DNA, 20 bp, Homo sapiens
ctggagagaagcaagccagc

SEQ ID NO: 5012230 - DNA, 22 bp, Homo sapiens
ctggaggatcccctccaagcct

SEQ ID NO: 5012231 - DNA, 17 bp, Homo sapiens
ctgggcagctgtccctt

SEQ ID NO: 5012232 - DNA, 19 bp, Homo sapiens
ctgggcagctgtcccttgc

SEQ ID NO: 5012233 - DNA, 22 bp, Homo sapiens
ctgggccatgtccaaagaggct

SEQ ID NO: 5012234 - DNA, 19 bp, Homo sapiens
ctgggctacagaaaccaca

SEQ ID NO: 5012235 - DNA, 14 bp, Homo sapiens
ctggggcaggctgg

SEQ ID NO: 5012236 - DNA, 21 bp, Homo sapiens
ctggggcaggctgggccatgt

SEQ ID NO: 5012237 - DNA, 14 bp, Homo sapiens
ctgggggcacagga

SEQ ID NO: 5012238 - DNA, 13 bp, Homo sapiens
ctgggtgctgccc

SEQ ID NO: 5012239 - DNA, 19 bp, Homo sapiens
ctggttccctgctgcgctg

SEQ ID NO: 5012240 - DNA, 20 bp, Homo sapiens
ctgtactgttactgggccct

SEQ ID NO: 5012241 - DNA, 19 bp, Homo sapiens
ctgtatatttgtaaagcta

SEQ ID NO: 5012242 - DNA, 18 bp, Homo sapiens
ctgtatttttatttttgc

SEQ ID NO: 5012243 - DNA, 15 bp, Homo sapiens
ctgtcaccaaggaaa

SEQ ID NO: 5012244 - DNA, 16 bp, Homo sapiens
ctgtcaccaaggaaac

SEQ ID NO: 5012245 - DNA, 18 bp, Homo sapiens
ctgtcccttgcttgcctg

SEQ ID NO: 5012246 - DNA, 17 bp, Homo sapiens
ctgtcctaaggaacctt

SEQ ID NO: 5012247 - DNA, 18 bp, Homo sapiens
ctgtgcaacggtctcctg

SEQ ID NO: 5012248 - DNA, 22 bp, Homo sapiens
ctgtgcaacggtctcctgactg

SEQ ID NO: 5012249 - DNA, 13 bp, Homo sapiens
ctgtgtgcaggtt

SEQ ID NO: 5012250 - DNA, 23 bp, Homo sapiens
ctgtgtgtcccaggcagggagac

SEQ ID NO: 5012251 - DNA, 23 bp, Homo sapiens
ctgttatatatttactcagtctt

SEQ ID NO: 5012252 - DNA, 16 bp, Homo sapiens
ctgttggtctgccttc

SEQ ID NO: 5012253 - DNA, 21 bp, Homo sapiens
ctgttggtctgccttctgctg

SEQ ID NO: 5012254 - DNA, 21 bp, Homo sapiens
ctgttttgtttggcaaggaaa

SEQ ID NO: 5012255 - DNA, 15 bp, Homo sapiens
cttacacactgtctg

SEQ ID NO: 5012256 - DNA, 18 bp, Homo sapiens
cttataagtaaagacagc

SEQ ID NO: 5012257 - DNA, 19 bp, Homo sapiens
cttatacgcttttctttgt

SEQ ID NO: 5012258 - DNA, 22 bp, Homo sapiens
cttattgacaaccgagaaggtt

SEQ ID NO: 5012259 - DNA, 15 bp, Homo sapiens
cttcaccctgagttt

SEQ ID NO: 5012260 - DNA, 16 bp, Homo sapiens
cttccaggggaacctg

SEQ ID NO: 5012261 - DNA, 13 bp, Homo sapiens
cttcccaccctgc

SEQ ID NO: 5012262 - DNA, 16 bp, Homo sapiens
cttcccagcgctgctg

SEQ ID NO: 5012263 - DNA, 13 bp, Homo sapiens
cttctagagtttt

SEQ ID NO: 5012264 - DNA, 19 bp, Homo sapiens
cttctccaggaagcccagg

SEQ ID NO: 5012265 - DNA, 17 bp, Homo sapiens
cttctctgttggtctgc

SEQ ID NO: 5012266 - DNA, 11 bp, Homo sapiens
cttctgctgaa

SEQ ID NO: 5012267 - DNA, 24 bp, Homo sapiens
cttcttggggcccagtgcatggtg

SEQ ID NO: 5012268 - DNA, 20 bp, Homo sapiens
cttgaagtctaaaagcagaa

SEQ ID NO: 5012269 - DNA, 17 bp, Homo sapiens
cttgagttcccagatgg

SEQ ID NO: 5012270 - DNA, 13 bp, Homo sapiens
cttgatgtatttc

SEQ ID NO: 5012271 - DNA, 20 bp, Homo sapiens
cttgcccccagtgcctcacc

SEQ ID NO: 5012272 - DNA, 13 bp, Homo sapiens
cttgcctccaggt

SEQ ID NO: 5012273 - DNA, 18 bp, Homo sapiens
cttgcctccaggtgcaga

SEQ ID NO: 5012274 - DNA, 16 bp, Homo sapiens
cttgcctgcagggcca

SEQ ID NO: 5012275 - DNA, 13 bp, Homo sapiens
cttgctgtatgct

SEQ ID NO: 5012276 - DNA, 14 bp, Homo sapiens
cttgcttcttactg

SEQ ID NO: 5012277 - DNA, 19 bp, Homo sapiens
cttgcttcttactgataat

SEQ ID NO: 5012278 - DNA, 14 bp, Homo sapiens
cttggagggaagcc

SEQ ID NO: 5012279 - DNA, 16 bp, Homo sapiens
cttggggcccagtgca

SEQ ID NO: 5012280 - DNA, 16 bp, Homo sapiens
cttgtccctccaactg

SEQ ID NO: 5012281 - DNA, 15 bp, Homo sapiens
ctttaaacaccccca

SEQ ID NO: 5012282 - DNA, 16 bp, Homo sapiens
ctttgaagtgcagctc

SEQ ID NO: 5012283 - DNA, 14 bp, Homo sapiens
ctttgccactgctg

SEQ ID NO: 5012284 - DNA, 18 bp, Homo sapiens
ctttggagatgctgaggg

SEQ ID NO: 5012285 - DNA, 15 bp, Homo sapiens
ctttgtacagagtgc

SEQ ID NO: 5012286 - DNA, 19 bp, Homo sapiens
ctttgtacagagtgctttt

SEQ ID NO: 5012287 - DNA, 13 bp, Homo sapiens
ctttgtgcattct

SEQ ID NO: 5012288 - DNA, 14 bp, Homo sapiens
cttttctggcaccg

SEQ ID NO: 5012289 - DNA, 15 bp, Homo sapiens
cttttctggcaccgc

SEQ ID NO: 5012290 - DNA, 21 bp, Homo sapiens
gaaacctacacactgtcatgc

SEQ ID NO: 5012291 - DNA, 23 bp, Homo sapiens
gaaacgctacctctctgtccctt

SEQ ID NO: 5012292 - DNA, 15 bp, Homo sapiens
gaaactagtgtacat

SEQ ID NO: 5012293 - DNA, 18 bp, Homo sapiens
gaaagactcgagaaccaa

SEQ ID NO: 5012294 - DNA, 21 bp, Homo sapiens
gaaagacttctcaaagagaat

SEQ ID NO: 5012295 - DNA, 16 bp, Homo sapiens
gaaagccttagggaag

SEQ ID NO: 5012296 - DNA, 23 bp, Homo sapiens
gaaattaagactttatgtagttt

SEQ ID NO: 5012297 - DNA, 22 bp, Homo sapiens
gaacagatcttttactttggcc

SEQ ID NO: 5012298 - DNA, 22 bp, Homo sapiens
gaacatgtcctaattcttctgt

SEQ ID NO: 5012299 - DNA, 16 bp, Homo sapiens
gaacctcattctggtt

SEQ ID NO: 5012300 - DNA, 16 bp, Homo sapiens
gaacctgtcctaagga

SEQ ID NO: 5012301 - DNA, 19 bp, Homo sapiens
gaaccttccttcctgcttg

SEQ ID NO: 5012302 - DNA, 18 bp, Homo sapiens
gaagccccacatgtccag

SEQ ID NO: 5012303 - DNA, 15 bp, Homo sapiens
gaagctacttctcca

SEQ ID NO: 5012304 - DNA, 15 bp, Homo sapiens
gaagcttgactccca

SEQ ID NO: 5012305 - DNA, 12 bp, Homo sapiens
gaagtcatatgt

SEQ ID NO: 5012306 - DNA, 15 bp, Homo sapiens
gaatttggggcagga

SEQ ID NO: 5012307 - DNA, 17 bp, Homo sapiens
gacaactgtgaagccac

SEQ ID NO: 5012308 - DNA, 14 bp, Homo sapiens
gacagtttttctgt

SEQ ID NO: 5012309 - DNA, 15 bp, Homo sapiens
gacatcacagggtgg

SEQ ID NO: 5012310 - DNA, 16 bp, Homo sapiens
gacatgaagctgttgt

SEQ ID NO: 5012311 - DNA, 22 bp, Homo sapiens
gaccacttccaggggaacctgc

SEQ ID NO: 5012312 - DNA, 14 bp, Homo sapiens
gaccagggcctttt

SEQ ID NO: 5012313 - DNA, 12 bp, Homo sapiens
gacccagtgcag

SEQ ID NO: 5012314 - DNA, 21 bp, Homo sapiens
gaccctgggggcacaggaggc

SEQ ID NO: 5012315 - DNA, 15 bp, Homo sapiens
gacctctgacaactg

SEQ ID NO: 5012316 - DNA, 23 bp, Homo sapiens
gacctgtatatttgtaaagctat

SEQ ID NO: 5012317 - DNA, 18 bp, Homo sapiens
gacgccacggagggctgg

SEQ ID NO: 5012318 - DNA, 23 bp, Homo sapiens
gacgtgctccgtagctctgctgc

SEQ ID NO: 5012319 - DNA, 12 bp, Homo sapiens
gactccatctct

SEQ ID NO: 5012320 - DNA, 19 bp, Homo sapiens
gactgaaattacgggtacc

SEQ ID NO: 5012321 - DNA, 18 bp, Homo sapiens
gagaaccaaccagggaag

SEQ ID NO: 5012322 - DNA, 21 bp, Homo sapiens
gagaaccaaccagggaagctg

SEQ ID NO: 5012323 - DNA, 16 bp, Homo sapiens
gagacctatgtaagaa

SEQ ID NO: 5012324 - DNA, 21 bp, Homo sapiens
gagacgccacggagggctggg

SEQ ID NO: 5012325 - DNA, 16 bp, Homo sapiens
gagactctagggtcca

SEQ ID NO: 5012326 - DNA, 22 bp, Homo sapiens
gagagggacatagaatctgtga

SEQ ID NO: 5012327 - DNA, 17 bp, Homo sapiens
gagagtacaccctttcc

SEQ ID NO: 5012328 - DNA, 21 bp, Homo sapiens
gagatcgtacctattgcactc

SEQ ID NO: 5012329 - DNA, 16 bp, Homo sapiens
gagcagggaaggcctg

SEQ ID NO: 5012330 - DNA, 14 bp, Homo sapiens
gagccagactctgt

SEQ ID NO: 5012331 - DNA, 14 bp, Homo sapiens
gagccctctcctcc

SEQ ID NO: 5012332 - DNA, 15 bp, Homo sapiens
gagccctctcctccc

SEQ ID NO: 5012333 - DNA, 20 bp, Homo sapiens
gagctgggcccgacatggct

SEQ ID NO: 5012334 - DNA, 17 bp, Homo sapiens
gaggatccactcccagg

SEQ ID NO: 5012335 - DNA, 21 bp, Homo sapiens
gaggatccactcccaggatga

SEQ ID NO: 5012336 - DNA, 18 bp, Homo sapiens
gaggcaggcatggccctg

SEQ ID NO: 5012337 - DNA, 19 bp, Homo sapiens
gaggcaggcatggccctgg

SEQ ID NO: 5012338 - DNA, 12 bp, Homo sapiens
gaggccccaggg

SEQ ID NO: 5012339 - DNA, 18 bp, Homo sapiens
gaggccctgcccaatgag

SEQ ID NO: 5012340 - DNA, 19 bp, Homo sapiens
gaggcctgcgaccctgggg

SEQ ID NO: 5012341 - DNA, 19 bp, Homo sapiens
gaggctgcccctctcacca

SEQ ID NO: 5012342 - DNA, 11 bp, Homo sapiens
gagggaggccc

SEQ ID NO: 5012343 - DNA, 22 bp, Homo sapiens
gaggggccggccctgtgtgcag

SEQ ID NO: 5012344 - DNA, 15 bp, Homo sapiens
gaggtcactcttttg

SEQ ID NO: 5012345 - DNA, 16 bp, Homo sapiens
gaggtgaggagcagag

SEQ ID NO: 5012346 - DNA, 18 bp, Homo sapiens
gagtacaccctttccagg

SEQ ID NO: 5012347 - DNA, 18 bp, Homo sapiens
gagtgccttttgcagaag

SEQ ID NO: 5012348 - DNA, 18 bp, Homo sapiens
gatcaacaacatccactg

SEQ ID NO: 5012349 - DNA, 14 bp, Homo sapiens
gatcatcgccagag

SEQ ID NO: 5012350 - DNA, 21 bp, Homo sapiens
gatcatcgccagaggtgcttc

SEQ ID NO: 5012351 - DNA, 23 bp, Homo sapiens
gatcatcgccagaggtgcttcac

SEQ ID NO: 5012352 - DNA, 20 bp, Homo sapiens
gatcttctgggagcaggaac

SEQ ID NO: 5012353 - DNA, 21 bp, Homo sapiens
gatgaaaaagaataaaaactt

SEQ ID NO: 5012354 - DNA, 17 bp, Homo sapiens
gatgccactcctccctc

SEQ ID NO: 5012355 - DNA, 18 bp, Homo sapiens
gatgccactcctccctcc

SEQ ID NO: 5012356 - DNA, 19 bp, Homo sapiens
gattgcggtttacagctat

SEQ ID NO: 5012357 - DNA, 14 bp, Homo sapiens
gatttagcaagcaa

SEQ ID NO: 5012358 - DNA, 19 bp, Homo sapiens
gattttatgatcagtgttg

SEQ ID NO: 5012359 - DNA, 20 bp, Homo sapiens
gattttattcaatatggtta

SEQ ID NO: 5012360 - DNA, 11 bp, Homo sapiens
gatttttaaga

SEQ ID NO: 5012361 - DNA, 22 bp, Homo sapiens
gcaacggtctcctgactggtgc

SEQ ID NO: 5012362 - DNA, 17 bp, Homo sapiens
gcacaccattttgtaaa

SEQ ID NO: 5012363 - DNA, 15 bp, Homo sapiens
gcacaggaggcaggc

SEQ ID NO: 5012364 - DNA, 20 bp, Homo sapiens
gcacaggaggcaggcatggc

SEQ ID NO: 5012365 - DNA, 12 bp, Homo sapiens
gcagaagagggt

SEQ ID NO: 5012366 - DNA, 21 bp, Homo sapiens
gcagaagcaagggggtgatgt

SEQ ID NO: 5012367 - DNA, 18 bp, Homo sapiens
gcagaatgtaagtgggcc

SEQ ID NO: 5012368 - DNA, 19 bp, Homo sapiens
gcagaatgtaagtgggccc

SEQ ID NO: 5012369 - DNA, 17 bp, Homo sapiens
gcagaggaccagggcct

SEQ ID NO: 5012370 - DNA, 16 bp, Homo sapiens
gcagaggtaccctggg

SEQ ID NO: 5012371 - DNA, 18 bp, Homo sapiens
gcagaggtaccctgggtg

SEQ ID NO: 5012372 - DNA, 19 bp, Homo sapiens
gcagaggtaccctgggtgt

SEQ ID NO: 5012373 - DNA, 17 bp, Homo sapiens
gcagcccaccctgctgc

SEQ ID NO: 5012374 - DNA, 11 bp, Homo sapiens
gcagctgccta

SEQ ID NO: 5012375 - DNA, 13 bp, Homo sapiens
gcagcttctccag

SEQ ID NO: 5012376 - DNA, 17 bp, Homo sapiens
gcaggaacaatgactac

SEQ ID NO: 5012377 - DNA, 13 bp, Homo sapiens
gcaggcatggccc

SEQ ID NO: 5012378 - DNA, 19 bp, Homo sapiens
gcaggcatggccctgggcg

SEQ ID NO: 5012379 - DNA, 10 bp, Homo sapiens
gcaggctggg

SEQ ID NO: 5012380 - DNA, 11 bp, Homo sapiens
gcaggctgggc

SEQ ID NO: 5012381 - DNA, 13 bp, Homo sapiens
gcaggctgggcca

SEQ ID NO: 5012382 - DNA, 23 bp, Homo sapiens
gcaggctgggccatgtccaaaga

SEQ ID NO: 5012383 - DNA, 22 bp, Homo sapiens
gcagggagctgggcccgacatg

SEQ ID NO: 5012384 - DNA, 18 bp, Homo sapiens
gcagggccatggctcagg

SEQ ID NO: 5012385 - DNA, 21 bp, Homo sapiens
gcagttttgttttaaaactgg

SEQ ID NO: 5012386 - DNA, 23 bp, Homo sapiens
gcatcaagaggtgggagggccct

SEQ ID NO: 5012387 - DNA, 21 bp, Homo sapiens
gcatcctcctctctggccttg

SEQ ID NO: 5012388 - DNA, 15 bp, Homo sapiens
gcatcttgcctccag

SEQ ID NO: 5012389 - DNA, 23 bp, Homo sapiens
gcatcttgcctccaggtgcagag

SEQ ID NO: 5012390 - DNA, 18 bp, Homo sapiens
gcatgagactcagtgcag

SEQ ID NO: 5012391 - DNA, 13 bp, Homo sapiens
gcatggccctggg

SEQ ID NO: 5012392 - DNA, 13 bp, Homo sapiens
gcatggtggccag

SEQ ID NO: 5012393 - DNA, 16 bp, Homo sapiens
gcatggtggccagagg

SEQ ID NO: 5012394 - DNA, 17 bp, Homo sapiens
gcattgtttgtgatatt

SEQ ID NO: 5012395 - DNA, 12 bp, Homo sapiens
gccagactctgt

SEQ ID NO: 5012396 - DNA, 18 bp, Homo sapiens
gccatgtccaaagaggct

SEQ ID NO: 5012397 - DNA, 18 bp, Homo sapiens
gcccacccggtgggaccc

SEQ ID NO: 5012398 - DNA, 21 bp, Homo sapiens
gcccaccctgctgctggtgca

SEQ ID NO: 5012399 - DNA, 13 bp, Homo sapiens
gcccacctgctcc

SEQ ID NO: 5012400 - DNA, 11 bp, Homo sapiens
gcccagtgcat

SEQ ID NO: 5012401 - DNA, 23 bp, Homo sapiens
gccccacatgtccagcaccttgt

SEQ ID NO: 5012402 - DNA, 13 bp, Homo sapiens
gccccaggccctg

SEQ ID NO: 5012403 - DNA, 21 bp, Homo sapiens
gccccaggcctgtggctccct

SEQ ID NO: 5012404 - DNA, 19 bp, Homo sapiens
gcccccagtgcctcacctt

SEQ ID NO: 5012405 - DNA, 16 bp, Homo sapiens
gcccgacatggctccg

SEQ ID NO: 5012406 - DNA, 19 bp, Homo sapiens
gcccgacatggctccggcc

SEQ ID NO: 5012407 - DNA, 21 bp, Homo sapiens
gcccggagcagcagcttctcc

SEQ ID NO: 5012408 - DNA, 15 bp, Homo sapiens
gccctcgcctcctcc

SEQ ID NO: 5012409 - DNA, 12 bp, Homo sapiens
gccctgtgtgca

SEQ ID NO: 5012410 - DNA, 13 bp, Homo sapiens
gccctgtgtgcag

SEQ ID NO: 5012411 - DNA, 17 bp, Homo sapiens
gccctttcaaagcactt

SEQ ID NO: 5012412 - DNA, 22 bp, Homo sapiens
gccgatagagggacggccaaga

SEQ ID NO: 5012413 - DNA, 11 bp, Homo sapiens
gccgctacctc

SEQ ID NO: 5012414 - DNA, 17 bp, Homo sapiens
gccgctacctccctccc

SEQ ID NO: 5012415 - DNA, 13 bp, Homo sapiens
gccggccctgtgt

SEQ ID NO: 5012416 - DNA, 17 bp, Homo sapiens
gccggccctgtgtgcag

SEQ ID NO: 5012417 - DNA, 17 bp, Homo sapiens
gcctcaattctccatta

SEQ ID NO: 5012418 - DNA, 16 bp, Homo sapiens
gcctccaggtgcagag

SEQ ID NO: 5012419 - DNA, 18 bp, Homo sapiens
gcctccaggtgcagaggt

SEQ ID NO: 5012420 - DNA, 16 bp, Homo sapiens
gcctcctcctcctgcc

SEQ ID NO: 5012421 - DNA, 17 bp, Homo sapiens
gcctcctcctcctgccc

SEQ ID NO: 5012422 - DNA, 22 bp, Homo sapiens
gcctcctcctcctgccctcctc

SEQ ID NO: 5012423 - DNA, 12 bp, Homo sapiens
gcctgcagggaa

SEQ ID NO: 5012424 - DNA, 20 bp, Homo sapiens
gcctgcagggaagccccaca

SEQ ID NO: 5012425 - DNA, 16 bp, Homo sapiens
gcctgcagggccatgg

SEQ ID NO: 5012426 - DNA, 18 bp, Homo sapiens
gcctgcagggccatggct

SEQ ID NO: 5012427 - DNA, 14 bp, Homo sapiens
gcctgcgaccctgg

SEQ ID NO: 5012428 - DNA, 13 bp, Homo sapiens
gcctggactgcta

SEQ ID NO: 5012429 - DNA, 21 bp, Homo sapiens
gcctggggtgttagtggcacc

SEQ ID NO: 5012430 - DNA, 19 bp, Homo sapiens
gcctgggtgatctgctgct

SEQ ID NO: 5012431 - DNA, 20 bp, Homo sapiens
gcctgtaatcccagcacttt

SEQ ID NO: 5012432 - DNA, 12 bp, Homo sapiens
gccttctgctga

SEQ ID NO: 5012433 - DNA, 13 bp, Homo sapiens
gccttctgctgaa

SEQ ID NO: 5012434 - DNA, 20 bp, Homo sapiens
gccttctgctgaaagactcg

SEQ ID NO: 5012435 - DNA, 22 bp, Homo sapiens
gccttttctggcaccgcagttt

SEQ ID NO: 5012436 - DNA, 16 bp, Homo sapiens
gccttttgcagaagag

SEQ ID NO: 5012437 - DNA, 13 bp, Homo sapiens
gcgaccctggggg

SEQ ID NO: 5012438 - DNA, 22 bp, Homo sapiens
gcgcatcttgcctccaggtgca

SEQ ID NO: 5012439 - DNA, 19 bp, Homo sapiens
gcggcccgcgcagctgcct

SEQ ID NO: 5012440 - DNA, 16 bp, Homo sapiens
gcgtggagggaggccc

SEQ ID NO: 5012441 - DNA, 22 bp, Homo sapiens
gcgtggagggaggccccagggg

SEQ ID NO: 5012442 - DNA, 12 bp, Homo sapiens
gctacctccctc

SEQ ID NO: 5012443 - DNA, 13 bp, Homo sapiens
gctacctccctcc

SEQ ID NO: 5012444 - DNA, 14 bp, Homo sapiens
gctacctctctgtc

SEQ ID NO: 5012445 - DNA, 22 bp, Homo sapiens
gctacctctctgtcccttgctg

SEQ ID NO: 5012446 - DNA, 16 bp, Homo sapiens
gctacctttcaaagct

SEQ ID NO: 5012447 - DNA, 16 bp, Homo sapiens
gctatttatgggcccc

SEQ ID NO: 5012448 - DNA, 15 bp, Homo sapiens
gctcacaccaaattt

SEQ ID NO: 5012449 - DNA, 12 bp, Homo sapiens
gctcagggtggt

SEQ ID NO: 5012450 - DNA, 15 bp, Homo sapiens
gctcccaggccccag

SEQ ID NO: 5012451 - DNA, 15 bp, Homo sapiens
gctcccttggtgccc

SEQ ID NO: 5012452 - DNA, 20 bp, Homo sapiens
gctccgtagctctgctgctg

SEQ ID NO: 5012453 - DNA, 21 bp, Homo sapiens
gctccgtagctctgctgctga

SEQ ID NO: 5012454 - DNA, 13 bp, Homo sapiens
gctctgctgctga

SEQ ID NO: 5012455 - DNA, 17 bp, Homo sapiens
gctctgggtgctgccct

SEQ ID NO: 5012456 - DNA, 21 bp, Homo sapiens
gctgacatgaagctgttgtgt

SEQ ID NO: 5012457 - DNA, 19 bp, Homo sapiens
gctgagcctgcagggaagc

SEQ ID NO: 5012458 - DNA, 22 bp, Homo sapiens
gctgatcatcgccagaggtgct

SEQ ID NO: 5012459 - DNA, 21 bp, Homo sapiens
gctgccacaaccagccaggca

SEQ ID NO: 5012460 - DNA, 22 bp, Homo sapiens
gctgctgatactgggtctgcga

SEQ ID NO: 5012461 - DNA, 22 bp, Homo sapiens
gctggccggggctctgggtgct

SEQ ID NO: 5012462 - DNA, 15 bp, Homo sapiens
gctggggatgcgcct

SEQ ID NO: 5012463 - DNA, 15 bp, Homo sapiens
gctgtatgctgatca

SEQ ID NO: 5012464 - DNA, 19 bp, Homo sapiens
gctgtgcaacggtctcctg

SEQ ID NO: 5012465 - DNA, 14 bp, Homo sapiens
gctgtgtgtcccag

SEQ ID NO: 5012466 - DNA, 15 bp, Homo sapiens
gctgtgtgtcccagg

SEQ ID NO: 5012467 - DNA, 20 bp, Homo sapiens
gctgtgtgtcccaggcaggg

SEQ ID NO: 5012468 - DNA, 18 bp, Homo sapiens
gcttatcaactaatgatt

SEQ ID NO: 5012469 - DNA, 19 bp, Homo sapiens
ttccatgatttagcaagca

SEQ ID NO: 5012470 - DNA, 11 bp, Homo sapiens
ttccatttgtg

SEQ ID NO: 5012471 - DNA, 18 bp, Homo sapiens
ttcccacttcccaccctg

SEQ ID NO: 5012472 - DNA, 15 bp, Homo sapiens
ttccgtttgcttttg

SEQ ID NO: 5012473 - DNA, 17 bp, Homo sapiens
ttccgtttgcttttgtt

SEQ ID NO: 5012474 - DNA, 14 bp, Homo sapiens
ttcctaacttttca

SEQ ID NO: 5012475 - DNA, 16 bp, Homo sapiens
ttcctcagcttatctc

SEQ ID NO: 5012476 - DNA, 12 bp, Homo sapiens
ttcctctcaccc

SEQ ID NO: 5012477 - DNA, 22 bp, Homo sapiens
ttcctctcaccccactcctgtc

SEQ ID NO: 5012478 - DNA, 15 bp, Homo sapiens
ttcctttcatacctt

SEQ ID NO: 5012479 - DNA, 23 bp, Homo sapiens
ttcgttaagaatttggggcagga

SEQ ID NO: 5012480 - DNA, 18 bp, Homo sapiens
ttctgacagtttttctgt

SEQ ID NO: 5012481 - DNA, 14 bp, Homo sapiens
ttctgcagttctca

SEQ ID NO: 5012482 - DNA, 16 bp, Homo sapiens
ttctgctgaaagactc

SEQ ID NO: 5012483 - DNA, 11 bp, Homo sapiens
ttctggcaccg

SEQ ID NO: 5012484 - DNA, 19 bp, Homo sapiens
ttctggggcaggctgggcc

SEQ ID NO: 5012485 - DNA, 21 bp, Homo sapiens
ttctggggcaggctgggccat

SEQ ID NO: 5012486 - DNA, 19 bp, Homo sapiens
ttctggggggacccagtgc

SEQ ID NO: 5012487 - DNA, 22 bp, Homo sapiens
ttctggggggacccagtgcaga

SEQ ID NO: 5012488 - DNA, 17 bp, Homo sapiens
ttctggtgtgttaacat

SEQ ID NO: 5012489 - DNA, 17 bp, Homo sapiens
ttctggttccctgctgc

SEQ ID NO: 5012490 - DNA, 17 bp, Homo sapiens
ttcttatacgcttttct

SEQ ID NO: 5012491 - DNA, 12 bp, Homo sapiens
ttcttgcactga

SEQ ID NO: 5012492 - DNA, 16 bp, Homo sapiens
ttgaatacaggtaact

SEQ ID NO: 5012493 - DNA, 16 bp, Homo sapiens
ttgactcccaagtttc

SEQ ID NO: 5012494 - DNA, 15 bp, Homo sapiens
ttgaggtcagtgttt

SEQ ID NO: 5012495 - DNA, 15 bp, Homo sapiens
ttgatttttaagaaa

SEQ ID NO: 5012496 - DNA, 22 bp, Homo sapiens
ttgcacaccattttgtaaatga

SEQ ID NO: 5012497 - DNA, 13 bp, Homo sapiens
ttgcagaagaggg

SEQ ID NO: 5012498 - DNA, 20 bp, Homo sapiens
ttgcagaagagggtgtgttt

SEQ ID NO: 5012499 - DNA, 15 bp, Homo sapiens
ttgccaccatacctc

SEQ ID NO: 5012500 - DNA, 12 bp, Homo sapiens
ttgcctccaggt

SEQ ID NO: 5012501 - DNA, 14 bp, Homo sapiens
ttgctctaggaaga

SEQ ID NO: 5012502 - DNA, 16 bp, Homo sapiens
ttgcttgcctgcaggg

SEQ ID NO: 5012503 - DNA, 14 bp, Homo sapiens
ttggactccatctc

SEQ ID NO: 5012504 - DNA, 15 bp, Homo sapiens
ttggggcccagtgca

SEQ ID NO: 5012505 - DNA, 12 bp, Homo sapiens
ttggttaaataa

SEQ ID NO: 5012506 - DNA, 15 bp, Homo sapiens
ttggttaaataaact

SEQ ID NO: 5012507 - DNA, 16 bp, Homo sapiens
ttgtaaaacttctgct

SEQ ID NO: 5012508 - DNA, 20 bp, Homo sapiens
ttgtatggggaggcaagtgt

SEQ ID NO: 5012509 - DNA, 23 bp, Homo sapiens
ttgtattgatttttaagaaagta

SEQ ID NO: 5012510 - DNA, 20 bp, Homo sapiens
ttgtcctttaaaaaagaaaa

SEQ ID NO: 5012511 - DNA, 14 bp, Homo sapiens
ttgtgcattctgga

SEQ ID NO: 5012512 - DNA, 13 bp, Homo sapiens
ttgtgcctggggt

SEQ ID NO: 5012513 - DNA, 14 bp, Homo sapiens
ttgttgttttccat

SEQ ID NO: 5012514 - DNA, 18 bp, Homo sapiens
ttgtttggcaaggaaagg

SEQ ID NO: 5012515 - DNA, 16 bp, Homo sapiens
tttaaaactggacctg

SEQ ID NO: 5012516 - DNA, 17 bp, Homo sapiens
tttaatttgtaaaactt

SEQ ID NO: 5012517 - DNA, 23 bp, Homo sapiens
tttaatttgtaaaacttctgctc

SEQ ID NO: 5012518 - DNA, 11 bp, Homo sapiens
tttagcaagca

SEQ ID NO: 5012519 - DNA, 22 bp, Homo sapiens
tttataaacagacaatatgtga

SEQ ID NO: 5012520 - DNA, 13 bp, Homo sapiens
tttatatgttgta

SEQ ID NO: 5012521 - DNA, 14 bp, Homo sapiens
tttatgatcagtgt

SEQ ID NO: 5012522 - DNA, 17 bp, Homo sapiens
tttatttgaggtcagtg

SEQ ID NO: 5012523 - DNA, 19 bp, Homo sapiens
tttcaaagcacttaagtgt

SEQ ID NO: 5012524 - DNA, 11 bp, Homo sapiens
tttccagggag

SEQ ID NO: 5012525 - DNA, 13 bp, Homo sapiens
tttccagggaggg

SEQ ID NO: 5012526 - DNA, 21 bp, Homo sapiens
tttccatgatttagcaagcaa

SEQ ID NO: 5012527 - DNA, 19 bp, Homo sapiens
tttcccacttcccaccctg

SEQ ID NO: 5012528 - DNA, 16 bp, Homo sapiens
tttccgtttgcttttg

SEQ ID NO: 5012529 - DNA, 13 bp, Homo sapiens
tttctgacagttt

SEQ ID NO: 5012530 - DNA, 16 bp, Homo sapiens
tttcttacacactgtc

SEQ ID NO: 5012531 - DNA, 18 bp, Homo sapiens
tttcttacacactgtctg

SEQ ID NO: 5012532 - DNA, 14 bp, Homo sapiens
tttgccactgctgt

SEQ ID NO: 5012533 - DNA, 14 bp, Homo sapiens
tttgctccgaagct

SEQ ID NO: 5012534 - DNA, 23 bp, Homo sapiens
tttggcaaggaaaggggagaagg

SEQ ID NO: 5012535 - DNA, 18 bp, Homo sapiens
tttgtaaaacttctgctc

SEQ ID NO: 5012536 - DNA, 17 bp, Homo sapiens
ttttaaaactggacctg

SEQ ID NO: 5012537 - DNA, 17 bp, Homo sapiens
ttttaacttttaattta

SEQ ID NO: 5012538 - DNA, 16 bp, Homo sapiens
ttttaatgcagttgct

SEQ ID NO: 5012539 - DNA, 14 bp, Homo sapiens
ttttaatttaaaaa

SEQ ID NO: 5012540 - DNA, 15 bp, Homo sapiens
ttttacaagatgtat

SEQ ID NO: 5012541 - DNA, 13 bp, Homo sapiens
ttttactgccctt

SEQ ID NO: 5012542 - DNA, 18 bp, Homo sapiens
ttttataaataaactgtt

SEQ ID NO: 5012543 - DNA, 14 bp, Homo sapiens
ttttattatgcatt

SEQ ID NO: 5012544 - DNA, 13 bp, Homo sapiens
ttttattctccag

SEQ ID NO: 5012545 - DNA, 17 bp, Homo sapiens
ttttccatgatttagca

SEQ ID NO: 5012546 - DNA, 18 bp, Homo sapiens
ttttccatgatttagcaa

SEQ ID NO: 5012547 - DNA, 21 bp, Homo sapiens
ttttccatgatttagcaagca

SEQ ID NO: 5012548 - DNA, 20 bp, Homo sapiens
ttttgacagccttcttgatg

SEQ ID NO: 5012549 - DNA, 16 bp, Homo sapiens
ttttgttttaaaactg

SEQ ID NO: 5012550 - DNA, 12 bp, Homo sapiens
tttttaactttt

SEQ ID NO: 5012551 - DNA, 15 bp, Homo sapiens
tttttaagaaagtaa

SEQ ID NO: 5012552 - DNA, 20 bp, Homo sapiens
tttttaagaaagtaatttaa

SEQ ID NO: 5012553 - DNA, 14 bp, Homo sapiens
tttttattatgcat

SEQ ID NO: 5012554 - DNA, 14 bp, Homo sapiens
ggcctcggcccctc

SEQ ID NO: 5012555 - DNA, 23 bp, Homo sapiens
ggcctgcgaccctgggggcacag

SEQ ID NO: 5012556 - DNA, 20 bp, Homo sapiens
ggcctgggtgatctgctgct

SEQ ID NO: 5012557 - DNA, 16 bp, Homo sapiens
ggcctgtggctccctt

SEQ ID NO: 5012558 - DNA, 17 bp, Homo sapiens
ggccttttctggcaccg

SEQ ID NO: 5012559 - DNA, 12 bp, Homo sapiens
ggctcagggtgg

SEQ ID NO: 5012560 - DNA, 17 bp, Homo sapiens
ggctctgggtgctgccc

SEQ ID NO: 5012561 - DNA, 18 bp, Homo sapiens
ggctctgggtgctgccct

SEQ ID NO: 5012562 - DNA, 20 bp, Homo sapiens
ggctggtacaacggaggcct

SEQ ID NO: 5012563 - DNA, 16 bp, Homo sapiens
ggctggttggagaagg

SEQ ID NO: 5012564 - DNA, 23 bp, Homo sapiens
ggctttcccacttcccaccctgc

SEQ ID NO: 5012565 - DNA, 17 bp, Homo sapiens
gggacatcacagggtgg

SEQ ID NO: 5012566 - DNA, 12 bp, Homo sapiens
gggacccagtgc

SEQ ID NO: 5012567 - DNA, 16 bp, Homo sapiens
gggacccagtgcagaa

SEQ ID NO: 5012568 - DNA, 20 bp, Homo sapiens
gggagacagaggttgcagtg

SEQ ID NO: 5012569 - DNA, 13 bp, Homo sapiens
gggagctgggccc

SEQ ID NO: 5012570 - DNA, 14 bp, Homo sapiens
gggaggccccaggg

SEQ ID NO: 5012571 - DNA, 18 bp, Homo sapiens
gggcacaggaggcaggca

SEQ ID NO: 5012572 - DNA, 14 bp, Homo sapiens
gggcaggctgggcc

SEQ ID NO: 5012573 - DNA, 15 bp, Homo sapiens
gggcaggctgggcca

SEQ ID NO: 5012574 - DNA, 16 bp, Homo sapiens
gggcaggctgggccat

SEQ ID NO: 5012575 - DNA, 15 bp, Homo sapiens
gggcagggagctggg

SEQ ID NO: 5012576 - DNA, 16 bp, Homo sapiens
gggccatgtccaaaga

SEQ ID NO: 5012577 - DNA, 17 bp, Homo sapiens
gggccatgtccaaagag

SEQ ID NO: 5012578 - DNA, 22 bp, Homo sapiens
gggcccagtgcatggtggccag

SEQ ID NO: 5012579 - DNA, 12 bp, Homo sapiens
gggcccctggca

SEQ ID NO: 5012580 - DNA, 21 bp, Homo sapiens
gggccctccgaccacttccag

SEQ ID NO: 5012581 - DNA, 21 bp, Homo sapiens
gggccttttctggcaccgcag

SEQ ID NO: 5012582 - DNA, 21 bp, Homo sapiens
gggcgtggagggaggccccag

SEQ ID NO: 5012583 - DNA, 18 bp, Homo sapiens
gggctctgggtgctgccc

SEQ ID NO: 5012584 - DNA, 13 bp, Homo sapiens
ggggacccagtgc

SEQ ID NO: 5012585 - DNA, 15 bp, Homo sapiens
ggggacccagtgcag

SEQ ID NO: 5012586 - DNA, 20 bp, Homo sapiens
ggggattttttactgccctt

SEQ ID NO: 5012587 - DNA, 15 bp, Homo sapiens
ggggcaggctgggcc

SEQ ID NO: 5012588 - DNA, 15 bp, Homo sapiens
gggggacccagtgca

SEQ ID NO: 5012589 - DNA, 15 bp, Homo sapiens
gggggcacaggaggc

SEQ ID NO: 5012590 - DNA, 18 bp, Homo sapiens
ggggtgttagtggcaccg

SEQ ID NO: 5012591 - DNA, 15 bp, Homo sapiens
gggtccttctccaca

SEQ ID NO: 5012592 - DNA, 14 bp, Homo sapiens
ggtacaacggaggc

SEQ ID NO: 5012593 - DNA, 18 bp, Homo sapiens
ggtacatggtgtttgtgg

SEQ ID NO: 5012594 - DNA, 13 bp, Homo sapiens
ggtaccctgggtg

SEQ ID NO: 5012595 - DNA, 19 bp, Homo sapiens
ggtatatactttgccactg

SEQ ID NO: 5012596 - DNA, 20 bp, Homo sapiens
ggtatatactttgccactgc

SEQ ID NO: 5012597 - DNA, 17 bp, Homo sapiens
ggtcactcttttgatgg

SEQ ID NO: 5012598 - DNA, 23 bp, Homo sapiens
ggtctcacccatgcaagcagagg

SEQ ID NO: 5012599 - DNA, 23 bp, Homo sapiens
ggtctcctgactggtgctgcagc

SEQ ID NO: 5012600 - DNA, 18 bp, Homo sapiens
ggtctgccttctgctgaa

SEQ ID NO: 5012601 - DNA, 22 bp, Homo sapiens
ggtctgtgtgtgtgtgtgtgcg

SEQ ID NO: 5012602 - DNA, 19 bp, Homo sapiens
ggtgccctcgcctcctcct

SEQ ID NO: 5012603 - DNA, 21 bp, Homo sapiens
ggtgctgcagcaccgaggggc

SEQ ID NO: 5012604 - DNA, 24 bp, Homo sapiens
ggtgtcacccaaaccggcaggtgc

SEQ ID NO: 5012605 - DNA, 17 bp, Homo sapiens
ggtgtcagtatccaggc

SEQ ID NO: 5012606 - DNA, 20 bp, Homo sapiens
ggtgtccccgctgctgtgca

SEQ ID NO: 5012607 - DNA, 11 bp, Homo sapiens
ggttaaataaa

SEQ ID NO: 5012608 - DNA, 14 bp, Homo sapiens
ggttccctgctgcg

SEQ ID NO: 5012609 - DNA, 14 bp, Homo sapiens
gtaaaacttctgct

SEQ ID NO: 5012610 - DNA, 20 bp, Homo sapiens
gtaaagctatttatgggccc

SEQ ID NO: 5012611 - DNA, 13 bp, Homo sapiens
gtaaatgaaactt

SEQ ID NO: 5012612 - DNA, 16 bp, Homo sapiens
gtaagtgggcccaccc

SEQ ID NO: 5012613 - DNA, 18 bp, Homo sapiens
gtaatttaatttgtaaaa

SEQ ID NO: 5012614 - DNA, 14 bp, Homo sapiens
gtacaacggaggcc

SEQ ID NO: 5012615 - DNA, 23 bp, Homo sapiens
gtacaacggaggcctgcgaccct

SEQ ID NO: 5012616 - DNA, 21 bp, Homo sapiens
gtacatttctataaatagatg

SEQ ID NO: 5012617 - DNA, 13 bp, Homo sapiens
gtacctcctctca

SEQ ID NO: 5012618 - DNA, 16 bp, Homo sapiens
gtacctcctctcagtg

SEQ ID NO: 5012619 - DNA, 13 bp, Homo sapiens
gtaccttgcttct

SEQ ID NO: 5012620 - DNA, 23 bp, Homo sapiens
gtactgaaagccttagggaagct

SEQ ID NO: 5012621 - DNA, 21 bp, Homo sapiens
gtactgccccccatgaggaag

SEQ ID NO: 5012622 - DNA, 22 bp, Homo sapiens
gtactgccccccatgaggaagg

SEQ ID NO: 5012623 - DNA, 19 bp, Homo sapiens
gtagaaggttgacacagtt

SEQ ID NO: 5012624 - DNA, 17 bp, Homo sapiens
gtagctctgctgctgat

SEQ ID NO: 5012625 - DNA, 18 bp, Homo sapiens
gtatatactttgccactg

SEQ ID NO: 5012626 - DNA, 19 bp, Homo sapiens
gtatatactttgccactgc

SEQ ID NO: 5012627 - DNA, 19 bp, Homo sapiens
gtatatggtatatatacat

SEQ ID NO: 5012628 - DNA, 21 bp, Homo sapiens
gtatatttgttttatgctact

SEQ ID NO: 5012629 - DNA, 18 bp, Homo sapiens
gtatgcagtattcttgca

SEQ ID NO: 5012630 - DNA, 13 bp, Homo sapiens
gtatgctgatcat

SEQ ID NO: 5012631 - DNA, 21 bp, Homo sapiens
gtatgctgatcatcgccagag

SEQ ID NO: 5012632 - DNA, 19 bp, Homo sapiens
gtattgatttttaagaaag

SEQ ID NO: 5012633 - DNA, 16 bp, Homo sapiens
gtcagtatccaggctt

SEQ ID NO: 5012634 - DNA, 10 bp, Homo sapiens
gtcagtgttt

SEQ ID NO: 5012635 - DNA, 12 bp, Homo sapiens
gtcatgcttcat

SEQ ID NO: 5012636 - DNA, 23 bp, Homo sapiens
gtccagcctgccccggagctgga

SEQ ID NO: 5012637 - DNA, 16 bp, Homo sapiens
gtcccaggcagggaga

SEQ ID NO: 5012638 - DNA, 15 bp, Homo sapiens
gtccctagcagccca

SEQ ID NO: 5012639 - DNA, 18 bp, Homo sapiens
gtccctagcagcccaccc

SEQ ID NO: 5012640 - DNA, 13 bp, Homo sapiens
gtcctcagggagc

SEQ ID NO: 5012641 - DNA, 19 bp, Homo sapiens
gtctcattccgttgtctgt

SEQ ID NO: 5012642 - DNA, 20 bp, Homo sapiens
gtctcctgactggtgctgca

SEQ ID NO: 5012643 - DNA, 20 bp, Homo sapiens
gtctcttcttggggcccagt

SEQ ID NO: 5012644 - DNA, 21 bp, Homo sapiens
gtctcttcttggggcccagtg

SEQ ID NO: 5012645 - DNA, 23 bp, Homo sapiens
gtctcttcttggggcccagtgca

SEQ ID NO: 5012646 - DNA, 17 bp, Homo sapiens
gtctgccttctgctgaa

SEQ ID NO: 5012647 - DNA, 21 bp, Homo sapiens
gtctgtttggactgcagaagc

SEQ ID NO: 5012648 - DNA, 21 bp, Homo sapiens
gtcttaccagtgacgctgctg

SEQ ID NO: 5012649 - DNA, 13 bp, Homo sapiens
gtgaattgactac

SEQ ID NO: 5012650 - DNA, 18 bp, Homo sapiens
gtgatatttcgtgtactg

SEQ ID NO: 5012651 - DNA, 21 bp, Homo sapiens
gtgcacatccgcgtgtgcctg

SEQ ID NO: 5012652 - DNA, 16 bp, Homo sapiens
gtgccctcgcctcctc

SEQ ID NO: 5012653 - DNA, 11 bp, Homo sapiens
gtgcctggggt

SEQ ID NO: 5012654 - DNA, 11 bp, Homo sapiens
tggagggaggc

SEQ ID NO: 5012655 - DNA, 13 bp, Homo sapiens
tggagggaggccc

SEQ ID NO: 5012656 - DNA, 18 bp, Homo sapiens
tggagggaggccccaggg

SEQ ID NO: 5012657 - DNA, 21 bp, Homo sapiens
tggccttgccccaggccctgc

SEQ ID NO: 5012658 - DNA, 18 bp, Homo sapiens
tggctccggcctctgcct

SEQ ID NO: 5012659 - DNA, 14 bp, Homo sapiens
tgggacccccgtgg

SEQ ID NO: 5012660 - DNA, 18 bp, Homo sapiens
tgggccatgtccaaagag

SEQ ID NO: 5012661 - DNA, 23 bp, Homo sapiens
tgggccatgtccaaagaggctgc

SEQ ID NO: 5012662 - DNA, 12 bp, Homo sapiens
tgggcccctggc

SEQ ID NO: 5012663 - DNA, 15 bp, Homo sapiens
tgggcccctggcact

SEQ ID NO: 5012664 - DNA, 15 bp, Homo sapiens
tgggctgggcgtggg

SEQ ID NO: 5012665 - DNA, 13 bp, Homo sapiens
tggggcagggagc

SEQ ID NO: 5012666 - DNA, 21 bp, Homo sapiens
tggggcagggagctgggcccg

SEQ ID NO: 5012667 - DNA, 17 bp, Homo sapiens
tggggggacccagtgca

SEQ ID NO: 5012668 - DNA, 19 bp, Homo sapiens
tggggggacccagtgcaga

SEQ ID NO: 5012669 - DNA, 18 bp, Homo sapiens
tggtacatggtgtttgtg

SEQ ID NO: 5012670 - DNA, 13 bp, Homo sapiens
tggtcggagaggg

SEQ ID NO: 5012671 - DNA, 14 bp, Homo sapiens
tggtcggagaggga

SEQ ID NO: 5012672 - DNA, 15 bp, Homo sapiens
tggtctgccttctgc

SEQ ID NO: 5012673 - DNA, 16 bp, Homo sapiens
tggtctgccttctgct

SEQ ID NO: 5012674 - DNA, 23 bp, Homo sapiens
tggtctgtgtgtgtgtgtgtgcg

SEQ ID NO: 5012675 - DNA, 18 bp, Homo sapiens
tggtgccctcgcctcctc

SEQ ID NO: 5012676 - DNA, 18 bp, Homo sapiens
tggtgtcagtatccaggc

SEQ ID NO: 5012677 - DNA, 22 bp, Homo sapiens
tggtttcataacttcctgtact

SEQ ID NO: 5012678 - DNA, 14 bp, Homo sapiens
tgtaaaacttctgc

SEQ ID NO: 5012679 - DNA, 15 bp, Homo sapiens
tgtaaaacttctgct

SEQ ID NO: 5012680 - DNA, 16 bp, Homo sapiens
tgtaaaacttctgctc

SEQ ID NO: 5012681 - DNA, 19 bp, Homo sapiens
tgtaaatgaaacttaagaa

SEQ ID NO: 5012682 - DNA, 20 bp, Homo sapiens
tgtaaatgaaacttaagaat

SEQ ID NO: 5012683 - DNA, 16 bp, Homo sapiens
tgtaagaattcagaag

SEQ ID NO: 5012684 - DNA, 14 bp, Homo sapiens
tgtaagtgggccca

SEQ ID NO: 5012685 - DNA, 17 bp, Homo sapiens
tgtaatatttcttcaaa

SEQ ID NO: 5012686 - DNA, 16 bp, Homo sapiens
tgtacatttctataaa

SEQ ID NO: 5012687 - DNA, 14 bp, Homo sapiens
tgtacgtccagcct

SEQ ID NO: 5012688 - DNA, 20 bp, Homo sapiens
tgtactgcaaagtgtatgca

SEQ ID NO: 5012689 - DNA, 13 bp, Homo sapiens
tgtaggagaaact

SEQ ID NO: 5012690 - DNA, 15 bp, Homo sapiens
tgtatatacatatat

SEQ ID NO: 5012691 - DNA, 23 bp, Homo sapiens
tgtatgctgatcatcgccagagg

SEQ ID NO: 5012692 - DNA, 19 bp, Homo sapiens
tgtattgatttttaagaaa

SEQ ID NO: 5012693 - DNA, 19 bp, Homo sapiens
tgtatttaaaaaaaagaaa

SEQ ID NO: 5012694 - DNA, 21 bp, Homo sapiens
tgtatttaaaaaaaagaaact

SEQ ID NO: 5012695 - DNA, 13 bp, Homo sapiens
tgtatttctccat

SEQ ID NO: 5012696 - DNA, 19 bp, Homo sapiens
tgtatttttatttttgcac

SEQ ID NO: 5012697 - DNA, 15 bp, Homo sapiens
tgtcaatctgtccgt

SEQ ID NO: 5012698 - DNA, 23 bp, Homo sapiens
tgtcaccaaggaaacgctacctc

SEQ ID NO: 5012699 - DNA, 11 bp, Homo sapiens
tgtccaaagag

SEQ ID NO: 5012700 - DNA, 19 bp, Homo sapiens
tgtccaaagaggctgcccc

SEQ ID NO: 5012701 - DNA, 12 bp, Homo sapiens
tgtccagcacct

SEQ ID NO: 5012702 - DNA, 17 bp, Homo sapiens
tgtcccaggcagggaga

SEQ ID NO: 5012703 - DNA, 12 bp, Homo sapiens
tgtccctctcct

SEQ ID NO: 5012704 - DNA, 19 bp, Homo sapiens
tgtccctctccttgccccc

SEQ ID NO: 5012705 - DNA, 12 bp, Homo sapiens
tgtcccttgctg

SEQ ID NO: 5012706 - DNA, 19 bp, Homo sapiens
tgtcctaaggaaccttcct

SEQ ID NO: 5012707 - DNA, 14 bp, Homo sapiens
tgtcctcagggagc

SEQ ID NO: 5012708 - DNA, 21 bp, Homo sapiens
tgtcgttaaaaagttgtttgt

SEQ ID NO: 5012709 - DNA, 23 bp, Homo sapiens
tgtcgttaaaaagttgtttgttt

SEQ ID NO: 5012710 - DNA, 17 bp, Homo sapiens
tgtctgtggatggtcat

SEQ ID NO: 5012711 - DNA, 16 bp, Homo sapiens
tgtgagtgccttttgc

SEQ ID NO: 5012712 - DNA, 19 bp, Homo sapiens
tgtgagtgccttttgcaga

SEQ ID NO: 5012713 - DNA, 21 bp, Homo sapiens
tgtgcacatccgcgtgtgcct

SEQ ID NO: 5012714 - DNA, 22 bp, Homo sapiens
tgtgcacatccgcgtgtgcctg

SEQ ID NO: 5012715 - DNA, 15 bp, Homo sapiens
tgtgcattctggatt

SEQ ID NO: 5012716 - DNA, 13 bp, Homo sapiens
tgtggctcccttg

SEQ ID NO: 5012717 - DNA, 19 bp, Homo sapiens
tgtgtcccaggcagggaga

SEQ ID NO: 5012718 - DNA, 16 bp, Homo sapiens
tgtgtgtcccaggcag

SEQ ID NO: 5012719 - DNA, 15 bp, Homo sapiens
tgtgtgtgtgcacat

SEQ ID NO: 5012720 - DNA, 14 bp, Homo sapiens
tgtgtgtgtgtgca

SEQ ID NO: 5012721 - DNA, 16 bp, Homo sapiens
tgtgtgtgtgtgtgca

SEQ ID NO: 5012722 - DNA, 19 bp, Homo sapiens
tgttacaagtttatatata

SEQ ID NO: 5012723 - DNA, 12 bp, Homo sapiens
aaaaaaaagaaa

SEQ ID NO: 5012724 - DNA, 15 bp, Homo sapiens
aaaaacttttgagga

SEQ ID NO: 5012725 - DNA, 16 bp, Homo sapiens
aaaactggacctgtat

SEQ ID NO: 5012726 - DNA, 18 bp, Homo sapiens
aaaacttctattatccag

SEQ ID NO: 5012727 - DNA, 12 bp, Homo sapiens
aaaacttctgct

SEQ ID NO: 5012728 - DNA, 14 bp, Homo sapiens
aaaacttttgagga

SEQ ID NO: 5012729 - DNA, 12 bp, Homo sapiens
aaaagaaacttt

SEQ ID NO: 5012730 - DNA, 13 bp, Homo sapiens
aaaagaaactttt

SEQ ID NO: 5012731 - DNA, 19 bp, Homo sapiens
aaaagatgaaaaagaataa

SEQ ID NO: 5012732 - DNA, 22 bp, Homo sapiens
aaaagcggaaagttagtgcttg

SEQ ID NO: 5012733 - DNA, 18 bp, Homo sapiens
aaaatcagaacaaaactt

SEQ ID NO: 5012734 - DNA, 16 bp, Homo sapiens
aaaatctgttcacttt

SEQ ID NO: 5012735 - DNA, 16 bp, Homo sapiens
aaacctagtactgccc

SEQ ID NO: 5012736 - DNA, 13 bp, Homo sapiens
aaacgctacctct

SEQ ID NO: 5012737 - DNA, 16 bp, Homo sapiens
aaacgctacctctctg

SEQ ID NO: 5012738 - DNA, 13 bp, Homo sapiens
aaacttaagaatt

SEQ ID NO: 5012739 - DNA, 15 bp, Homo sapiens
aaacttaagaattga

SEQ ID NO: 5012740 - DNA, 14 bp, Homo sapiens
aaagaataaaaact

SEQ ID NO: 5012741 - DNA, 15 bp, Homo sapiens
aaagaataaaaactt

SEQ ID NO: 5012742 - DNA, 13 bp, Homo sapiens
aaagatattgttg

SEQ ID NO: 5012743 - DNA, 19 bp, Homo sapiens
aaagccttagggaagctgg

SEQ ID NO: 5012744 - DNA, 22 bp, Homo sapiens
aaagctagtgtacctcctctca

SEQ ID NO: 5012745 - DNA, 12 bp, Homo sapiens
aaagtaatttaa

SEQ ID NO: 5012746 - DNA, 22 bp, Homo sapiens
aaagttttttattatgcattat

SEQ ID NO: 5012747 - DNA, 13 bp, Homo sapiens
aaatctaccactg

SEQ ID NO: 5012748 - DNA, 14 bp, Homo sapiens
aacaaaacttctat

SEQ ID NO: 5012749 - DNA, 21 bp, Homo sapiens
aacaaaagcgacccattcaga

SEQ ID NO: 5012750 - DNA, 15 bp, Homo sapiens
aacacaaaaaaaatt

SEQ ID NO: 5012751 - DNA, 19 bp, Homo sapiens
aacactccattattcctct

SEQ ID NO: 5012752 - DNA, 14 bp, Homo sapiens
aacactgaaatgaa

SEQ ID NO: 5012753 - DNA, 11 bp, Homo sapiens
aacacttccag

SEQ ID NO: 5012754 - DNA, 23 bp, Homo sapiens
aacctgtcctaaggaaccttcct

SEQ ID NO: 5012755 - DNA, 22 bp, Homo sapiens
aacggaggcctgcgaccctggg

SEQ ID NO: 5012756 - DNA, 13 bp, Homo sapiens
aacttttaattta

SEQ ID NO: 5012757 - DNA, 13 bp, Homo sapiens
aagaaacttttct

SEQ ID NO: 5012758 - DNA, 15 bp, Homo sapiens
aagaaacttttctga

SEQ ID NO: 5012759 - DNA, 14 bp, Homo sapiens
aagaataaaaactt

SEQ ID NO: 5012760 - DNA, 15 bp, Homo sapiens
aagaataaaaacttt

SEQ ID NO: 5012761 - DNA, 21 bp, Homo sapiens
aagaattgaattggaaagact

SEQ ID NO: 5012762 - DNA, 15 bp, Homo sapiens
aagacccctgactca

SEQ ID NO: 5012763 - DNA, 14 bp, Homo sapiens
aagagcagaacaga

SEQ ID NO: 5012764 - DNA, 22 bp, Homo sapiens
aagaggaacagcactggggagt

SEQ ID NO: 5012765 - DNA, 21 bp, Homo sapiens
aagaggctgcccctctcacca

SEQ ID NO: 5012766 - DNA, 16 bp, Homo sapiens
aagaggtgggagggcc

SEQ ID NO: 5012767 - DNA, 14 bp, Homo sapiens
aagatgaaaaagaa

SEQ ID NO: 5012768 - DNA, 15 bp, Homo sapiens
aagcagaggaccagg

SEQ ID NO: 5012769 - DNA, 23 bp, Homo sapiens
aagccaccctgggctacagaaac

SEQ ID NO: 5012770 - DNA, 20 bp, Homo sapiens
aagcccagggcaccatccag

SEQ ID NO: 5012771 - DNA, 16 bp, Homo sapiens
aagctcacaccaaatt

SEQ ID NO: 5012772 - DNA, 11 bp, Homo sapiens
aagctgagcct

SEQ ID NO: 5012773 - DNA, 14 bp, Homo sapiens
aagctggcctgaga

SEQ ID NO: 5012774 - DNA, 15 bp, Homo sapiens
aagcttgactcccaa

SEQ ID NO: 5012775 - DNA, 21 bp, Homo sapiens
aaggaaccttccttcctgctt

SEQ ID NO: 5012776 - DNA, 22 bp, Homo sapiens
aaggctggtacaacggaggcct

SEQ ID NO: 5012777 - DNA, 17 bp, Homo sapiens
aagggaatcctcctcca

SEQ ID NO: 5012778 - DNA, 13 bp, Homo sapiens
aagtaaagacagc

SEQ ID NO: 5012779 - DNA, 11 bp, Homo sapiens
aagtgggccca

SEQ ID NO: 5012780 - DNA, 11 bp, Homo sapiens
aataaaggctg

SEQ ID NO: 5012781 - DNA, 14 bp, Homo sapiens
aatcccactgtatg

SEQ ID NO: 5012782 - DNA, 18 bp, Homo sapiens
aatccccaacatgcactg

SEQ ID NO: 5012783 - DNA, 11 bp, Homo sapiens
aatcctcctcc

SEQ ID NO: 5012784 - DNA, 13 bp, Homo sapiens
aatcctcctccag

SEQ ID NO: 5012785 - DNA, 21 bp, Homo sapiens
aatctatccaaatctgaagat

SEQ ID NO: 5012786 - DNA, 16 bp, Homo sapiens
aatgaaacttaagaat

SEQ ID NO: 5012787 - DNA, 20 bp, Homo sapiens
aatgcaactctaactctgag

SEQ ID NO: 5012788 - DNA, 15 bp, Homo sapiens
aattcttctgtcctg

SEQ ID NO: 5012789 - DNA, 21 bp, Homo sapiens
aattgtgcagtactttgtgca

SEQ ID NO: 5012790 - DNA, 16 bp, Homo sapiens
aattgtgtatttaaaa

SEQ ID NO: 5012791 - DNA, 18 bp, Homo sapiens
aatttaaaaacacaaaaa

SEQ ID NO: 5012792 - DNA, 21 bp, Homo sapiens
aatttaatttgtaaaacttct

SEQ ID NO: 5012793 - DNA, 18 bp, Homo sapiens
aatttgggaaaataaata

SEQ ID NO: 5012794 - DNA, 15 bp, Homo sapiens
aatttgtaaaacttc

SEQ ID NO: 5012795 - DNA, 19 bp, Homo sapiens
aatttgtaaaacttctgct

SEQ ID NO: 5012796 - DNA, 14 bp, Homo sapiens
acaacatccactgt

SEQ ID NO: 5012797 - DNA, 14 bp, Homo sapiens
acaactgtgaagcc

SEQ ID NO: 5012798 - DNA, 23 bp, Homo sapiens
acaacttttgagagtatagcatg

SEQ ID NO: 5012799 - DNA, 14 bp, Homo sapiens
acaatatgtgagtg

SEQ ID NO: 5012800 - DNA, 19 bp, Homo sapiens
acacaaaaaaaattttagc

SEQ ID NO: 5012801 - DNA, 22 bp, Homo sapiens
acacactgtcatgcttcatcat

SEQ ID NO: 5012802 - DNA, 15 bp, Homo sapiens
acaccattttgtaaa

SEQ ID NO: 5012803 - DNA, 16 bp, Homo sapiens
acagccactccccggc

SEQ ID NO: 5012804 - DNA, 22 bp, Homo sapiens
acagctatcgaacttcacaact

SEQ ID NO: 5012805 - DNA, 21 bp, Homo sapiens
acaggaggcaggcatggccct

SEQ ID NO: 5012806 - DNA, 15 bp, Homo sapiens
acaggtaactaattg

SEQ ID NO: 5012807 - DNA, 14 bp, Homo sapiens
acatagaatctgtg

SEQ ID NO: 5012808 - DNA, 16 bp, Homo sapiens
acatatatatatataa

SEQ ID NO: 5012809 - DNA, 15 bp, Homo sapiens
acatcacagggtggg

SEQ ID NO: 5012810 - DNA, 16 bp, Homo sapiens
acatccgcgtgtgcct

SEQ ID NO: 5012811 - DNA, 17 bp, Homo sapiens
acatccgcgtgtgcctg

SEQ ID NO: 5012812 - DNA, 23 bp, Homo sapiens
acatgaaacctacacactgtcat

SEQ ID NO: 5012813 - DNA, 12 bp, Homo sapiens
acatgtcaatct

SEQ ID NO: 5012814 - DNA, 17 bp, Homo sapiens
acatgtccagcaccttg

SEQ ID NO: 5012815 - DNA, 19 bp, Homo sapiens
acatgtcctaattcttctg

SEQ ID NO: 5012816 - DNA, 20 bp, Homo sapiens
acattgccaagtcagatggt

SEQ ID NO: 5012817 - DNA, 13 bp, Homo sapiens
acatttagatcct

SEQ ID NO: 5012818 - DNA, 15 bp, Homo sapiens
acatttctataaata

SEQ ID NO: 5012819 - DNA, 17 bp, Homo sapiens
accaaatttttctatca

SEQ ID NO: 5012820 - DNA, 21 bp, Homo sapiens
accaaggaaacgctacctctc

SEQ ID NO: 5012821 - DNA, 16 bp, Homo sapiens
accagtgacgctgctg

SEQ ID NO: 5012822 - DNA, 15 bp, Homo sapiens
accatccagctcccc

SEQ ID NO: 5012823 - DNA, 22 bp, Homo sapiens
accatccagctccccagcccac

SEQ ID NO: 5012824 - DNA, 22 bp, Homo sapiens
acccaaagctgagcctgcaggg

SEQ ID NO: 5012825 - DNA, 18 bp, Homo sapiens
acccagtgcagaatgtaa

SEQ ID NO: 5012826 - DNA, 21 bp, Homo sapiens
acccattcagagactgtccct

SEQ ID NO: 5012827 - DNA, 23 bp, Homo sapiens
acccgcggcccgcgcagctgcct

SEQ ID NO: 5012828 - DNA, 19 bp, Homo sapiens
accctgggctacagaaacc

SEQ ID NO: 5012829 - DNA, 20 bp, Homo sapiens
accctgggtgtccccgctgc

SEQ ID NO: 5012830 - DNA, 19 bp, Homo sapiens
acccttctctgttggtctg

SEQ ID NO: 5012831 - DNA, 20 bp, Homo sapiens
acccttctctgttggtctgc

SEQ ID NO: 5012832 - DNA, 23 bp, Homo sapiens
acctacacactgtcatgcttcat

SEQ ID NO: 5012833 - DNA, 23 bp, Homo sapiens
acctcattctggttccctgctgc

SEQ ID NO: 5012834 - DNA, 12 bp, Homo sapiens
acctcctctcag

SEQ ID NO: 5012835 - DNA, 16 bp, Homo sapiens
acctcctctcagtgtt

SEQ ID NO: 5012836 - DNA, 15 bp, Homo sapiens
acctctctgtccctt

SEQ ID NO: 5012837 - DNA, 16 bp, Homo sapiens
acctctctgtcccttg

SEQ ID NO: 5012838 - DNA, 15 bp, Homo sapiens
acctctgacaactgt

SEQ ID NO: 5012839 - DNA, 19 bp, Homo sapiens
acctgccatgccaggaacc

SEQ ID NO: 5012840 - DNA, 15 bp, Homo sapiens
acctgctcccaggcc

SEQ ID NO: 5012841 - DNA, 21 bp, Homo sapiens
acctgtatatttgtaaagcta

SEQ ID NO: 5012842 - DNA, 19 bp, Homo sapiens
accttccaatgcttctgtt

SEQ ID NO: 5012843 - DNA, 16 bp, Homo sapiens
accttccttcctgctt

SEQ ID NO: 5012844 - DNA, 12 bp, Homo sapiens
accttgcttctt

SEQ ID NO: 5012845 - DNA, 12 bp, Homo sapiens
accttgtgcctg

SEQ ID NO: 5012846 - DNA, 16 bp, Homo sapiens
accttgtgcctggggt

SEQ ID NO: 5012847 - DNA, 17 bp, Homo sapiens
accttttgcatttcttt

SEQ ID NO: 5012848 - DNA, 12 bp, Homo sapiens
acggagggctgg

SEQ ID NO: 5012849 - DNA, 15 bp, Homo sapiens
acggccaagaatgta

SEQ ID NO: 5012850 - DNA, 16 bp, Homo sapiens
acggccaagaatgtac

SEQ ID NO: 5012851 - DNA, 19 bp, Homo sapiens
acgggacatcacagggtgg

SEQ ID NO: 5012852 - DNA, 23 bp, Homo sapiens
acgggacatcacagggtgggcct

SEQ ID NO: 5012853 - DNA, 17 bp, Homo sapiens
acggtttccagggaggg

SEQ ID NO: 5012854 - DNA, 18 bp, Homo sapiens
acgtgctccgtagctctg

SEQ ID NO: 5012855 - DNA, 19 bp, Homo sapiens
acgtgctccgtagctctgc

SEQ ID NO: 5012856 - DNA, 23 bp, Homo sapiens
acgtgttccagtgtctgtctgag

SEQ ID NO: 5012857 - DNA, 16 bp, Homo sapiens
acgttggttaaataaa

SEQ ID NO: 5012858 - DNA, 22 bp, Homo sapiens
actaagtccctataataaaggc

SEQ ID NO: 5012859 - DNA, 23 bp, Homo sapiens
actagtgtacatttctataaata

SEQ ID NO: 5012860 - DNA, 14 bp, Homo sapiens
actattacatattt

SEQ ID NO: 5012861 - DNA, 11 bp, Homo sapiens
actcagtgcag

SEQ ID NO: 5012862 - DNA, 18 bp, Homo sapiens
actccattattcctctca

SEQ ID NO: 5012863 - DNA, 23 bp, Homo sapiens
actcccaggatgacgtgctccgt

SEQ ID NO: 5012864 - DNA, 11 bp, Homo sapiens
actcctccctc

SEQ ID NO: 5012865 - DNA, 13 bp, Homo sapiens
actcctccctccg

SEQ ID NO: 5012866 - DNA, 14 bp, Homo sapiens
actctaactctgag

SEQ ID NO: 5012867 - DNA, 15 bp, Homo sapiens
actctgagagctgtt

SEQ ID NO: 5012868 - DNA, 13 bp, Homo sapiens
actcttttgatgg

SEQ ID NO: 5012869 - DNA, 17 bp, Homo sapiens
actgaggtttttttgct

SEQ ID NO: 5012870 - DNA, 17 bp, Homo sapiens
actgatgttgtgttttt

SEQ ID NO: 5012871 - DNA, 13 bp, Homo sapiens
actgcagaagcaa

SEQ ID NO: 5012872 - DNA, 23 bp, Homo sapiens
actgctgtatttttatttttgca

SEQ ID NO: 5012873 - DNA, 12 bp, Homo sapiens
actgggccctga

SEQ ID NO: 5012874 - DNA, 15 bp, Homo sapiens
actggggagtctttg

SEQ ID NO: 5012875 - DNA, 13 bp, Homo sapiens
actgggtctgcga

SEQ ID NO: 5012876 - DNA, 15 bp, Homo sapiens
actgtatgatttata

SEQ ID NO: 5012877 - DNA, 24 bp, Homo sapiens
actgtcatgcttcatcattccctc

SEQ ID NO: 5012878 - DNA, 15 bp, Homo sapiens
acttcaaagcaagct

SEQ ID NO: 5012879 - DNA, 16 bp, Homo sapiens
acttccaggggaacct

SEQ ID NO: 5012880 - DNA, 20 bp, Homo sapiens
acttccaggggaacctgcca

SEQ ID NO: 5012881 - DNA, 21 bp, Homo sapiens
acttccaggggaacctgccat

SEQ ID NO: 5012882 - DNA, 19 bp, Homo sapiens
acttcccaccctgcccctc

SEQ ID NO: 5012883 - DNA, 16 bp, Homo sapiens
acttctcaaagagaat

SEQ ID NO: 5012884 - DNA, 19 bp, Homo sapiens
acttctcaaagagaattgt

SEQ ID NO: 5012885 - DNA, 20 bp, Homo sapiens
acttctcaaagagaattgta

SEQ ID NO: 5012886 - DNA, 17 bp, Homo sapiens
acttcttacgcaatgct

SEQ ID NO: 5012887 - DNA, 22 bp, Homo sapiens
acttgaagtctaaaagcagaaa

SEQ ID NO: 5012888 - DNA, 13 bp, Homo sapiens
actttatgtagtt

SEQ ID NO: 5012889 - DNA, 20 bp, Homo sapiens
actttgaagtgcagctcatg

SEQ ID NO: 5012890 - DNA, 21 bp, Homo sapiens
actttgccactgctgtatttt

SEQ ID NO: 5012891 - DNA, 13 bp, Homo sapiens
acttttaatttaa

SEQ ID NO: 5012892 - DNA, 23 bp, Homo sapiens
agaaaccttccaatgcttctgtt

SEQ ID NO: 5012893 - DNA, 16 bp, Homo sapiens
agaacagatcttttac

SEQ ID NO: 5012894 - DNA, 16 bp, Homo sapiens
agaagggaatcctcct

SEQ ID NO: 5012895 - DNA, 13 bp, Homo sapiens
agaataaaaactt

SEQ ID NO: 5012896 - DNA, 20 bp, Homo sapiens
agaattagatttctatagga

SEQ ID NO: 5012897 - DNA, 18 bp, Homo sapiens
agaattcagaagacccct

SEQ ID NO: 5012898 - DNA, 12 bp, Homo sapiens
agaattgaattg

SEQ ID NO: 5012899 - DNA, 23 bp, Homo sapiens
agaattgaattggaaagacttct

SEQ ID NO: 5012900 - DNA, 14 bp, Homo sapiens
agacacctggttgc

SEQ ID NO: 5012901 - DNA, 17 bp, Homo sapiens
agaccacagagctgtca

SEQ ID NO: 5012902 - DNA, 13 bp, Homo sapiens
agactcgagaacc

SEQ ID NO: 5012903 - DNA, 24 bp, Homo sapiens
agactcgagaaccaaccagggaag

SEQ ID NO: 5012904 - DNA, 13 bp, Homo sapiens
agactctgtctca

SEQ ID NO: 5012905 - DNA, 20 bp, Homo sapiens
agagccctctcctccctctg

SEQ ID NO: 5012906 - DNA, 15 bp, Homo sapiens
agaggaccagggcct

SEQ ID NO: 5012907 - DNA, 19 bp, Homo sapiens
agaggctgcccctctcacc

SEQ ID NO: 5012908 - DNA, 21 bp, Homo sapiens
agagggacggccaagaatgta

SEQ ID NO: 5012909 - DNA, 13 bp, Homo sapiens
agaggtgcttcac

SEQ ID NO: 5012910 - DNA, 16 bp, Homo sapiens
agagtacaccctttcc

SEQ ID NO: 5012911 - DNA, 23 bp, Homo sapiens
agagttttatagcctggactgct

SEQ ID NO: 5012912 - DNA, 19 bp, Homo sapiens
agatattgttgttttccat

SEQ ID NO: 5012913 - DNA, 16 bp, Homo sapiens
agatgaaaaagaataa

SEQ ID NO: 5012914 - DNA, 21 bp, Homo sapiens
agatgaaataaagacccaggg

SEQ ID NO: 5012915 - DNA, 19 bp, Homo sapiens
agatgctgtgtatatggta

SEQ ID NO: 5012916 - DNA, 17 bp, Homo sapiens
agatggtttccacattt

SEQ ID NO: 5012917 - DNA, 19 bp, Homo sapiens
agatttattttttggactt

SEQ ID NO: 5012918 - DNA, 14 bp, Homo sapiens
agcaacaggaaaaa

SEQ ID NO: 5012919 - DNA, 16 bp, Homo sapiens
agcaagcaactaattt

SEQ ID NO: 5012920 - DNA, 15 bp, Homo sapiens
agcaatctgcctgta

SEQ ID NO: 5012921 - DNA, 18 bp, Homo sapiens
agcaatctgcctgtatct

SEQ ID NO: 5012922 - DNA, 16 bp, Homo sapiens
agcaccttgtgcctgg

SEQ ID NO: 5012923 - DNA, 18 bp, Homo sapiens
agcagaaaataaaggaag

SEQ ID NO: 5012924 - DNA, 20 bp, Homo sapiens
agcagaacagatcttttact

SEQ ID NO: 5012925 - DNA, 12 bp, Homo sapiens
agcagcccaccc

SEQ ID NO: 5012926 - DNA, 15 bp, Homo sapiens
agcattctgcaacat

SEQ ID NO: 5012927 - DNA, 13 bp, Homo sapiens
agccagactctgt

SEQ ID NO: 5012928 - DNA, 15 bp, Homo sapiens
agccagactctgtct

SEQ ID NO: 5012929 - DNA, 17 bp, Homo sapiens
agccaggagctgtcacc

SEQ ID NO: 5012930 - DNA, 20 bp, Homo sapiens
agccagggggatgccactcc

SEQ ID NO: 5012931 - DNA, 12 bp, Homo sapiens
agcccaccctgc

SEQ ID NO: 5012932 - DNA, 15 bp, Homo sapiens
agcccacctgctccc

SEQ ID NO: 5012933 - DNA, 21 bp, Homo sapiens
agcccacctgctcccaggccc

SEQ ID NO: 5012934 - DNA, 20 bp, Homo sapiens
agcccagggcaccatccagc

SEQ ID NO: 5012935 - DNA, 14 bp, Homo sapiens
agccctctcctccc

SEQ ID NO: 5012936 - DNA, 23 bp, Homo sapiens
agccctgatgtgtcctcagggag

SEQ ID NO: 5012937 - DNA, 17 bp, Homo sapiens
agcctcaattctccatt

SEQ ID NO: 5012938 - DNA, 17 bp, Homo sapiens
agcggccctaagggagt

SEQ ID NO: 5012939 - DNA, 17 bp, Homo sapiens
agcgtggggacttctgg

SEQ ID NO: 5012940 - DNA, 18 bp, Homo sapiens
agctagtgtacctcctct

SEQ ID NO: 5012941 - DNA, 22 bp, Homo sapiens
agctagtgtacctcctctcagt

SEQ ID NO: 5012942 - DNA, 23 bp, Homo sapiens
agctagtgtacctcctctcagtg

SEQ ID NO: 5012943 - DNA, 15 bp, Homo sapiens
agctatttatgggcc

SEQ ID NO: 5012944 - DNA, 16 bp, Homo sapiens
agctatttatgggccc

SEQ ID NO: 5012945 - DNA, 22 bp, Homo sapiens
agctatttatgggcccctggca

SEQ ID NO: 5012946 - DNA, 16 bp, Homo sapiens
agctccccagcccacc

SEQ ID NO: 5012947 - DNA, 12 bp, Homo sapiens
agctctgctgct

SEQ ID NO: 5012948 - DNA, 15 bp, Homo sapiens
agctctgctgctgat

SEQ ID NO: 5012949 - DNA, 21 bp, Homo sapiens
agctgagcctgcagggaagcc

SEQ ID NO: 5012950 - DNA, 23 bp, Homo sapiens
agctgagcctgcagggaagcccc

SEQ ID NO: 5012951 - DNA, 22 bp, Homo sapiens
agctgggcccgacatggctccg

SEQ ID NO: 5012952 - DNA, 14 bp, Homo sapiens
agctgtcccttgct

SEQ ID NO: 5012953 - DNA, 17 bp, Homo sapiens
agctgtttttgacagcc

SEQ ID NO: 5012954 - DNA, 20 bp, Homo sapiens
agctgtttttgacagccttc

SEQ ID NO: 5012955 - DNA, 17 bp, Homo sapiens
agcttatctcttttata

SEQ ID NO: 5012956 - DNA, 19 bp, Homo sapiens
agcttatctcttttatatt

SEQ ID NO: 5012957 - DNA, 15 bp, Homo sapiens
agcttgactcccaag

SEQ ID NO: 5012958 - DNA, 14 bp, Homo sapiens
aggaaccttccttc

SEQ ID NO: 5012959 - DNA, 19 bp, Homo sapiens
aggaataatgttttgggaa

SEQ ID NO: 5012960 - DNA, 22 bp, Homo sapiens
aggaggcaggcatggccctggg

SEQ ID NO: 5012961 - DNA, 16 bp, Homo sapiens
aggatcccctccaagc

SEQ ID NO: 5012962 - DNA, 13 bp, Homo sapiens
aggcatggccctg

SEQ ID NO: 5012963 - DNA, 14 bp, Homo sapiens
aggcatggccctgg

SEQ ID NO: 5012964 - DNA, 21 bp, Homo sapiens
aggcctgacttctgctggcat

SEQ ID NO: 5012965 - DNA, 17 bp, Homo sapiens
aggctgcccctctcacc

SEQ ID NO: 5012966 - DNA, 12 bp, Homo sapiens
aggctgggccat

SEQ ID NO: 5012967 - DNA, 19 bp, Homo sapiens
aggctggtacaacggaggc

SEQ ID NO: 5012968 - DNA, 17 bp, Homo sapiens
agggaagctggcctgag

SEQ ID NO: 5012969 - DNA, 15 bp, Homo sapiens
agggaagctgtcctg

SEQ ID NO: 5012970 - DNA, 14 bp, Homo sapiens
agggaaggcctgac

SEQ ID NO: 5012971 - DNA, 16 bp, Homo sapiens
agggaatcctcctcca

SEQ ID NO: 5012972 - DNA, 16 bp, Homo sapiens
agggagcagggaaggc

SEQ ID NO: 5012973 - DNA, 15 bp, Homo sapiens
agggagctgggcccg

SEQ ID NO: 5012974 - DNA, 16 bp, Homo sapiens
agggagctgggcccga

SEQ ID NO: 5012975 - DNA, 17 bp, Homo sapiens
agggaggggccggccct

SEQ ID NO: 5012976 - DNA, 23 bp, Homo sapiens
agggaggggccggccctgtgtgc

SEQ ID NO: 5012977 - DNA, 16 bp, Homo sapiens
agggccatggctcagg

SEQ ID NO: 5012978 - DNA, 21 bp, Homo sapiens
agggccatggctcagggtggt

SEQ ID NO: 5012979 - DNA, 17 bp, Homo sapiens
agggctggggatgcgcc

SEQ ID NO: 5012980 - DNA, 13 bp, Homo sapiens
aggggaacctgcc

SEQ ID NO: 5012981 - DNA, 15 bp, Homo sapiens
aggggaacctgccat

SEQ ID NO: 5012982 - DNA, 15 bp, Homo sapiens
aggggccggccctgt

SEQ ID NO: 5012983 - DNA, 17 bp, Homo sapiens
aggggccggccctgtgt

SEQ ID NO: 5012984 - DNA, 21 bp, Homo sapiens
aggggccggccctgtgtgcag

SEQ ID NO: 5012985 - DNA, 20 bp, Homo sapiens
aggtccctggtcggagaggg

SEQ ID NO: 5012986 - DNA, 17 bp, Homo sapiens
aggtgattccagtgaag

SEQ ID NO: 5012987 - DNA, 14 bp, Homo sapiens
agtaccttgcttct

SEQ ID NO: 5012988 - DNA, 17 bp, Homo sapiens
agtccgcagaagccctg

SEQ ID NO: 5012989 - DNA, 17 bp, Homo sapiens
agtgcagctcatgtttt

SEQ ID NO: 5012990 - DNA, 21 bp, Homo sapiens
agtgcagctcatgtttttaac

SEQ ID NO: 5012991 - DNA, 19 bp, Homo sapiens
agtgcatggtggccagagg

SEQ ID NO: 5012992 - DNA, 18 bp, Homo sapiens
agtgggcccacccggtgg

SEQ ID NO: 5012993 - DNA, 14 bp, Homo sapiens
agtgtacctcctct

SEQ ID NO: 5012994 - DNA, 17 bp, Homo sapiens
agtgtacctcctctcag

SEQ ID NO: 5012995 - DNA, 21 bp, Homo sapiens
agtgtacctcctctcagtgtt

SEQ ID NO: 5012996 - DNA, 14 bp, Homo sapiens
agtgtctgtatttg

SEQ ID NO: 5012997 - DNA, 14 bp, Homo sapiens
agtgttttggactc

SEQ ID NO: 5012998 - DNA, 21 bp, Homo sapiens
agtgttttggactccatctct

SEQ ID NO: 5012999 - DNA, 22 bp, Homo sapiens
agtgttttggactccatctctc

SEQ ID NO: 5013000 - DNA, 22 bp, Homo sapiens
agtttaaaaagatgaaaaagaa

SEQ ID NO: 5013001 - DNA, 17 bp, Homo sapiens
agtttcttacacactgt

SEQ ID NO: 5013002 - DNA, 19 bp, Homo sapiens
agtttcttacacactgtct

SEQ ID NO: 5013003 - DNA, 19 bp, Homo sapiens
agttttatagcctggactg

SEQ ID NO: 5013004 - DNA, 15 bp, Homo sapiens
agttttcttccatga

SEQ ID NO: 5013005 - DNA, 17 bp, Homo sapiens
agtttttatatgttgta

SEQ ID NO: 5013006 - DNA, 23 bp, Homo sapiens
agtttttctgttttgtttggcaa

SEQ ID NO: 5013007 - DNA, 17 bp, Homo sapiens
agttttttattatgcat

SEQ ID NO: 5013008 - DNA, 14 bp, Homo sapiens
ataaaaacttttga

SEQ ID NO: 5013009 - DNA, 14 bp, Homo sapiens
ataaacagacaata

SEQ ID NO: 5013010 - DNA, 19 bp, Homo sapiens
ataaacagacaatatgtga

SEQ ID NO: 5013011 - DNA, 14 bp, Homo sapiens
ataacatatatgga

SEQ ID NO: 5013012 - DNA, 13 bp, Homo sapiens
ataattttgctgg

SEQ ID NO: 5013013 - DNA, 13 bp, Homo sapiens
atacaggtaacta

SEQ ID NO: 5013014 - DNA, 20 bp, Homo sapiens
atacatatatatatataaca

SEQ ID NO: 5013015 - DNA, 15 bp, Homo sapiens
atacgcttttctttg

SEQ ID NO: 5013016 - DNA, 24 bp, Homo sapiens
atacgcttttctttgttataccat

SEQ ID NO: 5013017 - DNA, 20 bp, Homo sapiens
atactttgaagtgcagctca

SEQ ID NO: 5013018 - DNA, 15 bp, Homo sapiens
atagcaacaggaaaa

SEQ ID NO: 5013019 - DNA, 15 bp, Homo sapiens
atatatatatataac

SEQ ID NO: 5013020 - DNA, 15 bp, Homo sapiens
atatatatatatgca

SEQ ID NO: 5013021 - DNA, 15 bp, Homo sapiens
atatatatctatata

SEQ ID NO: 5013022 - DNA, 19 bp, Homo sapiens
atatctatatatataattt

SEQ ID NO: 5013023 - DNA, 16 bp, Homo sapiens
atatgcactatgtata

SEQ ID NO: 5013024 - DNA, 16 bp, Homo sapiens
atatgttgtaatattt

SEQ ID NO: 5013025 - DNA, 16 bp, Homo sapiens
atattgttgttttcca

SEQ ID NO: 5013026 - DNA, 12 bp, Homo sapiens
atatttatccaa

SEQ ID NO: 5013027 - DNA, 20 bp, Homo sapiens
atatttatccaaaatgtgta

SEQ ID NO: 5013028 - DNA, 13 bp, Homo sapiens
atatttgtaggag

SEQ ID NO: 5013029 - DNA, 15 bp, Homo sapiens
atcagaacaaaactt

SEQ ID NO: 5013030 - DNA, 17 bp, Homo sapiens
atcagaacaaaacttct

SEQ ID NO: 5013031 - DNA, 15 bp, Homo sapiens
atcatcgccagaggt

SEQ ID NO: 5013032 - DNA, 15 bp, Homo sapiens
atcattccctctcat

SEQ ID NO: 5013033 - DNA, 14 bp, Homo sapiens
atccaaaatgtgta

SEQ ID NO: 5013034 - DNA, 23 bp, Homo sapiens
atccaaaatgtgtatttcttata

SEQ ID NO: 5013035 - DNA, 20 bp, Homo sapiens
atccccaacatgcactgatg

SEQ ID NO: 5013036 - DNA, 14 bp, Homo sapiens
atccctgcttattt

SEQ ID NO: 5013037 - DNA, 22 bp, Homo sapiens
atcctagtctagcattctgcaa

SEQ ID NO: 5013038 - DNA, 21 bp, Homo sapiens
atcctccagtaccttgcttct

SEQ ID NO: 5013039 - DNA, 21 bp, Homo sapiens
atcctgcagatactttgaagt

SEQ ID NO: 5013040 - DNA, 23 bp, Homo sapiens
atcctggtttcataacttcctgt

SEQ ID NO: 5013041 - DNA, 20 bp, Homo sapiens
atctaacgtgttccagtgtc

SEQ ID NO: 5013042 - DNA, 14 bp, Homo sapiens
atctatatatataa

SEQ ID NO: 5013043 - DNA, 16 bp, Homo sapiens
atctcaggcttctgca

SEQ ID NO: 5013044 - DNA, 12 bp, Homo sapiens
atctctcatcct

SEQ ID NO: 5013045 - DNA, 15 bp, Homo sapiens
atcttcccagtatta

SEQ ID NO: 5013046 - DNA, 14 bp, Homo sapiens
atcttgcctccagg

SEQ ID NO: 5013047 - DNA, 21 bp, Homo sapiens
atcttgcctccaggtgcagag

SEQ ID NO: 5013048 - DNA, 18 bp, Homo sapiens
atgaaacttaagaattga

SEQ ID NO: 5013049 - DNA, 20 bp, Homo sapiens
atgaaagagccagactctgt

SEQ ID NO: 5013050 - DNA, 22 bp, Homo sapiens
atgaaagagccagactctgtct

SEQ ID NO: 5013051 - DNA, 15 bp, Homo sapiens
atgaaatcttcccag

SEQ ID NO: 5013052 - DNA, 13 bp, Homo sapiens
atgatcagtgttg

SEQ ID NO: 5013053 - DNA, 20 bp, Homo sapiens
atgatcagtgttgttgctct

SEQ ID NO: 5013054 - DNA, 21 bp, Homo sapiens
atgcaagcagaggaccagggc

SEQ ID NO: 5013055 - DNA, 21 bp, Homo sapiens
atgcacacacacacgctttct

SEQ ID NO: 5013056 - DNA, 16 bp, Homo sapiens
atgcactgatgttgtg

SEQ ID NO: 5013057 - DNA, 17 bp, Homo sapiens
atgccactcctccctcc

SEQ ID NO: 5013058 - DNA, 18 bp, Homo sapiens
atgccactcctccctccg

SEQ ID NO: 5013059 - DNA, 20 bp, Homo sapiens
atgctgagggtgtttcttcc

SEQ ID NO: 5013060 - DNA, 22 bp, Homo sapiens
atgcttcatcattccctctcat

SEQ ID NO: 5013061 - DNA, 20 bp, Homo sapiens
atggaagaggaaaaggctgg

SEQ ID NO: 5013062 - DNA, 12 bp, Homo sapiens
atgggcccctgg

SEQ ID NO: 5013063 - DNA, 16 bp, Homo sapiens
atgggcccctggcact

SEQ ID NO: 5013064 - DNA, 21 bp, Homo sapiens
atggggaggcaagtgtggggg

SEQ ID NO: 5013065 - DNA, 19 bp, Homo sapiens
atggtatatatacatatat

SEQ ID NO: 5013066 - DNA, 21 bp, Homo sapiens
atggttacgttggttaaataa

SEQ ID NO: 5013067 - DNA, 15 bp, Homo sapiens
atgtaagtgggccca

SEQ ID NO: 5013068 - DNA, 20 bp, Homo sapiens
atgtacgtccagcctgcccc

SEQ ID NO: 5013069 - DNA, 16 bp, Homo sapiens
atgtagcccatccttc

SEQ ID NO: 5013070 - DNA, 20 bp, Homo sapiens
atgtagtttttatatgttgt

SEQ ID NO: 5013071 - DNA, 22 bp, Homo sapiens
atgtatttctccatcctgcaga

SEQ ID NO: 5013072 - DNA, 12 bp, Homo sapiens
atgtccaaagag

SEQ ID NO: 5013073 - DNA, 22 bp, Homo sapiens
atgtccaaagaggctgcccctc

SEQ ID NO: 5013074 - DNA, 16 bp, Homo sapiens
atgtccagcaccttgt

SEQ ID NO: 5013075 - DNA, 20 bp, Homo sapiens
atgtgtcccgaatccacagt

SEQ ID NO: 5013076 - DNA, 19 bp, Homo sapiens
atgttgtaatatttcttca

SEQ ID NO: 5013077 - DNA, 22 bp, Homo sapiens
atgttgtattgatttttaagaa

SEQ ID NO: 5013078 - DNA, 23 bp, Homo sapiens
atgttttgggaaacactgaaatg

SEQ ID NO: 5013079 - DNA, 15 bp, Homo sapiens
attacatattttttg

SEQ ID NO: 5013080 - DNA, 19 bp, Homo sapiens
attcaatatggttacgttg

SEQ ID NO: 5013081 - DNA, 18 bp, Homo sapiens
attccgttgtctgtggat

SEQ ID NO: 5013082 - DNA, 21 bp, Homo sapiens
attcctctcaccccactcctg

SEQ ID NO: 5013083 - DNA, 22 bp, Homo sapiens
attcctctcaccccactcctgt

SEQ ID NO: 5013084 - DNA, 18 bp, Homo sapiens
attctgaggccctgccca

SEQ ID NO: 5013085 - DNA, 13 bp, Homo sapiens
attcttctgtcct

SEQ ID NO: 5013086 - DNA, 13 bp, Homo sapiens
attgatttttaag

SEQ ID NO: 5013087 - DNA, 16 bp, Homo sapiens
attgatttttaagaaa

SEQ ID NO: 5013088 - DNA, 18 bp, Homo sapiens
attgatttttaagaaagt

SEQ ID NO: 5013089 - DNA, 23 bp, Homo sapiens
attgatttttaagaaagtaattt

SEQ ID NO: 5013090 - DNA, 14 bp, Homo sapiens
attggaaagacttc

SEQ ID NO: 5013091 - DNA, 19 bp, Homo sapiens
attggaaagacttctcaaa

SEQ ID NO: 5013092 - DNA, 12 bp, Homo sapiens
attgtgtattta

SEQ ID NO: 5013093 - DNA, 17 bp, Homo sapiens
attgttcaaaaagatat

SEQ ID NO: 5013094 - DNA, 20 bp, Homo sapiens
atttaaaaaaaagaaacttt

SEQ ID NO: 5013095 - DNA, 15 bp, Homo sapiens
atttaaaaacacaaa

SEQ ID NO: 5013096 - DNA, 18 bp, Homo sapiens
atttaatttgtaaaactt

SEQ ID NO: 5013097 - DNA, 13 bp, Homo sapiens
atttagcaagcaa

SEQ ID NO: 5013098 - DNA, 20 bp, Homo sapiens
atttagcaagcaactaattt

SEQ ID NO: 5013099 - DNA, 21 bp, Homo sapiens
atttagcaagcaactaatttt

SEQ ID NO: 5013100 - DNA, 21 bp, Homo sapiens
atttagtgatcaaattgtgca

SEQ ID NO: 5013101 - DNA, 17 bp, Homo sapiens
atttataaacagacaat

SEQ ID NO: 5013102 - DNA, 17 bp, Homo sapiens
atttatgcacattcacg

SEQ ID NO: 5013103 - DNA, 13 bp, Homo sapiens
atttatgggcccc

SEQ ID NO: 5013104 - DNA, 19 bp, Homo sapiens
atttcctcagcttatctct

SEQ ID NO: 5013105 - DNA, 20 bp, Homo sapiens
atttctccatcctgcagata

SEQ ID NO: 5013106 - DNA, 22 bp, Homo sapiens
atttcttatacgcttttctttg

SEQ ID NO: 5013107 - DNA, 14 bp, Homo sapiens
atttgaggtcagtg

SEQ ID NO: 5013108 - DNA, 17 bp, Homo sapiens
atttgaggtcagtgttt

SEQ ID NO: 5013109 - DNA, 21 bp, Homo sapiens
atttggtatatactttgccac

SEQ ID NO: 5013110 - DNA, 14 bp, Homo sapiens
atttgtaaaacttc

SEQ ID NO: 5013111 - DNA, 15 bp, Homo sapiens
atttgtaaaacttct

SEQ ID NO: 5013112 - DNA, 17 bp, Homo sapiens
atttgtaaagctattta

SEQ ID NO: 5013113 - DNA, 13 bp, Homo sapiens
attttagctcttc

SEQ ID NO: 5013114 - DNA, 16 bp, Homo sapiens
attttttactgccctt

SEQ ID NO: 5013115 - DNA, 20 bp, Homo sapiens
caaaatgtgtatttcttata

SEQ ID NO: 5013116 - DNA, 13 bp, Homo sapiens
caaagaggctgcc

SEQ ID NO: 5013117 - DNA, 21 bp, Homo sapiens
caaagaggctgcccctctcac

SEQ ID NO: 5013118 - DNA, 13 bp, Homo sapiens
caaagctgagcct

SEQ ID NO: 5013119 - DNA, 22 bp, Homo sapiens
caaagctgagcctgcagggaag

SEQ ID NO: 5013120 - DNA, 14 bp, Homo sapiens
caaatctaccactg

SEQ ID NO: 5013121 - DNA, 18 bp, Homo sapiens
caaatctaccactgtatg

SEQ ID NO: 5013122 - DNA, 18 bp, Homo sapiens
caacaatgtgaggggtcc

SEQ ID NO: 5013123 - DNA, 21 bp, Homo sapiens
caacactccattattcctctc

SEQ ID NO: 5013124 - DNA, 13 bp, Homo sapiens
caacatccactgt

SEQ ID NO: 5013125 - DNA, 20 bp, Homo sapiens
caacggaggcctgcgaccct

SEQ ID NO: 5013126 - DNA, 18 bp, Homo sapiens
caagcaactaattttctc

SEQ ID NO: 5013127 - DNA, 11 bp, Homo sapiens
caagcagagga

SEQ ID NO: 5013128 - DNA, 20 bp, Homo sapiens
caagcagaggaccagggcct

SEQ ID NO: 5013129 - DNA, 15 bp, Homo sapiens
caagctgattttatt

SEQ ID NO: 5013130 - DNA, 20 bp, Homo sapiens
caaggaaacgctacctctct

SEQ ID NO: 5013131 - DNA, 19 bp, Homo sapiens
caaggaaaggggagaaggg

SEQ ID NO: 5013132 - DNA, 18 bp, Homo sapiens
caagtgtggggggtcctt

SEQ ID NO: 5013133 - DNA, 20 bp, Homo sapiens
caagtttccatagcaacagg

SEQ ID NO: 5013134 - DNA, 13 bp, Homo sapiens
caatctgcctgta

SEQ ID NO: 5013135 - DNA, 18 bp, Homo sapiens
caatgtgaggggtcccta

SEQ ID NO: 5013136 - DNA, 18 bp, Homo sapiens
caattcccccatccttca

SEQ ID NO: 5013137 - DNA, 16 bp, Homo sapiens
cacaaccagccaggca

SEQ ID NO: 5013138 - DNA, 16 bp, Homo sapiens
cacaccattttgtaaa

SEQ ID NO: 5013139 - DNA, 22 bp, Homo sapiens
cacacccaaagctgagcctgca

SEQ ID NO: 5013140 - DNA, 22 bp, Homo sapiens
cacactgtcatgcttcatcatt

SEQ ID NO: 5013141 - DNA, 19 bp, Homo sapiens
cacagagagggagagcaga

SEQ ID NO: 5013142 - DNA, 22 bp, Homo sapiens
cacagagagggagagcagagaa

SEQ ID NO: 5013143 - DNA, 22 bp, Homo sapiens
cacagagctttggtctgtgtgt

SEQ ID NO: 5013144 - DNA, 11 bp, Homo sapiens
cacagatcatg

SEQ ID NO: 5013145 - DNA, 22 bp, Homo sapiens
cacagccagggggatgccactc

SEQ ID NO: 5013146 - DNA, 14 bp, Homo sapiens
cacaggaggcaggc

SEQ ID NO: 5013147 - DNA, 15 bp, Homo sapiens
cacaggaggcaggca

SEQ ID NO: 5013148 - DNA, 22 bp, Homo sapiens
cacaggaggcaggcatggccct

SEQ ID NO: 5013149 - DNA, 14 bp, Homo sapiens
cacagggtgggcct

SEQ ID NO: 5013150 - DNA, 19 bp, Homo sapiens
cacatccgcgtgtgcctgt

SEQ ID NO: 5013151 - DNA, 20 bp, Homo sapiens
caccaaggaaacgctacctc

SEQ ID NO: 5013152 - DNA, 17 bp, Homo sapiens
caccacccctgggcagc

SEQ ID NO: 5013153 - DNA, 22 bp, Homo sapiens
caccacgggacatcacagggtg

SEQ ID NO: 5013154 - DNA, 15 bp, Homo sapiens
caccatccagctccc

SEQ ID NO: 5013155 - DNA, 16 bp, Homo sapiens
caccatccagctcccc

SEQ ID NO: 5013156 - DNA, 20 bp, Homo sapiens
cacccaaaccggcaggtgcg

SEQ ID NO: 5013157 - DNA, 16 bp, Homo sapiens
cacccaaagctgagcc

SEQ ID NO: 5013158 - DNA, 22 bp, Homo sapiens
cacccatgcaagcagaggacca

SEQ ID NO: 5013159 - DNA, 20 bp, Homo sapiens
caccctgctgctggtgcaca

SEQ ID NO: 5013160 - DNA, 16 bp, Homo sapiens
caccctttccaggaat

SEQ ID NO: 5013161 - DNA, 13 bp, Homo sapiens
caccgaggggcct

SEQ ID NO: 5013162 - DNA, 12 bp, Homo sapiens
cacctccaggct

SEQ ID NO: 5013163 - DNA, 19 bp, Homo sapiens
cactccattattcctctca

SEQ ID NO: 5013164 - DNA, 22 bp, Homo sapiens
cactccattattcctctcaccc

SEQ ID NO: 5013165 - DNA, 15 bp, Homo sapiens
cactcttttgatggt

SEQ ID NO: 5013166 - DNA, 19 bp, Homo sapiens
cactgatgttgtgttttta

SEQ ID NO: 5013167 - DNA, 17 bp, Homo sapiens
cactgccatctgatgcc

SEQ ID NO: 5013168 - DNA, 22 bp, Homo sapiens
cactgctgtatttttatttttg

SEQ ID NO: 5013169 - DNA, 15 bp, Homo sapiens
cactgtatgatttat

SEQ ID NO: 5013170 - DNA, 12 bp, Homo sapiens
cacttccagggg

SEQ ID NO: 5013171 - DNA, 21 bp, Homo sapiens
cagaaaccacagtcttcccag

SEQ ID NO: 5013172 - DNA, 14 bp, Homo sapiens
cagaacaaaacttc

SEQ ID NO: 5013173 - DNA, 16 bp, Homo sapiens
cagaagacccctgact

SEQ ID NO: 5013174 - DNA, 22 bp, Homo sapiens
cagaagcaagggggtgatgtag

SEQ ID NO: 5013175 - DNA, 19 bp, Homo sapiens
cagaatgtaagtgggccca

SEQ ID NO: 5013176 - DNA, 20 bp, Homo sapiens
cagaatgtaagtgggcccac

SEQ ID NO: 5013177 - DNA, 21 bp, Homo sapiens
cagagagggagagcagagaaa

SEQ ID NO: 5013178 - DNA, 13 bp, Homo sapiens
cagagcaggcaat

SEQ ID NO: 5013179 - DNA, 17 bp, Homo sapiens
cagagctttggtctgtg

SEQ ID NO: 5013180 - DNA, 16 bp, Homo sapiens
cagaggaccagggcct

SEQ ID NO: 5013181 - DNA, 18 bp, Homo sapiens
cagaggtaccctgggtgt

SEQ ID NO: 5013182 - DNA, 15 bp, Homo sapiens
cagagtgcttttctg

SEQ ID NO: 5013183 - DNA, 19 bp, Homo sapiens
cagagttgactttcctccc

SEQ ID NO: 5013184 - DNA, 22 bp, Homo sapiens
cagagttgactttcctcccatt

SEQ ID NO: 5013185 - DNA, 23 bp, Homo sapiens
cagatcctgggtactgaaagcct

SEQ ID NO: 5013186 - DNA, 19 bp, Homo sapiens
cagatggtttccacattta

SEQ ID NO: 5013187 - DNA, 13 bp, Homo sapiens
cagcaccttgtgc

SEQ ID NO: 5013188 - DNA, 18 bp, Homo sapiens
cagcaccttgtgcctggg

SEQ ID NO: 5013189 - DNA, 22 bp, Homo sapiens
cagcatgaggacagaccacaga

SEQ ID NO: 5013190 - DNA, 18 bp, Homo sapiens
cagcatttagctggccac

SEQ ID NO: 5013191 - DNA, 22 bp, Homo sapiens
cagcatttagctggccacatgg

SEQ ID NO: 5013192 - DNA, 13 bp, Homo sapiens
cagcccaccctgc

SEQ ID NO: 5013193 - DNA, 16 bp, Homo sapiens
cagcccaccctgctgc

SEQ ID NO: 5013194 - DNA, 15 bp, Homo sapiens
cagcccacctgctcc

SEQ ID NO: 5013195 - DNA, 16 bp, Homo sapiens
cagcccacctgctccc

SEQ ID NO: 5013196 - DNA, 19 bp, Homo sapiens
cagcccacctgctcccagg

SEQ ID NO: 5013197 - DNA, 20 bp, Homo sapiens
cagcccacctgctcccaggc

SEQ ID NO: 5013198 - DNA, 22 bp, Homo sapiens
cagcccacctgctcccaggccc

SEQ ID NO: 5013199 - DNA, 23 bp, Homo sapiens
cagcccagcttggccctttcctt

SEQ ID NO: 5013200 - DNA, 14 bp, Homo sapiens
cagcctgccccgga

SEQ ID NO: 5013201 - DNA, 16 bp, Homo sapiens
cagctacacagagctt

SEQ ID NO: 5013202 - DNA, 19 bp, Homo sapiens
cagctatcgaacttcacaa

SEQ ID NO: 5013203 - DNA, 18 bp, Homo sapiens
cagcttatctcttttata

SEQ ID NO: 5013204 - DNA, 21 bp, Homo sapiens
cagcttatctcttttatattt

SEQ ID NO: 5013205 - DNA, 13 bp, Homo sapiens
cagcttctccagg

SEQ ID NO: 5013206 - DNA, 21 bp, Homo sapiens
caggaggcaggcatggccctg

SEQ ID NO: 5013207 - DNA, 15 bp, Homo sapiens
caggcatggccctgg

SEQ ID NO: 5013208 - DNA, 17 bp, Homo sapiens
caggcatggccctgggc

SEQ ID NO: 5013209 - DNA, 12 bp, Homo sapiens
caggctgggcca

SEQ ID NO: 5013210 - DNA, 13 bp, Homo sapiens
caggctgggccat

SEQ ID NO: 5013211 - DNA, 18 bp, Homo sapiens
caggctgggccatgtcca

SEQ ID NO: 5013212 - DNA, 22 bp, Homo sapiens
caggctgggccatgtccaaaga

SEQ ID NO: 5013213 - DNA, 13 bp, Homo sapiens
caggctttcccac

SEQ ID NO: 5013214 - DNA, 15 bp, Homo sapiens
cagggaagccccaca

SEQ ID NO: 5013215 - DNA, 15 bp, Homo sapiens
cagggaaggcctgac

SEQ ID NO: 5013216 - DNA, 16 bp, Homo sapiens
cagggaaggcctgact

SEQ ID NO: 5013217 - DNA, 23 bp, Homo sapiens
cagggagacggtttccagggagg

SEQ ID NO: 5013218 - DNA, 18 bp, Homo sapiens
cagggagcagggaaggcc

SEQ ID NO: 5013219 - DNA, 20 bp, Homo sapiens
cagggagcagggaaggcctg

SEQ ID NO: 5013220 - DNA, 16 bp, Homo sapiens
cagggagctgggcccg

SEQ ID NO: 5013221 - DNA, 19 bp, Homo sapiens
cagggagctgggcccgaca

SEQ ID NO: 5013222 - DNA, 19 bp, Homo sapiens
cagggaggggccggccctg

SEQ ID NO: 5013223 - DNA, 15 bp, Homo sapiens
cagggcaccatccag

SEQ ID NO: 5013224 - DNA, 23 bp, Homo sapiens
cagggcctcccgcatcaaggtca

SEQ ID NO: 5013225 - DNA, 20 bp, Homo sapiens
cagggccttttctggcaccg

SEQ ID NO: 5013226 - DNA, 21 bp, Homo sapiens
cagggcttgtccctccaactg

SEQ ID NO: 5013227 - DNA, 14 bp, Homo sapiens
caggggaacctgcc

SEQ ID NO: 5013228 - DNA, 16 bp, Homo sapiens
caggggaacctgccat

SEQ ID NO: 5013229 - DNA, 16 bp, Homo sapiens
caggtgcagaggtacc

SEQ ID NO: 5013230 - DNA, 18 bp, Homo sapiens
cagtactttgtgcattct

SEQ ID NO: 5013231 - DNA, 20 bp, Homo sapiens
cagtgaagatattttatttc

SEQ ID NO: 5013232 - DNA, 15 bp, Homo sapiens
cagtgacgctgctga

SEQ ID NO: 5013233 - DNA, 14 bp, Homo sapiens
cagtgcatggtggc

SEQ ID NO: 5013234 - DNA, 15 bp, Homo sapiens
cagtgcatggtggcc

SEQ ID NO: 5013235 - DNA, 20 bp, Homo sapiens
cagtgttttggactccatct

SEQ ID NO: 5013236 - DNA, 16 bp, Homo sapiens
cagttctcatgactcc

SEQ ID NO: 5013237 - DNA, 18 bp, Homo sapiens
cagttgaaaatgcaactc

SEQ ID NO: 5013238 - DNA, 21 bp, Homo sapiens
cagttgaaaatgcaactctaa

SEQ ID NO: 5013239 - DNA, 20 bp, Homo sapiens
cagtttaagagcagaacaga

SEQ ID NO: 5013240 - DNA, 14 bp, Homo sapiens
cataacttcctgta

SEQ ID NO: 5013241 - DNA, 16 bp, Homo sapiens
catagcaacaggaaaa

SEQ ID NO: 5013242 - DNA, 16 bp, Homo sapiens
catatatatatataac

SEQ ID NO: 5013243 - DNA, 21 bp, Homo sapiens
catcaagaggtgggagggccc

SEQ ID NO: 5013244 - DNA, 21 bp, Homo sapiens
catcacagggtgggcctcggc

SEQ ID NO: 5013245 - DNA, 23 bp, Homo sapiens
catcattccctctcatctcaggt

SEQ ID NO: 5013246 - DNA, 19 bp, Homo sapiens
catcctccagtaccttgct

SEQ ID NO: 5013247 - DNA, 15 bp, Homo sapiens
catcttgcctccagg

SEQ ID NO: 5013248 - DNA, 18 bp, Homo sapiens
catcttgcctccaggtgc

SEQ ID NO: 5013249 - DNA, 19 bp, Homo sapiens
catcttgcctccaggtgca

SEQ ID NO: 5013250 - DNA, 15 bp, Homo sapiens
catgaagctgttgtg

SEQ ID NO: 5013251 - DNA, 13 bp, Homo sapiens
catgaatgttttt

SEQ ID NO: 5013252 - DNA, 18 bp, Homo sapiens
catgacatatgacttgat

SEQ ID NO: 5013253 - DNA, 17 bp, Homo sapiens
catgagactcagtgcag

SEQ ID NO: 5013254 - DNA, 22 bp, Homo sapiens
catgatttagcaagcaactaat

SEQ ID NO: 5013255 - DNA, 23 bp, Homo sapiens
catgcaagcagaggaccagggcc

SEQ ID NO: 5013256 - DNA, 14 bp, Homo sapiens
catgcactgatgtt

SEQ ID NO: 5013257 - DNA, 20 bp, Homo sapiens
catgcactgatgttgtgttt

SEQ ID NO: 5013258 - DNA, 13 bp, Homo sapiens
catgccaggaacc

SEQ ID NO: 5013259 - DNA, 12 bp, Homo sapiens
catggccctggg

SEQ ID NO: 5013260 - DNA, 16 bp, Homo sapiens
catggctcagggtggt

SEQ ID NO: 5013261 - DNA, 17 bp, Homo sapiens
catggctccggcctctg

SEQ ID NO: 5013262 - DNA, 20 bp, Homo sapiens
catggtagagaatctctccc

SEQ ID NO: 5013263 - DNA, 15 bp, Homo sapiens
catgtccaaagaggc

SEQ ID NO: 5013264 - DNA, 19 bp, Homo sapiens
catgtccaaagaggctgcc

SEQ ID NO: 5013265 - DNA, 20 bp, Homo sapiens
catgtccaaagaggctgccc

SEQ ID NO: 5013266 - DNA, 21 bp, Homo sapiens
catgtccagcaccttgtgcct

SEQ ID NO: 5013267 - DNA, 22 bp, Homo sapiens
catgtccagcaccttgtgcctg

SEQ ID NO: 5013268 - DNA, 18 bp, Homo sapiens
catgtcctaattcttctg

SEQ ID NO: 5013269 - DNA, 19 bp, Homo sapiens
cattctggttccctgctgc

SEQ ID NO: 5013270 - DNA, 12 bp, Homo sapiens
cattgcagttta

SEQ ID NO: 5013271 - DNA, 21 bp, Homo sapiens
catttagctggccacatggcg

SEQ ID NO: 5013272 - DNA, 12 bp, Homo sapiens
cattttgtaaat

SEQ ID NO: 5013273 - DNA, 20 bp, Homo sapiens
ccaaagaggctgcccctctc

SEQ ID NO: 5013274 - DNA, 23 bp, Homo sapiens
ccaaagaggctgcccctctcacc

SEQ ID NO: 5013275 - DNA, 13 bp, Homo sapiens
ccaacatgcactg

SEQ ID NO: 5013276 - DNA, 21 bp, Homo sapiens
ccaacatgcactgatgttgtg

SEQ ID NO: 5013277 - DNA, 23 bp, Homo sapiens
ccaacatgcactgatgttgtgtt

SEQ ID NO: 5013278 - DNA, 11 bp, Homo sapiens
ccaagaatgta

SEQ ID NO: 5013279 - DNA, 12 bp, Homo sapiens
ccaagaatgtac

SEQ ID NO: 5013280 - DNA, 17 bp, Homo sapiens
ccaagaatgtacgtcca

SEQ ID NO: 5013281 - DNA, 16 bp, Homo sapiens
ccaagctgattttatt

SEQ ID NO: 5013282 - DNA, 21 bp, Homo sapiens
ccaatgagactctagggtcca

SEQ ID NO: 5013283 - DNA, 19 bp, Homo sapiens
ccacaccccaacacttcca

SEQ ID NO: 5013284 - DNA, 20 bp, Homo sapiens
ccacatgtacagacatacat

SEQ ID NO: 5013285 - DNA, 13 bp, Homo sapiens
ccaccctgcccct

SEQ ID NO: 5013286 - DNA, 16 bp, Homo sapiens
ccaccctgctgctggt

SEQ ID NO: 5013287 - DNA, 11 bp, Homo sapiens
ccacctgctcc

SEQ ID NO: 5013288 - DNA, 15 bp, Homo sapiens
ccactccccggcatg

SEQ ID NO: 5013289 - DNA, 13 bp, Homo sapiens
ccactcctccctc

SEQ ID NO: 5013290 - DNA, 15 bp, Homo sapiens
ccactcctccctccg

SEQ ID NO: 5013291 - DNA, 13 bp, Homo sapiens
ccactttgtccat

SEQ ID NO: 5013292 - DNA, 14 bp, Homo sapiens
ccagcaccttgtgc

SEQ ID NO: 5013293 - DNA, 20 bp, Homo sapiens
ccagcatttagctggccaca

SEQ ID NO: 5013294 - DNA, 18 bp, Homo sapiens
ccagcccacctgctccca

SEQ ID NO: 5013295 - DNA, 19 bp, Homo sapiens
ccagcctcgttggaagagg

SEQ ID NO: 5013296 - DNA, 19 bp, Homo sapiens
ccagctccccagcccacct

SEQ ID NO: 5013297 - DNA, 23 bp, Homo sapiens
ccagctccccagcccacctgctc

SEQ ID NO: 5013298 - DNA, 15 bp, Homo sapiens
ccaggagctgtcacc

SEQ ID NO: 5013299 - DNA, 18 bp, Homo sapiens
ccaggcctgtggctccct

SEQ ID NO: 5013300 - DNA, 16 bp, Homo sapiens
ccagggcaccatccag

SEQ ID NO: 5013301 - DNA, 21 bp, Homo sapiens
ccagggcaccatccagctccc

SEQ ID NO: 5013302 - DNA, 12 bp, Homo sapiens
ccagggcctttt

SEQ ID NO: 5013303 - DNA, 15 bp, Homo sapiens
ccaggggaacctgcc

SEQ ID NO: 5013304 - DNA, 23 bp, Homo sapiens
ccaggtgcagaggtaccctgggt

SEQ ID NO: 5013305 - DNA, 15 bp, Homo sapiens
ccagtgcagaatgta

SEQ ID NO: 5013306 - DNA, 15 bp, Homo sapiens
ccagtgcatggtggc

SEQ ID NO: 5013307 - DNA, 15 bp, Homo sapiens
ccagtgtctgtctga

SEQ ID NO: 5013308 - DNA, 20 bp, Homo sapiens
ccatgcaagcagaggaccag

SEQ ID NO: 5013309 - DNA, 23 bp, Homo sapiens
ccatgtatggaatcccactgtat

SEQ ID NO: 5013310 - DNA, 17 bp, Homo sapiens
ccatgtccaaagaggct

SEQ ID NO: 5013311 - DNA, 19 bp, Homo sapiens
ccatgtccaaagaggctgc

SEQ ID NO: 5013312 - DNA, 14 bp, Homo sapiens
cccaaagctgagcc

SEQ ID NO: 5013313 - DNA, 18 bp, Homo sapiens
cccaaagctgagcctgca

SEQ ID NO: 5013314 - DNA, 16 bp, Homo sapiens
cccaagctgattttat

SEQ ID NO: 5013315 - DNA, 23 bp, Homo sapiens
cccaagtttccatagcaacagga

SEQ ID NO: 5013316 - DNA, 22 bp, Homo sapiens
cccaatgagactctagggtcca

SEQ ID NO: 5013317 - DNA, 13 bp, Homo sapiens
cccactcctgtca

SEQ ID NO: 5013318 - DNA, 13 bp, Homo sapiens
cccagcccacctg

SEQ ID NO: 5013319 - DNA, 13 bp, Homo sapiens
cccagcgctgctg

SEQ ID NO: 5013320 - DNA, 10 bp, Homo sapiens
cccagtgcag

SEQ ID NO: 5013321 - DNA, 11 bp, Homo sapiens
cccagtgcaga

SEQ ID NO: 5013322 - DNA, 12 bp, Homo sapiens
cccagtgcatgg

SEQ ID NO: 5013323 - DNA, 21 bp, Homo sapiens
cccagtgcatggtggccagag

SEQ ID NO: 5013324 - DNA, 20 bp, Homo sapiens
cccagtgcctcaccttccaa

SEQ ID NO: 5013325 - DNA, 17 bp, Homo sapiens
ccccagcccacctgctc

SEQ ID NO: 5013326 - DNA, 18 bp, Homo sapiens
ccccagcccacctgctcc

SEQ ID NO: 5013327 - DNA, 13 bp, Homo sapiens
ccccaggccctgc

SEQ ID NO: 5013328 - DNA, 21 bp, Homo sapiens
ccccagtgcctcaccttccaa

SEQ ID NO: 5013329 - DNA, 13 bp, Homo sapiens
ccccatccttcag

SEQ ID NO: 5013330 - DNA, 18 bp, Homo sapiens
ccccatgaggaaggaaca

SEQ ID NO: 5013331 - DNA, 15 bp, Homo sapiens
cccctagagccctct

SEQ ID NO: 5013332 - DNA, 20 bp, Homo sapiens
cccctagagccctctcctcc

SEQ ID NO: 5013333 - DNA, 20 bp, Homo sapiens
cccggagcagcagcttctcc

SEQ ID NO: 5013334 - DNA, 21 bp, Homo sapiens
cccggagcagcagcttctcca

SEQ ID NO: 5013335 - DNA, 14 bp, Homo sapiens
cccggagctggagg

SEQ ID NO: 5013336 - DNA, 20 bp, Homo sapiens
cccggcatgagactcagtgc

SEQ ID NO: 5013337 - DNA, 20 bp, Homo sapiens
cccggtgggacccccgtggg

SEQ ID NO: 5013338 - DNA, 15 bp, Homo sapiens
ccctataataaaggc

SEQ ID NO: 5013339 - DNA, 19 bp, Homo sapiens
ccctcccacacccaaagct

SEQ ID NO: 5013340 - DNA, 15 bp, Homo sapiens
ccctcgcctcctcct

SEQ ID NO: 5013341 - DNA, 20 bp, Homo sapiens
ccctcgcctcctcctcctgc

SEQ ID NO: 5013342 - DNA, 16 bp, Homo sapiens
ccctctcatctcaggt

SEQ ID NO: 5013343 - DNA, 13 bp, Homo sapiens
ccctgctgctggt

SEQ ID NO: 5013344 - DNA, 21 bp, Homo sapiens
ccctgggggcacaggaggcag

SEQ ID NO: 5013345 - DNA, 13 bp, Homo sapiens
ccctgtgtgcagg

SEQ ID NO: 5013346 - DNA, 13 bp, Homo sapiens
cccttctctgttg

SEQ ID NO: 5013347 - DNA, 21 bp, Homo sapiens
cccttgctgtatgctgatcat

SEQ ID NO: 5013348 - DNA, 19 bp, Homo sapiens
cccttgcttgcctgcaggg

SEQ ID NO: 5013349 - DNA, 23 bp, Homo sapiens
cccttggtgccctcgcctcctcc

SEQ ID NO: 5013350 - DNA, 17 bp, Homo sapiens
ccgaccacttccagggg

SEQ ID NO: 5013351 - DNA, 14 bp, Homo sapiens
ccgcgtgtgcctgt

SEQ ID NO: 5013352 - DNA, 20 bp, Homo sapiens
ccggagcagcagcttctcca

SEQ ID NO: 5013353 - DNA, 22 bp, Homo sapiens
ccggtgggacccccgtggggca

SEQ ID NO: 5013354 - DNA, 14 bp, Homo sapiens
ccgtagctctgctg

SEQ ID NO: 5013355 - DNA, 16 bp, Homo sapiens
ccgtagctctgctgct

SEQ ID NO: 5013356 - DNA, 17 bp, Homo sapiens
ccgtcacccctgtttct

SEQ ID NO: 5013357 - DNA, 14 bp, Homo sapiens
ccgtggggcaggga

SEQ ID NO: 5013358 - DNA, 13 bp, Homo sapiens
ccgtttgcttttg

SEQ ID NO: 5013359 - DNA, 14 bp, Homo sapiens
cctaacttttcaat

SEQ ID NO: 5013360 - DNA, 15 bp, Homo sapiens
cctacacactgtcat

SEQ ID NO: 5013361 - DNA, 12 bp, Homo sapiens
cctcaccttcca

SEQ ID NO: 5013362 - DNA, 17 bp, Homo sapiens
cctcagggagcagggaa

SEQ ID NO: 5013363 - DNA, 23 bp, Homo sapiens
cctcattctggttccctgctgcg

SEQ ID NO: 5013364 - DNA, 22 bp, Homo sapiens
cctcccacacccaaagctgagc

SEQ ID NO: 5013365 - DNA, 14 bp, Homo sapiens
cctcctctcagtgt

SEQ ID NO: 5013366 - DNA, 16 bp, Homo sapiens
cctctcaccccactcc

SEQ ID NO: 5013367 - DNA, 21 bp, Homo sapiens
cctctcaccccactcctgtca

SEQ ID NO: 5013368 - DNA, 15 bp, Homo sapiens
cctctcatctcaggt

SEQ ID NO: 5013369 - DNA, 15 bp, Homo sapiens
cctctccttgccccc

SEQ ID NO: 5013370 - DNA, 22 bp, Homo sapiens
cctctggcttgggcagggtctg

SEQ ID NO: 5013371 - DNA, 15 bp, Homo sapiens
cctctgtccctctcc

SEQ ID NO: 5013372 - DNA, 17 bp, Homo sapiens
cctgaagatgggagcct

SEQ ID NO: 5013373 - DNA, 12 bp, Homo sapiens
cctgactggtgc

SEQ ID NO: 5013374 - DNA, 20 bp, Homo sapiens
cctgagaggggaagcggccc

SEQ ID NO: 5013375 - DNA, 13 bp, Homo sapiens
cctgagtctgggc

SEQ ID NO: 5013376 - DNA, 15 bp, Homo sapiens
cctgccatgccagga

SEQ ID NO: 5013377 - DNA, 23 bp, Homo sapiens
cctgcccaatgagactctagggt

SEQ ID NO: 5013378 - DNA, 16 bp, Homo sapiens
cctgcccctcagagac

SEQ ID NO: 5013379 - DNA, 12 bp, Homo sapiens
cctgccctcctc

SEQ ID NO: 5013380 - DNA, 15 bp, Homo sapiens
cctgcgaccctgggg

SEQ ID NO: 5013381 - DNA, 17 bp, Homo sapiens
cctgcgaccctgggggc

SEQ ID NO: 5013382 - DNA, 17 bp, Homo sapiens
cctgctcccaggcccca

SEQ ID NO: 5013383 - DNA, 20 bp, Homo sapiens
cctgctcccaggccccaggc

SEQ ID NO: 5013384 - DNA, 13 bp, Homo sapiens
cctgctgcgctgc

SEQ ID NO: 5013385 - DNA, 16 bp, Homo sapiens
cctgctgcgctgcttg

SEQ ID NO: 5013386 - DNA, 21 bp, Homo sapiens
cctggggtgttagtggcaccg

SEQ ID NO: 5013387 - DNA, 21 bp, Homo sapiens
cctgggtgtccccgctgctgt

SEQ ID NO: 5013388 - DNA, 17 bp, Homo sapiens
cctgtcctaaggaacct

SEQ ID NO: 5013389 - DNA, 21 bp, Homo sapiens
cctgtcctaaggaaccttcct

SEQ ID NO: 5013390 - DNA, 16 bp, Homo sapiens
ccttccaatgcttctg

SEQ ID NO: 5013391 - DNA, 12 bp, Homo sapiens
ccttctgctgaa

SEQ ID NO: 5013392 - DNA, 18 bp, Homo sapiens
ccttgcccccagtgcctc

SEQ ID NO: 5013393 - DNA, 20 bp, Homo sapiens
ccttgctgtatgctgatcat

SEQ ID NO: 5013394 - DNA, 20 bp, Homo sapiens
ccttgcttcttactgataat

SEQ ID NO: 5013395 - DNA, 16 bp, Homo sapiens
ccttgcttgcctgcag

SEQ ID NO: 5013396 - DNA, 20 bp, Homo sapiens
ccttggctgacatgaagctg

SEQ ID NO: 5013397 - DNA, 15 bp, Homo sapiens
cctttcaaagcactt

SEQ ID NO: 5013398 - DNA, 13 bp, Homo sapiens
cctttcaaagctt

SEQ ID NO: 5013399 - DNA, 13 bp, Homo sapiens
cctttccaggaat

SEQ ID NO: 5013400 - DNA, 18 bp, Homo sapiens
cctttgtcctttttcagg

SEQ ID NO: 5013401 - DNA, 15 bp, Homo sapiens
ccttttctggcaccg

SEQ ID NO: 5013402 - DNA, 19 bp, Homo sapiens
cgaccctgggggcacagga

SEQ ID NO: 5013403 - DNA, 19 bp, Homo sapiens
cgcatcttgcctccaggtg

SEQ ID NO: 5013404 - DNA, 18 bp, Homo sapiens
cgcctccccacctccagg

SEQ ID NO: 5013405 - DNA, 19 bp, Homo sapiens
cgcctccccacctccaggc

SEQ ID NO: 5013406 - DNA, 14 bp, Homo sapiens
cgcgcagctgccta

SEQ ID NO: 5013407 - DNA, 16 bp, Homo sapiens
cgcgcagctgcctagg

SEQ ID NO: 5013408 - DNA, 20 bp, Homo sapiens
cgcggcccgcgcagctgcct

SEQ ID NO: 5013409 - DNA, 23 bp, Homo sapiens
cggcatgagactcagtgcagatg

SEQ ID NO: 5013410 - DNA, 12 bp, Homo sapiens
cggccaagaatg

SEQ ID NO: 5013411 - DNA, 13 bp, Homo sapiens
cggccaagaatgt

SEQ ID NO: 5013412 - DNA, 15 bp, Homo sapiens
cggcccgcgcagctg

SEQ ID NO: 5013413 - DNA, 19 bp, Homo sapiens
cgggacatcacagggtggg

SEQ ID NO: 5013414 - DNA, 15 bp, Homo sapiens
cggtctcctgactgg

SEQ ID NO: 5013415 - DNA, 18 bp, Homo sapiens
cggtgggacccccgtggg

SEQ ID NO: 5013416 - DNA, 16 bp, Homo sapiens
cggtttccagggaggg

SEQ ID NO: 5013417 - DNA, 15 bp, Homo sapiens
cgtagctctgctgct

SEQ ID NO: 5013418 - DNA, 21 bp, Homo sapiens
cgtcacccctgtttctggcac

SEQ ID NO: 5013419 - DNA, 20 bp, Homo sapiens
cgtgatggcaggtgcctgta

SEQ ID NO: 5013420 - DNA, 16 bp, Homo sapiens
cgtggagggaggcccc

SEQ ID NO: 5013421 - DNA, 14 bp, Homo sapiens
cgtggggacttctg

SEQ ID NO: 5013422 - DNA, 16 bp, Homo sapiens
cgtgggggggcgtgga

SEQ ID NO: 5013423 - DNA, 17 bp, Homo sapiens
cgtgttccagtgtctgt

SEQ ID NO: 5013424 - DNA, 21 bp, Homo sapiens
cgttaagaatttggggcagga

SEQ ID NO: 5013425 - DNA, 23 bp, Homo sapiens
cgttctgtactgttactgggccc

SEQ ID NO: 5013426 - DNA, 18 bp, Homo sapiens
ctaactctgagagctgtt

SEQ ID NO: 5013427 - DNA, 15 bp, Homo sapiens
ctaaggaaccttcct

SEQ ID NO: 5013428 - DNA, 20 bp, Homo sapiens
ctaagtccctataataaagg

SEQ ID NO: 5013429 - DNA, 18 bp, Homo sapiens
ctaattcttctgtcctga

SEQ ID NO: 5013430 - DNA, 22 bp, Homo sapiens
ctaattgctgtgtgtcccaggc

SEQ ID NO: 5013431 - DNA, 20 bp, Homo sapiens
ctacagaaaccacagtcttc

SEQ ID NO: 5013432 - DNA, 21 bp, Homo sapiens
ctacagaaaccacagtcttcc

SEQ ID NO: 5013433 - DNA, 12 bp, Homo sapiens
ctacctccctcc

SEQ ID NO: 5013434 - DNA, 13 bp, Homo sapiens
ctacctccctccc

SEQ ID NO: 5013435 - DNA, 14 bp, Homo sapiens
ctacctctctgtcc

SEQ ID NO: 5013436 - DNA, 16 bp, Homo sapiens
ctacctttcaaagctt

SEQ ID NO: 5013437 - DNA, 21 bp, Homo sapiens
ctagagccctctcctccctct

SEQ ID NO: 5013438 - DNA, 23 bp, Homo sapiens
ctagagccctctcctccctctgt

SEQ ID NO: 5013439 - DNA, 17 bp, Homo sapiens
ctaggatgttctgggct

SEQ ID NO: 5013440 - DNA, 22 bp, Homo sapiens
ctagtttcttacacactgtctg

SEQ ID NO: 5013441 - DNA, 13 bp, Homo sapiens
ctataataaaggc

SEQ ID NO: 5013442 - DNA, 14 bp, Homo sapiens
ctataataaaggct

SEQ ID NO: 5013443 - DNA, 20 bp, Homo sapiens
ctcaaagagaattgtatgta

SEQ ID NO: 5013444 - DNA, 20 bp, Homo sapiens
ctcaacatttgtctggtctt

SEQ ID NO: 5013445 - DNA, 13 bp, Homo sapiens
ctcaccccactcc

SEQ ID NO: 5013446 - DNA, 16 bp, Homo sapiens
ctcaccttccaacact

SEQ ID NO: 5013447 - DNA, 14 bp, Homo sapiens
ctcagcttatctct

SEQ ID NO: 5013448 - DNA, 19 bp, Homo sapiens
ctcagggagcagggaaggc

SEQ ID NO: 5013449 - DNA, 22 bp, Homo sapiens
ctcagggagcagggaaggcctg

SEQ ID NO: 5013450 - DNA, 20 bp, Homo sapiens
ctcagtaaatgtacaactgc

SEQ ID NO: 5013451 - DNA, 12 bp, Homo sapiens
ctcagtgcagat

SEQ ID NO: 5013452 - DNA, 23 bp, Homo sapiens
ctcagtgttttggactccatctc

SEQ ID NO: 5013453 - DNA, 21 bp, Homo sapiens
ctcagttgaaaatgcaactct

SEQ ID NO: 5013454 - DNA, 21 bp, Homo sapiens
ctcattctggttccctgctgc

SEQ ID NO: 5013455 - DNA, 15 bp, Homo sapiens
ctccaggtgcagagg

SEQ ID NO: 5013456 - DNA, 15 bp, Homo sapiens
ctccatcctgcagat

SEQ ID NO: 5013457 - DNA, 20 bp, Homo sapiens
ctccatctctcatcctccag

SEQ ID NO: 5013458 - DNA, 19 bp, Homo sapiens
ctccattattcctctcacc

SEQ ID NO: 5013459 - DNA, 19 bp, Homo sapiens
ctcccaagctgattttatt

SEQ ID NO: 5013460 - DNA, 15 bp, Homo sapiens
ctccccacctccagg

SEQ ID NO: 5013461 - DNA, 16 bp, Homo sapiens
ctccccacctccaggc

SEQ ID NO: 5013462 - DNA, 14 bp, Homo sapiens
ctccccagcccacc

SEQ ID NO: 5013463 - DNA, 21 bp, Homo sapiens
ctcccctagagccctctcctc

SEQ ID NO: 5013464 - DNA, 22 bp, Homo sapiens
ctcccctagagccctctcctcc

SEQ ID NO: 5013465 - DNA, 20 bp, Homo sapiens
ctcccttggtgccctcgcct

SEQ ID NO: 5013466 - DNA, 18 bp, Homo sapiens
ctccgtagctctgctgct

SEQ ID NO: 5013467 - DNA, 19 bp, Homo sapiens
ctccgtagctctgctgctg

SEQ ID NO: 5013468 - DNA, 20 bp, Homo sapiens
ctccgtagctctgctgctga

SEQ ID NO: 5013469 - DNA, 14 bp, Homo sapiens
ctcctccctctgtc

SEQ ID NO: 5013470 - DNA, 18 bp, Homo sapiens
ctcctcctgccctcctct

SEQ ID NO: 5013471 - DNA, 14 bp, Homo sapiens
ctcctctcagtgtt

SEQ ID NO: 5013472 - DNA, 20 bp, Homo sapiens
ctcctgccctcctctcccct

SEQ ID NO: 5013473 - DNA, 20 bp, Homo sapiens
ctccttccccgagtgactct

SEQ ID NO: 5013474 - DNA, 18 bp, Homo sapiens
ctccttgcccccagtgcc

SEQ ID NO: 5013475 - DNA, 12 bp, Homo sapiens
ctctagggtcca

SEQ ID NO: 5013476 - DNA, 12 bp, Homo sapiens
ctctcaccccac

SEQ ID NO: 5013477 - DNA, 15 bp, Homo sapiens
ctctcaccccactcc

SEQ ID NO: 5013478 - DNA, 16 bp, Homo sapiens
ctctcaccccactcct

SEQ ID NO: 5013479 - DNA, 12 bp, Homo sapiens
ctctcagtgttt

SEQ ID NO: 5013480 - DNA, 22 bp, Homo sapiens
ctctcagtgttttggactccat

SEQ ID NO: 5013481 - DNA, 20 bp, Homo sapiens
ctctcccctagagccctctc

SEQ ID NO: 5013482 - DNA, 22 bp, Homo sapiens
ctctcctccctctgtccctctc

SEQ ID NO: 5013483 - DNA, 14 bp, Homo sapiens
ctctccttgccccc

SEQ ID NO: 5013484 - DNA, 16 bp, Homo sapiens
ctctccttgcccccag

SEQ ID NO: 5013485 - DNA, 19 bp, Homo sapiens
ctctccttgcccccagtgc

SEQ ID NO: 5013486 - DNA, 19 bp, Homo sapiens
ctctctgtcccttgctgta

SEQ ID NO: 5013487 - DNA, 23 bp, Homo sapiens
ctctctgtcccttgctgtatgct

SEQ ID NO: 5013488 - DNA, 20 bp, Homo sapiens
ctctgacaactgtgaagcca

SEQ ID NO: 5013489 - DNA, 14 bp, Homo sapiens
ctctgccgctacct

SEQ ID NO: 5013490 - DNA, 21 bp, Homo sapiens
ctctgccgctacctccctccc

SEQ ID NO: 5013491 - DNA, 23 bp, Homo sapiens
ctctgcctttgcaccacgggaca

SEQ ID NO: 5013492 - DNA, 15 bp, Homo sapiens
ctctgggtgctgccc

SEQ ID NO: 5013493 - DNA, 17 bp, Homo sapiens
ctctgggtgctgccctg

SEQ ID NO: 5013494 - DNA, 15 bp, Homo sapiens
ctctgtccctctcct

SEQ ID NO: 5013495 - DNA, 17 bp, Homo sapiens
ctctgtccctctccttg

SEQ ID NO: 5013496 - DNA, 15 bp, Homo sapiens
ctctgtcccttgctg

SEQ ID NO: 5013497 - DNA, 14 bp, Homo sapiens
ctctgttggtctgc

SEQ ID NO: 5013498 - DNA, 14 bp, Homo sapiens
ctcttcccactttt

SEQ ID NO: 5013499 - DNA, 23 bp, Homo sapiens
ctcttctggggcaggctgggcca

SEQ ID NO: 5013500 - DNA, 20 bp, Homo sapiens
ctcttcttggggcccagtgc

SEQ ID NO: 5013501 - DNA, 21 bp, Homo sapiens
ctcttcttggggcccagtgca

SEQ ID NO: 5013502 - DNA, 15 bp, Homo sapiens
ctcttttatatttgt

SEQ ID NO: 5013503 - DNA, 22 bp, Homo sapiens
ctcttttatatttgtaggagaa

SEQ ID NO: 5013504 - DNA, 20 bp, Homo sapiens
ctgaaagccttagggaagct

SEQ ID NO: 5013505 - DNA, 20 bp, Homo sapiens
ctgaagcttgactcccaagt

SEQ ID NO: 5013506 - DNA, 14 bp, Homo sapiens
ctgaatgctgccac

SEQ ID NO: 5013507 - DNA, 17 bp, Homo sapiens
ctgacaactgtgaagcc

SEQ ID NO: 5013508 - DNA, 21 bp, Homo sapiens
ctgacgtctgaagcttgactc

SEQ ID NO: 5013509 - DNA, 23 bp, Homo sapiens
ctgacttcagggaaggtgaaaca

SEQ ID NO: 5013510 - DNA, 22 bp, Homo sapiens
ctgagacgccacggagggctgg

SEQ ID NO: 5013511 - DNA, 17 bp, Homo sapiens
ctgagagctgtttttga

SEQ ID NO: 5013512 - DNA, 19 bp, Homo sapiens
ctgagcctgcagggaagcc

SEQ ID NO: 5013513 - DNA, 16 bp, Homo sapiens
ctgatactgggtctgc

SEQ ID NO: 5013514 - DNA, 19 bp, Homo sapiens
ctgatcatcgccagaggtg

SEQ ID NO: 5013515 - DNA, 12 bp, Homo sapiens
ctgatgttgtgt

SEQ ID NO: 5013516 - DNA, 16 bp, Homo sapiens
ctgcagcaccgagggg

SEQ ID NO: 5013517 - DNA, 18 bp, Homo sapiens
ctgcagcaccgaggggcc

SEQ ID NO: 5013518 - DNA, 18 bp, Homo sapiens
ctgcagggccatggctca

SEQ ID NO: 5013519 - DNA, 20 bp, Homo sapiens
ctgccacaaccagccaggca

SEQ ID NO: 5013520 - DNA, 16 bp, Homo sapiens
ctgccatgccaggaac

SEQ ID NO: 5013521 - DNA, 18 bp, Homo sapiens
ctgccatgccaggaacct

SEQ ID NO: 5013522 - DNA, 23 bp, Homo sapiens
ctgccatgccaggaacctgtcct

SEQ ID NO: 5013523 - DNA, 19 bp, Homo sapiens
ctgccccggagctggagga

SEQ ID NO: 5013524 - DNA, 15 bp, Homo sapiens
ctgcccctcagagac

SEQ ID NO: 5013525 - DNA, 17 bp, Homo sapiens
ctgcccctctcaccaaa

SEQ ID NO: 5013526 - DNA, 12 bp, Homo sapiens
ctgccttctgct

SEQ ID NO: 5013527 - DNA, 13 bp, Homo sapiens
ctgcgaccctggg

SEQ ID NO: 5013528 - DNA, 22 bp, Homo sapiens
ctgcgaccctgggggcacagga

SEQ ID NO: 5013529 - DNA, 13 bp, Homo sapiens
ctgcgatgcagcg

SEQ ID NO: 5013530 - DNA, 18 bp, Homo sapiens
ctgctcccaggccccagg

SEQ ID NO: 5013531 - DNA, 21 bp, Homo sapiens
ctgctgaaagactcgagaacc

SEQ ID NO: 5013532 - DNA, 19 bp, Homo sapiens
ctgctgatactgggtctgc

SEQ ID NO: 5013533 - DNA, 20 bp, Homo sapiens
ctgctgatactgggtctgcg

SEQ ID NO: 5013534 - DNA, 13 bp, Homo sapiens
ctgctgcgctgct

SEQ ID NO: 5013535 - DNA, 15 bp, Homo sapiens
ctgctgcgctgcttg

SEQ ID NO: 5013536 - DNA, 16 bp, Homo sapiens
ctgctgcgctgcttgg

SEQ ID NO: 5013537 - DNA, 17 bp, Homo sapiens
ctgctgcgctgcttggt

SEQ ID NO: 5013538 - DNA, 16 bp, Homo sapiens
ctgctgctgagacgcc

SEQ ID NO: 5013539 - DNA, 20 bp, Homo sapiens
ctgcttgagttcccagatgg

SEQ ID NO: 5013540 - DNA, 22 bp, Homo sapiens
ctggcatcaagaggtgggaggg

SEQ ID NO: 5013541 - DNA, 21 bp, Homo sapiens
ctgggcccgacatggctccgg

SEQ ID NO: 5013542 - DNA, 16 bp, Homo sapiens
ctgggctacagaaacc

SEQ ID NO: 5013543 - DNA, 16 bp, Homo sapiens
ctggggcaggctgggc

SEQ ID NO: 5013544 - DNA, 19 bp, Homo sapiens
ctggggcaggctgggccat

SEQ ID NO: 5013545 - DNA, 20 bp, Homo sapiens
ctggggggacccagtgcaga

SEQ ID NO: 5013546 - DNA, 13 bp, Homo sapiens
ctgggtctgcgat

SEQ ID NO: 5013547 - DNA, 18 bp, Homo sapiens
ctgggtctgcgatgcagc

SEQ ID NO: 5013548 - DNA, 13 bp, Homo sapiens
ctgggtgatctgc

SEQ ID NO: 5013549 - DNA, 20 bp, Homo sapiens
ctgggtgtccccgctgctgt

SEQ ID NO: 5013550 - DNA, 20 bp, Homo sapiens
ctggtcagtcgtggagcgcc

SEQ ID NO: 5013551 - DNA, 19 bp, Homo sapiens
ctggtgcacagccactccc

SEQ ID NO: 5013552 - DNA, 15 bp, Homo sapiens
ctggttccctgctgc

SEQ ID NO: 5013553 - DNA, 16 bp, Homo sapiens
ctggttccctgctgcg

SEQ ID NO: 5013554 - DNA, 21 bp, Homo sapiens
ctggttccctgctgcgctgct

SEQ ID NO: 5013555 - DNA, 19 bp, Homo sapiens
ctgtactgttactgggccc

SEQ ID NO: 5013556 - DNA, 20 bp, Homo sapiens
ctgtatatttgtaaagctat

SEQ ID NO: 5013557 - DNA, 15 bp, Homo sapiens
ctgtatgctgatcat

SEQ ID NO: 5013558 - DNA, 22 bp, Homo sapiens
ctgtatttggtatatactttgc

SEQ ID NO: 5013559 - DNA, 20 bp, Homo sapiens
ctgtatttttatttttgcac

SEQ ID NO: 5013560 - DNA, 14 bp, Homo sapiens
ctgtcatgcttcat

SEQ ID NO: 5013561 - DNA, 23 bp, Homo sapiens
ctgtctgtatagtgtctgtattt

SEQ ID NO: 5013562 - DNA, 19 bp, Homo sapiens
ctgtgcaacggtctcctga

SEQ ID NO: 5013563 - DNA, 19 bp, Homo sapiens
ctgtgtgtcccaggcaggg

SEQ ID NO: 5013564 - DNA, 20 bp, Homo sapiens
ctgtgtgtcccaggcaggga

SEQ ID NO: 5013565 - DNA, 16 bp, Homo sapiens
ctgttactgggccctg

SEQ ID NO: 5013566 - DNA, 14 bp, Homo sapiens
ctgttggtctgcct

SEQ ID NO: 5013567 - DNA, 13 bp, Homo sapiens
cttacacactgtc

SEQ ID NO: 5013568 - DNA, 12 bp, Homo sapiens
cttatctctttt

SEQ ID NO: 5013569 - DNA, 19 bp, Homo sapiens
cttcagggaaggtgaaaca

SEQ ID NO: 5013570 - DNA, 17 bp, Homo sapiens
cttccaatgcttctgtt

SEQ ID NO: 5013571 - DNA, 12 bp, Homo sapiens
cttccagatcct

SEQ ID NO: 5013572 - DNA, 21 bp, Homo sapiens
cttccagcatttagctggcca

SEQ ID NO: 5013573 - DNA, 15 bp, Homo sapiens
cttccaggggaacct

SEQ ID NO: 5013574 - DNA, 14 bp, Homo sapiens
cttccatgatttta

SEQ ID NO: 5013575 - DNA, 13 bp, Homo sapiens
cttcccagcaatt

SEQ ID NO: 5013576 - DNA, 14 bp, Homo sapiens
cttccttcctgctt

SEQ ID NO: 5013577 - DNA, 15 bp, Homo sapiens
cttctagagttttat

SEQ ID NO: 5013578 - DNA, 21 bp, Homo sapiens
cttctattatccagagtcatg

SEQ ID NO: 5013579 - DNA, 23 bp, Homo sapiens
cttctcaaagagaattgtatgta

SEQ ID NO: 5013580 - DNA, 11 bp, Homo sapiens
cttctccagga

SEQ ID NO: 5013581 - DNA, 13 bp, Homo sapiens
cttctctgttggt

SEQ ID NO: 5013582 - DNA, 17 bp, Homo sapiens
cttctgctcgtttacac

SEQ ID NO: 5013583 - DNA, 22 bp, Homo sapiens
cttctgctgaaagactcgagaa

SEQ ID NO: 5013584 - DNA, 14 bp, Homo sapiens
cttctggggcaggc

SEQ ID NO: 5013585 - DNA, 16 bp, Homo sapiens
cttctggggcaggctg

SEQ ID NO: 5013586 - DNA, 21 bp, Homo sapiens
cttctggggcaggctgggcca

SEQ ID NO: 5013587 - DNA, 19 bp, Homo sapiens
cttcttggggcccagtgca

SEQ ID NO: 5013588 - DNA, 22 bp, Homo sapiens
cttcttggggcccagtgcatgg

SEQ ID NO: 5013589 - DNA, 19 bp, Homo sapiens
cttgaagtctaaaagcaga

SEQ ID NO: 5013590 - DNA, 18 bp, Homo sapiens
cttgaccgggagacagag

SEQ ID NO: 5013591 - DNA, 15 bp, Homo sapiens
cttgcccccagtgcc

SEQ ID NO: 5013592 - DNA, 16 bp, Homo sapiens
cttgcctccaggtgca

SEQ ID NO: 5013593 - DNA, 13 bp, Homo sapiens
cttgcctgcaggg

SEQ ID NO: 5013594 - DNA, 20 bp, Homo sapiens
cttgcttcttactgataatt

SEQ ID NO: 5013595 - DNA, 17 bp, Homo sapiens
cttgcttgcctgcaggg

SEQ ID NO: 5013596 - DNA, 17 bp, Homo sapiens
cttggggcccagtgcat

SEQ ID NO: 5013597 - DNA, 16 bp, Homo sapiens
cttggtgccctcgcct

SEQ ID NO: 5013598 - DNA, 19 bp, Homo sapiens
cttggtgccctcgcctcct

SEQ ID NO: 5013599 - DNA, 14 bp, Homo sapiens
cttgtccctccaac

SEQ ID NO: 5013600 - DNA, 22 bp, Homo sapiens
ctttaggagatttattttttgg

SEQ ID NO: 5013601 - DNA, 12 bp, Homo sapiens
ctttcaaagctt

SEQ ID NO: 5013602 - DNA, 22 bp, Homo sapiens
ctttgaagtgcagctcatgttt

SEQ ID NO: 5013603 - DNA, 15 bp, Homo sapiens
ctttgccactgctgt

SEQ ID NO: 5013604 - DNA, 14 bp, Homo sapiens
ctttgttataccat

SEQ ID NO: 5013605 - DNA, 13 bp, Homo sapiens
cttttaatttaaa

SEQ ID NO: 5013606 - DNA, 18 bp, Homo sapiens
cttttatgcaaaaggttt

SEQ ID NO: 5013607 - DNA, 23 bp, Homo sapiens
cttttgatggtggccctgaacct

SEQ ID NO: 5013608 - DNA, 18 bp, Homo sapiens
cttttgcagaagagggtg

SEQ ID NO: 5013609 - DNA, 22 bp, Homo sapiens
gaaaaataaagacacctggttg

SEQ ID NO: 5013610 - DNA, 24 bp, Homo sapiens
gaaaagctagtgtacctcctctca

SEQ ID NO: 5013611 - DNA, 19 bp, Homo sapiens
gaaaccacagtcttcccag

SEQ ID NO: 5013612 - DNA, 17 bp, Homo sapiens
gaaacctagtactgccc

SEQ ID NO: 5013613 - DNA, 18 bp, Homo sapiens
gaaacctagtactgcccc

SEQ ID NO: 5013614 - DNA, 21 bp, Homo sapiens
gaaacgctacctctctgtccc

SEQ ID NO: 5013615 - DNA, 18 bp, Homo sapiens
gaaagagccagactctgt

SEQ ID NO: 5013616 - DNA, 21 bp, Homo sapiens
gaaagtaatttaatttgtaaa

SEQ ID NO: 5013617 - DNA, 22 bp, Homo sapiens
gaaagtaatttaatttgtaaaa

SEQ ID NO: 5013618 - DNA, 13 bp, Homo sapiens
gaaatcttcccag

SEQ ID NO: 5013619 - DNA, 13 bp, Homo sapiens
gaacaaaacttct

SEQ ID NO: 5013620 - DNA, 24 bp, Homo sapiens
gaacatgtcctaattcttctgtcc

SEQ ID NO: 5013621 - DNA, 19 bp, Homo sapiens
gaagacccctgactcatca

SEQ ID NO: 5013622 - DNA, 13 bp, Homo sapiens
gaagccaccctgg

SEQ ID NO: 5013623 - DNA, 14 bp, Homo sapiens
gaagctggcctgag

SEQ ID NO: 5013624 - DNA, 15 bp, Homo sapiens
gaagctggcctgaga

SEQ ID NO: 5013625 - DNA, 19 bp, Homo sapiens
gaagctggcctgagagggg

SEQ ID NO: 5013626 - DNA, 15 bp, Homo sapiens
gaagtgcagctcatg

SEQ ID NO: 5013627 - DNA, 19 bp, Homo sapiens
gaatccccaacatgcactg

SEQ ID NO: 5013628 - DNA, 18 bp, Homo sapiens
gaattcctaacttttcaa

SEQ ID NO: 5013629 - DNA, 19 bp, Homo sapiens
gaattggaaagacttctca

SEQ ID NO: 5013630 - DNA, 22 bp, Homo sapiens
gaatttgaaaaatgcataataa

SEQ ID NO: 5013631 - DNA, 17 bp, Homo sapiens
gacacctgaaccctcca

SEQ ID NO: 5013632 - DNA, 19 bp, Homo sapiens
gacatcacagggtgggcct

SEQ ID NO: 5013633 - DNA, 11 bp, Homo sapiens
gaccagggcct

SEQ ID NO: 5013634 - DNA, 19 bp, Homo sapiens
gaccagggccttttctggc

SEQ ID NO: 5013635 - DNA, 13 bp, Homo sapiens
gacccagtgcaga

SEQ ID NO: 5013636 - DNA, 14 bp, Homo sapiens
gacccagtgcagaa

SEQ ID NO: 5013637 - DNA, 11 bp, Homo sapiens
gaccctggggg

SEQ ID NO: 5013638 - DNA, 13 bp, Homo sapiens
gaccgggccaggc

SEQ ID NO: 5013639 - DNA, 21 bp, Homo sapiens
gacctgtatatttgtaaagct

SEQ ID NO: 5013640 - DNA, 15 bp, Homo sapiens
gacggtttccaggga

SEQ ID NO: 5013641 - DNA, 13 bp, Homo sapiens
gactattacatat

SEQ ID NO: 5013642 - DNA, 17 bp, Homo sapiens
gactccatctctcatcc

SEQ ID NO: 5013643 - DNA, 17 bp, Homo sapiens
gactcccaagtttccat

SEQ ID NO: 5013644 - DNA, 22 bp, Homo sapiens
gactcccaagtttccatagcaa

SEQ ID NO: 5013645 - DNA, 21 bp, Homo sapiens
gactgctacctttcaaagctt

SEQ ID NO: 5013646 - DNA, 15 bp, Homo sapiens
gactggtgctgcagc

SEQ ID NO: 5013647 - DNA, 17 bp, Homo sapiens
gacttcaaagcaagctg

SEQ ID NO: 5013648 - DNA, 22 bp, Homo sapiens
gacttcagggaaggtgaaacag

SEQ ID NO: 5013649 - DNA, 17 bp, Homo sapiens
gacttctcaaagagaat

SEQ ID NO: 5013650 - DNA, 13 bp, Homo sapiens
gactttcctccca

SEQ ID NO: 5013651 - DNA, 22 bp, Homo sapiens
gagaaggtcacaacccttctct

SEQ ID NO: 5013652 - DNA, 23 bp, Homo sapiens
gagaatcacttgaccgggagaca

SEQ ID NO: 5013653 - DNA, 17 bp, Homo sapiens
gagacggtttccaggga

SEQ ID NO: 5013654 - DNA, 19 bp, Homo sapiens
gagacggtttccagggagg

SEQ ID NO: 5013655 - DNA, 15 bp, Homo sapiens
gagactcagtgcaga

SEQ ID NO: 5013656 - DNA, 16 bp, Homo sapiens
gagactcagtgcagat

SEQ ID NO: 5013657 - DNA, 23 bp, Homo sapiens
gagactcagtgcagatggagaga

SEQ ID NO: 5013658 - DNA, 19 bp, Homo sapiens
gagactctagggtccagtg

SEQ ID NO: 5013659 - DNA, 13 bp, Homo sapiens
gagactgtccctg

SEQ ID NO: 5013660 - DNA, 16 bp, Homo sapiens
gagcagcagcttctcc

SEQ ID NO: 5013661 - DNA, 13 bp, Homo sapiens
gagcagggaaggc

SEQ ID NO: 5013662 - DNA, 13 bp, Homo sapiens
gagcctgcaggga

SEQ ID NO: 5013663 - DNA, 16 bp, Homo sapiens
gagcctgcagggaagc

SEQ ID NO: 5013664 - DNA, 13 bp, Homo sapiens
gagctgggcccga

SEQ ID NO: 5013665 - DNA, 19 bp, Homo sapiens
gagctgggcccgacatggc

SEQ ID NO: 5013666 - DNA, 16 bp, Homo sapiens
gagctgtcaccaagga

SEQ ID NO: 5013667 - DNA, 19 bp, Homo sapiens
gagctgtcaccaaggaaac

SEQ ID NO: 5013668 - DNA, 16 bp, Homo sapiens
gaggcaggcatggccc

SEQ ID NO: 5013669 - DNA, 20 bp, Homo sapiens
gaggcaggcatggccctggg

SEQ ID NO: 5013670 - DNA, 20 bp, Homo sapiens
gaggcctgcgaccctggggg

SEQ ID NO: 5013671 - DNA, 14 bp, Homo sapiens
gaggctgcccctct

SEQ ID NO: 5013672 - DNA, 17 bp, Homo sapiens
gagggaggccccagggg

SEQ ID NO: 5013673 - DNA, 13 bp, Homo sapiens
gaggtgattccag

SEQ ID NO: 5013674 - DNA, 21 bp, Homo sapiens
gaggtgattccagtgaagata

SEQ ID NO: 5013675 - DNA, 13 bp, Homo sapiens
gaggtgggagggc

SEQ ID NO: 5013676 - DNA, 13 bp, Homo sapiens
gatactttgaagt

SEQ ID NO: 5013677 - DNA, 22 bp, Homo sapiens
gatactttgaagtgcagctcat

SEQ ID NO: 5013678 - DNA, 13 bp, Homo sapiens
gatagagttccat

SEQ ID NO: 5013679 - DNA, 19 bp, Homo sapiens
gatcatcgccagaggtgct

SEQ ID NO: 5013680 - DNA, 22 bp, Homo sapiens
gatcctgggtactgaaagcctt

SEQ ID NO: 5013681 - DNA, 17 bp, Homo sapiens
gatctcaggcttctgca

SEQ ID NO: 5013682 - DNA, 13 bp, Homo sapiens
gatgaaaaagaat

SEQ ID NO: 5013683 - DNA, 20 bp, Homo sapiens
gattttttactgccctttca

SEQ ID NO: 5013684 - DNA, 14 bp, Homo sapiens
gcaagcagaggacc

SEQ ID NO: 5013685 - DNA, 21 bp, Homo sapiens
gcaagcagaggaccagggcct

SEQ ID NO: 5013686 - DNA, 22 bp, Homo sapiens
gcaagtgtggggggtccttctc

SEQ ID NO: 5013687 - DNA, 22 bp, Homo sapiens
gcacaggaggcaggcatggccc

SEQ ID NO: 5013688 - DNA, 19 bp, Homo sapiens
gcacatccgcgtgtgcctg

SEQ ID NO: 5013689 - DNA, 23 bp, Homo sapiens
gcaccacgggacatcacagggtg

SEQ ID NO: 5013690 - DNA, 16 bp, Homo sapiens
gcaccatccagctccc

SEQ ID NO: 5013691 - DNA, 18 bp, Homo sapiens
gcaccttgtgcctggggt

SEQ ID NO: 5013692 - DNA, 19 bp, Homo sapiens
gcaccttgtgcctggggtg

SEQ ID NO: 5013693 - DNA, 14 bp, Homo sapiens
gcagaagagggtgt

SEQ ID NO: 5013694 - DNA, 16 bp, Homo sapiens
gcagaagagggtgtgt

SEQ ID NO: 5013695 - DNA, 22 bp, Homo sapiens
gcagaatgtaagtgggcccacc

SEQ ID NO: 5013696 - DNA, 15 bp, Homo sapiens
gcagaggtaccctgg

SEQ ID NO: 5013697 - DNA, 13 bp, Homo sapiens
gcagctcatgttt

SEQ ID NO: 5013698 - DNA, 13 bp, Homo sapiens
gcagctgcctagg

SEQ ID NO: 5013699 - DNA, 22 bp, Homo sapiens
gcagctgtcccttgcttgcctg

SEQ ID NO: 5013700 - DNA, 15 bp, Homo sapiens
gcaggcatggccctg

SEQ ID NO: 5013701 - DNA, 22 bp, Homo sapiens
gcagggccatggctcagggtgg

SEQ ID NO: 5013702 - DNA, 21 bp, Homo sapiens
gcagggtctgtttggactgca

SEQ ID NO: 5013703 - DNA, 23 bp, Homo sapiens
gcatatttatccaaaatgtgtat

SEQ ID NO: 5013704 - DNA, 17 bp, Homo sapiens
gcatcttgcctccaggt

SEQ ID NO: 5013705 - DNA, 19 bp, Homo sapiens
gcatcttgcctccaggtgc

SEQ ID NO: 5013706 - DNA, 15 bp, Homo sapiens
gcatgaatgttttta

SEQ ID NO: 5013707 - DNA, 15 bp, Homo sapiens
gcatggtggccagag

SEQ ID NO: 5013708 - DNA, 20 bp, Homo sapiens
gccaaggaggtgaggagcag

SEQ ID NO: 5013709 - DNA, 21 bp, Homo sapiens
gccaagtccgcagaagccctg

SEQ ID NO: 5013710 - DNA, 15 bp, Homo sapiens
gccagactctgtctc

SEQ ID NO: 5013711 - DNA, 22 bp, Homo sapiens
gccaggaacctgtcctaaggaa

SEQ ID NO: 5013712 - DNA, 23 bp, Homo sapiens
gccaggagctgtcaccaaggaaa

SEQ ID NO: 5013713 - DNA, 15 bp, Homo sapiens
gccagggggatgcca

SEQ ID NO: 5013714 - DNA, 15 bp, Homo sapiens
gccatgccaggaacc

SEQ ID NO: 5013715 - DNA, 18 bp, Homo sapiens
gccatgccaggaacctgt

SEQ ID NO: 5013716 - DNA, 17 bp, Homo sapiens
gccatggctcagggtgg

SEQ ID NO: 5013717 - DNA, 23 bp, Homo sapiens
gccatggctcagggtggtctctt

SEQ ID NO: 5013718 - DNA, 20 bp, Homo sapiens
gcccaatgagactctagggt

SEQ ID NO: 5013719 - DNA, 17 bp, Homo sapiens
gcccaccctgctgctgg

SEQ ID NO: 5013720 - DNA, 18 bp, Homo sapiens
gcccaccctgctgctggt

SEQ ID NO: 5013721 - DNA, 14 bp, Homo sapiens
gcccacctgctccc

SEQ ID NO: 5013722 - DNA, 16 bp, Homo sapiens
gcccacctgctcccag

SEQ ID NO: 5013723 - DNA, 12 bp, Homo sapiens
gcccagtgcatg

SEQ ID NO: 5013724 - DNA, 20 bp, Homo sapiens
gccccaggcctgtggctccc

SEQ ID NO: 5013725 - DNA, 21 bp, Homo sapiens
gcccctcccacacccaaagct

SEQ ID NO: 5013726 - DNA, 23 bp, Homo sapiens
gcccctcccacacccaaagctga

SEQ ID NO: 5013727 - DNA, 15 bp, Homo sapiens
gcccctctcaccaaa

SEQ ID NO: 5013728 - DNA, 12 bp, Homo sapiens
gcccctggcact

SEQ ID NO: 5013729 - DNA, 17 bp, Homo sapiens
gcccctggcactcttgt

SEQ ID NO: 5013730 - DNA, 22 bp, Homo sapiens
gcccgacatggctccggcctct

SEQ ID NO: 5013731 - DNA, 22 bp, Homo sapiens
gccctccgaccacttccagggg

SEQ ID NO: 5013732 - DNA, 9 bp, Homo sapiens
gccctcctc

SEQ ID NO: 5013733 - DNA, 14 bp, Homo sapiens
gccctcgcctcctc

SEQ ID NO: 5013734 - DNA, 14 bp, Homo sapiens
gccctctcctccct

SEQ ID NO: 5013735 - DNA, 16 bp, Homo sapiens
gccctctcctccctct

SEQ ID NO: 5013736 - DNA, 22 bp, Homo sapiens
gccctgatgtgtcctcagggag

SEQ ID NO: 5013737 - DNA, 15 bp, Homo sapiens
gccctgtgtgcaggt

SEQ ID NO: 5013738 - DNA, 18 bp, Homo sapiens
gccggccctgtgtgcagg

SEQ ID NO: 5013739 - DNA, 16 bp, Homo sapiens
gcctccccacctccag

SEQ ID NO: 5013740 - DNA, 20 bp, Homo sapiens
gcctcctcctcctgccctcc

SEQ ID NO: 5013741 - DNA, 20 bp, Homo sapiens
gcctcgttggaagaggaaca

SEQ ID NO: 5013742 - DNA, 19 bp, Homo sapiens
gcctgacttctgctggcat

SEQ ID NO: 5013743 - DNA, 16 bp, Homo sapiens
gcctgagaggggaagc

SEQ ID NO: 5013744 - DNA, 15 bp, Homo sapiens
gccttagggaagctg

SEQ ID NO: 5013745 - DNA, 22 bp, Homo sapiens
gccttagggaagctggcctgag

SEQ ID NO: 5013746 - DNA, 16 bp, Homo sapiens
gccttttctggcaccg

SEQ ID NO: 5013747 - DNA, 23 bp, Homo sapiens
gcgaccctgggggcacaggaggc

SEQ ID NO: 5013748 - DNA, 12 bp, Homo sapiens
gcgcagctgcct

SEQ ID NO: 5013749 - DNA, 18 bp, Homo sapiens
gcggcccgcgcagctgcc

SEQ ID NO: 5013750 - DNA, 15 bp, Homo sapiens
gcgtgatggcaggtg

SEQ ID NO: 5013751 - DNA, 22 bp, Homo sapiens
gcgtgcgcatcttgcctccagg

SEQ ID NO: 5013752 - DNA, 23 bp, Homo sapiens
gcgtgcgcatcttgcctccaggt

SEQ ID NO: 5013753 - DNA, 16 bp, Homo sapiens
gcgtgtgcctgtgtgc

SEQ ID NO: 5013754 - DNA, 16 bp, Homo sapiens
gctacctctctgtccc

SEQ ID NO: 5013755 - DNA, 21 bp, Homo sapiens
gctacctctctgtcccttgct

SEQ ID NO: 5013756 - DNA, 18 bp, Homo sapiens
gctatttatgggcccctg

SEQ ID NO: 5013757 - DNA, 19 bp, Homo sapiens
gctatttatgggcccctgg

SEQ ID NO: 5013758 - DNA, 17 bp, Homo sapiens
gctcatgtttttaactt

SEQ ID NO: 5013759 - DNA, 15 bp, Homo sapiens
gctccaggcacccag

SEQ ID NO: 5013760 - DNA, 17 bp, Homo sapiens
gctcccaggccccaggc

SEQ ID NO: 5013761 - DNA, 19 bp, Homo sapiens
gctcccaggccccaggcct

SEQ ID NO: 5013762 - DNA, 17 bp, Homo sapiens
gctccccagcccacctg

SEQ ID NO: 5013763 - DNA, 19 bp, Homo sapiens
gctccccagcccacctgct

SEQ ID NO: 5013764 - DNA, 20 bp, Homo sapiens
gctccccagcccacctgctc

SEQ ID NO: 5013765 - DNA, 22 bp, Homo sapiens
gctccccagcccacctgctccc

SEQ ID NO: 5013766 - DNA, 23 bp, Homo sapiens
gctccccagcccacctgctccca

SEQ ID NO: 5013767 - DNA, 14 bp, Homo sapiens
gctccgtagctctg

SEQ ID NO: 5013768 - DNA, 16 bp, Homo sapiens
gctccgtagctctgct

SEQ ID NO: 5013769 - DNA, 18 bp, Homo sapiens
gctccgtagctctgctgc

SEQ ID NO: 5013770 - DNA, 14 bp, Homo sapiens
gctctgctgctgat

SEQ ID NO: 5013771 - DNA, 16 bp, Homo sapiens
gctctgggtgctgccc

SEQ ID NO: 5013772 - DNA, 15 bp, Homo sapiens
gctcttcccactttt

SEQ ID NO: 5013773 - DNA, 15 bp, Homo sapiens
gctgagcctgcaggg

SEQ ID NO: 5013774 - DNA, 19 bp, Homo sapiens
gctgagggtgtttcttcct

SEQ ID NO: 5013775 - DNA, 20 bp, Homo sapiens
gctgatcatcgccagaggtg

SEQ ID NO: 5013776 - DNA, 16 bp, Homo sapiens
gctgcagcaccgaggg

SEQ ID NO: 5013777 - DNA, 23 bp, Homo sapiens
gctgcagcaccgaggggcctttg

SEQ ID NO: 5013778 - DNA, 16 bp, Homo sapiens
gctgcccctctcacca

SEQ ID NO: 5013779 - DNA, 18 bp, Homo sapiens
gctgcccctctcaccaaa

SEQ ID NO: 5013780 - DNA, 22 bp, Homo sapiens
gctgcctaggatgttctgggct

SEQ ID NO: 5013781 - DNA, 23 bp, Homo sapiens
gctgctggtcagtcgtggagcgc

SEQ ID NO: 5013782 - DNA, 22 bp, Homo sapiens
gctgctgtgcaacggtctcctg

SEQ ID NO: 5013783 - DNA, 17 bp, Homo sapiens
gctgggccatgtccaaa

SEQ ID NO: 5013784 - DNA, 16 bp, Homo sapiens
gctggggatgcgcctg

SEQ ID NO: 5013785 - DNA, 12 bp, Homo sapiens
gctggtgcacag

SEQ ID NO: 5013786 - DNA, 20 bp, Homo sapiens
gctgtatttttatttttgca

SEQ ID NO: 5013787 - DNA, 18 bp, Homo sapiens
gctgtgtgtcccaggcag

SEQ ID NO: 5013788 - DNA, 21 bp, Homo sapiens
gcttatctcttttatatttgt

SEQ ID NO: 5013789 - DNA, 12 bp, Homo sapiens
gcttctccagga

SEQ ID NO: 5013790 - DNA, 19 bp, Homo sapiens
gcttgaaaagctagtgtac

SEQ ID NO: 5013791 - DNA, 15 bp, Homo sapiens
gcttgcctgcagggc

SEQ ID NO: 5013792 - DNA, 22 bp, Homo sapiens
gcttgcctgcagggccatggct

SEQ ID NO: 5013793 - DNA, 12 bp, Homo sapiens
gcttggtgtgac

SEQ ID NO: 5013794 - DNA, 22 bp, Homo sapiens
gctttcccacttcccaccctgc

SEQ ID NO: 5013795 - DNA, 21 bp, Homo sapiens
ggaacagcactggggagtctt

SEQ ID NO: 5013796 - DNA, 11 bp, Homo sapiens
ggaacctgcca

SEQ ID NO: 5013797 - DNA, 13 bp, Homo sapiens
ggaacctgccatg

SEQ ID NO: 5013798 - DNA, 22 bp, Homo sapiens
ggactccatctctcatcctcca

SEQ ID NO: 5013799 - DNA, 20 bp, Homo sapiens
ggagacagaggttgcagtga

SEQ ID NO: 5013800 - DNA, 19 bp, Homo sapiens
ggagacggtttccagggag

SEQ ID NO: 5013801 - DNA, 21 bp, Homo sapiens
ggagcagggaaggcctgactt

SEQ ID NO: 5013802 - DNA, 12 bp, Homo sapiens
ggagctgggccc

SEQ ID NO: 5013803 - DNA, 19 bp, Homo sapiens
ggagctgtcaccaaggaaa

SEQ ID NO: 5013804 - DNA, 14 bp, Homo sapiens
ggaggcaggcatgg

SEQ ID NO: 5013805 - DNA, 14 bp, Homo sapiens
ggaggccccagggg

SEQ ID NO: 5013806 - DNA, 22 bp, Homo sapiens
ggaggccgaggtgggcagatca

SEQ ID NO: 5013807 - DNA, 21 bp, Homo sapiens
ggaggtccctggtcggagagg

SEQ ID NO: 5013808 - DNA, 18 bp, Homo sapiens
ggagtcagccaggagctg

SEQ ID NO: 5013809 - DNA, 19 bp, Homo sapiens
ggagtcagccaggagctgt

SEQ ID NO: 5013810 - DNA, 22 bp, Homo sapiens
ggatgaaagagccagactctgt

SEQ ID NO: 5013811 - DNA, 19 bp, Homo sapiens
ggatgccactcctccctcc

SEQ ID NO: 5013812 - DNA, 20 bp, Homo sapiens
ggcacaggaggcaggcatgg

SEQ ID NO: 5013813 - DNA, 17 bp, Homo sapiens
ggcaccatccagctccc

SEQ ID NO: 5013814 - DNA, 16 bp, Homo sapiens
ggcaggcatggccctg

SEQ ID NO: 5013815 - DNA, 18 bp, Homo sapiens
ggcaggcatggccctggg

SEQ ID NO: 5013816 - DNA, 13 bp, Homo sapiens
ggcaggctgggcc

SEQ ID NO: 5013817 - DNA, 14 bp, Homo sapiens
ggcaggctgggcca

SEQ ID NO: 5013818 - DNA, 16 bp, Homo sapiens
ggcaggctgggccatg

SEQ ID NO: 5013819 - DNA, 22 bp, Homo sapiens
ggcaggctgggccatgtccaaa

SEQ ID NO: 5013820 - DNA, 21 bp, Homo sapiens
ggcatcaagaggtgggagggc

SEQ ID NO: 5013821 - DNA, 15 bp, Homo sapiens
ggcccgcgcagctgc

SEQ ID NO: 5013822 - DNA, 14 bp, Homo sapiens
ggccctgtgtgcag

SEQ ID NO: 5013823 - DNA, 15 bp, Homo sapiens
ggccctgtgtgcagg

SEQ ID NO: 5013824 - DNA, 14 bp, Homo sapiens
ggccggccctgtgt

SEQ ID NO: 5013825 - DNA, 18 bp, Homo sapiens
ggcctgagaggggaagcg

SEQ ID NO: 5013826 - DNA, 16 bp, Homo sapiens
ggcctgcgaccctggg

SEQ ID NO: 5013827 - DNA, 21 bp, Homo sapiens
ggcctgggtgatctgctgctg

SEQ ID NO: 5013828 - DNA, 17 bp, Homo sapiens
ggcctttgttctggggg

SEQ ID NO: 5013829 - DNA, 16 bp, Homo sapiens
ggccttttctggcacc

SEQ ID NO: 5013830 - DNA, 21 bp, Homo sapiens
ggctgggccatgtccaaagag

SEQ ID NO: 5013831 - DNA, 15 bp, Homo sapiens
gggaaggcctgactt

SEQ ID NO: 5013832 - DNA, 21 bp, Homo sapiens
gggacagacaaggtgcctgtt

SEQ ID NO: 5013833 - DNA, 15 bp, Homo sapiens
gggacccagtgcaga

SEQ ID NO: 5013834 - DNA, 23 bp, Homo sapiens
gggacccccgtggggcagggagc

SEQ ID NO: 5013835 - DNA, 20 bp, Homo sapiens
gggagacggtttccagggag

SEQ ID NO: 5013836 - DNA, 20 bp, Homo sapiens
gggatgccactcctccctcc

SEQ ID NO: 5013837 - DNA, 13 bp, Homo sapiens
gggcacaggaggc

SEQ ID NO: 5013838 - DNA, 13 bp, Homo sapiens
gggcaggctgggc

SEQ ID NO: 5013839 - DNA, 22 bp, Homo sapiens
gggccactggtccccaacaatg

SEQ ID NO: 5013840 - DNA, 13 bp, Homo sapiens
gggccaggcctgg

SEQ ID NO: 5013841 - DNA, 15 bp, Homo sapiens
gggccatggctcagg

SEQ ID NO: 5013842 - DNA, 22 bp, Homo sapiens
gggccatgtccaaagaggctgc

SEQ ID NO: 5013843 - DNA, 13 bp, Homo sapiens
gggcccagtgcat

SEQ ID NO: 5013844 - DNA, 11 bp, Homo sapiens
gggcccctggc

SEQ ID NO: 5013845 - DNA, 14 bp, Homo sapiens
gggccctgagtctg

SEQ ID NO: 5013846 - DNA, 19 bp, Homo sapiens
gggccggccctgtgtgcag

SEQ ID NO: 5013847 - DNA, 20 bp, Homo sapiens
gggcctttgttctgggggga

SEQ ID NO: 5013848 - DNA, 15 bp, Homo sapiens
gggcgtggagggagg

SEQ ID NO: 5013849 - DNA, 16 bp, Homo sapiens
gggctggggatgcgcc

SEQ ID NO: 5013850 - DNA, 13 bp, Homo sapiens
ggggcaggctggg

SEQ ID NO: 5013851 - DNA, 13 bp, Homo sapiens
ggggcagggagct

SEQ ID NO: 5013852 - DNA, 21 bp, Homo sapiens
gggggatgccactcctccctc

SEQ ID NO: 5013853 - DNA, 22 bp, Homo sapiens
gggggatgccactcctccctcc

SEQ ID NO: 5013854 - DNA, 22 bp, Homo sapiens
ggggtccctagcagcccaccct

SEQ ID NO: 5013855 - DNA, 11 bp, Homo sapiens
gggtgggcctc

SEQ ID NO: 5013856 - DNA, 13 bp, Homo sapiens
gggtgggcctcgg

SEQ ID NO: 5013857 - DNA, 19 bp, Homo sapiens
gggtgtccccgctgctgtg

SEQ ID NO: 5013858 - DNA, 11 bp, Homo sapiens
ggtaccctggg

SEQ ID NO: 5013859 - DNA, 16 bp, Homo sapiens
ggtctgccttctgctg

SEQ ID NO: 5013860 - DNA, 22 bp, Homo sapiens
ggtgcctgtaatcctagctact

SEQ ID NO: 5013861 - DNA, 20 bp, Homo sapiens
ggtgggacccccgtggggca

SEQ ID NO: 5013862 - DNA, 19 bp, Homo sapiens
ggttcgttctgtactgtta

SEQ ID NO: 5013863 - DNA, 11 bp, Homo sapiens
gtaaaacttct

SEQ ID NO: 5013864 - DNA, 12 bp, Homo sapiens
gtaaaacttctg

SEQ ID NO: 5013865 - DNA, 14 bp, Homo sapiens
gtaaatacaggtag

SEQ ID NO: 5013866 - DNA, 17 bp, Homo sapiens
gtaagaattcagaagac

SEQ ID NO: 5013867 - DNA, 17 bp, Homo sapiens
gtaagtgggcccacccg

SEQ ID NO: 5013868 - DNA, 15 bp, Homo sapiens
gtacaacggaggcct

SEQ ID NO: 5013869 - DNA, 13 bp, Homo sapiens
gtacaccctttcc

SEQ ID NO: 5013870 - DNA, 14 bp, Homo sapiens
gtacatttctataa

SEQ ID NO: 5013871 - DNA, 14 bp, Homo sapiens
gtactgaaagcctt

SEQ ID NO: 5013872 - DNA, 22 bp, Homo sapiens
gtactgaaagccttagggaagc

SEQ ID NO: 5013873 - DNA, 23 bp, Homo sapiens
gtacttgaagtctaaaagcagaa

SEQ ID NO: 5013874 - DNA, 17 bp, Homo sapiens
gtagcccatccttccct

SEQ ID NO: 5013875 - DNA, 20 bp, Homo sapiens
gtatatactttgccactgct

SEQ ID NO: 5013876 - DNA, 18 bp, Homo sapiens
gtatatatacatatatat

SEQ ID NO: 5013877 - DNA, 17 bp, Homo sapiens
gtatatttgtaaagcta

SEQ ID NO: 5013878 - DNA, 14 bp, Homo sapiens
gtatatttgtttta

SEQ ID NO: 5013879 - DNA, 17 bp, Homo sapiens
gtatttttatttttgca

SEQ ID NO: 5013880 - DNA, 19 bp, Homo sapiens
gtatttttatttttgcaca

SEQ ID NO: 5013881 - DNA, 18 bp, Homo sapiens
gtcacaacccttctctgt

SEQ ID NO: 5013882 - DNA, 14 bp, Homo sapiens
gtcaccaaggaaac

SEQ ID NO: 5013883 - DNA, 15 bp, Homo sapiens
gtcagccaggagctg

SEQ ID NO: 5013884 - DNA, 20 bp, Homo sapiens
gtcagccaggagctgtcacc

SEQ ID NO: 5013885 - DNA, 16 bp, Homo sapiens
gtccaaagaggctgcc

SEQ ID NO: 5013886 - DNA, 19 bp, Homo sapiens
gtccaaagaggctgcccct

SEQ ID NO: 5013887 - DNA, 16 bp, Homo sapiens
gtccccgctgctgtgc

SEQ ID NO: 5013888 - DNA, 16 bp, Homo sapiens
gtcccttgctgtatgc

SEQ ID NO: 5013889 - DNA, 15 bp, Homo sapiens
gtcctaaggaacctt

SEQ ID NO: 5013890 - DNA, 13 bp, Homo sapiens
gtctcacccatgc

SEQ ID NO: 5013891 - DNA, 20 bp, Homo sapiens
gtctcattccgttgtctgtg

SEQ ID NO: 5013892 - DNA, 15 bp, Homo sapiens
gtctgccttctgctg

SEQ ID NO: 5013893 - DNA, 23 bp, Homo sapiens
gtctgccttctgctgaaagactc

SEQ ID NO: 5013894 - DNA, 13 bp, Homo sapiens
gtctgtttggact

SEQ ID NO: 5013895 - DNA, 22 bp, Homo sapiens
gtcttaccagtgacgctgctga

SEQ ID NO: 5013896 - DNA, 18 bp, Homo sapiens
gtcttataagtaaagaca

SEQ ID NO: 5013897 - DNA, 21 bp, Homo sapiens
gtgaaacagggcttgtccctc

SEQ ID NO: 5013898 - DNA, 13 bp, Homo sapiens
gtgaggggtccct

SEQ ID NO: 5013899 - DNA, 13 bp, Homo sapiens
gtgagtgcctttt

SEQ ID NO: 5013900 - DNA, 13 bp, Homo sapiens
gtgcacagccact

SEQ ID NO: 5013901 - DNA, 15 bp, Homo sapiens
gtgcagtactttgtg

SEQ ID NO: 5013902 - DNA, 15 bp, Homo sapiens
gtgcatggtggccag

SEQ ID NO: 5013903 - DNA, 24 bp, Homo sapiens
gtgcgcatcttgcctccaggtgca

SEQ ID NO: 5013904 - DNA, 19 bp, Homo sapiens
gtgctccgtagctctgctg

SEQ ID NO: 5013905 - DNA, 21 bp, Homo sapiens
gtgctccgtagctctgctgct

SEQ ID NO: 5013906 - DNA, 22 bp, Homo sapiens
gtgctccgtagctctgctgctg

SEQ ID NO: 5013907 - DNA, 19 bp, Homo sapiens
gtggccagaggtgtcaccc

SEQ ID NO: 5013908 - DNA, 12 bp, Homo sapiens
gtgggcccaccc

SEQ ID NO: 5013909 - DNA, 13 bp, Homo sapiens
gtggggacttctg

SEQ ID NO: 5013910 - DNA, 13 bp, Homo sapiens
gtggggggtcctt

SEQ ID NO: 5013911 - DNA, 14 bp, Homo sapiens
gtgtcccaggcagg

SEQ ID NO: 5013912 - DNA, 21 bp, Homo sapiens
gtgtccccgctgctgtgcaac

SEQ ID NO: 5013913 - DNA, 20 bp, Homo sapiens
gtgtcccttcccagcgctgc

SEQ ID NO: 5013914 - DNA, 23 bp, Homo sapiens
gtgtgcacatccgcgtgtgcctg

SEQ ID NO: 5013915 - DNA, 14 bp, Homo sapiens
gtgtgtgtgtgcac

SEQ ID NO: 5013916 - DNA, 17 bp, Homo sapiens
gtgttgttgctctagga

SEQ ID NO: 5013917 - DNA, 22 bp, Homo sapiens
gttacagagacctatgtaagaa

SEQ ID NO: 5013918 - DNA, 16 bp, Homo sapiens
gttatatcatatgtat

SEQ ID NO: 5013919 - DNA, 16 bp, Homo sapiens
gttccagtgtctgtct

SEQ ID NO: 5013920 - DNA, 21 bp, Homo sapiens
gttcccagatggctggaaggg

SEQ ID NO: 5013921 - DNA, 16 bp, Homo sapiens
gttccctgctgcgctg

SEQ ID NO: 5013922 - DNA, 22 bp, Homo sapiens
gttccctgctgcgctgcttggt

SEQ ID NO: 5013923 - DNA, 16 bp, Homo sapiens
gttctggggggaccca

SEQ ID NO: 5013924 - DNA, 17 bp, Homo sapiens
gttgaaaatgcaactct

SEQ ID NO: 5013925 - DNA, 22 bp, Homo sapiens
gttggaggtgattccagtgaag

SEQ ID NO: 5013926 - DNA, 13 bp, Homo sapiens
gttggtctgcctt

SEQ ID NO: 5013927 - DNA, 16 bp, Homo sapiens
gttggtctgccttctg

SEQ ID NO: 5013928 - DNA, 17 bp, Homo sapiens
gttgtaatatttcttca

SEQ ID NO: 5013929 - DNA, 17 bp, Homo sapiens
gttgtcacaccctgact

SEQ ID NO: 5013930 - DNA, 12 bp, Homo sapiens
gttgttttccat

SEQ ID NO: 5013931 - DNA, 23 bp, Homo sapiens
gtttctctgccgctacctccctc

SEQ ID NO: 5013932 - DNA, 21 bp, Homo sapiens
gttttaaaactggacctgtat

SEQ ID NO: 5013933 - DNA, 18 bp, Homo sapiens
gttttatagcctggactg

SEQ ID NO: 5013934 - DNA, 22 bp, Homo sapiens
gttttccatgatttagcaagca

SEQ ID NO: 5013935 - DNA, 20 bp, Homo sapiens
gttttgtttggcaaggaaag

SEQ ID NO: 5013936 - DNA, 18 bp, Homo sapiens
taaaactggacctgtata

SEQ ID NO: 5013937 - DNA, 15 bp, Homo sapiens
taaaacttctgctcg

SEQ ID NO: 5013938 - DNA, 16 bp, Homo sapiens
taaaacttctgctcgt

SEQ ID NO: 5013939 - DNA, 22 bp, Homo sapiens
taaaggctgaggctgcatctgc

SEQ ID NO: 5013940 - DNA, 22 bp, Homo sapiens
taacacttcttacgcaatgctt

SEQ ID NO: 5013941 - DNA, 19 bp, Homo sapiens
taaccgcacatgcacacac

SEQ ID NO: 5013942 - DNA, 14 bp, Homo sapiens
taacgcaggagaat

SEQ ID NO: 5013943 - DNA, 13 bp, Homo sapiens
taactctgagagc

SEQ ID NO: 5013944 - DNA, 16 bp, Homo sapiens
taacttttaatttaaa

SEQ ID NO: 5013945 - DNA, 22 bp, Homo sapiens
taagaaagtaatttaatttgta

SEQ ID NO: 5013946 - DNA, 20 bp, Homo sapiens
taagaattgaattggaaaga

SEQ ID NO: 5013947 - DNA, 15 bp, Homo sapiens
taaggaaccttcctt

SEQ ID NO: 5013948 - DNA, 19 bp, Homo sapiens
taaggaaccttccttcctg

SEQ ID NO: 5013949 - DNA, 18 bp, Homo sapiens
taagtgggcccacccggt

SEQ ID NO: 5013950 - DNA, 21 bp, Homo sapiens
taatactggtatttttactta

SEQ ID NO: 5013951 - DNA, 22 bp, Homo sapiens
taatttaatttgtaaaacttct

SEQ ID NO: 5013952 - DNA, 17 bp, Homo sapiens
taatttgtaaaacttct

SEQ ID NO: 5013953 - DNA, 19 bp, Homo sapiens
taatttgtaaaacttctgc

SEQ ID NO: 5013954 - DNA, 12 bp, Homo sapiens
tacaccctttcc

SEQ ID NO: 5013955 - DNA, 12 bp, Homo sapiens
tacctccctccc

SEQ ID NO: 5013956 - DNA, 14 bp, Homo sapiens
tacctcctctcagt

SEQ ID NO: 5013957 - DNA, 19 bp, Homo sapiens
tacctcctctcagtgtttt

SEQ ID NO: 5013958 - DNA, 12 bp, Homo sapiens
tacctctctgtc

SEQ ID NO: 5013959 - DNA, 18 bp, Homo sapiens
tacctctctgtcccttgc

SEQ ID NO: 5013960 - DNA, 15 bp, Homo sapiens
tacctttcaaagctt

SEQ ID NO: 5013961 - DNA, 21 bp, Homo sapiens
tactgccctttcaaagcactt

SEQ ID NO: 5013962 - DNA, 18 bp, Homo sapiens
tactgggccctgagtctg

SEQ ID NO: 5013963 - DNA, 14 bp, Homo sapiens
tactgggtctgcga

SEQ ID NO: 5013964 - DNA, 23 bp, Homo sapiens
tacttgaagtctaaaagcagaaa

SEQ ID NO: 5013965 - DNA, 22 bp, Homo sapiens
tactttgaagtgcagctcatgt

SEQ ID NO: 5013966 - DNA, 13 bp, Homo sapiens
tactttgccactg

SEQ ID NO: 5013967 - DNA, 12 bp, Homo sapiens
tagcaacaggaa

SEQ ID NO: 5013968 - DNA, 13 bp, Homo sapiens
tagcaagcaacta

SEQ ID NO: 5013969 - DNA, 14 bp, Homo sapiens
tagcagcccaccct

SEQ ID NO: 5013970 - DNA, 16 bp, Homo sapiens
tagcagcccaccctgc

SEQ ID NO: 5013971 - DNA, 17 bp, Homo sapiens
tagcagcccaccctgct

SEQ ID NO: 5013972 - DNA, 16 bp, Homo sapiens
tagcctcaattctcca

SEQ ID NO: 5013973 - DNA, 11 bp, Homo sapiens
tagctctgctg

SEQ ID NO: 5013974 - DNA, 12 bp, Homo sapiens
tagctctgctgc

SEQ ID NO: 5013975 - DNA, 13 bp, Homo sapiens
tagctctgctgct

SEQ ID NO: 5013976 - DNA, 15 bp, Homo sapiens
tagctctgctgctga

SEQ ID NO: 5013977 - DNA, 19 bp, Homo sapiens
tagggaagctggcctgaga

SEQ ID NO: 5013978 - DNA, 21 bp, Homo sapiens
tagtgtacctcctctcagtgt

SEQ ID NO: 5013979 - DNA, 19 bp, Homo sapiens
tataacatatatggaagag

SEQ ID NO: 5013980 - DNA, 12 bp, Homo sapiens
tataataaaggc

SEQ ID NO: 5013981 - DNA, 14 bp, Homo sapiens
tataccatttcctc

SEQ ID NO: 5013982 - DNA, 17 bp, Homo sapiens
tatactttgccactgct

SEQ ID NO: 5013983 - DNA, 18 bp, Homo sapiens
tatactttgccactgctg

SEQ ID NO: 5013984 - DNA, 16 bp, Homo sapiens
tatatactttgccact

SEQ ID NO: 5013985 - DNA, 14 bp, Homo sapiens
tatatatacatata

SEQ ID NO: 5013986 - DNA, 14 bp, Homo sapiens
tatatcatatgtat

SEQ ID NO: 5013987 - DNA, 15 bp, Homo sapiens
tatatggtatatata

SEQ ID NO: 5013988 - DNA, 22 bp, Homo sapiens
tatatggtatatatacatatat

SEQ ID NO: 5013989 - DNA, 13 bp, Homo sapiens
tatatttgtagga

SEQ ID NO: 5013990 - DNA, 23 bp, Homo sapiens
tatccaaaatgtgtatttcttat

SEQ ID NO: 5013991 - DNA, 21 bp, Homo sapiens
tatctcttttatatttgtagg

SEQ ID NO: 5013992 - DNA, 14 bp, Homo sapiens
tatgatcagtgttg

SEQ ID NO: 5013993 - DNA, 19 bp, Homo sapiens
tatgatttataaacagaca

SEQ ID NO: 5013994 - DNA, 20 bp, Homo sapiens
tatgatttataaacagacaa

SEQ ID NO: 5013995 - DNA, 14 bp, Homo sapiens
tatgcattatatca

SEQ ID NO: 5013996 - DNA, 15 bp, Homo sapiens
tatgggcccctggca

SEQ ID NO: 5013997 - DNA, 22 bp, Homo sapiens
tatggttacgttggttaaataa

SEQ ID NO: 5013998 - DNA, 22 bp, Homo sapiens
tatgttgtaatatttcttcaaa

SEQ ID NO: 5013999 - DNA, 20 bp, Homo sapiens
tattataaattgtgtattta

SEQ ID NO: 5014000 - DNA, 20 bp, Homo sapiens
tattcctctcaccccactcc

SEQ ID NO: 5014001 - DNA, 14 bp, Homo sapiens
tattcttgcactga

SEQ ID NO: 5014002 - DNA, 16 bp, Homo sapiens
tatttaaaaaaaagaa

SEQ ID NO: 5014003 - DNA, 22 bp, Homo sapiens
tatttaaaaaaaagaaactttt

SEQ ID NO: 5014004 - DNA, 20 bp, Homo sapiens
tatttatccaaaatgtgtat

SEQ ID NO: 5014005 - DNA, 22 bp, Homo sapiens
tatttatgggcccctggcactc

SEQ ID NO: 5014006 - DNA, 18 bp, Homo sapiens
tatttgaggtcagtgttt

SEQ ID NO: 5014007 - DNA, 15 bp, Homo sapiens
tatttgtaggagaaa

SEQ ID NO: 5014008 - DNA, 17 bp, Homo sapiens
tatttgttttatgctac

SEQ ID NO: 5014009 - DNA, 16 bp, Homo sapiens
tattttcatacaaatt

SEQ ID NO: 5014010 - DNA, 17 bp, Homo sapiens
tatttttgcacaacttt

SEQ ID NO: 5014011 - DNA, 21 bp, Homo sapiens
tattttttggacttcaaagca

SEQ ID NO: 5014012 - DNA, 23 bp, Homo sapiens
tcaaataaaactagtgacagctt

SEQ ID NO: 5014013 - DNA, 16 bp, Homo sapiens
tcaacaacatccactg

SEQ ID NO: 5014014 - DNA, 19 bp, Homo sapiens
tcaagaggtgggagggccc

SEQ ID NO: 5014015 - DNA, 19 bp, Homo sapiens
tcacaacccttctctgttg

SEQ ID NO: 5014016 - DNA, 16 bp, Homo sapiens
tcacaccctgacttca

SEQ ID NO: 5014017 - DNA, 19 bp, Homo sapiens
tcacagggtgggcctcggc

SEQ ID NO: 5014018 - DNA, 21 bp, Homo sapiens
tcacccatgcaagcagaggac

SEQ ID NO: 5014019 - DNA, 15 bp, Homo sapiens
tcaccccactcctgt

SEQ ID NO: 5014020 - DNA, 15 bp, Homo sapiens
tcacccctgtttctg

SEQ ID NO: 5014021 - DNA, 15 bp, Homo sapiens
tcaccttccaacact

SEQ ID NO: 5014022 - DNA, 13 bp, Homo sapiens
tcactcttttgat

SEQ ID NO: 5014023 - DNA, 16 bp, Homo sapiens
tcagaacaaaacttct

SEQ ID NO: 5014024 - DNA, 18 bp, Homo sapiens
tcagccaggagctgtcac

SEQ ID NO: 5014025 - DNA, 19 bp, Homo sapiens
tcagccaggagctgtcacc

SEQ ID NO: 5014026 - DNA, 17 bp, Homo sapiens
tcagggaaggtgaaaca

SEQ ID NO: 5014027 - DNA, 23 bp, Homo sapiens
tcagggtggtctcttcttggggc

SEQ ID NO: 5014028 - DNA, 13 bp, Homo sapiens
tcagtatccaggc

SEQ ID NO: 5014029 - DNA, 17 bp, Homo sapiens
tcagtatccaggctttg

SEQ ID NO: 5014030 - DNA, 15 bp, Homo sapiens
tcagtgttttggact

SEQ ID NO: 5014031 - DNA, 16 bp, Homo sapiens
tcagtgttttggactc

SEQ ID NO: 5014032 - DNA, 14 bp, Homo sapiens
tcatcattccctct

SEQ ID NO: 5014033 - DNA, 21 bp, Homo sapiens
tcatcctccagtaccttgctt

SEQ ID NO: 5014034 - DNA, 15 bp, Homo sapiens
tcatcgccagaggtg

SEQ ID NO: 5014035 - DNA, 17 bp, Homo sapiens
tcattccctctcatctc

SEQ ID NO: 5014036 - DNA, 17 bp, Homo sapiens
tcattccgttgtctgtg

SEQ ID NO: 5014037 - DNA, 20 bp, Homo sapiens
tcattctggttccctgctgc

SEQ ID NO: 5014038 - DNA, 16 bp, Homo sapiens
tccaaagaggctgccc

SEQ ID NO: 5014039 - DNA, 20 bp, Homo sapiens
tccagcatttagctggccac

SEQ ID NO: 5014040 - DNA, 16 bp, Homo sapiens
tccagcctgccccgga

SEQ ID NO: 5014041 - DNA, 18 bp, Homo sapiens
tccaggaagcccagggca

SEQ ID NO: 5014042 - DNA, 20 bp, Homo sapiens
tccaggctttcccacttccc

SEQ ID NO: 5014043 - DNA, 22 bp, Homo sapiens
tccaggctttcccacttcccac

SEQ ID NO: 5014044 - DNA, 16 bp, Homo sapiens
tccatagcaacaggaa

SEQ ID NO: 5014045 - DNA, 16 bp, Homo sapiens
tccatctctcatcctc

SEQ ID NO: 5014046 - DNA, 18 bp, Homo sapiens
tccatgatttagcaagca

SEQ ID NO: 5014047 - DNA, 19 bp, Homo sapiens
tccatgatttagcaagcaa

SEQ ID NO: 5014048 - DNA, 12 bp, Homo sapiens
tcccacacccaa

SEQ ID NO: 5014049 - DNA, 18 bp, Homo sapiens
tcccagcaattattacaa

SEQ ID NO: 5014050 - DNA, 13 bp, Homo sapiens
tcccatgtatgga

SEQ ID NO: 5014051 - DNA, 12 bp, Homo sapiens
tcccccatcctt

SEQ ID NO: 5014052 - DNA, 15 bp, Homo sapiens
tccccgagtgactct

SEQ ID NO: 5014053 - DNA, 17 bp, Homo sapiens
tccccgagtgactctgg

SEQ ID NO: 5014054 - DNA, 15 bp, Homo sapiens
tccccgctgctgtgc

SEQ ID NO: 5014055 - DNA, 17 bp, Homo sapiens
tccccgctgctgtgcaa

SEQ ID NO: 5014056 - DNA, 22 bp, Homo sapiens
tccccggcatgagactcagtgc

SEQ ID NO: 5014057 - DNA, 18 bp, Homo sapiens
tcccctagagccctctcc

SEQ ID NO: 5014058 - DNA, 19 bp, Homo sapiens
tcccctagagccctctcct

SEQ ID NO: 5014059 - DNA, 16 bp, Homo sapiens
tccctgctgcgctgct

SEQ ID NO: 5014060 - DNA, 17 bp, Homo sapiens
tccctgctgcgctgctt

SEQ ID NO: 5014061 - DNA, 18 bp, Homo sapiens
tccgaagctacttctcca

SEQ ID NO: 5014062 - DNA, 15 bp, Homo sapiens
tccgcagaagccctg

SEQ ID NO: 5014063 - DNA, 18 bp, Homo sapiens
tccgcgtgtgcctgtgtg

SEQ ID NO: 5014064 - DNA, 17 bp, Homo sapiens
tccgtagctctgctgct

SEQ ID NO: 5014065 - DNA, 16 bp, Homo sapiens
tccgtttcgcgctggc

SEQ ID NO: 5014066 - DNA, 14 bp, Homo sapiens
tcctcagcttatct

SEQ ID NO: 5014067 - DNA, 12 bp, Homo sapiens
tcctcctcctgc

SEQ ID NO: 5014068 - DNA, 15 bp, Homo sapiens
tcctcctgccctcct

SEQ ID NO: 5014069 - DNA, 14 bp, Homo sapiens
tcctctctggcctt

SEQ ID NO: 5014070 - DNA, 20 bp, Homo sapiens
tcctgacgtctgaagcttga

SEQ ID NO: 5014071 - DNA, 13 bp, Homo sapiens
tcctgactggtgc

SEQ ID NO: 5014072 - DNA, 13 bp, Homo sapiens
tcctgagaagcat

SEQ ID NO: 5014073 - DNA, 18 bp, Homo sapiens
tcctgccctcctctcccc

SEQ ID NO: 5014074 - DNA, 21 bp, Homo sapiens
tccttgcaaggttaagcaagg

SEQ ID NO: 5014075 - DNA, 16 bp, Homo sapiens
tccttgcccccagtgc

SEQ ID NO: 5014076 - DNA, 18 bp, Homo sapiens
tccttgcccccagtgcct

SEQ ID NO: 5014077 - DNA, 15 bp, Homo sapiens
tcctttaaaaaagaa

SEQ ID NO: 5014078 - DNA, 20 bp, Homo sapiens
tcgcattgaactctacaaca

SEQ ID NO: 5014079 - DNA, 18 bp, Homo sapiens
tcgcctcctcctcctgcc

SEQ ID NO: 5014080 - DNA, 11 bp, Homo sapiens
tcggagaggga

SEQ ID NO: 5014081 - DNA, 18 bp, Homo sapiens
tcggagagggacatagaa

SEQ ID NO: 5014082 - DNA, 16 bp, Homo sapiens
tctaaaagcagaaaat

SEQ ID NO: 5014083 - DNA, 14 bp, Homo sapiens
tctagcattctgca

SEQ ID NO: 5014084 - DNA, 14 bp, Homo sapiens
tctatatatataat

SEQ ID NO: 5014085 - DNA, 22 bp, Homo sapiens
tctcacccatgcaagcagagga

SEQ ID NO: 5014086 - DNA, 13 bp, Homo sapiens
tctcaccccactc

SEQ ID NO: 5014087 - DNA, 14 bp, Homo sapiens
tctcaccccactcc

SEQ ID NO: 5014088 - DNA, 15 bp, Homo sapiens
tctcaccccactcct

SEQ ID NO: 5014089 - DNA, 18 bp, Homo sapiens
tctcaccccactcctgtc

SEQ ID NO: 5014090 - DNA, 22 bp, Homo sapiens
tctcaggtagaaggttgacaca

SEQ ID NO: 5014091 - DNA, 21 bp, Homo sapiens
tctcattccgttgtctgtgga

SEQ ID NO: 5014092 - DNA, 17 bp, Homo sapiens
tctccaggaagcccagg

SEQ ID NO: 5014093 - DNA, 20 bp, Homo sapiens
tctcccaagctgattttatt

SEQ ID NO: 5014094 - DNA, 20 bp, Homo sapiens
tctcccctagagccctctcc

SEQ ID NO: 5014095 - DNA, 23 bp, Homo sapiens
tctcctccctctgtccctctcct

SEQ ID NO: 5014096 - DNA, 19 bp, Homo sapiens
tctccttgcccccagtgcc

SEQ ID NO: 5014097 - DNA, 14 bp, Homo sapiens
tctctgtcccttgc

SEQ ID NO: 5014098 - DNA, 19 bp, Homo sapiens
tctctgtcccttgctgtat

SEQ ID NO: 5014099 - DNA, 16 bp, Homo sapiens
tctctgttggtctgcc

SEQ ID NO: 5014100 - DNA, 15 bp, Homo sapiens
tctgccgctacctcc

SEQ ID NO: 5014101 - DNA, 19 bp, Homo sapiens
tctgccgctacctccctcc

SEQ ID NO: 5014102 - DNA, 20 bp, Homo sapiens
tctgccgctacctccctccc

SEQ ID NO: 5014103 - DNA, 13 bp, Homo sapiens
tctgccttctgct

SEQ ID NO: 5014104 - DNA, 14 bp, Homo sapiens
tctgccttctgctg

SEQ ID NO: 5014105 - DNA, 15 bp, Homo sapiens
tctgccttctgctga

SEQ ID NO: 5014106 - DNA, 18 bp, Homo sapiens
tctggatttggtgctgga

SEQ ID NO: 5014107 - DNA, 17 bp, Homo sapiens
tctggggcaggctgggc

SEQ ID NO: 5014108 - DNA, 21 bp, Homo sapiens
tctggggcaggctgggccatg

SEQ ID NO: 5014109 - DNA, 15 bp, Homo sapiens
tctggttccctgctg

SEQ ID NO: 5014110 - DNA, 17 bp, Homo sapiens
tctggttccctgctgcg

SEQ ID NO: 5014111 - DNA, 14 bp, Homo sapiens
tctgtgacctctga

SEQ ID NO: 5014112 - DNA, 13 bp, Homo sapiens
tctgtgggatata

SEQ ID NO: 5014113 - DNA, 20 bp, Homo sapiens
tctgtgtgtgtgtgtgtgcg

SEQ ID NO: 5014114 - DNA, 16 bp, Homo sapiens
tctgttggtctgcctt

SEQ ID NO: 5014115 - DNA, 13 bp, Homo sapiens
tcttacacactgt

SEQ ID NO: 5014116 - DNA, 14 bp, Homo sapiens
tcttccatgatttt

SEQ ID NO: 5014117 - DNA, 15 bp, Homo sapiens
tcttctaattgctgt

SEQ ID NO: 5014118 - DNA, 20 bp, Homo sapiens
tcttcttggggcccagtgca

SEQ ID NO: 5014119 - DNA, 20 bp, Homo sapiens
tcttgatgccaccttcagat

SEQ ID NO: 5014120 - DNA, 17 bp, Homo sapiens
tcttgcctccaggtgca

SEQ ID NO: 5014121 - DNA, 13 bp, Homo sapiens
tcttggggcccag

SEQ ID NO: 5014122 - DNA, 18 bp, Homo sapiens
tcttggggcccagtgcat

SEQ ID NO: 5014123 - DNA, 15 bp, Homo sapiens
tctttaggagattta

SEQ ID NO: 5014124 - DNA, 16 bp, Homo sapiens
tctttaggagatttat

SEQ ID NO: 5014125 - DNA, 14 bp, Homo sapiens
tcttttatatttgt

SEQ ID NO: 5014126 - DNA, 13 bp, Homo sapiens
tgaaaaagaataa

SEQ ID NO: 5014127 - DNA, 20 bp, Homo sapiens
tgaaaaagaataaaaacttt

SEQ ID NO: 5014128 - DNA, 20 bp, Homo sapiens
tgaaacctacacactgtcat

SEQ ID NO: 5014129 - DNA, 18 bp, Homo sapiens
tgaaacctagtactgccc

SEQ ID NO: 5014130 - DNA, 19 bp, Homo sapiens
tgaaacctagtactgcccc

SEQ ID NO: 5014131 - DNA, 17 bp, Homo sapiens
tgaaacttaagaattga

SEQ ID NO: 5014132 - DNA, 22 bp, Homo sapiens
tgaaagccttagggaagctggc

SEQ ID NO: 5014133 - DNA, 16 bp, Homo sapiens
tgaaatgaaatcttcc

SEQ ID NO: 5014134 - DNA, 19 bp, Homo sapiens
tgaaattacgggtacctga

SEQ ID NO: 5014135 - DNA, 20 bp, Homo sapiens
tgaaattacgggtacctgaa

SEQ ID NO: 5014136 - DNA, 13 bp, Homo sapiens
tgaaccctccagg

SEQ ID NO: 5014137 - DNA, 18 bp, Homo sapiens
tgaagccaccctgggcta

SEQ ID NO: 5014138 - DNA, 18 bp, Homo sapiens
tgaagcttgactcccaag

SEQ ID NO: 5014139 - DNA, 14 bp, Homo sapiens
tgaagtttacagag

SEQ ID NO: 5014140 - DNA, 13 bp, Homo sapiens
tgaatgctgccac

SEQ ID NO: 5014141 - DNA, 13 bp, Homo sapiens
tgaattgactacc

SEQ ID NO: 5014142 - DNA, 20 bp, Homo sapiens
tgaattggaaagacttctca

SEQ ID NO: 5014143 - DNA, 17 bp, Homo sapiens
tgacaaccgagaaggtt

SEQ ID NO: 5014144 - DNA, 15 bp, Homo sapiens
tgacaactgtgaagc

SEQ ID NO: 5014145 - DNA, 16 bp, Homo sapiens
tgacagtttttctgtt

SEQ ID NO: 5014146 - DNA, 16 bp, Homo sapiens
tgaccgggagacagag

SEQ ID NO: 5014147 - DNA, 13 bp, Homo sapiens
tgactttcctccc

SEQ ID NO: 5014148 - DNA, 15 bp, Homo sapiens
tgagactcagtgcag

SEQ ID NO: 5014149 - DNA, 18 bp, Homo sapiens
tgagcatgtaaaagcgga

SEQ ID NO: 5014150 - DNA, 14 bp, Homo sapiens
tgagggtgtttctt

SEQ ID NO: 5014151 - DNA, 14 bp, Homo sapiens
tgaggtcagtgttt

SEQ ID NO: 5014152 - DNA, 14 bp, Homo sapiens
tgagtctgggcagc

SEQ ID NO: 5014153 - DNA, 15 bp, Homo sapiens
tgagtgccttttgca

SEQ ID NO: 5014154 - DNA, 15 bp, Homo sapiens
tgatttataaacaga

SEQ ID NO: 5014155 - DNA, 17 bp, Homo sapiens
tgatttataaacagaca

SEQ ID NO: 5014156 - DNA, 14 bp, Homo sapiens
tgatttttaagaaa

SEQ ID NO: 5014157 - DNA, 16 bp, Homo sapiens
tgatttttaagaaagt

SEQ ID NO: 5014158 - DNA, 13 bp, Homo sapiens
tgcaagcagagga

SEQ ID NO: 5014159 - DNA, 22 bp, Homo sapiens
tgcaagcagaggaccagggcct

SEQ ID NO: 5014160 - DNA, 16 bp, Homo sapiens
tgcacaccattttgta

SEQ ID NO: 5014161 - DNA, 20 bp, Homo sapiens
tgcacatccgcgtgtgcctg

SEQ ID NO: 5014162 - DNA, 13 bp, Homo sapiens
tgcactgatgttg

SEQ ID NO: 5014163 - DNA, 21 bp, Homo sapiens
tgcactgatgttgtgttttta

SEQ ID NO: 5014164 - DNA, 20 bp, Homo sapiens
tgcagaatgtaagtgggccc

SEQ ID NO: 5014165 - DNA, 18 bp, Homo sapiens
tgcagaggtaccctgggt

SEQ ID NO: 5014166 - DNA, 19 bp, Homo sapiens
tgcagaggtaccctgggtg

SEQ ID NO: 5014167 - DNA, 15 bp, Homo sapiens
tgcagggccatggct

SEQ ID NO: 5014168 - DNA, 18 bp, Homo sapiens
tgcagtactttgtgcatt

SEQ ID NO: 5014169 - DNA, 15 bp, Homo sapiens
tgcagtattcttgca

SEQ ID NO: 5014170 - DNA, 22 bp, Homo sapiens
tgcatagcagatggtttccaca

SEQ ID NO: 5014171 - DNA, 15 bp, Homo sapiens
tgcatatttatccaa

SEQ ID NO: 5014172 - DNA, 15 bp, Homo sapiens
tgccactcctccctc

SEQ ID NO: 5014173 - DNA, 22 bp, Homo sapiens
tgccaggaacctgtcctaagga

SEQ ID NO: 5014174 - DNA, 15 bp, Homo sapiens
tgccccaggccctgc

SEQ ID NO: 5014175 - DNA, 14 bp, Homo sapiens
tgcccccagtgcct

SEQ ID NO: 5014176 - DNA, 23 bp, Homo sapiens
tgccccccatgaggaaggaacag

SEQ ID NO: 5014177 - DNA, 16 bp, Homo sapiens
tgcccctcagagactg

SEQ ID NO: 5014178 - DNA, 23 bp, Homo sapiens
tgcccggagcagcagcttctcca

SEQ ID NO: 5014179 - DNA, 14 bp, Homo sapiens
tgccctcctctccc

SEQ ID NO: 5014180 - DNA, 13 bp, Homo sapiens
tgccctttcaaag

SEQ ID NO: 5014181 - DNA, 22 bp, Homo sapiens
tgccctttcaaagcacttaagt

SEQ ID NO: 5014182 - DNA, 15 bp, Homo sapiens
tgccgctacctccct

SEQ ID NO: 5014183 - DNA, 17 bp, Homo sapiens
tgccgctacctccctcc

SEQ ID NO: 5014184 - DNA, 23 bp, Homo sapiens
tgcctagtttcttacacactgtc

SEQ ID NO: 5014185 - DNA, 12 bp, Homo sapiens
tgcctcaccttc

SEQ ID NO: 5014186 - DNA, 22 bp, Homo sapiens
tgcctcaccttccaacactcca

SEQ ID NO: 5014187 - DNA, 15 bp, Homo sapiens
tgcctccaggtgcag

SEQ ID NO: 5014188 - DNA, 12 bp, Homo sapiens
tgcctgcagggc

SEQ ID NO: 5014189 - DNA, 14 bp, Homo sapiens
tgcctgcagggcca

SEQ ID NO: 5014190 - DNA, 16 bp, Homo sapiens
tgcctgcagggccatg

SEQ ID NO: 5014191 - DNA, 19 bp, Homo sapiens
tgcctttgcaccacgggac

SEQ ID NO: 5014192 - DNA, 21 bp, Homo sapiens
tgcgaccctgggggcacagga

SEQ ID NO: 5014193 - DNA, 15 bp, Homo sapiens
tgcgcatcttgcctc

SEQ ID NO: 5014194 - DNA, 20 bp, Homo sapiens
tgcgcatcttgcctccaggt

SEQ ID NO: 5014195 - DNA, 18 bp, Homo sapiens
tgctacctttcaaagctt

SEQ ID NO: 5014196 - DNA, 11 bp, Homo sapiens
tgctcccaggc

SEQ ID NO: 5014197 - DNA, 18 bp, Homo sapiens
tgctcccaggccccaggc

SEQ ID NO: 5014198 - DNA, 23 bp, Homo sapiens
tgctcccaggccccaggcctgtg

SEQ ID NO: 5014199 - DNA, 18 bp, Homo sapiens
tgctccgtagctctgctg

SEQ ID NO: 5014200 - DNA, 23 bp, Homo sapiens
tgctgatcatcgccagaggtgct

SEQ ID NO: 5014201 - DNA, 20 bp, Homo sapiens
tgctgtatgctgatcatcgc

SEQ ID NO: 5014202 - DNA, 15 bp, Homo sapiens
tgcttcttactgata

SEQ ID NO: 5014203 - DNA, 17 bp, Homo sapiens
tgcttcttactgataat

SEQ ID NO: 5014204 - DNA, 15 bp, Homo sapiens
tgcttgcctgcaggg

SEQ ID NO: 5014205 - DNA, 15 bp, Homo sapiens
tgcttggtgtgaccc

SEQ ID NO: 5014206 - DNA, 23 bp, Homo sapiens
tggaaagacttctcaaagagaat

SEQ ID NO: 5014207 - DNA, 15 bp, Homo sapiens
tggaagaggaaaagg

SEQ ID NO: 5014208 - DNA, 13 bp, Homo sapiens
tggaaggagaggg

SEQ ID NO: 5014209 - DNA, 22 bp, Homo sapiens
tggaaggagaggggaggtcact

SEQ ID NO: 5014210 - DNA, 13 bp, Homo sapiens
tggactgcagaag

SEQ ID NO: 5014211 - DNA, 22 bp, Homo sapiens
tggactgctacctttcaaagct

SEQ ID NO: 5014212 - DNA, 23 bp, Homo sapiens
tggactgctacctttcaaagctt

SEQ ID NO: 5014213 - DNA, 18 bp, Homo sapiens
tggacttcaaagcaagct

SEQ ID NO: 5014214 - DNA, 19 bp, Homo sapiens
tggacttcaaagcaagctg

SEQ ID NO: 5014215 - DNA, 19 bp, Homo sapiens
tggagagaagcaagccagc

SEQ ID NO: 5014216 - DNA, 16 bp, Homo sapiens
tggagggaggccccag

SEQ ID NO: 5014217 - DNA, 16 bp, Homo sapiens
tggcaccgcctcccca

SEQ ID NO: 5014218 - DNA, 23 bp, Homo sapiens
tggcatcaagaggtgggagggcc

SEQ ID NO: 5014219 - DNA, 15 bp, Homo sapiens
tggctccggcctctg

SEQ ID NO: 5014220 - DNA, 19 bp, Homo sapiens
tggctccggcctctgcctt

SEQ ID NO: 5014221 - DNA, 20 bp, Homo sapiens
tgggaaacactgaaatgaaa

SEQ ID NO: 5014222 - DNA, 17 bp, Homo sapiens
tgggaggccgaggtggg

SEQ ID NO: 5014223 - DNA, 21 bp, Homo sapiens
tgggcagggtctgtttggact

SEQ ID NO: 5014224 - DNA, 19 bp, Homo sapiens
tgggccatgtccaaagagg

SEQ ID NO: 5014225 - DNA, 22 bp, Homo sapiens
tgggccctgagtctgggcagct

SEQ ID NO: 5014226 - DNA, 19 bp, Homo sapiens
tgggcctcggcccctccca

SEQ ID NO: 5014227 - DNA, 23 bp, Homo sapiens
tgggctggttggagaaggtcaca

SEQ ID NO: 5014228 - DNA, 15 bp, Homo sapiens
tggggcaggctgggc

SEQ ID NO: 5014229 - DNA, 16 bp, Homo sapiens
tggggcaggctgggcc

SEQ ID NO: 5014230 - DNA, 14 bp, Homo sapiens
tggggcagggagct

SEQ ID NO: 5014231 - DNA, 13 bp, Homo sapiens
tggggcccagtgc

SEQ ID NO: 5014232 - DNA, 22 bp, Homo sapiens
tggggcccagtgcatggtggcc

SEQ ID NO: 5014233 - DNA, 17 bp, Homo sapiens
tgggtggaaactaagac

SEQ ID NO: 5014234 - DNA, 13 bp, Homo sapiens
tggtatatataca

SEQ ID NO: 5014235 - DNA, 17 bp, Homo sapiens
tggtgcatagcagatgg

SEQ ID NO: 5014236 - DNA, 14 bp, Homo sapiens
tggttccctgctgc

SEQ ID NO: 5014237 - DNA, 15 bp, Homo sapiens
tggttccctgctgcg

SEQ ID NO: 5014238 - DNA, 18 bp, Homo sapiens
tggttccctgctgcgctg

SEQ ID NO: 5014239 - DNA, 19 bp, Homo sapiens
tggttccctgctgcgctgc

SEQ ID NO: 5014240 - DNA, 13 bp, Homo sapiens
tggttggagaagg

SEQ ID NO: 5014241 - DNA, 21 bp, Homo sapiens
tgtacatttctataaatagat

SEQ ID NO: 5014242 - DNA, 19 bp, Homo sapiens
tgtacctcctctcagtgtt

SEQ ID NO: 5014243 - DNA, 20 bp, Homo sapiens
tgtacctcctctcagtgttt

SEQ ID NO: 5014244 - DNA, 23 bp, Homo sapiens
tgtacttgaagtctaaaagcaga

SEQ ID NO: 5014245 - DNA, 23 bp, Homo sapiens
tgtagcccatccttccctttgga

SEQ ID NO: 5014246 - DNA, 18 bp, Homo sapiens
tgtaggagaaactcccat

SEQ ID NO: 5014247 - DNA, 19 bp, Homo sapiens
tgtagtttttatatgttgt

SEQ ID NO: 5014248 - DNA, 19 bp, Homo sapiens
tgtatatggtatatataca

SEQ ID NO: 5014249 - DNA, 20 bp, Homo sapiens
tgtatatggtatatatacat

SEQ ID NO: 5014250 - DNA, 18 bp, Homo sapiens
tgtatatttgtaaagcta

SEQ ID NO: 5014251 - DNA, 15 bp, Homo sapiens
tgtatgatttataaa

SEQ ID NO: 5014252 - DNA, 22 bp, Homo sapiens
tgtatgcagtattcttgcactg

SEQ ID NO: 5014253 - DNA, 19 bp, Homo sapiens
tgtatggaatcccactgta

SEQ ID NO: 5014254 - DNA, 18 bp, Homo sapiens
tgtattgatttttaagaa

SEQ ID NO: 5014255 - DNA, 19 bp, Homo sapiens
tgtattgttttctgacagt

SEQ ID NO: 5014256 - DNA, 13 bp, Homo sapiens
tgtatttcttata

SEQ ID NO: 5014257 - DNA, 20 bp, Homo sapiens
tgtatttttatttttgcaca

SEQ ID NO: 5014258 - DNA, 21 bp, Homo sapiens
tgtatttttatttttgcacaa

SEQ ID NO: 5014259 - DNA, 19 bp, Homo sapiens
tgtcaaaatatttctcatc

SEQ ID NO: 5014260 - DNA, 23 bp, Homo sapiens
tgtcaaaatatttctcatctgca

SEQ ID NO: 5014261 - DNA, 14 bp, Homo sapiens
tgtcaccaaggaaa

SEQ ID NO: 5014262 - DNA, 17 bp, Homo sapiens
tgtccaaagaggctgcc

SEQ ID NO: 5014263 - DNA, 20 bp, Homo sapiens
tgtccagcaccttgtgcctg

SEQ ID NO: 5014264 - DNA, 15 bp, Homo sapiens
tgtccctctccttgc

SEQ ID NO: 5014265 - DNA, 21 bp, Homo sapiens
tgtccctctccttgcccccag

SEQ ID NO: 5014266 - DNA, 14 bp, Homo sapiens
tgtcccttgctgta

SEQ ID NO: 5014267 - DNA, 16 bp, Homo sapiens
tgtcctaattcttctg

SEQ ID NO: 5014268 - DNA, 20 bp, Homo sapiens
tgtcctaattcttctgtcct

SEQ ID NO: 5014269 - DNA, 16 bp, Homo sapiens
tgtcctttaaaaaaga

SEQ ID NO: 5014270 - DNA, 18 bp, Homo sapiens
tgtcctttaaaaaagaaa

SEQ ID NO: 5014271 - DNA, 20 bp, Homo sapiens
tgtctgtggatggtcattgc

SEQ ID NO: 5014272 - DNA, 21 bp, Homo sapiens
tgtctgtggatggtcattgca

SEQ ID NO: 5014273 - DNA, 15 bp, Homo sapiens
tgtgaattgactacc

SEQ ID NO: 5014274 - DNA, 15 bp, Homo sapiens
tgtgacctctgacaa

SEQ ID NO: 5014275 - DNA, 24 bp, Homo sapiens
tgtgatatttcgtgtactgcaaag

SEQ ID NO: 5014276 - DNA, 22 bp, Homo sapiens
tgtggattctgaggccctgccc

SEQ ID NO: 5014277 - DNA, 14 bp, Homo sapiens
tgtggggggtcctt

SEQ ID NO: 5014278 - DNA, 13 bp, Homo sapiens
tgtgtatatggta

SEQ ID NO: 5014279 - DNA, 13 bp, Homo sapiens
tgtgtcccaggca

SEQ ID NO: 5014280 - DNA, 14 bp, Homo sapiens
tgtgtcctcaggga

SEQ ID NO: 5014281 - DNA, 15 bp, Homo sapiens
tgtgtgtcccaggca

SEQ ID NO: 5014282 - DNA, 14 bp, Homo sapiens
tgtgtgtgtgtgcg

SEQ ID NO: 5014283 - DNA, 15 bp, Homo sapiens
tgttactgggccctg

SEQ ID NO: 5014284 - DNA, 17 bp, Homo sapiens
tgttgctctaggaagac

SEQ ID NO: 5014285 - DNA, 20 bp, Homo sapiens
tgttgctctaggaagacatt

SEQ ID NO: 5014286 - DNA, 15 bp, Homo sapiens
tgtttggcaaggaaa

SEQ ID NO: 5014287 - DNA, 16 bp, Homo sapiens
tgtttggcaaggaaag

SEQ ID NO: 5014288 - DNA, 18 bp, Homo sapiens
tgttttaaaactggacct

SEQ ID NO: 5014289 - DNA, 22 bp, Homo sapiens
tgttttccatgatttagcaagc

SEQ ID NO: 5014290 - DNA, 20 bp, Homo sapiens
ttaaaaagatgaaaaagaat

SEQ ID NO: 5014291 - DNA, 22 bp, Homo sapiens
ttaaataaactttttttagatt

SEQ ID NO: 5014292 - DNA, 23 bp, Homo sapiens
ttaacagtggttcaaatttcctt

SEQ ID NO: 5014293 - DNA, 18 bp, Homo sapiens
ttaactactatattgatt

SEQ ID NO: 5014294 - DNA, 20 bp, Homo sapiens
ttaactactatattgattgt

SEQ ID NO: 5014295 - DNA, 12 bp, Homo sapiens
ttaatttgtaaa

SEQ ID NO: 5014296 - DNA, 16 bp, Homo sapiens
ttaatttgtaaaactt

SEQ ID NO: 5014297 - DNA, 21 bp, Homo sapiens
ttacgttggttaaataaactt

SEQ ID NO: 5014298 - DNA, 22 bp, Homo sapiens
ttactgccctttcaaagcactt

SEQ ID NO: 5014299 - DNA, 19 bp, Homo sapiens
ttataaacagacaatatgt

SEQ ID NO: 5014300 - DNA, 16 bp, Homo sapiens
ttatatagactgttga

SEQ ID NO: 5014301 - DNA, 17 bp, Homo sapiens
ttatccaaaatgtgtat

SEQ ID NO: 5014302 - DNA, 11 bp, Homo sapiens
ttatgtagttt

SEQ ID NO: 5014303 - DNA, 12 bp, Homo sapiens
ttattagatgtt

SEQ ID NO: 5014304 - DNA, 16 bp, Homo sapiens
ttattcaatatggtta

SEQ ID NO: 5014305 - DNA, 21 bp, Homo sapiens
ttattttttggacttcaaagc

SEQ ID NO: 5014306 - DNA, 13 bp, Homo sapiens
ttcaaaaagatat

SEQ ID NO: 5014307 - DNA, 11 bp, Homo sapiens
ttcagaagacc

SEQ ID NO: 5014308 - DNA, 17 bp, Homo sapiens
ttcatcattccctctca

SEQ ID NO: 5014309 - DNA, 20 bp, Homo sapiens
ttcatcattccctctcatct

SEQ ID NO: 5014310 - DNA, 20 bp, Homo sapiens
ttccagcatttagctggcca

SEQ ID NO: 5014311 - DNA, 14 bp, Homo sapiens
ttccaggggaacct

SEQ ID NO: 5014312 - DNA, 17 bp, Homo sapiens
ttccaggggaacctgcc

SEQ ID NO: 5014313 - DNA, 14 bp, Homo sapiens
ttccagtgtctgtc

SEQ ID NO: 5014314 - DNA, 15 bp, Homo sapiens
ttccagtgtctgtct

SEQ ID NO: 5014315 - DNA, 17 bp, Homo sapiens
ttccatagcaacaggaa

SEQ ID NO: 5014316 - DNA, 20 bp, Homo sapiens
ttccatgatttagcaagcaa

SEQ ID NO: 5014317 - DNA, 18 bp, Homo sapiens
ttccccgagtgactctgg

SEQ ID NO: 5014318 - DNA, 14 bp, Homo sapiens
ttccctctcatctc

SEQ ID NO: 5014319 - DNA, 14 bp, Homo sapiens
ttccgttgtctgtg

SEQ ID NO: 5014320 - DNA, 15 bp, Homo sapiens
ttcctatttatttga

SEQ ID NO: 5014321 - DNA, 19 bp, Homo sapiens
ttcctcagcttatctcttt

SEQ ID NO: 5014322 - DNA, 16 bp, Homo sapiens
ttcctctcaccccact

SEQ ID NO: 5014323 - DNA, 17 bp, Homo sapiens
ttcctctcaccccactc

SEQ ID NO: 5014324 - DNA, 23 bp, Homo sapiens
ttcctctcaccccactcctgtca

SEQ ID NO: 5014325 - DNA, 17 bp, Homo sapiens
ttcgttctgtactgtta

SEQ ID NO: 5014326 - DNA, 14 bp, Homo sapiens
ttctcatgactcct

SEQ ID NO: 5014327 - DNA, 22 bp, Homo sapiens
ttctctgccgctacctccctcc

SEQ ID NO: 5014328 - DNA, 23 bp, Homo sapiens
ttctctgccgctacctccctccc

SEQ ID NO: 5014329 - DNA, 21 bp, Homo sapiens
ttctgacagtttttctgtttt

SEQ ID NO: 5014330 - DNA, 15 bp, Homo sapiens
ttctgctgaaagact

SEQ ID NO: 5014331 - DNA, 20 bp, Homo sapiens
ttctggggcaggctgggcca

SEQ ID NO: 5014332 - DNA, 21 bp, Homo sapiens
ttctggggggacccagtgcag

SEQ ID NO: 5014333 - DNA, 16 bp, Homo sapiens
ttctggttccctgctg

SEQ ID NO: 5014334 - DNA, 19 bp, Homo sapiens
ttcttggggcccagtgcat

SEQ ID NO: 5014335 - DNA, 19 bp, Homo sapiens
ttgactcccaagtttccat

SEQ ID NO: 5014336 - DNA, 16 bp, Homo sapiens
ttgcagaagagggtgt

SEQ ID NO: 5014337 - DNA, 13 bp, Homo sapiens
ttgcccccagtgc

SEQ ID NO: 5014338 - DNA, 20 bp, Homo sapiens
ttgcccccagtgcctcacct

SEQ ID NO: 5014339 - DNA, 15 bp, Homo sapiens
ttgcctccaggtgca

SEQ ID NO: 5014340 - DNA, 20 bp, Homo sapiens
ttgcctccaggtgcagaggt

SEQ ID NO: 5014341 - DNA, 13 bp, Homo sapiens
ttgcctgcagggc

SEQ ID NO: 5014342 - DNA, 18 bp, Homo sapiens
ttgctgtatgctgatcat

SEQ ID NO: 5014343 - DNA, 13 bp, Homo sapiens
ttggcaaggaaag

SEQ ID NO: 5014344 - DNA, 18 bp, Homo sapiens
ttggtctgccttctgctg

SEQ ID NO: 5014345 - DNA, 19 bp, Homo sapiens
ttgtaaaacttctgctcgt

SEQ ID NO: 5014346 - DNA, 16 bp, Homo sapiens
ttgtaaatgaaactta

SEQ ID NO: 5014347 - DNA, 20 bp, Homo sapiens
ttgtaaatgaaacttaagaa

SEQ ID NO: 5014348 - DNA, 21 bp, Homo sapiens
ttgtaaatgaaacttaagaat

SEQ ID NO: 5014349 - DNA, 22 bp, Homo sapiens
ttgtaaatgaaacttaagaatt

SEQ ID NO: 5014350 - DNA, 16 bp, Homo sapiens
ttgtagggttacagag

SEQ ID NO: 5014351 - DNA, 20 bp, Homo sapiens
ttgtatatttgttttatgct

SEQ ID NO: 5014352 - DNA, 13 bp, Homo sapiens
ttgtattgttttc

SEQ ID NO: 5014353 - DNA, 14 bp, Homo sapiens
ttgtattgttttct

SEQ ID NO: 5014354 - DNA, 18 bp, Homo sapiens
ttgtcctttttcaggaga

SEQ ID NO: 5014355 - DNA, 13 bp, Homo sapiens
ttgttttaaaact

SEQ ID NO: 5014356 - DNA, 17 bp, Homo sapiens
tttaacttttaatttaa

SEQ ID NO: 5014357 - DNA, 19 bp, Homo sapiens
tttacagggatttctgttt

SEQ ID NO: 5014358 - DNA, 18 bp, Homo sapiens
tttaccttttatgcaaaa

SEQ ID NO: 5014359 - DNA, 21 bp, Homo sapiens
tttactgtcaaaatatttctc

SEQ ID NO: 5014360 - DNA, 17 bp, Homo sapiens
tttatccaaaatgtgta

SEQ ID NO: 5014361 - DNA, 15 bp, Homo sapiens
tttatgatcagtgtt

SEQ ID NO: 5014362 - DNA, 19 bp, Homo sapiens
tttatttttgcacaacttt

SEQ ID NO: 5014363 - DNA, 12 bp, Homo sapiens
tttcaaagcact

SEQ ID NO: 5014364 - DNA, 13 bp, Homo sapiens
tttcaaagcactt

SEQ ID NO: 5014365 - DNA, 23 bp, Homo sapiens
tttcccacttcccaccctgcccc

SEQ ID NO: 5014366 - DNA, 14 bp, Homo sapiens
tttcctttgtcctt

SEQ ID NO: 5014367 - DNA, 20 bp, Homo sapiens
tttctgtttactgtcaaaat

SEQ ID NO: 5014368 - DNA, 13 bp, Homo sapiens
tttcttacacact

SEQ ID NO: 5014369 - DNA, 18 bp, Homo sapiens
tttctttaggagatttat

SEQ ID NO: 5014370 - DNA, 16 bp, Homo sapiens
tttgaagtgcagctca

SEQ ID NO: 5014371 - DNA, 19 bp, Homo sapiens
tttgcaaacccgaaaataa

SEQ ID NO: 5014372 - DNA, 19 bp, Homo sapiens
tttgcacaccattttgtaa

SEQ ID NO: 5014373 - DNA, 18 bp, Homo sapiens
tttggactccatctctca

SEQ ID NO: 5014374 - DNA, 14 bp, Homo sapiens
tttgtaaaacttct

SEQ ID NO: 5014375 - DNA, 15 bp, Homo sapiens
tttgtaaaacttctg

SEQ ID NO: 5014376 - DNA, 22 bp, Homo sapiens
tttgtaaatgaaacttaagaat

SEQ ID NO: 5014377 - DNA, 24 bp, Homo sapiens
tttgtaaatgaaacttaagaattg

SEQ ID NO: 5014378 - DNA, 14 bp, Homo sapiens
tttgtacagagtgc

SEQ ID NO: 5014379 - DNA, 18 bp, Homo sapiens
ttttaagaaagtaattta

SEQ ID NO: 5014380 - DNA, 23 bp, Homo sapiens
ttttaagaaagtaatttaatttg

SEQ ID NO: 5014381 - DNA, 23 bp, Homo sapiens
ttttactgccctttcaaagcact

SEQ ID NO: 5014382 - DNA, 13 bp, Homo sapiens
ttttatatttgta

SEQ ID NO: 5014383 - DNA, 14 bp, Homo sapiens
ttttatatttgtag

SEQ ID NO: 5014384 - DNA, 11 bp, Homo sapiens
ttttctggcac

SEQ ID NO: 5014385 - DNA, 13 bp, Homo sapiens
ttttgcagaagag

SEQ ID NO: 5014386 - DNA, 23 bp, Homo sapiens
ttttgctggaattcctaactttt

SEQ ID NO: 5014387 - DNA, 17 bp, Homo sapiens
ttttggacttcaaagca

SEQ ID NO: 5014388 - DNA, 18 bp, Homo sapiens
ttttgtttggcaaggaaa

SEQ ID NO: 5014389 - DNA, 19 bp, Homo sapiens
ttttgtttggcaaggaaag

SEQ ID NO: 5014390 - DNA, 14 bp, Homo sapiens
tttttacaagatgt

SEQ ID NO: 5014391 - DNA, 18 bp, Homo sapiens
ccagttgatcaatgaata

SEQ ID NO: 5014392 - DNA, 16 bp, Homo sapiens
aaaccttattgtacct

SEQ ID NO: 5014393 - DNA, 19 bp, Homo sapiens
aaactttatgctaagtgaa

SEQ ID NO: 5014394 - DNA, 15 bp, Homo sapiens
aaagaggaatgaagt

SEQ ID NO: 5014395 - DNA, 19 bp, Homo sapiens
aaataaatttggttctaat

SEQ ID NO: 5014396 - DNA, 23 bp, Homo sapiens
aaatcggatctggggctctggga

SEQ ID NO: 5014397 - DNA, 16 bp, Homo sapiens
aaatctatttattaat

SEQ ID NO: 5014398 - DNA, 17 bp, Homo sapiens
aaatctatttattaata

SEQ ID NO: 5014399 - DNA, 21 bp, Homo sapiens
aaatgaaagcagggacttgaa

SEQ ID NO: 5014400 - DNA, 19 bp, Homo sapiens
aaatgaatatctattaata

SEQ ID NO: 5014401 - DNA, 17 bp, Homo sapiens
aaatgtatcttattcac

SEQ ID NO: 5014402 - DNA, 15 bp, Homo sapiens
aaatttggttctaat

SEQ ID NO: 5014403 - DNA, 12 bp, Homo sapiens
aacacagtgtct

SEQ ID NO: 5014404 - DNA, 14 bp, Homo sapiens
aacagaagcttcca

SEQ ID NO: 5014405 - DNA, 22 bp, Homo sapiens
aacagtgattaccagggactga

SEQ ID NO: 5014406 - DNA, 18 bp, Homo sapiens
aacccaaatgttcatcaa

SEQ ID NO: 5014407 - DNA, 23 bp, Homo sapiens
aacccaaatgttcatcaatgaat

SEQ ID NO: 5014408 - DNA, 20 bp, Homo sapiens
aacctgagccccaaaaggta

SEQ ID NO: 5014409 - DNA, 19 bp, Homo sapiens
aactcatttgttaaaatta

SEQ ID NO: 5014410 - DNA, 16 bp, Homo sapiens
aacttgaatgtgtcag

SEQ ID NO: 5014411 - DNA, 13 bp, Homo sapiens
aagaaagaaaatc

SEQ ID NO: 5014412 - DNA, 14 bp, Homo sapiens
aagaaagaaaatca

SEQ ID NO: 5014413 - DNA, 16 bp, Homo sapiens
aagaagtgaaaatcta

SEQ ID NO: 5014414 - DNA, 13 bp, Homo sapiens
aagatgtagagga

SEQ ID NO: 5014415 - DNA, 19 bp, Homo sapiens
aagatgtagaggagaaact

SEQ ID NO: 5014416 - DNA, 17 bp, Homo sapiens
aagcaacccaaatgttc

SEQ ID NO: 5014417 - DNA, 15 bp, Homo sapiens
aagcagggacttgaa

SEQ ID NO: 5014418 - DNA, 13 bp, Homo sapiens
aagtatttataat

SEQ ID NO: 5014419 - DNA, 14 bp, Homo sapiens
aagtgaagtgatac

SEQ ID NO: 5014420 - DNA, 21 bp, Homo sapiens
aataaatgtatcttattcaca

SEQ ID NO: 5014421 - DNA, 13 bp, Homo sapiens
aatagcaactttt

SEQ ID NO: 5014422 - DNA, 17 bp, Homo sapiens
aatagcaacttttgtgt

SEQ ID NO: 5014423 - DNA, 14 bp, Homo sapiens
aatatatgtattat

SEQ ID NO: 5014424 - DNA, 14 bp, Homo sapiens
aatatatttttaga

SEQ ID NO: 5014425 - DNA, 18 bp, Homo sapiens
aatatatttttagactca

SEQ ID NO: 5014426 - DNA, 14 bp, Homo sapiens
aatatcctaataaa

SEQ ID NO: 5014427 - DNA, 14 bp, Homo sapiens
aatatctaatatat

SEQ ID NO: 5014428 - DNA, 22 bp, Homo sapiens
aatatctaatatatatgaataa

SEQ ID NO: 5014429 - DNA, 21 bp, Homo sapiens
aatatttaacattatttatat

SEQ ID NO: 5014430 - DNA, 12 bp, Homo sapiens
aatatttattac

SEQ ID NO: 5014431 - DNA, 16 bp, Homo sapiens
aatatttattacctct

SEQ ID NO: 5014432 - DNA, 19 bp, Homo sapiens
aatatttattattttcacc

SEQ ID NO: 5014433 - DNA, 23 bp, Homo sapiens
aatcctttgttttctgactaatt

SEQ ID NO: 5014434 - DNA, 23 bp, Homo sapiens
aatcggatctggggctctgggat

SEQ ID NO: 5014435 - DNA, 17 bp, Homo sapiens
aatctaaatctatttat

SEQ ID NO: 5014436 - DNA, 13 bp, Homo sapiens
aatgaaaatgaat

SEQ ID NO: 5014437 - DNA, 15 bp, Homo sapiens
aatgaatatctatta

SEQ ID NO: 5014438 - DNA, 19 bp, Homo sapiens
aatgaatatctattaatat

SEQ ID NO: 5014439 - DNA, 16 bp, Homo sapiens
aatggtttaaatggtc

SEQ ID NO: 5014440 - DNA, 13 bp, Homo sapiens
aatgtatcttatt

SEQ ID NO: 5014441 - DNA, 20 bp, Homo sapiens
aatgttcatcaatgaatgaa

SEQ ID NO: 5014442 - DNA, 23 bp, Homo sapiens
aattaggcaaggctatgtgatta

SEQ ID NO: 5014443 - DNA, 22 bp, Homo sapiens
aattccacttataggaattgac

SEQ ID NO: 5014444 - DNA, 21 bp, Homo sapiens
aattcctatatcctgtgactg

SEQ ID NO: 5014445 - DNA, 14 bp, Homo sapiens
aattcctctgggaa

SEQ ID NO: 5014446 - DNA, 18 bp, Homo sapiens
aatttatcttgtctctgg

SEQ ID NO: 5014447 - DNA, 19 bp, Homo sapiens
aatttatcttgtctctggg

SEQ ID NO: 5014448 - DNA, 12 bp, Homo sapiens
aatttattcaat

SEQ ID NO: 5014449 - DNA, 21 bp, Homo sapiens
aatttattcaattcctctggg

SEQ ID NO: 5014450 - DNA, 16 bp, Homo sapiens
aatttggttctaatag

SEQ ID NO: 5014451 - DNA, 21 bp, Homo sapiens
aattttgaataaataaatgta

SEQ ID NO: 5014452 - DNA, 17 bp, Homo sapiens
acaaatttacagagaca

SEQ ID NO: 5014453 - DNA, 18 bp, Homo sapiens
acaaatttacagagacag

SEQ ID NO: 5014454 - DNA, 13 bp, Homo sapiens
acaactgtgactg

SEQ ID NO: 5014455 - DNA, 13 bp, Homo sapiens
acaagaaatgaaa

SEQ ID NO: 5014456 - DNA, 22 bp, Homo sapiens
acaagaaatgaaagcagggact

SEQ ID NO: 5014457 - DNA, 13 bp, Homo sapiens
acagaagcttcca

SEQ ID NO: 5014458 - DNA, 17 bp, Homo sapiens
acaggaagtagaggagg

SEQ ID NO: 5014459 - DNA, 18 bp, Homo sapiens
acatagaattaacacatg

SEQ ID NO: 5014460 - DNA, 13 bp, Homo sapiens
acatcaacagata

SEQ ID NO: 5014461 - DNA, 20 bp, Homo sapiens
accaaggctgattaaaccaa

SEQ ID NO: 5014462 - DNA, 13 bp, Homo sapiens
accactgcagaag

SEQ ID NO: 5014463 - DNA, 15 bp, Homo sapiens
acccaaaaggcagaa

SEQ ID NO: 5014464 - DNA, 15 bp, Homo sapiens
acccacaagaaatga

SEQ ID NO: 5014465 - DNA, 22 bp, Homo sapiens
acctcaacccccatttctattt

SEQ ID NO: 5014466 - DNA, 13 bp, Homo sapiens
acctctgatacct

SEQ ID NO: 5014467 - DNA, 19 bp, Homo sapiens
acctgtttttaagctgttt

SEQ ID NO: 5014468 - DNA, 14 bp, Homo sapiens
accttattgtacct

SEQ ID NO: 5014469 - DNA, 17 bp, Homo sapiens
accttattgtacctctc

SEQ ID NO: 5014470 - DNA, 18 bp, Homo sapiens
accttattgtacctctct

SEQ ID NO: 5014471 - DNA, 19 bp, Homo sapiens
accttgaaaactttatgct

SEQ ID NO: 5014472 - DNA, 19 bp, Homo sapiens
acggacgaaccttgaaaac

SEQ ID NO: 5014473 - DNA, 15 bp, Homo sapiens
actcagttttaacta

SEQ ID NO: 5014474 - DNA, 20 bp, Homo sapiens
actcatcaatcaaataagta

SEQ ID NO: 5014475 - DNA, 19 bp, Homo sapiens
actccagtgagacagctct

SEQ ID NO: 5014476 - DNA, 15 bp, Homo sapiens
actctgtctcagtcc

SEQ ID NO: 5014477 - DNA, 17 bp, Homo sapiens
actctgtctcagtccat

SEQ ID NO: 5014478 - DNA, 17 bp, Homo sapiens
actcttaggaagagaaa

SEQ ID NO: 5014479 - DNA, 17 bp, Homo sapiens
actgagcttctctgtga

SEQ ID NO: 5014480 - DNA, 12 bp, Homo sapiens
actggaactctc

SEQ ID NO: 5014481 - DNA, 23 bp, Homo sapiens
acttataagtgaagtgatactat

SEQ ID NO: 5014482 - DNA, 19 bp, Homo sapiens
acttcattcttgaaagctg

SEQ ID NO: 5014483 - DNA, 21 bp, Homo sapiens
acttcattcttgaaagctgtg

SEQ ID NO: 5014484 - DNA, 21 bp, Homo sapiens
acttgaacccatatttgtaca

SEQ ID NO: 5014485 - DNA, 19 bp, Homo sapiens
acttgaacccgggaggcag

SEQ ID NO: 5014486 - DNA, 21 bp, Homo sapiens
acttgaacccgggaggcagag

SEQ ID NO: 5014487 - DNA, 23 bp, Homo sapiens
acttgaacccgggaggcagaggt

SEQ ID NO: 5014488 - DNA, 15 bp, Homo sapiens
acttgaatgtgtcag

SEQ ID NO: 5014489 - DNA, 18 bp, Homo sapiens
actttaacacagtgtctg

SEQ ID NO: 5014490 - DNA, 17 bp, Homo sapiens
actttatgctaagtgaa

SEQ ID NO: 5014491 - DNA, 12 bp, Homo sapiens
actttgggaggc

SEQ ID NO: 5014492 - DNA, 19 bp, Homo sapiens
acttttgtgtaatgaaaat

SEQ ID NO: 5014493 - DNA, 18 bp, Homo sapiens
agaaaccttattgtacct

SEQ ID NO: 5014494 - DNA, 13 bp, Homo sapiens
agaaactggaact

SEQ ID NO: 5014495 - DNA, 12 bp, Homo sapiens
agaaagaagccc

SEQ ID NO: 5014496 - DNA, 22 bp, Homo sapiens
agaacagtgattaccagggact

SEQ ID NO: 5014497 - DNA, 19 bp, Homo sapiens
agaagcaacccaaatgttc

SEQ ID NO: 5014498 - DNA, 17 bp, Homo sapiens
agaagtcaaggcttaga

SEQ ID NO: 5014499 - DNA, 16 bp, Homo sapiens
agaatatttattacct

SEQ ID NO: 5014500 - DNA, 19 bp, Homo sapiens
agaatatttattacctctg

SEQ ID NO: 5014501 - DNA, 18 bp, Homo sapiens
ctctgggtctcagtgtcc

SEQ ID NO: 5014502 - DNA, 13 bp, Homo sapiens
ctgaaagaggaat

SEQ ID NO: 5014503 - DNA, 16 bp, Homo sapiens
ctgagcgacagtgaga

SEQ ID NO: 5014504 - DNA, 20 bp, Homo sapiens
ctgagcgacagtgagactct

SEQ ID NO: 5014505 - DNA, 18 bp, Homo sapiens
ctgcaatatttgaatttt

SEQ ID NO: 5014506 - DNA, 13 bp, Homo sapiens
ctgccaatatcct

SEQ ID NO: 5014507 - DNA, 20 bp, Homo sapiens
ctgccaatatcctaataaaa

SEQ ID NO: 5014508 - DNA, 22 bp, Homo sapiens
ctgccaatatcctaataaaaag

SEQ ID NO: 5014509 - DNA, 18 bp, Homo sapiens
ctgcctgcaatatttgaa

SEQ ID NO: 5014510 - DNA, 20 bp, Homo sapiens
ctgcctgcaatatttgaatt

SEQ ID NO: 5014511 - DNA, 12 bp, Homo sapiens
ctggagctctgc

SEQ ID NO: 5014512 - DNA, 22 bp, Homo sapiens
ctggagcttgaaatagtgtctg

SEQ ID NO: 5014513 - DNA, 16 bp, Homo sapiens
ctggccaacggggtga

SEQ ID NO: 5014514 - DNA, 13 bp, Homo sapiens
ctggcctgctgga

SEQ ID NO: 5014515 - DNA, 19 bp, Homo sapiens
ctgggcttggggcttccta

SEQ ID NO: 5014516 - DNA, 14 bp, Homo sapiens
ctggggctctggga

SEQ ID NO: 5014517 - DNA, 22 bp, Homo sapiens
ctgggggggattgtaaaatggt

SEQ ID NO: 5014518 - DNA, 17 bp, Homo sapiens
ctgggtctcagtgtcct

SEQ ID NO: 5014519 - DNA, 22 bp, Homo sapiens
ctgggtgacagagcaagactct

SEQ ID NO: 5014520 - DNA, 17 bp, Homo sapiens
ctggtgcttccaaatat

SEQ ID NO: 5014521 - DNA, 23 bp, Homo sapiens
ctgtggccagcttgttatttata

SEQ ID NO: 5014522 - DNA, 15 bp, Homo sapiens
ctgttgagctgtttt

SEQ ID NO: 5014523 - DNA, 20 bp, Homo sapiens
cttaaaaatggtttaaatgg

SEQ ID NO: 5014524 - DNA, 21 bp, Homo sapiens
cttaactcattgcaacctcca

SEQ ID NO: 5014525 - DNA, 18 bp, Homo sapiens
cttaatgccactaaattg

SEQ ID NO: 5014526 - DNA, 18 bp, Homo sapiens
cttagaccctcatgctgc

SEQ ID NO: 5014527 - DNA, 19 bp, Homo sapiens
cttagaccctcatgctgcc

SEQ ID NO: 5014528 - DNA, 22 bp, Homo sapiens
cttagaccctcatgctgccaat

SEQ ID NO: 5014529 - DNA, 17 bp, Homo sapiens
cttaggaagagaaacca

SEQ ID NO: 5014530 - DNA, 22 bp, Homo sapiens
cttaggaagagaaaccagggag

SEQ ID NO: 5014531 - DNA, 13 bp, Homo sapiens
cttatagaatatt

SEQ ID NO: 5014532 - DNA, 19 bp, Homo sapiens
cttctgggttcaagcgatt

SEQ ID NO: 5014533 - DNA, 15 bp, Homo sapiens
cttgaacccaggaga

SEQ ID NO: 5014534 - DNA, 14 bp, Homo sapiens
cttgaacccgggag

SEQ ID NO: 5014535 - DNA, 19 bp, Homo sapiens
cttgaacccgggaggcaga

SEQ ID NO: 5014536 - DNA, 21 bp, Homo sapiens
cttgcatggtttagaaagctt

SEQ ID NO: 5014537 - DNA, 13 bp, Homo sapiens
cttggcccaggag

SEQ ID NO: 5014538 - DNA, 15 bp, Homo sapiens
cttggcccaggagtt

SEQ ID NO: 5014539 - DNA, 16 bp, Homo sapiens
cttggcccaggagttt

SEQ ID NO: 5014540 - DNA, 20 bp, Homo sapiens
cttggcccaggagtttggcc

SEQ ID NO: 5014541 - DNA, 23 bp, Homo sapiens
cttggcccaggagtttggccaga

SEQ ID NO: 5014542 - DNA, 23 bp, Homo sapiens
cttggtctcagtgtcaatgcagc

SEQ ID NO: 5014543 - DNA, 16 bp, Homo sapiens
ctttaacacagtgtct

SEQ ID NO: 5014544 - DNA, 23 bp, Homo sapiens
ctttctagctgttgagctgtttt

SEQ ID NO: 5014545 - DNA, 16 bp, Homo sapiens
cttttgtgtaatgaaa

SEQ ID NO: 5014546 - DNA, 20 bp, Homo sapiens
gaaaatgaatatctattaat

SEQ ID NO: 5014547 - DNA, 14 bp, Homo sapiens
gaaaccctgtctct

SEQ ID NO: 5014548 - DNA, 17 bp, Homo sapiens
gaaatgaaagcagggac

SEQ ID NO: 5014549 - DNA, 18 bp, Homo sapiens
gaacaaatttacagagac

SEQ ID NO: 5014550 - DNA, 17 bp, Homo sapiens
gaacccgggaggcagag

SEQ ID NO: 5014551 - DNA, 19 bp, Homo sapiens
gaacccgggaggcagaggt

SEQ ID NO: 5014552 - DNA, 18 bp, Homo sapiens
gaagtcaaggcttagacc

SEQ ID NO: 5014553 - DNA, 17 bp, Homo sapiens
gaagttgcagtgagctg

SEQ ID NO: 5014554 - DNA, 17 bp, Homo sapiens
gaatatttattacctct

SEQ ID NO: 5014555 - DNA, 21 bp, Homo sapiens
gaatatttattacctctgata

SEQ ID NO: 5014556 - DNA, 14 bp, Homo sapiens
gaattaacacatga

SEQ ID NO: 5014557 - DNA, 16 bp, Homo sapiens
gaattgacccacaaga

SEQ ID NO: 5014558 - DNA, 17 bp, Homo sapiens
gaatttattcaattcct

SEQ ID NO: 5014559 - DNA, 14 bp, Homo sapiens
gacagaaagcagaa

SEQ ID NO: 5014560 - DNA, 20 bp, Homo sapiens
gacatagaattaacacatga

SEQ ID NO: 5014561 - DNA, 14 bp, Homo sapiens
gaccacgctttcta

SEQ ID NO: 5014562 - DNA, 17 bp, Homo sapiens
gaccagccaacctgggg

SEQ ID NO: 5014563 - DNA, 23 bp, Homo sapiens
gacccagccccttgagaaacctt

SEQ ID NO: 5014564 - DNA, 18 bp, Homo sapiens
gaccctcatgctgccaat

SEQ ID NO: 5014565 - DNA, 21 bp, Homo sapiens
gaccctcatgctgccaatatc

SEQ ID NO: 5014566 - DNA, 15 bp, Homo sapiens
gacctgctgtttcct

SEQ ID NO: 5014567 - DNA, 23 bp, Homo sapiens
gagaaaccttattgtacctctct

SEQ ID NO: 5014568 - DNA, 14 bp, Homo sapiens
gagcaagactctgt

SEQ ID NO: 5014569 - DNA, 14 bp, Homo sapiens
gagcttctctgtga

SEQ ID NO: 5014570 - DNA, 13 bp, Homo sapiens
gaggcaagagaat

SEQ ID NO: 5014571 - DNA, 23 bp, Homo sapiens
gagtgaacaaatttacagagaca

SEQ ID NO: 5014572 - DNA, 20 bp, Homo sapiens
gagtggcgcgcgccaccacg

SEQ ID NO: 5014573 - DNA, 20 bp, Homo sapiens
gatatgtacctaacgaagta

SEQ ID NO: 5014574 - DNA, 18 bp, Homo sapiens
gatctggggctctgggat

SEQ ID NO: 5014575 - DNA, 21 bp, Homo sapiens
gatggaagttgcagtgagctg

SEQ ID NO: 5014576 - DNA, 18 bp, Homo sapiens
gatgtagaggagaaactg

SEQ ID NO: 5014577 - DNA, 13 bp, Homo sapiens
gattttaattttg

SEQ ID NO: 5014578 - DNA, 19 bp, Homo sapiens
gcaagagaattgcttgaac

SEQ ID NO: 5014579 - DNA, 18 bp, Homo sapiens
gcaatatttgaattttaa

SEQ ID NO: 5014580 - DNA, 21 bp, Homo sapiens
gcacctgtaatcccagctact

SEQ ID NO: 5014581 - DNA, 18 bp, Homo sapiens
gcagaggttgcagtgagc

SEQ ID NO: 5014582 - DNA, 14 bp, Homo sapiens
gcagccaacctaag

SEQ ID NO: 5014583 - DNA, 20 bp, Homo sapiens
gcagccccgtggggttcctc

SEQ ID NO: 5014584 - DNA, 19 bp, Homo sapiens
gcagggacttgaacccata

SEQ ID NO: 5014585 - DNA, 16 bp, Homo sapiens
gcagtgcttggcccag

SEQ ID NO: 5014586 - DNA, 18 bp, Homo sapiens
gcagtgcttggcccagga

SEQ ID NO: 5014587 - DNA, 13 bp, Homo sapiens
gccaatatcctaa

SEQ ID NO: 5014588 - DNA, 16 bp, Homo sapiens
gccagaagtcaaggct

SEQ ID NO: 5014589 - DNA, 21 bp, Homo sapiens
gccatgctggccaggctggtc

SEQ ID NO: 5014590 - DNA, 13 bp, Homo sapiens
gcccaggagtttg

SEQ ID NO: 5014591 - DNA, 15 bp, Homo sapiens
gcccaggagtttggc

SEQ ID NO: 5014592 - DNA, 20 bp, Homo sapiens
gcctgggtgacagagcaaga

SEQ ID NO: 5014593 - DNA, 22 bp, Homo sapiens
gcgacagtgagactctgtctca

SEQ ID NO: 5014594 - DNA, 13 bp, Homo sapiens
gctacttgggagg

SEQ ID NO: 5014595 - DNA, 21 bp, Homo sapiens
gctgattaaaccaaggctaga

SEQ ID NO: 5014596 - DNA, 14 bp, Homo sapiens
gctggagctctgcc

SEQ ID NO: 5014597 - DNA, 13 bp, Homo sapiens
gctgtttccatag

SEQ ID NO: 5014598 - DNA, 17 bp, Homo sapiens
gctgttttccctgacct

SEQ ID NO: 5014599 - DNA, 19 bp, Homo sapiens
gcttctctgtgaacgattt

SEQ ID NO: 5014600 - DNA, 22 bp, Homo sapiens
gcttctctgtgaacgatttaga

SEQ ID NO: 5014601 - DNA, 13 bp, Homo sapiens
gcttgaacccagg

SEQ ID NO: 5014602 - DNA, 13 bp, Homo sapiens
gcttggcccagga

SEQ ID NO: 5014603 - DNA, 20 bp, Homo sapiens
ggagccaacagaagcttcca

SEQ ID NO: 5014604 - DNA, 14 bp, Homo sapiens
ggagtttggccaga

SEQ ID NO: 5014605 - DNA, 15 bp, Homo sapiens
ggattgtaaaatggt

SEQ ID NO: 5014606 - DNA, 20 bp, Homo sapiens
ggcacttgggacaaaaacaa

SEQ ID NO: 5014607 - DNA, 22 bp, Homo sapiens
ggcacttgggacaaaaacaaac

SEQ ID NO: 5014608 - DNA, 21 bp, Homo sapiens
ggcagtgcttggcccaggagt

SEQ ID NO: 5014609 - DNA, 11 bp, Homo sapiens
ggcccaggagt

SEQ ID NO: 5014610 - DNA, 20 bp, Homo sapiens
ggcccaggagtttggccaga

SEQ ID NO: 5014611 - DNA, 21 bp, Homo sapiens
ggcccaggagtttggccagaa

SEQ ID NO: 5014612 - DNA, 22 bp, Homo sapiens
ggcccaggagtttggccagaag

SEQ ID NO: 5014613 - DNA, 18 bp, Homo sapiens
ggcgtgagccaccaaacc

SEQ ID NO: 5014614 - DNA, 20 bp, Homo sapiens
ggctggagtgcagtggcgca

SEQ ID NO: 5014615 - DNA, 16 bp, Homo sapiens
ggcttagaccctcatg

SEQ ID NO: 5014616 - DNA, 22 bp, Homo sapiens
ggcttagaccctcatgctgcca

SEQ ID NO: 5014617 - DNA, 15 bp, Homo sapiens
ggcttggggcttcct

SEQ ID NO: 5014618 - DNA, 21 bp, Homo sapiens
ggtcaggagttcctaaccagc

SEQ ID NO: 5014619 - DNA, 17 bp, Homo sapiens
gtaaaatggagacacca

SEQ ID NO: 5014620 - DNA, 16 bp, Homo sapiens
gtaatcccagctactt

SEQ ID NO: 5014621 - DNA, 20 bp, Homo sapiens
gtaatcccagctacttggga

SEQ ID NO: 5014622 - DNA, 17 bp, Homo sapiens
gtaatgaaaatgaatat

SEQ ID NO: 5014623 - DNA, 13 bp, Homo sapiens
gtattttaatcac

SEQ ID NO: 5014624 - DNA, 15 bp, Homo sapiens
ataagtgaagtgata

SEQ ID NO: 5014625 - DNA, 22 bp, Homo sapiens
ataattcctatatcctgtgact

SEQ ID NO: 5014626 - DNA, 22 bp, Homo sapiens
atactcttaggaagagaaacca

SEQ ID NO: 5014627 - DNA, 19 bp, Homo sapiens
atagagtgggacagttcct

SEQ ID NO: 5014628 - DNA, 22 bp, Homo sapiens
atagcagattttaattttgaat

SEQ ID NO: 5014629 - DNA, 15 bp, Homo sapiens
atagcagcttattca

SEQ ID NO: 5014630 - DNA, 23 bp, Homo sapiens
atagcatctcaggagatttcatg

SEQ ID NO: 5014631 - DNA, 21 bp, Homo sapiens
ataggaattgacccacaagaa

SEQ ID NO: 5014632 - DNA, 20 bp, Homo sapiens
atagttgtaccgcaatgtga

SEQ ID NO: 5014633 - DNA, 18 bp, Homo sapiens
atatcctaataaaaaggt

SEQ ID NO: 5014634 - DNA, 13 bp, Homo sapiens
atatcctgtgact

SEQ ID NO: 5014635 - DNA, 14 bp, Homo sapiens
atatcctgtgactg

SEQ ID NO: 5014636 - DNA, 20 bp, Homo sapiens
atatcctgtgactgtctcac

SEQ ID NO: 5014637 - DNA, 14 bp, Homo sapiens
atatctattaatat

SEQ ID NO: 5014638 - DNA, 22 bp, Homo sapiens
atatttaacattatttatatgg

SEQ ID NO: 5014639 - DNA, 20 bp, Homo sapiens
atattttttgttaaatgatt

SEQ ID NO: 5014640 - DNA, 17 bp, Homo sapiens
atcaaataagtatttat

SEQ ID NO: 5014641 - DNA, 20 bp, Homo sapiens
catagcagcttattcacaag

SEQ ID NO: 5014642 - DNA, 19 bp, Homo sapiens
catcaatcaaataagtatt

SEQ ID NO: 5014643 - DNA, 18 bp, Homo sapiens
catcaatgaatgaatgaa

SEQ ID NO: 5014644 - DNA, 19 bp, Homo sapiens
catgaggtactgagagtga

SEQ ID NO: 5014645 - DNA, 21 bp, Homo sapiens
catgctgccaatatcctaata

SEQ ID NO: 5014646 - DNA, 20 bp, Homo sapiens
catgtgattaccctctgggt

SEQ ID NO: 5014647 - DNA, 14 bp, Homo sapiens
cattatttatatgg

SEQ ID NO: 5014648 - DNA, 23 bp, Homo sapiens
cattatttatatggggaatatat

SEQ ID NO: 5014649 - DNA, 18 bp, Homo sapiens
cattgtttgtctgtcttc

SEQ ID NO: 5014650 - DNA, 14 bp, Homo sapiens
catttctatttatt

SEQ ID NO: 5014651 - DNA, 23 bp, Homo sapiens
catttctatttatttactgagct

SEQ ID NO: 5014652 - DNA, 17 bp, Homo sapiens
gacagttcctgagacca

SEQ ID NO: 5014653 - DNA, 21 bp, Homo sapiens
gaccacgctttctagctgttg

SEQ ID NO: 5014654 - DNA, 16 bp, Homo sapiens
gacccaaaaggcagaa

SEQ ID NO: 5014655 - DNA, 19 bp, Homo sapiens
gacccaaaaggcagaagca

SEQ ID NO: 5014656 - DNA, 14 bp, Homo sapiens
gaccctcatgctgc

SEQ ID NO: 5014657 - DNA, 16 bp, Homo sapiens
gactgaggggagggga

SEQ ID NO: 5014658 - DNA, 14 bp, Homo sapiens
gagacaccaccacc

SEQ ID NO: 5014659 - DNA, 17 bp, Homo sapiens
tgtctctactaaaaata

SEQ ID NO: 5014660 - DNA, 15 bp, Homo sapiens
tgtcttcatagcaga

SEQ ID NO: 5014661 - DNA, 16 bp, Homo sapiens
aatgtatcttattcac

SEQ ID NO: 5014662 - DNA, 11 bp, Homo sapiens
aatgtgatatg

SEQ ID NO: 5014663 - DNA, 20 bp, Homo sapiens
aattaggcaaggctatgtga

SEQ ID NO: 5014664 - DNA, 20 bp, Homo sapiens
aattatcaatatctaatata

SEQ ID NO: 5014665 - DNA, 16 bp, Homo sapiens
aattgacccacaagaa

SEQ ID NO: 5014666 - DNA, 19 bp, Homo sapiens
aattgacccacaagaaatg

SEQ ID NO: 5014667 - DNA, 22 bp, Homo sapiens
aattgacccacaagaaatgaaa

SEQ ID NO: 5014668 - DNA, 18 bp, Homo sapiens
aatttacagagacagaaa

SEQ ID NO: 5014669 - DNA, 22 bp, Homo sapiens
aatttggttctaatagaactca

SEQ ID NO: 5014670 - DNA, 17 bp, Homo sapiens
aatttggttctaggccg

SEQ ID NO: 5014671 - DNA, 19 bp, Homo sapiens
acaaatttacagagacaga

SEQ ID NO: 5014672 - DNA, 11 bp, Homo sapiens
acaactgtgac

SEQ ID NO: 5014673 - DNA, 15 bp, Homo sapiens
acaagaaatgaaagc

SEQ ID NO: 5014674 - DNA, 14 bp, Homo sapiens
acacagtgtctggc

SEQ ID NO: 5014675 - DNA, 15 bp, Homo sapiens
acaccaatattcata

SEQ ID NO: 5014676 - DNA, 22 bp, Homo sapiens
acactatggtatttgagtgttt

SEQ ID NO: 5014677 - DNA, 14 bp, Homo sapiens
acactccagtgaga

SEQ ID NO: 5014678 - DNA, 15 bp, Homo sapiens
acacttaaaaatggt

SEQ ID NO: 5014679 - DNA, 19 bp, Homo sapiens
acagaacttgaatgtgtca

SEQ ID NO: 5014680 - DNA, 20 bp, Homo sapiens
acagaacttgaatgtgtcag

SEQ ID NO: 5014681 - DNA, 14 bp, Homo sapiens
acagtgagactctg

SEQ ID NO: 5014682 - DNA, 18 bp, Homo sapiens
acagtgagactctgtctc

SEQ ID NO: 5014683 - DNA, 20 bp, Homo sapiens
acagtgattaccagggactg

SEQ ID NO: 5014684 - DNA, 13 bp, Homo sapiens
acataaattagag

SEQ ID NO: 5014685 - DNA, 14 bp, Homo sapiens
acatagaattaaca

SEQ ID NO: 5014686 - DNA, 20 bp, Homo sapiens
acatgaggtactgagagtga

SEQ ID NO: 5014687 - DNA, 23 bp, Homo sapiens
acatgaggtactgagagtgaaca

SEQ ID NO: 5014688 - DNA, 19 bp, Homo sapiens
accaaggctgattaaacca

SEQ ID NO: 5014689 - DNA, 13 bp, Homo sapiens
accacttcattct

SEQ ID NO: 5014690 - DNA, 14 bp, Homo sapiens
accagggactgagg

SEQ ID NO: 5014691 - DNA, 13 bp, Homo sapiens
acccaaaaggcag

SEQ ID NO: 5014692 - DNA, 20 bp, Homo sapiens
acccaaatgttcatcaatga

SEQ ID NO: 5014693 - DNA, 17 bp, Homo sapiens
acccagccccttgagaa

SEQ ID NO: 5014694 - DNA, 21 bp, Homo sapiens
acccagccccttgagaaacct

SEQ ID NO: 5014695 - DNA, 18 bp, Homo sapiens
acccccatttctatttat

SEQ ID NO: 5014696 - DNA, 22 bp, Homo sapiens
accctctgggtctcagtgtcct

SEQ ID NO: 5014697 - DNA, 12 bp, Homo sapiens
acctgcaggcgt

SEQ ID NO: 5014698 - DNA, 15 bp, Homo sapiens
acctgtaatcccagc

SEQ ID NO: 5014699 - DNA, 19 bp, Homo sapiens
acctgtaatcccagctact

SEQ ID NO: 5014700 - DNA, 15 bp, Homo sapiens
actagaatttattca

SEQ ID NO: 5014701 - DNA, 16 bp, Homo sapiens
actatggtatttgagt

SEQ ID NO: 5014702 - DNA, 18 bp, Homo sapiens
actctatagactctagga

SEQ ID NO: 5014703 - DNA, 18 bp, Homo sapiens
actctgtctcagtccatg

SEQ ID NO: 5014704 - DNA, 20 bp, Homo sapiens
actctgtctcagtccatgaa

SEQ ID NO: 5014705 - DNA, 20 bp, Homo sapiens
actcttaggaagagaaacca

SEQ ID NO: 5014706 - DNA, 23 bp, Homo sapiens
actgctacaaatactcttaggaa

SEQ ID NO: 5014707 - DNA, 13 bp, Homo sapiens
acttaaaaatggt

SEQ ID NO: 5014708 - DNA, 21 bp, Homo sapiens
acttcagacatagaattaaca

SEQ ID NO: 5014709 - DNA, 14 bp, Homo sapiens
acttcattcttgaa

SEQ ID NO: 5014710 - DNA, 12 bp, Homo sapiens
actttatgctaa

SEQ ID NO: 5014711 - DNA, 18 bp, Homo sapiens
acttttgtgtaatgaaaa

SEQ ID NO: 5014712 - DNA, 16 bp, Homo sapiens
agaaaatcaggctggc

SEQ ID NO: 5014713 - DNA, 16 bp, Homo sapiens
agaaaccttattgtac

SEQ ID NO: 5014714 - DNA, 20 bp, Homo sapiens
agaaagcagaacagtgatta

SEQ ID NO: 5014715 - DNA, 17 bp, Homo sapiens
agaactcagttttaact

SEQ ID NO: 5014716 - DNA, 18 bp, Homo sapiens
agaagcccaatattataa

SEQ ID NO: 5014717 - DNA, 18 bp, Homo sapiens
agaagcttccattccaag

SEQ ID NO: 5014718 - DNA, 16 bp, Homo sapiens
agaagtcaaggcttag

SEQ ID NO: 5014719 - DNA, 15 bp, Homo sapiens
agaattaacacatga

SEQ ID NO: 5014720 - DNA, 13 bp, Homo sapiens
agaatttattcaa

SEQ ID NO: 5014721 - DNA, 17 bp, Homo sapiens
agacatcaacagataaa

SEQ ID NO: 5014722 - DNA, 18 bp, Homo sapiens
agacatcaacagataaat

SEQ ID NO: 5014723 - DNA, 17 bp, Homo sapiens
agacccaaaaggcagaa

SEQ ID NO: 5014724 - DNA, 23 bp, Homo sapiens
agacggggtttgccatgctggcc

SEQ ID NO: 5014725 - DNA, 14 bp, Homo sapiens
agagacagaaagca

SEQ ID NO: 5014726 - DNA, 15 bp, Homo sapiens
agagacagaaagcag

SEQ ID NO: 5014727 - DNA, 14 bp, Homo sapiens
agagtgaacaaatt

SEQ ID NO: 5014728 - DNA, 23 bp, Homo sapiens
agatggaagttgcagtgagctga

SEQ ID NO: 5014729 - DNA, 12 bp, Homo sapiens
agcaagactctg

SEQ ID NO: 5014730 - DNA, 14 bp, Homo sapiens
agcactttgggagg

SEQ ID NO: 5014731 - DNA, 17 bp, Homo sapiens
agccccttgagaaacct

SEQ ID NO: 5014732 - DNA, 22 bp, Homo sapiens
agcctgaaagaggaatgaagta

SEQ ID NO: 5014733 - DNA, 19 bp, Homo sapiens
agcctgagcgacagtgaga

SEQ ID NO: 5014734 - DNA, 15 bp, Homo sapiens
agcgacagtgagact

SEQ ID NO: 5014735 - DNA, 16 bp, Homo sapiens
agctacttgggaggct

SEQ ID NO: 5014736 - DNA, 17 bp, Homo sapiens
agctacttgggaggctg

SEQ ID NO: 5014737 - DNA, 23 bp, Homo sapiens
agctctgcccatcctgcccctga

SEQ ID NO: 5014738 - DNA, 15 bp, Homo sapiens
agctgttgagctgtt

SEQ ID NO: 5014739 - DNA, 14 bp, Homo sapiens
agctgtttccatag

SEQ ID NO: 5014740 - DNA, 14 bp, Homo sapiens
agcttctctgtgaa

SEQ ID NO: 5014741 - DNA, 19 bp, Homo sapiens
agcttgaaatagtgtctga

SEQ ID NO: 5014742 - DNA, 18 bp, Homo sapiens
aggagaaactggaactct

SEQ ID NO: 5014743 - DNA, 19 bp, Homo sapiens
aggagttcctaaccagcct

SEQ ID NO: 5014744 - DNA, 14 bp, Homo sapiens
aggagtttggccag

SEQ ID NO: 5014745 - DNA, 15 bp, Homo sapiens
aggagtttggccaga

SEQ ID NO: 5014746 - DNA, 12 bp, Homo sapiens
aggcaagagaat

SEQ ID NO: 5014747 - DNA, 19 bp, Homo sapiens
aggcagccaacctaagcaa

SEQ ID NO: 5014748 - DNA, 21 bp, Homo sapiens
aggctagaaccacctgcctat

SEQ ID NO: 5014749 - DNA, 18 bp, Homo sapiens
aggggagcatgggaagtg

SEQ ID NO: 5014750 - DNA, 20 bp, Homo sapiens
agggtttatgtttaggatgt

SEQ ID NO: 5014751 - DNA, 18 bp, Homo sapiens
aggtgaccctgatgaaaa

SEQ ID NO: 5014752 - DNA, 22 bp, Homo sapiens
aggttaagcactttaacacagt

SEQ ID NO: 5014753 - DNA, 13 bp, Homo sapiens
agtactcatacat

SEQ ID NO: 5014754 - DNA, 14 bp, Homo sapiens
agtcaaggcttaga

SEQ ID NO: 5014755 - DNA, 20 bp, Homo sapiens
agtgatactatccagttact

SEQ ID NO: 5014756 - DNA, 18 bp, Homo sapiens
agtgattaccagggactg

SEQ ID NO: 5014757 - DNA, 12 bp, Homo sapiens
agtgcttggccc

SEQ ID NO: 5014758 - DNA, 18 bp, Homo sapiens
agtgcttggcccaggagt

SEQ ID NO: 5014759 - DNA, 13 bp, Homo sapiens
agtgctttaatgg

SEQ ID NO: 5014760 - DNA, 15 bp, Homo sapiens
agtgggacagttcct

SEQ ID NO: 5014761 - DNA, 22 bp, Homo sapiens
agtgtctcggagggattcccct

SEQ ID NO: 5014762 - DNA, 16 bp, Homo sapiens
agttctgcagataaac

SEQ ID NO: 5014763 - DNA, 12 bp, Homo sapiens
agtttggccaga

SEQ ID NO: 5014764 - DNA, 15 bp, Homo sapiens
ataaatgtatcttat

SEQ ID NO: 5014765 - DNA, 19 bp, Homo sapiens
ataagtatttataatagca

SEQ ID NO: 5014766 - DNA, 18 bp, Homo sapiens
atcaaataagtatttata

SEQ ID NO: 5014767 - DNA, 19 bp, Homo sapiens
atcaaataagtatttataa

SEQ ID NO: 5014768 - DNA, 13 bp, Homo sapiens
atcaatcaaataa

SEQ ID NO: 5014769 - DNA, 13 bp, Homo sapiens
atcctgcccctga

SEQ ID NO: 5014770 - DNA, 21 bp, Homo sapiens
atcggatctggggctctggga

SEQ ID NO: 5014771 - DNA, 13 bp, Homo sapiens
atctaaatctatt

SEQ ID NO: 5014772 - DNA, 18 bp, Homo sapiens
atctaaatctatttatta

SEQ ID NO: 5014773 - DNA, 20 bp, Homo sapiens
atctaaatctatttattaat

SEQ ID NO: 5014774 - DNA, 20 bp, Homo sapiens
atctaatatatatgaataaa

SEQ ID NO: 5014775 - DNA, 18 bp, Homo sapiens
atctacactccagtgaga

SEQ ID NO: 5014776 - DNA, 19 bp, Homo sapiens
atctacactccagtgagac

SEQ ID NO: 5014777 - DNA, 14 bp, Homo sapiens
atctattaatatat

SEQ ID NO: 5014778 - DNA, 13 bp, Homo sapiens
atctatttattaa

SEQ ID NO: 5014779 - DNA, 15 bp, Homo sapiens
atctatttattaata

SEQ ID NO: 5014780 - DNA, 19 bp, Homo sapiens
atctatttattaatattta

SEQ ID NO: 5014781 - DNA, 14 bp, Homo sapiens
atcttgtctctggg

SEQ ID NO: 5014782 - DNA, 18 bp, Homo sapiens
atgaatatctattaatat

SEQ ID NO: 5014783 - DNA, 15 bp, Homo sapiens
atgaggtactgagag

SEQ ID NO: 5014784 - DNA, 15 bp, Homo sapiens
atgccactaaattga

SEQ ID NO: 5014785 - DNA, 13 bp, Homo sapiens
atgctaagtgaaa

SEQ ID NO: 5014786 - DNA, 17 bp, Homo sapiens
atgctgccaatatccta

SEQ ID NO: 5014787 - DNA, 20 bp, Homo sapiens
atgctgccaatatcctaata

SEQ ID NO: 5014788 - DNA, 22 bp, Homo sapiens
atgctgccaatatcctaataaa

SEQ ID NO: 5014789 - DNA, 19 bp, Homo sapiens
atggctaagcaaaatgtga

SEQ ID NO: 5014790 - DNA, 16 bp, Homo sapiens
atggtggcgcgcacct

SEQ ID NO: 5014791 - DNA, 19 bp, Homo sapiens
atgtatattttatatcaat

SEQ ID NO: 5014792 - DNA, 16 bp, Homo sapiens
atgtattatttataat

SEQ ID NO: 5014793 - DNA, 14 bp, Homo sapiens
atgttacattgttt

SEQ ID NO: 5014794 - DNA, 18 bp, Homo sapiens
atgttcatcaatgaatga

SEQ ID NO: 5014795 - DNA, 19 bp, Homo sapiens
atgttcatcaatgaatgaa

SEQ ID NO: 5014796 - DNA, 21 bp, Homo sapiens
attaatatatgtattatttat

SEQ ID NO: 5014797 - DNA, 18 bp, Homo sapiens
attagccgggcatggtgg

SEQ ID NO: 5014798 - DNA, 21 bp, Homo sapiens
attaggcaaggctatgtgatt

SEQ ID NO: 5014799 - DNA, 22 bp, Homo sapiens
attataatttttttcaatattt

SEQ ID NO: 5014800 - DNA, 17 bp, Homo sapiens
attatcaatatctaata

SEQ ID NO: 5014801 - DNA, 13 bp, Homo sapiens
attatttatatgg

SEQ ID NO: 5014802 - DNA, 18 bp, Homo sapiens
attcaattcctctgggaa

SEQ ID NO: 5014803 - DNA, 13 bp, Homo sapiens
attcctctgggaa

SEQ ID NO: 5014804 - DNA, 19 bp, Homo sapiens
attgacacttaaaaatggt

SEQ ID NO: 5014805 - DNA, 19 bp, Homo sapiens
attgagcacctgcaggcgt

SEQ ID NO: 5014806 - DNA, 14 bp, Homo sapiens
attgtaaaatggtg

SEQ ID NO: 5014807 - DNA, 12 bp, Homo sapiens
attgtacctctc

SEQ ID NO: 5014808 - DNA, 20 bp, Homo sapiens
attgtttgtctgtcttcata

SEQ ID NO: 5014809 - DNA, 17 bp, Homo sapiens
atttaaaaaaaaacctg

SEQ ID NO: 5014810 - DNA, 13 bp, Homo sapiens
atttactgagctt

SEQ ID NO: 5014811 - DNA, 20 bp, Homo sapiens
atttactgagcttctctgtg

SEQ ID NO: 5014812 - DNA, 21 bp, Homo sapiens
atttactgagcttctctgtga

SEQ ID NO: 5014813 - DNA, 21 bp, Homo sapiens
atttattattttcacctgttt

SEQ ID NO: 5014814 - DNA, 19 bp, Homo sapiens
atttattcaattcctctgg

SEQ ID NO: 5014815 - DNA, 24 bp, Homo sapiens
atttatttactgagcttctctgtg

SEQ ID NO: 5014816 - DNA, 12 bp, Homo sapiens
atttcacttgat

SEQ ID NO: 5014817 - DNA, 13 bp, Homo sapiens
atttctatttatt

SEQ ID NO: 5014818 - DNA, 21 bp, Homo sapiens
atttgttaaaattatcaatat

SEQ ID NO: 5014819 - DNA, 19 bp, Homo sapiens
attttaaatctaaatctat

SEQ ID NO: 5014820 - DNA, 21 bp, Homo sapiens
attttatatcaatttaaaaaa

SEQ ID NO: 5014821 - DNA, 21 bp, Homo sapiens
attttcacctgtttttaagct

SEQ ID NO: 5014822 - DNA, 18 bp, Homo sapiens
attttttgttaaatgatt

SEQ ID NO: 5014823 - DNA, 20 bp, Homo sapiens
caaaaaaaaaaaaaaattag

SEQ ID NO: 5014824 - DNA, 15 bp, Homo sapiens
caaaaggcagaagca

SEQ ID NO: 5014825 - DNA, 17 bp, Homo sapiens
caaataagtatttataa

SEQ ID NO: 5014826 - DNA, 14 bp, Homo sapiens
caaatactcttagg

SEQ ID NO: 5014827 - DNA, 14 bp, Homo sapiens
caaatgttcatcaa

SEQ ID NO: 5014828 - DNA, 14 bp, Homo sapiens
caaatttacagaga

SEQ ID NO: 5014829 - DNA, 19 bp, Homo sapiens
caacccaaatgttcatcaa

SEQ ID NO: 5014830 - DNA, 16 bp, Homo sapiens
caacccccatttctat

SEQ ID NO: 5014831 - DNA, 20 bp, Homo sapiens
caacttttgtgtaatgaaaa

SEQ ID NO: 5014832 - DNA, 22 bp, Homo sapiens
caagagaattgcttgaacccag

SEQ ID NO: 5014833 - DNA, 21 bp, Homo sapiens
caagcctgaccacgctttcta

SEQ ID NO: 5014834 - DNA, 15 bp, Homo sapiens
caaggcttagaccct

SEQ ID NO: 5014835 - DNA, 21 bp, Homo sapiens
caatatcttttttttaataaa

SEQ ID NO: 5014836 - DNA, 13 bp, Homo sapiens
caatattataatt

SEQ ID NO: 5014837 - DNA, 22 bp, Homo sapiens
caatattataatttttttcaat

SEQ ID NO: 5014838 - DNA, 15 bp, Homo sapiens
caatatttgaatttt

SEQ ID NO: 5014839 - DNA, 22 bp, Homo sapiens
caatgtgacttaatgccactaa

SEQ ID NO: 5014840 - DNA, 13 bp, Homo sapiens
caattcctctggg

SEQ ID NO: 5014841 - DNA, 12 bp, Homo sapiens
caatttaaaaaa

SEQ ID NO: 5014842 - DNA, 23 bp, Homo sapiens
cacaagaaatgaaagcagggact

SEQ ID NO: 5014843 - DNA, 19 bp, Homo sapiens
cacaggctccaaactggag

SEQ ID NO: 5014844 - DNA, 18 bp, Homo sapiens
caccagggcctggctggg

SEQ ID NO: 5014845 - DNA, 19 bp, Homo sapiens
cacctgtttttaagctgtt

SEQ ID NO: 5014846 - DNA, 20 bp, Homo sapiens
cacctgtttttaagctgttt

SEQ ID NO: 5014847 - DNA, 13 bp, Homo sapiens
cactccagcctga

SEQ ID NO: 5014848 - DNA, 22 bp, Homo sapiens
cactggttcttcttggtctcag

SEQ ID NO: 5014849 - DNA, 20 bp, Homo sapiens
cacttgaacccgggaggcag

SEQ ID NO: 5014850 - DNA, 18 bp, Homo sapiens
cacttgaggtcaggagtt

SEQ ID NO: 5014851 - DNA, 22 bp, Homo sapiens
cacttgaggtcaggagttccta

SEQ ID NO: 5014852 - DNA, 16 bp, Homo sapiens
cactttaacacagtgt

SEQ ID NO: 5014853 - DNA, 19 bp, Homo sapiens
cagaaagcagaacagtgat

SEQ ID NO: 5014854 - DNA, 20 bp, Homo sapiens
cagaagcaacccaaatgttc

SEQ ID NO: 5014855 - DNA, 12 bp, Homo sapiens
cagaagcttcca

SEQ ID NO: 5014856 - DNA, 16 bp, Homo sapiens
cagaagtcaaggctta

SEQ ID NO: 5014857 - DNA, 15 bp, Homo sapiens
cagacagaacttgaa

SEQ ID NO: 5014858 - DNA, 23 bp, Homo sapiens
cagacagaacttgaatgtgtcag

SEQ ID NO: 5014859 - DNA, 13 bp, Homo sapiens
cagcagagacggg

SEQ ID NO: 5014860 - DNA, 16 bp, Homo sapiens
cagcttattcacaaga

SEQ ID NO: 5014861 - DNA, 17 bp, Homo sapiens
cagcttattcacaagac

SEQ ID NO: 5014862 - DNA, 15 bp, Homo sapiens
caggaagtagaggag

SEQ ID NO: 5014863 - DNA, 16 bp, Homo sapiens
caggaagtagaggagg

SEQ ID NO: 5014864 - DNA, 14 bp, Homo sapiens
caggagtttggcca

SEQ ID NO: 5014865 - DNA, 15 bp, Homo sapiens
caggagtttggccag

SEQ ID NO: 5014866 - DNA, 17 bp, Homo sapiens
caggagtttggccagaa

SEQ ID NO: 5014867 - DNA, 17 bp, Homo sapiens
caggatagagtgggaca

SEQ ID NO: 5014868 - DNA, 15 bp, Homo sapiens
cagtgagacagctct

SEQ ID NO: 5014869 - DNA, 18 bp, Homo sapiens
cagtgattaccagggact

SEQ ID NO: 5014870 - DNA, 13 bp, Homo sapiens
cagtgcttggccc

SEQ ID NO: 5014871 - DNA, 16 bp, Homo sapiens
cagtgcttggcccagg

SEQ ID NO: 5014872 - DNA, 17 bp, Homo sapiens
cagtgcttggcccagga

SEQ ID NO: 5014873 - DNA, 20 bp, Homo sapiens
cagtgcttggcccaggagtt

SEQ ID NO: 5014874 - DNA, 18 bp, Homo sapiens
catagcagattttaattt

SEQ ID NO: 5014875 - DNA, 16 bp, Homo sapiens
tagctgttgagctgtt

SEQ ID NO: 5014876 - DNA, 14 bp, Homo sapiens
taggaagagaaacc

SEQ ID NO: 5014877 - DNA, 19 bp, Homo sapiens
taggaagagaaaccaggga

SEQ ID NO: 5014878 - DNA, 23 bp, Homo sapiens
taggaattgacccacaagaaatg

SEQ ID NO: 5014879 - DNA, 21 bp, Homo sapiens
tataattcctatatcctgtga

SEQ ID NO: 5014880 - DNA, 21 bp, Homo sapiens
tatattttttgttaaatgatt

SEQ ID NO: 5014881 - DNA, 14 bp, Homo sapiens
tatcaatatctaat

SEQ ID NO: 5014882 - DNA, 12 bp, Homo sapiens
tatcctaataaa

SEQ ID NO: 5014883 - DNA, 13 bp, Homo sapiens
tatcctgtgactg

SEQ ID NO: 5014884 - DNA, 17 bp, Homo sapiens
tatctaatatatatgaa

SEQ ID NO: 5014885 - DNA, 17 bp, Homo sapiens
tatctattaatatatgt

SEQ ID NO: 5014886 - DNA, 12 bp, Homo sapiens
tatgaataaagt

SEQ ID NO: 5014887 - DNA, 14 bp, Homo sapiens
tatggtatttgagt

SEQ ID NO: 5014888 - DNA, 14 bp, Homo sapiens
tattaatatatgta

SEQ ID NO: 5014889 - DNA, 15 bp, Homo sapiens
tattcaattcctctg

SEQ ID NO: 5014890 - DNA, 15 bp, Homo sapiens
tatttaacattattt

SEQ ID NO: 5014891 - DNA, 21 bp, Homo sapiens
tatttactgagcttctctgtg

SEQ ID NO: 5014892 - DNA, 22 bp, Homo sapiens
tatttactgagcttctctgtga

SEQ ID NO: 5014893 - DNA, 19 bp, Homo sapiens
tatttataacaacctaaat

SEQ ID NO: 5014894 - DNA, 15 bp, Homo sapiens
tatttataattccta

SEQ ID NO: 5014895 - DNA, 13 bp, Homo sapiens
tatttattacctc

SEQ ID NO: 5014896 - DNA, 13 bp, Homo sapiens
tatttatttactg

SEQ ID NO: 5014897 - DNA, 18 bp, Homo sapiens
tatttgaattttaaatct

SEQ ID NO: 5014898 - DNA, 19 bp, Homo sapiens
tatttgaattttaaatcta

SEQ ID NO: 5014899 - DNA, 17 bp, Homo sapiens
tcaaataagtatttata

SEQ ID NO: 5014900 - DNA, 13 bp, Homo sapiens
tcaatatctaata

SEQ ID NO: 5014901 - DNA, 15 bp, Homo sapiens
tcaatatctaatata

SEQ ID NO: 5014902 - DNA, 22 bp, Homo sapiens
tcaatatcttttttttaataaa

SEQ ID NO: 5014903 - DNA, 20 bp, Homo sapiens
tcaatatttattattttcac

SEQ ID NO: 5014904 - DNA, 14 bp, Homo sapiens
tcaattcctctggg

SEQ ID NO: 5014905 - DNA, 18 bp, Homo sapiens
tcacaagacccaaaaggc

SEQ ID NO: 5014906 - DNA, 22 bp, Homo sapiens
tcacaagacccaaaaggcagaa

SEQ ID NO: 5014907 - DNA, 21 bp, Homo sapiens
tcacctgtttttaagctgttt

SEQ ID NO: 5014908 - DNA, 20 bp, Homo sapiens
tcacttgatgatacaatgaa

SEQ ID NO: 5014909 - DNA, 16 bp, Homo sapiens
tcagacagaacttgaa

SEQ ID NO: 5014910 - DNA, 22 bp, Homo sapiens
tcagacatagaattaacacatg

SEQ ID NO: 5014911 - DNA, 11 bp, Homo sapiens
tcatagcagct

SEQ ID NO: 5014912 - DNA, 12 bp, Homo sapiens
tcatagcagctt

SEQ ID NO: 5014913 - DNA, 13 bp, Homo sapiens
tcatcaatcaaat

SEQ ID NO: 5014914 - DNA, 19 bp, Homo sapiens
tcatgctgccaatatccta

SEQ ID NO: 5014915 - DNA, 21 bp, Homo sapiens
tcatgctgccaatatcctaat

SEQ ID NO: 5014916 - DNA, 20 bp, Homo sapiens
tcattgcaacctccaccttc

SEQ ID NO: 5014917 - DNA, 22 bp, Homo sapiens
tcatttgttaaaattatcaata

SEQ ID NO: 5014918 - DNA, 18 bp, Homo sapiens
tccagtgagacagctctg

SEQ ID NO: 5014919 - DNA, 13 bp, Homo sapiens
tccatgaagatgt

SEQ ID NO: 5014920 - DNA, 22 bp, Homo sapiens
tccatgaagatgtagaggagaa

SEQ ID NO: 5014921 - DNA, 21 bp, Homo sapiens
tcccaaagtgctgggaattac

SEQ ID NO: 5014922 - DNA, 14 bp, Homo sapiens
tccctctaatttat

SEQ ID NO: 5014923 - DNA, 21 bp, Homo sapiens
tccctgacctccctctaattt

SEQ ID NO: 5014924 - DNA, 23 bp, Homo sapiens
tcctagcgcagccatgtgattac

SEQ ID NO: 5014925 - DNA, 20 bp, Homo sapiens
tcctcaaaacttcagacata

SEQ ID NO: 5014926 - DNA, 20 bp, Homo sapiens
tcctgcctaagtgcagcccc

SEQ ID NO: 5014927 - DNA, 13 bp, Homo sapiens
tccttcagcctga

SEQ ID NO: 5014928 - DNA, 20 bp, Homo sapiens
tcctttgttttctgactaat

SEQ ID NO: 5014929 - DNA, 17 bp, Homo sapiens
tctaaatctatttatta

SEQ ID NO: 5014930 - DNA, 19 bp, Homo sapiens
tctaatagaactcagtttt

SEQ ID NO: 5014931 - DNA, 10 bp, Homo sapiens
tctattaata

SEQ ID NO: 5014932 - DNA, 22 bp, Homo sapiens
tctatttatttactgagcttct

SEQ ID NO: 5014933 - DNA, 16 bp, Homo sapiens
tctcaggagatttcat

SEQ ID NO: 5014934 - DNA, 21 bp, Homo sapiens
tctctgggcttggggcttcct

SEQ ID NO: 5014935 - DNA, 16 bp, Homo sapiens
tctctgtgaacgattt

SEQ ID NO: 5014936 - DNA, 18 bp, Homo sapiens
tctcttatagaatattta

SEQ ID NO: 5014937 - DNA, 13 bp, Homo sapiens
tctgactaattag

SEQ ID NO: 5014938 - DNA, 20 bp, Homo sapiens
tctgcccatcctgcccctga

SEQ ID NO: 5014939 - DNA, 19 bp, Homo sapiens
tctgggcttggggcttcct

SEQ ID NO: 5014940 - DNA, 13 bp, Homo sapiens
tcttgtctctggg

SEQ ID NO: 5014941 - DNA, 14 bp, Homo sapiens
tcttgtctctgggc

SEQ ID NO: 5014942 - DNA, 15 bp, Homo sapiens
tcttgtctctgggct

SEQ ID NO: 5014943 - DNA, 22 bp, Homo sapiens
tgaaaaagttctgcagataaac

SEQ ID NO: 5014944 - DNA, 18 bp, Homo sapiens
tgaaagcagggacttgaa

SEQ ID NO: 5014945 - DNA, 19 bp, Homo sapiens
tgaaagcagggacttgaac

SEQ ID NO: 5014946 - DNA, 17 bp, Homo sapiens
tgaaataagccagacat

SEQ ID NO: 5014947 - DNA, 20 bp, Homo sapiens
tgaaataagccagacatcaa

SEQ ID NO: 5014948 - DNA, 13 bp, Homo sapiens
tgaaatagtgtct

SEQ ID NO: 5014949 - DNA, 14 bp, Homo sapiens
tgaaatagtgtctg

SEQ ID NO: 5014950 - DNA, 16 bp, Homo sapiens
tgaataaataaatgta

SEQ ID NO: 5014951 - DNA, 17 bp, Homo sapiens
tgaatatctattaatat

SEQ ID NO: 5014952 - DNA, 21 bp, Homo sapiens
tgaatatctattaatatatgt

SEQ ID NO: 5014953 - DNA, 17 bp, Homo sapiens
tgaattttaaatctaaa

SEQ ID NO: 5014954 - DNA, 16 bp, Homo sapiens
tgacaactgtgactgt

SEQ ID NO: 5014955 - DNA, 17 bp, Homo sapiens
tgacacttaaaaatggt

SEQ ID NO: 5014956 - DNA, 21 bp, Homo sapiens
tgacagagcaagactctgtct

SEQ ID NO: 5014957 - DNA, 22 bp, Homo sapiens
tgaccacgctttctagctgttg

SEQ ID NO: 5014958 - DNA, 21 bp, Homo sapiens
tgacccagccccttgagaaac

SEQ ID NO: 5014959 - DNA, 15 bp, Homo sapiens
tgaccctgatgaaaa

SEQ ID NO: 5014960 - DNA, 13 bp, Homo sapiens
tgacctccctcta

SEQ ID NO: 5014961 - DNA, 14 bp, Homo sapiens
tgacctccctctaa

SEQ ID NO: 5014962 - DNA, 22 bp, Homo sapiens
tgacctccctctaatttatctt

SEQ ID NO: 5014963 - DNA, 11 bp, Homo sapiens
tgactaattag

SEQ ID NO: 5014964 - DNA, 14 bp, Homo sapiens
tgagacagctctgc

SEQ ID NO: 5014965 - DNA, 13 bp, Homo sapiens
tgagaccagccaa

SEQ ID NO: 5014966 - DNA, 11 bp, Homo sapiens
tgagctgtttt

SEQ ID NO: 5014967 - DNA, 16 bp, Homo sapiens
tgaggtcaggagttcc

SEQ ID NO: 5014968 - DNA, 18 bp, Homo sapiens
tgatactatccagttact

SEQ ID NO: 5014969 - DNA, 12 bp, Homo sapiens
tgattaaaccaa

SEQ ID NO: 5014970 - DNA, 16 bp, Homo sapiens
tgattaccagggactg

SEQ ID NO: 5014971 - DNA, 21 bp, Homo sapiens
tgcaacctccaccttctgggt

SEQ ID NO: 5014972 - DNA, 15 bp, Homo sapiens
tgcactccagcctga

SEQ ID NO: 5014973 - DNA, 17 bp, Homo sapiens
tgcactccagcctgagc

SEQ ID NO: 5014974 - DNA, 17 bp, Homo sapiens
tgcatggtttagaaagc

SEQ ID NO: 5014975 - DNA, 17 bp, Homo sapiens
tgccaatatcctaataa

SEQ ID NO: 5014976 - DNA, 18 bp, Homo sapiens
tgccaatatcctaataaa

SEQ ID NO: 5014977 - DNA, 15 bp, Homo sapiens
tgcctcaccccttgc

SEQ ID NO: 5014978 - DNA, 19 bp, Homo sapiens
tgctgccaatatcctaata

SEQ ID NO: 5014979 - DNA, 14 bp, Homo sapiens
tgctggagctctgc

SEQ ID NO: 5014980 - DNA, 23 bp, Homo sapiens
tgcttggcccaggagtttggcca

SEQ ID NO: 5014981 - DNA, 14 bp, Homo sapiens
tggaactctcgagc

SEQ ID NO: 5014982 - DNA, 17 bp, Homo sapiens
tggccagaagtcaaggc

SEQ ID NO: 5014983 - DNA, 20 bp, Homo sapiens
tggccaggctggtctcgaac

SEQ ID NO: 5014984 - DNA, 20 bp, Homo sapiens
tggcccaggagtttggccag

SEQ ID NO: 5014985 - DNA, 15 bp, Homo sapiens
tggcctgctggatgt

SEQ ID NO: 5014986 - DNA, 20 bp, Homo sapiens
tgggaatgttacattgtttg

SEQ ID NO: 5014987 - DNA, 19 bp, Homo sapiens
tgggaggctgagatgggag

SEQ ID NO: 5014988 - DNA, 22 bp, Homo sapiens
tggggagccaacagaagcttcc

SEQ ID NO: 5014989 - DNA, 18 bp, Homo sapiens
tggggcagtgcttggccc

SEQ ID NO: 5014990 - DNA, 16 bp, Homo sapiens
tgggtctcagtgtcct

SEQ ID NO: 5014991 - DNA, 17 bp, Homo sapiens
tggtcacaggaagtaga

SEQ ID NO: 5014992 - DNA, 19 bp, Homo sapiens
tggtgcttccaaatattgt

SEQ ID NO: 5014993 - DNA, 15 bp, Homo sapiens
tggttctaatagaac

SEQ ID NO: 5014994 - DNA, 11 bp, Homo sapiens
tgtaaaatggt

SEQ ID NO: 5014995 - DNA, 15 bp, Homo sapiens
tgtaatcacagctac

SEQ ID NO: 5014996 - DNA, 14 bp, Homo sapiens
tgtattatttataa

SEQ ID NO: 5014997 - DNA, 23 bp, Homo sapiens
tgtcagacagaacttgaatgtgt

SEQ ID NO: 5014998 - DNA, 23 bp, Homo sapiens
tgtcatttgctggagctctgccc

SEQ ID NO: 5014999 - DNA, 14 bp, Homo sapiens
agaatcacttgaac

SEQ ID NO: 5015000 - DNA, 15 bp, Homo sapiens
agacaccaccaccct

SEQ ID NO: 5015001 - DNA, 14 bp, Homo sapiens
agacatagaattaa

SEQ ID NO: 5015002 - DNA, 20 bp, Homo sapiens
agaccctcatgctgccaata

SEQ ID NO: 5015003 - DNA, 20 bp, Homo sapiens
agagtgggacagttcctgag

SEQ ID NO: 5015004 - DNA, 23 bp, Homo sapiens
agatcccatgggttgtgtgttta

SEQ ID NO: 5015005 - DNA, 14 bp, Homo sapiens
agatgtagaggaga

SEQ ID NO: 5015006 - DNA, 14 bp, Homo sapiens
agattttaattttg

SEQ ID NO: 5015007 - DNA, 15 bp, Homo sapiens
agcaacttttgtgta

SEQ ID NO: 5015008 - DNA, 21 bp, Homo sapiens
agcagattttaattttgaata

SEQ ID NO: 5015009 - DNA, 22 bp, Homo sapiens
agcagattttaattttgaataa

SEQ ID NO: 5015010 - DNA, 18 bp, Homo sapiens
agccaacagaagcttcca

SEQ ID NO: 5015011 - DNA, 15 bp, Homo sapiens
agcccaatattataa

SEQ ID NO: 5015012 - DNA, 20 bp, Homo sapiens
agcccaatattataattttt

SEQ ID NO: 5015013 - DNA, 18 bp, Homo sapiens
agcctgagcgacagtgag

SEQ ID NO: 5015014 - DNA, 17 bp, Homo sapiens
agcgacagtgagactct

SEQ ID NO: 5015015 - DNA, 23 bp, Homo sapiens
agctgacccagccccttgagaaa

SEQ ID NO: 5015016 - DNA, 14 bp, Homo sapiens
agctgttgagctgt

SEQ ID NO: 5015017 - DNA, 15 bp, Homo sapiens
agctgttttccctga

SEQ ID NO: 5015018 - DNA, 18 bp, Homo sapiens
agctgttttccctgacct

SEQ ID NO: 5015019 - DNA, 23 bp, Homo sapiens
agcttccattccaagcctgacca

SEQ ID NO: 5015020 - DNA, 20 bp, Homo sapiens
agcttgccctggtgcctcac

SEQ ID NO: 5015021 - DNA, 16 bp, Homo sapiens
agcttgttatttataa

SEQ ID NO: 5015022 - DNA, 14 bp, Homo sapiens
aggaagagaaacca

SEQ ID NO: 5015023 - DNA, 19 bp, Homo sapiens
aggaattgacccacaagaa

SEQ ID NO: 5015024 - DNA, 17 bp, Homo sapiens
aggagaaactggaactc

SEQ ID NO: 5015025 - DNA, 20 bp, Homo sapiens
aggagatggaagttgcagtg

SEQ ID NO: 5015026 - DNA, 18 bp, Homo sapiens
aggagtttggccagaagt

SEQ ID NO: 5015027 - DNA, 17 bp, Homo sapiens
aggatgttgaaaaagtt

SEQ ID NO: 5015028 - DNA, 18 bp, Homo sapiens
aggcaaggctatgtgatt

SEQ ID NO: 5015029 - DNA, 14 bp, Homo sapiens
aggcttagaccctc

SEQ ID NO: 5015030 - DNA, 22 bp, Homo sapiens
aggcttagaccctcatgctgcc

SEQ ID NO: 5015031 - DNA, 24 bp, Homo sapiens
aggcttagaccctcatgctgccaa

SEQ ID NO: 5015032 - DNA, 17 bp, Homo sapiens
agggagcccctttgatg

SEQ ID NO: 5015033 - DNA, 15 bp, Homo sapiens
aggtcaggagttcct

SEQ ID NO: 5015034 - DNA, 16 bp, Homo sapiens
aggtcaggagttccta

SEQ ID NO: 5015035 - DNA, 14 bp, Homo sapiens
aggttgcagtgagc

SEQ ID NO: 5015036 - DNA, 22 bp, Homo sapiens
agtaactcatttgttaaaatta

SEQ ID NO: 5015037 - DNA, 16 bp, Homo sapiens
agtatttataatagca

SEQ ID NO: 5015038 - DNA, 16 bp, Homo sapiens
agtcaaggcttagacc

SEQ ID NO: 5015039 - DNA, 20 bp, Homo sapiens
agtgaacaaatttacagaga

SEQ ID NO: 5015040 - DNA, 21 bp, Homo sapiens
agtgaacaaatttacagagac

SEQ ID NO: 5015041 - DNA, 14 bp, Homo sapiens
agtgagacagctct

SEQ ID NO: 5015042 - DNA, 16 bp, Homo sapiens
agtgagccgagattgt

SEQ ID NO: 5015043 - DNA, 13 bp, Homo sapiens
agtgattaccagg

SEQ ID NO: 5015044 - DNA, 15 bp, Homo sapiens
agtgcttggcccagg

SEQ ID NO: 5015045 - DNA, 19 bp, Homo sapiens
agtgtcaatgcagccccca

SEQ ID NO: 5015046 - DNA, 11 bp, Homo sapiens
agtttggccag

SEQ ID NO: 5015047 - DNA, 13 bp, Homo sapiens
agtttggccagaa

SEQ ID NO: 5015048 - DNA, 12 bp, Homo sapiens
ataaataaatgt

SEQ ID NO: 5015049 - DNA, 15 bp, Homo sapiens
ataaatagtttatga

SEQ ID NO: 5015050 - DNA, 18 bp, Homo sapiens
ataaatgtatcttattca

SEQ ID NO: 5015051 - DNA, 20 bp, Homo sapiens
ataaatttggttctaataga

SEQ ID NO: 5015052 - DNA, 14 bp, Homo sapiens
ataagccagacatc

SEQ ID NO: 5015053 - DNA, 22 bp, Homo sapiens
ataagccagacatcaacagata

SEQ ID NO: 5015054 - DNA, 15 bp, Homo sapiens
ataagtatttataat

SEQ ID NO: 5015055 - DNA, 20 bp, Homo sapiens
ataatttttttcaatattta

SEQ ID NO: 5015056 - DNA, 22 bp, Homo sapiens
atacaaaaaaaaaaaaaaatta

SEQ ID NO: 5015057 - DNA, 16 bp, Homo sapiens
atactcattaggatgg

SEQ ID NO: 5015058 - DNA, 21 bp, Homo sapiens
atagaactcagttttaactag

SEQ ID NO: 5015059 - DNA, 13 bp, Homo sapiens
atagaatatttat

SEQ ID NO: 5015060 - DNA, 22 bp, Homo sapiens
atagcaacttttgtgtaatgaa

SEQ ID NO: 5015061 - DNA, 14 bp, Homo sapiens
atatatatgaataa

SEQ ID NO: 5015062 - DNA, 12 bp, Homo sapiens
atatcctaataa

SEQ ID NO: 5015063 - DNA, 16 bp, Homo sapiens
atatcctaataaaaag

SEQ ID NO: 5015064 - DNA, 20 bp, Homo sapiens
atatcctaataaaaaggtga

SEQ ID NO: 5015065 - DNA, 13 bp, Homo sapiens
atatctaatatat

SEQ ID NO: 5015066 - DNA, 14 bp, Homo sapiens
atatctaatatata

SEQ ID NO: 5015067 - DNA, 15 bp, Homo sapiens
atatctattaatata

SEQ ID NO: 5015068 - DNA, 23 bp, Homo sapiens
atatgtacctaacgaagtatcct

SEQ ID NO: 5015069 - DNA, 16 bp, Homo sapiens
atatgtattatttata

SEQ ID NO: 5015070 - DNA, 18 bp, Homo sapiens
atatgtattatttataat

SEQ ID NO: 5015071 - DNA, 21 bp, Homo sapiens
atattgttgacaactgtgact

SEQ ID NO: 5015072 - DNA, 13 bp, Homo sapiens
atatttgaatttt

SEQ ID NO: 5015073 - DNA, 19 bp, Homo sapiens
atcaatcaaataagtattt

SEQ ID NO: 5015074 - DNA, 23 bp, Homo sapiens
atcacttgaacccgggaggcaga

SEQ ID NO: 5015075 - DNA, 15 bp, Homo sapiens
atcctaataaaaagg

SEQ ID NO: 5015076 - DNA, 17 bp, Homo sapiens
atcctaataaaaaggtg

SEQ ID NO: 5015077 - DNA, 18 bp, Homo sapiens
atcctaataaaaaggtga

SEQ ID NO: 5015078 - DNA, 16 bp, Homo sapiens
atcctgcaattccact

SEQ ID NO: 5015079 - DNA, 11 bp, Homo sapiens
atcctgtgact

SEQ ID NO: 5015080 - DNA, 21 bp, Homo sapiens
atcctgtgactgtctcactta

SEQ ID NO: 5015081 - DNA, 19 bp, Homo sapiens
atcctttgttttctgacta

SEQ ID NO: 5015082 - DNA, 21 bp, Homo sapiens
atcctttgttttctgactaat

SEQ ID NO: 5015083 - DNA, 23 bp, Homo sapiens
atcctttgttttctgactaatta

SEQ ID NO: 5015084 - DNA, 16 bp, Homo sapiens
atctaaatctatttat

SEQ ID NO: 5015085 - DNA, 15 bp, Homo sapiens
atctaatatatatga

SEQ ID NO: 5015086 - DNA, 19 bp, Homo sapiens
atctaatatatatgaataa

SEQ ID NO: 5015087 - DNA, 12 bp, Homo sapiens
atctattaatat

SEQ ID NO: 5015088 - DNA, 15 bp, Homo sapiens
atctattaatatatg

SEQ ID NO: 5015089 - DNA, 18 bp, Homo sapiens
atctcaggagatttcatg

SEQ ID NO: 5015090 - DNA, 16 bp, Homo sapiens
atctggggctctggga

SEQ ID NO: 5015091 - DNA, 17 bp, Homo sapiens
atgaatatctattaata

SEQ ID NO: 5015092 - DNA, 20 bp, Homo sapiens
atgaatatctattaatatat

SEQ ID NO: 5015093 - DNA, 23 bp, Homo sapiens
atgacgtgactggcctgctggat

SEQ ID NO: 5015094 - DNA, 18 bp, Homo sapiens
atgaggtactgagagtga

SEQ ID NO: 5015095 - DNA, 13 bp, Homo sapiens
atgatacaatgaa

SEQ ID NO: 5015096 - DNA, 13 bp, Homo sapiens
atgatttcattca

SEQ ID NO: 5015097 - DNA, 20 bp, Homo sapiens
atgcccctgtactccagcct

SEQ ID NO: 5015098 - DNA, 14 bp, Homo sapiens
atgctgccaatatc

SEQ ID NO: 5015099 - DNA, 19 bp, Homo sapiens
atgctgccaatatcctaat

SEQ ID NO: 5015100 - DNA, 23 bp, Homo sapiens
atgctgccaatatcctaataaaa

SEQ ID NO: 5015101 - DNA, 16 bp, Homo sapiens
atggaaagtaactcat

SEQ ID NO: 5015102 - DNA, 24 bp, Homo sapiens
atggtgaaaccccgtctctactaa

SEQ ID NO: 5015103 - DNA, 17 bp, Homo sapiens
atgtagaggagaaactg

SEQ ID NO: 5015104 - DNA, 15 bp, Homo sapiens
atgtattatttataa

SEQ ID NO: 5015105 - DNA, 15 bp, Homo sapiens
atgtgattacaaggc

SEQ ID NO: 5015106 - DNA, 17 bp, Homo sapiens
atgttctaagaagtgaa

SEQ ID NO: 5015107 - DNA, 23 bp, Homo sapiens
attaatatttaacattatttata

SEQ ID NO: 5015108 - DNA, 20 bp, Homo sapiens
attaggcaaggctatgtgat

SEQ ID NO: 5015109 - DNA, 22 bp, Homo sapiens
attatttatatggggaatatat

SEQ ID NO: 5015110 - DNA, 14 bp, Homo sapiens
attcaattcctctg

SEQ ID NO: 5015111 - DNA, 18 bp, Homo sapiens
attcacaagacccaaaag

SEQ ID NO: 5015112 - DNA, 20 bp, Homo sapiens
attccacttataggaattga

SEQ ID NO: 5015113 - DNA, 20 bp, Homo sapiens
attcctatatcctgtgactg

SEQ ID NO: 5015114 - DNA, 22 bp, Homo sapiens
attcctctgggaatgttacatt

SEQ ID NO: 5015115 - DNA, 20 bp, Homo sapiens
attgacacttaaaaatggtt

SEQ ID NO: 5015116 - DNA, 21 bp, Homo sapiens
attgacccacaagaaatgaaa

SEQ ID NO: 5015117 - DNA, 21 bp, Homo sapiens
attgcaacctccaccttctgg

SEQ ID NO: 5015118 - DNA, 19 bp, Homo sapiens
attgtacctctcttataga

SEQ ID NO: 5015119 - DNA, 16 bp, Homo sapiens
atttaacattatttat

SEQ ID NO: 5015120 - DNA, 22 bp, Homo sapiens
atttagaaagaagcccaatatt

SEQ ID NO: 5015121 - DNA, 19 bp, Homo sapiens
atttatatggggaatatat

SEQ ID NO: 5015122 - DNA, 16 bp, Homo sapiens
gtcaaggcttagaccc

SEQ ID NO: 5015123 - DNA, 18 bp, Homo sapiens
gtcaaggcttagaccctc

SEQ ID NO: 5015124 - DNA, 20 bp, Homo sapiens
gtcaaggcttagaccctcat

SEQ ID NO: 5015125 - DNA, 23 bp, Homo sapiens
gtccatgaagatgtagaggagaa

SEQ ID NO: 5015126 - DNA, 16 bp, Homo sapiens
gtgattaccagggact

SEQ ID NO: 5015127 - DNA, 13 bp, Homo sapiens
gtgcttggcccag

SEQ ID NO: 5015128 - DNA, 20 bp, Homo sapiens
gtggcgactctatagactct

SEQ ID NO: 5015129 - DNA, 22 bp, Homo sapiens
gtgggacagttcctgagaccag

SEQ ID NO: 5015130 - DNA, 23 bp, Homo sapiens
gtgggacagttcctgagaccagc

SEQ ID NO: 5015131 - DNA, 23 bp, Homo sapiens
gtggggcagtgcttggcccagga

SEQ ID NO: 5015132 - DNA, 15 bp, Homo sapiens
gtgggtggggcagtg

SEQ ID NO: 5015133 - DNA, 13 bp, Homo sapiens
gttgagctgtttt

SEQ ID NO: 5015134 - DNA, 13 bp, Homo sapiens
gtttagaaagctt

SEQ ID NO: 5015135 - DNA, 14 bp, Homo sapiens
gtttatgattccac

SEQ ID NO: 5015136 - DNA, 12 bp, Homo sapiens
gtttggccagaa

SEQ ID NO: 5015137 - DNA, 14 bp, Homo sapiens
gtttttaagctgtt

SEQ ID NO: 5015138 - DNA, 9 bp, Homo sapiens
taaaatggt

SEQ ID NO: 5015139 - DNA, 22 bp, Homo sapiens
taaaattatcaatatctaatat

SEQ ID NO: 5015140 - DNA, 22 bp, Homo sapiens
taaataaatgtatcttattcac

SEQ ID NO: 5015141 - DNA, 16 bp, Homo sapiens
taaatctatttattaa

SEQ ID NO: 5015142 - DNA, 18 bp, Homo sapiens
taactagaatttattcaa

SEQ ID NO: 5015143 - DNA, 12 bp, Homo sapiens
taactcatttgt

SEQ ID NO: 5015144 - DNA, 18 bp, Homo sapiens
taagaagtgaaaatctac

SEQ ID NO: 5015145 - DNA, 16 bp, Homo sapiens
taagctgtttccatag

SEQ ID NO: 5015146 - DNA, 13 bp, Homo sapiens
taagtgaaataag

SEQ ID NO: 5015147 - DNA, 14 bp, Homo sapiens
taataaaaaggtga

SEQ ID NO: 5015148 - DNA, 15 bp, Homo sapiens
taataaaaaggtgac

SEQ ID NO: 5015149 - DNA, 16 bp, Homo sapiens
taatatatatgaataa

SEQ ID NO: 5015150 - DNA, 18 bp, Homo sapiens
taatatatatgaataaag

SEQ ID NO: 5015151 - DNA, 21 bp, Homo sapiens
taatatttaacattatttata

SEQ ID NO: 5015152 - DNA, 19 bp, Homo sapiens
taatcccagctacttggga

SEQ ID NO: 5015153 - DNA, 23 bp, Homo sapiens
taatcctttgttttctgactaat

SEQ ID NO: 5015154 - DNA, 16 bp, Homo sapiens
taatggcatgtcagac

SEQ ID NO: 5015155 - DNA, 22 bp, Homo sapiens
taattaggcaaggctatgtgat

SEQ ID NO: 5015156 - DNA, 22 bp, Homo sapiens
taatttttttcaatatttatta

SEQ ID NO: 5015157 - DNA, 19 bp, Homo sapiens
tacaaatactcttaggaag

SEQ ID NO: 5015158 - DNA, 21 bp, Homo sapiens
tacaatgaacacttataagtg

SEQ ID NO: 5015159 - DNA, 22 bp, Homo sapiens
tacatgaggtactgagagtgaa

SEQ ID NO: 5015160 - DNA, 13 bp, Homo sapiens
taccctctgggtc

SEQ ID NO: 5015161 - DNA, 17 bp, Homo sapiens
tactatccagttactgc

SEQ ID NO: 5015162 - DNA, 18 bp, Homo sapiens
tactcttaggaagagaaa

SEQ ID NO: 5015163 - DNA, 14 bp, Homo sapiens
tactgagcttctct

SEQ ID NO: 5015164 - DNA, 12 bp, Homo sapiens
tacttgggaggc

SEQ ID NO: 5015165 - DNA, 15 bp, Homo sapiens
tagaattaacacatg

SEQ ID NO: 5015166 - DNA, 16 bp, Homo sapiens
tagaattaacacatga

SEQ ID NO: 5015167 - DNA, 14 bp, Homo sapiens
tagcagattttaat

SEQ ID NO: 5015168 - DNA, 20 bp, Homo sapiens
tagcagattttaattttgaa

SEQ ID NO: 5015169 - DNA, 23 bp, Homo sapiens
tagctgacccagccccttgagaa

SEQ ID NO: 5015170 - DNA, 13 bp, Homo sapiens
tagctgttgagct

SEQ ID NO: 5015171 - DNA, 20 bp, Homo sapiens
taggaattgacccacaagaa

SEQ ID NO: 5015172 - DNA, 13 bp, Homo sapiens
tagtatcaaaaga

SEQ ID NO: 5015173 - DNA, 21 bp, Homo sapiens
tagttgtaccgcaatgtgact

SEQ ID NO: 5015174 - DNA, 14 bp, Homo sapiens
tataagtgaagtga

SEQ ID NO: 5015175 - DNA, 21 bp, Homo sapiens
tatagaatatttattacctct

SEQ ID NO: 5015176 - DNA, 13 bp, Homo sapiens
tataggaattgac

SEQ ID NO: 5015177 - DNA, 14 bp, Homo sapiens
tataggaattgacc

SEQ ID NO: 5015178 - DNA, 18 bp, Homo sapiens
tatatcctgtgactgtct

SEQ ID NO: 5015179 - DNA, 16 bp, Homo sapiens
tatatgtattatttat

SEQ ID NO: 5015180 - DNA, 19 bp, Homo sapiens
tatattttttgttaaatga

SEQ ID NO: 5015181 - DNA, 14 bp, Homo sapiens
tatcaaaagaaaga

SEQ ID NO: 5015182 - DNA, 21 bp, Homo sapiens
tatcaatatctaatatatatg

SEQ ID NO: 5015183 - DNA, 22 bp, Homo sapiens
tatcaatatctaatatatatga

SEQ ID NO: 5015184 - DNA, 22 bp, Homo sapiens
tatcctaataaaaaggtgacca

SEQ ID NO: 5015185 - DNA, 17 bp, Homo sapiens
tatcctgtgactgtctc

SEQ ID NO: 5015186 - DNA, 14 bp, Homo sapiens
tatccttcagcctg

SEQ ID NO: 5015187 - DNA, 15 bp, Homo sapiens
tatcttgtctctggg

SEQ ID NO: 5015188 - DNA, 17 bp, Homo sapiens
tatcttgtctctgggct

SEQ ID NO: 5015189 - DNA, 13 bp, Homo sapiens
tatgtgattacaa

SEQ ID NO: 5015190 - DNA, 11 bp, Homo sapiens
tattacctctg

SEQ ID NO: 5015191 - DNA, 14 bp, Homo sapiens
tattacctctgata

SEQ ID NO: 5015192 - DNA, 15 bp, Homo sapiens
tattattttcacctg

SEQ ID NO: 5015193 - DNA, 23 bp, Homo sapiens
tattcatagcagcttattcacaa

SEQ ID NO: 5015194 - DNA, 20 bp, Homo sapiens
tattgttgacaactgtgact

SEQ ID NO: 5015195 - DNA, 14 bp, Homo sapiens
tatttactgagctt

SEQ ID NO: 5015196 - DNA, 16 bp, Homo sapiens
tatttactgagcttct

SEQ ID NO: 5015197 - DNA, 19 bp, Homo sapiens
tatttactgagcttctctg

SEQ ID NO: 5015198 - DNA, 23 bp, Homo sapiens
tatttactgagcttctctgtgaa

SEQ ID NO: 5015199 - DNA, 20 bp, Homo sapiens
tatttataacaacctaaatt

SEQ ID NO: 5015200 - DNA, 13 bp, Homo sapiens
tatttattaatat

SEQ ID NO: 5015201 - DNA, 17 bp, Homo sapiens
tatttattaatatttaa

SEQ ID NO: 5015202 - DNA, 15 bp, Homo sapiens
tatttattacctctg

SEQ ID NO: 5015203 - DNA, 19 bp, Homo sapiens
tatttttagactcatcaat

SEQ ID NO: 5015204 - DNA, 19 bp, Homo sapiens
tcaaataagtatttataat

SEQ ID NO: 5015205 - DNA, 20 bp, Homo sapiens
tcaaataagtatttataata

SEQ ID NO: 5015206 - DNA, 10 bp, Homo sapiens
tcaatattta

SEQ ID NO: 5015207 - DNA, 16 bp, Homo sapiens
tcaattcctctgggaa

SEQ ID NO: 5015208 - DNA, 12 bp, Homo sapiens
tcaatttaaaaa

SEQ ID NO: 5015209 - DNA, 14 bp, Homo sapiens
tcacaggaagtaga

SEQ ID NO: 5015210 - DNA, 19 bp, Homo sapiens
tcacaggaagtagaggagg

SEQ ID NO: 5015211 - DNA, 14 bp, Homo sapiens
tcaccaaggctgat

SEQ ID NO: 5015212 - DNA, 18 bp, Homo sapiens
tcacctgtttttaagctg

SEQ ID NO: 5015213 - DNA, 22 bp, Homo sapiens
tcacttgaggtcaggagttcct

SEQ ID NO: 5015214 - DNA, 14 bp, Homo sapiens
tcacttgatgatac

SEQ ID NO: 5015215 - DNA, 15 bp, Homo sapiens
tcagcagagacgggg

SEQ ID NO: 5015216 - DNA, 18 bp, Homo sapiens
tcagtccatgaagatgta

SEQ ID NO: 5015217 - DNA, 11 bp, Homo sapiens
tcagtgtcctc

SEQ ID NO: 5015218 - DNA, 13 bp, Homo sapiens
tcagttttaacta

SEQ ID NO: 5015219 - DNA, 23 bp, Homo sapiens
tcatcaatcaaataagtatttat

SEQ ID NO: 5015220 - DNA, 23 bp, Homo sapiens
tcatgctgccaatatcctaataa

SEQ ID NO: 5015221 - DNA, 15 bp, Homo sapiens
tccaccttctgggtt

SEQ ID NO: 5015222 - DNA, 16 bp, Homo sapiens
tccagtgtctcggagg

SEQ ID NO: 5015223 - DNA, 18 bp, Homo sapiens
tcccagcactttgggagg

SEQ ID NO: 5015224 - DNA, 19 bp, Homo sapiens
tcccagcactttgggaggc

SEQ ID NO: 5015225 - DNA, 16 bp, Homo sapiens
tcccagctacttggga

SEQ ID NO: 5015226 - DNA, 19 bp, Homo sapiens
tcccagctacttgggaggc

SEQ ID NO: 5015227 - DNA, 16 bp, Homo sapiens
tccctctaatttatct

SEQ ID NO: 5015228 - DNA, 16 bp, Homo sapiens
tccctgacctccctct

SEQ ID NO: 5015229 - DNA, 17 bp, Homo sapiens
tccctgacctccctcta

SEQ ID NO: 5015230 - DNA, 12 bp, Homo sapiens
tcctaataaaaa

SEQ ID NO: 5015231 - DNA, 13 bp, Homo sapiens
tcctaataaaaag

SEQ ID NO: 5015232 - DNA, 18 bp, Homo sapiens
tcctaataaaaaggtgac

SEQ ID NO: 5015233 - DNA, 15 bp, Homo sapiens
tcctagcgcagccat

SEQ ID NO: 5015234 - DNA, 18 bp, Homo sapiens
tcctttgttttctgacta

SEQ ID NO: 5015235 - DNA, 19 bp, Homo sapiens
tctaaatctatttattaat

SEQ ID NO: 5015236 - DNA, 22 bp, Homo sapiens
tctaatttatcttgtctctggg

SEQ ID NO: 5015237 - DNA, 15 bp, Homo sapiens
tctactaaaaataca

SEQ ID NO: 5015238 - DNA, 19 bp, Homo sapiens
tctactaaaaatacaaaaa

SEQ ID NO: 5015239 - DNA, 12 bp, Homo sapiens
tctattaatata

SEQ ID NO: 5015240 - DNA, 13 bp, Homo sapiens
tctattaatatat

SEQ ID NO: 5015241 - DNA, 22 bp, Homo sapiens
tctattaatatatgtattattt

SEQ ID NO: 5015242 - DNA, 23 bp, Homo sapiens
tctcagtccatgaagatgtagag

SEQ ID NO: 5015243 - DNA, 16 bp, Homo sapiens
tctcgaactgctggat

SEQ ID NO: 5015244 - DNA, 22 bp, Homo sapiens
tctctgtgaacgatttagaaag

SEQ ID NO: 5015245 - DNA, 23 bp, Homo sapiens
tctctgtgaacgatttagaaaga

SEQ ID NO: 5015246 - DNA, 21 bp, Homo sapiens
aaaactttatgctaagtgaaa

SEQ ID NO: 5015247 - DNA, 17 bp, Homo sapiens
aaaagaaagaaaatcag

SEQ ID NO: 5015248 - DNA, 22 bp, Homo sapiens
aaaatgaatatctattaatata

SEQ ID NO: 5015249 - DNA, 16 bp, Homo sapiens
aaaatggtttaaatgg

SEQ ID NO: 5015250 - DNA, 18 bp, Homo sapiens
aaaatggtttaaatggtc

SEQ ID NO: 5015251 - DNA, 12 bp, Homo sapiens
aaaccagggagc

SEQ ID NO: 5015252 - DNA, 18 bp, Homo sapiens
aaaccttattgtacctct

SEQ ID NO: 5015253 - DNA, 13 bp, Homo sapiens
aaacgaaaaacat

SEQ ID NO: 5015254 - DNA, 19 bp, Homo sapiens
aaacttcagacatagaatt

SEQ ID NO: 5015255 - DNA, 20 bp, Homo sapiens
aaagaagcccaatattataa

SEQ ID NO: 5015256 - DNA, 19 bp, Homo sapiens
aaaggcagaagcaacccaa

SEQ ID NO: 5015257 - DNA, 12 bp, Homo sapiens
aaataagtattt

SEQ ID NO: 5015258 - DNA, 15 bp, Homo sapiens
aaataagtatttata

SEQ ID NO: 5015259 - DNA, 22 bp, Homo sapiens
aaataagtatttataatagcaa

SEQ ID NO: 5015260 - DNA, 22 bp, Homo sapiens
aaatcggatctggggctctggg

SEQ ID NO: 5015261 - DNA, 20 bp, Homo sapiens
aaatctaaatctatttatta

SEQ ID NO: 5015262 - DNA, 16 bp, Homo sapiens
aaatgaatatctatta

SEQ ID NO: 5015263 - DNA, 14 bp, Homo sapiens
aaatgtatcttatt

SEQ ID NO: 5015264 - DNA, 19 bp, Homo sapiens
aaattgacacttaaaaatg

SEQ ID NO: 5015265 - DNA, 18 bp, Homo sapiens
aacaaatttacagagaca

SEQ ID NO: 5015266 - DNA, 18 bp, Homo sapiens
agcccatggcactctatg

SEQ ID NO: 5015267 - DNA, 21 bp, Homo sapiens
agccgggcgtggtggtgagtg

SEQ ID NO: 5015268 - DNA, 15 bp, Homo sapiens
agcctcatgtccact

SEQ ID NO: 5015269 - DNA, 14 bp, Homo sapiens
agctacttgggagg

SEQ ID NO: 5015270 - DNA, 18 bp, Homo sapiens
agctacttgggaggctga

SEQ ID NO: 5015271 - DNA, 13 bp, Homo sapiens
agctgttgagctg

SEQ ID NO: 5015272 - DNA, 12 bp, Homo sapiens
aggagtttggcc

SEQ ID NO: 5015273 - DNA, 13 bp, Homo sapiens
aggagtttggcca

SEQ ID NO: 5015274 - DNA, 17 bp, Homo sapiens
aggctatgtgattacaa

SEQ ID NO: 5015275 - DNA, 21 bp, Homo sapiens
aggcttagaccctcatgctgc

SEQ ID NO: 5015276 - DNA, 23 bp, Homo sapiens
aggcttagaccctcatgctgcca

SEQ ID NO: 5015277 - DNA, 15 bp, Homo sapiens
agggactgaggggag

SEQ ID NO: 5015278 - DNA, 20 bp, Homo sapiens
aggtcaggagttcctaacca

SEQ ID NO: 5015279 - DNA, 23 bp, Homo sapiens
agtgaacaaatttacagagacag

SEQ ID NO: 5015280 - DNA, 21 bp, Homo sapiens
agtgcctgtaatcacagctac

SEQ ID NO: 5015281 - DNA, 21 bp, Homo sapiens
agtgctgggaattacaggcgt

SEQ ID NO: 5015282 - DNA, 19 bp, Homo sapiens
agtgcttggcccaggagtt

SEQ ID NO: 5015283 - DNA, 20 bp, Homo sapiens
agtgttttaagataaattat

SEQ ID NO: 5015284 - DNA, 18 bp, Homo sapiens
agttgtaccgcaatgtga

SEQ ID NO: 5015285 - DNA, 14 bp, Homo sapiens
agtttggccagaag

SEQ ID NO: 5015286 - DNA, 18 bp, Homo sapiens
agttttaactagaattta

SEQ ID NO: 5015287 - DNA, 21 bp, Homo sapiens
ataatagcaacttttgtgtaa

SEQ ID NO: 5015288 - DNA, 21 bp, Homo sapiens
ataatttttttcaatatttat

SEQ ID NO: 5015289 - DNA, 22 bp, Homo sapiens
ataatttttttcaatatttatt

SEQ ID NO: 5015290 - DNA, 19 bp, Homo sapiens
atactcttaggaagagaaa

SEQ ID NO: 5015291 - DNA, 21 bp, Homo sapiens
atactcttaggaagagaaacc

SEQ ID NO: 5015292 - DNA, 12 bp, Homo sapiens
atagaatattta

SEQ ID NO: 5015293 - DNA, 19 bp, Homo sapiens
atagaatatttattacctc

SEQ ID NO: 5015294 - DNA, 17 bp, Homo sapiens
atagaattaacacatga

SEQ ID NO: 5015295 - DNA, 18 bp, Homo sapiens
atagcagcttattcacaa

SEQ ID NO: 5015296 - DNA, 12 bp, Homo sapiens
atatatgaataa

SEQ ID NO: 5015297 - DNA, 19 bp, Homo sapiens
atatatgtattatttataa

SEQ ID NO: 5015298 - DNA, 13 bp, Homo sapiens
atatcctaataaa

SEQ ID NO: 5015299 - DNA, 14 bp, Homo sapiens
atatcctaataaaa

SEQ ID NO: 5015300 - DNA, 18 bp, Homo sapiens
atatctaatatatatgaa

SEQ ID NO: 5015301 - DNA, 13 bp, Homo sapiens
atatctattaata

SEQ ID NO: 5015302 - DNA, 23 bp, Homo sapiens
atatgtattatttataattccta

SEQ ID NO: 5015303 - DNA, 13 bp, Homo sapiens
atattgttgacaa

SEQ ID NO: 5015304 - DNA, 15 bp, Homo sapiens
atattgttgacaact

SEQ ID NO: 5015305 - DNA, 19 bp, Homo sapiens
atatttaacattatttata

SEQ ID NO: 5015306 - DNA, 14 bp, Homo sapiens
atatttattacctc

SEQ ID NO: 5015307 - DNA, 16 bp, Homo sapiens
atatttttagactcat

SEQ ID NO: 5015308 - DNA, 14 bp, Homo sapiens
atcaaaagaaagaa

SEQ ID NO: 5015309 - DNA, 20 bp, Homo sapiens
atcaaataagtatttataat

SEQ ID NO: 5015310 - DNA, 15 bp, Homo sapiens
atcaatatctaatat

SEQ ID NO: 5015311 - DNA, 18 bp, Homo sapiens
atcaatatctaatatata

SEQ ID NO: 5015312 - DNA, 22 bp, Homo sapiens
atcccagcactttgggaggctg

SEQ ID NO: 5015313 - DNA, 16 bp, Homo sapiens
atcctaataaaaaggt

SEQ ID NO: 5015314 - DNA, 22 bp, Homo sapiens
atcctaataaaaaggtgaccat

SEQ ID NO: 5015315 - DNA, 15 bp, Homo sapiens
atctaaatctattta

SEQ ID NO: 5015316 - DNA, 17 bp, Homo sapiens
atctaatatatatgaat

SEQ ID NO: 5015317 - DNA, 22 bp, Homo sapiens
atctaatatatatgaataaagt

SEQ ID NO: 5015318 - DNA, 18 bp, Homo sapiens
atctattaatatatgtat

SEQ ID NO: 5015319 - DNA, 21 bp, Homo sapiens
atgaagtactcatacatgtta

SEQ ID NO: 5015320 - DNA, 21 bp, Homo sapiens
atgaatatctattaatatatg

SEQ ID NO: 5015321 - DNA, 22 bp, Homo sapiens
atgaatatctattaatatatgt

SEQ ID NO: 5015322 - DNA, 23 bp, Homo sapiens
atgaatggctaagcaaaatgtga

SEQ ID NO: 5015323 - DNA, 17 bp, Homo sapiens
atgaggtactgagagtg

SEQ ID NO: 5015324 - DNA, 16 bp, Homo sapiens
atgattaattcacctt

SEQ ID NO: 5015325 - DNA, 17 bp, Homo sapiens
atgccactaaattgaca

SEQ ID NO: 5015326 - DNA, 13 bp, Homo sapiens
atgtagaggagaa

SEQ ID NO: 5015327 - DNA, 17 bp, Homo sapiens
atgtattatttataatt

SEQ ID NO: 5015328 - DNA, 16 bp, Homo sapiens
atgtccactggttctt

SEQ ID NO: 5015329 - DNA, 20 bp, Homo sapiens
attaatatatgtattattta

SEQ ID NO: 5015330 - DNA, 12 bp, Homo sapiens
attaatatttaa

SEQ ID NO: 5015331 - DNA, 21 bp, Homo sapiens
attacaggcgtgagccaccaa

SEQ ID NO: 5015332 - DNA, 12 bp, Homo sapiens
attaccagggac

SEQ ID NO: 5015333 - DNA, 23 bp, Homo sapiens
attataatttttttcaatattta

SEQ ID NO: 5015334 - DNA, 19 bp, Homo sapiens
attatcaatatctaatata

SEQ ID NO: 5015335 - DNA, 12 bp, Homo sapiens
attatttataat

SEQ ID NO: 5015336 - DNA, 16 bp, Homo sapiens
attcaattcctctggg

SEQ ID NO: 5015337 - DNA, 19 bp, Homo sapiens
attcacaagacccaaaagg

SEQ ID NO: 5015338 - DNA, 23 bp, Homo sapiens
attcaccttccagtgtctcggag

SEQ ID NO: 5015339 - DNA, 12 bp, Homo sapiens
attcctctggga

SEQ ID NO: 5015340 - DNA, 17 bp, Homo sapiens
attgacacttaaaaatg

SEQ ID NO: 5015341 - DNA, 18 bp, Homo sapiens
attgtacctctcttatag

SEQ ID NO: 5015342 - DNA, 13 bp, Homo sapiens
attgtgcccctgc

SEQ ID NO: 5015343 - DNA, 18 bp, Homo sapiens
attgttgacaactgtgac

SEQ ID NO: 5015344 - DNA, 20 bp, Homo sapiens
atttaacattatttatatgg

SEQ ID NO: 5015345 - DNA, 20 bp, Homo sapiens
atttatatggggaatatatt

SEQ ID NO: 5015346 - DNA, 15 bp, Homo sapiens
atttattaatattta

SEQ ID NO: 5015347 - DNA, 18 bp, Homo sapiens
atttattcaattcctctg

SEQ ID NO: 5015348 - DNA, 18 bp, Homo sapiens
atttgaattttaaatcta

SEQ ID NO: 5015349 - DNA, 20 bp, Homo sapiens
atttgaattttaaatctaaa

SEQ ID NO: 5015350 - DNA, 12 bp, Homo sapiens
atttgagacagg

SEQ ID NO: 5015351 - DNA, 21 bp, Homo sapiens
attttaaatctaaatctattt

SEQ ID NO: 5015352 - DNA, 15 bp, Homo sapiens
caaaaattagccggg

SEQ ID NO: 5015353 - DNA, 23 bp, Homo sapiens
caaaacttcagacatagaattaa

SEQ ID NO: 5015354 - DNA, 16 bp, Homo sapiens
caaataagtatttata

SEQ ID NO: 5015355 - DNA, 18 bp, Homo sapiens
caaatattgttgacaact

SEQ ID NO: 5015356 - DNA, 21 bp, Homo sapiens
caaatgttcatcaatgaatga

SEQ ID NO: 5015357 - DNA, 15 bp, Homo sapiens
caaatttacagagac

SEQ ID NO: 5015358 - DNA, 15 bp, Homo sapiens
cagattttaattttg

SEQ ID NO: 5015359 - DNA, 23 bp, Homo sapiens
cagattttaattttgaataaata

SEQ ID NO: 5015360 - DNA, 17 bp, Homo sapiens
cagccccttgagaaacc

SEQ ID NO: 5015361 - DNA, 22 bp, Homo sapiens
cagcctgagcgacagtgagact

SEQ ID NO: 5015362 - DNA, 23 bp, Homo sapiens
cagcctgagcgacagtgagactc

SEQ ID NO: 5015363 - DNA, 20 bp, Homo sapiens
cagcctggtcaacatggtga

SEQ ID NO: 5015364 - DNA, 15 bp, Homo sapiens
cagctacttgggagg

SEQ ID NO: 5015365 - DNA, 20 bp, Homo sapiens
cagctctgcatactcattag

SEQ ID NO: 5015366 - DNA, 17 bp, Homo sapiens
cagcttgttatttataa

SEQ ID NO: 5015367 - DNA, 16 bp, Homo sapiens
caggcgtgagccacca

SEQ ID NO: 5015368 - DNA, 15 bp, Homo sapiens
caggctccaaactgg

SEQ ID NO: 5015369 - DNA, 22 bp, Homo sapiens
cagggcctggctgggagtggca

SEQ ID NO: 5015370 - DNA, 12 bp, Homo sapiens
cagtatggcagc

SEQ ID NO: 5015371 - DNA, 17 bp, Homo sapiens
cagtgattaccagggac

SEQ ID NO: 5015372 - DNA, 15 bp, Homo sapiens
cagtgcttggcccag

SEQ ID NO: 5015373 - DNA, 16 bp, Homo sapiens
cagttttaactagaat

SEQ ID NO: 5015374 - DNA, 22 bp, Homo sapiens
catctgtaaaatggagacacca

SEQ ID NO: 5015375 - DNA, 19 bp, Homo sapiens
catgaagatgtagaggaga

SEQ ID NO: 5015376 - DNA, 15 bp, Homo sapiens
catgctgccaatatc

SEQ ID NO: 5015377 - DNA, 13 bp, Homo sapiens
catttctatttat

SEQ ID NO: 5015378 - DNA, 17 bp, Homo sapiens
ccaaatgttcatcaatg

SEQ ID NO: 5015379 - DNA, 18 bp, Homo sapiens
ccaaggctagaaccacct

SEQ ID NO: 5015380 - DNA, 12 bp, Homo sapiens
ccaccttctggg

SEQ ID NO: 5015381 - DNA, 18 bp, Homo sapiens
ccagaagtcaaggcttag

SEQ ID NO: 5015382 - DNA, 19 bp, Homo sapiens
ccagccaacctgggggctt

SEQ ID NO: 5015383 - DNA, 14 bp, Homo sapiens
ccagccccttgaga

SEQ ID NO: 5015384 - DNA, 19 bp, Homo sapiens
ccagcctgagcgacagtga

SEQ ID NO: 5015385 - DNA, 17 bp, Homo sapiens
ccagcttgttatttata

SEQ ID NO: 5015386 - DNA, 15 bp, Homo sapiens
ccaggagtttggcca

SEQ ID NO: 5015387 - DNA, 17 bp, Homo sapiens
ccaggagtttggccaga

SEQ ID NO: 5015388 - DNA, 18 bp, Homo sapiens
ccaggagtttggccagaa

SEQ ID NO: 5015389 - DNA, 14 bp, Homo sapiens
ccatgaagatgtag

SEQ ID NO: 5015390 - DNA, 18 bp, Homo sapiens
cccaaaaggcagaagcaa

SEQ ID NO: 5015391 - DNA, 17 bp, Homo sapiens
cccaatattataatttt

SEQ ID NO: 5015392 - DNA, 16 bp, Homo sapiens
cccaggagtttggcca

SEQ ID NO: 5015393 - DNA, 23 bp, Homo sapiens
cccattgtggtcacaggaagtag

SEQ ID NO: 5015394 - DNA, 17 bp, Homo sapiens
ccccatttctatttatt

SEQ ID NO: 5015395 - DNA, 20 bp, Homo sapiens
ccccatttctatttatttac

SEQ ID NO: 5015396 - DNA, 20 bp, Homo sapiens
cccctttgatgattaattca

SEQ ID NO: 5015397 - DNA, 14 bp, Homo sapiens
cccttgagaaacct

SEQ ID NO: 5015398 - DNA, 16 bp, Homo sapiens
ccgggcgtggtggtga

SEQ ID NO: 5015399 - DNA, 15 bp, Homo sapiens
cctaataaaaaggtg

SEQ ID NO: 5015400 - DNA, 20 bp, Homo sapiens
cctcatgctgccaatatcct

SEQ ID NO: 5015401 - DNA, 15 bp, Homo sapiens
cctctgatacctcaa

SEQ ID NO: 5015402 - DNA, 19 bp, Homo sapiens
cctctgggtctcagtgtcc

SEQ ID NO: 5015403 - DNA, 20 bp, Homo sapiens
cctctgggtctcagtgtcct

SEQ ID NO: 5015404 - DNA, 22 bp, Homo sapiens
cctctgggtctcagtgtcctca

SEQ ID NO: 5015405 - DNA, 22 bp, Homo sapiens
cctctgttgccaaggctggagt

SEQ ID NO: 5015406 - DNA, 13 bp, Homo sapiens
cctgaaagaggaa

SEQ ID NO: 5015407 - DNA, 16 bp, Homo sapiens
cctgacctccctctaa

SEQ ID NO: 5015408 - DNA, 18 bp, Homo sapiens
cctgcaggcgtgacctga

SEQ ID NO: 5015409 - DNA, 16 bp, Homo sapiens
cctgtgactgtctcac

SEQ ID NO: 5015410 - DNA, 12 bp, Homo sapiens
ccttcagcctga

SEQ ID NO: 5015411 - DNA, 14 bp, Homo sapiens
ccttgagaaacctt

SEQ ID NO: 5015412 - DNA, 16 bp, Homo sapiens
cgctttctagctgttg

SEQ ID NO: 5015413 - DNA, 22 bp, Homo sapiens
cgctttctagctgttgagctgt

SEQ ID NO: 5015414 - DNA, 12 bp, Homo sapiens
ctaaatctattt

SEQ ID NO: 5015415 - DNA, 16 bp, Homo sapiens
ctaaatctatttatta

SEQ ID NO: 5015416 - DNA, 19 bp, Homo sapiens
ctaaatctatttattaata

SEQ ID NO: 5015417 - DNA, 20 bp, Homo sapiens
ctaacgaagtatccttcagc

SEQ ID NO: 5015418 - DNA, 20 bp, Homo sapiens
ctaagtgaaataagccagac

SEQ ID NO: 5015419 - DNA, 20 bp, Homo sapiens
ctaatagaactcagttttaa

SEQ ID NO: 5015420 - DNA, 21 bp, Homo sapiens
ctaatttatcttgtctctggg

SEQ ID NO: 5015421 - DNA, 15 bp, Homo sapiens
ctacatgaggtactg

SEQ ID NO: 5015422 - DNA, 12 bp, Homo sapiens
ctacttgggagg

SEQ ID NO: 5015423 - DNA, 15 bp, Homo sapiens
ctacttgggaggctg

SEQ ID NO: 5015424 - DNA, 12 bp, Homo sapiens
ctagaatttatt

SEQ ID NO: 5015425 - DNA, 13 bp, Homo sapiens
ctagaatttattc

SEQ ID NO: 5015426 - DNA, 22 bp, Homo sapiens
ctagaatttattcaattcctct

SEQ ID NO: 5015427 - DNA, 17 bp, Homo sapiens
ctagtatcaaaagaaag

SEQ ID NO: 5015428 - DNA, 17 bp, Homo sapiens
ctatatcctgtgactgt

SEQ ID NO: 5015429 - DNA, 20 bp, Homo sapiens
ctatattttttgttaaatga

SEQ ID NO: 5015430 - DNA, 23 bp, Homo sapiens
ctatgtcatttgctggagctctg

SEQ ID NO: 5015431 - DNA, 15 bp, Homo sapiens
ctattaatatatgta

SEQ ID NO: 5015432 - DNA, 17 bp, Homo sapiens
ctattaatatatgtatt

SEQ ID NO: 5015433 - DNA, 14 bp, Homo sapiens
ctatttatttactg

SEQ ID NO: 5015434 - DNA, 22 bp, Homo sapiens
ctcaacccccatttctatttat

SEQ ID NO: 5015435 - DNA, 16 bp, Homo sapiens
ctcagtccatgaagat

SEQ ID NO: 5015436 - DNA, 17 bp, Homo sapiens
ctcatttgttaaaatta

SEQ ID NO: 5015437 - DNA, 21 bp, Homo sapiens
ctccagtgagacagctctgca

SEQ ID NO: 5015438 - DNA, 16 bp, Homo sapiens
ctcccttctcttcaca

SEQ ID NO: 5015439 - DNA, 17 bp, Homo sapiens
ctcggagggattcccct

SEQ ID NO: 5015440 - DNA, 19 bp, Homo sapiens
ctctcttatagaatattta

SEQ ID NO: 5015441 - DNA, 23 bp, Homo sapiens
ctctcttatagaatatttattac

SEQ ID NO: 5015442 - DNA, 18 bp, Homo sapiens
ctctgtgaacgatttaga

SEQ ID NO: 5015443 - DNA, 23 bp, Homo sapiens
ctctgtgaacgatttagaaagaa

SEQ ID NO: 5015444 - DNA, 22 bp, Homo sapiens
ctctgttgccaaggctggagtg

SEQ ID NO: 5015445 - DNA, 17 bp, Homo sapiens
ctcttatagaatattta

SEQ ID NO: 5015446 - DNA, 18 bp, Homo sapiens
ctcttatagaatatttat

SEQ ID NO: 5015447 - DNA, 20 bp, Homo sapiens
ctcttatagaatatttatta

SEQ ID NO: 5015448 - DNA, 21 bp, Homo sapiens
ctcttatagaatatttattac

SEQ ID NO: 5015449 - DNA, 17 bp, Homo sapiens
ctgaaagaggaatgaag

SEQ ID NO: 5015450 - DNA, 22 bp, Homo sapiens
ctgaccacgctttctagctgtt

SEQ ID NO: 5015451 - DNA, 19 bp, Homo sapiens
ctgcaatatttgaatttta

SEQ ID NO: 5015452 - DNA, 16 bp, Homo sapiens
ctgcactccagcctga

SEQ ID NO: 5015453 - DNA, 20 bp, Homo sapiens
ctgcactccagcctgagcga

SEQ ID NO: 5015454 - DNA, 13 bp, Homo sapiens
ctgcagaagacag

SEQ ID NO: 5015455 - DNA, 23 bp, Homo sapiens
ctgcagaagacagtatggcagct

SEQ ID NO: 5015456 - DNA, 14 bp, Homo sapiens
ctgccaatatccta

SEQ ID NO: 5015457 - DNA, 16 bp, Homo sapiens
ctgccaatatcctaat

SEQ ID NO: 5015458 - DNA, 14 bp, Homo sapiens
ctgccggtttgaaa

SEQ ID NO: 5015459 - DNA, 20 bp, Homo sapiens
ctgccggtttgaaaatatgc

SEQ ID NO: 5015460 - DNA, 15 bp, Homo sapiens
ctgcctaagtgcagc

SEQ ID NO: 5015461 - DNA, 17 bp, Homo sapiens
ctgcctgcaatatttga

SEQ ID NO: 5015462 - DNA, 13 bp, Homo sapiens
ctggagctctgcc

SEQ ID NO: 5015463 - DNA, 20 bp, Homo sapiens
ctgggcttggggcttcctaa

SEQ ID NO: 5015464 - DNA, 13 bp, Homo sapiens
ctgggtgacagag

SEQ ID NO: 5015465 - DNA, 23 bp, Homo sapiens
ctgggtgacagagcaagactctg

SEQ ID NO: 5015466 - DNA, 12 bp, Homo sapiens
ctggtgcctcac

SEQ ID NO: 5015467 - DNA, 16 bp, Homo sapiens
ctgtaaaatggagaca

SEQ ID NO: 5015468 - DNA, 23 bp, Homo sapiens
ctgtaatcacagctacttgggag

SEQ ID NO: 5015469 - DNA, 13 bp, Homo sapiens
ctgtaatcccagc

SEQ ID NO: 5015470 - DNA, 20 bp, Homo sapiens
ctgtaatcccagcactttgg

SEQ ID NO: 5015471 - DNA, 18 bp, Homo sapiens
ctgtctctactaaaaata

SEQ ID NO: 5015472 - DNA, 18 bp, Homo sapiens
ctgtgaacgatttagaaa

SEQ ID NO: 5015473 - DNA, 22 bp, Homo sapiens
ctgtggccagcttgttatttat

SEQ ID NO: 5015474 - DNA, 13 bp, Homo sapiens
ctgttttccctga

SEQ ID NO: 5015475 - DNA, 16 bp, Homo sapiens
ctgtttttaagctgtt

SEQ ID NO: 5015476 - DNA, 12 bp, Homo sapiens
cttaaaaatggt

SEQ ID NO: 5015477 - DNA, 13 bp, Homo sapiens
cttaaaaatggtt

SEQ ID NO: 5015478 - DNA, 21 bp, Homo sapiens
cttagaccctcatgctgccaa

SEQ ID NO: 5015479 - DNA, 23 bp, Homo sapiens
cttagaccctcatgctgccaata

SEQ ID NO: 5015480 - DNA, 14 bp, Homo sapiens
cttatagaatattt

SEQ ID NO: 5015481 - DNA, 11 bp, Homo sapiens
cttcagacata

SEQ ID NO: 5015482 - DNA, 15 bp, Homo sapiens
cttcagcctgaaaga

SEQ ID NO: 5015483 - DNA, 18 bp, Homo sapiens
cttcatagcagattttaa

SEQ ID NO: 5015484 - DNA, 21 bp, Homo sapiens
cttctctgtgaacgatttaga

SEQ ID NO: 5015485 - DNA, 13 bp, Homo sapiens
cttgaaagctgtg

SEQ ID NO: 5015486 - DNA, 20 bp, Homo sapiens
cttgaacccgggaggcagag

SEQ ID NO: 5015487 - DNA, 13 bp, Homo sapiens
cttgagaaacctt

SEQ ID NO: 5015488 - DNA, 22 bp, Homo sapiens
cttgaggacttgggcgggacac

SEQ ID NO: 5015489 - DNA, 22 bp, Homo sapiens
cttggcccaggagtttggccag

SEQ ID NO: 5015490 - DNA, 14 bp, Homo sapiens
cttgtctctgggct

SEQ ID NO: 5015491 - DNA, 13 bp, Homo sapiens
cttgttatttata

SEQ ID NO: 5015492 - DNA, 19 bp, Homo sapiens
ctttcctcaaaacttcaga

SEQ ID NO: 5015493 - DNA, 17 bp, Homo sapiens
cttttgtgtaatgaaaa

SEQ ID NO: 5015494 - DNA, 20 bp, Homo sapiens
gaaaaaaaatgttctttggg

SEQ ID NO: 5015495 - DNA, 22 bp, Homo sapiens
gaaaatctacactccagtgaga

SEQ ID NO: 5015496 - DNA, 19 bp, Homo sapiens
gaaaccttattgtacctct

SEQ ID NO: 5015497 - DNA, 20 bp, Homo sapiens
gaaaccttattgtacctctc

SEQ ID NO: 5015498 - DNA, 21 bp, Homo sapiens
gaaagaggaatgaagtactca

SEQ ID NO: 5015499 - DNA, 17 bp, Homo sapiens
gaaagcagaacagtgat

SEQ ID NO: 5015500 - DNA, 22 bp, Homo sapiens
gaaagcagaacagtgattacca

SEQ ID NO: 5015501 - DNA, 16 bp, Homo sapiens
gaacagtgattaccag

SEQ ID NO: 5015502 - DNA, 18 bp, Homo sapiens
gaacgatttagaaagaag

SEQ ID NO: 5015503 - DNA, 23 bp, Homo sapiens
gaagcaacccaaatgttcatcaa

SEQ ID NO: 5015504 - DNA, 22 bp, Homo sapiens
gaataaataaatgtatcttatt

SEQ ID NO: 5015505 - DNA, 10 bp, Homo sapiens
gaatatttat

SEQ ID NO: 5015506 - DNA, 12 bp, Homo sapiens
gaatatttatta

SEQ ID NO: 5015507 - DNA, 15 bp, Homo sapiens
gaatgaatggctaag

SEQ ID NO: 5015508 - DNA, 12 bp, Homo sapiens
gaatgtgtcagg

SEQ ID NO: 5015509 - DNA, 17 bp, Homo sapiens
gaatgttacattgtttg

SEQ ID NO: 5015510 - DNA, 20 bp, Homo sapiens
gaatgttacattgtttgtct

SEQ ID NO: 5015511 - DNA, 21 bp, Homo sapiens
gaattgacccacaagaaatga

SEQ ID NO: 5015512 - DNA, 23 bp, Homo sapiens
gaatttattcaattcctctggga

SEQ ID NO: 5015513 - DNA, 12 bp, Homo sapiens
gacaccaccacc

SEQ ID NO: 5015514 - DNA, 16 bp, Homo sapiens
gacacttaaaaatggt

SEQ ID NO: 5015515 - DNA, 20 bp, Homo sapiens
gacagtatggcagctttcct

SEQ ID NO: 5015516 - DNA, 16 bp, Homo sapiens
gaccactgcagaagac

SEQ ID NO: 5015517 - DNA, 18 bp, Homo sapiens
gacccaaaaggcagaagc

SEQ ID NO: 5015518 - DNA, 15 bp, Homo sapiens
gacccacaagaaatg

SEQ ID NO: 5015519 - DNA, 22 bp, Homo sapiens
gacccacaagaaatgaaagcag

SEQ ID NO: 5015520 - DNA, 22 bp, Homo sapiens
gacccagccccttgagaaacct

SEQ ID NO: 5015521 - DNA, 12 bp, Homo sapiens
gaccctcatgct

SEQ ID NO: 5015522 - DNA, 17 bp, Homo sapiens
gaccctcatgctgccaa

SEQ ID NO: 5015523 - DNA, 15 bp, Homo sapiens
gactaattaggcaag

SEQ ID NO: 5015524 - DNA, 21 bp, Homo sapiens
gagaaaccttattgtacctct

SEQ ID NO: 5015525 - DNA, 14 bp, Homo sapiens
gagaatcacttgaa

SEQ ID NO: 5015526 - DNA, 16 bp, Homo sapiens
gagcacctgcaggcgt

SEQ ID NO: 5015527 - DNA, 21 bp, Homo sapiens
gagcacctgcaggcgtgacct

SEQ ID NO: 5015528 - DNA, 15 bp, Homo sapiens
gagcgacagtgagac

SEQ ID NO: 5015529 - DNA, 16 bp, Homo sapiens
gagcttctctgtgaac

SEQ ID NO: 5015530 - DNA, 19 bp, Homo sapiens
gaggcagaggttgcagtga

SEQ ID NO: 5015531 - DNA, 18 bp, Homo sapiens
gaggctgagatgggagaa

SEQ ID NO: 5015532 - DNA, 19 bp, Homo sapiens
gagtgaacaaatttacaga

SEQ ID NO: 5015533 - DNA, 17 bp, Homo sapiens
gatctggggctctggga

SEQ ID NO: 5015534 - DNA, 14 bp, Homo sapiens
gatgaaaacatagc

SEQ ID NO: 5015535 - DNA, 21 bp, Homo sapiens
gatggctagtatcaaaagaaa

SEQ ID NO: 5015536 - DNA, 17 bp, Homo sapiens
gatgtagaggagaaact

SEQ ID NO: 5015537 - DNA, 21 bp, Homo sapiens
gattcccctaacctcattccc

SEQ ID NO: 5015538 - DNA, 15 bp, Homo sapiens
gattttaattttgaa

SEQ ID NO: 5015539 - DNA, 19 bp, Homo sapiens
gcactttaacacagtgtct

SEQ ID NO: 5015540 - DNA, 12 bp, Homo sapiens
gcagaacagtga

SEQ ID NO: 5015541 - DNA, 18 bp, Homo sapiens
gcagcaggatagagtggg

SEQ ID NO: 5015542 - DNA, 15 bp, Homo sapiens
gcagcttattcacaa

SEQ ID NO: 5015543 - DNA, 20 bp, Homo sapiens
gcagtgcttggcccaggagt

SEQ ID NO: 5015544 - DNA, 17 bp, Homo sapiens
gccaatatcctaataaa

SEQ ID NO: 5015545 - DNA, 19 bp, Homo sapiens
gccaatatcctaataaaaa

SEQ ID NO: 5015546 - DNA, 20 bp, Homo sapiens
gccaatatcctaataaaaag

SEQ ID NO: 5015547 - DNA, 23 bp, Homo sapiens
gccaatatcctaataaaaaggtg

SEQ ID NO: 5015548 - DNA, 20 bp, Homo sapiens
gccagaagtcaaggcttaga

SEQ ID NO: 5015549 - DNA, 23 bp, Homo sapiens
gccagaagtcaaggcttagaccc

SEQ ID NO: 5015550 - DNA, 22 bp, Homo sapiens
gcccacaccagggcctggctgg

SEQ ID NO: 5015551 - DNA, 16 bp, Homo sapiens
gcccaggagtttggcc

SEQ ID NO: 5015552 - DNA, 17 bp, Homo sapiens
gcccaggagtttggcca

SEQ ID NO: 5015553 - DNA, 18 bp, Homo sapiens
gcccaggagtttggccag

SEQ ID NO: 5015554 - DNA, 19 bp, Homo sapiens
gcccaggagtttggccaga

SEQ ID NO: 5015555 - DNA, 17 bp, Homo sapiens
gccccgtggggttcctc

SEQ ID NO: 5015556 - DNA, 20 bp, Homo sapiens
gcctgagcgacagtgagact

SEQ ID NO: 5015557 - DNA, 18 bp, Homo sapiens
gcctgtaatcccagcact

SEQ ID NO: 5015558 - DNA, 11 bp, Homo sapiens
gcgccaccacg

SEQ ID NO: 5015559 - DNA, 13 bp, Homo sapiens
gcgcgccaccacg

SEQ ID NO: 5015560 - DNA, 17 bp, Homo sapiens
gctacttgggaggctga

SEQ ID NO: 5015561 - DNA, 16 bp, Homo sapiens
gctagtatcaaaagaa

SEQ ID NO: 5015562 - DNA, 15 bp, Homo sapiens
gctctgcccatcctg

SEQ ID NO: 5015563 - DNA, 21 bp, Homo sapiens
gctctgcccatcctgcccctg

SEQ ID NO: 5015564 - DNA, 22 bp, Homo sapiens
gctgacccagccccttgagaaa

SEQ ID NO: 5015565 - DNA, 19 bp, Homo sapiens
gctgccaatatcctaataa

SEQ ID NO: 5015566 - DNA, 23 bp, Homo sapiens
gctgccaatatcctaataaaaag

SEQ ID NO: 5015567 - DNA, 17 bp, Homo sapiens
gctggagctctgcccat

SEQ ID NO: 5015568 - DNA, 14 bp, Homo sapiens
gctggccaggctgg

SEQ ID NO: 5015569 - DNA, 16 bp, Homo sapiens
gctgttgagctgtttt

SEQ ID NO: 5015570 - DNA, 21 bp, Homo sapiens
gcttagaccctcatgctgcca

SEQ ID NO: 5015571 - DNA, 15 bp, Homo sapiens
gcttccaaatattgt

SEQ ID NO: 5015572 - DNA, 19 bp, Homo sapiens
gcttgccctggtgcctcac

SEQ ID NO: 5015573 - DNA, 22 bp, Homo sapiens
gcttggcccaggagtttggcca

SEQ ID NO: 5015574 - DNA, 16 bp, Homo sapiens
gcttggggcttcctaa

SEQ ID NO: 5015575 - DNA, 13 bp, Homo sapiens
ggagaaactggaa

SEQ ID NO: 5015576 - DNA, 19 bp, Homo sapiens
ggaggctgagatgggagaa

SEQ ID NO: 5015577 - DNA, 15 bp, Homo sapiens
ggagtttggccagaa

SEQ ID NO: 5015578 - DNA, 18 bp, Homo sapiens
ggatctggggctctggga

SEQ ID NO: 5015579 - DNA, 13 bp, Homo sapiens
ggattcaagtgat

SEQ ID NO: 5015580 - DNA, 22 bp, Homo sapiens
ggcagtgcttggcccaggagtt

SEQ ID NO: 5015581 - DNA, 23 bp, Homo sapiens
ggcagtgcttggcccaggagttt

SEQ ID NO: 5015582 - DNA, 21 bp, Homo sapiens
ggcatgtatgacgtgactggc

SEQ ID NO: 5015583 - DNA, 13 bp, Homo sapiens
ggcccaggagttt

SEQ ID NO: 5015584 - DNA, 18 bp, Homo sapiens
ggcccaggagtttggcca

SEQ ID NO: 5015585 - DNA, 23 bp, Homo sapiens
ggcccaggagtttggccagaagt

SEQ ID NO: 5015586 - DNA, 22 bp, Homo sapiens
ggcgcgcacctgtaatcccagc

SEQ ID NO: 5015587 - DNA, 19 bp, Homo sapiens
ggcgggacacaggctccaa

SEQ ID NO: 5015588 - DNA, 21 bp, Homo sapiens
ggctggagtgcagtggcgcaa

SEQ ID NO: 5015589 - DNA, 11 bp, Homo sapiens
gggaggcagag

SEQ ID NO: 5015590 - DNA, 17 bp, Homo sapiens
gggattgtaaaatggtg

SEQ ID NO: 5015591 - DNA, 21 bp, Homo sapiens
ggggcagtgcttggcccagga

SEQ ID NO: 5015592 - DNA, 23 bp, Homo sapiens
ggggcagtgcttggcccaggagt

SEQ ID NO: 5015593 - DNA, 18 bp, Homo sapiens
ggtggggcagtgcttggc

SEQ ID NO: 5015594 - DNA, 16 bp, Homo sapiens
ggtgtgaccactgcag

SEQ ID NO: 5015595 - DNA, 16 bp, Homo sapiens
ggtttagaaagcttgc

SEQ ID NO: 5015596 - DNA, 20 bp, Homo sapiens
gtaatcccagcactttggga

SEQ ID NO: 5015597 - DNA, 16 bp, Homo sapiens
gtatattttatatcaa

SEQ ID NO: 5015598 - DNA, 12 bp, Homo sapiens
gtattatttata

SEQ ID NO: 5015599 - DNA, 15 bp, Homo sapiens
gtcaatgcagccccc

SEQ ID NO: 5015600 - DNA, 20 bp, Homo sapiens
gtcacaggaagtagaggagg

SEQ ID NO: 5015601 - DNA, 22 bp, Homo sapiens
gtctcagtgtcctcatctgtaa

SEQ ID NO: 5015602 - DNA, 16 bp, Homo sapiens
gtgaacgatttagaaa

SEQ ID NO: 5015603 - DNA, 15 bp, Homo sapiens
gtgcttggcccagga

SEQ ID NO: 5015604 - DNA, 16 bp, Homo sapiens
gtgcttggcccaggag

SEQ ID NO: 5015605 - DNA, 21 bp, Homo sapiens
gtgtctcggagggattcccct

SEQ ID NO: 5015606 - DNA, 16 bp, Homo sapiens
gttcatcaatgaatga

SEQ ID NO: 5015607 - DNA, 14 bp, Homo sapiens
gttgacaactgtga

SEQ ID NO: 5015608 - DNA, 23 bp, Homo sapiens
gtttggccagaagtcaaggctta

SEQ ID NO: 5015609 - DNA, 19 bp, Homo sapiens
gtttttaagctgtttccat

SEQ ID NO: 5015610 - DNA, 15 bp, Homo sapiens
taaaaaggtgaccat

SEQ ID NO: 5015611 - DNA, 18 bp, Homo sapiens
taaatctatttattaata

SEQ ID NO: 5015612 - DNA, 19 bp, Homo sapiens
taaatgtatcttattcaca

SEQ ID NO: 5015613 - DNA, 20 bp, Homo sapiens
taaattgacacttaaaaatg

SEQ ID NO: 5015614 - DNA, 23 bp, Homo sapiens
taaattgacacttaaaaatggtt

SEQ ID NO: 5015615 - DNA, 15 bp, Homo sapiens
taacattatttatat

SEQ ID NO: 5015616 - DNA, 16 bp, Homo sapiens
taacattatttatatg

SEQ ID NO: 5015617 - DNA, 21 bp, Homo sapiens
taagcaaaatgtgatatgtac

SEQ ID NO: 5015618 - DNA, 13 bp, Homo sapiens
taagccagacatc

SEQ ID NO: 5015619 - DNA, 14 bp, Homo sapiens
taatatatatgaat

SEQ ID NO: 5015620 - DNA, 20 bp, Homo sapiens
taatatatgtattatttata

SEQ ID NO: 5015621 - DNA, 13 bp, Homo sapiens
taatatttaacat

SEQ ID NO: 5015622 - DNA, 19 bp, Homo sapiens
taatcccagcactttggga

SEQ ID NO: 5015623 - DNA, 22 bp, Homo sapiens
taatcctttgttttctgactaa

SEQ ID NO: 5015624 - DNA, 19 bp, Homo sapiens
taatgccactaaattgaca

SEQ ID NO: 5015625 - DNA, 23 bp, Homo sapiens
taatttatcttgtctctgggctt

SEQ ID NO: 5015626 - DNA, 15 bp, Homo sapiens
tacaatgaacactta

SEQ ID NO: 5015627 - DNA, 12 bp, Homo sapiens
taccctctgggt

SEQ ID NO: 5015628 - DNA, 22 bp, Homo sapiens
tacctaacgaagtatccttcag

SEQ ID NO: 5015629 - DNA, 22 bp, Homo sapiens
tacctcaacccccatttctatt

SEQ ID NO: 5015630 - DNA, 14 bp, Homo sapiens
tacctctgatacct

SEQ ID NO: 5015631 - DNA, 15 bp, Homo sapiens
tacctctgatacctc

SEQ ID NO: 5015632 - DNA, 17 bp, Homo sapiens
tacctctgatacctcaa

SEQ ID NO: 5015633 - DNA, 14 bp, Homo sapiens
tactaaaaatacaa

SEQ ID NO: 5015634 - DNA, 21 bp, Homo sapiens
tagaaagaagcccaatattat

SEQ ID NO: 5015635 - DNA, 15 bp, Homo sapiens
tagaatatttattac

SEQ ID NO: 5015636 - DNA, 22 bp, Homo sapiens
tagaatttattcaattcctctg

SEQ ID NO: 5015637 - DNA, 23 bp, Homo sapiens
tagaccctcatgctgccaatatc

SEQ ID NO: 5015638 - DNA, 19 bp, Homo sapiens
tagaggagaaactggaact

SEQ ID NO: 5015639 - DNA, 21 bp, Homo sapiens
tagctgacccagccccttgag

SEQ ID NO: 5015640 - DNA, 15 bp, Homo sapiens
taggaagagaaacca

SEQ ID NO: 5015641 - DNA, 12 bp, Homo sapiens
taggaattgacc

SEQ ID NO: 5015642 - DNA, 20 bp, Homo sapiens
taggacataaattagaggtc

SEQ ID NO: 5015643 - DNA, 19 bp, Homo sapiens
taggcaaggctatgtgatt

SEQ ID NO: 5015644 - DNA, 18 bp, Homo sapiens
tataagtgaagtgatact

SEQ ID NO: 5015645 - DNA, 17 bp, Homo sapiens
tataatagcaacttttg

SEQ ID NO: 5015646 - DNA, 18 bp, Homo sapiens
tataatttttttcaatat

SEQ ID NO: 5015647 - DNA, 15 bp, Homo sapiens
tatagaatatttatt

SEQ ID NO: 5015648 - DNA, 11 bp, Homo sapiens
tatagactcta

SEQ ID NO: 5015649 - DNA, 14 bp, Homo sapiens
tatatcctgtgact

SEQ ID NO: 5015650 - DNA, 19 bp, Homo sapiens
tatatgtattatttataat

SEQ ID NO: 5015651 - DNA, 15 bp, Homo sapiens
tatcctaataaaaag

SEQ ID NO: 5015652 - DNA, 18 bp, Homo sapiens
tatcctaataaaaaggtg

SEQ ID NO: 5015653 - DNA, 16 bp, Homo sapiens
tatcctgtgactgtct

SEQ ID NO: 5015654 - DNA, 15 bp, Homo sapiens
tatccttcagcctga

SEQ ID NO: 5015655 - DNA, 18 bp, Homo sapiens
tatctaatatatatgaat

SEQ ID NO: 5015656 - DNA, 20 bp, Homo sapiens
tatctaatatatatgaataa

SEQ ID NO: 5015657 - DNA, 13 bp, Homo sapiens
tatctattaatat

SEQ ID NO: 5015658 - DNA, 18 bp, Homo sapiens
tatctattaatatatgta

SEQ ID NO: 5015659 - DNA, 13 bp, Homo sapiens
tatgtattattta

SEQ ID NO: 5015660 - DNA, 13 bp, Homo sapiens
tattaatatttaa

SEQ ID NO: 5015661 - DNA, 13 bp, Homo sapiens
tattacctctgat

SEQ ID NO: 5015662 - DNA, 19 bp, Homo sapiens
tattataatttttttcaat

SEQ ID NO: 5015663 - DNA, 15 bp, Homo sapiens
tattatttataattc

SEQ ID NO: 5015664 - DNA, 16 bp, Homo sapiens
tattattttcacctgt

SEQ ID NO: 5015665 - DNA, 16 bp, Homo sapiens
tattcaattcctctgg

SEQ ID NO: 5015666 - DNA, 14 bp, Homo sapiens
tattgtacctctct

SEQ ID NO: 5015667 - DNA, 19 bp, Homo sapiens
tattgttgacaactgtgac

SEQ ID NO: 5015668 - DNA, 23 bp, Homo sapiens
tattgttgacaactgtgactgta

SEQ ID NO: 5015669 - DNA, 18 bp, Homo sapiens
tatttattaatatttaac

SEQ ID NO: 5015670 - DNA, 19 bp, Homo sapiens
tatttattaatatttaaca

SEQ ID NO: 5015671 - DNA, 16 bp, Homo sapiens
tatttattacctctga

SEQ ID NO: 5015672 - DNA, 19 bp, Homo sapiens
tatttattattttcacctg

SEQ ID NO: 5015673 - DNA, 16 bp, Homo sapiens
tatttcacttgatgat

SEQ ID NO: 5015674 - DNA, 18 bp, Homo sapiens
tcaaaagaaagaaaatca

SEQ ID NO: 5015675 - DNA, 18 bp, Homo sapiens
tcaaataagtatttataa

SEQ ID NO: 5015676 - DNA, 18 bp, Homo sapiens
tcaacccccatttctatt

SEQ ID NO: 5015677 - DNA, 19 bp, Homo sapiens
tcaatatctaatatatatg

SEQ ID NO: 5015678 - DNA, 21 bp, Homo sapiens
tcaatatctaatatatatgaa

SEQ ID NO: 5015679 - DNA, 11 bp, Homo sapiens
tcaatatttat

SEQ ID NO: 5015680 - DNA, 21 bp, Homo sapiens
tcaatcaaataagtatttata

SEQ ID NO: 5015681 - DNA, 23 bp, Homo sapiens
tcaatgaatgaatgaatggctaa

SEQ ID NO: 5015682 - DNA, 13 bp, Homo sapiens
tcaatgcagcccc

SEQ ID NO: 5015683 - DNA, 13 bp, Homo sapiens
tcacaagacccaa

SEQ ID NO: 5015684 - DNA, 20 bp, Homo sapiens
tcacctgtttttaagctgtt

SEQ ID NO: 5015685 - DNA, 22 bp, Homo sapiens
tcacctgtttttaagctgtttc

SEQ ID NO: 5015686 - DNA, 23 bp, Homo sapiens
tcacttgaacccgggaggcagag

SEQ ID NO: 5015687 - DNA, 12 bp, Homo sapiens
tcaggagttcct

SEQ ID NO: 5015688 - DNA, 21 bp, Homo sapiens
tcatcaatcaaataagtattt

SEQ ID NO: 5015689 - DNA, 13 bp, Homo sapiens
tcatgctgccaat

SEQ ID NO: 5015690 - DNA, 17 bp, Homo sapiens
tcatgctgccaatatcc

SEQ ID NO: 5015691 - DNA, 20 bp, Homo sapiens
tcatgctgccaatatcctaa

SEQ ID NO: 5015692 - DNA, 16 bp, Homo sapiens
tcattaggatggctag

SEQ ID NO: 5015693 - DNA, 17 bp, Homo sapiens
tcattcttgaaagctgt

SEQ ID NO: 5015694 - DNA, 18 bp, Homo sapiens
tcattcttgaaagctgtg

SEQ ID NO: 5015695 - DNA, 20 bp, Homo sapiens
tccagcctgagcgacagtga

SEQ ID NO: 5015696 - DNA, 14 bp, Homo sapiens
tccagtgagacagc

SEQ ID NO: 5015697 - DNA, 16 bp, Homo sapiens
tcccagcactttggga

SEQ ID NO: 5015698 - DNA, 17 bp, Homo sapiens
tcccagctacttgggag

SEQ ID NO: 5015699 - DNA, 14 bp, Homo sapiens
tcccctaacctcat

SEQ ID NO: 5015700 - DNA, 16 bp, Homo sapiens
tcctaataaaaaggtg

SEQ ID NO: 5015701 - DNA, 17 bp, Homo sapiens
tcctaataaaaaggtga

SEQ ID NO: 5015702 - DNA, 18 bp, Homo sapiens
tcctatatcctgtgactg

SEQ ID NO: 5015703 - DNA, 18 bp, Homo sapiens
tcctgcccctgagcccat

SEQ ID NO: 5015704 - DNA, 22 bp, Homo sapiens
tcctttgttttctgactaatta

SEQ ID NO: 5015705 - DNA, 14 bp, Homo sapiens
tctaaatctattta

SEQ ID NO: 5015706 - DNA, 16 bp, Homo sapiens
tctaaatctatttatt

SEQ ID NO: 5015707 - DNA, 23 bp, Homo sapiens
tctaatttatcttgtctctgggc

SEQ ID NO: 5015708 - DNA, 17 bp, Homo sapiens
tgaagtactcatacatg

SEQ ID NO: 5015709 - DNA, 12 bp, Homo sapiens
tgaataaagtgt

SEQ ID NO: 5015710 - DNA, 14 bp, Homo sapiens
tgaatatctattaa

SEQ ID NO: 5015711 - DNA, 16 bp, Homo sapiens
tgaatatctattaata

SEQ ID NO: 5015712 - DNA, 20 bp, Homo sapiens
tgaatgaatggctaagcaaa

SEQ ID NO: 5015713 - DNA, 12 bp, Homo sapiens
tgaatgtgtcag

SEQ ID NO: 5015714 - DNA, 13 bp, Homo sapiens
tgacaactgtgac

SEQ ID NO: 5015715 - DNA, 16 bp, Homo sapiens
tgacacttaaaaatgg

SEQ ID NO: 5015716 - DNA, 17 bp, Homo sapiens
tgaccactgcagaagac

SEQ ID NO: 5015717 - DNA, 20 bp, Homo sapiens
tgaccactgcagaagacagt

SEQ ID NO: 5015718 - DNA, 17 bp, Homo sapiens
tgacccacaagaaatga

SEQ ID NO: 5015719 - DNA, 23 bp, Homo sapiens
tgagaaaccttattgtacctctc

SEQ ID NO: 5015720 - DNA, 16 bp, Homo sapiens
tgagacagctctgcat

SEQ ID NO: 5015721 - DNA, 21 bp, Homo sapiens
tgagccagtgctttaatggca

SEQ ID NO: 5015722 - DNA, 14 bp, Homo sapiens
tgagcgacagtgag

SEQ ID NO: 5015723 - DNA, 16 bp, Homo sapiens
tgagcgacagtgagac

SEQ ID NO: 5015724 - DNA, 24 bp, Homo sapiens
tgatagttgtaccgcaatgtgact

SEQ ID NO: 5015725 - DNA, 21 bp, Homo sapiens
tgattaattcaccttccagtg

SEQ ID NO: 5015726 - DNA, 13 bp, Homo sapiens
tgatttcattcaa

SEQ ID NO: 5015727 - DNA, 14 bp, Homo sapiens
tgcagaagacagta

SEQ ID NO: 5015728 - DNA, 16 bp, Homo sapiens
tgcagataaacagtag

SEQ ID NO: 5015729 - DNA, 17 bp, Homo sapiens
tgcagataaacagtagt

SEQ ID NO: 5015730 - DNA, 20 bp, Homo sapiens
tgcaggcagcaggatagagt

SEQ ID NO: 5015731 - DNA, 14 bp, Homo sapiens
tgccaatatcctaa

SEQ ID NO: 5015732 - DNA, 15 bp, Homo sapiens
tgccaatatcctaat

SEQ ID NO: 5015733 - DNA, 16 bp, Homo sapiens
tgccaatatcctaata

SEQ ID NO: 5015734 - DNA, 19 bp, Homo sapiens
tgccaatatcctaataaaa

SEQ ID NO: 5015735 - DNA, 20 bp, Homo sapiens
tgccactaaattgacactta

SEQ ID NO: 5015736 - DNA, 13 bp, Homo sapiens
tgccataattact

SEQ ID NO: 5015737 - DNA, 20 bp, Homo sapiens
tgcctggtgcttccaaatat

SEQ ID NO: 5015738 - DNA, 18 bp, Homo sapiens
tgcctgtaatcacagcta

SEQ ID NO: 5015739 - DNA, 16 bp, Homo sapiens
tgctgccaatatccta

SEQ ID NO: 5015740 - DNA, 13 bp, Homo sapiens
tgctggagctctg

SEQ ID NO: 5015741 - DNA, 16 bp, Homo sapiens
tggagacaccaccacc

SEQ ID NO: 5015742 - DNA, 18 bp, Homo sapiens
tggagacaccaccaccct

SEQ ID NO: 5015743 - DNA, 22 bp, Homo sapiens
tggagcttgaaatagtgtctga

SEQ ID NO: 5015744 - DNA, 12 bp, Homo sapiens
tggcccaggagt

SEQ ID NO: 5015745 - DNA, 13 bp, Homo sapiens
tggcccaggagtt

SEQ ID NO: 5015746 - DNA, 14 bp, Homo sapiens
tggcccaggagttt

SEQ ID NO: 5015747 - DNA, 19 bp, Homo sapiens
tggcccaggagtttggcca

SEQ ID NO: 5015748 - DNA, 14 bp, Homo sapiens
tgggcgggacacag

SEQ ID NO: 5015749 - DNA, 20 bp, Homo sapiens
tggggcagtgcttggcccag

SEQ ID NO: 5015750 - DNA, 23 bp, Homo sapiens
tggggcagtgcttggcccaggag

SEQ ID NO: 5015751 - DNA, 14 bp, Homo sapiens
tgggtgacagagca

SEQ ID NO: 5015752 - DNA, 12 bp, Homo sapiens
tgtaaaatggtg

SEQ ID NO: 5015753 - DNA, 21 bp, Homo sapiens
tgtaatgaaaatgaatatcta

SEQ ID NO: 5015754 - DNA, 21 bp, Homo sapiens
tgtcagacagaacttgaatgt

SEQ ID NO: 5015755 - DNA, 21 bp, Homo sapiens
tgtctcagtccatgaagatgt

SEQ ID NO: 5015756 - DNA, 23 bp, Homo sapiens
tgtctctgggcttggggcttcct

SEQ ID NO: 5015757 - DNA, 20 bp, Homo sapiens
tgtggtcacaggaagtagag

SEQ ID NO: 5015758 - DNA, 13 bp, Homo sapiens
tgtgtaatgaaaa

SEQ ID NO: 5015759 - DNA, 21 bp, Homo sapiens
tgttaaaattatcaatatcta

SEQ ID NO: 5015760 - DNA, 15 bp, Homo sapiens
tgttctaagaagtga

SEQ ID NO: 5015761 - DNA, 19 bp, Homo sapiens
tgtttgtctgtcttcatag

SEQ ID NO: 5015762 - DNA, 15 bp, Homo sapiens
tgtttttaagctgtt

SEQ ID NO: 5015763 - DNA, 22 bp, Homo sapiens
tgtttttaagctgtttccatag

SEQ ID NO: 5015764 - DNA, 23 bp, Homo sapiens
ttaaaattatcaatatctaatat

SEQ ID NO: 5015765 - DNA, 12 bp, Homo sapiens
ttaactagaatt

SEQ ID NO: 5015766 - DNA, 14 bp, Homo sapiens
ttaactagaattta

SEQ ID NO: 5015767 - DNA, 16 bp, Homo sapiens
ttaactagaatttatt

SEQ ID NO: 5015768 - DNA, 21 bp, Homo sapiens
ttaactagaatttattcaatt

SEQ ID NO: 5015769 - DNA, 14 bp, Homo sapiens
ttaagctgtttcca

SEQ ID NO: 5015770 - DNA, 16 bp, Homo sapiens
ttaatatttaacatta

SEQ ID NO: 5015771 - DNA, 20 bp, Homo sapiens
ttacagagacagaaagcaga

SEQ ID NO: 5015772 - DNA, 23 bp, Homo sapiens
ttaccctctgggtctcagtgtcc

SEQ ID NO: 5015773 - DNA, 22 bp, Homo sapiens
ttagaaagaagcccaatattat

SEQ ID NO: 5015774 - DNA, 19 bp, Homo sapiens
ttagaccctcatgctgcca

SEQ ID NO: 5015775 - DNA, 20 bp, Homo sapiens
ttagaccctcatgctgccaa

SEQ ID NO: 5015776 - DNA, 18 bp, Homo sapiens
ttaggatgttgaaaaagt

SEQ ID NO: 5015777 - DNA, 20 bp, Homo sapiens
ttaggcaaggctatgtgatt

SEQ ID NO: 5015778 - DNA, 15 bp, Homo sapiens
ttatcaatatctaat

SEQ ID NO: 5015779 - DNA, 16 bp, Homo sapiens
ttatcaatatctaata

SEQ ID NO: 5015780 - DNA, 16 bp, Homo sapiens
ttatcttgtctctggg

SEQ ID NO: 5015781 - DNA, 11 bp, Homo sapiens
ttattaatatt

SEQ ID NO: 5015782 - DNA, 12 bp, Homo sapiens
ttattacctctg

SEQ ID NO: 5015783 - DNA, 16 bp, Homo sapiens
ttattattttcacctg

SEQ ID NO: 5015784 - DNA, 19 bp, Homo sapiens
ttattcaattcctctggga

SEQ ID NO: 5015785 - DNA, 21 bp, Homo sapiens
ttatttactgagcttctctgt

SEQ ID NO: 5015786 - DNA, 21 bp, Homo sapiens
ttatttatatggggaatatat

SEQ ID NO: 5015787 - DNA, 14 bp, Homo sapiens
ttatttcacttgat

SEQ ID NO: 5015788 - DNA, 12 bp, Homo sapiens
ttcaattcctct

SEQ ID NO: 5015789 - DNA, 16 bp, Homo sapiens
ttcaattcctctggga

SEQ ID NO: 5015790 - DNA, 22 bp, Homo sapiens
ttcacctgtttttaagctgttt

SEQ ID NO: 5015791 - DNA, 19 bp, Homo sapiens
ttccacttataggaattga

SEQ ID NO: 5015792 - DNA, 18 bp, Homo sapiens
ttccccaaccacttcatt

SEQ ID NO: 5015793 - DNA, 13 bp, Homo sapiens
ttctaagaagtga

SEQ ID NO: 5015794 - DNA, 15 bp, Homo sapiens
ttctatttatttact

SEQ ID NO: 5015795 - DNA, 20 bp, Homo sapiens
ttctctgtgaacgatttaga

SEQ ID NO: 5015796 - DNA, 13 bp, Homo sapiens
ttcttgaaagctg

SEQ ID NO: 5015797 - DNA, 22 bp, Homo sapiens
ttgaaagctgtggccagcttgt

SEQ ID NO: 5015798 - DNA, 12 bp, Homo sapiens
ttgaataaataa

SEQ ID NO: 5015799 - DNA, 16 bp, Homo sapiens
ttgaattttaaatcta

SEQ ID NO: 5015800 - DNA, 16 bp, Homo sapiens
ttgacaactgtgactg

SEQ ID NO: 5015801 - DNA, 19 bp, Homo sapiens
ttgacacttaaaaatggtt

SEQ ID NO: 5015802 - DNA, 10 bp, Homo sapiens
ttgagaaacc

SEQ ID NO: 5015803 - DNA, 23 bp, Homo sapiens
ttgagaaaccttattgtacctct

SEQ ID NO: 5015804 - DNA, 10 bp, Homo sapiens
ttgagacagg

SEQ ID NO: 5015805 - DNA, 18 bp, Homo sapiens
ttgagctgttttccctga

SEQ ID NO: 5015806 - DNA, 21 bp, Homo sapiens
ttgatgatacaatgaacactt

SEQ ID NO: 5015807 - DNA, 20 bp, Homo sapiens
ttggccagaagtcaaggctt

SEQ ID NO: 5015808 - DNA, 21 bp, Homo sapiens
ttggcccaggagtttggccag

SEQ ID NO: 5015809 - DNA, 16 bp, Homo sapiens
ttgtaccgcaatgtga

SEQ ID NO: 5015810 - DNA, 20 bp, Homo sapiens
ttgtcctgcctgcaatattt

SEQ ID NO: 5015811 - DNA, 11 bp, Homo sapiens
tttaagctgtt

SEQ ID NO: 5015812 - DNA, 12 bp, Homo sapiens
tttaagctgttt

SEQ ID NO: 5015813 - DNA, 18 bp, Homo sapiens
tttactgagcttctctgt

SEQ ID NO: 5015814 - DNA, 23 bp, Homo sapiens
tttagaaagaagcccaatattat

SEQ ID NO: 5015815 - DNA, 17 bp, Homo sapiens
tttattcaattcctctg

SEQ ID NO: 5015816 - DNA, 13 bp, Homo sapiens
aaaaatacaaaaa

SEQ ID NO: 5015817 - DNA, 17 bp, Homo sapiens
aaaaatggtttaaatgg

SEQ ID NO: 5015818 - DNA, 16 bp, Homo sapiens
aaaacatagcatctca

SEQ ID NO: 5015819 - DNA, 22 bp, Homo sapiens
aaaaggtatttattgagcacct

SEQ ID NO: 5015820 - DNA, 21 bp, Homo sapiens
aaaatctacactccagtgaga

SEQ ID NO: 5015821 - DNA, 14 bp, Homo sapiens
aaaatgaatatcta

SEQ ID NO: 5015822 - DNA, 18 bp, Homo sapiens
aaaatgaatatctattaa

SEQ ID NO: 5015823 - DNA, 15 bp, Homo sapiens
aaaatggagacacca

SEQ ID NO: 5015824 - DNA, 21 bp, Homo sapiens
aaaccctgtctctactaaaaa

SEQ ID NO: 5015825 - DNA, 12 bp, Homo sapiens
aaactttatgct

SEQ ID NO: 5015826 - DNA, 23 bp, Homo sapiens
aaagctgtggccagcttgttatt

SEQ ID NO: 5015827 - DNA, 14 bp, Homo sapiens
aaagtaactcattt

SEQ ID NO: 5015828 - DNA, 15 bp, Homo sapiens
aaagtaactcatttg

SEQ ID NO: 5015829 - DNA, 18 bp, Homo sapiens
aaagtaactcatttgtta

SEQ ID NO: 5015830 - DNA, 22 bp, Homo sapiens
aaagtaactcatttgttaaaat

SEQ ID NO: 5015831 - DNA, 14 bp, Homo sapiens
aaataaaaataaat

SEQ ID NO: 5015832 - DNA, 17 bp, Homo sapiens
aaatattgttgacaact

SEQ ID NO: 5015833 - DNA, 16 bp, Homo sapiens
aaatctaaatctattt

SEQ ID NO: 5015834 - DNA, 19 bp, Homo sapiens
aaatctacactccagtgag

SEQ ID NO: 5015835 - DNA, 19 bp, Homo sapiens
aaatctatttattaatatt

SEQ ID NO: 5015836 - DNA, 22 bp, Homo sapiens
aaatctatttattaatatttaa

SEQ ID NO: 5015837 - DNA, 22 bp, Homo sapiens
aaatgaaagcagggacttgaac

SEQ ID NO: 5015838 - DNA, 18 bp, Homo sapiens
aaatgaatatctattaat

SEQ ID NO: 5015839 - DNA, 20 bp, Homo sapiens
aaatggaaagtaactcattt

SEQ ID NO: 5015840 - DNA, 20 bp, Homo sapiens
aaatgttcatcaatgaatga

SEQ ID NO: 5015841 - DNA, 16 bp, Homo sapiens
aaattatcaatatcta

SEQ ID NO: 5015842 - DNA, 22 bp, Homo sapiens
aaattgacacttaaaaatggtt

SEQ ID NO: 5015843 - DNA, 16 bp, Homo sapiens
aacagataaatagttt

SEQ ID NO: 5015844 - DNA, 18 bp, Homo sapiens
aacctgagccccaaaagg

SEQ ID NO: 5015845 - DNA, 17 bp, Homo sapiens
aaccttattgtacctct

SEQ ID NO: 5015846 - DNA, 19 bp, Homo sapiens
aaccttattgtacctctct

SEQ ID NO: 5015847 - DNA, 20 bp, Homo sapiens
aacttttgtgtaatgaaaat

SEQ ID NO: 5015848 - DNA, 16 bp, Homo sapiens
aagaaagaaaatcagg

SEQ ID NO: 5015849 - DNA, 23 bp, Homo sapiens
aagaggaatgaagtactcataca

SEQ ID NO: 5015850 - DNA, 13 bp, Homo sapiens
aagcaaaatgtga

SEQ ID NO: 5015851 - DNA, 21 bp, Homo sapiens
aagcactttaacacagtgtct

SEQ ID NO: 5015852 - DNA, 15 bp, Homo sapiens
aaggctatgtgatta

SEQ ID NO: 5015853 - DNA, 22 bp, Homo sapiens
aagtgctgggaattacaggcgt

SEQ ID NO: 5015854 - DNA, 16 bp, Homo sapiens
aagttgcagtgagctg

SEQ ID NO: 5015855 - DNA, 12 bp, Homo sapiens
aataaaaaggtg

SEQ ID NO: 5015856 - DNA, 13 bp, Homo sapiens
aataaaaaggtga

SEQ ID NO: 5015857 - DNA, 20 bp, Homo sapiens
aataaatgtatcttattcac

SEQ ID NO: 5015858 - DNA, 23 bp, Homo sapiens
aatactcttaggaagagaaacca

SEQ ID NO: 5015859 - DNA, 15 bp, Homo sapiens
aatagcaacttttgt

SEQ ID NO: 5015860 - DNA, 12 bp, Homo sapiens
aatatatgtatt

SEQ ID NO: 5015861 - DNA, 21 bp, Homo sapiens
aatatcctaataaaaaggtga

SEQ ID NO: 5015862 - DNA, 14 bp, Homo sapiens
aatatctattaata

SEQ ID NO: 5015863 - DNA, 16 bp, Homo sapiens
aatattgttgacaact

SEQ ID NO: 5015864 - DNA, 22 bp, Homo sapiens
aatattgttgacaactgtgact

SEQ ID NO: 5015865 - DNA, 13 bp, Homo sapiens
aatatttattacc

SEQ ID NO: 5015866 - DNA, 15 bp, Homo sapiens
aatatttattacctc

SEQ ID NO: 5015867 - DNA, 17 bp, Homo sapiens
aatatttattacctctg

SEQ ID NO: 5015868 - DNA, 18 bp, Homo sapiens
aatatttattacctctga

SEQ ID NO: 5015869 - DNA, 14 bp, Homo sapiens
aatcaaataagtat

SEQ ID NO: 5015870 - DNA, 16 bp, Homo sapiens
aatcaaataagtattt

SEQ ID NO: 5015871 - DNA, 18 bp, Homo sapiens
aatcaaataagtatttat

SEQ ID NO: 5015872 - DNA, 21 bp, Homo sapiens
aatcggatctggggctctggg

SEQ ID NO: 5015873 - DNA, 22 bp, Homo sapiens
aatcggatctggggctctggga

SEQ ID NO: 5015874 - DNA, 16 bp, Homo sapiens
aatctatttattaata

SEQ ID NO: 5015875 - DNA, 15 bp, Homo sapiens
aatgaatgaatgaat

SEQ ID NO: 5015876 - DNA, 16 bp, Homo sapiens
aatgatttcattcaat

SEQ ID NO: 5015877 - DNA, 18 bp, Homo sapiens
catttgttaaaattatca

SEQ ID NO: 5015878 - DNA, 14 bp, Homo sapiens
ccaaaaggcagaag

SEQ ID NO: 5015879 - DNA, 12 bp, Homo sapiens
ccaatatcctaa

SEQ ID NO: 5015880 - DNA, 13 bp, Homo sapiens
ccaatatcctaat

SEQ ID NO: 5015881 - DNA, 18 bp, Homo sapiens
ccaatatcctaataaaaa

SEQ ID NO: 5015882 - DNA, 19 bp, Homo sapiens
ccaatatcctaataaaaag

SEQ ID NO: 5015883 - DNA, 13 bp, Homo sapiens
ccaatattataat

SEQ ID NO: 5015884 - DNA, 15 bp, Homo sapiens
ccagggcctggctgg

SEQ ID NO: 5015885 - DNA, 23 bp, Homo sapiens
ccatggcactctatgttctaaga

SEQ ID NO: 5015886 - DNA, 12 bp, Homo sapiens
ccatttctattt

SEQ ID NO: 5015887 - DNA, 13 bp, Homo sapiens
ccatttctattta

SEQ ID NO: 5015888 - DNA, 17 bp, Homo sapiens
ccatttctatttattta

SEQ ID NO: 5015889 - DNA, 11 bp, Homo sapiens
cccaatattat

SEQ ID NO: 5015890 - DNA, 15 bp, Homo sapiens
cccaatattataatt

SEQ ID NO: 5015891 - DNA, 13 bp, Homo sapiens
cccacaagaaatg

SEQ ID NO: 5015892 - DNA, 15 bp, Homo sapiens
cccagctacttggga

SEQ ID NO: 5015893 - DNA, 15 bp, Homo sapiens
cccaggagtttggcc

SEQ ID NO: 5015894 - DNA, 20 bp, Homo sapiens
cccaggagtttggccagaag

SEQ ID NO: 5015895 - DNA, 23 bp, Homo sapiens
cccatgggttgtgtgtttatttc

SEQ ID NO: 5015896 - DNA, 17 bp, Homo sapiens
cccatttctatttattt

SEQ ID NO: 5015897 - DNA, 20 bp, Homo sapiens
cccatttctatttatttact

SEQ ID NO: 5015898 - DNA, 13 bp, Homo sapiens
cccctgcactcca

SEQ ID NO: 5015899 - DNA, 14 bp, Homo sapiens
cccctgtactccag

SEQ ID NO: 5015900 - DNA, 23 bp, Homo sapiens
cccgggaggcagaggttgcagtg

SEQ ID NO: 5015901 - DNA, 15 bp, Homo sapiens
cccgtggggttcctc

SEQ ID NO: 5015902 - DNA, 14 bp, Homo sapiens
ccctcatgctgcca

SEQ ID NO: 5015903 - DNA, 17 bp, Homo sapiens
ccctcatgctgccaata

SEQ ID NO: 5015904 - DNA, 22 bp, Homo sapiens
ccgggaggcagaggttgcagtg

SEQ ID NO: 5015905 - DNA, 16 bp, Homo sapiens
cctaataaaaaggtga

SEQ ID NO: 5015906 - DNA, 13 bp, Homo sapiens
cctcatgctgcca

SEQ ID NO: 5015907 - DNA, 15 bp, Homo sapiens
cctcatgctgccaat

SEQ ID NO: 5015908 - DNA, 20 bp, Homo sapiens
cctcatgtccactggttctt

SEQ ID NO: 5015909 - DNA, 13 bp, Homo sapiens
cctccctctaatt

SEQ ID NO: 5015910 - DNA, 23 bp, Homo sapiens
cctgaaagaggaatgaagtactc

SEQ ID NO: 5015911 - DNA, 20 bp, Homo sapiens
cctgaccacgctttctagct

SEQ ID NO: 5015912 - DNA, 16 bp, Homo sapiens
cctgcaatatttgaat

SEQ ID NO: 5015913 - DNA, 17 bp, Homo sapiens
cctgcccctgagcccat

SEQ ID NO: 5015914 - DNA, 23 bp, Homo sapiens
cctgtaatcccagcactttggga

SEQ ID NO: 5015915 - DNA, 18 bp, Homo sapiens
cctgtttttaagctgttt

SEQ ID NO: 5015916 - DNA, 17 bp, Homo sapiens
ccttctcttcacagtca

SEQ ID NO: 5015917 - DNA, 18 bp, Homo sapiens
cgactctatagactctag

SEQ ID NO: 5015918 - DNA, 14 bp, Homo sapiens
cgcgcgccaccacg

SEQ ID NO: 5015919 - DNA, 19 bp, Homo sapiens
cgtgactggcctgctggat

SEQ ID NO: 5015920 - DNA, 14 bp, Homo sapiens
ctaaatctatttat

SEQ ID NO: 5015921 - DNA, 23 bp, Homo sapiens
ctaaattgacacttaaaaatggt

SEQ ID NO: 5015922 - DNA, 18 bp, Homo sapiens
ctaagcaaaatgtgatat

SEQ ID NO: 5015923 - DNA, 15 bp, Homo sapiens
ctaatatatatgaat

SEQ ID NO: 5015924 - DNA, 18 bp, Homo sapiens
ctaatatatatgaataaa

SEQ ID NO: 5015925 - DNA, 18 bp, Homo sapiens
ctacatgaggtactgaga

SEQ ID NO: 5015926 - DNA, 19 bp, Homo sapiens
ctacttgggaggctgagat

SEQ ID NO: 5015927 - DNA, 15 bp, Homo sapiens
ctagtatcaaaagaa

SEQ ID NO: 5015928 - DNA, 15 bp, Homo sapiens
ctatatcctgtgact

SEQ ID NO: 5015929 - DNA, 22 bp, Homo sapiens
ctatattttttgttaaatgatt

SEQ ID NO: 5015930 - DNA, 18 bp, Homo sapiens
ctatgttctaagaagtga

SEQ ID NO: 5015931 - DNA, 15 bp, Homo sapiens
ctatttattaatatt

SEQ ID NO: 5015932 - DNA, 17 bp, Homo sapiens
ctatttattaatattta

SEQ ID NO: 5015933 - DNA, 15 bp, Homo sapiens
ctatttatttactga

SEQ ID NO: 5015934 - DNA, 18 bp, Homo sapiens
ctatttatttactgagct

SEQ ID NO: 5015935 - DNA, 17 bp, Homo sapiens
ctcaccccttgccataa

SEQ ID NO: 5015936 - DNA, 13 bp, Homo sapiens
ctcagtgtcctca

SEQ ID NO: 5015937 - DNA, 12 bp, Homo sapiens
ctcatgctgcca

SEQ ID NO: 5015938 - DNA, 22 bp, Homo sapiens
ctctactaaaaatacaaaaatt

SEQ ID NO: 5015939 - DNA, 19 bp, Homo sapiens
ctctatgttctaagaagtg

SEQ ID NO: 5015940 - DNA, 18 bp, Homo sapiens
ctctcttatagaatattt

SEQ ID NO: 5015941 - DNA, 21 bp, Homo sapiens
ctctcttatagaatatttatt

SEQ ID NO: 5015942 - DNA, 23 bp, Homo sapiens
ctctgcatactcattaggatggc

SEQ ID NO: 5015943 - DNA, 20 bp, Homo sapiens
ctgacctccctctaatttat

SEQ ID NO: 5015944 - DNA, 22 bp, Homo sapiens
ctgagccagtgctttaatggca

SEQ ID NO: 5015945 - DNA, 15 bp, Homo sapiens
ctgagcttctctgtg

SEQ ID NO: 5015946 - DNA, 16 bp, Homo sapiens
ctgagcttctctgtga

SEQ ID NO: 5015947 - DNA, 12 bp, Homo sapiens
ctgaggcaagag

SEQ ID NO: 5015948 - DNA, 16 bp, Homo sapiens
ctgaggcaagagaatt

SEQ ID NO: 5015949 - DNA, 12 bp, Homo sapiens
ctgatacctcaa

SEQ ID NO: 5015950 - DNA, 12 bp, Homo sapiens
ctgcaatatttg

SEQ ID NO: 5015951 - DNA, 16 bp, Homo sapiens
ctgcaatatttgaatt

SEQ ID NO: 5015952 - DNA, 17 bp, Homo sapiens
ctgcaggcgtgacctga

SEQ ID NO: 5015953 - DNA, 17 bp, Homo sapiens
ctgccaatatcctaata

SEQ ID NO: 5015954 - DNA, 23 bp, Homo sapiens
ctgctacaaatactcttaggaag

SEQ ID NO: 5015955 - DNA, 14 bp, Homo sapiens
ctgctgtttcctag

SEQ ID NO: 5015956 - DNA, 16 bp, Homo sapiens
ctggagctctgcccat

SEQ ID NO: 5015957 - DNA, 15 bp, Homo sapiens
ctggcacttgggaca

SEQ ID NO: 5015958 - DNA, 23 bp, Homo sapiens
ctggggtgggtggggcagtgctt

SEQ ID NO: 5015959 - DNA, 16 bp, Homo sapiens
ctgggtctcagtgtcc

SEQ ID NO: 5015960 - DNA, 18 bp, Homo sapiens
ctgggtctcagtgtcctc

SEQ ID NO: 5015961 - DNA, 19 bp, Homo sapiens
ctggtctcgaactgctgga

SEQ ID NO: 5015962 - DNA, 22 bp, Homo sapiens
ctgtaaaatggagacaccacca

SEQ ID NO: 5015963 - DNA, 19 bp, Homo sapiens
ctgtcttcatagcagattt

SEQ ID NO: 5015964 - DNA, 16 bp, Homo sapiens
ctgtgaacgatttaga

SEQ ID NO: 5015965 - DNA, 19 bp, Homo sapiens
ctgtttttaagctgtttcc

SEQ ID NO: 5015966 - DNA, 23 bp, Homo sapiens
ctgtttttaagctgtttccatag

SEQ ID NO: 5015967 - DNA, 21 bp, Homo sapiens
cttaaaaatggtttaaatggt

SEQ ID NO: 5015968 - DNA, 14 bp, Homo sapiens
cttagaccctcatg

SEQ ID NO: 5015969 - DNA, 20 bp, Homo sapiens
cttataagtgaagtgatact

SEQ ID NO: 5015970 - DNA, 14 bp, Homo sapiens
cttattgtacctct

SEQ ID NO: 5015971 - DNA, 20 bp, Homo sapiens
cttcattcttgaaagctgtg

SEQ ID NO: 5015972 - DNA, 15 bp, Homo sapiens
cttgaatgtgtcagg

SEQ ID NO: 5015973 - DNA, 11 bp, Homo sapiens
cttgagaaacc

SEQ ID NO: 5015974 - DNA, 17 bp, Homo sapiens
ctttgttttctgactaa

SEQ ID NO: 5015975 - DNA, 20 bp, Homo sapiens
ctttgttttctgactaatta

SEQ ID NO: 5015976 - DNA, 22 bp, Homo sapiens
gaaaatgaatatctattaatat

SEQ ID NO: 5015977 - DNA, 18 bp, Homo sapiens
gaaagaaaatcaggctgg

SEQ ID NO: 5015978 - DNA, 13 bp, Homo sapiens
gaaagcagaacag

SEQ ID NO: 5015979 - DNA, 21 bp, Homo sapiens
gaaagcttgccctggtgcctc

SEQ ID NO: 5015980 - DNA, 20 bp, Homo sapiens
gaacagtgattaccagggac

SEQ ID NO: 5015981 - DNA, 18 bp, Homo sapiens
gaagatgtagaggagaaa

SEQ ID NO: 5015982 - DNA, 14 bp, Homo sapiens
gaagtatccttcag

SEQ ID NO: 5015983 - DNA, 16 bp, Homo sapiens
gaagtatccttcagcc

SEQ ID NO: 5015984 - DNA, 18 bp, Homo sapiens
gaatatttattacctctg

SEQ ID NO: 5015985 - DNA, 19 bp, Homo sapiens
gaatatttattacctctga

SEQ ID NO: 5015986 - DNA, 14 bp, Homo sapiens
gaatgaatggctaa

SEQ ID NO: 5015987 - DNA, 20 bp, Homo sapiens
gaatgaatggctaagcaaaa

SEQ ID NO: 5015988 - DNA, 15 bp, Homo sapiens
gaattaacacatgat

SEQ ID NO: 5015989 - DNA, 22 bp, Homo sapiens
gaattacaggcgtgagccacca

SEQ ID NO: 5015990 - DNA, 18 bp, Homo sapiens
gacagaacttgaatgtgt

SEQ ID NO: 5015991 - DNA, 12 bp, Homo sapiens
gacagctctgca

SEQ ID NO: 5015992 - DNA, 21 bp, Homo sapiens
gacagtgagactctgtctcag

SEQ ID NO: 5015993 - DNA, 20 bp, Homo sapiens
tgtgactgtacccaaatgga

SEQ ID NO: 5015994 - DNA, 23 bp, Homo sapiens
tgttaaaattatcaatatctaat

SEQ ID NO: 5015995 - DNA, 13 bp, Homo sapiens
tgttctttgggga

SEQ ID NO: 5015996 - DNA, 15 bp, Homo sapiens
tgttgacaactgtga

SEQ ID NO: 5015997 - DNA, 18 bp, Homo sapiens
tgttgacaactgtgactg

SEQ ID NO: 5015998 - DNA, 12 bp, Homo sapiens
tgttttccctga

SEQ ID NO: 5015999 - DNA, 16 bp, Homo sapiens
tgttttctgactaatt

SEQ ID NO: 5016000 - DNA, 17 bp, Homo sapiens
tgttttctgactaatta

SEQ ID NO: 5016001 - DNA, 12 bp, Homo sapiens
ttaatatttaac

SEQ ID NO: 5016002 - DNA, 21 bp, Homo sapiens
ttacctctgatacctcaaccc

SEQ ID NO: 5016003 - DNA, 21 bp, Homo sapiens
ttagactcatcaatcaaataa

SEQ ID NO: 5016004 - DNA, 16 bp, Homo sapiens
ttataatttttttcaa

SEQ ID NO: 5016005 - DNA, 19 bp, Homo sapiens
ttatcaatatctaatatat

SEQ ID NO: 5016006 - DNA, 13 bp, Homo sapiens
ttattacctctga

SEQ ID NO: 5016007 - DNA, 15 bp, Homo sapiens
ttattacctctgata

SEQ ID NO: 5016008 - DNA, 17 bp, Homo sapiens
ttattgtacctctctta

SEQ ID NO: 5016009 - DNA, 17 bp, Homo sapiens
ttatttactgagcttct

SEQ ID NO: 5016010 - DNA, 22 bp, Homo sapiens
ttatttactgagcttctctgtg

SEQ ID NO: 5016011 - DNA, 19 bp, Homo sapiens
ttcacctgtttttaagctg

SEQ ID NO: 5016012 - DNA, 21 bp, Homo sapiens
ttcacctgtttttaagctgtt

SEQ ID NO: 5016013 - DNA, 12 bp, Homo sapiens
ttctaatagaac

SEQ ID NO: 5016014 - DNA, 12 bp, Homo sapiens
ttctagctgttg

SEQ ID NO: 5016015 - DNA, 12 bp, Homo sapiens
ttctctgtgaac

SEQ ID NO: 5016016 - DNA, 14 bp, Homo sapiens
ttgaaatagtgtct

SEQ ID NO: 5016017 - DNA, 17 bp, Homo sapiens
ttgaaatagtgtctgat

SEQ ID NO: 5016018 - DNA, 18 bp, Homo sapiens
ttgaacccgggaggcaga

SEQ ID NO: 5016019 - DNA, 13 bp, Homo sapiens
ttgaatgtgtcag

SEQ ID NO: 5016020 - DNA, 12 bp, Homo sapiens
ttgagctgtttt

SEQ ID NO: 5016021 - DNA, 17 bp, Homo sapiens
ttgagtgttttaagata

SEQ ID NO: 5016022 - DNA, 14 bp, Homo sapiens
ttggcccaggagtt

SEQ ID NO: 5016023 - DNA, 15 bp, Homo sapiens
ttggcccaggagttt

SEQ ID NO: 5016024 - DNA, 20 bp, Homo sapiens
ttggcccaggagtttggcca

SEQ ID NO: 5016025 - DNA, 15 bp, Homo sapiens
ttggttctaatagaa

SEQ ID NO: 5016026 - DNA, 19 bp, Homo sapiens
ttggttctaatagaactca

SEQ ID NO: 5016027 - DNA, 12 bp, Homo sapiens
ttgtaaaatggt

SEQ ID NO: 5016028 - DNA, 20 bp, Homo sapiens
ttgtaaaatggtgtgaccac

SEQ ID NO: 5016029 - DNA, 11 bp, Homo sapiens
ttgtacctctc

SEQ ID NO: 5016030 - DNA, 16 bp, Homo sapiens
ttgttttctgactaat

SEQ ID NO: 5016031 - DNA, 18 bp, Homo sapiens
ttgttttctgactaatta

SEQ ID NO: 5016032 - DNA, 22 bp, Homo sapiens
tttaaatctaaatctatttatt

SEQ ID NO: 5016033 - DNA, 17 bp, Homo sapiens
tttaactagaatttatt

SEQ ID NO: 5016034 - DNA, 13 bp, Homo sapiens
tttaagctgtttc

SEQ ID NO: 5016035 - DNA, 14 bp, Homo sapiens
tttactgagcttct

SEQ ID NO: 5016036 - DNA, 21 bp, Homo sapiens
tttactgagcttctctgtgaa

SEQ ID NO: 5016037 - DNA, 18 bp, Homo sapiens
tttataatagcaactttt

SEQ ID NO: 5016038 - DNA, 18 bp, Homo sapiens
tttatatggggaatatat

SEQ ID NO: 5016039 - DNA, 14 bp, Homo sapiens
tttatcttgtctct

SEQ ID NO: 5016040 - DNA, 20 bp, Homo sapiens
tttattacctctgatacctc

SEQ ID NO: 5016041 - DNA, 22 bp, Homo sapiens
tttcacctgtttttaagctgtt

SEQ ID NO: 5016042 - DNA, 22 bp, Homo sapiens
tttcctcaaaacttcagacata

SEQ ID NO: 5016043 - DNA, 19 bp, Homo sapiens
tttctagctgttgagctgt

SEQ ID NO: 5016044 - DNA, 22 bp, Homo sapiens
tttgttaaaattatcaatatct

SEQ ID NO: 5016045 - DNA, 14 bp, Homo sapiens
ttttcaatatttat

SEQ ID NO: 5016046 - DNA, 16 bp, Homo sapiens
tttttcaatatttatt

SEQ ID NO: 5016047 - DNA, 13 bp, Homo sapiens
gagacagctctgc

SEQ ID NO: 5016048 - DNA, 18 bp, Homo sapiens
gagacagctctgcatact

SEQ ID NO: 5016049 - DNA, 20 bp, Homo sapiens
gagacagctctgcatactca

SEQ ID NO: 5016050 - DNA, 15 bp, Homo sapiens
gagagtgaacaaatt

SEQ ID NO: 5016051 - DNA, 19 bp, Homo sapiens
gagagtgaacaaatttaca

SEQ ID NO: 5016052 - DNA, 20 bp, Homo sapiens
gagatggaagttgcagtgag

SEQ ID NO: 5016053 - DNA, 12 bp, Homo sapiens
gagcaagactct

SEQ ID NO: 5016054 - DNA, 12 bp, Homo sapiens
gaggagaaactg

SEQ ID NO: 5016055 - DNA, 22 bp, Homo sapiens
gagtgaacaaatttacagagac

SEQ ID NO: 5016056 - DNA, 22 bp, Homo sapiens
gagtgcagtggcgcaatcttaa

SEQ ID NO: 5016057 - DNA, 12 bp, Homo sapiens
gagtttggccag

SEQ ID NO: 5016058 - DNA, 13 bp, Homo sapiens
gagtttggccaga

SEQ ID NO: 5016059 - DNA, 14 bp, Homo sapiens
gagtttggccagaa

SEQ ID NO: 5016060 - DNA, 13 bp, Homo sapiens
gataaacagtagt

SEQ ID NO: 5016061 - DNA, 12 bp, Homo sapiens
gataaattataa

SEQ ID NO: 5016062 - DNA, 14 bp, Homo sapiens
gattaccagggact

SEQ ID NO: 5016063 - DNA, 13 bp, Homo sapiens
gattgtgcccctg

SEQ ID NO: 5016064 - DNA, 18 bp, Homo sapiens
gcactttaacacagtgtc

SEQ ID NO: 5016065 - DNA, 13 bp, Homo sapiens
gcagaacagtgat

SEQ ID NO: 5016066 - DNA, 14 bp, Homo sapiens
gcagaagacagtat

SEQ ID NO: 5016067 - DNA, 23 bp, Homo sapiens
gcagaggttgcagtgagccgaga

SEQ ID NO: 5016068 - DNA, 17 bp, Homo sapiens
gcagtgcttggcccagg

SEQ ID NO: 5016069 - DNA, 17 bp, Homo sapiens
gccaacagaagcttcca

SEQ ID NO: 5016070 - DNA, 19 bp, Homo sapiens
gccaacagaagcttccatt

SEQ ID NO: 5016071 - DNA, 15 bp, Homo sapiens
gccaatatcctaata

SEQ ID NO: 5016072 - DNA, 22 bp, Homo sapiens
gccaatatcctaataaaaaggt

SEQ ID NO: 5016073 - DNA, 22 bp, Homo sapiens
gccacgttcttactagtttccc

SEQ ID NO: 5016074 - DNA, 18 bp, Homo sapiens
gccagcttgttatttata

SEQ ID NO: 5016075 - DNA, 15 bp, Homo sapiens
gccaggctggtctcg

SEQ ID NO: 5016076 - DNA, 12 bp, Homo sapiens
gcccaagggtgg

SEQ ID NO: 5016077 - DNA, 12 bp, Homo sapiens
gcccaatattat

SEQ ID NO: 5016078 - DNA, 20 bp, Homo sapiens
gcccaggagtttggccagaa

SEQ ID NO: 5016079 - DNA, 11 bp, Homo sapiens
gccccaaaagg

SEQ ID NO: 5016080 - DNA, 19 bp, Homo sapiens
gcccctgcactccagcctg

SEQ ID NO: 5016081 - DNA, 20 bp, Homo sapiens
gccgggcgtggtggtgagtg

SEQ ID NO: 5016082 - DNA, 22 bp, Homo sapiens
gcctcatgtccactggttcttc

SEQ ID NO: 5016083 - DNA, 20 bp, Homo sapiens
gcctggtgcttccaaatatt

SEQ ID NO: 5016084 - DNA, 18 bp, Homo sapiens
gcctgtaatcacagctac

SEQ ID NO: 5016085 - DNA, 12 bp, Homo sapiens
gcgacagtgaga

SEQ ID NO: 5016086 - DNA, 21 bp, Homo sapiens
gcgactctatagactctagga

SEQ ID NO: 5016087 - DNA, 17 bp, Homo sapiens
gctaagcaaaatgtgat

SEQ ID NO: 5016088 - DNA, 20 bp, Homo sapiens
gctacaaatactcttaggaa

SEQ ID NO: 5016089 - DNA, 14 bp, Homo sapiens
gctgccaatatcct

SEQ ID NO: 5016090 - DNA, 22 bp, Homo sapiens
gctgggaattacaggcgtgagc

SEQ ID NO: 5016091 - DNA, 20 bp, Homo sapiens
gctggtctcgaactgctgga

SEQ ID NO: 5016092 - DNA, 18 bp, Homo sapiens
gctgttgagctgttttcc

SEQ ID NO: 5016093 - DNA, 12 bp, Homo sapiens
gcttccattcca

SEQ ID NO: 5016094 - DNA, 17 bp, Homo sapiens
gcttgaaatagtgtctg

SEQ ID NO: 5016095 - DNA, 14 bp, Homo sapiens
gcttggcccaggag

SEQ ID NO: 5016096 - DNA, 23 bp, Homo sapiens
gcttggcccaggagtttggccag

SEQ ID NO: 5016097 - DNA, 15 bp, Homo sapiens
ggagaatcacttgaa

SEQ ID NO: 5016098 - DNA, 15 bp, Homo sapiens
ggaggctgagatggg

SEQ ID NO: 5016099 - DNA, 22 bp, Homo sapiens
ggatgttgaaaaagttctgcag

SEQ ID NO: 5016100 - DNA, 17 bp, Homo sapiens
ggcagtgcttggcccag

SEQ ID NO: 5016101 - DNA, 18 bp, Homo sapiens
ggcagtgcttggcccagg

SEQ ID NO: 5016102 - DNA, 19 bp, Homo sapiens
ggcagtgcttggcccagga

SEQ ID NO: 5016103 - DNA, 19 bp, Homo sapiens
ggcccaggagtttggccag

SEQ ID NO: 5016104 - DNA, 23 bp, Homo sapiens
ggctctgggatagctgacccagc

SEQ ID NO: 5016105 - DNA, 15 bp, Homo sapiens
ggctgggagtggcat

SEQ ID NO: 5016106 - DNA, 18 bp, Homo sapiens
ggcttagaccctcatgct

SEQ ID NO: 5016107 - DNA, 21 bp, Homo sapiens
gggactgaggggaggggagca

SEQ ID NO: 5016108 - DNA, 12 bp, Homo sapiens
gggagtggcgcg

SEQ ID NO: 5016109 - DNA, 16 bp, Homo sapiens
gggattgtaaaatggt

SEQ ID NO: 5016110 - DNA, 18 bp, Homo sapiens
gggcagtgcttggcccag

SEQ ID NO: 5016111 - DNA, 19 bp, Homo sapiens
gggcagtgcttggcccagg

SEQ ID NO: 5016112 - DNA, 15 bp, Homo sapiens
gggtctcagtgtcct

SEQ ID NO: 5016113 - DNA, 14 bp, Homo sapiens
gggtggggcagtgc

SEQ ID NO: 5016114 - DNA, 19 bp, Homo sapiens
ggtcaacatggtgaaaccc

SEQ ID NO: 5016115 - DNA, 20 bp, Homo sapiens
ggtggggtgagggcttgagg

SEQ ID NO: 5016116 - DNA, 21 bp, Homo sapiens
gtcaattttgttatgtatatt

SEQ ID NO: 5016117 - DNA, 18 bp, Homo sapiens
gtcagacagaacttgaat

SEQ ID NO: 5016118 - DNA, 22 bp, Homo sapiens
gtccatgaagatgtagaggaga

SEQ ID NO: 5016119 - DNA, 17 bp, Homo sapiens
gtcctgcctgcaatatt

SEQ ID NO: 5016120 - DNA, 12 bp, Homo sapiens
gtctcagtgtcc

SEQ ID NO: 5016121 - DNA, 15 bp, Homo sapiens
gtctcccaaagtgct

SEQ ID NO: 5016122 - DNA, 21 bp, Homo sapiens
gtgaacaaatttacagagaca

SEQ ID NO: 5016123 - DNA, 11 bp, Homo sapiens
gtgattaccag

SEQ ID NO: 5016124 - DNA, 17 bp, Homo sapiens
gtgattaccagggactg

SEQ ID NO: 5016125 - DNA, 14 bp, Homo sapiens
gtgcttggcccagg

SEQ ID NO: 5016126 - DNA, 17 bp, Homo sapiens
gtgcttggcccaggagt

SEQ ID NO: 5016127 - DNA, 19 bp, Homo sapiens
gtgcttggcccaggagttt

SEQ ID NO: 5016128 - DNA, 16 bp, Homo sapiens
gttgacaactgtgact

SEQ ID NO: 5016129 - DNA, 17 bp, Homo sapiens
gtttagaaagcttgccc

SEQ ID NO: 5016130 - DNA, 11 bp, Homo sapiens
gtttggccaga

SEQ ID NO: 5016131 - DNA, 18 bp, Homo sapiens
gtttggccagaagtcaag

SEQ ID NO: 5016132 - DNA, 18 bp, Homo sapiens
gtttgtctgtcttcatag

SEQ ID NO: 5016133 - DNA, 19 bp, Homo sapiens
gttttaactagaatttatt

SEQ ID NO: 5016134 - DNA, 15 bp, Homo sapiens
gtttttaagctgttt

SEQ ID NO: 5016135 - DNA, 21 bp, Homo sapiens
taaaaaaaaacctgagcccca

SEQ ID NO: 5016136 - DNA, 15 bp, Homo sapiens
taaaaatggtttaaa

SEQ ID NO: 5016137 - DNA, 18 bp, Homo sapiens
taaaaatggtttaaatgg

SEQ ID NO: 5016138 - DNA, 19 bp, Homo sapiens
taaaaatggtttaaatggt

SEQ ID NO: 5016139 - DNA, 19 bp, Homo sapiens
taaaccaaggctagaacca

SEQ ID NO: 5016140 - DNA, 19 bp, Homo sapiens
taaatctatttattaatat

SEQ ID NO: 5016141 - DNA, 20 bp, Homo sapiens
taaatctatttattaatatt

SEQ ID NO: 5016142 - DNA, 14 bp, Homo sapiens
taacacagtgtctg

SEQ ID NO: 5016143 - DNA, 15 bp, Homo sapiens
taactagaatttatt

SEQ ID NO: 5016144 - DNA, 13 bp, Homo sapiens
taagaagtgaaaa

SEQ ID NO: 5016145 - DNA, 18 bp, Homo sapiens
taagcactttaacacagt

SEQ ID NO: 5016146 - DNA, 22 bp, Homo sapiens
taagcactttaacacagtgtct

SEQ ID NO: 5016147 - DNA, 20 bp, Homo sapiens
taagccagacatcaacagat

SEQ ID NO: 5016148 - DNA, 21 bp, Homo sapiens
taagccagacatcaacagata

SEQ ID NO: 5016149 - DNA, 12 bp, Homo sapiens
taataaaaaggt

SEQ ID NO: 5016150 - DNA, 18 bp, Homo sapiens
taatcctttgttttctga

SEQ ID NO: 5016151 - DNA, 20 bp, Homo sapiens
taatcctttgttttctgact

SEQ ID NO: 5016152 - DNA, 18 bp, Homo sapiens
taatgaaaatgaatatct

SEQ ID NO: 5016153 - DNA, 15 bp, Homo sapiens
taattttgaataaat

SEQ ID NO: 5016154 - DNA, 21 bp, Homo sapiens
tacaaaaaaaaaaaaaaatta

SEQ ID NO: 5016155 - DNA, 17 bp, Homo sapiens
tacagagacagaaagca

SEQ ID NO: 5016156 - DNA, 16 bp, Homo sapiens
tacaggcgtgagccac

SEQ ID NO: 5016157 - DNA, 21 bp, Homo sapiens
tacatgaggtactgagagtga

SEQ ID NO: 5016158 - DNA, 17 bp, Homo sapiens
tactgagagtgaacaaa

SEQ ID NO: 5016159 - DNA, 19 bp, Homo sapiens
tactgagagtgaacaaatt

SEQ ID NO: 5016160 - DNA, 14 bp, Homo sapiens
tagaaagaagccca

SEQ ID NO: 5016161 - DNA, 19 bp, Homo sapiens
tagaactcagttttaacta

SEQ ID NO: 5016162 - DNA, 22 bp, Homo sapiens
tagaactcagttttaactagaa

SEQ ID NO: 5016163 - DNA, 12 bp, Homo sapiens
tagaatatttat

SEQ ID NO: 5016164 - DNA, 15 bp, Homo sapiens
tagaatttattcaat

SEQ ID NO: 5016165 - DNA, 23 bp, Homo sapiens
tagaatttattcaattcctctgg

SEQ ID NO: 5016166 - DNA, 19 bp, Homo sapiens
tagaccctcatgctgccaa

SEQ ID NO: 5016167 - DNA, 21 bp, Homo sapiens
aaaaataaatttggttctaat

SEQ ID NO: 5016168 - DNA, 15 bp, Homo sapiens
aaaacttcagacata

SEQ ID NO: 5016169 - DNA, 18 bp, Homo sapiens
aaaagttctgcagataaa

SEQ ID NO: 5016170 - DNA, 14 bp, Homo sapiens
aaacagtagtgata

SEQ ID NO: 5016171 - DNA, 17 bp, Homo sapiens
aaaccttattgtacctc

SEQ ID NO: 5016172 - DNA, 16 bp, Homo sapiens
aaagcagaacagtgat

SEQ ID NO: 5016173 - DNA, 17 bp, Homo sapiens
aaagcagggacttgaac

SEQ ID NO: 5016174 - DNA, 14 bp, Homo sapiens
aaaggcagaagcaa

SEQ ID NO: 5016175 - DNA, 20 bp, Homo sapiens
aaaggtattttaatcaccaa

SEQ ID NO: 5016176 - DNA, 20 bp, Homo sapiens
aaagtaactcatttgttaaa

SEQ ID NO: 5016177 - DNA, 23 bp, Homo sapiens
aaagttctgcagataaacagtag

SEQ ID NO: 5016178 - DNA, 14 bp, Homo sapiens
aaataagtatttat

SEQ ID NO: 5016179 - DNA, 17 bp, Homo sapiens
aaataagtatttataat

SEQ ID NO: 5016180 - DNA, 15 bp, Homo sapiens
aaatctaaatctatt

SEQ ID NO: 5016181 - DNA, 17 bp, Homo sapiens
aaatctaaatctattta

SEQ ID NO: 5016182 - DNA, 12 bp, Homo sapiens
aaatctatttat

SEQ ID NO: 5016183 - DNA, 17 bp, Homo sapiens
aaatgaatatctattaa

SEQ ID NO: 5016184 - DNA, 13 bp, Homo sapiens
aaatgttcatcaa

SEQ ID NO: 5016185 - DNA, 17 bp, Homo sapiens
aaatgttcatcaatgaa

SEQ ID NO: 5016186 - DNA, 15 bp, Homo sapiens
aaatgttctttgggg

SEQ ID NO: 5016187 - DNA, 16 bp, Homo sapiens
aaatttggttctaata

SEQ ID NO: 5016188 - DNA, 22 bp, Homo sapiens
aacagtagtgatagttgtaccg

SEQ ID NO: 5016189 - DNA, 12 bp, Homo sapiens
aacattatttat

SEQ ID NO: 5016190 - DNA, 21 bp, Homo sapiens
aaccagggagcccctttgatg

SEQ ID NO: 5016191 - DNA, 20 bp, Homo sapiens
aacccatatttgtacaccaa

SEQ ID NO: 5016192 - DNA, 22 bp, Homo sapiens
aacctaaatttggttctaggcc

SEQ ID NO: 5016193 - DNA, 14 bp, Homo sapiens
aacctcattcccca

SEQ ID NO: 5016194 - DNA, 18 bp, Homo sapiens
aaccttattgtacctctc

SEQ ID NO: 5016195 - DNA, 18 bp, Homo sapiens
aaccttgaaaactttatg

SEQ ID NO: 5016196 - DNA, 12 bp, Homo sapiens
aacgatttagaa

SEQ ID NO: 5016197 - DNA, 19 bp, Homo sapiens
aactagaatttattcaatt

SEQ ID NO: 5016198 - DNA, 22 bp, Homo sapiens
aactagaatttattcaattcct

SEQ ID NO: 5016199 - DNA, 15 bp, Homo sapiens
aactcagttttaact

SEQ ID NO: 5016200 - DNA, 13 bp, Homo sapiens
aacttcagacata

SEQ ID NO: 5016201 - DNA, 21 bp, Homo sapiens
aactttatgctaagtgaaata

SEQ ID NO: 5016202 - DNA, 22 bp, Homo sapiens
aagatgtagaggagaaactgga

SEQ ID NO: 5016203 - DNA, 17 bp, Homo sapiens
aagcactttaacacagt

SEQ ID NO: 5016204 - DNA, 15 bp, Homo sapiens
aagctgtttccatag

SEQ ID NO: 5016205 - DNA, 15 bp, Homo sapiens
aaggctttatctcag

SEQ ID NO: 5016206 - DNA, 16 bp, Homo sapiens
aagtaactcatttgtt

SEQ ID NO: 5016207 - DNA, 21 bp, Homo sapiens
aagtaactcatttgttaaaat

SEQ ID NO: 5016208 - DNA, 12 bp, Homo sapiens
aagtagaggagg

SEQ ID NO: 5016209 - DNA, 17 bp, Homo sapiens
aagttctgcagataaac

SEQ ID NO: 5016210 - DNA, 21 bp, Homo sapiens
aataaatttggttctaataga

SEQ ID NO: 5016211 - DNA, 16 bp, Homo sapiens
aataagtatttataat

SEQ ID NO: 5016212 - DNA, 19 bp, Homo sapiens
aatagcaacttttgtgtaa

SEQ ID NO: 5016213 - DNA, 13 bp, Homo sapiens
aatatatatgaat

SEQ ID NO: 5016214 - DNA, 18 bp, Homo sapiens
aatatatgtattatttat

SEQ ID NO: 5016215 - DNA, 12 bp, Homo sapiens
aatatcctaata

SEQ ID NO: 5016216 - DNA, 15 bp, Homo sapiens
aatatcctaataaaa

SEQ ID NO: 5016217 - DNA, 20 bp, Homo sapiens
aatatctaatatatatgaat

SEQ ID NO: 5016218 - DNA, 21 bp, Homo sapiens
aatatctaatatatatgaata

SEQ ID NO: 5016219 - DNA, 19 bp, Homo sapiens
aatatcttttttttaataa

SEQ ID NO: 5016220 - DNA, 20 bp, Homo sapiens
aatattgttgacaactgtga

SEQ ID NO: 5016221 - DNA, 20 bp, Homo sapiens
aatatttattattttcacct

SEQ ID NO: 5016222 - DNA, 22 bp, Homo sapiens
aatcctttgttttctgactaat

SEQ ID NO: 5016223 - DNA, 14 bp, Homo sapiens
aatctaaatctatt

SEQ ID NO: 5016224 - DNA, 19 bp, Homo sapiens
aatctaaatctatttatta

SEQ ID NO: 5016225 - DNA, 18 bp, Homo sapiens
aatctatttattaatatt

SEQ ID NO: 5016226 - DNA, 21 bp, Homo sapiens
aatctatttattaatatttaa

SEQ ID NO: 5016227 - DNA, 16 bp, Homo sapiens
aatgaaaatgaatatc

SEQ ID NO: 5016228 - DNA, 22 bp, Homo sapiens
aatgaatggctaagcaaaatgt

SEQ ID NO: 5016229 - DNA, 19 bp, Homo sapiens
aatggaaagtaactcattt

SEQ ID NO: 5016230 - DNA, 15 bp, Homo sapiens
aatgttacattgttt

SEQ ID NO: 5016231 - DNA, 13 bp, Homo sapiens
aattgacccacaa

SEQ ID NO: 5016232 - DNA, 21 bp, Homo sapiens
aattgacccacaagaaatgaa

SEQ ID NO: 5016233 - DNA, 17 bp, Homo sapiens
aatttacagagacagaa

SEQ ID NO: 5016234 - DNA, 15 bp, Homo sapiens
aatttttttcaatat

SEQ ID NO: 5016235 - DNA, 19 bp, Homo sapiens
aatttttttcaatatttat

SEQ ID NO: 5016236 - DNA, 15 bp, Homo sapiens
acaaatactcttagg

SEQ ID NO: 5016237 - DNA, 17 bp, Homo sapiens
acaaatactcttaggaa

SEQ ID NO: 5016238 - DNA, 23 bp, Homo sapiens
acaaatactcttaggaagagaaa

SEQ ID NO: 5016239 - DNA, 14 bp, Homo sapiens
acaactgtgactgt

SEQ ID NO: 5016240 - DNA, 16 bp, Homo sapiens
acaatgaacacttata

SEQ ID NO: 5016241 - DNA, 18 bp, Homo sapiens
acacatgatcctgcaatt

SEQ ID NO: 5016242 - DNA, 18 bp, Homo sapiens
acactatggtatttgagt

SEQ ID NO: 5016243 - DNA, 19 bp, Homo sapiens
acactatggtatttgagtg

SEQ ID NO: 5016244 - DNA, 13 bp, Homo sapiens
acacttaaaaatg

SEQ ID NO: 5016245 - DNA, 19 bp, Homo sapiens
acagaaagcagaacagtga

SEQ ID NO: 5016246 - DNA, 15 bp, Homo sapiens
acagagcaagactct

SEQ ID NO: 5016247 - DNA, 20 bp, Homo sapiens
acagctctgcatactcatta

SEQ ID NO: 5016248 - DNA, 21 bp, Homo sapiens
acagtatggcagctttcctca

SEQ ID NO: 5016249 - DNA, 16 bp, Homo sapiens
acatgaggtactgaga

SEQ ID NO: 5016250 - DNA, 13 bp, Homo sapiens
acatgttacaaca

SEQ ID NO: 5016251 - DNA, 14 bp, Homo sapiens
acattatttatatg

SEQ ID NO: 5016252 - DNA, 18 bp, Homo sapiens
acattatttatatgggga

SEQ ID NO: 5016253 - DNA, 19 bp, Homo sapiens
accactgcagaagacagta

SEQ ID NO: 5016254 - DNA, 17 bp, Homo sapiens
accacttcattcttgaa

SEQ ID NO: 5016255 - DNA, 20 bp, Homo sapiens
accagggagcccctttgatg

SEQ ID NO: 5016256 - DNA, 17 bp, Homo sapiens
accagggcctggctggg

SEQ ID NO: 5016257 - DNA, 18 bp, Homo sapiens
acccaaaaggcagaagca

SEQ ID NO: 5016258 - DNA, 16 bp, Homo sapiens
acccaaatgttcatca

SEQ ID NO: 5016259 - DNA, 21 bp, Homo sapiens
acccacaagaaatgaaagcag

SEQ ID NO: 5016260 - DNA, 23 bp, Homo sapiens
acccaggagatggaagttgcagt

SEQ ID NO: 5016261 - DNA, 17 bp, Homo sapiens
acccccatttctattta

SEQ ID NO: 5016262 - DNA, 17 bp, Homo sapiens
acccgggaggcagaggt

SEQ ID NO: 5016263 - DNA, 14 bp, Homo sapiens
accctcatgctgcc

SEQ ID NO: 5016264 - DNA, 22 bp, Homo sapiens
accctcatgctgccaatatcct

SEQ ID NO: 5016265 - DNA, 21 bp, Homo sapiens
accctgtctctactaaaaata

SEQ ID NO: 5016266 - DNA, 19 bp, Homo sapiens
acctcaacccccatttcta

SEQ ID NO: 5016267 - DNA, 15 bp, Homo sapiens
acctctgatacctca

SEQ ID NO: 5016268 - DNA, 20 bp, Homo sapiens
acctgtaatcccagctactt

SEQ ID NO: 5016269 - DNA, 18 bp, Homo sapiens
acctgtttttaagctgtt

SEQ ID NO: 5016270 - DNA, 17 bp, Homo sapiens
acgctttctagctgttg

SEQ ID NO: 5016271 - DNA, 18 bp, Homo sapiens
acgtgactggcctgctgg

SEQ ID NO: 5016272 - DNA, 15 bp, Homo sapiens
actatggtatttgag

SEQ ID NO: 5016273 - DNA, 22 bp, Homo sapiens
actcatttgttaaaattatcaa

SEQ ID NO: 5016274 - DNA, 17 bp, Homo sapiens
actctatgttctaagaa

SEQ ID NO: 5016275 - DNA, 19 bp, Homo sapiens
actcttaggaagagaaacc

SEQ ID NO: 5016276 - DNA, 18 bp, Homo sapiens
actgagagtgaacaaatt

SEQ ID NO: 5016277 - DNA, 17 bp, Homo sapiens
actgaggggaggggagc

SEQ ID NO: 5016278 - DNA, 22 bp, Homo sapiens
actgaggggaggggagcatggg

SEQ ID NO: 5016279 - DNA, 22 bp, Homo sapiens
actggagcttgaaatagtgtct

SEQ ID NO: 5016280 - DNA, 16 bp, Homo sapiens
actggcctgctggatg

SEQ ID NO: 5016281 - DNA, 21 bp, Homo sapiens
acttaaaaatggtttaaatgg

SEQ ID NO: 5016282 - DNA, 20 bp, Homo sapiens
acttgaacccgggaggcaga

SEQ ID NO: 5016283 - DNA, 22 bp, Homo sapiens
acttgggaggctgagatgggag

SEQ ID NO: 5016284 - DNA, 15 bp, Homo sapiens
agaaactggaactct

SEQ ID NO: 5016285 - DNA, 18 bp, Homo sapiens
agaaagcagaacagtgat

SEQ ID NO: 5016286 - DNA, 18 bp, Homo sapiens
agaacttgaatgtgtcag

SEQ ID NO: 5016287 - DNA, 23 bp, Homo sapiens
agaattaacacatgatcctgcaa

SEQ ID NO: 5016288 - DNA, 13 bp, Homo sapiens
agacaccaccacc

SEQ ID NO: 5016289 - DNA, 17 bp, Homo sapiens
agacagaacttgaatgt

SEQ ID NO: 5016290 - DNA, 19 bp, Homo sapiens
agacccaaaaggcagaagc

SEQ ID NO: 5016291 - DNA, 17 bp, Homo sapiens
agaccctcatgctgcca

SEQ ID NO: 5016292 - DNA, 18 bp, Homo sapiens
agactctgtctcagtcca

SEQ ID NO: 5016293 - DNA, 13 bp, Homo sapiens
agaggaatgaagt

SEQ ID NO: 5016294 - DNA, 15 bp, Homo sapiens
agaggttgcagtgag

SEQ ID NO: 5016295 - DNA, 22 bp, Homo sapiens
agagtgaacaaatttacagaga

SEQ ID NO: 5016296 - DNA, 22 bp, Homo sapiens
agatggaagttgcagtgagctg

SEQ ID NO: 5016297 - DNA, 21 bp, Homo sapiens
agatgggagaatcacttgaac

SEQ ID NO: 5016298 - DNA, 16 bp, Homo sapiens
agatgtagaggagaaa

SEQ ID NO: 5016299 - DNA, 16 bp, Homo sapiens
agattgtgcccctgca

SEQ ID NO: 5016300 - DNA, 21 bp, Homo sapiens
agattgtgcccctgcactcca

SEQ ID NO: 5016301 - DNA, 16 bp, Homo sapiens
agcccaatattataat

SEQ ID NO: 5016302 - DNA, 18 bp, Homo sapiens
agccccgtggggttcctc

SEQ ID NO: 5016303 - DNA, 13 bp, Homo sapiens
agcgacagtgaga

SEQ ID NO: 5016304 - DNA, 16 bp, Homo sapiens
agctgacccagcccct

SEQ ID NO: 5016305 - DNA, 16 bp, Homo sapiens
agctgttgagctgttt

SEQ ID NO: 5016306 - DNA, 17 bp, Homo sapiens
agctgttgagctgtttt

SEQ ID NO: 5016307 - DNA, 13 bp, Homo sapiens
agcttctctgtga

SEQ ID NO: 5016308 - DNA, 21 bp, Homo sapiens
agcttgaaatagtgtctgatg

SEQ ID NO: 5016309 - DNA, 13 bp, Homo sapiens
aggaagtagagga

SEQ ID NO: 5016310 - DNA, 23 bp, Homo sapiens
aggaattgacccacaagaaatga

SEQ ID NO: 5016311 - DNA, 20 bp, Homo sapiens
aggacataaattagaggtct

SEQ ID NO: 5016312 - DNA, 23 bp, Homo sapiens
aggacttgggcgggacacaggct

SEQ ID NO: 5016313 - DNA, 11 bp, Homo sapiens
aggagaaactg

SEQ ID NO: 5016314 - DNA, 19 bp, Homo sapiens
aggagaaactggaactctc

SEQ ID NO: 5016315 - DNA, 16 bp, Homo sapiens
aggagtttggccagaa

SEQ ID NO: 5016316 - DNA, 17 bp, Homo sapiens
aggagtttggccagaag

SEQ ID NO: 5016317 - DNA, 14 bp, Homo sapiens
aggatgttgaaaaa

SEQ ID NO: 5016318 - DNA, 20 bp, Homo sapiens
aggcaaggctatgtgattac

SEQ ID NO: 5016319 - DNA, 20 bp, Homo sapiens
aggcagaggttgcagtgagc

SEQ ID NO: 5016320 - DNA, 14 bp, Homo sapiens
aggctatgtgatta

SEQ ID NO: 5016321 - DNA, 18 bp, Homo sapiens
aggctgaggcaagagaat

SEQ ID NO: 5016322 - DNA, 18 bp, Homo sapiens
aggctggagtgcagtggc

SEQ ID NO: 5016323 - DNA, 12 bp, Homo sapiens
aggcttagaccc

SEQ ID NO: 5016324 - DNA, 12 bp, Homo sapiens
agtaactcattt

SEQ ID NO: 5016325 - DNA, 20 bp, Homo sapiens
agtcacattccaagcctcat

SEQ ID NO: 5016326 - DNA, 16 bp, Homo sapiens
agtgaacaaatttaca

SEQ ID NO: 5016327 - DNA, 22 bp, Homo sapiens
agtgaacaaatttacagagaca

SEQ ID NO: 5016328 - DNA, 15 bp, Homo sapiens
agtgattaccaggga

SEQ ID NO: 5016329 - DNA, 14 bp, Homo sapiens
agtgcttggcccag

SEQ ID NO: 5016330 - DNA, 16 bp, Homo sapiens
agtgcttggcccagga

SEQ ID NO: 5016331 - DNA, 20 bp, Homo sapiens
agtgcttggcccaggagttt

SEQ ID NO: 5016332 - DNA, 16 bp, Homo sapiens
agtggcgcgcgccacc

SEQ ID NO: 5016333 - DNA, 18 bp, Homo sapiens
agtggcgcgcgccaccac

SEQ ID NO: 5016334 - DNA, 23 bp, Homo sapiens
agtgggacagttcctgagaccag

SEQ ID NO: 5016335 - DNA, 21 bp, Homo sapiens
agttactgccggtttgaaaat

SEQ ID NO: 5016336 - DNA, 16 bp, Homo sapiens
agttcctgagaccagc

SEQ ID NO: 5016337 - DNA, 20 bp, Homo sapiens
agttcctgagaccagccaac

SEQ ID NO: 5016338 - DNA, 21 bp, Homo sapiens
agttctgcagataaacagtag

SEQ ID NO: 5016339 - DNA, 19 bp, Homo sapiens
agttgtaccgcaatgtgac

SEQ ID NO: 5016340 - DNA, 13 bp, Homo sapiens
ataaaaataaatt

SEQ ID NO: 5016341 - DNA, 22 bp, Homo sapiens
ataaaaataaatttggttctaa

SEQ ID NO: 5016342 - DNA, 13 bp, Homo sapiens
ataaattataagt

SEQ ID NO: 5016343 - DNA, 21 bp, Homo sapiens
ataagccagacatcaacagat

SEQ ID NO: 5016344 - DNA, 17 bp, Homo sapiens
atacaatgaacacttat

SEQ ID NO: 5016345 - DNA, 18 bp, Homo sapiens
atacaatgaacacttata

SEQ ID NO: 5016346 - DNA, 22 bp, Homo sapiens
atagaatatttattacctctga

SEQ ID NO: 5016347 - DNA, 14 bp, Homo sapiens
atagcagattttaa

SEQ ID NO: 5016348 - DNA, 22 bp, Homo sapiens
ataggaattgacccacaagaaa

SEQ ID NO: 5016349 - DNA, 15 bp, Homo sapiens
atatatatgaataaa

SEQ ID NO: 5016350 - DNA, 20 bp, Homo sapiens
atatatgtattatttataat

SEQ ID NO: 5016351 - DNA, 15 bp, Homo sapiens
atatcaatttaaaaa

SEQ ID NO: 5016352 - DNA, 23 bp, Homo sapiens
atatcctaataaaaaggtgacca

SEQ ID NO: 5016353 - DNA, 17 bp, Homo sapiens
atatctaatatatatga

SEQ ID NO: 5016354 - DNA, 19 bp, Homo sapiens
atatctaatatatatgaat

SEQ ID NO: 5016355 - DNA, 12 bp, Homo sapiens
atatctattaat

SEQ ID NO: 5016356 - DNA, 18 bp, Homo sapiens
atatctattaatatatgt

SEQ ID NO: 5016357 - DNA, 22 bp, Homo sapiens
atatctattaatatatgtatta

SEQ ID NO: 5016358 - DNA, 16 bp, Homo sapiens
atatggggaatatatt

SEQ ID NO: 5016359 - DNA, 17 bp, Homo sapiens
atatgtattatttataa

SEQ ID NO: 5016360 - DNA, 22 bp, Homo sapiens
atatgtattatttataattcct

SEQ ID NO: 5016361 - DNA, 22 bp, Homo sapiens
atattataatttttttcaatat

SEQ ID NO: 5016362 - DNA, 16 bp, Homo sapiens
atatttattacctctg

SEQ ID NO: 5016363 - DNA, 23 bp, Homo sapiens
atatttattattttcacctgttt

SEQ ID NO: 5016364 - DNA, 20 bp, Homo sapiens
atatttgaattttaaatcta

SEQ ID NO: 5016365 - DNA, 18 bp, Homo sapiens
atattttttgttaaatga

SEQ ID NO: 5016366 - DNA, 14 bp, Homo sapiens
atcaacagataaat

SEQ ID NO: 5016367 - DNA, 15 bp, Homo sapiens
atcaatcaaataagt

SEQ ID NO: 5016368 - DNA, 13 bp, Homo sapiens
atcaatttaaaaa

SEQ ID NO: 5016369 - DNA, 19 bp, Homo sapiens
atcacttgaggtcaggagt

SEQ ID NO: 5016370 - DNA, 19 bp, Homo sapiens
atcccagcactttgggagg

SEQ ID NO: 5016371 - DNA, 22 bp, Homo sapiens
atcccagctacttgggaggctg

SEQ ID NO: 5016372 - DNA, 12 bp, Homo sapiens
atcctaataaaa

SEQ ID NO: 5016373 - DNA, 14 bp, Homo sapiens
atcctaataaaaag

SEQ ID NO: 5016374 - DNA, 22 bp, Homo sapiens
atctaaatctatttattaatat

SEQ ID NO: 5016375 - DNA, 18 bp, Homo sapiens
atctaatatatatgaata

SEQ ID NO: 5016376 - DNA, 19 bp, Homo sapiens
atctccgtctcccaaagtg

SEQ ID NO: 5016377 - DNA, 15 bp, Homo sapiens
atctgagccagtgct

SEQ ID NO: 5016378 - DNA, 13 bp, Homo sapiens
atcttattcacat

SEQ ID NO: 5016379 - DNA, 15 bp, Homo sapiens
atcttgtctctgggc

SEQ ID NO: 5016380 - DNA, 15 bp, Homo sapiens
atgaaagcagggact

SEQ ID NO: 5016381 - DNA, 13 bp, Homo sapiens
atgaacacttata

SEQ ID NO: 5016382 - DNA, 18 bp, Homo sapiens
atgaagatgtagaggaga

SEQ ID NO: 5016383 - DNA, 13 bp, Homo sapiens
atgaagtactcat

SEQ ID NO: 5016384 - DNA, 19 bp, Homo sapiens
atgaatatctattaatata

SEQ ID NO: 5016385 - DNA, 13 bp, Homo sapiens
atgaatgaatggc

SEQ ID NO: 5016386 - DNA, 17 bp, Homo sapiens
atgatacaatgaacact

SEQ ID NO: 5016387 - DNA, 13 bp, Homo sapiens
atgctgccaatat

SEQ ID NO: 5016388 - DNA, 18 bp, Homo sapiens
atgctgccaatatcctaa

SEQ ID NO: 5016389 - DNA, 21 bp, Homo sapiens
atgctgccaatatcctaataa

SEQ ID NO: 5016390 - DNA, 13 bp, Homo sapiens
atggagacaccac

SEQ ID NO: 5016391 - DNA, 20 bp, Homo sapiens
atggctagtatcaaaagaaa

SEQ ID NO: 5016392 - DNA, 12 bp, Homo sapiens
atgtagaggaga

SEQ ID NO: 5016393 - DNA, 19 bp, Homo sapiens
atgtagaggagaaactgga

SEQ ID NO: 5016394 - DNA, 17 bp, Homo sapiens
atgtccactggttcttc

SEQ ID NO: 5016395 - DNA, 16 bp, Homo sapiens
attaatatatgtatta

SEQ ID NO: 5016396 - DNA, 22 bp, Homo sapiens
attaatatatgtattatttata

SEQ ID NO: 5016397 - DNA, 19 bp, Homo sapiens
attaattcaccttccagtg

SEQ ID NO: 5016398 - DNA, 19 bp, Homo sapiens
attacaggcgtgagccacc

SEQ ID NO: 5016399 - DNA, 13 bp, Homo sapiens
attacctctgata

SEQ ID NO: 5016400 - DNA, 17 bp, Homo sapiens
attcaattcctctggga

SEQ ID NO: 5016401 - DNA, 20 bp, Homo sapiens
attcagccccgggagtggcg

SEQ ID NO: 5016402 - DNA, 19 bp, Homo sapiens
attcatagcagcttattca

SEQ ID NO: 5016403 - DNA, 22 bp, Homo sapiens
attcatagcagcttattcacaa

SEQ ID NO: 5016404 - DNA, 19 bp, Homo sapiens
attcctatatcctgtgact

SEQ ID NO: 5016405 - DNA, 16 bp, Homo sapiens
attcttgaaagctgtg

SEQ ID NO: 5016406 - DNA, 15 bp, Homo sapiens
attgacacttaaaaa

SEQ ID NO: 5016407 - DNA, 18 bp, Homo sapiens
attgacccacaagaaatg

SEQ ID NO: 5016408 - DNA, 13 bp, Homo sapiens
attgtaaaatggt

SEQ ID NO: 5016409 - DNA, 19 bp, Homo sapiens
attgttgacaactgtgact

SEQ ID NO: 5016410 - DNA, 20 bp, Homo sapiens
attgttgacaactgtgactg

SEQ ID NO: 5016411 - DNA, 15 bp, Homo sapiens
atttaacattattta

SEQ ID NO: 5016412 - DNA, 17 bp, Homo sapiens
atttaacattatttata

SEQ ID NO: 5016413 - DNA, 14 bp, Homo sapiens
atttataattccta

SEQ ID NO: 5016414 - DNA, 12 bp, Homo sapiens
atttattaatat

SEQ ID NO: 5016415 - DNA, 14 bp, Homo sapiens
atttattaatattt

SEQ ID NO: 5016416 - DNA, 23 bp, Homo sapiens
atttattaatatttaacattatt

SEQ ID NO: 5016417 - DNA, 14 bp, Homo sapiens
atttattacctctg

SEQ ID NO: 5016418 - DNA, 14 bp, Homo sapiens
atttattattttca

SEQ ID NO: 5016419 - DNA, 19 bp, Homo sapiens
atttcacttgatgatacaa

SEQ ID NO: 5016420 - DNA, 16 bp, Homo sapiens
atttctatttatttac

SEQ ID NO: 5016421 - DNA, 12 bp, Homo sapiens
atttgagtgttt

SEQ ID NO: 5016422 - DNA, 14 bp, Homo sapiens
atttgttaaaatta

SEQ ID NO: 5016423 - DNA, 20 bp, Homo sapiens
attttgaataaataaatgta

SEQ ID NO: 5016424 - DNA, 15 bp, Homo sapiens
atttttttcaatatt

SEQ ID NO: 5016425 - DNA, 21 bp, Homo sapiens
caaaaggtattttaatcacca

SEQ ID NO: 5016426 - DNA, 18 bp, Homo sapiens
caaataagtatttataat

SEQ ID NO: 5016427 - DNA, 22 bp, Homo sapiens
caaatggaaagtaactcatttg

SEQ ID NO: 5016428 - DNA, 17 bp, Homo sapiens
caaatttacagagacag

SEQ ID NO: 5016429 - DNA, 15 bp, Homo sapiens
caacagaagcttcca

SEQ ID NO: 5016430 - DNA, 18 bp, Homo sapiens
caacatggtgaaaccccg

SEQ ID NO: 5016431 - DNA, 13 bp, Homo sapiens
caacctaaatttg

SEQ ID NO: 5016432 - DNA, 16 bp, Homo sapiens
caacctccaccttctg

SEQ ID NO: 5016433 - DNA, 17 bp, Homo sapiens
caagaaatgaaagcagg

SEQ ID NO: 5016434 - DNA, 19 bp, Homo sapiens
caagacccaaaaggcagaa

SEQ ID NO: 5016435 - DNA, 17 bp, Homo sapiens
caaggctgattaaacca

SEQ ID NO: 5016436 - DNA, 18 bp, Homo sapiens
caaggcttagaccctcat

SEQ ID NO: 5016437 - DNA, 13 bp, Homo sapiens
caatatcctaata

SEQ ID NO: 5016438 - DNA, 15 bp, Homo sapiens
caatatcctaataaa

SEQ ID NO: 5016439 - DNA, 16 bp, Homo sapiens
caatatcctaataaaa

SEQ ID NO: 5016440 - DNA, 18 bp, Homo sapiens
caatatcctaataaaaag

SEQ ID NO: 5016441 - DNA, 20 bp, Homo sapiens
caatatcctaataaaaaggt

SEQ ID NO: 5016442 - DNA, 16 bp, Homo sapiens
caatatctaatatata

SEQ ID NO: 5016443 - DNA, 17 bp, Homo sapiens
caatatctaatatatat

SEQ ID NO: 5016444 - DNA, 12 bp, Homo sapiens
caatatttatta

SEQ ID NO: 5016445 - DNA, 13 bp, Homo sapiens
caatatttattat

SEQ ID NO: 5016446 - DNA, 19 bp, Homo sapiens
caatatttattattttcac

SEQ ID NO: 5016447 - DNA, 19 bp, Homo sapiens
caatatttgaattttaaat

SEQ ID NO: 5016448 - DNA, 22 bp, Homo sapiens
caatcaaataagtatttataat

SEQ ID NO: 5016449 - DNA, 22 bp, Homo sapiens
caatgaatgaatgaatggctaa

SEQ ID NO: 5016450 - DNA, 14 bp, Homo sapiens
caattcctctggga

SEQ ID NO: 5016451 - DNA, 13 bp, Homo sapiens
cacaagaaatgaa

SEQ ID NO: 5016452 - DNA, 15 bp, Homo sapiens
cacaagaaatgaaag

SEQ ID NO: 5016453 - DNA, 15 bp, Homo sapiens
cacaggaagtagagg

SEQ ID NO: 5016454 - DNA, 17 bp, Homo sapiens
cacaggctccaaactgg

SEQ ID NO: 5016455 - DNA, 13 bp, Homo sapiens
cacagtgtctggc

SEQ ID NO: 5016456 - DNA, 14 bp, Homo sapiens
caccaccacccttg

SEQ ID NO: 5016457 - DNA, 17 bp, Homo sapiens
caccagggcctggctgg

SEQ ID NO: 5016458 - DNA, 21 bp, Homo sapiens
cacctgtaatcccagctactt

SEQ ID NO: 5016459 - DNA, 17 bp, Homo sapiens
cacgctttctagctgtt

SEQ ID NO: 5016460 - DNA, 17 bp, Homo sapiens
cactatggtatttgagt

SEQ ID NO: 5016461 - DNA, 12 bp, Homo sapiens
cactccagcctg

SEQ ID NO: 5016462 - DNA, 16 bp, Homo sapiens
cactccagtgagacag

SEQ ID NO: 5016463 - DNA, 21 bp, Homo sapiens
cactccagtgagacagctctg

SEQ ID NO: 5016464 - DNA, 21 bp, Homo sapiens
cactgcagaagacagtatggc

SEQ ID NO: 5016465 - DNA, 22 bp, Homo sapiens
cacttcattcttgaaagctgtg

SEQ ID NO: 5016466 - DNA, 21 bp, Homo sapiens
cacttgaacccgggaggcaga

SEQ ID NO: 5016467 - DNA, 21 bp, Homo sapiens
cactttaacacagtgtctggc

SEQ ID NO: 5016468 - DNA, 12 bp, Homo sapiens
cactttgggagg

SEQ ID NO: 5016469 - DNA, 13 bp, Homo sapiens
cactttgggaggc

SEQ ID NO: 5016470 - DNA, 18 bp, Homo sapiens
cagaacagtgattaccag

SEQ ID NO: 5016471 - DNA, 23 bp, Homo sapiens
cagaacagtgattaccagggact

SEQ ID NO: 5016472 - DNA, 18 bp, Homo sapiens
cagaagtcaaggcttaga

SEQ ID NO: 5016473 - DNA, 16 bp, Homo sapiens
cagaggttgcagtgag

SEQ ID NO: 5016474 - DNA, 23 bp, Homo sapiens
cagataaatagtttatgattcca

SEQ ID NO: 5016475 - DNA, 15 bp, Homo sapiens
cagcactttgggagg

SEQ ID NO: 5016476 - DNA, 16 bp, Homo sapiens
cagcactttgggaggc

SEQ ID NO: 5016477 - DNA, 17 bp, Homo sapiens
cagcaggatagagtggg

SEQ ID NO: 5016478 - DNA, 17 bp, Homo sapiens
cagccccgggagtggcg

SEQ ID NO: 5016479 - DNA, 18 bp, Homo sapiens
cagccccttgagaaacct

SEQ ID NO: 5016480 - DNA, 16 bp, Homo sapiens
cagctacttgggaggc

SEQ ID NO: 5016481 - DNA, 19 bp, Homo sapiens
cagctacttgggaggctga

SEQ ID NO: 5016482 - DNA, 14 bp, Homo sapiens
caggctggtctcga

SEQ ID NO: 5016483 - DNA, 24 bp, Homo sapiens
caggctggtctcgaactgctggat

SEQ ID NO: 5016484 - DNA, 12 bp, Homo sapiens
cagtagtgatag

SEQ ID NO: 5016485 - DNA, 13 bp, Homo sapiens
cagtccatgaaga

SEQ ID NO: 5016486 - DNA, 22 bp, Homo sapiens
cagtgattaccagggactgagg

SEQ ID NO: 5016487 - DNA, 12 bp, Homo sapiens
cagtgcttggcc

SEQ ID NO: 5016488 - DNA, 18 bp, Homo sapiens
cagtgcttggcccaggag

SEQ ID NO: 5016489 - DNA, 19 bp, Homo sapiens
cagtgcttggcccaggagt

SEQ ID NO: 5016490 - DNA, 14 bp, Homo sapiens
cagtgtcaatgcag

SEQ ID NO: 5016491 - DNA, 21 bp, Homo sapiens
catctccgtctcccaaagtgc

SEQ ID NO: 5016492 - DNA, 16 bp, Homo sapiens
catctgtaaaatggag

SEQ ID NO: 5016493 - DNA, 17 bp, Homo sapiens
catgctgccaatatcct

SEQ ID NO: 5016494 - DNA, 18 bp, Homo sapiens
catgtgattaccctctgg

SEQ ID NO: 5016495 - DNA, 15 bp, Homo sapiens
cattaggatggctag

SEQ ID NO: 5016496 - DNA, 14 bp, Homo sapiens
cattccaagcctga

SEQ ID NO: 5016497 - DNA, 14 bp, Homo sapiens
cattgcaacctcca

SEQ ID NO: 5016498 - DNA, 22 bp, Homo sapiens
cattgtttgtctgtcttcatag

SEQ ID NO: 5016499 - DNA, 18 bp, Homo sapiens
catttctatttatttact

SEQ ID NO: 5016500 - DNA, 22 bp, Homo sapiens
catttgttaaaattatcaatat

SEQ ID NO: 5016501 - DNA, 19 bp, Homo sapiens
ccaaggctgattaaaccaa

SEQ ID NO: 5016502 - DNA, 14 bp, Homo sapiens
ccaatatcctaata

SEQ ID NO: 5016503 - DNA, 16 bp, Homo sapiens
ccaatattcatagcag

SEQ ID NO: 5016504 - DNA, 16 bp, Homo sapiens
ccacaagaaatgaaag

SEQ ID NO: 5016505 - DNA, 18 bp, Homo sapiens
ccactgcagaagacagta

SEQ ID NO: 5016506 - DNA, 14 bp, Homo sapiens
ccagacatcaacag

SEQ ID NO: 5016507 - DNA, 15 bp, Homo sapiens
ccagcttgttattta

SEQ ID NO: 5016508 - DNA, 16 bp, Homo sapiens
ccagcttgttatttat

SEQ ID NO: 5016509 - DNA, 14 bp, Homo sapiens
ccaggagtttggcc

SEQ ID NO: 5016510 - DNA, 12 bp, Homo sapiens
cccaatattata

SEQ ID NO: 5016511 - DNA, 20 bp, Homo sapiens
cccacaagaaatgaaagcag

SEQ ID NO: 5016512 - DNA, 15 bp, Homo sapiens
cccagcactttggga

SEQ ID NO: 5016513 - DNA, 17 bp, Homo sapiens
cccaggagtttggccag

SEQ ID NO: 5016514 - DNA, 20 bp, Homo sapiens
cccatatttgtacaccaata

SEQ ID NO: 5016515 - DNA, 22 bp, Homo sapiens
cccatgggttgtgtgtttattt

SEQ ID NO: 5016516 - DNA, 22 bp, Homo sapiens
cccattgtggtcacaggaagta

SEQ ID NO: 5016517 - DNA, 15 bp, Homo sapiens
cccatttctatttat

SEQ ID NO: 5016518 - DNA, 16 bp, Homo sapiens
cccatttctatttatt

SEQ ID NO: 5016519 - DNA, 19 bp, Homo sapiens
cccatttctatttatttac

SEQ ID NO: 5016520 - DNA, 15 bp, Homo sapiens
ccccattgtggtcac

SEQ ID NO: 5016521 - DNA, 13 bp, Homo sapiens
ccccatttctatt

SEQ ID NO: 5016522 - DNA, 18 bp, Homo sapiens
cccctgcactccagcctg

SEQ ID NO: 5016523 - DNA, 17 bp, Homo sapiens
ccctgacctccctctaa

SEQ ID NO: 5016524 - DNA, 22 bp, Homo sapiens
cccttgagaaaccttattgtac

SEQ ID NO: 5016525 - DNA, 16 bp, Homo sapiens
ccgtctcccaaagtgc

SEQ ID NO: 5016526 - DNA, 20 bp, Homo sapiens
cctaataaaaaggtgaccat

SEQ ID NO: 5016527 - DNA, 16 bp, Homo sapiens
cctcatgctgccaata

SEQ ID NO: 5016528 - DNA, 21 bp, Homo sapiens
cctcatgctgccaatatccta

SEQ ID NO: 5016529 - DNA, 19 bp, Homo sapiens
cctctgttgccaaggctgg

SEQ ID NO: 5016530 - DNA, 12 bp, Homo sapiens
cctgctggatgt

SEQ ID NO: 5016531 - DNA, 15 bp, Homo sapiens
cctgtaatcacagct

SEQ ID NO: 5016532 - DNA, 19 bp, Homo sapiens
cctgtttttaagctgtttc

SEQ ID NO: 5016533 - DNA, 16 bp, Homo sapiens
ccttattgtacctctc

SEQ ID NO: 5016534 - DNA, 19 bp, Homo sapiens
ccttgagaaaccttattgt

SEQ ID NO: 5016535 - DNA, 15 bp, Homo sapiens
cgacagtgagactct

SEQ ID NO: 5016536 - DNA, 16 bp, Homo sapiens
cgacagtgagactctg

SEQ ID NO: 5016537 - DNA, 17 bp, Homo sapiens
cggagggattcccctaa

SEQ ID NO: 5016538 - DNA, 19 bp, Homo sapiens
ctaaattgacacttaaaaa

SEQ ID NO: 5016539 - DNA, 15 bp, Homo sapiens
ctaagcaaaatgtga

SEQ ID NO: 5016540 - DNA, 23 bp, Homo sapiens
ctaagtgaaataagccagacatc

SEQ ID NO: 5016541 - DNA, 13 bp, Homo sapiens
ctaatagaactca

SEQ ID NO: 5016542 - DNA, 13 bp, Homo sapiens
ctaatatatatga

SEQ ID NO: 5016543 - DNA, 17 bp, Homo sapiens
ctaatatatatgaataa

SEQ ID NO: 5016544 - DNA, 16 bp, Homo sapiens
ctacactccagtgaga

SEQ ID NO: 5016545 - DNA, 21 bp, Homo sapiens
ctattaatatatgtattattt

SEQ ID NO: 5016546 - DNA, 13 bp, Homo sapiens
ctatttattaata

SEQ ID NO: 5016547 - DNA, 20 bp, Homo sapiens
ctatttattaatatttaaca

SEQ ID NO: 5016548 - DNA, 21 bp, Homo sapiens
ctatttattaatatttaacat

SEQ ID NO: 5016549 - DNA, 22 bp, Homo sapiens
ctcatgctgccaatatcctaat

SEQ ID NO: 5016550 - DNA, 18 bp, Homo sapiens
ctcattaggatggctagt

SEQ ID NO: 5016551 - DNA, 21 bp, Homo sapiens
ctctgtgaacgatttagaaag

SEQ ID NO: 5016552 - DNA, 19 bp, Homo sapiens
ctcttaggaagagaaacca

SEQ ID NO: 5016553 - DNA, 16 bp, Homo sapiens
ctcttatagaatattt

SEQ ID NO: 5016554 - DNA, 22 bp, Homo sapiens
ctcttatagaatatttattacc

SEQ ID NO: 5016555 - DNA, 21 bp, Homo sapiens
ctgacccagccccttgagaaa

SEQ ID NO: 5016556 - DNA, 18 bp, Homo sapiens
ctgacctccctctaattt

SEQ ID NO: 5016557 - DNA, 21 bp, Homo sapiens
ctgacctccctctaatttatc

SEQ ID NO: 5016558 - DNA, 12 bp, Homo sapiens
ctgatgaaaaca

SEQ ID NO: 5016559 - DNA, 17 bp, Homo sapiens
ctgcactccagcctgag

SEQ ID NO: 5016560 - DNA, 18 bp, Homo sapiens
ctgccaatatcctaataa

SEQ ID NO: 5016561 - DNA, 19 bp, Homo sapiens
ctgccaatatcctaataaa

SEQ ID NO: 5016562 - DNA, 19 bp, Homo sapiens
ctgcctgcaatatttgaat

SEQ ID NO: 5016563 - DNA, 19 bp, Homo sapiens
ctgctggattcaagtgatc

SEQ ID NO: 5016564 - DNA, 22 bp, Homo sapiens
ctgctgtttcctagcgcagcca

SEQ ID NO: 5016565 - DNA, 15 bp, Homo sapiens
ctggggctctgggat

SEQ ID NO: 5016566 - DNA, 21 bp, Homo sapiens
ctggtgcctcaccccttgcca

SEQ ID NO: 5016567 - DNA, 22 bp, Homo sapiens
ctgtcttcatagcagattttaa

SEQ ID NO: 5016568 - DNA, 22 bp, Homo sapiens
ctgtgaacgatttagaaagaag

SEQ ID NO: 5016569 - DNA, 20 bp, Homo sapiens
ctgttgagctgttttccctg

SEQ ID NO: 5016570 - DNA, 15 bp, Homo sapiens
ctgtttttaagctgt

SEQ ID NO: 5016571 - DNA, 17 bp, Homo sapiens
ctgtttttaagctgttt

SEQ ID NO: 5016572 - DNA, 18 bp, Homo sapiens
ctgtttttaagctgtttc

SEQ ID NO: 5016573 - DNA, 19 bp, Homo sapiens
cttactagtttcccttgca

SEQ ID NO: 5016574 - DNA, 20 bp, Homo sapiens
cttagaccctcatgctgcca

SEQ ID NO: 5016575 - DNA, 19 bp, Homo sapiens
cttataagtgaagtgatac

SEQ ID NO: 5016576 - DNA, 15 bp, Homo sapiens
cttatagaatattta

SEQ ID NO: 5016577 - DNA, 16 bp, Homo sapiens
cttatagaatatttat

SEQ ID NO: 5016578 - DNA, 20 bp, Homo sapiens
cttatagaatatttattacc

SEQ ID NO: 5016579 - DNA, 19 bp, Homo sapiens
cttataggaattgacccac

SEQ ID NO: 5016580 - DNA, 13 bp, Homo sapiens
cttattgtacctc

SEQ ID NO: 5016581 - DNA, 15 bp, Homo sapiens
cttattgtacctctc

SEQ ID NO: 5016582 - DNA, 18 bp, Homo sapiens
cttattgtacctctctta

SEQ ID NO: 5016583 - DNA, 21 bp, Homo sapiens
cttcattcttgaaagctgtgg

SEQ ID NO: 5016584 - DNA, 22 bp, Homo sapiens
cttctctgtgaacgatttagaa

SEQ ID NO: 5016585 - DNA, 12 bp, Homo sapiens
cttgagaaacct

SEQ ID NO: 5016586 - DNA, 18 bp, Homo sapiens
cttgccctggtgcctcac

SEQ ID NO: 5016587 - DNA, 14 bp, Homo sapiens
cttggcccaggagt

SEQ ID NO: 5016588 - DNA, 14 bp, Homo sapiens
cttggggcttccta

SEQ ID NO: 5016589 - DNA, 13 bp, Homo sapiens
cttgtctctgggc

SEQ ID NO: 5016590 - DNA, 15 bp, Homo sapiens
cttgttatttataac

SEQ ID NO: 5016591 - DNA, 15 bp, Homo sapiens
ctttaacacagtgtc

SEQ ID NO: 5016592 - DNA, 14 bp, Homo sapiens
ctttctagctgttg

SEQ ID NO: 5016593 - DNA, 21 bp, Homo sapiens
ctttgatgattaattcacctt

SEQ ID NO: 5016594 - DNA, 21 bp, Homo sapiens
gaaaactttatgctaagtgaa

SEQ ID NO: 5016595 - DNA, 17 bp, Homo sapiens
gaaaccttattgtacct

SEQ ID NO: 5016596 - DNA, 14 bp, Homo sapiens
gaaagcagaacagt

SEQ ID NO: 5016597 - DNA, 14 bp, Homo sapiens
gaaagcagggactt

SEQ ID NO: 5016598 - DNA, 18 bp, Homo sapiens
gaaatgaaagcagggact

SEQ ID NO: 5016599 - DNA, 17 bp, Homo sapiens
gaacaaatttacagaga

SEQ ID NO: 5016600 - DNA, 23 bp, Homo sapiens
gaacaaatttacagagacagaaa

SEQ ID NO: 5016601 - DNA, 14 bp, Homo sapiens
gaacttgaatgtgt

SEQ ID NO: 5016602 - DNA, 17 bp, Homo sapiens
gaacttgaatgtgtcag

SEQ ID NO: 5016603 - DNA, 12 bp, Homo sapiens
gaagagaaacca

SEQ ID NO: 5016604 - DNA, 17 bp, Homo sapiens
gaagatgtagaggagaa

SEQ ID NO: 5016605 - DNA, 22 bp, Homo sapiens
gaagtgatactatccagttact

SEQ ID NO: 5016606 - DNA, 17 bp, Homo sapiens
gaatatctattaatata

SEQ ID NO: 5016607 - DNA, 13 bp, Homo sapiens
gaatatttattac

SEQ ID NO: 5016608 - DNA, 15 bp, Homo sapiens
gaatatttattacct

SEQ ID NO: 5016609 - DNA, 13 bp, Homo sapiens
gaatttattcaat

SEQ ID NO: 5016610 - DNA, 12 bp, Homo sapiens
gacaactgtgac

SEQ ID NO: 5016611 - DNA, 13 bp, Homo sapiens
gacaactgtgact

SEQ ID NO: 5016612 - DNA, 20 bp, Homo sapiens
gacagaaagcagaacagtga

SEQ ID NO: 5016613 - DNA, 21 bp, Homo sapiens
gacagaaagcagaacagtgat

SEQ ID NO: 5016614 - DNA, 14 bp, Homo sapiens
gacatcaacagata

SEQ ID NO: 5016615 - DNA, 18 bp, Homo sapiens
gaccactgcagaagacag

SEQ ID NO: 5016616 - DNA, 21 bp, Homo sapiens
gaccactgcagaagacagtat

SEQ ID NO: 5016617 - DNA, 20 bp, Homo sapiens
gacccaaaaggcagaagcaa

SEQ ID NO: 5016618 - DNA, 16 bp, Homo sapiens
gaccctcatgctgcca

SEQ ID NO: 5016619 - DNA, 22 bp, Homo sapiens
gaccctcatgctgccaatatcc

SEQ ID NO: 5016620 - DNA, 23 bp, Homo sapiens
gaccctcatgctgccaatatcct

SEQ ID NO: 5016621 - DNA, 22 bp, Homo sapiens
gactcatcaatcaaataagtat

SEQ ID NO: 5016622 - DNA, 19 bp, Homo sapiens
gactgtctcacttaatcct

SEQ ID NO: 5016623 - DNA, 15 bp, Homo sapiens
gagaatcacttgaac

SEQ ID NO: 5016624 - DNA, 18 bp, Homo sapiens
gagaattgcttgaaccca

SEQ ID NO: 5016625 - DNA, 15 bp, Homo sapiens
gagacagctctgcat

SEQ ID NO: 5016626 - DNA, 15 bp, Homo sapiens
gagaccagccaacct

SEQ ID NO: 5016627 - DNA, 21 bp, Homo sapiens
gagattgtgcccctgcactcc

SEQ ID NO: 5016628 - DNA, 20 bp, Homo sapiens
gagccaacagaagcttccat

SEQ ID NO: 5016629 - DNA, 13 bp, Homo sapiens
gagcgacagtgag

SEQ ID NO: 5016630 - DNA, 10 bp, Homo sapiens
gagcttctct

SEQ ID NO: 5016631 - DNA, 18 bp, Homo sapiens
gagcttgaaatagtgtct

SEQ ID NO: 5016632 - DNA, 20 bp, Homo sapiens
gagcttgaaatagtgtctga

SEQ ID NO: 5016633 - DNA, 14 bp, Homo sapiens
gaggagaaactgga

SEQ ID NO: 5016634 - DNA, 19 bp, Homo sapiens
gaggcgggtggatcacttg

SEQ ID NO: 5016635 - DNA, 16 bp, Homo sapiens
gaggctgaggcaagag

SEQ ID NO: 5016636 - DNA, 22 bp, Homo sapiens
gataaatagtttatgattccac

SEQ ID NO: 5016637 - DNA, 13 bp, Homo sapiens
gataaattataag

SEQ ID NO: 5016638 - DNA, 19 bp, Homo sapiens
gatgttgaaaaagttctgc

SEQ ID NO: 5016639 - DNA, 20 bp, Homo sapiens
gcaacttttgtgtaatgaaa

SEQ ID NO: 5016640 - DNA, 15 bp, Homo sapiens
gcaaggctatgtgat

SEQ ID NO: 5016641 - DNA, 14 bp, Homo sapiens
gcaatatttgaatt

SEQ ID NO: 5016642 - DNA, 18 bp, Homo sapiens
gcacctgcaggcgtgacc

SEQ ID NO: 5016643 - DNA, 18 bp, Homo sapiens
gcagaacagtgattacca

SEQ ID NO: 5016644 - DNA, 22 bp, Homo sapiens
gcagaacagtgattaccaggga

SEQ ID NO: 5016645 - DNA, 18 bp, Homo sapiens
gcagataaacagtagtga

SEQ ID NO: 5016646 - DNA, 19 bp, Homo sapiens
gcagtgcttggcccaggag

SEQ ID NO: 5016647 - DNA, 16 bp, Homo sapiens
gcatgtatgacgtgac

SEQ ID NO: 5016648 - DNA, 21 bp, Homo sapiens
gcatgtcagacagaacttgaa

SEQ ID NO: 5016649 - DNA, 14 bp, Homo sapiens
gccaatatcctaat

SEQ ID NO: 5016650 - DNA, 16 bp, Homo sapiens
gccaatatcctaataa

SEQ ID NO: 5016651 - DNA, 18 bp, Homo sapiens
gccaatatcctaataaaa

SEQ ID NO: 5016652 - DNA, 22 bp, Homo sapiens
gccagaagtcaaggcttagacc

SEQ ID NO: 5016653 - DNA, 22 bp, Homo sapiens
gccagacatcaacagataaata

SEQ ID NO: 5016654 - DNA, 14 bp, Homo sapiens
gccatgctggccag

SEQ ID NO: 5016655 - DNA, 18 bp, Homo sapiens
gcccaatattataatttt

SEQ ID NO: 5016656 - DNA, 17 bp, Homo sapiens
gcctaagtgcagccccg

SEQ ID NO: 5016657 - DNA, 22 bp, Homo sapiens
gcctatattttttgttaaatga

SEQ ID NO: 5016658 - DNA, 17 bp, Homo sapiens
gcctgagcgacagtgag

SEQ ID NO: 5016659 - DNA, 18 bp, Homo sapiens
gcctgcaatctgagccag

SEQ ID NO: 5016660 - DNA, 14 bp, Homo sapiens
gcgggacacaggct

SEQ ID NO: 5016661 - DNA, 21 bp, Homo sapiens
gctctgggatagctgacccag

SEQ ID NO: 5016662 - DNA, 15 bp, Homo sapiens
gctgccaatatccta

SEQ ID NO: 5016663 - DNA, 16 bp, Homo sapiens
gctgccaatatcctaa

SEQ ID NO: 5016664 - DNA, 17 bp, Homo sapiens
gctgccaatatcctaat

SEQ ID NO: 5016665 - DNA, 18 bp, Homo sapiens
gctgccaatatcctaata

SEQ ID NO: 5016666 - DNA, 20 bp, Homo sapiens
gctgccaatatcctaataaa

SEQ ID NO: 5016667 - DNA, 21 bp, Homo sapiens
gctgccaatatcctaataaaa

SEQ ID NO: 5016668 - DNA, 12 bp, Homo sapiens
gctggccaggct

SEQ ID NO: 5016669 - DNA, 18 bp, Homo sapiens
gctgggaattacaggcgt

SEQ ID NO: 5016670 - DNA, 12 bp, Homo sapiens
gctgttgagctg

SEQ ID NO: 5016671 - DNA, 16 bp, Homo sapiens
gcttagaccctcatgc

SEQ ID NO: 5016672 - DNA, 17 bp, Homo sapiens
gcttgccctggtgcctc

SEQ ID NO: 5016673 - DNA, 15 bp, Homo sapiens
gcttggcccaggagt

SEQ ID NO: 5016674 - DNA, 16 bp, Homo sapiens
gcttggcccaggagtt

SEQ ID NO: 5016675 - DNA, 15 bp, Homo sapiens
gcttgttatttataa

SEQ ID NO: 5016676 - DNA, 13 bp, Homo sapiens
ggaagagaaacca

SEQ ID NO: 5016677 - DNA, 20 bp, Homo sapiens
ggaagtgacggtttaatggg

SEQ ID NO: 5016678 - DNA, 19 bp, Homo sapiens
ggagaatcacttgaacccg

SEQ ID NO: 5016679 - DNA, 20 bp, Homo sapiens
ggagatggaagttgcagtga

SEQ ID NO: 5016680 - DNA, 19 bp, Homo sapiens
ggaggggagcatgggaagt

SEQ ID NO: 5016681 - DNA, 13 bp, Homo sapiens
ggagtttggccag

SEQ ID NO: 5016682 - DNA, 21 bp, Homo sapiens
ggcagaggttgcagtgagccg

SEQ ID NO: 5016683 - DNA, 16 bp, Homo sapiens
ggcagtgcttggccca

SEQ ID NO: 5016684 - DNA, 20 bp, Homo sapiens
ggcagtgcttggcccaggag

SEQ ID NO: 5016685 - DNA, 11 bp, Homo sapiens
ggccaggctgg

SEQ ID NO: 5016686 - DNA, 20 bp, Homo sapiens
ggctagtatcaaaagaaaga

SEQ ID NO: 5016687 - DNA, 23 bp, Homo sapiens
ggcttagaccctcatgctgccaa

SEQ ID NO: 5016688 - DNA, 20 bp, Homo sapiens
gggaggcagaggttgcagtg

SEQ ID NO: 5016689 - DNA, 20 bp, Homo sapiens
gggcagtgcttggcccagga

SEQ ID NO: 5016690 - DNA, 22 bp, Homo sapiens
gggcagtgcttggcccaggagt

SEQ ID NO: 5016691 - DNA, 23 bp, Homo sapiens
gggcagtgcttggcccaggagtt

SEQ ID NO: 5016692 - DNA, 15 bp, Homo sapiens
gggcgtggtggtgag

SEQ ID NO: 5016693 - DNA, 15 bp, Homo sapiens
gggctttagggacct

SEQ ID NO: 5016694 - DNA, 12 bp, Homo sapiens
ggggctctggga

SEQ ID NO: 5016695 - DNA, 21 bp, Homo sapiens
ggtggcgactctatagactct

SEQ ID NO: 5016696 - DNA, 15 bp, Homo sapiens
gtagaggagaaactg

SEQ ID NO: 5016697 - DNA, 12 bp, Homo sapiens
gtatttataata

SEQ ID NO: 5016698 - DNA, 13 bp, Homo sapiens
gtcaaggcttaga

SEQ ID NO: 5016699 - DNA, 14 bp, Homo sapiens
gtcaaggcttagac

SEQ ID NO: 5016700 - DNA, 13 bp, Homo sapiens
gtcacaggaagta

SEQ ID NO: 5016701 - DNA, 15 bp, Homo sapiens
gtcacaggaagtaga

SEQ ID NO: 5016702 - DNA, 13 bp, Homo sapiens
gtcaggagttcct

SEQ ID NO: 5016703 - DNA, 14 bp, Homo sapiens
gtcaggtgaccctg

SEQ ID NO: 5016704 - DNA, 23 bp, Homo sapiens
gtctcagtccatgaagatgtaga

SEQ ID NO: 5016705 - DNA, 14 bp, Homo sapiens
gtgaacgatttaga

SEQ ID NO: 5016706 - DNA, 21 bp, Homo sapiens
gtgctgggaattacaggcgtg

SEQ ID NO: 5016707 - DNA, 24 bp, Homo sapiens
gtgcttggcccaggagtttggcca

SEQ ID NO: 5016708 - DNA, 14 bp, Homo sapiens
gtggggcagtgctt

SEQ ID NO: 5016709 - DNA, 21 bp, Homo sapiens
gtgtgaccactgcagaagaca

SEQ ID NO: 5016710 - DNA, 15 bp, Homo sapiens
gttgacaactgtgac

SEQ ID NO: 5016711 - DNA, 15 bp, Homo sapiens
gttgcagtgagctga

SEQ ID NO: 5016712 - DNA, 18 bp, Homo sapiens
gttgtaccgcaatgtgac

SEQ ID NO: 5016713 - DNA, 20 bp, Homo sapiens
gtttaggatgttgaaaaagt

SEQ ID NO: 5016714 - DNA, 16 bp, Homo sapiens
gtttatttcacttgat

SEQ ID NO: 5016715 - DNA, 15 bp, Homo sapiens
gtttgtctgtcttca

SEQ ID NO: 5016716 - DNA, 21 bp, Homo sapiens
gttttccctgacctccctcta

SEQ ID NO: 5016717 - DNA, 13 bp, Homo sapiens
gtttttaagctgt

SEQ ID NO: 5016718 - DNA, 13 bp, Homo sapiens
taaaaaggtgacc

SEQ ID NO: 5016719 - DNA, 17 bp, Homo sapiens
taaaaataaatttggtt

SEQ ID NO: 5016720 - DNA, 18 bp, Homo sapiens
taaagtgtaagttcacaa

SEQ ID NO: 5016721 - DNA, 14 bp, Homo sapiens
taaatctaaatcta

SEQ ID NO: 5016722 - DNA, 15 bp, Homo sapiens
taaatctaaatctat

SEQ ID NO: 5016723 - DNA, 19 bp, Homo sapiens
taaatctaaatctatttat

SEQ ID NO: 5016724 - DNA, 17 bp, Homo sapiens
taaatgatttcattcaa

SEQ ID NO: 5016725 - DNA, 13 bp, Homo sapiens
taacacagtgtct

SEQ ID NO: 5016726 - DNA, 12 bp, Homo sapiens
taacattattta

SEQ ID NO: 5016727 - DNA, 14 bp, Homo sapiens
taacattatttata

SEQ ID NO: 5016728 - DNA, 17 bp, Homo sapiens
taactagaatttattca

SEQ ID NO: 5016729 - DNA, 20 bp, Homo sapiens
taactcatttgttaaaatta

SEQ ID NO: 5016730 - DNA, 14 bp, Homo sapiens
taagcaaaatgtga

SEQ ID NO: 5016731 - DNA, 11 bp, Homo sapiens
taagctgtttc

SEQ ID NO: 5016732 - DNA, 14 bp, Homo sapiens
taagtatttataat

SEQ ID NO: 5016733 - DNA, 20 bp, Homo sapiens
taatagcaacttttgtgtaa

SEQ ID NO: 5016734 - DNA, 21 bp, Homo sapiens
taatagcaacttttgtgtaat

SEQ ID NO: 5016735 - DNA, 16 bp, Homo sapiens
taatcctttgttttct

SEQ ID NO: 5016736 - DNA, 17 bp, Homo sapiens
taattaggcaaggctat

SEQ ID NO: 5016737 - DNA, 21 bp, Homo sapiens
taattaggcaaggctatgtga

SEQ ID NO: 5016738 - DNA, 21 bp, Homo sapiens
taattcctatatcctgtgact

SEQ ID NO: 5016739 - DNA, 16 bp, Homo sapiens
taatttttttcaatat

SEQ ID NO: 5016740 - DNA, 17 bp, Homo sapiens
tacaaatactcttagga

SEQ ID NO: 5016741 - DNA, 23 bp, Homo sapiens
tacaaatactcttaggaagagaa

SEQ ID NO: 5016742 - DNA, 14 bp, Homo sapiens
tacactccagtgag

SEQ ID NO: 5016743 - DNA, 19 bp, Homo sapiens
tacattgtttgtctgtctt

SEQ ID NO: 5016744 - DNA, 23 bp, Homo sapiens
tacattgtttgtctgtcttcata

SEQ ID NO: 5016745 - DNA, 19 bp, Homo sapiens
taccagggactgaggggag

SEQ ID NO: 5016746 - DNA, 17 bp, Homo sapiens
tacctctcttatagaat

SEQ ID NO: 5016747 - DNA, 21 bp, Homo sapiens
tacctctcttatagaatattt

SEQ ID NO: 5016748 - DNA, 23 bp, Homo sapiens
tacctctcttatagaatatttat

SEQ ID NO: 5016749 - DNA, 18 bp, Homo sapiens
tactaaaaatacaaaaaa

SEQ ID NO: 5016750 - DNA, 21 bp, Homo sapiens
tactcttaggaagagaaacca

SEQ ID NO: 5016751 - DNA, 17 bp, Homo sapiens
tactgagcttctctgtg

SEQ ID NO: 5016752 - DNA, 18 bp, Homo sapiens
tactgagcttctctgtga

SEQ ID NO: 5016753 - DNA, 23 bp, Homo sapiens
tagaaagaagcccaatattataa

SEQ ID NO: 5016754 - DNA, 20 bp, Homo sapiens
tagaatatttattacctctg

SEQ ID NO: 5016755 - DNA, 18 bp, Homo sapiens
tagaattaacacatgatc

SEQ ID NO: 5016756 - DNA, 20 bp, Homo sapiens
tagaatttattcaattcctc

SEQ ID NO: 5016757 - DNA, 17 bp, Homo sapiens
tagaccctcatgctgcc

SEQ ID NO: 5016758 - DNA, 18 bp, Homo sapiens
tagaccctcatgctgcca

SEQ ID NO: 5016759 - DNA, 13 bp, Homo sapiens
tagcaacttttgt

SEQ ID NO: 5016760 - DNA, 17 bp, Homo sapiens
tagcaacttttgtgtaa

SEQ ID NO: 5016761 - DNA, 18 bp, Homo sapiens
tagcagattttaattttg

SEQ ID NO: 5016762 - DNA, 22 bp, Homo sapiens
tagcatctcaggagatttcatg

SEQ ID NO: 5016763 - DNA, 17 bp, Homo sapiens
tagctgttgagctgttt

SEQ ID NO: 5016764 - DNA, 13 bp, Homo sapiens
taggatgttgaaa

SEQ ID NO: 5016765 - DNA, 22 bp, Homo sapiens
tataattcctatatcctgtgac

SEQ ID NO: 5016766 - DNA, 21 bp, Homo sapiens
tataatttttttcaatattta

SEQ ID NO: 5016767 - DNA, 12 bp, Homo sapiens
tataggaattga

SEQ ID NO: 5016768 - DNA, 19 bp, Homo sapiens
tataggaattgacccacaa

SEQ ID NO: 5016769 - DNA, 15 bp, Homo sapiens
tatatcctgtgactg

SEQ ID NO: 5016770 - DNA, 17 bp, Homo sapiens
tatatcctgtgactgtc

SEQ ID NO: 5016771 - DNA, 16 bp, Homo sapiens
tatatgaataaagtgt

SEQ ID NO: 5016772 - DNA, 17 bp, Homo sapiens
tatcaatatctaatata

SEQ ID NO: 5016773 - DNA, 18 bp, Homo sapiens
tatcaatatctaatatat

SEQ ID NO: 5016774 - DNA, 18 bp, Homo sapiens
tatcatgcccctgtactc

SEQ ID NO: 5016775 - DNA, 14 bp, Homo sapiens
tatccagttactgc

SEQ ID NO: 5016776 - DNA, 19 bp, Homo sapiens
tatcctaataaaaaggtga

SEQ ID NO: 5016777 - DNA, 14 bp, Homo sapiens
tatcctgtgactgt

SEQ ID NO: 5016778 - DNA, 23 bp, Homo sapiens
tatcctgtgactgtctcacttaa

SEQ ID NO: 5016779 - DNA, 21 bp, Homo sapiens
tatctaatatatatgaataaa

SEQ ID NO: 5016780 - DNA, 12 bp, Homo sapiens
tatctattaata

SEQ ID NO: 5016781 - DNA, 15 bp, Homo sapiens
tatctattaatatat

SEQ ID NO: 5016782 - DNA, 19 bp, Homo sapiens
tatctattaatatatgtat

SEQ ID NO: 5016783 - DNA, 21 bp, Homo sapiens
tatgtattatttataattcct

SEQ ID NO: 5016784 - DNA, 17 bp, Homo sapiens
tatgttctaagaagtga

SEQ ID NO: 5016785 - DNA, 19 bp, Homo sapiens
tattacctctgatacctca

SEQ ID NO: 5016786 - DNA, 17 bp, Homo sapiens
tattcaattcctctggg

SEQ ID NO: 5016787 - DNA, 18 bp, Homo sapiens
tattcaattcctctggga

SEQ ID NO: 5016788 - DNA, 11 bp, Homo sapiens
tattgtacctc

SEQ ID NO: 5016789 - DNA, 13 bp, Homo sapiens
tattgtacctctc

SEQ ID NO: 5016790 - DNA, 22 bp, Homo sapiens
tatttataatagcaacttttgt

SEQ ID NO: 5016791 - DNA, 17 bp, Homo sapiens
tatttatttactgagct

SEQ ID NO: 5016792 - DNA, 12 bp, Homo sapiens
tatttgaatttt

SEQ ID NO: 5016793 - DNA, 21 bp, Homo sapiens
tatttgaattttaaatctaaa

SEQ ID NO: 5016794 - DNA, 14 bp, Homo sapiens
tcaaggcttagacc

SEQ ID NO: 5016795 - DNA, 12 bp, Homo sapiens
tcaatatttatt

SEQ ID NO: 5016796 - DNA, 13 bp, Homo sapiens
tcaatatttatta

SEQ ID NO: 5016797 - DNA, 15 bp, Homo sapiens
tcaattcctctggga

SEQ ID NO: 5016798 - DNA, 13 bp, Homo sapiens
tcaatttaaaaaa

SEQ ID NO: 5016799 - DNA, 17 bp, Homo sapiens
tcacaagacccaaaagg

SEQ ID NO: 5016800 - DNA, 16 bp, Homo sapiens
tcacagtcacattcca

SEQ ID NO: 5016801 - DNA, 19 bp, Homo sapiens
tcacctgtttttaagctgt

SEQ ID NO: 5016802 - DNA, 15 bp, Homo sapiens
tcagacagaacttga

SEQ ID NO: 5016803 - DNA, 23 bp, Homo sapiens
tcagacagaacttgaatgtgtca

SEQ ID NO: 5016804 - DNA, 19 bp, Homo sapiens
tcagacatagaattaacac

SEQ ID NO: 5016805 - DNA, 18 bp, Homo sapiens
tcatagcagattttaatt

SEQ ID NO: 5016806 - DNA, 17 bp, Homo sapiens
tcatcaatgaatgaatg

SEQ ID NO: 5016807 - DNA, 14 bp, Homo sapiens
tccacctacatgag

SEQ ID NO: 5016808 - DNA, 22 bp, Homo sapiens
tccactggttcttcttggtctc

SEQ ID NO: 5016809 - DNA, 21 bp, Homo sapiens
tccagcctgagcgacagtgag

SEQ ID NO: 5016810 - DNA, 12 bp, Homo sapiens
tccagcctgggt

SEQ ID NO: 5016811 - DNA, 21 bp, Homo sapiens
tccatgaagatgtagaggaga

SEQ ID NO: 5016812 - DNA, 18 bp, Homo sapiens
tcccagctacttgggagg

SEQ ID NO: 5016813 - DNA, 14 bp, Homo sapiens
tcctaataaaaagg

SEQ ID NO: 5016814 - DNA, 15 bp, Homo sapiens
tcctaataaaaaggt

SEQ ID NO: 5016815 - DNA, 15 bp, Homo sapiens
tcctgagaccagcca

SEQ ID NO: 5016816 - DNA, 17 bp, Homo sapiens
tcctgcccctgagccca

SEQ ID NO: 5016817 - DNA, 20 bp, Homo sapiens
tcggatctggggctctggga

SEQ ID NO: 5016818 - DNA, 20 bp, Homo sapiens
tctaaatctatttattaata

SEQ ID NO: 5016819 - DNA, 21 bp, Homo sapiens
tctaaatctatttattaatat

SEQ ID NO: 5016820 - DNA, 22 bp, Homo sapiens
tctaatagaactcagttttaac

SEQ ID NO: 5016821 - DNA, 15 bp, Homo sapiens
tctaatatatatgaa

SEQ ID NO: 5016822 - DNA, 19 bp, Homo sapiens
tctaatatatatgaataaa

SEQ ID NO: 5016823 - DNA, 17 bp, Homo sapiens
tctacactccagtgaga

SEQ ID NO: 5016824 - DNA, 12 bp, Homo sapiens
tctactaaaaat

SEQ ID NO: 5016825 - DNA, 11 bp, Homo sapiens
tctagctgttg

SEQ ID NO: 5016826 - DNA, 19 bp, Homo sapiens
tctagctgttgagctgttt

SEQ ID NO: 5016827 - DNA, 16 bp, Homo sapiens
tctatagactctagga

SEQ ID NO: 5016828 - DNA, 16 bp, Homo sapiens
tctattaatatatgta

SEQ ID NO: 5016829 - DNA, 21 bp, Homo sapiens
tctattaatatatgtattatt

SEQ ID NO: 5016830 - DNA, 11 bp, Homo sapiens
tctcagtgtcc

SEQ ID NO: 5016831 - DNA, 17 bp, Homo sapiens
tctcttatagaatattt

SEQ ID NO: 5016832 - DNA, 18 bp, Homo sapiens
tctcttcacagtcacatt

SEQ ID NO: 5016833 - DNA, 18 bp, Homo sapiens
tctgcagataaacagtag

SEQ ID NO: 5016834 - DNA, 21 bp, Homo sapiens
tctgggcttggggcttcctaa

SEQ ID NO: 5016835 - DNA, 17 bp, Homo sapiens
tctgggtctcagtgtcc

SEQ ID NO: 5016836 - DNA, 21 bp, Homo sapiens
tctgtctcaaaaaataaaaat

SEQ ID NO: 5016837 - DNA, 19 bp, Homo sapiens
tcttatagaatatttatta

SEQ ID NO: 5016838 - DNA, 16 bp, Homo sapiens
tcttcttggtctcagt

SEQ ID NO: 5016839 - DNA, 19 bp, Homo sapiens
tgaaaactttatgctaagt

SEQ ID NO: 5016840 - DNA, 19 bp, Homo sapiens
tgaaaatgaatatctatta

SEQ ID NO: 5016841 - DNA, 21 bp, Homo sapiens
tgaaaatgaatatctattaat

SEQ ID NO: 5016842 - DNA, 23 bp, Homo sapiens
tgaaaatgaatatctattaatat

SEQ ID NO: 5016843 - DNA, 18 bp, Homo sapiens
tgaaataagccagacatc

SEQ ID NO: 5016844 - DNA, 13 bp, Homo sapiens
tgaacaaatttac

SEQ ID NO: 5016845 - DNA, 18 bp, Homo sapiens
tgaacaaatttacagaga

SEQ ID NO: 5016846 - DNA, 20 bp, Homo sapiens
tgaacaaatttacagagaca

SEQ ID NO: 5016847 - DNA, 13 bp, Homo sapiens
tgaacacttataa

SEQ ID NO: 5016848 - DNA, 17 bp, Homo sapiens
tgaagatgtagaggaga

SEQ ID NO: 5016849 - DNA, 18 bp, Homo sapiens
tgaagatgtagaggagaa

SEQ ID NO: 5016850 - DNA, 18 bp, Homo sapiens
tgaatatctattaatata

SEQ ID NO: 5016851 - DNA, 12 bp, Homo sapiens
tgacaactgtga

SEQ ID NO: 5016852 - DNA, 14 bp, Homo sapiens
tgacaactgtgact

SEQ ID NO: 5016853 - DNA, 15 bp, Homo sapiens
tgacacttaaaaatg

SEQ ID NO: 5016854 - DNA, 18 bp, Homo sapiens
tgacagagcaagactctg

SEQ ID NO: 5016855 - DNA, 16 bp, Homo sapiens
tgaccactgcagaaga

SEQ ID NO: 5016856 - DNA, 19 bp, Homo sapiens
tgacccagccccttgagaa

SEQ ID NO: 5016857 - DNA, 23 bp, Homo sapiens
tgacccagccccttgagaaacct

SEQ ID NO: 5016858 - DNA, 16 bp, Homo sapiens
tgacctgacagcccaa

SEQ ID NO: 5016859 - DNA, 12 bp, Homo sapiens
tgagacagctct

SEQ ID NO: 5016860 - DNA, 23 bp, Homo sapiens
tgagcacctgcaggcgtgacctg

SEQ ID NO: 5016861 - DNA, 16 bp, Homo sapiens
tgagcttctctgtgaa

SEQ ID NO: 5016862 - DNA, 22 bp, Homo sapiens
tgaggacttgggcgggacacag

SEQ ID NO: 5016863 - DNA, 14 bp, Homo sapiens
tgaggcaagagaat

SEQ ID NO: 5016864 - DNA, 17 bp, Homo sapiens
tgaggtactgagagtga

SEQ ID NO: 5016865 - DNA, 16 bp, Homo sapiens
tgatacaatgaacact

SEQ ID NO: 5016866 - DNA, 17 bp, Homo sapiens
tgatgatacaatgaaca

SEQ ID NO: 5016867 - DNA, 15 bp, Homo sapiens
tgcagaagacagtat

SEQ ID NO: 5016868 - DNA, 19 bp, Homo sapiens
tgcagtgagccgagattgt

SEQ ID NO: 5016869 - DNA, 13 bp, Homo sapiens
tgcatactcatta

SEQ ID NO: 5016870 - DNA, 23 bp, Homo sapiens
tgccaatatcctaataaaaaggt

SEQ ID NO: 5016871 - DNA, 15 bp, Homo sapiens
tgctgccaatatcct

SEQ ID NO: 5016872 - DNA, 17 bp, Homo sapiens
tgctgccaatatcctaa

SEQ ID NO: 5016873 - DNA, 18 bp, Homo sapiens
tgctgccaatatcctaat

SEQ ID NO: 5016874 - DNA, 21 bp, Homo sapiens
tgctgccaatatcctaataaa

SEQ ID NO: 5016875 - DNA, 22 bp, Homo sapiens
tgctgccaatatcctaataaaa

SEQ ID NO: 5016876 - DNA, 23 bp, Homo sapiens
tgctgccaatatcctaataaaaa

SEQ ID NO: 5016877 - DNA, 20 bp, Homo sapiens
tgctgggggggattgtaaaa

SEQ ID NO: 5016878 - DNA, 18 bp, Homo sapiens
tgcttggcccaggagttt

SEQ ID NO: 5016879 - DNA, 19 bp, Homo sapiens
tggaaagtaactcatttgt

SEQ ID NO: 5016880 - DNA, 12 bp, Homo sapiens
tggagacaccac

SEQ ID NO: 5016881 - DNA, 16 bp, Homo sapiens
tggagcttgaaatagt

SEQ ID NO: 5016882 - DNA, 22 bp, Homo sapiens
tggcccaggagtttggccagaa

SEQ ID NO: 5016883 - DNA, 11 bp, Homo sapiens
tgggaggctga

SEQ ID NO: 5016884 - DNA, 13 bp, Homo sapiens
tggggctctggga

SEQ ID NO: 5016885 - DNA, 17 bp, Homo sapiens
tgggtgacagagcaaga

SEQ ID NO: 5016886 - DNA, 23 bp, Homo sapiens
tggtgtgaccactgcagaagaca

SEQ ID NO: 5016887 - DNA, 14 bp, Homo sapiens
tgtaatcacagcta

SEQ ID NO: 5016888 - DNA, 16 bp, Homo sapiens
tgtaatcccagctact

SEQ ID NO: 5016889 - DNA, 22 bp, Homo sapiens
tgtaatcccagctacttgggag

SEQ ID NO: 5016890 - DNA, 15 bp, Homo sapiens
tgtaccgcaatgtga

SEQ ID NO: 5016891 - DNA, 16 bp, Homo sapiens
tgtagaggagaaactg

SEQ ID NO: 5016892 - DNA, 15 bp, Homo sapiens
tgtattatttataat

SEQ ID NO: 5016893 - DNA, 22 bp, Homo sapiens
tgtctcagtccatgaagatgta

SEQ ID NO: 5016894 - DNA, 21 bp, Homo sapiens
tgtgaacgatttagaaagaag

SEQ ID NO: 5016895 - DNA, 22 bp, Homo sapiens
tgtgaccactgcagaagacagt

SEQ ID NO: 5016896 - DNA, 14 bp, Homo sapiens
tgtgtttatttcac

SEQ ID NO: 5016897 - DNA, 14 bp, Homo sapiens
tgtttttaagctgt

SEQ ID NO: 5016898 - DNA, 22 bp, Homo sapiens
ttaaaaaaaaacctgagcccca

SEQ ID NO: 5016899 - DNA, 20 bp, Homo sapiens
ttaaaaatggtttaaatggt

SEQ ID NO: 5016900 - DNA, 14 bp, Homo sapiens
ttaacacagtgtct

SEQ ID NO: 5016901 - DNA, 15 bp, Homo sapiens
ttaactagaatttat

SEQ ID NO: 5016902 - DNA, 15 bp, Homo sapiens
ttaatatatgtatta

SEQ ID NO: 5016903 - DNA, 22 bp, Homo sapiens
ttaatcctttgttttctgacta

SEQ ID NO: 5016904 - DNA, 23 bp, Homo sapiens
ttaatcctttgttttctgactaa

SEQ ID NO: 5016905 - DNA, 13 bp, Homo sapiens
ttactgagcttct

SEQ ID NO: 5016906 - DNA, 19 bp, Homo sapiens
ttactgagcttctctgtga

SEQ ID NO: 5016907 - DNA, 19 bp, Homo sapiens
ttactgccggtttgaaaat

SEQ ID NO: 5016908 - DNA, 15 bp, Homo sapiens
ttaggaagagaaacc

SEQ ID NO: 5016909 - DNA, 17 bp, Homo sapiens
ttataagtgaagtgata

SEQ ID NO: 5016910 - DNA, 11 bp, Homo sapiens
ttataatagca

SEQ ID NO: 5016911 - DNA, 15 bp, Homo sapiens
ttatagaatatttat

SEQ ID NO: 5016912 - DNA, 23 bp, Homo sapiens
ttatagaatatttattacctctg

SEQ ID NO: 5016913 - DNA, 17 bp, Homo sapiens
ttatcaatatctaatat

SEQ ID NO: 5016914 - DNA, 18 bp, Homo sapiens
ttattaatatttaacatt

SEQ ID NO: 5016915 - DNA, 18 bp, Homo sapiens
ttattcaattcctctggg

SEQ ID NO: 5016916 - DNA, 15 bp, Homo sapiens
ttattgtacctctct

SEQ ID NO: 5016917 - DNA, 23 bp, Homo sapiens
ttatttgagacagggaaagggtc

SEQ ID NO: 5016918 - DNA, 14 bp, Homo sapiens
ttattttcacctgt

SEQ ID NO: 5016919 - DNA, 11 bp, Homo sapiens
ttcaatattta

SEQ ID NO: 5016920 - DNA, 23 bp, Homo sapiens
ttcacaagacccaaaaggcagaa

SEQ ID NO: 5016921 - DNA, 23 bp, Homo sapiens
ttcacctgtttttaagctgtttc

SEQ ID NO: 5016922 - DNA, 21 bp, Homo sapiens
ttcacttgatgatacaatgaa

SEQ ID NO: 5016923 - DNA, 19 bp, Homo sapiens
ttcccctaacctcattccc

SEQ ID NO: 5016924 - DNA, 23 bp, Homo sapiens
ttctaagaagtgaaaatctacac

SEQ ID NO: 5016925 - DNA, 14 bp, Homo sapiens
ttctaatagaactc

SEQ ID NO: 5016926 - DNA, 18 bp, Homo sapiens
ttctaatagaactcagtt

SEQ ID NO: 5016927 - DNA, 20 bp, Homo sapiens
ttctagctgttgagctgttt

SEQ ID NO: 5016928 - DNA, 14 bp, Homo sapiens
ttcttgaaagctgt

SEQ ID NO: 5016929 - DNA, 19 bp, Homo sapiens
ttgaacccgggaggcagag

SEQ ID NO: 5016930 - DNA, 14 bp, Homo sapiens
ttgacccacaagaa

SEQ ID NO: 5016931 - DNA, 17 bp, Homo sapiens
ttgacccacaagaaatg

SEQ ID NO: 5016932 - DNA, 22 bp, Homo sapiens
ttggcccaggagtttggccaga

SEQ ID NO: 5016933 - DNA, 12 bp, Homo sapiens
ttgggaggctga

SEQ ID NO: 5016934 - DNA, 12 bp, Homo sapiens
ttgtctctgggc

SEQ ID NO: 5016935 - DNA, 12 bp, Homo sapiens
ttgtgcccctgc

SEQ ID NO: 5016936 - DNA, 23 bp, Homo sapiens
ttgtgtaatgaaaatgaatatct

SEQ ID NO: 5016937 - DNA, 24 bp, Homo sapiens
ttgtgtaatgaaaatgaatatcta

SEQ ID NO: 5016938 - DNA, 19 bp, Homo sapiens
tttaaatctaaatctattt

SEQ ID NO: 5016939 - DNA, 15 bp, Homo sapiens
tttaagataaattat

SEQ ID NO: 5016940 - DNA, 18 bp, Homo sapiens
tttaagctgtttccatag

SEQ ID NO: 5016941 - DNA, 13 bp, Homo sapiens
tttacagagacag

SEQ ID NO: 5016942 - DNA, 17 bp, Homo sapiens
tttactgagcttctctg

SEQ ID NO: 5016943 - DNA, 22 bp, Homo sapiens
tttagactcatcaatcaaataa

SEQ ID NO: 5016944 - DNA, 14 bp, Homo sapiens
tttattacctctga

SEQ ID NO: 5016945 - DNA, 13 bp, Homo sapiens
tttccctgacctc

SEQ ID NO: 5016946 - DNA, 21 bp, Homo sapiens
tttctagctgttgagctgttt

SEQ ID NO: 5016947 - DNA, 14 bp, Homo sapiens
tttgagtgttttaa

SEQ ID NO: 5016948 - DNA, 16 bp, Homo sapiens
tttgtgtaatgaaaat

SEQ ID NO: 5016949 - DNA, 14 bp, Homo sapiens
ttttaaatctaaat

SEQ ID NO: 5016950 - DNA, 18 bp, Homo sapiens
ttttaaatctaaatctat

SEQ ID NO: 5016951 - DNA, 21 bp, Homo sapiens
ttttaaatctaaatctattta

SEQ ID NO: 5016952 - DNA, 22 bp, Homo sapiens
ttttaagataaattataagtta

SEQ ID NO: 5016953 - DNA, 16 bp, Homo sapiens
ttttcaatatttatta

SEQ ID NO: 5016954 - DNA, 23 bp, Homo sapiens
ttttcacctgtttttaagctgtt

SEQ ID NO: 5016955 - DNA, 13 bp, Homo sapiens
ttttctgactaat

SEQ ID NO: 5016956 - DNA, 18 bp, Homo sapiens
tttttaagctgtttccat

SEQ ID NO: 5016957 - DNA, 18 bp, Homo sapiens
ttttttcaatatttatta

SEQ ID NO: 5016958 - DNA, 19 bp, Homo sapiens
atttatcttgtctctgggc

SEQ ID NO: 5016959 - DNA, 15 bp, Homo sapiens
atttattacctctga

SEQ ID NO: 5016960 - DNA, 12 bp, Homo sapiens
atttctatttat

SEQ ID NO: 5016961 - DNA, 17 bp, Homo sapiens
atttctatttatttact

SEQ ID NO: 5016962 - DNA, 19 bp, Homo sapiens
atttgagtgttttaagata

SEQ ID NO: 5016963 - DNA, 15 bp, Homo sapiens
atttggttctaatag

SEQ ID NO: 5016964 - DNA, 17 bp, Homo sapiens
caaaaattagccgggca

SEQ ID NO: 5016965 - DNA, 22 bp, Homo sapiens
caaatattgttgacaactgtga

SEQ ID NO: 5016966 - DNA, 23 bp, Homo sapiens
caaatattgttgacaactgtgac

SEQ ID NO: 5016967 - DNA, 18 bp, Homo sapiens
caaatgttcatcaatgaa

SEQ ID NO: 5016968 - DNA, 20 bp, Homo sapiens
caaatgttcatcaatgaatg

SEQ ID NO: 5016969 - DNA, 13 bp, Homo sapiens
caagaaatgaaag

SEQ ID NO: 5016970 - DNA, 19 bp, Homo sapiens
caaggcttagaccctcatg

SEQ ID NO: 5016971 - DNA, 22 bp, Homo sapiens
caaggcttagaccctcatgctg

SEQ ID NO: 5016972 - DNA, 14 bp, Homo sapiens
caatatcctaataa

SEQ ID NO: 5016973 - DNA, 21 bp, Homo sapiens
caatatcctaataaaaaggtg

SEQ ID NO: 5016974 - DNA, 22 bp, Homo sapiens
caatatcctaataaaaaggtga

SEQ ID NO: 5016975 - DNA, 14 bp, Homo sapiens
caatatttattatt

SEQ ID NO: 5016976 - DNA, 17 bp, Homo sapiens
caatcaaataagtattt

SEQ ID NO: 5016977 - DNA, 18 bp, Homo sapiens
caatgaacacttataagt

SEQ ID NO: 5016978 - DNA, 20 bp, Homo sapiens
cacaagaaatgaaagcaggg

SEQ ID NO: 5016979 - DNA, 23 bp, Homo sapiens
cacaagacccaaaaggcagaagc

SEQ ID NO: 5016980 - DNA, 21 bp, Homo sapiens
cacctacatgaggtactgaga

SEQ ID NO: 5016981 - DNA, 14 bp, Homo sapiens
cacgctttctagct

SEQ ID NO: 5016982 - DNA, 21 bp, Homo sapiens
cactaaattgacacttaaaaa

SEQ ID NO: 5016983 - DNA, 23 bp, Homo sapiens
cactccagcctgagcgacagtga

SEQ ID NO: 5016984 - DNA, 23 bp, Homo sapiens
cacttgaacccgggaggcagagg

SEQ ID NO: 5016985 - DNA, 18 bp, Homo sapiens
cagaaagcagaacagtga

SEQ ID NO: 5016986 - DNA, 12 bp, Homo sapiens
cagaacagtgat

SEQ ID NO: 5016987 - DNA, 15 bp, Homo sapiens
cagaacttgaatgtg

SEQ ID NO: 5016988 - DNA, 20 bp, Homo sapiens
cagacagaacttgaatgtgt

SEQ ID NO: 5016989 - DNA, 17 bp, Homo sapiens
cagacatagaattaaca

SEQ ID NO: 5016990 - DNA, 19 bp, Homo sapiens
cagccccgtggggttcctc

SEQ ID NO: 5016991 - DNA, 18 bp, Homo sapiens
cagcctgagcgacagtga

SEQ ID NO: 5016992 - DNA, 19 bp, Homo sapiens
cagcctgagcgacagtgag

SEQ ID NO: 5016993 - DNA, 23 bp, Homo sapiens
cagctttcctcaaaacttcagac

SEQ ID NO: 5016994 - DNA, 20 bp, Homo sapiens
caggagatggaagttgcagt

SEQ ID NO: 5016995 - DNA, 13 bp, Homo sapiens
caggagtttggcc

SEQ ID NO: 5016996 - DNA, 16 bp, Homo sapiens
caggagtttggccaga

SEQ ID NO: 5016997 - DNA, 16 bp, Homo sapiens
caggcgtgacctgaca

SEQ ID NO: 5016998 - DNA, 15 bp, Homo sapiens
cagtcacattccaag

SEQ ID NO: 5016999 - DNA, 14 bp, Homo sapiens
cagtgcttggccca

SEQ ID NO: 5017000 - DNA, 16 bp, Homo sapiens
cagtgctttaatggca

SEQ ID NO: 5017001 - DNA, 14 bp, Homo sapiens
cagtgtctcggagg

SEQ ID NO: 5017002 - DNA, 19 bp, Homo sapiens
cagttcctgagaccagcca

SEQ ID NO: 5017003 - DNA, 16 bp, Homo sapiens
catagcagattttaat

SEQ ID NO: 5017004 - DNA, 17 bp, Homo sapiens
catagcagattttaatt

SEQ ID NO: 5017005 - DNA, 19 bp, Homo sapiens
catagcagcttattcacaa

SEQ ID NO: 5017006 - DNA, 18 bp, Homo sapiens
catctcaggagatttcat

SEQ ID NO: 5017007 - DNA, 18 bp, Homo sapiens
catgaagatgtagaggag

SEQ ID NO: 5017008 - DNA, 16 bp, Homo sapiens
catgaggtactgagag

SEQ ID NO: 5017009 - DNA, 19 bp, Homo sapiens
catgctgccaatatcctaa

SEQ ID NO: 5017010 - DNA, 22 bp, Homo sapiens
catgctgccaatatcctaataa

SEQ ID NO: 5017011 - DNA, 17 bp, Homo sapiens
cattcttgaaagctgtg

SEQ ID NO: 5017012 - DNA, 15 bp, Homo sapiens
catttgttaaaatta

SEQ ID NO: 5017013 - DNA, 14 bp, Homo sapiens
ccaaactggagctt

SEQ ID NO: 5017014 - DNA, 18 bp, Homo sapiens
ccaaatgttcatcaatga

SEQ ID NO: 5017015 - DNA, 13 bp, Homo sapiens
ccaagcctgacca

SEQ ID NO: 5017016 - DNA, 15 bp, Homo sapiens
ccaatatcctaataa

SEQ ID NO: 5017017 - DNA, 16 bp, Homo sapiens
ccaatatcctaataaa

SEQ ID NO: 5017018 - DNA, 17 bp, Homo sapiens
ccaatatcctaataaaa

SEQ ID NO: 5017019 - DNA, 12 bp, Homo sapiens
ccaatattataa

SEQ ID NO: 5017020 - DNA, 20 bp, Homo sapiens
ccaatattcatagcagctta

SEQ ID NO: 5017021 - DNA, 22 bp, Homo sapiens
ccacaagaaatgaaagcaggga

SEQ ID NO: 5017022 - DNA, 13 bp, Homo sapiens
ccactgcagaaga

SEQ ID NO: 5017023 - DNA, 15 bp, Homo sapiens
ccactggttcttctt

SEQ ID NO: 5017024 - DNA, 21 bp, Homo sapiens
ccacttcattcttgaaagctg

SEQ ID NO: 5017025 - DNA, 23 bp, Homo sapiens
ccacttcattcttgaaagctgtg

SEQ ID NO: 5017026 - DNA, 16 bp, Homo sapiens
ccaggagtttggccag

SEQ ID NO: 5017027 - DNA, 22 bp, Homo sapiens
ccattgtggtcacaggaagtag

SEQ ID NO: 5017028 - DNA, 14 bp, Homo sapiens
ccatttctatttat

SEQ ID NO: 5017029 - DNA, 13 bp, Homo sapiens
cccaaaaggcaga

SEQ ID NO: 5017030 - DNA, 18 bp, Homo sapiens
cccaggagtttggccaga

SEQ ID NO: 5017031 - DNA, 19 bp, Homo sapiens
cccaggagtttggccagaa

SEQ ID NO: 5017032 - DNA, 14 bp, Homo sapiens
ccccgtctctacta

SEQ ID NO: 5017033 - DNA, 15 bp, Homo sapiens
cctaacgaagtatcc

SEQ ID NO: 5017034 - DNA, 20 bp, Homo sapiens
cctaacgaagtatccttcag

SEQ ID NO: 5017035 - DNA, 14 bp, Homo sapiens
cctaataaaaaggt

SEQ ID NO: 5017036 - DNA, 16 bp, Homo sapiens
cctatatcctgtgact

SEQ ID NO: 5017037 - DNA, 15 bp, Homo sapiens
cctcatgtccactgg

SEQ ID NO: 5017038 - DNA, 16 bp, Homo sapiens
cctcccttctcttcac

SEQ ID NO: 5017039 - DNA, 20 bp, Homo sapiens
cctctcttatagaatattta

SEQ ID NO: 5017040 - DNA, 14 bp, Homo sapiens
cctctgatacctca

SEQ ID NO: 5017041 - DNA, 14 bp, Homo sapiens
cctctgggtctcag

SEQ ID NO: 5017042 - DNA, 18 bp, Homo sapiens
cctgaaagaggaatgaag

SEQ ID NO: 5017043 - DNA, 22 bp, Homo sapiens
cctgagaccagccaacctgggg

SEQ ID NO: 5017044 - DNA, 11 bp, Homo sapiens
cctgagcccca

SEQ ID NO: 5017045 - DNA, 13 bp, Homo sapiens
cctgcaatatttg

SEQ ID NO: 5017046 - DNA, 17 bp, Homo sapiens
cctgctggatgtggagg

SEQ ID NO: 5017047 - DNA, 15 bp, Homo sapiens
cctggtgcttccaaa

SEQ ID NO: 5017048 - DNA, 17 bp, Homo sapiens
cctgtctctactaaaaa

SEQ ID NO: 5017049 - DNA, 17 bp, Homo sapiens
cctgtttttaagctgtt

SEQ ID NO: 5017050 - DNA, 15 bp, Homo sapiens
ccttattgtacctct

SEQ ID NO: 5017051 - DNA, 20 bp, Homo sapiens
ccttgaaaactttatgctaa

SEQ ID NO: 5017052 - DNA, 20 bp, Homo sapiens
cgactctatagactctagga

SEQ ID NO: 5017053 - DNA, 11 bp, Homo sapiens
cgcaatgtgac

SEQ ID NO: 5017054 - DNA, 20 bp, Homo sapiens
cgggaggcagaggttgcagt

SEQ ID NO: 5017055 - DNA, 20 bp, Homo sapiens
cggtggctcacgcctgtaat

SEQ ID NO: 5017056 - DNA, 21 bp, Homo sapiens
ctaaatctatttattaatatt

SEQ ID NO: 5017057 - DNA, 20 bp, Homo sapiens
ctaactgctacaaatactct

SEQ ID NO: 5017058 - DNA, 14 bp, Homo sapiens
ctaagcaaaatgtg

SEQ ID NO: 5017059 - DNA, 11 bp, Homo sapiens
ctaataaaaag

SEQ ID NO: 5017060 - DNA, 13 bp, Homo sapiens
ctaataaaaaggt

SEQ ID NO: 5017061 - DNA, 14 bp, Homo sapiens
ctaataaaaaggtg

SEQ ID NO: 5017062 - DNA, 15 bp, Homo sapiens
ctaataaaaaggtga

SEQ ID NO: 5017063 - DNA, 19 bp, Homo sapiens
ctaataaaaaggtgaccat

SEQ ID NO: 5017064 - DNA, 17 bp, Homo sapiens
ctacactccagtgagac

SEQ ID NO: 5017065 - DNA, 20 bp, Homo sapiens
ctacatgaggtactgagagt

SEQ ID NO: 5017066 - DNA, 18 bp, Homo sapiens
ctacttgggaggctgaga

SEQ ID NO: 5017067 - DNA, 15 bp, Homo sapiens
ctagaatttattcaa

SEQ ID NO: 5017068 - DNA, 23 bp, Homo sapiens
ctagaatttattcaattcctctg

SEQ ID NO: 5017069 - DNA, 18 bp, Homo sapiens
ctagctgttgagctgttt

SEQ ID NO: 5017070 - DNA, 12 bp, Homo sapiens
ctaggccgggcg

SEQ ID NO: 5017071 - DNA, 23 bp, Homo sapiens
ctagtatcaaaagaaagaaaatc

SEQ ID NO: 5017072 - DNA, 12 bp, Homo sapiens
ctatagactcta

SEQ ID NO: 5017073 - DNA, 11 bp, Homo sapiens
ctattaatata

SEQ ID NO: 5017074 - DNA, 12 bp, Homo sapiens
ctattaatatat

SEQ ID NO: 5017075 - DNA, 14 bp, Homo sapiens
ctattaatatatgt

SEQ ID NO: 5017076 - DNA, 14 bp, Homo sapiens
ctatttattaatat

SEQ ID NO: 5017077 - DNA, 19 bp, Homo sapiens
ctcaacccccatttctatt

SEQ ID NO: 5017078 - DNA, 17 bp, Homo sapiens
ctcatcaatcaaataag

SEQ ID NO: 5017079 - DNA, 21 bp, Homo sapiens
ctcatcaatcaaataagtatt

SEQ ID NO: 5017080 - DNA, 14 bp, Homo sapiens
ctcatgctgccaat

SEQ ID NO: 5017081 - DNA, 17 bp, Homo sapiens
ctcattaggatggctag

SEQ ID NO: 5017082 - DNA, 20 bp, Homo sapiens
tctcttatagaatatttatt

SEQ ID NO: 5017083 - DNA, 21 bp, Homo sapiens
tctcttatagaatatttatta

SEQ ID NO: 5017084 - DNA, 15 bp, Homo sapiens
tctgactaattaggc

SEQ ID NO: 5017085 - DNA, 15 bp, Homo sapiens
tctggggctctggga

SEQ ID NO: 5017086 - DNA, 16 bp, Homo sapiens
tctggggctctgggat

SEQ ID NO: 5017087 - DNA, 14 bp, Homo sapiens
tctgtctcagtcca

SEQ ID NO: 5017088 - DNA, 17 bp, Homo sapiens
tctgtgaacgatttaga

SEQ ID NO: 5017089 - DNA, 15 bp, Homo sapiens
tcttaggaagagaaa

SEQ ID NO: 5017090 - DNA, 17 bp, Homo sapiens
tgaaagaggaatgaagt

SEQ ID NO: 5017091 - DNA, 18 bp, Homo sapiens
tgaaagaggaatgaagta

SEQ ID NO: 5017092 - DNA, 14 bp, Homo sapiens
tgaaataagccaga

SEQ ID NO: 5017093 - DNA, 22 bp, Homo sapiens
tgaacccatatttgtacaccaa

SEQ ID NO: 5017094 - DNA, 18 bp, Homo sapiens
tgaacccgggaggcagag

SEQ ID NO: 5017095 - DNA, 15 bp, Homo sapiens
tgaatgaatggctaa

SEQ ID NO: 5017096 - DNA, 23 bp, Homo sapiens
tgaattttaaatctaaatctatt

SEQ ID NO: 5017097 - DNA, 15 bp, Homo sapiens
tgacaactgtgactg

SEQ ID NO: 5017098 - DNA, 21 bp, Homo sapiens
tgaccacgctttctagctgtt

SEQ ID NO: 5017099 - DNA, 18 bp, Homo sapiens
tgaccactgcagaagaca

SEQ ID NO: 5017100 - DNA, 18 bp, Homo sapiens
tgacccagccccttgaga

SEQ ID NO: 5017101 - DNA, 20 bp, Homo sapiens
tgagactctgtctcagtcca

SEQ ID NO: 5017102 - DNA, 16 bp, Homo sapiens
tgagagtgaacaaatt

SEQ ID NO: 5017103 - DNA, 13 bp, Homo sapiens
tgagccccaaaag

SEQ ID NO: 5017104 - DNA, 13 bp, Homo sapiens
tgagcgacagtga

SEQ ID NO: 5017105 - DNA, 20 bp, Homo sapiens
tgagcgacagtgagactctg

SEQ ID NO: 5017106 - DNA, 15 bp, Homo sapiens
tgagcttctctgtga

SEQ ID NO: 5017107 - DNA, 23 bp, Homo sapiens
tgaggacttgggcgggacacagg

SEQ ID NO: 5017108 - DNA, 22 bp, Homo sapiens
tgaggtactgagagtgaacaaa

SEQ ID NO: 5017109 - DNA, 21 bp, Homo sapiens
tgatatcatgcccctgtactc

SEQ ID NO: 5017110 - DNA, 14 bp, Homo sapiens
tgattaccagggac

SEQ ID NO: 5017111 - DNA, 14 bp, Homo sapiens
tgcaatatttgaat

SEQ ID NO: 5017112 - DNA, 22 bp, Homo sapiens
tgcagaagacagtatggcagct

SEQ ID NO: 5017113 - DNA, 19 bp, Homo sapiens
tgcagataaacagtagtga

SEQ ID NO: 5017114 - DNA, 14 bp, Homo sapiens
tgcagtgagccgag

SEQ ID NO: 5017115 - DNA, 19 bp, Homo sapiens
tgcatactcattaggatgg

SEQ ID NO: 5017116 - DNA, 21 bp, Homo sapiens
tgccaatatcctaataaaaag

SEQ ID NO: 5017117 - DNA, 16 bp, Homo sapiens
tgccactaaattgaca

SEQ ID NO: 5017118 - DNA, 13 bp, Homo sapiens
tgccatgctggcc

SEQ ID NO: 5017119 - DNA, 17 bp, Homo sapiens
tgcttgaacccaggaga

SEQ ID NO: 5017120 - DNA, 12 bp, Homo sapiens
tgcttggcccag

SEQ ID NO: 5017121 - DNA, 15 bp, Homo sapiens
tgcttggcccaggag

SEQ ID NO: 5017122 - DNA, 16 bp, Homo sapiens
tgcttggcccaggagt

SEQ ID NO: 5017123 - DNA, 11 bp, Homo sapiens
tggcccaggag

SEQ ID NO: 5017124 - DNA, 21 bp, Homo sapiens
tggcccaggagtttggccaga

SEQ ID NO: 5017125 - DNA, 18 bp, Homo sapiens
tggctaagcaaaatgtga

SEQ ID NO: 5017126 - DNA, 16 bp, Homo sapiens
tggggagccaacagaa

SEQ ID NO: 5017127 - DNA, 22 bp, Homo sapiens
tggggcagtgcttggcccagga

SEQ ID NO: 5017128 - DNA, 15 bp, Homo sapiens
tgggtctcagtgtcc

SEQ ID NO: 5017129 - DNA, 22 bp, Homo sapiens
tggtcacaggaagtagaggagg

SEQ ID NO: 5017130 - DNA, 14 bp, Homo sapiens
tgtaagttcacaac

SEQ ID NO: 5017131 - DNA, 22 bp, Homo sapiens
tgtaatcccagcactttgggag

SEQ ID NO: 5017132 - DNA, 15 bp, Homo sapiens
tgtaatgaaaatgaa

SEQ ID NO: 5017133 - DNA, 18 bp, Homo sapiens
tgtaatgaaaatgaatat

SEQ ID NO: 5017134 - DNA, 18 bp, Homo sapiens
tgtagaggagaaactgga

SEQ ID NO: 5017135 - DNA, 22 bp, Homo sapiens
tgtcctgcctgcaatatttgaa

SEQ ID NO: 5017136 - DNA, 15 bp, Homo sapiens
tgtgtttatttcact

SEQ ID NO: 5017137 - DNA, 13 bp, Homo sapiens
tgttgagctgttt

SEQ ID NO: 5017138 - DNA, 17 bp, Homo sapiens
tgtttgtctgtcttcat

SEQ ID NO: 5017139 - DNA, 16 bp, Homo sapiens
tgttttccctgacctc

SEQ ID NO: 5017140 - DNA, 17 bp, Homo sapiens
tgtttttaagctgtttc

SEQ ID NO: 5017141 - DNA, 20 bp, Homo sapiens
tgtttttaagctgtttccat

SEQ ID NO: 5017142 - DNA, 20 bp, Homo sapiens
ttaaatctaaatctatttat

SEQ ID NO: 5017143 - DNA, 17 bp, Homo sapiens
ttaacacagtgtctggc

SEQ ID NO: 5017144 - DNA, 13 bp, Homo sapiens
ttaacattattta

SEQ ID NO: 5017145 - DNA, 19 bp, Homo sapiens
ttaatatatgtattattta

SEQ ID NO: 5017146 - DNA, 17 bp, Homo sapiens
ttaatatttaacattat

SEQ ID NO: 5017147 - DNA, 17 bp, Homo sapiens
ttacattgtttgtctgt

SEQ ID NO: 5017148 - DNA, 11 bp, Homo sapiens
ttacctctgat

SEQ ID NO: 5017149 - DNA, 17 bp, Homo sapiens
ttactagtttcccttgc

SEQ ID NO: 5017150 - DNA, 14 bp, Homo sapiens
ttactgagcttctc

SEQ ID NO: 5017151 - DNA, 16 bp, Homo sapiens
ttactgagcttctctg

SEQ ID NO: 5017152 - DNA, 17 bp, Homo sapiens
ttactgagcttctctgt

SEQ ID NO: 5017153 - DNA, 18 bp, Homo sapiens
ttactgagcttctctgtg

SEQ ID NO: 5017154 - DNA, 22 bp, Homo sapiens
ttatcaatatctaatatatatg

SEQ ID NO: 5017155 - DNA, 17 bp, Homo sapiens
ttatcttgtctctgggc

SEQ ID NO: 5017156 - DNA, 12 bp, Homo sapiens
ttattgtacctc

SEQ ID NO: 5017157 - DNA, 14 bp, Homo sapiens
ttattgtacctctc

SEQ ID NO: 5017158 - DNA, 22 bp, Homo sapiens
ttcacaagacccaaaaggcaga

SEQ ID NO: 5017159 - DNA, 16 bp, Homo sapiens
ttcagacatagaatta

SEQ ID NO: 5017160 - DNA, 20 bp, Homo sapiens
ttcagacatagaattaacac

SEQ ID NO: 5017161 - DNA, 15 bp, Homo sapiens
ttcatcaatgaatga

SEQ ID NO: 5017162 - DNA, 13 bp, Homo sapiens
ttcattcttgaaa

SEQ ID NO: 5017163 - DNA, 19 bp, Homo sapiens
ttcattcttgaaagctgtg

SEQ ID NO: 5017164 - DNA, 14 bp, Homo sapiens
ttcctatatcctgt

SEQ ID NO: 5017165 - DNA, 12 bp, Homo sapiens
ttcctctgggaa

SEQ ID NO: 5017166 - DNA, 21 bp, Homo sapiens
ttctagctgttgagctgtttt

SEQ ID NO: 5017167 - DNA, 15 bp, Homo sapiens
ttcttgaaagctgtg

SEQ ID NO: 5017168 - DNA, 12 bp, Homo sapiens
ttgaaagctgtg

SEQ ID NO: 5017169 - DNA, 15 bp, Homo sapiens
ttgaattttaaatct

SEQ ID NO: 5017170 - DNA, 14 bp, Homo sapiens
ttgacaactgtgac

SEQ ID NO: 5017171 - DNA, 17 bp, Homo sapiens
ttgacacttaaaaatgg

SEQ ID NO: 5017172 - DNA, 22 bp, Homo sapiens
ttgagaaaccttattgtacctc

SEQ ID NO: 5017173 - DNA, 13 bp, Homo sapiens
ttggcccaggagt

SEQ ID NO: 5017174 - DNA, 13 bp, Homo sapiens
ttgtaaaatggtg

SEQ ID NO: 5017175 - DNA, 18 bp, Homo sapiens
ttgtgtgtttatttcact

SEQ ID NO: 5017176 - DNA, 14 bp, Homo sapiens
ttgttatttataac

SEQ ID NO: 5017177 - DNA, 17 bp, Homo sapiens
ttgttttctgactaatt

SEQ ID NO: 5017178 - DNA, 12 bp, Homo sapiens
tttaacattatt

SEQ ID NO: 5017179 - DNA, 15 bp, Homo sapiens
tttaactagaattta

SEQ ID NO: 5017180 - DNA, 13 bp, Homo sapiens
tttaataaaccat

SEQ ID NO: 5017181 - DNA, 13 bp, Homo sapiens
tttattacctctg

SEQ ID NO: 5017182 - DNA, 17 bp, Homo sapiens
tttattattttcacctg

SEQ ID NO: 5017183 - DNA, 11 bp, Homo sapiens
tttatttcact

SEQ ID NO: 5017184 - DNA, 20 bp, Homo sapiens
tttgctggagctctgcccat

SEQ ID NO: 5017185 - DNA, 10 bp, Homo sapiens
tttggccaga

SEQ ID NO: 5017186 - DNA, 14 bp, Homo sapiens
tttggccagaagtc

SEQ ID NO: 5017187 - DNA, 13 bp, Homo sapiens
tttggttctaata

SEQ ID NO: 5017188 - DNA, 12 bp, Homo sapiens
ttttaactagaa

SEQ ID NO: 5017189 - DNA, 12 bp, Homo sapiens
ttttaagctgtt

SEQ ID NO: 5017190 - DNA, 20 bp, Homo sapiens
ttttatatcaatttaaaaaa

SEQ ID NO: 5017191 - DNA, 17 bp, Homo sapiens
ttttgtgtaatgaaaat

SEQ ID NO: 5017192 - DNA, 16 bp, Homo sapiens
aacagaagcttccatt

SEQ ID NO: 5017193 - DNA, 15 bp, Homo sapiens
aacagtgattaccag

SEQ ID NO: 5017194 - DNA, 13 bp, Homo sapiens
aacccaaatgttc

SEQ ID NO: 5017195 - DNA, 16 bp, Homo sapiens
aacccgggaggcagag

SEQ ID NO: 5017196 - DNA, 15 bp, Homo sapiens
aaccttattgtacct

SEQ ID NO: 5017197 - DNA, 16 bp, Homo sapiens
aaccttattgtacctc

SEQ ID NO: 5017198 - DNA, 13 bp, Homo sapiens
aacgatttagaaa

SEQ ID NO: 5017199 - DNA, 17 bp, Homo sapiens
aactagaatttattcaa

SEQ ID NO: 5017200 - DNA, 18 bp, Homo sapiens
aactcagttttaactaga

SEQ ID NO: 5017201 - DNA, 20 bp, Homo sapiens
aactttatgctaagtgaaat

SEQ ID NO: 5017202 - DNA, 22 bp, Homo sapiens
aagaagtgaaaatctacactcc

SEQ ID NO: 5017203 - DNA, 13 bp, Homo sapiens
aagacccaaaagg

SEQ ID NO: 5017204 - DNA, 18 bp, Homo sapiens
aagcccaatattataatt

SEQ ID NO: 5017205 - DNA, 13 bp, Homo sapiens
aagctgtggccag

SEQ ID NO: 5017206 - DNA, 23 bp, Homo sapiens
aagctgtttccatagggtgacac

SEQ ID NO: 5017207 - DNA, 12 bp, Homo sapiens
aagtaactcatt

SEQ ID NO: 5017208 - DNA, 14 bp, Homo sapiens
aagtaactcatttg

SEQ ID NO: 5017209 - DNA, 12 bp, Homo sapiens
aagtatttataa

SEQ ID NO: 5017210 - DNA, 13 bp, Homo sapiens
aagtcaaggctta

SEQ ID NO: 5017211 - DNA, 22 bp, Homo sapiens
aagtcaaggcttagaccctcat

SEQ ID NO: 5017212 - DNA, 18 bp, Homo sapiens
aagtgtaagttcacaact

SEQ ID NO: 5017213 - DNA, 22 bp, Homo sapiens
aagttgcagtgagctgatatca

SEQ ID NO: 5017214 - DNA, 16 bp, Homo sapiens
aataaaaaggtgacca

SEQ ID NO: 5017215 - DNA, 16 bp, Homo sapiens
aataaaaataaatttg

SEQ ID NO: 5017216 - DNA, 10 bp, Homo sapiens
aataaaccat

SEQ ID NO: 5017217 - DNA, 18 bp, Homo sapiens
aataaatttggttctaat

SEQ ID NO: 5017218 - DNA, 20 bp, Homo sapiens
aatacaaaaattagccgggc

SEQ ID NO: 5017219 - DNA, 21 bp, Homo sapiens
aatatatgtattatttataat

SEQ ID NO: 5017220 - DNA, 15 bp, Homo sapiens
aatatatttttagac

SEQ ID NO: 5017221 - DNA, 13 bp, Homo sapiens
aatatcctaataa

SEQ ID NO: 5017222 - DNA, 19 bp, Homo sapiens
aatatcctaataaaaaggt

SEQ ID NO: 5017223 - DNA, 15 bp, Homo sapiens
aatatctattaatat

SEQ ID NO: 5017224 - DNA, 16 bp, Homo sapiens
aatatctattaatata

SEQ ID NO: 5017225 - DNA, 23 bp, Homo sapiens
aatatgcctgcaatctgagccag

SEQ ID NO: 5017226 - DNA, 14 bp, Homo sapiens
aatatttattacct

SEQ ID NO: 5017227 - DNA, 12 bp, Homo sapiens
aatatttattat

SEQ ID NO: 5017228 - DNA, 15 bp, Homo sapiens
aatcaaataagtatt

SEQ ID NO: 5017229 - DNA, 19 bp, Homo sapiens
aatcaaataagtatttata

SEQ ID NO: 5017230 - DNA, 15 bp, Homo sapiens
aatctaaatctattt

SEQ ID NO: 5017231 - DNA, 16 bp, Homo sapiens
aatctaaatctattta

SEQ ID NO: 5017232 - DNA, 19 bp, Homo sapiens
aatctacactccagtgaga

SEQ ID NO: 5017233 - DNA, 17 bp, Homo sapiens
aatctatttattaatat

SEQ ID NO: 5017234 - DNA, 20 bp, Homo sapiens
aatctatttattaatattta

SEQ ID NO: 5017235 - DNA, 14 bp, Homo sapiens
aatgaatatctatt

SEQ ID NO: 5017236 - DNA, 18 bp, Homo sapiens
aatgaatatctattaata

SEQ ID NO: 5017237 - DNA, 20 bp, Homo sapiens
aatgaatatctattaatata

SEQ ID NO: 5017238 - DNA, 17 bp, Homo sapiens
aatgtatcttattcaca

SEQ ID NO: 5017239 - DNA, 18 bp, Homo sapiens
aatgtatcttattcacat

SEQ ID NO: 5017240 - DNA, 13 bp, Homo sapiens
aatgttcatcaat

SEQ ID NO: 5017241 - DNA, 16 bp, Homo sapiens
aatgttcatcaatgaa

SEQ ID NO: 5017242 - DNA, 13 bp, Homo sapiens
aattcctctggga

SEQ ID NO: 5017243 - DNA, 20 bp, Homo sapiens
aatttatcttgtctctgggc

SEQ ID NO: 5017244 - DNA, 16 bp, Homo sapiens
acaagaaatgaaagca

SEQ ID NO: 5017245 - DNA, 20 bp, Homo sapiens
acaagacccaaaaggcagaa

SEQ ID NO: 5017246 - DNA, 18 bp, Homo sapiens
acacaggctccaaactgg

SEQ ID NO: 5017247 - DNA, 11 bp, Homo sapiens
acacagtgtct

SEQ ID NO: 5017248 - DNA, 16 bp, Homo sapiens
acacagtgtctggcac

SEQ ID NO: 5017249 - DNA, 17 bp, Homo sapiens
acactatggtatttgag

SEQ ID NO: 5017250 - DNA, 14 bp, Homo sapiens
acacttataagtga

SEQ ID NO: 5017251 - DNA, 17 bp, Homo sapiens
acagaacttgaatgtgt

SEQ ID NO: 5017252 - DNA, 19 bp, Homo sapiens
acagtgattaccagggact

SEQ ID NO: 5017253 - DNA, 21 bp, Homo sapiens
acagtgattaccagggactga

SEQ ID NO: 5017254 - DNA, 19 bp, Homo sapiens
acatgatcctgcaattcca

SEQ ID NO: 5017255 - DNA, 14 bp, Homo sapiens
accactgcagaaga

SEQ ID NO: 5017256 - DNA, 20 bp, Homo sapiens
accagcctggtcaacatggt

SEQ ID NO: 5017257 - DNA, 21 bp, Homo sapiens
acccaaatgttcatcaatgaa

SEQ ID NO: 5017258 - DNA, 17 bp, Homo sapiens
acccacaagaaatgaaa

SEQ ID NO: 5017259 - DNA, 16 bp, Homo sapiens
acccagccccttgaga

SEQ ID NO: 5017260 - DNA, 20 bp, Homo sapiens
acccagccccttgagaaacc

SEQ ID NO: 5017261 - DNA, 15 bp, Homo sapiens
acccgggaggcagag

SEQ ID NO: 5017262 - DNA, 16 bp, Homo sapiens
accctcatgctgccaa

SEQ ID NO: 5017263 - DNA, 14 bp, Homo sapiens
accctgatgaaaac

SEQ ID NO: 5017264 - DNA, 21 bp, Homo sapiens
acctcaacccccatttctatt

SEQ ID NO: 5017265 - DNA, 22 bp, Homo sapiens
acctctcttatagaatatttat

SEQ ID NO: 5017266 - DNA, 23 bp, Homo sapiens
acctctcttatagaatatttatt

SEQ ID NO: 5017267 - DNA, 12 bp, Homo sapiens
acctgagcccca

SEQ ID NO: 5017268 - DNA, 17 bp, Homo sapiens
acctgagccccaaaagg

SEQ ID NO: 5017269 - DNA, 16 bp, Homo sapiens
acctgtttttaagctg

SEQ ID NO: 5017270 - DNA, 20 bp, Homo sapiens
acctgtttttaagctgtttc

SEQ ID NO: 5017271 - DNA, 20 bp, Homo sapiens
accttattgtacctctctta

SEQ ID NO: 5017272 - DNA, 22 bp, Homo sapiens
accttattgtacctctcttata

SEQ ID NO: 5017273 - DNA, 18 bp, Homo sapiens
acgatttagaaagaagcc

SEQ ID NO: 5017274 - DNA, 20 bp, Homo sapiens
acgcctgtaatcccagcact

SEQ ID NO: 5017275 - DNA, 13 bp, Homo sapiens
actaaaaatacaa

SEQ ID NO: 5017276 - DNA, 22 bp, Homo sapiens
actcagttttaactagaattta

SEQ ID NO: 5017277 - DNA, 15 bp, Homo sapiens
actctatagactcta

SEQ ID NO: 5017278 - DNA, 18 bp, Homo sapiens
actgagcttctctgtgaa

SEQ ID NO: 5017279 - DNA, 16 bp, Homo sapiens
actgtacccaaatgga

SEQ ID NO: 5017280 - DNA, 17 bp, Homo sapiens
actgtacccaaatggaa

SEQ ID NO: 5017281 - DNA, 14 bp, Homo sapiens
acttaaaaatggtt

SEQ ID NO: 5017282 - DNA, 22 bp, Homo sapiens
acttaaaaatggtttaaatggt

SEQ ID NO: 5017283 - DNA, 12 bp, Homo sapiens
acttcagacata

SEQ ID NO: 5017284 - DNA, 15 bp, Homo sapiens
acttcattcttgaaa

SEQ ID NO: 5017285 - DNA, 20 bp, Homo sapiens
agaaaccttattgtacctct

SEQ ID NO: 5017286 - DNA, 14 bp, Homo sapiens
agaaagaaaatcag

SEQ ID NO: 5017287 - DNA, 17 bp, Homo sapiens
agaaagcagaacagtga

SEQ ID NO: 5017288 - DNA, 14 bp, Homo sapiens
agaaatgaaagcag

SEQ ID NO: 5017289 - DNA, 21 bp, Homo sapiens
agaagcccaatattataattt

SEQ ID NO: 5017290 - DNA, 18 bp, Homo sapiens
agaagtcaaggcttagac

SEQ ID NO: 5017291 - DNA, 19 bp, Homo sapiens
agaagtcaaggcttagacc

SEQ ID NO: 5017292 - DNA, 21 bp, Homo sapiens
agaagtgaaaatctacactcc

SEQ ID NO: 5017293 - DNA, 11 bp, Homo sapiens
agaatatttat

SEQ ID NO: 5017294 - DNA, 22 bp, Homo sapiens
agaatatttattacctctgata

SEQ ID NO: 5017295 - DNA, 14 bp, Homo sapiens
agaatttattcaat

SEQ ID NO: 5017296 - DNA, 21 bp, Homo sapiens
agaatttattcaattcctctg

SEQ ID NO: 5017297 - DNA, 21 bp, Homo sapiens
agacatagaattaacacatga

SEQ ID NO: 5017298 - DNA, 18 bp, Homo sapiens
agaccctcatgctgccaa

SEQ ID NO: 5017299 - DNA, 19 bp, Homo sapiens
agaccctcatgctgccaat

SEQ ID NO: 5017300 - DNA, 21 bp, Homo sapiens
agaccctcatgctgccaatat

SEQ ID NO: 5017301 - DNA, 24 bp, Homo sapiens
agaccctcatgctgccaatatcct

SEQ ID NO: 5017302 - DNA, 21 bp, Homo sapiens
agactctaggacataaattag

SEQ ID NO: 5017303 - DNA, 24 bp, Homo sapiens
agagacagaaagcagaacagtgat

SEQ ID NO: 5017304 - DNA, 14 bp, Homo sapiens
agagcaagactctg

SEQ ID NO: 5017305 - DNA, 13 bp, Homo sapiens
agataaattataa

SEQ ID NO: 5017306 - DNA, 19 bp, Homo sapiens
agatgtagaggagaaactg

SEQ ID NO: 5017307 - DNA, 17 bp, Homo sapiens
agattttaattttgaat

SEQ ID NO: 5017308 - DNA, 21 bp, Homo sapiens
agattttaattttgaataaat

SEQ ID NO: 5017309 - DNA, 20 bp, Homo sapiens
agcaacttttgtgtaatgaa

SEQ ID NO: 5017310 - DNA, 18 bp, Homo sapiens
agcactttaacacagtgt

SEQ ID NO: 5017311 - DNA, 20 bp, Homo sapiens
agcactttaacacagtgtct

SEQ ID NO: 5017312 - DNA, 16 bp, Homo sapiens
agcactttgggaggct

SEQ ID NO: 5017313 - DNA, 14 bp, Homo sapiens
agcagaacagtgat

SEQ ID NO: 5017314 - DNA, 13 bp, Homo sapiens
agcagattttaat

SEQ ID NO: 5017315 - DNA, 16 bp, Homo sapiens
agccaacctaagcaag

SEQ ID NO: 5017316 - DNA, 23 bp, Homo sapiens
tttcacctgtttttaagctgttt

SEQ ID NO: 5017317 - DNA, 17 bp, Homo sapiens
tttgaattttaaatcta

SEQ ID NO: 5017318 - DNA, 12 bp, Homo sapiens
tttggccagaag

SEQ ID NO: 5017319 - DNA, 17 bp, Homo sapiens
tttgtctgtcttcatag

SEQ ID NO: 5017320 - DNA, 16 bp, Homo sapiens
ttttaactagaattta

SEQ ID NO: 5017321 - DNA, 16 bp, Homo sapiens
caaatttacagagaca

SEQ ID NO: 5017322 - DNA, 23 bp, Homo sapiens
caaatttacagagacagaaagca

SEQ ID NO: 5017323 - DNA, 23 bp, Homo sapiens
caactggggtgggtggggcagtg

SEQ ID NO: 5017324 - DNA, 12 bp, Homo sapiens
caactgtgactg

SEQ ID NO: 5017325 - DNA, 21 bp, Homo sapiens
caacttttgtgtaatgaaaat

SEQ ID NO: 5017326 - DNA, 15 bp, Homo sapiens
caagaaatgaaagca

SEQ ID NO: 5017327 - DNA, 19 bp, Homo sapiens
caagaaatgaaagcaggga

SEQ ID NO: 5017328 - DNA, 15 bp, Homo sapiens
caagactctgtctca

SEQ ID NO: 5017329 - DNA, 14 bp, Homo sapiens
caaggctatgtgat

SEQ ID NO: 5017330 - DNA, 14 bp, Homo sapiens
caaggcttagaccc

SEQ ID NO: 5017331 - DNA, 12 bp, Homo sapiens
caatatcctaat

SEQ ID NO: 5017332 - DNA, 19 bp, Homo sapiens
caatatcctaataaaaagg

SEQ ID NO: 5017333 - DNA, 15 bp, Homo sapiens
caatatctaatatat

SEQ ID NO: 5017334 - DNA, 14 bp, Homo sapiens
caatattataattt

SEQ ID NO: 5017335 - DNA, 23 bp, Homo sapiens
caatcaaataagtatttataata

SEQ ID NO: 5017336 - DNA, 15 bp, Homo sapiens
caattcctctgggaa

SEQ ID NO: 5017337 - DNA, 18 bp, Homo sapiens
cacaagaaatgaaagcag

SEQ ID NO: 5017338 - DNA, 21 bp, Homo sapiens
cacaagaaatgaaagcaggga

SEQ ID NO: 5017339 - DNA, 22 bp, Homo sapiens
cacgttcttactagtttccctt

SEQ ID NO: 5017340 - DNA, 15 bp, Homo sapiens
cacttaaaaatggtt

SEQ ID NO: 5017341 - DNA, 23 bp, Homo sapiens
cacttgatgatacaatgaacact

SEQ ID NO: 5017342 - DNA, 11 bp, Homo sapiens
cagaacagtga

SEQ ID NO: 5017343 - DNA, 17 bp, Homo sapiens
cagaacagtgattacca

SEQ ID NO: 5017344 - DNA, 16 bp, Homo sapiens
cagaacttgaatgtgt

SEQ ID NO: 5017345 - DNA, 19 bp, Homo sapiens
cagaagcaacccaaatgtt

SEQ ID NO: 5017346 - DNA, 17 bp, Homo sapiens
cagaagtcaaggcttag

SEQ ID NO: 5017347 - DNA, 19 bp, Homo sapiens
cagacatagaattaacaca

SEQ ID NO: 5017348 - DNA, 20 bp, Homo sapiens
cagagcaagactctgtctca

SEQ ID NO: 5017349 - DNA, 17 bp, Homo sapiens
cagaggttgcagtgagc

SEQ ID NO: 5017350 - DNA, 14 bp, Homo sapiens
cagataaacagtag

SEQ ID NO: 5017351 - DNA, 18 bp, Homo sapiens
tctagctgttgagctgtt

SEQ ID NO: 5017352 - DNA, 13 bp, Homo sapiens
tctatagactcta

SEQ ID NO: 5017353 - DNA, 16 bp, Homo sapiens
tctatttattaatatt

SEQ ID NO: 5017354 - DNA, 15 bp, Homo sapiens
tctatttatttactg

SEQ ID NO: 5017355 - DNA, 21 bp, Homo sapiens
tctcagtgtcaatgcagcccc

SEQ ID NO: 5017356 - DNA, 18 bp, Homo sapiens
tctccgtctcccaaagtg

SEQ ID NO: 5017357 - DNA, 15 bp, Homo sapiens
tctcttatagaatat

SEQ ID NO: 5017358 - DNA, 20 bp, Homo sapiens
tctgagccagtgctttaatg

SEQ ID NO: 5017359 - DNA, 15 bp, Homo sapiens
tctgcagataaacag

SEQ ID NO: 5017360 - DNA, 21 bp, Homo sapiens
tctgtgaacgatttagaaaga

SEQ ID NO: 5017361 - DNA, 19 bp, Homo sapiens
tcttaggaagagaaaccag

SEQ ID NO: 5017362 - DNA, 20 bp, Homo sapiens
tcttatagaatatttattac

SEQ ID NO: 5017363 - DNA, 14 bp, Homo sapiens
tcttgaaagctgtg

SEQ ID NO: 5017364 - DNA, 12 bp, Homo sapiens
tcttgtctctgg

SEQ ID NO: 5017365 - DNA, 18 bp, Homo sapiens
tgaaaccctgtctctact

SEQ ID NO: 5017366 - DNA, 23 bp, Homo sapiens
tgaaagcagggacttgaacccat

SEQ ID NO: 5017367 - DNA, 11 bp, Homo sapiens
tgaaagctgtg

SEQ ID NO: 5017368 - DNA, 23 bp, Homo sapiens
tgaaataagccagacatcaacag

SEQ ID NO: 5017369 - DNA, 19 bp, Homo sapiens
tgaacaaatttacagagac

SEQ ID NO: 5017370 - DNA, 22 bp, Homo sapiens
tagaggagaaactggaactctc

SEQ ID NO: 5017371 - DNA, 20 bp, Homo sapiens
ctaaatatttaagtgcagtc

SEQ ID NO: 5017372 - DNA, 20 bp, Homo sapiens
actaaatatttaagtgcagt

SEQ ID NO: 5017373 - DNA, 11 bp, Homo sapiens
aaaaaaatagt

SEQ ID NO: 5017374 - DNA, 16 bp, Homo sapiens
aaaaacatagaaaaat

SEQ ID NO: 5017375 - DNA, 22 bp, Homo sapiens
aaaaacattttatttttaaaat

SEQ ID NO: 5017376 - DNA, 23 bp, Homo sapiens
aaaaacctgagatttattaaaga

SEQ ID NO: 5017377 - DNA, 15 bp, Homo sapiens
aaaaactgtctttaa

SEQ ID NO: 5017378 - DNA, 21 bp, Homo sapiens
aaaaacttagtgacaaaatag

SEQ ID NO: 5017379 - DNA, 13 bp, Homo sapiens
aaaaagataaaca

SEQ ID NO: 5017380 - DNA, 20 bp, Homo sapiens
aaaaagttgcagctgttttg

SEQ ID NO: 5017381 - DNA, 22 bp, Homo sapiens
aaaaagttgcagctgttttgtt

SEQ ID NO: 5017382 - DNA, 23 bp, Homo sapiens
aaaaagttgcagctgttttgttg

SEQ ID NO: 5017383 - DNA, 14 bp, Homo sapiens
aaaaatgctgctct

SEQ ID NO: 5017384 - DNA, 16 bp, Homo sapiens
aaaaatgtattttatg

SEQ ID NO: 5017385 - DNA, 17 bp, Homo sapiens
aaaaatgtattttatgt

SEQ ID NO: 5017386 - DNA, 14 bp, Homo sapiens
aaaaattgaaatgt

SEQ ID NO: 5017387 - DNA, 19 bp, Homo sapiens
aaaacaatctggaagaaaa

SEQ ID NO: 5017388 - DNA, 19 bp, Homo sapiens
aaaacatattcttgtgctt

SEQ ID NO: 5017389 - DNA, 12 bp, Homo sapiens
aaaaccacacaa

SEQ ID NO: 5017390 - DNA, 15 bp, Homo sapiens
aaaacctgagattta

SEQ ID NO: 5017391 - DNA, 13 bp, Homo sapiens
aaaagaattgttg

SEQ ID NO: 5017392 - DNA, 21 bp, Homo sapiens
aaaagaggtttttcttaaata

SEQ ID NO: 5017393 - DNA, 22 bp, Homo sapiens
aaaagaggtttttcttaaataa

SEQ ID NO: 5017394 - DNA, 19 bp, Homo sapiens
aaaagataaacacaagatt

SEQ ID NO: 5017395 - DNA, 22 bp, Homo sapiens
aaaagatgcactttgctttaat

SEQ ID NO: 5017396 - DNA, 17 bp, Homo sapiens
aaaagcacaagtacttt

SEQ ID NO: 5017397 - DNA, 23 bp, Homo sapiens
aaaagtatgttctaacctttaca

SEQ ID NO: 5017398 - DNA, 17 bp, Homo sapiens
aaaagttattaatattt

SEQ ID NO: 5017399 - DNA, 14 bp, Homo sapiens
aaaagttgcagctg

SEQ ID NO: 5017400 - DNA, 21 bp, Homo sapiens
aaaagttgcagctgttttgtt

SEQ ID NO: 5017401 - DNA, 20 bp, Homo sapiens
aaaagttggaaggatctgct

SEQ ID NO: 5017402 - DNA, 21 bp, Homo sapiens
aaaagttggaaggatctgctg

SEQ ID NO: 5017403 - DNA, 14 bp, Homo sapiens
aaaatacaagactg

SEQ ID NO: 5017404 - DNA, 15 bp, Homo sapiens
aaaatacaagactgc

SEQ ID NO: 5017405 - DNA, 17 bp, Homo sapiens
aaaatacaagactgcca

SEQ ID NO: 5017406 - DNA, 15 bp, Homo sapiens
aaaatagcgttcttg

SEQ ID NO: 5017407 - DNA, 20 bp, Homo sapiens
aaaatagcgttcttgtaatt

SEQ ID NO: 5017408 - DNA, 21 bp, Homo sapiens
aaaatagggtatattttccta

SEQ ID NO: 5017409 - DNA, 19 bp, Homo sapiens
aaaatgctggctatagatg

SEQ ID NO: 5017410 - DNA, 15 bp, Homo sapiens
aaaatggagacacca

SEQ ID NO: 5017411 - DNA, 11 bp, Homo sapiens
aaaatgtattt

SEQ ID NO: 5017412 - DNA, 23 bp, Homo sapiens
aaaattaatctgggccagaattt

SEQ ID NO: 5017413 - DNA, 16 bp, Homo sapiens
aaaattcagcaaacca

SEQ ID NO: 5017414 - DNA, 16 bp, Homo sapiens
aaaattgaaatgtaag

SEQ ID NO: 5017415 - DNA, 18 bp, Homo sapiens
aaaattgaaatgtaaggc

SEQ ID NO: 5017416 - DNA, 21 bp, Homo sapiens
aaaattgaaatgtaaggctgt

SEQ ID NO: 5017417 - DNA, 17 bp, Homo sapiens
aaacaagaaaaataaag

SEQ ID NO: 5017418 - DNA, 20 bp, Homo sapiens
aaacaagaaaaataaagaaa

SEQ ID NO: 5017419 - DNA, 15 bp, Homo sapiens
aaacacaagattggt

SEQ ID NO: 5017420 - DNA, 21 bp, Homo sapiens
aaacaggcagttggccagaga

SEQ ID NO: 5017421 - DNA, 15 bp, Homo sapiens
aaacattatgatgtg

SEQ ID NO: 5017422 - DNA, 17 bp, Homo sapiens
aaacattggttcttgta

SEQ ID NO: 5017423 - DNA, 18 bp, Homo sapiens
aaacattggttcttgtat

SEQ ID NO: 5017424 - DNA, 21 bp, Homo sapiens
aaacatttctggacagtacct

SEQ ID NO: 5017425 - DNA, 12 bp, Homo sapiens
aaaccacacaaa

SEQ ID NO: 5017426 - DNA, 15 bp, Homo sapiens
aaacctctgtgagca

SEQ ID NO: 5017427 - DNA, 16 bp, Homo sapiens
aaacctgagatttatt

SEQ ID NO: 5017428 - DNA, 21 bp, Homo sapiens
aaacctgagatttattaaaga

SEQ ID NO: 5017429 - DNA, 22 bp, Homo sapiens
aaacctgagatttattaaagaa

SEQ ID NO: 5017430 - DNA, 14 bp, Homo sapiens
aaaccttctgcctt

SEQ ID NO: 5017431 - DNA, 19 bp, Homo sapiens
aagaaaaaaattgaaatgt

SEQ ID NO: 5017432 - DNA, 14 bp, Homo sapiens
aagaaaaataaaga

SEQ ID NO: 5017433 - DNA, 15 bp, Homo sapiens
aagaaaaataaagaa

SEQ ID NO: 5017434 - DNA, 11 bp, Homo sapiens
aagaaaagatg

SEQ ID NO: 5017435 - DNA, 18 bp, Homo sapiens
aagaaatggcgtctgctc

SEQ ID NO: 5017436 - DNA, 13 bp, Homo sapiens
aagaagaagggca

SEQ ID NO: 5017437 - DNA, 16 bp, Homo sapiens
aagaagacaaactttg

SEQ ID NO: 5017438 - DNA, 20 bp, Homo sapiens
aagaagacctgagaatgtat

SEQ ID NO: 5017439 - DNA, 21 bp, Homo sapiens
aagaagacctgagaatgtatc

SEQ ID NO: 5017440 - DNA, 12 bp, Homo sapiens
aagaattgttgg

SEQ ID NO: 5017441 - DNA, 16 bp, Homo sapiens
aagacatcagtctcca

SEQ ID NO: 5017442 - DNA, 12 bp, Homo sapiens
aagactccagta

SEQ ID NO: 5017443 - DNA, 14 bp, Homo sapiens
tgggactggcctct

SEQ ID NO: 5017444 - DNA, 19 bp, Homo sapiens
tgggatcacatgtggactt

SEQ ID NO: 5017445 - DNA, 15 bp, Homo sapiens
tgggatggggaggga

SEQ ID NO: 5017446 - DNA, 16 bp, Homo sapiens
tgggcaaacaggcagt

SEQ ID NO: 5017447 - DNA, 15 bp, Homo sapiens
tgggcatttggtgag

SEQ ID NO: 5017448 - DNA, 23 bp, Homo sapiens
tgggcatttggtgagagtcaaag

SEQ ID NO: 5017449 - DNA, 15 bp, Homo sapiens
tgggccactgtggtg

SEQ ID NO: 5017450 - DNA, 17 bp, Homo sapiens
tgggccagtccccgagg

SEQ ID NO: 5017451 - DNA, 15 bp, Homo sapiens
tgggcccctggcccc

SEQ ID NO: 5017452 - DNA, 19 bp, Homo sapiens
tgggcctcagtgtgcccat

SEQ ID NO: 5017453 - DNA, 14 bp, Homo sapiens
tgggcgggacacag

SEQ ID NO: 5017454 - DNA, 17 bp, Homo sapiens
tgggctgaacactccaa

SEQ ID NO: 5017455 - DNA, 13 bp, Homo sapiens
tggggaaaatggc

SEQ ID NO: 5017456 - DNA, 18 bp, Homo sapiens
tggggagcccgtctcagt

SEQ ID NO: 5017457 - DNA, 20 bp, Homo sapiens
tggggctaggggctggggcc

SEQ ID NO: 5017458 - DNA, 15 bp, Homo sapiens
tggggctgagctggg

SEQ ID NO: 5017459 - DNA, 16 bp, Homo sapiens
tggggtgtttgggagg

SEQ ID NO: 5017460 - DNA, 14 bp, Homo sapiens
tgggtcacacacac

SEQ ID NO: 5017461 - DNA, 16 bp, Homo sapiens
tgggtctcagtgtcct

SEQ ID NO: 5017462 - DNA, 14 bp, Homo sapiens
tgggtctctggaag

SEQ ID NO: 5017463 - DNA, 12 bp, Homo sapiens
tggtaaaaatgc

SEQ ID NO: 5017464 - DNA, 18 bp, Homo sapiens
tggtaaaaatgctgctct

SEQ ID NO: 5017465 - DNA, 22 bp, Homo sapiens
tggtaggggagggcaggcttgg

SEQ ID NO: 5017466 - DNA, 22 bp, Homo sapiens
tggtagtgtagctgtgtggctt

SEQ ID NO: 5017467 - DNA, 16 bp, Homo sapiens
tggtccaggccctgtg

SEQ ID NO: 5017468 - DNA, 19 bp, Homo sapiens
tggtccaggccctgtggca

SEQ ID NO: 5017469 - DNA, 14 bp, Homo sapiens
tggtctcaggcagc

SEQ ID NO: 5017470 - DNA, 17 bp, Homo sapiens
tggtctcaggcagcacc

SEQ ID NO: 5017471 - DNA, 13 bp, Homo sapiens
ttgtattacagat

SEQ ID NO: 5017472 - DNA, 20 bp, Homo sapiens
ttgtccaatgtacaggaagt

SEQ ID NO: 5017473 - DNA, 14 bp, Homo sapiens
ttgtccttttcata

SEQ ID NO: 5017474 - DNA, 20 bp, Homo sapiens
ttgtcgggcaccagccagcg

SEQ ID NO: 5017475 - DNA, 15 bp, Homo sapiens
ttgtctataaagcat

SEQ ID NO: 5017476 - DNA, 15 bp, Homo sapiens
ttgtgacagtgcctc

SEQ ID NO: 5017477 - DNA, 21 bp, Homo sapiens
ttgtgcaatgtgtataaacaa

SEQ ID NO: 5017478 - DNA, 11 bp, Homo sapiens
ttgtgcagaga

SEQ ID NO: 5017479 - DNA, 21 bp, Homo sapiens
ttgtgccagaatgctttagga

SEQ ID NO: 5017480 - DNA, 15 bp, Homo sapiens
ttgttatataattta

SEQ ID NO: 5017481 - DNA, 16 bp, Homo sapiens
ttgttctgttaactga

SEQ ID NO: 5017482 - DNA, 12 bp, Homo sapiens
ttgttgacattc

SEQ ID NO: 5017483 - DNA, 16 bp, Homo sapiens
ttgttgacattctgaa

SEQ ID NO: 5017484 - DNA, 21 bp, Homo sapiens
ttgttgttctgttaactgaat

SEQ ID NO: 5017485 - DNA, 15 bp, Homo sapiens
ttgtttatgtaattt

SEQ ID NO: 5017486 - DNA, 13 bp, Homo sapiens
ttgtttcgctctt

SEQ ID NO: 5017487 - DNA, 15 bp, Homo sapiens
ttgtttcgctctttg

SEQ ID NO: 5017488 - DNA, 18 bp, Homo sapiens
ttgtttcgctctttgaga

SEQ ID NO: 5017489 - DNA, 22 bp, Homo sapiens
ttgtttcgctctttgagaaata

SEQ ID NO: 5017490 - DNA, 21 bp, Homo sapiens
ttgtttgagaaattaagtatc

SEQ ID NO: 5017491 - DNA, 12 bp, Homo sapiens
ttgtttgctgct

SEQ ID NO: 5017492 - DNA, 14 bp, Homo sapiens
ttgtttgctgctat

SEQ ID NO: 5017493 - DNA, 19 bp, Homo sapiens
ttgttttgtgtctcttatg

SEQ ID NO: 5017494 - DNA, 18 bp, Homo sapiens
ttgtttttaaactgtaca

SEQ ID NO: 5017495 - DNA, 17 bp, Homo sapiens
tttaaaaaattaatctg

SEQ ID NO: 5017496 - DNA, 22 bp, Homo sapiens
tttaaaagagagagagagaaaa

SEQ ID NO: 5017497 - DNA, 23 bp, Homo sapiens
tttaaaagagagagagagaaaaa

SEQ ID NO: 5017498 - DNA, 14 bp, Homo sapiens
tttaaacacctcct

SEQ ID NO: 5017499 - DNA, 16 bp, Homo sapiens
tttaaactgtacagtg

SEQ ID NO: 5017500 - DNA, 21 bp, Homo sapiens
tttaaagaaaaaaattgaaat

SEQ ID NO: 5017501 - DNA, 16 bp, Homo sapiens
tttaaataaaagcaca

SEQ ID NO: 5017502 - DNA, 21 bp, Homo sapiens
tttaaatgaacaagagaagca

SEQ ID NO: 5017503 - DNA, 23 bp, Homo sapiens
tttaaatgaacaagagaagcatt

SEQ ID NO: 5017504 - DNA, 19 bp, Homo sapiens
tttaaatgtgtacaatgta

SEQ ID NO: 5017505 - DNA, 13 bp, Homo sapiens
tttaacataagct

SEQ ID NO: 5017506 - DNA, 19 bp, Homo sapiens
tttaacataagctattttt

SEQ ID NO: 5017507 - DNA, 19 bp, Homo sapiens
tttaacccccctgtacaca

SEQ ID NO: 5017508 - DNA, 19 bp, Homo sapiens
tttaagacatttttggaag

SEQ ID NO: 5017509 - DNA, 18 bp, Homo sapiens
tttaatctgttatgtact

SEQ ID NO: 5017510 - DNA, 20 bp, Homo sapiens
tttaattaattgggccagct

SEQ ID NO: 5017511 - DNA, 15 bp, Homo sapiens
tttacaatgtcatat

SEQ ID NO: 5017512 - DNA, 23 bp, Homo sapiens
tttacaccaatttggtaaaaatg

SEQ ID NO: 5017513 - DNA, 14 bp, Homo sapiens
tttacctagagaac

SEQ ID NO: 5017514 - DNA, 12 bp, Homo sapiens
tttataagcatc

SEQ ID NO: 5017515 - DNA, 13 bp, Homo sapiens
tttataagcatca

SEQ ID NO: 5017516 - DNA, 14 bp, Homo sapiens
tttataagcatcat

SEQ ID NO: 5017517 - DNA, 16 bp, Homo sapiens
tttataagcatcatta

SEQ ID NO: 5017518 - DNA, 19 bp, Homo sapiens
tttataagtcattgtatgt

SEQ ID NO: 5017519 - DNA, 19 bp, Homo sapiens
tttatgtattgtgcaatgt

SEQ ID NO: 5017520 - DNA, 16 bp, Homo sapiens
tttatgtgatcaattt

SEQ ID NO: 5017521 - DNA, 14 bp, Homo sapiens
tttatgttatatat

SEQ ID NO: 5017522 - DNA, 22 bp, Homo sapiens
tttatgttatatataaatatat

SEQ ID NO: 5017523 - DNA, 12 bp, Homo sapiens
tttattaaagaa

SEQ ID NO: 5017524 - DNA, 16 bp, Homo sapiens
tttattaaagaaaaaa

SEQ ID NO: 5017525 - DNA, 18 bp, Homo sapiens
tttcagataactgttatt

SEQ ID NO: 5017526 - DNA, 12 bp, Homo sapiens
tttcaggaggaa

SEQ ID NO: 5017527 - DNA, 19 bp, Homo sapiens
tttcaggaggaatactgaa

SEQ ID NO: 5017528 - DNA, 21 bp, Homo sapiens
tttcaggaggaatactgaaca

SEQ ID NO: 5017529 - DNA, 13 bp, Homo sapiens
tttcatattttag

SEQ ID NO: 5017530 - DNA, 19 bp, Homo sapiens
tttcatccataactgaaca

SEQ ID NO: 5017531 - DNA, 17 bp, Homo sapiens
tttcatgcaaactcttt

SEQ ID NO: 5017532 - DNA, 18 bp, Homo sapiens
tttcatgcaaactctttg

SEQ ID NO: 5017533 - DNA, 11 bp, Homo sapiens
tttccaaagag

SEQ ID NO: 5017534 - DNA, 20 bp, Homo sapiens
tttcccttcagtaccctctc

SEQ ID NO: 5017535 - DNA, 21 bp, Homo sapiens
tttcctgataaagcacagctg

SEQ ID NO: 5017536 - DNA, 9 bp, Homo sapiens
tttcctttg

SEQ ID NO: 5017537 - DNA, 14 bp, Homo sapiens
tttctaaaggagtt

SEQ ID NO: 5017538 - DNA, 18 bp, Homo sapiens
tttctaactacaaaggtt

SEQ ID NO: 5017539 - DNA, 20 bp, Homo sapiens
tttctaactacaaaggttta

SEQ ID NO: 5017540 - DNA, 21 bp, Homo sapiens
tttctacccaacggccctgca

SEQ ID NO: 5017541 - DNA, 19 bp, Homo sapiens
tttctagcccgaatacaaa

SEQ ID NO: 5017542 - DNA, 12 bp, Homo sapiens
tttctccagctg

SEQ ID NO: 5017543 - DNA, 23 bp, Homo sapiens
tttctccttgaatatctttcgat

SEQ ID NO: 5017544 - DNA, 16 bp, Homo sapiens
tttctgtgcttggatt

SEQ ID NO: 5017545 - DNA, 16 bp, Homo sapiens
tttctgtttgattctt

SEQ ID NO: 5017546 - DNA, 17 bp, Homo sapiens
tttcttaaagtgccagt

SEQ ID NO: 5017547 - DNA, 17 bp, Homo sapiens
tttcttattgcgctgct

SEQ ID NO: 5017548 - DNA, 18 bp, Homo sapiens
tttcttgtctataaagca

SEQ ID NO: 5017549 - DNA, 15 bp, Homo sapiens
tttctttacaaaaca

SEQ ID NO: 5017550 - DNA, 19 bp, Homo sapiens
tttgaaagtctgtccttga

SEQ ID NO: 5017551 - DNA, 17 bp, Homo sapiens
tttgaatgatttttctt

SEQ ID NO: 5017552 - DNA, 14 bp, Homo sapiens
tttgacaaagtgcc

SEQ ID NO: 5017553 - DNA, 23 bp, Homo sapiens
tttgacttaatgtgattactgct

SEQ ID NO: 5017554 - DNA, 18 bp, Homo sapiens
tttgataatcaactgggc

SEQ ID NO: 5017555 - DNA, 14 bp, Homo sapiens
tttgcaccaaagac

SEQ ID NO: 5017556 - DNA, 14 bp, Homo sapiens
tttgcatctcagta

SEQ ID NO: 5017557 - DNA, 19 bp, Homo sapiens
tttgcttgctcatatgcat

SEQ ID NO: 5017558 - DNA, 12 bp, Homo sapiens
tttggaagaagg

SEQ ID NO: 5017559 - DNA, 20 bp, Homo sapiens
tttggagtcccctcacctcc

SEQ ID NO: 5017560 - DNA, 17 bp, Homo sapiens
tttggccatctgctcct

SEQ ID NO: 5017561 - DNA, 19 bp, Homo sapiens
tttggtaaaaatgctgctc

SEQ ID NO: 5017562 - DNA, 20 bp, Homo sapiens
tttggttaagtctgttttat

SEQ ID NO: 5017563 - DNA, 17 bp, Homo sapiens
tttggttgctttaatat

SEQ ID NO: 5017564 - DNA, 13 bp, Homo sapiens
tttgtctgtcgtg

SEQ ID NO: 5017565 - DNA, 19 bp, Homo sapiens
tttgtgatggagtgctgtt

SEQ ID NO: 5017566 - DNA, 21 bp, Homo sapiens
tttgtgatggagtgctgtttt

SEQ ID NO: 5017567 - DNA, 14 bp, Homo sapiens
tttgttagcaaaga

SEQ ID NO: 5017568 - DNA, 20 bp, Homo sapiens
tttgttagcaaagattaaat

SEQ ID NO: 5017569 - DNA, 16 bp, Homo sapiens
tttgttattgttttgt

SEQ ID NO: 5017570 - DNA, 14 bp, Homo sapiens
tttgttcattaaac

SEQ ID NO: 5017571 - DNA, 18 bp, Homo sapiens
tttgttgacattctgaat

SEQ ID NO: 5017572 - DNA, 20 bp, Homo sapiens
tttgttgacattctgaatgc

SEQ ID NO: 5017573 - DNA, 14 bp, Homo sapiens
tgcccccgcctgcc

SEQ ID NO: 5017574 - DNA, 20 bp, Homo sapiens
tgccccttggacacgctcag

SEQ ID NO: 5017575 - DNA, 16 bp, Homo sapiens
tgcccggcgccgggca

SEQ ID NO: 5017576 - DNA, 17 bp, Homo sapiens
tgcccgtgcccgcagga

SEQ ID NO: 5017577 - DNA, 16 bp, Homo sapiens
tgccctctcccctcag

SEQ ID NO: 5017578 - DNA, 19 bp, Homo sapiens
tgccgacttggagactcct

SEQ ID NO: 5017579 - DNA, 16 bp, Homo sapiens
tgccgccagctgccgc

SEQ ID NO: 5017580 - DNA, 21 bp, Homo sapiens
tgccgccagctgccgcaccag

SEQ ID NO: 5017581 - DNA, 13 bp, Homo sapiens
tgccggtgggacc

SEQ ID NO: 5017582 - DNA, 16 bp, Homo sapiens
tgccggtgggaccctg

SEQ ID NO: 5017583 - DNA, 19 bp, Homo sapiens
tgccggtgggaccctgtcc

SEQ ID NO: 5017584 - DNA, 16 bp, Homo sapiens
tgcctctacccaacca

SEQ ID NO: 5017585 - DNA, 18 bp, Homo sapiens
tgcctcttccagtgaaca

SEQ ID NO: 5017586 - DNA, 15 bp, Homo sapiens
tgcctgccctggtga

SEQ ID NO: 5017587 - DNA, 15 bp, Homo sapiens
tgcctgctcccatcc

SEQ ID NO: 5017588 - DNA, 20 bp, Homo sapiens
tgcctgctcccatcctgtgt

SEQ ID NO: 5017589 - DNA, 13 bp, Homo sapiens
tgcggctgtgtgt

SEQ ID NO: 5017590 - DNA, 22 bp, Homo sapiens
tgcgggcgcgggcagccaccca

SEQ ID NO: 5017591 - DNA, 17 bp, Homo sapiens
tgcgtctccagtcatct

SEQ ID NO: 5017592 - DNA, 13 bp, Homo sapiens
tgctaaataaaca

SEQ ID NO: 5017593 - DNA, 18 bp, Homo sapiens
tgctaatattttcctcct

SEQ ID NO: 5017594 - DNA, 15 bp, Homo sapiens
tgctaccgttgactt

SEQ ID NO: 5017595 - DNA, 18 bp, Homo sapiens
tgctcctggatctccctg

SEQ ID NO: 5017596 - DNA, 21 bp, Homo sapiens
tgctcctggatctccctgaga

SEQ ID NO: 5017597 - DNA, 18 bp, Homo sapiens
tgctctcagcctcccaca

SEQ ID NO: 5017598 - DNA, 14 bp, Homo sapiens
tgctctttgttttg

SEQ ID NO: 5017599 - DNA, 15 bp, Homo sapiens
tgctctttgttttgt

SEQ ID NO: 5017600 - DNA, 18 bp, Homo sapiens
tgctctttgttttgtgtc

SEQ ID NO: 5017601 - DNA, 22 bp, Homo sapiens
tgctctttgttttgtgtctctt

SEQ ID NO: 5017602 - DNA, 15 bp, Homo sapiens
tgctgaggcccagtg

SEQ ID NO: 5017603 - DNA, 14 bp, Homo sapiens
tgctgcttggattt

SEQ ID NO: 5017604 - DNA, 14 bp, Homo sapiens
tgctggtagagacc

SEQ ID NO: 5017605 - DNA, 19 bp, Homo sapiens
tgctggtagagacccccag

SEQ ID NO: 5017606 - DNA, 20 bp, Homo sapiens
tgaatgatttttctttacaa

SEQ ID NO: 5017607 - DNA, 23 bp, Homo sapiens
tgaatgcttctaagtaaatacaa

SEQ ID NO: 5017608 - DNA, 17 bp, Homo sapiens
tgaatgtttttctaaag

SEQ ID NO: 5017609 - DNA, 14 bp, Homo sapiens
tgacaaaccatttc

SEQ ID NO: 5017610 - DNA, 13 bp, Homo sapiens
tgacaaagtgcct

SEQ ID NO: 5017611 - DNA, 15 bp, Homo sapiens
tgacaaagtgcctca

SEQ ID NO: 5017612 - DNA, 20 bp, Homo sapiens
tgacaacctccattctattt

SEQ ID NO: 5017613 - DNA, 16 bp, Homo sapiens
tgacagctttctggga

SEQ ID NO: 5017614 - DNA, 20 bp, Homo sapiens
tgacagctttctgggatgtc

SEQ ID NO: 5017615 - DNA, 13 bp, Homo sapiens
tgacaggcagcag

SEQ ID NO: 5017616 - DNA, 15 bp, Homo sapiens
tgacaggcagcagag

SEQ ID NO: 5017617 - DNA, 19 bp, Homo sapiens
tgacaggcagcagagactt

SEQ ID NO: 5017618 - DNA, 16 bp, Homo sapiens
tgacattctgaatgct

SEQ ID NO: 5017619 - DNA, 12 bp, Homo sapiens
tgaccacactcc

SEQ ID NO: 5017620 - DNA, 19 bp, Homo sapiens
tgaccacactccagctggg

SEQ ID NO: 5017621 - DNA, 23 bp, Homo sapiens
tgaccaccaccccaacaaaccat

SEQ ID NO: 5017622 - DNA, 16 bp, Homo sapiens
tgacccggaggaaagg

SEQ ID NO: 5017623 - DNA, 16 bp, Homo sapiens
tgacctcagctttgat

SEQ ID NO: 5017624 - DNA, 22 bp, Homo sapiens
tgacctttcatcgtaaagtgct

SEQ ID NO: 5017625 - DNA, 17 bp, Homo sapiens
tgacggtaagtgttctc

SEQ ID NO: 5017626 - DNA, 15 bp, Homo sapiens
tgactgtatctgtgt

SEQ ID NO: 5017627 - DNA, 17 bp, Homo sapiens
tgactgtatctgtgtag

SEQ ID NO: 5017628 - DNA, 19 bp, Homo sapiens
tgactgtatctgtgtagac

SEQ ID NO: 5017629 - DNA, 19 bp, Homo sapiens
tgacttaagcaaaagaaaa

SEQ ID NO: 5017630 - DNA, 22 bp, Homo sapiens
tgacttcattaataataaattc

SEQ ID NO: 5017631 - DNA, 21 bp, Homo sapiens
tgagaaggcagtagttttcaa

SEQ ID NO: 5017632 - DNA, 16 bp, Homo sapiens
tgagaatgtatcccca

SEQ ID NO: 5017633 - DNA, 14 bp, Homo sapiens
tgagagccagcagc

SEQ ID NO: 5017634 - DNA, 15 bp, Homo sapiens
tgagagccagcagca

SEQ ID NO: 5017635 - DNA, 16 bp, Homo sapiens
tgagagccagcagcaa

SEQ ID NO: 5017636 - DNA, 17 bp, Homo sapiens
tgagatagttttcatcc

SEQ ID NO: 5017637 - DNA, 21 bp, Homo sapiens
tgagatagttttcatccataa

SEQ ID NO: 5017638 - DNA, 17 bp, Homo sapiens
tgagatgctggttttct

SEQ ID NO: 5017639 - DNA, 22 bp, Homo sapiens
tgagatgggcttcccaagggct

SEQ ID NO: 5017640 - DNA, 17 bp, Homo sapiens
tgagatttattaaagaa

SEQ ID NO: 5017641 - DNA, 16 bp, Homo sapiens
tgagcagaacaggtag

SEQ ID NO: 5017642 - DNA, 17 bp, Homo sapiens
tgagcagcgagcctgct

SEQ ID NO: 5017643 - DNA, 22 bp, Homo sapiens
tgagcaggccacacttcaaact

SEQ ID NO: 5017644 - DNA, 18 bp, Homo sapiens
tctcagtttgtgtgtctt

SEQ ID NO: 5017645 - DNA, 14 bp, Homo sapiens
tctcatgaagcagg

SEQ ID NO: 5017646 - DNA, 14 bp, Homo sapiens
tctcattggaaatt

SEQ ID NO: 5017647 - DNA, 17 bp, Homo sapiens
tctcattggaaatttag

SEQ ID NO: 5017648 - DNA, 19 bp, Homo sapiens
tctcattggaaatttagca

SEQ ID NO: 5017649 - DNA, 21 bp, Homo sapiens
tctcattggaaatttagcatt

SEQ ID NO: 5017650 - DNA, 21 bp, Homo sapiens
tctccaactgcctaaggccct

SEQ ID NO: 5017651 - DNA, 19 bp, Homo sapiens
tctccagctgggctctgca

SEQ ID NO: 5017652 - DNA, 19 bp, Homo sapiens
tctccagtcatctgtaaga

SEQ ID NO: 5017653 - DNA, 18 bp, Homo sapiens
tctccccaggcatttgcc

SEQ ID NO: 5017654 - DNA, 19 bp, Homo sapiens
tctccctcccctctcagaa

SEQ ID NO: 5017655 - DNA, 21 bp, Homo sapiens
tctccctgcactccctcctgg

SEQ ID NO: 5017656 - DNA, 13 bp, Homo sapiens
tctccctgggcct

SEQ ID NO: 5017657 - DNA, 20 bp, Homo sapiens
tctcctgcctgtgctgtgac

SEQ ID NO: 5017658 - DNA, 21 bp, Homo sapiens
tctcgtcctcgtttgtgttct

SEQ ID NO: 5017659 - DNA, 23 bp, Homo sapiens
tctctcggctccccatgtgtcct

SEQ ID NO: 5017660 - DNA, 16 bp, Homo sapiens
tctctgaagtgaaact

SEQ ID NO: 5017661 - DNA, 15 bp, Homo sapiens
tctctgatgcagctt

SEQ ID NO: 5017662 - DNA, 19 bp, Homo sapiens
tctctgcaatcttctcaga

SEQ ID NO: 5017663 - DNA, 10 bp, Homo sapiens
tctctgcagt

SEQ ID NO: 5017664 - DNA, 17 bp, Homo sapiens
tctctgcccacagtctt

SEQ ID NO: 5017665 - DNA, 12 bp, Homo sapiens
tctctgggctgc

SEQ ID NO: 5017666 - DNA, 19 bp, Homo sapiens
tctcttcctccgaggccag

SEQ ID NO: 5017667 - DNA, 13 bp, Homo sapiens
tctcttgctttct

SEQ ID NO: 5017668 - DNA, 22 bp, Homo sapiens
tctgaatgcttctaagtaaata

SEQ ID NO: 5017669 - DNA, 17 bp, Homo sapiens
tctgacgcttgtgacag

SEQ ID NO: 5017670 - DNA, 18 bp, Homo sapiens
tctgacgcttgtgacagt

SEQ ID NO: 5017671 - DNA, 19 bp, Homo sapiens
tctgacttaagcaaaagaa

SEQ ID NO: 5017672 - DNA, 23 bp, Homo sapiens
tctgacttaagcaaaagaaaaag

SEQ ID NO: 5017673 - DNA, 17 bp, Homo sapiens
tctgcagtttttcccaa

SEQ ID NO: 5017674 - DNA, 23 bp, Homo sapiens
tctgcgcttggtctttctgtgct

SEQ ID NO: 5017675 - DNA, 15 bp, Homo sapiens
tctgctaaataaaca

SEQ ID NO: 5017676 - DNA, 13 bp, Homo sapiens
tctgctcattttg

SEQ ID NO: 5017677 - DNA, 13 bp, Homo sapiens
tctgctctggtgg

SEQ ID NO: 5017678 - DNA, 17 bp, Homo sapiens
tctgctctggtggctta

SEQ ID NO: 5017679 - DNA, 18 bp, Homo sapiens
tctggcattagaattatt

SEQ ID NO: 5017680 - DNA, 15 bp, Homo sapiens
tctgggatgtcacag

SEQ ID NO: 5017681 - DNA, 19 bp, Homo sapiens
tctgggatgtcacagtcca

SEQ ID NO: 5017682 - DNA, 13 bp, Homo sapiens
tctggttcctccc

SEQ ID NO: 5017683 - DNA, 12 bp, Homo sapiens
tctgtaattgca

SEQ ID NO: 5017684 - DNA, 17 bp, Homo sapiens
tctgtcatcctcaggaa

SEQ ID NO: 5017685 - DNA, 15 bp, Homo sapiens
tctgtccccagcctg

SEQ ID NO: 5017686 - DNA, 16 bp, Homo sapiens
tctgtccccagcctgg

SEQ ID NO: 5017687 - DNA, 16 bp, Homo sapiens
tccaccatccccaccc

SEQ ID NO: 5017688 - DNA, 17 bp, Homo sapiens
tccaccatccccacccc

SEQ ID NO: 5017689 - DNA, 20 bp, Homo sapiens
tccaccccatccctccccag

SEQ ID NO: 5017690 - DNA, 14 bp, Homo sapiens
tccagagtagtttc

SEQ ID NO: 5017691 - DNA, 13 bp, Homo sapiens
tccagattctgat

SEQ ID NO: 5017692 - DNA, 20 bp, Homo sapiens
tccagccctggctgaaggac

SEQ ID NO: 5017693 - DNA, 19 bp, Homo sapiens
tccagcctgcctggcaggc

SEQ ID NO: 5017694 - DNA, 18 bp, Homo sapiens
tccagctcccgctgtggc

SEQ ID NO: 5017695 - DNA, 23 bp, Homo sapiens
tccaggttcaacccacagctact

SEQ ID NO: 5017696 - DNA, 17 bp, Homo sapiens
tccagtcaaatctgggc

SEQ ID NO: 5017697 - DNA, 13 bp, Homo sapiens
tccagtttgcatt

SEQ ID NO: 5017698 - DNA, 14 bp, Homo sapiens
tccataactgaaca

SEQ ID NO: 5017699 - DNA, 14 bp, Homo sapiens
tccatgtacttgtt

SEQ ID NO: 5017700 - DNA, 19 bp, Homo sapiens
tccattaaacgatttttaa

SEQ ID NO: 5017701 - DNA, 22 bp, Homo sapiens
tccattttcttattgcgctgct

SEQ ID NO: 5017702 - DNA, 21 bp, Homo sapiens
tcccaaagtgctgggaattac

SEQ ID NO: 5017703 - DNA, 20 bp, Homo sapiens
tcccaagtaccctgagatac

SEQ ID NO: 5017704 - DNA, 15 bp, Homo sapiens
tcccacattaaagaa

SEQ ID NO: 5017705 - DNA, 19 bp, Homo sapiens
tcccacattaaagaagacc

SEQ ID NO: 5017706 - DNA, 22 bp, Homo sapiens
tcccacattaaagaagacctga

SEQ ID NO: 5017707 - DNA, 14 bp, Homo sapiens
tcccacccacccgc

SEQ ID NO: 5017708 - DNA, 22 bp, Homo sapiens
tcccacccccacccccagctca

SEQ ID NO: 5017709 - DNA, 16 bp, Homo sapiens
tcccaggatgtacaag

SEQ ID NO: 5017710 - DNA, 14 bp, Homo sapiens
tcccatcctgtgtg

SEQ ID NO: 5017711 - DNA, 10 bp, Homo sapiens
tcccatgtgg

SEQ ID NO: 5017712 - DNA, 19 bp, Homo sapiens
tccccacagtgccacccat

SEQ ID NO: 5017713 - DNA, 14 bp, Homo sapiens
tccccagcctggga

SEQ ID NO: 5017714 - DNA, 17 bp, Homo sapiens
tccccatgtctcgactc

SEQ ID NO: 5017715 - DNA, 18 bp, Homo sapiens
tccccgcttctgcctgca

SEQ ID NO: 5017716 - DNA, 17 bp, Homo sapiens
tcccctcacctcctcta

SEQ ID NO: 5017717 - DNA, 13 bp, Homo sapiens
tcccctctcagaa

SEQ ID NO: 5017718 - DNA, 14 bp, Homo sapiens
tcccctctcagaac

SEQ ID NO: 5017719 - DNA, 15 bp, Homo sapiens
tcccctctcagaaca

SEQ ID NO: 5017720 - DNA, 20 bp, Homo sapiens
tcccctctgctgctgtccct

SEQ ID NO: 5017721 - DNA, 22 bp, Homo sapiens
tccctattttttttctgttata

SEQ ID NO: 5017722 - DNA, 14 bp, Homo sapiens
tccctcccccttgt

SEQ ID NO: 5017723 - DNA, 14 bp, Homo sapiens
tccctcctggagct

SEQ ID NO: 5017724 - DNA, 19 bp, Homo sapiens
tccctcctggagctctgtg

SEQ ID NO: 5017725 - DNA, 20 bp, Homo sapiens
tccctctgtcatcctcagga

SEQ ID NO: 5017726 - DNA, 23 bp, Homo sapiens
tccctctttggctcccctgtacc

SEQ ID NO: 5017727 - DNA, 20 bp, Homo sapiens
tccctgcactccctcctgga

SEQ ID NO: 5017728 - DNA, 11 bp, Homo sapiens
tccctggcctt

SEQ ID NO: 5017729 - DNA, 16 bp, Homo sapiens
tccctggcctttcata

SEQ ID NO: 5017730 - DNA, 21 bp, Homo sapiens
tccctggggccaacggcaaca

SEQ ID NO: 5017731 - DNA, 18 bp, Homo sapiens
tcccttcagtaccctctc

SEQ ID NO: 5017732 - DNA, 19 bp, Homo sapiens
tcccttcagtaccctctca

SEQ ID NO: 5017733 - DNA, 15 bp, Homo sapiens
tccgatgaattctta

SEQ ID NO: 5017734 - DNA, 21 bp, Homo sapiens
tccgcccacaggaagcctgca

SEQ ID NO: 5017735 - DNA, 19 bp, Homo sapiens
tcctagcacacacttttgg

SEQ ID NO: 5017736 - DNA, 14 bp, Homo sapiens
tcctcatccacccc

SEQ ID NO: 5017737 - DNA, 15 bp, Homo sapiens
tcctcatccacccca

SEQ ID NO: 5017738 - DNA, 17 bp, Homo sapiens
tcctcatccaccccatc

SEQ ID NO: 5017739 - DNA, 14 bp, Homo sapiens
tcctcatcccgtgt

SEQ ID NO: 5017740 - DNA, 22 bp, Homo sapiens
tcctcatttgttcattaaacgt

SEQ ID NO: 5017741 - DNA, 18 bp, Homo sapiens
tcctcccctcctcctgga

SEQ ID NO: 5017742 - DNA, 14 bp, Homo sapiens
tcctccgaggccag

SEQ ID NO: 5017743 - DNA, 13 bp, Homo sapiens
tcctcctggactc

SEQ ID NO: 5017744 - DNA, 13 bp, Homo sapiens
tcctcgtttgtgt

SEQ ID NO: 5017745 - DNA, 16 bp, Homo sapiens
tcctcgtttgtgttct

SEQ ID NO: 5017746 - DNA, 18 bp, Homo sapiens
tcctctcaaccacctttc

SEQ ID NO: 5017747 - DNA, 12 bp, Homo sapiens
tcctctctctgt

SEQ ID NO: 5017748 - DNA, 13 bp, Homo sapiens
tcctctctctgtg

SEQ ID NO: 5017749 - DNA, 14 bp, Homo sapiens
tcctctgaggctga

SEQ ID NO: 5017750 - DNA, 15 bp, Homo sapiens
tcctgagaccagcca

SEQ ID NO: 5017751 - DNA, 15 bp, Homo sapiens
tcctgagtgcttgct

SEQ ID NO: 5017752 - DNA, 21 bp, Homo sapiens
tcctgcaatgaagtctctgaa

SEQ ID NO: 5017753 - DNA, 22 bp, Homo sapiens
tcctgcaatgaagtctctgaag

SEQ ID NO: 5017754 - DNA, 14 bp, Homo sapiens
tcctgccagcccct

SEQ ID NO: 5017755 - DNA, 19 bp, Homo sapiens
tcctgcctaaggctgaact

SEQ ID NO: 5017756 - DNA, 14 bp, Homo sapiens
tcctgcctgtgctg

SEQ ID NO: 5017757 - DNA, 22 bp, Homo sapiens
tcctggaagcgcgagggcctca

SEQ ID NO: 5017758 - DNA, 15 bp, Homo sapiens
tcctggagctctgtg

SEQ ID NO: 5017759 - DNA, 16 bp, Homo sapiens
tcctggagctctgtgg

SEQ ID NO: 5017760 - DNA, 22 bp, Homo sapiens
tcctggatgatactaataaact

SEQ ID NO: 5017761 - DNA, 12 bp, Homo sapiens
tcctggcctcct

SEQ ID NO: 5017762 - DNA, 13 bp, Homo sapiens
tcctggtctgtga

SEQ ID NO: 5017763 - DNA, 14 bp, Homo sapiens
tcctggtctgtgaa

SEQ ID NO: 5017764 - DNA, 23 bp, Homo sapiens
tcctggttcccgtttctccacct

SEQ ID NO: 5017765 - DNA, 21 bp, Homo sapiens
tcctgtaaagaaacatttcct

SEQ ID NO: 5017766 - DNA, 12 bp, Homo sapiens
tcctgtgtgtta

SEQ ID NO: 5017767 - DNA, 15 bp, Homo sapiens
tccttccaccaagtt

SEQ ID NO: 5017768 - DNA, 19 bp, Homo sapiens
tccttgaatatctttcgat

SEQ ID NO: 5017769 - DNA, 12 bp, Homo sapiens
tccttttaaaga

SEQ ID NO: 5017770 - DNA, 20 bp, Homo sapiens
tccttttcataggtctgaaa

SEQ ID NO: 5017771 - DNA, 14 bp, Homo sapiens
tcgagagctggcca

SEQ ID NO: 5017772 - DNA, 19 bp, Homo sapiens
tcgagattatcgttttctt

SEQ ID NO: 5017773 - DNA, 23 bp, Homo sapiens
tcgcaatagttttttacttctct

SEQ ID NO: 5017774 - DNA, 14 bp, Homo sapiens
tcgcagctgtgggt

SEQ ID NO: 5017775 - DNA, 13 bp, Homo sapiens
tcgctctttgaga

SEQ ID NO: 5017776 - DNA, 22 bp, Homo sapiens
tcgcttctgtgtatctctttca

SEQ ID NO: 5017777 - DNA, 14 bp, Homo sapiens
tcggcctttgggtg

SEQ ID NO: 5017778 - DNA, 13 bp, Homo sapiens
tcggctctggagg

SEQ ID NO: 5017779 - DNA, 15 bp, Homo sapiens
tcgggcaccagccag

SEQ ID NO: 5017780 - DNA, 16 bp, Homo sapiens
tcgggctgagaaggca

SEQ ID NO: 5017781 - DNA, 13 bp, Homo sapiens
tcgtgatggggca

SEQ ID NO: 5017782 - DNA, 18 bp, Homo sapiens
tcgtttttatattaatgt

SEQ ID NO: 5017783 - DNA, 15 bp, Homo sapiens
tctaactacaaaggt

SEQ ID NO: 5017784 - DNA, 14 bp, Homo sapiens
tctaagtaaataca

SEQ ID NO: 5017785 - DNA, 20 bp, Homo sapiens
tctaattctaaggaatatga

SEQ ID NO: 5017786 - DNA, 15 bp, Homo sapiens
tctacatcttctgcc

SEQ ID NO: 5017787 - DNA, 18 bp, Homo sapiens
tctacattgagcatttga

SEQ ID NO: 5017788 - DNA, 22 bp, Homo sapiens
tctaccagcctccctatttttt

SEQ ID NO: 5017789 - DNA, 20 bp, Homo sapiens
tctacttctctgttgtcaaa

SEQ ID NO: 5017790 - DNA, 16 bp, Homo sapiens
tctataaagcatttaa

SEQ ID NO: 5017791 - DNA, 20 bp, Homo sapiens
tctataaagcatttaacccc

SEQ ID NO: 5017792 - DNA, 15 bp, Homo sapiens
tctatgggtgttatc

SEQ ID NO: 5017793 - DNA, 13 bp, Homo sapiens
tctattctttaac

SEQ ID NO: 5017794 - DNA, 14 bp, Homo sapiens
tctattttagaata

SEQ ID NO: 5017795 - DNA, 22 bp, Homo sapiens
tctcagaaggcaaatgactttg

SEQ ID NO: 5017796 - DNA, 18 bp, Homo sapiens
tctcagatgccccaaagt

SEQ ID NO: 5017797 - DNA, 21 bp, Homo sapiens
tctcagatgccccaaagtttc

SEQ ID NO: 5017798 - DNA, 13 bp, Homo sapiens
tctcagcctccca

SEQ ID NO: 5017799 - DNA, 14 bp, Homo sapiens
tctcagcctcccac

SEQ ID NO: 5017800 - DNA, 16 bp, Homo sapiens
tctcagtgaagactat

SEQ ID NO: 5017801 - DNA, 22 bp, Homo sapiens
tctcagtgttgagccttttccc

SEQ ID NO: 5017802 - DNA, 17 bp, Homo sapiens
tctcagtttgtgtgtct

SEQ ID NO: 5017803 - DNA, 12 bp, Homo sapiens
gctccccatgtg

SEQ ID NO: 5017804 - DNA, 18 bp, Homo sapiens
gctctacatcttctgcct

SEQ ID NO: 5017805 - DNA, 15 bp, Homo sapiens
gctctgtccccagcc

SEQ ID NO: 5017806 - DNA, 21 bp, Homo sapiens
gctctttgttttgtgtctctt

SEQ ID NO: 5017807 - DNA, 22 bp, Homo sapiens
gctgaaggactgtgacaggcag

SEQ ID NO: 5017808 - DNA, 15 bp, Homo sapiens
gctgacgtgtgaggg

SEQ ID NO: 5017809 - DNA, 12 bp, Homo sapiens
gctgagcaggcc

SEQ ID NO: 5017810 - DNA, 20 bp, Homo sapiens
gctgcactatcacgagcctt

SEQ ID NO: 5017811 - DNA, 14 bp, Homo sapiens
gctgccccagccag

SEQ ID NO: 5017812 - DNA, 24 bp, Homo sapiens
gctgccgacttggagactcctggt

SEQ ID NO: 5017813 - DNA, 22 bp, Homo sapiens
gctgccgagacagaccctctgc

SEQ ID NO: 5017814 - DNA, 17 bp, Homo sapiens
gctgccggggcagcccc

SEQ ID NO: 5017815 - DNA, 22 bp, Homo sapiens
gctgctaccgttgacttccagg

SEQ ID NO: 5017816 - DNA, 16 bp, Homo sapiens
gctgctccccaggcca

SEQ ID NO: 5017817 - DNA, 17 bp, Homo sapiens
gctgctccccaggccac

SEQ ID NO: 5017818 - DNA, 12 bp, Homo sapiens
gctgctgctgct

SEQ ID NO: 5017819 - DNA, 16 bp, Homo sapiens
gctgctgtccctcccc

SEQ ID NO: 5017820 - DNA, 18 bp, Homo sapiens
gctgctgtccctccccct

SEQ ID NO: 5017821 - DNA, 23 bp, Homo sapiens
gctgctgtccctcccccttgtcc

SEQ ID NO: 5017822 - DNA, 14 bp, Homo sapiens
gctgcttcccagag

SEQ ID NO: 5017823 - DNA, 13 bp, Homo sapiens
gctggccgggacc

SEQ ID NO: 5017824 - DNA, 13 bp, Homo sapiens
gctggctgcggcc

SEQ ID NO: 5017825 - DNA, 22 bp, Homo sapiens
gctgggaattacaggcgtgagc

SEQ ID NO: 5017826 - DNA, 20 bp, Homo sapiens
gctgggagaccctccccaca

SEQ ID NO: 5017827 - DNA, 18 bp, Homo sapiens
gctgggagtagttgtctt

SEQ ID NO: 5017828 - DNA, 13 bp, Homo sapiens
gctgggcccctgc

SEQ ID NO: 5017829 - DNA, 17 bp, Homo sapiens
gctgggcccctgcacag

SEQ ID NO: 5017830 - DNA, 16 bp, Homo sapiens
gctggggacctggtac

SEQ ID NO: 5017831 - DNA, 17 bp, Homo sapiens
gctggggccggggctga

SEQ ID NO: 5017832 - DNA, 17 bp, Homo sapiens
gctgggtggcccctgtc

SEQ ID NO: 5017833 - DNA, 15 bp, Homo sapiens
gctggtagagacccc

SEQ ID NO: 5017834 - DNA, 18 bp, Homo sapiens
gctggtagagacccccag

SEQ ID NO: 5017835 - DNA, 19 bp, Homo sapiens
gctggtagagacccccagg

SEQ ID NO: 5017836 - DNA, 16 bp, Homo sapiens
gctgtccctccccctt

SEQ ID NO: 5017837 - DNA, 13 bp, Homo sapiens
gctgtctggccag

SEQ ID NO: 5017838 - DNA, 17 bp, Homo sapiens
gctgtctggccaggcct

SEQ ID NO: 5017839 - DNA, 21 bp, Homo sapiens
gctgtggggctaggggctggg

SEQ ID NO: 5017840 - DNA, 18 bp, Homo sapiens
gctgtgtaagatttgttt

SEQ ID NO: 5017841 - DNA, 19 bp, Homo sapiens
gctgtgtctgccaaacaca

SEQ ID NO: 5017842 - DNA, 16 bp, Homo sapiens
gctgttggtcctctct

SEQ ID NO: 5017843 - DNA, 22 bp, Homo sapiens
gctgttggtcctctctctgtgg

SEQ ID NO: 5017844 - DNA, 19 bp, Homo sapiens
gctgttttgttatataatt

SEQ ID NO: 5017845 - DNA, 23 bp, Homo sapiens
gctgttttgttatataatttaga

SEQ ID NO: 5017846 - DNA, 19 bp, Homo sapiens
gctgttttgttgacattct

SEQ ID NO: 5017847 - DNA, 12 bp, Homo sapiens
gcttaaaataca

SEQ ID NO: 5017848 - DNA, 18 bp, Homo sapiens
gcttaaaatacaagactg

SEQ ID NO: 5017849 - DNA, 19 bp, Homo sapiens
gcttaagtgagcagaacag

SEQ ID NO: 5017850 - DNA, 15 bp, Homo sapiens
gcttatacccagtga

SEQ ID NO: 5017851 - DNA, 22 bp, Homo sapiens
gcttatacgaaataattgttgt

SEQ ID NO: 5017852 - DNA, 23 bp, Homo sapiens
gcttatacgaaataattgttgtt

SEQ ID NO: 5017853 - DNA, 14 bp, Homo sapiens
gcttatttaataaa

SEQ ID NO: 5017854 - DNA, 12 bp, Homo sapiens
gcttccaggctg

SEQ ID NO: 5017855 - DNA, 19 bp, Homo sapiens
gcttctaagtaaatacaat

SEQ ID NO: 5017856 - DNA, 15 bp, Homo sapiens
gcttggatcctgggc

SEQ ID NO: 5017857 - DNA, 16 bp, Homo sapiens
gcttgtgacagtgcct

SEQ ID NO: 5017858 - DNA, 15 bp, Homo sapiens
gcttgtttcctagca

SEQ ID NO: 5017859 - DNA, 23 bp, Homo sapiens
gcttgtttcctagcacacacttt

SEQ ID NO: 5017860 - DNA, 13 bp, Homo sapiens
gctttaatataaa

SEQ ID NO: 5017861 - DNA, 17 bp, Homo sapiens
gctttaatataaatgca

SEQ ID NO: 5017862 - DNA, 19 bp, Homo sapiens
gctttaatataaatgcaaa

SEQ ID NO: 5017863 - DNA, 20 bp, Homo sapiens
gctttaatatcatcagtatt

SEQ ID NO: 5017864 - DNA, 22 bp, Homo sapiens
gctttaatatcatcagtattga

SEQ ID NO: 5017865 - DNA, 23 bp, Homo sapiens
gctttccgtttttttctttcctg

SEQ ID NO: 5017866 - DNA, 19 bp, Homo sapiens
gctttctgggatgtcacag

SEQ ID NO: 5017867 - DNA, 16 bp, Homo sapiens
gctttgagagagaaag

SEQ ID NO: 5017868 - DNA, 14 bp, Homo sapiens
gcttttcaaacaaa

SEQ ID NO: 5017869 - DNA, 17 bp, Homo sapiens
ggaaattggaagagcac

SEQ ID NO: 5017870 - DNA, 17 bp, Homo sapiens
ggaaatttagcattgta

SEQ ID NO: 5017871 - DNA, 16 bp, Homo sapiens
ggaactgggctgggcc

SEQ ID NO: 5017872 - DNA, 21 bp, Homo sapiens
ggaacttgagcgtgaatctgt

SEQ ID NO: 5017873 - DNA, 18 bp, Homo sapiens
ggaagagcccgcagggcc

SEQ ID NO: 5017874 - DNA, 13 bp, Homo sapiens
ggaagcagctttc

SEQ ID NO: 5017875 - DNA, 17 bp, Homo sapiens
ggaagctagtcttttgc

SEQ ID NO: 5017876 - DNA, 23 bp, Homo sapiens
ggaagctagtcttttgcttttgc

SEQ ID NO: 5017877 - DNA, 18 bp, Homo sapiens
ggaaggatctgctgaggc

SEQ ID NO: 5017878 - DNA, 22 bp, Homo sapiens
ggaaggatctgctgaggcccag

SEQ ID NO: 5017879 - DNA, 16 bp, Homo sapiens
ggaaggggcttctgga

SEQ ID NO: 5017880 - DNA, 19 bp, Homo sapiens
ggaatactgaacatctgag

SEQ ID NO: 5017881 - DNA, 21 bp, Homo sapiens
ggaatttgttcaagttttggg

SEQ ID NO: 5017882 - DNA, 19 bp, Homo sapiens
ggacacacatggtgagcct

SEQ ID NO: 5017883 - DNA, 16 bp, Homo sapiens
ggacacgctcagtggg

SEQ ID NO: 5017884 - DNA, 16 bp, Homo sapiens
ggacagcccctcctcc

SEQ ID NO: 5017885 - DNA, 15 bp, Homo sapiens
ggacagcgggaaaaa

SEQ ID NO: 5017886 - DNA, 16 bp, Homo sapiens
ggacaggccgcagctc

SEQ ID NO: 5017887 - DNA, 19 bp, Homo sapiens
ggacagtacctgattgtat

SEQ ID NO: 5017888 - DNA, 18 bp, Homo sapiens
ggacatcaggagactggg

SEQ ID NO: 5017889 - DNA, 14 bp, Homo sapiens
ggacatgcttagca

SEQ ID NO: 5017890 - DNA, 17 bp, Homo sapiens
tcaatgagcatgtttag

SEQ ID NO: 5017891 - DNA, 15 bp, Homo sapiens
tcacagagctttccg

SEQ ID NO: 5017892 - DNA, 15 bp, Homo sapiens
tcacagtattgctca

SEQ ID NO: 5017893 - DNA, 21 bp, Homo sapiens
tcacagttttggttgctttaa

SEQ ID NO: 5017894 - DNA, 16 bp, Homo sapiens
tcacatgaattattac

SEQ ID NO: 5017895 - DNA, 17 bp, Homo sapiens
tcacatgaattattaca

SEQ ID NO: 5017896 - DNA, 18 bp, Homo sapiens
tcacatgaattattacag

SEQ ID NO: 5017897 - DNA, 22 bp, Homo sapiens
tcacatgaattattacagtgtt

SEQ ID NO: 5017898 - DNA, 11 bp, Homo sapiens
tcacattgttt

SEQ ID NO: 5017899 - DNA, 16 bp, Homo sapiens
tcactaggcttctggt

SEQ ID NO: 5017900 - DNA, 22 bp, Homo sapiens
tcactcaagagttcagtgctca

SEQ ID NO: 5017901 - DNA, 17 bp, Homo sapiens
tcactccaccatcccca

SEQ ID NO: 5017902 - DNA, 21 bp, Homo sapiens
tcactccaccatccccacccc

SEQ ID NO: 5017903 - DNA, 16 bp, Homo sapiens
tcactccttttaaaga

SEQ ID NO: 5017904 - DNA, 21 bp, Homo sapiens
tcactgtgggaaggccagctg

SEQ ID NO: 5017905 - DNA, 14 bp, Homo sapiens
tcactttgaaaagt

SEQ ID NO: 5017906 - DNA, 16 bp, Homo sapiens
tcacttttttccacat

SEQ ID NO: 5017907 - DNA, 20 bp, Homo sapiens
tcagaacatactgattggga

SEQ ID NO: 5017908 - DNA, 21 bp, Homo sapiens
tcagagcaagttcctgagtgc

SEQ ID NO: 5017909 - DNA, 21 bp, Homo sapiens
tcagaggggaataaactgttg

SEQ ID NO: 5017910 - DNA, 19 bp, Homo sapiens
tcagatctttctccttgaa

SEQ ID NO: 5017911 - DNA, 22 bp, Homo sapiens
tcagcaaaaatctcccagtgac

SEQ ID NO: 5017912 - DNA, 18 bp, Homo sapiens
tcagcaatttcagaacca

SEQ ID NO: 5017913 - DNA, 15 bp, Homo sapiens
tcagcactgcctgct

SEQ ID NO: 5017914 - DNA, 17 bp, Homo sapiens
tcagcagaacctgcaca

SEQ ID NO: 5017915 - DNA, 15 bp, Homo sapiens
tcagcagagacgggg

SEQ ID NO: 5017916 - DNA, 19 bp, Homo sapiens
tcagcatttccacaccaag

SEQ ID NO: 5017917 - DNA, 11 bp, Homo sapiens
tcagcccagct

SEQ ID NO: 5017918 - DNA, 17 bp, Homo sapiens
tcagctctggtccaggc

SEQ ID NO: 5017919 - DNA, 16 bp, Homo sapiens
tcagtaccctctcagc

SEQ ID NO: 5017920 - DNA, 19 bp, Homo sapiens
tcagtaccctctcagctcc

SEQ ID NO: 5017921 - DNA, 13 bp, Homo sapiens
tcagtatgaatta

SEQ ID NO: 5017922 - DNA, 19 bp, Homo sapiens
tcagtattgaagcatttta

SEQ ID NO: 5017923 - DNA, 13 bp, Homo sapiens
tcagtgaagacta

SEQ ID NO: 5017924 - DNA, 18 bp, Homo sapiens
tcagtgtacacgtctgga

SEQ ID NO: 5017925 - DNA, 11 bp, Homo sapiens
tcagtgtcctc

SEQ ID NO: 5017926 - DNA, 16 bp, Homo sapiens
tcagttaagcctttgg

SEQ ID NO: 5017927 - DNA, 15 bp, Homo sapiens
tcataggtctgaaat

SEQ ID NO: 5017928 - DNA, 16 bp, Homo sapiens
tcatcagtattgaagc

SEQ ID NO: 5017929 - DNA, 21 bp, Homo sapiens
tcatcagtattgaagcatttt

SEQ ID NO: 5017930 - DNA, 23 bp, Homo sapiens
tcatcagtattgaagcattttat

SEQ ID NO: 5017931 - DNA, 20 bp, Homo sapiens
tcatccaccccatccctccc

SEQ ID NO: 5017932 - DNA, 18 bp, Homo sapiens
tcatcttcagttgtctct

SEQ ID NO: 5017933 - DNA, 12 bp, Homo sapiens
tcatgccagcta

SEQ ID NO: 5017934 - DNA, 14 bp, Homo sapiens
tcatgcccagctct

SEQ ID NO: 5017935 - DNA, 16 bp, Homo sapiens
tcatgcccagctctct

SEQ ID NO: 5017936 - DNA, 13 bp, Homo sapiens
tcatggcccctct

SEQ ID NO: 5017937 - DNA, 14 bp, Homo sapiens
tcatggcccctctg

SEQ ID NO: 5017938 - DNA, 18 bp, Homo sapiens
tcatggtggccacggcca

SEQ ID NO: 5017939 - DNA, 15 bp, Homo sapiens
tcatgttttttcctt

SEQ ID NO: 5017940 - DNA, 22 bp, Homo sapiens
tcattatttatgtattgtgcaa

SEQ ID NO: 5017941 - DNA, 15 bp, Homo sapiens
tcattgtatgttatt

SEQ ID NO: 5017942 - DNA, 13 bp, Homo sapiens
tcatttgttcatt

SEQ ID NO: 5017943 - DNA, 22 bp, Homo sapiens
tcattttattttcatgcttttt

SEQ ID NO: 5017944 - DNA, 19 bp, Homo sapiens
tcattttgacaaagtgcct

SEQ ID NO: 5017945 - DNA, 22 bp, Homo sapiens
tccaaaaacattttatttttaa

SEQ ID NO: 5017946 - DNA, 14 bp, Homo sapiens
tccaaaacatttct

SEQ ID NO: 5017947 - DNA, 20 bp, Homo sapiens
tccaaaacatttctggacag

SEQ ID NO: 5017948 - DNA, 20 bp, Homo sapiens
tccaaagctttattaccagt

SEQ ID NO: 5017949 - DNA, 17 bp, Homo sapiens
tccacaccaagcagcaa

SEQ ID NO: 5017950 - DNA, 17 bp, Homo sapiens
gccacctctttaaaaac

SEQ ID NO: 5017951 - DNA, 15 bp, Homo sapiens
gccactgccccccga

SEQ ID NO: 5017952 - DNA, 22 bp, Homo sapiens
gccactgccccccgaggctgct

SEQ ID NO: 5017953 - DNA, 23 bp, Homo sapiens
gccactgccccccgaggctgcta

SEQ ID NO: 5017954 - DNA, 21 bp, Homo sapiens
gccagatgcacatccctggaa

SEQ ID NO: 5017955 - DNA, 13 bp, Homo sapiens
gccagctgccgca

SEQ ID NO: 5017956 - DNA, 17 bp, Homo sapiens
gccagctgccgcaccag

SEQ ID NO: 5017957 - DNA, 19 bp, Homo sapiens
gccagctgccgcaccagcc

SEQ ID NO: 5017958 - DNA, 18 bp, Homo sapiens
gccaggagcacggctctg

SEQ ID NO: 5017959 - DNA, 21 bp, Homo sapiens
gccaggagcacggctctgtcc

SEQ ID NO: 5017960 - DNA, 19 bp, Homo sapiens
gccaggcattggctcagcc

SEQ ID NO: 5017961 - DNA, 17 bp, Homo sapiens
gccaggcctcttggcag

SEQ ID NO: 5017962 - DNA, 22 bp, Homo sapiens
gccagtctcactgtgggaaggc

SEQ ID NO: 5017963 - DNA, 13 bp, Homo sapiens
gccagtctcagat

SEQ ID NO: 5017964 - DNA, 18 bp, Homo sapiens
gccatccctttttttaca

SEQ ID NO: 5017965 - DNA, 12 bp, Homo sapiens
gccatctgctcc

SEQ ID NO: 5017966 - DNA, 14 bp, Homo sapiens
gccatgcagacctc

SEQ ID NO: 5017967 - DNA, 23 bp, Homo sapiens
gccatgcagacctcatgcccagc

SEQ ID NO: 5017968 - DNA, 21 bp, Homo sapiens
gccatgcaggaggtggagaaa

SEQ ID NO: 5017969 - DNA, 14 bp, Homo sapiens
gcccacagtctttc

SEQ ID NO: 5017970 - DNA, 17 bp, Homo sapiens
gcccagctctctgacgc

SEQ ID NO: 5017971 - DNA, 15 bp, Homo sapiens
gcccagtgccactgc

SEQ ID NO: 5017972 - DNA, 21 bp, Homo sapiens
gccccacatgtggccatggcc

SEQ ID NO: 5017973 - DNA, 11 bp, Homo sapiens
gccccagccag

SEQ ID NO: 5017974 - DNA, 17 bp, Homo sapiens
gcccccatttcacccat

SEQ ID NO: 5017975 - DNA, 22 bp, Homo sapiens
gccccccgcacagccacccgtg

SEQ ID NO: 5017976 - DNA, 14 bp, Homo sapiens
gcccccgcctgcca

SEQ ID NO: 5017977 - DNA, 16 bp, Homo sapiens
gcccccgcctgccacc

SEQ ID NO: 5017978 - DNA, 20 bp, Homo sapiens
gccccctccccccagactct

SEQ ID NO: 5017979 - DNA, 18 bp, Homo sapiens
gccccgcctgcctgccac

SEQ ID NO: 5017980 - DNA, 18 bp, Homo sapiens
gcccctcccacagcgctg

SEQ ID NO: 5017981 - DNA, 15 bp, Homo sapiens
gcccctgcacaggca

SEQ ID NO: 5017982 - DNA, 18 bp, Homo sapiens
gcccctgctgtctctctg

SEQ ID NO: 5017983 - DNA, 19 bp, Homo sapiens
gcccctgctgtctctctgg

SEQ ID NO: 5017984 - DNA, 18 bp, Homo sapiens
gcccctggccccgcctgc

SEQ ID NO: 5017985 - DNA, 19 bp, Homo sapiens
gcccctggccccgcctgcc

SEQ ID NO: 5017986 - DNA, 16 bp, Homo sapiens
gcccctgtctcggggc

SEQ ID NO: 5017987 - DNA, 19 bp, Homo sapiens
gcccgcaggaactgggctg

SEQ ID NO: 5017988 - DNA, 19 bp, Homo sapiens
gcccgcagggccatgcaga

SEQ ID NO: 5017989 - DNA, 15 bp, Homo sapiens
gcccgctgagtgggg

SEQ ID NO: 5017990 - DNA, 14 bp, Homo sapiens
gcccggccacaccc

SEQ ID NO: 5017991 - DNA, 22 bp, Homo sapiens
gccctcatggcccctctgacct

SEQ ID NO: 5017992 - DNA, 21 bp, Homo sapiens
gccctggcagggtcatcctgt

SEQ ID NO: 5017993 - DNA, 18 bp, Homo sapiens
gccctggctgaaggactg

SEQ ID NO: 5017994 - DNA, 19 bp, Homo sapiens
gccctggctgaaggactgt

SEQ ID NO: 5017995 - DNA, 16 bp, Homo sapiens
gccctggtcctggcct

SEQ ID NO: 5017996 - DNA, 22 bp, Homo sapiens
gccctgtcctggtggtattttc

SEQ ID NO: 5017997 - DNA, 19 bp, Homo sapiens
gcccttatgcccggcgccg

SEQ ID NO: 5017998 - DNA, 15 bp, Homo sapiens
gcccttcctctttgg

SEQ ID NO: 5017999 - DNA, 12 bp, Homo sapiens
gccgcaccagcc

SEQ ID NO: 5018000 - DNA, 19 bp, Homo sapiens
gccgcacgcctctccctgc

SEQ ID NO: 5018001 - DNA, 16 bp, Homo sapiens
gccgcctcccacggca

SEQ ID NO: 5018002 - DNA, 22 bp, Homo sapiens
gccggctatgaaagggagcgag

SEQ ID NO: 5018003 - DNA, 16 bp, Homo sapiens
gccggtgggaccctgt

SEQ ID NO: 5018004 - DNA, 20 bp, Homo sapiens
gccggtgggaccctgtccgg

SEQ ID NO: 5018005 - DNA, 12 bp, Homo sapiens
gcctaaggccct

SEQ ID NO: 5018006 - DNA, 15 bp, Homo sapiens
gcctagccctgggac

SEQ ID NO: 5018007 - DNA, 15 bp, Homo sapiens
gcctcagcctactcc

SEQ ID NO: 5018008 - DNA, 14 bp, Homo sapiens
gcctcccacggcac

SEQ ID NO: 5018009 - DNA, 17 bp, Homo sapiens
gcctcctcatcccgtgt

SEQ ID NO: 5018010 - DNA, 24 bp, Homo sapiens
gcctctccctgcactccctcctgg

SEQ ID NO: 5018011 - DNA, 18 bp, Homo sapiens
gcctctgctgatcctccc

SEQ ID NO: 5018012 - DNA, 14 bp, Homo sapiens
gcctgccctggtga

SEQ ID NO: 5018013 - DNA, 13 bp, Homo sapiens
gcctgcctggcag

SEQ ID NO: 5018014 - DNA, 16 bp, Homo sapiens
gcctgcctggcaggct

SEQ ID NO: 5018015 - DNA, 12 bp, Homo sapiens
gcctgctggctg

SEQ ID NO: 5018016 - DNA, 18 bp, Homo sapiens
gcctgctggctgcggccc

SEQ ID NO: 5018017 - DNA, 21 bp, Homo sapiens
gcctgctggctgcggccccct

SEQ ID NO: 5018018 - DNA, 20 bp, Homo sapiens
gcctgctgttggtcctctct

SEQ ID NO: 5018019 - DNA, 23 bp, Homo sapiens
gcctggctccaaaccctcgaggc

SEQ ID NO: 5018020 - DNA, 23 bp, Homo sapiens
gcctggggctccgaaattccaag

SEQ ID NO: 5018021 - DNA, 21 bp, Homo sapiens
gcctgggggacccctggctct

SEQ ID NO: 5018022 - DNA, 21 bp, Homo sapiens
gcctgtccaccctgccaagac

SEQ ID NO: 5018023 - DNA, 12 bp, Homo sapiens
gcctgtgcctgc

SEQ ID NO: 5018024 - DNA, 14 bp, Homo sapiens
gcctgtgctgtgac

SEQ ID NO: 5018025 - DNA, 22 bp, Homo sapiens
gcctgtttggcgtttcccagag

SEQ ID NO: 5018026 - DNA, 17 bp, Homo sapiens
gccttctctgcccacag

SEQ ID NO: 5018027 - DNA, 21 bp, Homo sapiens
gcgagcccctcggctctggag

SEQ ID NO: 5018028 - DNA, 19 bp, Homo sapiens
gcgaggcccttcctctttg

SEQ ID NO: 5018029 - DNA, 15 bp, Homo sapiens
gcgatcccacacagg

SEQ ID NO: 5018030 - DNA, 20 bp, Homo sapiens
gcgatcccacacaggctggc

SEQ ID NO: 5018031 - DNA, 16 bp, Homo sapiens
gcgcctgtgatgctgg

SEQ ID NO: 5018032 - DNA, 21 bp, Homo sapiens
gcgctgtttttgttgtgtgtg

SEQ ID NO: 5018033 - DNA, 20 bp, Homo sapiens
gcggccccccgcacagccac

SEQ ID NO: 5018034 - DNA, 22 bp, Homo sapiens
gcggccccccgcacagccaccc

SEQ ID NO: 5018035 - DNA, 21 bp, Homo sapiens
gcggctggggtcccagcagct

SEQ ID NO: 5018036 - DNA, 18 bp, Homo sapiens
gcgggcaggttctgcctg

SEQ ID NO: 5018037 - DNA, 19 bp, Homo sapiens
gcgggcggctgggtctgtg

SEQ ID NO: 5018038 - DNA, 14 bp, Homo sapiens
gcggtgggggagga

SEQ ID NO: 5018039 - DNA, 21 bp, Homo sapiens
gcggtgtctctcctgcccctt

SEQ ID NO: 5018040 - DNA, 21 bp, Homo sapiens
gcgtcctgtccacacccagct

SEQ ID NO: 5018041 - DNA, 13 bp, Homo sapiens
gcgtctccagtca

SEQ ID NO: 5018042 - DNA, 13 bp, Homo sapiens
ccaagcctgctgg

SEQ ID NO: 5018043 - DNA, 17 bp, Homo sapiens
ccaagcggtgtctctcc

SEQ ID NO: 5018044 - DNA, 13 bp, Homo sapiens
ccaagtcttctcc

SEQ ID NO: 5018045 - DNA, 22 bp, Homo sapiens
ccaattattttcatccttgtct

SEQ ID NO: 5018046 - DNA, 20 bp, Homo sapiens
ccaatttggtaaaaatgctg

SEQ ID NO: 5018047 - DNA, 22 bp, Homo sapiens
ccacaaatgggaaaaccagact

SEQ ID NO: 5018048 - DNA, 14 bp, Homo sapiens
ccacaccaagcagc

SEQ ID NO: 5018049 - DNA, 14 bp, Homo sapiens
ccacacccagcggc

SEQ ID NO: 5018050 - DNA, 12 bp, Homo sapiens
ccacactccagc

SEQ ID NO: 5018051 - DNA, 22 bp, Homo sapiens
ccacaggaagcctgcagtcctg

SEQ ID NO: 5018052 - DNA, 19 bp, Homo sapiens
ccacaggcttctgagcagc

SEQ ID NO: 5018053 - DNA, 14 bp, Homo sapiens
ccacagtgccaccc

SEQ ID NO: 5018054 - DNA, 14 bp, Homo sapiens
ccacattaaagaag

SEQ ID NO: 5018055 - DNA, 20 bp, Homo sapiens
ccacattaaagaagacctga

SEQ ID NO: 5018056 - DNA, 14 bp, Homo sapiens
ccaccatccccacc

SEQ ID NO: 5018057 - DNA, 12 bp, Homo sapiens
ccacccaagcct

SEQ ID NO: 5018058 - DNA, 11 bp, Homo sapiens
ccaccccaccc

SEQ ID NO: 5018059 - DNA, 13 bp, Homo sapiens
ccacccccagctc

SEQ ID NO: 5018060 - DNA, 21 bp, Homo sapiens
ccaccctgccaagactcctca

SEQ ID NO: 5018061 - DNA, 18 bp, Homo sapiens
ccaccctgcctctaccca

SEQ ID NO: 5018062 - DNA, 21 bp, Homo sapiens
ccaccggaggtcactccacca

SEQ ID NO: 5018063 - DNA, 17 bp, Homo sapiens
ccacctgttttctgaaa

SEQ ID NO: 5018064 - DNA, 14 bp, Homo sapiens
ccaccttgtctgct

SEQ ID NO: 5018065 - DNA, 14 bp, Homo sapiens
ccacggccacagtc

SEQ ID NO: 5018066 - DNA, 17 bp, Homo sapiens
ccacggtggtcactgga

SEQ ID NO: 5018067 - DNA, 17 bp, Homo sapiens
ccactaaccttgcctgg

SEQ ID NO: 5018068 - DNA, 21 bp, Homo sapiens
ccactaaccttgcctggtaca

SEQ ID NO: 5018069 - DNA, 11 bp, Homo sapiens
ccactctgtaa

SEQ ID NO: 5018070 - DNA, 12 bp, Homo sapiens
ccactctgtaat

SEQ ID NO: 5018071 - DNA, 19 bp, Homo sapiens
ccactgccccccgaggctg

SEQ ID NO: 5018072 - DNA, 13 bp, Homo sapiens
ccactgtggtggc

SEQ ID NO: 5018073 - DNA, 15 bp, Homo sapiens
ccacttgtccgctgg

SEQ ID NO: 5018074 - DNA, 16 bp, Homo sapiens
ccagaatgctttagga

SEQ ID NO: 5018075 - DNA, 13 bp, Homo sapiens
ccagacgatgtct

SEQ ID NO: 5018076 - DNA, 17 bp, Homo sapiens
ccagactctttttttga

SEQ ID NO: 5018077 - DNA, 21 bp, Homo sapiens
ccagagagcctggtgctgctg

SEQ ID NO: 5018078 - DNA, 15 bp, Homo sapiens
ccagagccttaataa

SEQ ID NO: 5018079 - DNA, 15 bp, Homo sapiens
ccagagctgccgact

SEQ ID NO: 5018080 - DNA, 11 bp, Homo sapiens
ccagaggtgga

SEQ ID NO: 5018081 - DNA, 17 bp, Homo sapiens
ccagatggactccagcc

SEQ ID NO: 5018082 - DNA, 12 bp, Homo sapiens
ccagattctgat

SEQ ID NO: 5018083 - DNA, 15 bp, Homo sapiens
ccagattctgatgca

SEQ ID NO: 5018084 - DNA, 10 bp, Homo sapiens
ccagcagctg

SEQ ID NO: 5018085 - DNA, 20 bp, Homo sapiens
ccagcggccccccgcacagc

SEQ ID NO: 5018086 - DNA, 22 bp, Homo sapiens
ccagcggccccccgcacagcca

SEQ ID NO: 5018087 - DNA, 16 bp, Homo sapiens
ccagctaccctttttc

SEQ ID NO: 5018088 - DNA, 17 bp, Homo sapiens
ccagctacttcctcctc

SEQ ID NO: 5018089 - DNA, 11 bp, Homo sapiens
ccagctcagca

SEQ ID NO: 5018090 - DNA, 12 bp, Homo sapiens
ccagctcagcac

SEQ ID NO: 5018091 - DNA, 15 bp, Homo sapiens
ccagctcagcactgc

SEQ ID NO: 5018092 - DNA, 18 bp, Homo sapiens
ccagctcccgctgtggcc

SEQ ID NO: 5018093 - DNA, 18 bp, Homo sapiens
ccagctgccccagccaga

SEQ ID NO: 5018094 - DNA, 15 bp, Homo sapiens
ccagctgccgcacca

SEQ ID NO: 5018095 - DNA, 16 bp, Homo sapiens
ccaggagcacggctct

SEQ ID NO: 5018096 - DNA, 22 bp, Homo sapiens
ccaggagcacggctctgtcccc

SEQ ID NO: 5018097 - DNA, 18 bp, Homo sapiens
ccaggcctcttggcagtc

SEQ ID NO: 5018098 - DNA, 19 bp, Homo sapiens
ccaggcctcttggcagtca

SEQ ID NO: 5018099 - DNA, 15 bp, Homo sapiens
ccaggcctgtccacc

SEQ ID NO: 5018100 - DNA, 19 bp, Homo sapiens
ccaggcctgtccaccctgc

SEQ ID NO: 5018101 - DNA, 16 bp, Homo sapiens
ccagggccccggggcc

SEQ ID NO: 5018102 - DNA, 17 bp, Homo sapiens
ccagggtagaattcaat

SEQ ID NO: 5018103 - DNA, 21 bp, Homo sapiens
ccagtcatctgtaagagcttg

SEQ ID NO: 5018104 - DNA, 14 bp, Homo sapiens
ccagtgacaacatc

SEQ ID NO: 5018105 - DNA, 17 bp, Homo sapiens
ccagtgaggatgctgca

SEQ ID NO: 5018106 - DNA, 21 bp, Homo sapiens
ccagtgaggatgctgcagtga

SEQ ID NO: 5018107 - DNA, 13 bp, Homo sapiens
ccataactgaaca

SEQ ID NO: 5018108 - DNA, 23 bp, Homo sapiens
ccataatgctaatttaaagagac

SEQ ID NO: 5018109 - DNA, 20 bp, Homo sapiens
ccatattaaattttttgttg

SEQ ID NO: 5018110 - DNA, 16 bp, Homo sapiens
ccatccctccccagtt

SEQ ID NO: 5018111 - DNA, 17 bp, Homo sapiens
ccatcctaggctgacac

SEQ ID NO: 5018112 - DNA, 11 bp, Homo sapiens
ccatctgctcc

SEQ ID NO: 5018113 - DNA, 20 bp, Homo sapiens
ccatgcaccaggactggctg

SEQ ID NO: 5018114 - DNA, 21 bp, Homo sapiens
ccatgcaccaggactggctgt

SEQ ID NO: 5018115 - DNA, 22 bp, Homo sapiens
ccatgcagacctcatgcccagc

SEQ ID NO: 5018116 - DNA, 16 bp, Homo sapiens
ccatgcagctgctccc

SEQ ID NO: 5018117 - DNA, 14 bp, Homo sapiens
ccatgtgtcctggt

SEQ ID NO: 5018118 - DNA, 23 bp, Homo sapiens
ccattaaacgatttttaaaatgt

SEQ ID NO: 5018119 - DNA, 22 bp, Homo sapiens
ccatttcatttgtgccagaatg

SEQ ID NO: 5018120 - DNA, 15 bp, Homo sapiens
ccatttgcatttgtt

SEQ ID NO: 5018121 - DNA, 15 bp, Homo sapiens
gatctccctgagatg

SEQ ID NO: 5018122 - DNA, 20 bp, Homo sapiens
gatctttctttccaaaacat

SEQ ID NO: 5018123 - DNA, 21 bp, Homo sapiens
gatgactatgcagaggcctgg

SEQ ID NO: 5018124 - DNA, 15 bp, Homo sapiens
gatgagcgccacctc

SEQ ID NO: 5018125 - DNA, 20 bp, Homo sapiens
gatgataagttcctttcctt

SEQ ID NO: 5018126 - DNA, 19 bp, Homo sapiens
gatgatactaataaactaa

SEQ ID NO: 5018127 - DNA, 16 bp, Homo sapiens
gatgatgaaaactaag

SEQ ID NO: 5018128 - DNA, 21 bp, Homo sapiens
gatgcactttgctttaatata

SEQ ID NO: 5018129 - DNA, 22 bp, Homo sapiens
gatgcactttgctttaatataa

SEQ ID NO: 5018130 - DNA, 15 bp, Homo sapiens
gatgcagcttatacg

SEQ ID NO: 5018131 - DNA, 22 bp, Homo sapiens
gatgccttttttgtagtttttt

SEQ ID NO: 5018132 - DNA, 23 bp, Homo sapiens
gatgctgggcacttcatctgatc

SEQ ID NO: 5018133 - DNA, 16 bp, Homo sapiens
gatggagccccacctt

SEQ ID NO: 5018134 - DNA, 23 bp, Homo sapiens
gatggagccccaccttgtctgct

SEQ ID NO: 5018135 - DNA, 24 bp, Homo sapiens
gatggcatttggtctcaggcagca

SEQ ID NO: 5018136 - DNA, 15 bp, Homo sapiens
gatgtccccagcaga

SEQ ID NO: 5018137 - DNA, 14 bp, Homo sapiens
gatgtcttcatacc

SEQ ID NO: 5018138 - DNA, 18 bp, Homo sapiens
gatgtcttcatacctaca

SEQ ID NO: 5018139 - DNA, 18 bp, Homo sapiens
gatgtggggctgagctgg

SEQ ID NO: 5018140 - DNA, 19 bp, Homo sapiens
gatgtggggctgagctggg

SEQ ID NO: 5018141 - DNA, 14 bp, Homo sapiens
gatgttatgaacag

SEQ ID NO: 5018142 - DNA, 23 bp, Homo sapiens
gatgttatgaacagctgtgtctg

SEQ ID NO: 5018143 - DNA, 20 bp, Homo sapiens
gattatcgttttcttaaagt

SEQ ID NO: 5018144 - DNA, 21 bp, Homo sapiens
gattatcgttttcttaaagtg

SEQ ID NO: 5018145 - DNA, 14 bp, Homo sapiens
gattccaaaaacat

SEQ ID NO: 5018146 - DNA, 23 bp, Homo sapiens
gattcccactgccgctgcccgct

SEQ ID NO: 5018147 - DNA, 15 bp, Homo sapiens
gattctgatgcatac

SEQ ID NO: 5018148 - DNA, 15 bp, Homo sapiens
gatttaaacacacag

SEQ ID NO: 5018149 - DNA, 14 bp, Homo sapiens
gatttattaaagaa

SEQ ID NO: 5018150 - DNA, 17 bp, Homo sapiens
gatttattaaagaaaaa

SEQ ID NO: 5018151 - DNA, 22 bp, Homo sapiens
gatttctttctttgcaccaaag

SEQ ID NO: 5018152 - DNA, 14 bp, Homo sapiens
gattttaccaaagc

SEQ ID NO: 5018153 - DNA, 16 bp, Homo sapiens
gattttaccaaagcat

SEQ ID NO: 5018154 - DNA, 14 bp, Homo sapiens
gattttatgcttta

SEQ ID NO: 5018155 - DNA, 12 bp, Homo sapiens
gatttttcttta

SEQ ID NO: 5018156 - DNA, 20 bp, Homo sapiens
gatttttctttacaaaacaa

SEQ ID NO: 5018157 - DNA, 16 bp, Homo sapiens
gcaaaccatttttaaa

SEQ ID NO: 5018158 - DNA, 19 bp, Homo sapiens
gcaaataacaaatgccaaa

SEQ ID NO: 5018159 - DNA, 12 bp, Homo sapiens
gcaaatgacttt

SEQ ID NO: 5018160 - DNA, 13 bp, Homo sapiens
gcaaatgactttg

SEQ ID NO: 5018161 - DNA, 20 bp, Homo sapiens
gcaaattgctagtcagggtg

SEQ ID NO: 5018162 - DNA, 13 bp, Homo sapiens
gcaacagacaagt

SEQ ID NO: 5018163 - DNA, 19 bp, Homo sapiens
gcaacagcaaatcacgacc

SEQ ID NO: 5018164 - DNA, 22 bp, Homo sapiens
gcaacgggattgaagggtcctg

SEQ ID NO: 5018165 - DNA, 18 bp, Homo sapiens
gcaactgctcagctctgg

SEQ ID NO: 5018166 - DNA, 17 bp, Homo sapiens
gcaagaaatggcgtctg

SEQ ID NO: 5018167 - DNA, 21 bp, Homo sapiens
gcaagaaatggcgtctgctct

SEQ ID NO: 5018168 - DNA, 17 bp, Homo sapiens
gcaagctggcggctggg

SEQ ID NO: 5018169 - DNA, 14 bp, Homo sapiens
gcaatgtatagtgt

SEQ ID NO: 5018170 - DNA, 17 bp, Homo sapiens
gcaatgtgtataaacaa

SEQ ID NO: 5018171 - DNA, 14 bp, Homo sapiens
gcaattcccctctg

SEQ ID NO: 5018172 - DNA, 21 bp, Homo sapiens
gcaattcccctctgctgctgt

SEQ ID NO: 5018173 - DNA, 14 bp, Homo sapiens
gcaattttgtggtt

SEQ ID NO: 5018174 - DNA, 17 bp, Homo sapiens
gcacacaggacagcggg

SEQ ID NO: 5018175 - DNA, 23 bp, Homo sapiens
gcacagctgtagtggggttctag

SEQ ID NO: 5018176 - DNA, 13 bp, Homo sapiens
gcacatccctgga

SEQ ID NO: 5018177 - DNA, 21 bp, Homo sapiens
gcaccctagttctacctcagg

SEQ ID NO: 5018178 - DNA, 17 bp, Homo sapiens
gcaccctcatacacaga

SEQ ID NO: 5018179 - DNA, 20 bp, Homo sapiens
gcaccctcatacacagaaac

SEQ ID NO: 5018180 - DNA, 20 bp, Homo sapiens
gcacggctctgtccccagcc

SEQ ID NO: 5018181 - DNA, 18 bp, Homo sapiens
gcacggtgactctgtcca

SEQ ID NO: 5018182 - DNA, 21 bp, Homo sapiens
gcactcgtgtgcaacagacaa

SEQ ID NO: 5018183 - DNA, 17 bp, Homo sapiens
gcactgaagtgcttagt

SEQ ID NO: 5018184 - DNA, 21 bp, Homo sapiens
gcactgcctgctcccatcctg

SEQ ID NO: 5018185 - DNA, 15 bp, Homo sapiens
gcactggggagcccg

SEQ ID NO: 5018186 - DNA, 22 bp, Homo sapiens
gcactggggagcccgtctcagt

SEQ ID NO: 5018187 - DNA, 23 bp, Homo sapiens
gcactggggagcccgtctcagtg

SEQ ID NO: 5018188 - DNA, 18 bp, Homo sapiens
gcactttaacacagtgtc

SEQ ID NO: 5018189 - DNA, 19 bp, Homo sapiens
gcactttgctttaatataa

SEQ ID NO: 5018190 - DNA, 21 bp, Homo sapiens
gcagaacctgcacacaggaca

SEQ ID NO: 5018191 - DNA, 20 bp, Homo sapiens
gcagacatagaagagccaag

SEQ ID NO: 5018192 - DNA, 21 bp, Homo sapiens
gcagacctcatgcccagctct

SEQ ID NO: 5018193 - DNA, 12 bp, Homo sapiens
gcagagacttgg

SEQ ID NO: 5018194 - DNA, 21 bp, Homo sapiens
gcagcagccactgcacaggag

SEQ ID NO: 5018195 - DNA, 11 bp, Homo sapiens
gcagccaccca

SEQ ID NO: 5018196 - DNA, 20 bp, Homo sapiens
gcagccacccaagcctgctg

SEQ ID NO: 5018197 - DNA, 23 bp, Homo sapiens
gcagccacccaagcctgctggct

SEQ ID NO: 5018198 - DNA, 16 bp, Homo sapiens
gcagcgaccgccccct

SEQ ID NO: 5018199 - DNA, 15 bp, Homo sapiens
gcagcgagcctgcta

SEQ ID NO: 5018200 - DNA, 13 bp, Homo sapiens
gcagcgagggcgg

SEQ ID NO: 5018201 - DNA, 22 bp, Homo sapiens
gcaggaggcccttgtcgtggga

SEQ ID NO: 5018202 - DNA, 17 bp, Homo sapiens
gcaggaggctcaggtga

SEQ ID NO: 5018203 - DNA, 14 bp, Homo sapiens
gcaggaggtggaga

SEQ ID NO: 5018204 - DNA, 15 bp, Homo sapiens
gcaggaggtggagaa

SEQ ID NO: 5018205 - DNA, 17 bp, Homo sapiens
gcaggctgtctggccag

SEQ ID NO: 5018206 - DNA, 17 bp, Homo sapiens
gcagggtggggagggag

SEQ ID NO: 5018207 - DNA, 22 bp, Homo sapiens
gcaggtatgatcggcaggacac

SEQ ID NO: 5018208 - DNA, 22 bp, Homo sapiens
gcaggttcttgttggtgcacag

SEQ ID NO: 5018209 - DNA, 16 bp, Homo sapiens
gcagtagttttcaaaa

SEQ ID NO: 5018210 - DNA, 23 bp, Homo sapiens
gcagtccccttccctccaagaag

SEQ ID NO: 5018211 - DNA, 12 bp, Homo sapiens
gcagtgtggagt

SEQ ID NO: 5018212 - DNA, 11 bp, Homo sapiens
gcagttatatt

SEQ ID NO: 5018213 - DNA, 22 bp, Homo sapiens
gcagttcccacattaaagaaga

SEQ ID NO: 5018214 - DNA, 22 bp, Homo sapiens
gcagttggccagagagcctggt

SEQ ID NO: 5018215 - DNA, 17 bp, Homo sapiens
gcagttttttttttctt

SEQ ID NO: 5018216 - DNA, 16 bp, Homo sapiens
gcataaaaacatttta

SEQ ID NO: 5018217 - DNA, 13 bp, Homo sapiens
gcatcaatacaac

SEQ ID NO: 5018218 - DNA, 15 bp, Homo sapiens
gcatcagtgccctcc

SEQ ID NO: 5018219 - DNA, 20 bp, Homo sapiens
ctgctgaggcccagtgcata

SEQ ID NO: 5018220 - DNA, 22 bp, Homo sapiens
ctgctgaggcccagtgcatatg

SEQ ID NO: 5018221 - DNA, 11 bp, Homo sapiens
ctgctgtctct

SEQ ID NO: 5018222 - DNA, 12 bp, Homo sapiens
ctgcttagcttg

SEQ ID NO: 5018223 - DNA, 15 bp, Homo sapiens
ctgcttccaggctgg

SEQ ID NO: 5018224 - DNA, 16 bp, Homo sapiens
cttttttggccatctg

SEQ ID NO: 5018225 - DNA, 16 bp, Homo sapiens
ctttttttacatttca

SEQ ID NO: 5018226 - DNA, 16 bp, Homo sapiens
ctctctgtggggctga

SEQ ID NO: 5018227 - DNA, 19 bp, Homo sapiens
ctctgaagtgaaactgctt

SEQ ID NO: 5018228 - DNA, 21 bp, Homo sapiens
ctctgacaacagacttctgaa

SEQ ID NO: 5018229 - DNA, 15 bp, Homo sapiens
ctctgacctgcactg

SEQ ID NO: 5018230 - DNA, 14 bp, Homo sapiens
ctctgacgcttgtg

SEQ ID NO: 5018231 - DNA, 18 bp, Homo sapiens
ctctgacgcttgtgacag

SEQ ID NO: 5018232 - DNA, 17 bp, Homo sapiens
ctctgatgaagaggagt

SEQ ID NO: 5018233 - DNA, 18 bp, Homo sapiens
ctctgatgcagcttatac

SEQ ID NO: 5018234 - DNA, 16 bp, Homo sapiens
ctctgcaattcccctc

SEQ ID NO: 5018235 - DNA, 17 bp, Homo sapiens
ctctgcaattcccctct

SEQ ID NO: 5018236 - DNA, 19 bp, Homo sapiens
cccaaacaccttccagctc

SEQ ID NO: 5018237 - DNA, 22 bp, Homo sapiens
cccaaacaccttccagctcctg

SEQ ID NO: 5018238 - DNA, 15 bp, Homo sapiens
cccaaccctggcacc

SEQ ID NO: 5018239 - DNA, 17 bp, Homo sapiens
cccaagcctgctggctg

SEQ ID NO: 5018240 - DNA, 16 bp, Homo sapiens
cccaagcggtgtctct

SEQ ID NO: 5018241 - DNA, 17 bp, Homo sapiens
cccaagcggtgtctctc

SEQ ID NO: 5018242 - DNA, 17 bp, Homo sapiens
cccaaggtaccatccta

SEQ ID NO: 5018243 - DNA, 14 bp, Homo sapiens
cccaagtcttctcc

SEQ ID NO: 5018244 - DNA, 22 bp, Homo sapiens
cccacaattaaaccgcatgtga

SEQ ID NO: 5018245 - DNA, 13 bp, Homo sapiens
cccacagcgctgg

SEQ ID NO: 5018246 - DNA, 22 bp, Homo sapiens
cccacccgccgcctcccacggc

SEQ ID NO: 5018247 - DNA, 23 bp, Homo sapiens
cccacctgttttctgaaacacac

SEQ ID NO: 5018248 - DNA, 16 bp, Homo sapiens
cccacttctgtgccac

SEQ ID NO: 5018249 - DNA, 15 bp, Homo sapiens
cccagcagctgccag

SEQ ID NO: 5018250 - DNA, 22 bp, Homo sapiens
cccagccagatggactccagcc

SEQ ID NO: 5018251 - DNA, 22 bp, Homo sapiens
cccagctaccctttttctccag

SEQ ID NO: 5018252 - DNA, 12 bp, Homo sapiens
cccagtgccact

SEQ ID NO: 5018253 - DNA, 14 bp, Homo sapiens
cccagtgccactgc

SEQ ID NO: 5018254 - DNA, 20 bp, Homo sapiens
cccatccagtctcccaactt

SEQ ID NO: 5018255 - DNA, 19 bp, Homo sapiens
cccatgcagctgctcccca

SEQ ID NO: 5018256 - DNA, 21 bp, Homo sapiens
cccattgttgtcaaggaagaa

SEQ ID NO: 5018257 - DNA, 16 bp, Homo sapiens
ccccacagtgccaccc

SEQ ID NO: 5018258 - DNA, 13 bp, Homo sapiens
ccccacccccagc

SEQ ID NO: 5018259 - DNA, 16 bp, Homo sapiens
ccccacccccagctca

SEQ ID NO: 5018260 - DNA, 14 bp, Homo sapiens
ccccacccctccag

SEQ ID NO: 5018261 - DNA, 17 bp, Homo sapiens
ccccagaggctgggtga

SEQ ID NO: 5018262 - DNA, 14 bp, Homo sapiens
ccccagcctctggc

SEQ ID NO: 5018263 - DNA, 15 bp, Homo sapiens
ccccagcctctggca

SEQ ID NO: 5018264 - DNA, 11 bp, Homo sapiens
ccccagcctgg

SEQ ID NO: 5018265 - DNA, 14 bp, Homo sapiens
ccccagctcaatgg

SEQ ID NO: 5018266 - DNA, 21 bp, Homo sapiens
ccccaggcctgtccaccctgc

SEQ ID NO: 5018267 - DNA, 23 bp, Homo sapiens
ccccaggcctgtccaccctgcca

SEQ ID NO: 5018268 - DNA, 18 bp, Homo sapiens
ccccatgtgtcctggttc

SEQ ID NO: 5018269 - DNA, 15 bp, Homo sapiens
cccccagactctttt

SEQ ID NO: 5018270 - DNA, 15 bp, Homo sapiens
cccccagcctctggc

SEQ ID NO: 5018271 - DNA, 16 bp, Homo sapiens
cccccgcacagccacc

SEQ ID NO: 5018272 - DNA, 12 bp, Homo sapiens
cccccgccatgc

SEQ ID NO: 5018273 - DNA, 22 bp, Homo sapiens
ccccctcaaaccctgccctcct

SEQ ID NO: 5018274 - DNA, 15 bp, Homo sapiens
ccccctccccccaga

SEQ ID NO: 5018275 - DNA, 21 bp, Homo sapiens
ccccctgccccccagcctctg

SEQ ID NO: 5018276 - DNA, 13 bp, Homo sapiens
ccccgatgtcccc

SEQ ID NO: 5018277 - DNA, 13 bp, Homo sapiens
ccccgcctgccac

SEQ ID NO: 5018278 - DNA, 14 bp, Homo sapiens
ccccgcctgccacc

SEQ ID NO: 5018279 - DNA, 20 bp, Homo sapiens
ccccgctgatggagccccac

SEQ ID NO: 5018280 - DNA, 13 bp, Homo sapiens
ccccggggcctgt

SEQ ID NO: 5018281 - DNA, 20 bp, Homo sapiens
cccctcacagtattgctcac

SEQ ID NO: 5018282 - DNA, 14 bp, Homo sapiens
cccctcacctcctc

SEQ ID NO: 5018283 - DNA, 23 bp, Homo sapiens
cccctcagcctctcccctgcctg

SEQ ID NO: 5018284 - DNA, 17 bp, Homo sapiens
cccctccccccagactc

SEQ ID NO: 5018285 - DNA, 21 bp, Homo sapiens
cccctcctctagctgtggggg

SEQ ID NO: 5018286 - DNA, 22 bp, Homo sapiens
cccctctcagaacatactgatt

SEQ ID NO: 5018287 - DNA, 16 bp, Homo sapiens
cccctctgctgctgtc

SEQ ID NO: 5018288 - DNA, 12 bp, Homo sapiens
cccctctgtctt

SEQ ID NO: 5018289 - DNA, 17 bp, Homo sapiens
cccctgctgtctctctg

SEQ ID NO: 5018290 - DNA, 19 bp, Homo sapiens
cccctgctgtctctctggg

SEQ ID NO: 5018291 - DNA, 20 bp, Homo sapiens
cccctggaggcactgaagtg

SEQ ID NO: 5018292 - DNA, 11 bp, Homo sapiens
cccctggctct

SEQ ID NO: 5018293 - DNA, 17 bp, Homo sapiens
cccctggctctgggccg

SEQ ID NO: 5018294 - DNA, 14 bp, Homo sapiens
ccccttaccactgc

SEQ ID NO: 5018295 - DNA, 10 bp, Homo sapiens
cccctttcct

SEQ ID NO: 5018296 - DNA, 23 bp, Homo sapiens
cccgaatacaaacacctggactt

SEQ ID NO: 5018297 - DNA, 13 bp, Homo sapiens
cccgagcctggct

SEQ ID NO: 5018298 - DNA, 15 bp, Homo sapiens
cccgagcctggctcc

SEQ ID NO: 5018299 - DNA, 15 bp, Homo sapiens
cccgaggagctgggc

SEQ ID NO: 5018300 - DNA, 16 bp, Homo sapiens
cccgaggagctgggcc

SEQ ID NO: 5018301 - DNA, 19 bp, Homo sapiens
cccgaggagctgggcccct

SEQ ID NO: 5018302 - DNA, 19 bp, Homo sapiens
cccgatgtcccctgcgggc

SEQ ID NO: 5018303 - DNA, 15 bp, Homo sapiens
cccgcactctgcccc

SEQ ID NO: 5018304 - DNA, 17 bp, Homo sapiens
cccgcactctgccccca

SEQ ID NO: 5018305 - DNA, 21 bp, Homo sapiens
cccgccccgttgtgagctgga

SEQ ID NO: 5018306 - DNA, 16 bp, Homo sapiens
cccgccgcctcccacg

SEQ ID NO: 5018307 - DNA, 12 bp, Homo sapiens
cccgcctgccac

SEQ ID NO: 5018308 - DNA, 13 bp, Homo sapiens
cccgcctgccacc

SEQ ID NO: 5018309 - DNA, 12 bp, Homo sapiens
cccgcctgccct

SEQ ID NO: 5018310 - DNA, 14 bp, Homo sapiens
cccgcctgccctca

SEQ ID NO: 5018311 - DNA, 14 bp, Homo sapiens
cccggcgccgggca

SEQ ID NO: 5018312 - DNA, 15 bp, Homo sapiens
cccggcgccgggcac

SEQ ID NO: 5018313 - DNA, 16 bp, Homo sapiens
cccggcgccgggcacc

SEQ ID NO: 5018314 - DNA, 14 bp, Homo sapiens
cccggtgctccctc

SEQ ID NO: 5018315 - DNA, 16 bp, Homo sapiens
cccggtgctccctctg

SEQ ID NO: 5018316 - DNA, 12 bp, Homo sapiens
cccgtctcagtg

SEQ ID NO: 5018317 - DNA, 22 bp, Homo sapiens
cccgtgcccccgcctgccaccg

SEQ ID NO: 5018318 - DNA, 15 bp, Homo sapiens
cccgtgcccgcagga

SEQ ID NO: 5018319 - DNA, 16 bp, Homo sapiens
cccgtggggtgctgcc

SEQ ID NO: 5018320 - DNA, 12 bp, Homo sapiens
cccgtttctcca

SEQ ID NO: 5018321 - DNA, 14 bp, Homo sapiens
ccctagcaaaactc

SEQ ID NO: 5018322 - DNA, 23 bp, Homo sapiens
ccctagcctgacccggaggaaag

SEQ ID NO: 5018323 - DNA, 17 bp, Homo sapiens
ccctatggaagcatatt

SEQ ID NO: 5018324 - DNA, 21 bp, Homo sapiens
ccctattttttttctgttata

SEQ ID NO: 5018325 - DNA, 18 bp, Homo sapiens
ccctcacagtattgctca

SEQ ID NO: 5018326 - DNA, 14 bp, Homo sapiens
ccctcacctcctct

SEQ ID NO: 5018327 - DNA, 16 bp, Homo sapiens
ccctcatcaaggacac

SEQ ID NO: 5018328 - DNA, 19 bp, Homo sapiens
ccctcatcaaggacacggg

SEQ ID NO: 5018329 - DNA, 19 bp, Homo sapiens
ccctccagaacacggctca

SEQ ID NO: 5018330 - DNA, 19 bp, Homo sapiens
ccctccccacagtgccacc

SEQ ID NO: 5018331 - DNA, 13 bp, Homo sapiens
ccctcccccttgt

SEQ ID NO: 5018332 - DNA, 16 bp, Homo sapiens
ccctcctcctggactc

SEQ ID NO: 5018333 - DNA, 18 bp, Homo sapiens
ccctcctctagctgtggg

SEQ ID NO: 5018334 - DNA, 22 bp, Homo sapiens
ccctcgaggcggatctttggac

SEQ ID NO: 5018335 - DNA, 13 bp, Homo sapiens
ccctcggctctgg

SEQ ID NO: 5018336 - DNA, 14 bp, Homo sapiens
ccctctcagaacat

SEQ ID NO: 5018337 - DNA, 16 bp, Homo sapiens
ccctctcggccaggca

SEQ ID NO: 5018338 - DNA, 14 bp, Homo sapiens
ccctctgacctgca

SEQ ID NO: 5018339 - DNA, 16 bp, Homo sapiens
ccctctgacctgcact

SEQ ID NO: 5018340 - DNA, 17 bp, Homo sapiens
ccctctgacctgcactg

SEQ ID NO: 5018341 - DNA, 19 bp, Homo sapiens
ccctctgacctgcactggg

SEQ ID NO: 5018342 - DNA, 12 bp, Homo sapiens
ccctctggaggg

SEQ ID NO: 5018343 - DNA, 22 bp, Homo sapiens
ccctctggaggggtgtggctcc

SEQ ID NO: 5018344 - DNA, 14 bp, Homo sapiens
ccctctgtctagga

SEQ ID NO: 5018345 - DNA, 20 bp, Homo sapiens
ccctctttggctcccctgta

SEQ ID NO: 5018346 - DNA, 14 bp, Homo sapiens
ccctgcagccagct

SEQ ID NO: 5018347 - DNA, 19 bp, Homo sapiens
ccctgccccccagcctctg

SEQ ID NO: 5018348 - DNA, 21 bp, Homo sapiens
ccctgccccccagcctctggc

SEQ ID NO: 5018349 - DNA, 15 bp, Homo sapiens
ccctgccccttgcca

SEQ ID NO: 5018350 - DNA, 22 bp, Homo sapiens
ccctgcgcctgtgatgctgggc

SEQ ID NO: 5018351 - DNA, 21 bp, Homo sapiens
ccctgcgggcgcgggcagcca

SEQ ID NO: 5018352 - DNA, 22 bp, Homo sapiens
cactcgtgtgcaacagacaagt

SEQ ID NO: 5018353 - DNA, 12 bp, Homo sapiens
cactctgccccc

SEQ ID NO: 5018354 - DNA, 13 bp, Homo sapiens
cactctgccccca

SEQ ID NO: 5018355 - DNA, 15 bp, Homo sapiens
cactctgcccccatt

SEQ ID NO: 5018356 - DNA, 15 bp, Homo sapiens
cactctgcctgcctg

SEQ ID NO: 5018357 - DNA, 13 bp, Homo sapiens
cactctgtaattg

SEQ ID NO: 5018358 - DNA, 20 bp, Homo sapiens
cactgccaggggttcttgag

SEQ ID NO: 5018359 - DNA, 21 bp, Homo sapiens
cactgccaggggttcttgagc

SEQ ID NO: 5018360 - DNA, 22 bp, Homo sapiens
cactgccccccgaggctgctag

SEQ ID NO: 5018361 - DNA, 14 bp, Homo sapiens
cactgcctgctccc

SEQ ID NO: 5018362 - DNA, 21 bp, Homo sapiens
cactgcctgctcccatcctgt

SEQ ID NO: 5018363 - DNA, 19 bp, Homo sapiens
cactggaactcagtgtgac

SEQ ID NO: 5018364 - DNA, 24 bp, Homo sapiens
cactggcccctcaaatcgtccagc

SEQ ID NO: 5018365 - DNA, 21 bp, Homo sapiens
cactggtacttagagtttctg

SEQ ID NO: 5018366 - DNA, 21 bp, Homo sapiens
cactgtgggaaggccagctgc

SEQ ID NO: 5018367 - DNA, 16 bp, Homo sapiens
cactgttcttagctca

SEQ ID NO: 5018368 - DNA, 11 bp, Homo sapiens
cacttcaaact

SEQ ID NO: 5018369 - DNA, 12 bp, Homo sapiens
cacttcaaacta

SEQ ID NO: 5018370 - DNA, 21 bp, Homo sapiens
cactttaacacagtgtctggc

SEQ ID NO: 5018371 - DNA, 22 bp, Homo sapiens
cactttataagtcattgtatgt

SEQ ID NO: 5018372 - DNA, 20 bp, Homo sapiens
cactttgaaaagttggaagg

SEQ ID NO: 5018373 - DNA, 21 bp, Homo sapiens
cactttgaaaagttggaagga

SEQ ID NO: 5018374 - DNA, 18 bp, Homo sapiens
cactttgctttaatataa

SEQ ID NO: 5018375 - DNA, 19 bp, Homo sapiens
cactttgctttaatataaa

SEQ ID NO: 5018376 - DNA, 14 bp, Homo sapiens
cacttttttccaca

SEQ ID NO: 5018377 - DNA, 17 bp, Homo sapiens
cagaaacacccctctgt

SEQ ID NO: 5018378 - DNA, 18 bp, Homo sapiens
cagaaacacccctctgtc

SEQ ID NO: 5018379 - DNA, 23 bp, Homo sapiens
cagaaacacccctctgtctagga

SEQ ID NO: 5018380 - DNA, 19 bp, Homo sapiens
cagaacacggctcacgctt

SEQ ID NO: 5018381 - DNA, 20 bp, Homo sapiens
cagaaccaattattttcatc

SEQ ID NO: 5018382 - DNA, 18 bp, Homo sapiens
cagaacctgcacacagga

SEQ ID NO: 5018383 - DNA, 18 bp, Homo sapiens
cagaaggcaaatgacttt

SEQ ID NO: 5018384 - DNA, 20 bp, Homo sapiens
cagaaggcaaatgactttgg

SEQ ID NO: 5018385 - DNA, 17 bp, Homo sapiens
cagaatacggaagagca

SEQ ID NO: 5018386 - DNA, 21 bp, Homo sapiens
cagacaagtgactgtatctgt

SEQ ID NO: 5018387 - DNA, 22 bp, Homo sapiens
cagacatagaagagccaagagt

SEQ ID NO: 5018388 - DNA, 15 bp, Homo sapiens
cagacctcatgccca

SEQ ID NO: 5018389 - DNA, 20 bp, Homo sapiens
cagagagcctggtgctgctg

SEQ ID NO: 5018390 - DNA, 16 bp, Homo sapiens
cagagataaagacctt

SEQ ID NO: 5018391 - DNA, 22 bp, Homo sapiens
cagagcgtgagctgagcaggcc

SEQ ID NO: 5018392 - DNA, 22 bp, Homo sapiens
cagagctgccgacttggagact

SEQ ID NO: 5018393 - DNA, 17 bp, Homo sapiens
cagaggcagtacctggg

SEQ ID NO: 5018394 - DNA, 20 bp, Homo sapiens
cagaggtggatgttatgaac

SEQ ID NO: 5018395 - DNA, 23 bp, Homo sapiens
cagaggtggatgttatgaacagc

SEQ ID NO: 5018396 - DNA, 12 bp, Homo sapiens
cagagtggaggc

SEQ ID NO: 5018397 - DNA, 14 bp, Homo sapiens
cagataactgttat

SEQ ID NO: 5018398 - DNA, 16 bp, Homo sapiens
catacaacagaaacca

SEQ ID NO: 5018399 - DNA, 15 bp, Homo sapiens
catacctacatgtat

SEQ ID NO: 5018400 - DNA, 15 bp, Homo sapiens
catactgattgggag

SEQ ID NO: 5018401 - DNA, 13 bp, Homo sapiens
catactggcctgg

SEQ ID NO: 5018402 - DNA, 22 bp, Homo sapiens
catactggcctggactgttttc

SEQ ID NO: 5018403 - DNA, 11 bp, Homo sapiens
catagaaaaat

SEQ ID NO: 5018404 - DNA, 16 bp, Homo sapiens
catagttaaaaaagaa

SEQ ID NO: 5018405 - DNA, 15 bp, Homo sapiens
catattctaaaacca

SEQ ID NO: 5018406 - DNA, 17 bp, Homo sapiens
catattctaaaaccatt

SEQ ID NO: 5018407 - DNA, 16 bp, Homo sapiens
catatttattgcattg

SEQ ID NO: 5018408 - DNA, 17 bp, Homo sapiens
catatttgcatatgtat

SEQ ID NO: 5018409 - DNA, 13 bp, Homo sapiens
catcaagttctcc

SEQ ID NO: 5018410 - DNA, 13 bp, Homo sapiens
catcacagttttg

SEQ ID NO: 5018411 - DNA, 14 bp, Homo sapiens
catcaggagactgg

SEQ ID NO: 5018412 - DNA, 14 bp, Homo sapiens
catcattatttatg

SEQ ID NO: 5018413 - DNA, 15 bp, Homo sapiens
catcattatttatgt

SEQ ID NO: 5018414 - DNA, 23 bp, Homo sapiens
catccaaaatcttgatcagttaa

SEQ ID NO: 5018415 - DNA, 18 bp, Homo sapiens
catccatgttccgagaag

SEQ ID NO: 5018416 - DNA, 19 bp, Homo sapiens
catccatgttccgagaaga

SEQ ID NO: 5018417 - DNA, 18 bp, Homo sapiens
catccctttttttacatt

SEQ ID NO: 5018418 - DNA, 21 bp, Homo sapiens
catccctttttttacatttca

SEQ ID NO: 5018419 - DNA, 11 bp, Homo sapiens
catcctggctg

SEQ ID NO: 5018420 - DNA, 19 bp, Homo sapiens
catcctttacgtgtttaaa

SEQ ID NO: 5018421 - DNA, 12 bp, Homo sapiens
catctctgcagt

SEQ ID NO: 5018422 - DNA, 18 bp, Homo sapiens
catctctgtactttgctt

SEQ ID NO: 5018423 - DNA, 21 bp, Homo sapiens
catctgagtcctggatgatac

SEQ ID NO: 5018424 - DNA, 22 bp, Homo sapiens
catctgctcctggatctccctg

SEQ ID NO: 5018425 - DNA, 16 bp, Homo sapiens
catctgtaaaatggag

SEQ ID NO: 5018426 - DNA, 19 bp, Homo sapiens
catctgtaagagcttgctc

SEQ ID NO: 5018427 - DNA, 23 bp, Homo sapiens
catctgtaagagcttgctccaga

SEQ ID NO: 5018428 - DNA, 15 bp, Homo sapiens
catcttcagttgtct

SEQ ID NO: 5018429 - DNA, 22 bp, Homo sapiens
catcttcagttgtctctgatgc

SEQ ID NO: 5018430 - DNA, 22 bp, Homo sapiens
catcttgccaagggtccctgtg

SEQ ID NO: 5018431 - DNA, 19 bp, Homo sapiens
catgaagcaggaggccctt

SEQ ID NO: 5018432 - DNA, 22 bp, Homo sapiens
catgacttgagaaacaaataat

SEQ ID NO: 5018433 - DNA, 20 bp, Homo sapiens
catgaggactctattcttta

SEQ ID NO: 5018434 - DNA, 14 bp, Homo sapiens
catgcagctgctcc

SEQ ID NO: 5018435 - DNA, 16 bp, Homo sapiens
catgcagctgctcccc

SEQ ID NO: 5018436 - DNA, 18 bp, Homo sapiens
catgcagctgctccccag

SEQ ID NO: 5018437 - DNA, 12 bp, Homo sapiens
catgcaggaggt

SEQ ID NO: 5018438 - DNA, 14 bp, Homo sapiens
catgcaggaggtgg

SEQ ID NO: 5018439 - DNA, 17 bp, Homo sapiens
catgcttagcagtcccc

SEQ ID NO: 5018440 - DNA, 23 bp, Homo sapiens
catgcttagcagtccccttccct

SEQ ID NO: 5018441 - DNA, 16 bp, Homo sapiens
catggaaatttaaagc

SEQ ID NO: 5018442 - DNA, 17 bp, Homo sapiens
catggaaatttaaagca

SEQ ID NO: 5018443 - DNA, 13 bp, Homo sapiens
catggcccctctg

SEQ ID NO: 5018444 - DNA, 18 bp, Homo sapiens
catggcccctctgacctg

SEQ ID NO: 5018445 - DNA, 14 bp, Homo sapiens
catggccgtgaact

SEQ ID NO: 5018446 - DNA, 16 bp, Homo sapiens
catggcctctgcaact

SEQ ID NO: 5018447 - DNA, 22 bp, Homo sapiens
catgtaaccggcatgtttccag

SEQ ID NO: 5018448 - DNA, 13 bp, Homo sapiens
catgtacttgttt

SEQ ID NO: 5018449 - DNA, 14 bp, Homo sapiens
catgtcccacccac

SEQ ID NO: 5018450 - DNA, 18 bp, Homo sapiens
catgtcccacccacccgc

SEQ ID NO: 5018451 - DNA, 18 bp, Homo sapiens
catgtgattaccctctgg

SEQ ID NO: 5018452 - DNA, 13 bp, Homo sapiens
catgtgccctcag

SEQ ID NO: 5018453 - DNA, 15 bp, Homo sapiens
catgtggccatggcc

SEQ ID NO: 5018454 - DNA, 19 bp, Homo sapiens
catgtggccatggcctctg

SEQ ID NO: 5018455 - DNA, 21 bp, Homo sapiens
catgtggccatggcctctgca

SEQ ID NO: 5018456 - DNA, 15 bp, Homo sapiens
catgtgtcctggttc

SEQ ID NO: 5018457 - DNA, 22 bp, Homo sapiens
catgtttggtgtttgtctgtgt

SEQ ID NO: 5018458 - DNA, 13 bp, Homo sapiens
cattaatctcaaa

SEQ ID NO: 5018459 - DNA, 17 bp, Homo sapiens
cattaatctcaaagaga

SEQ ID NO: 5018460 - DNA, 17 bp, Homo sapiens
cattacaagtattttta

SEQ ID NO: 5018461 - DNA, 22 bp, Homo sapiens
cattagtctcagtgaagactat

SEQ ID NO: 5018462 - DNA, 22 bp, Homo sapiens
cattatttatgtattgtgcaat

SEQ ID NO: 5018463 - DNA, 23 bp, Homo sapiens
cattcaaaatagggtatattttc

SEQ ID NO: 5018464 - DNA, 13 bp, Homo sapiens
cattcagtactta

SEQ ID NO: 5018465 - DNA, 21 bp, Homo sapiens
cattcattagtcatgtttatc

SEQ ID NO: 5018466 - DNA, 16 bp, Homo sapiens
cattccaaagctttat

SEQ ID NO: 5018467 - DNA, 23 bp, Homo sapiens
cattccagtcaaatctgggctca

SEQ ID NO: 5018468 - DNA, 12 bp, Homo sapiens
cattcccactgc

SEQ ID NO: 5018469 - DNA, 14 bp, Homo sapiens
cattcccactgcca

SEQ ID NO: 5018470 - DNA, 16 bp, Homo sapiens
cattctacacagagca

SEQ ID NO: 5018471 - DNA, 19 bp, Homo sapiens
attacaggcgtgagccacc

SEQ ID NO: 5018472 - DNA, 21 bp, Homo sapiens
attacatatttgcatatgtat

SEQ ID NO: 5018473 - DNA, 13 bp, Homo sapiens
attacttgtaaat

SEQ ID NO: 5018474 - DNA, 15 bp, Homo sapiens
attacttgtaaatat

SEQ ID NO: 5018475 - DNA, 20 bp, Homo sapiens
attagaatcaaacattttga

SEQ ID NO: 5018476 - DNA, 23 bp, Homo sapiens
attagtattgttgtccttttcat

SEQ ID NO: 5018477 - DNA, 20 bp, Homo sapiens
attatcacattaatctcaaa

SEQ ID NO: 5018478 - DNA, 13 bp, Homo sapiens
attattacagtgt

SEQ ID NO: 5018479 - DNA, 14 bp, Homo sapiens
attattacttgtaa

SEQ ID NO: 5018480 - DNA, 23 bp, Homo sapiens
attattagaatcaaacattttga

SEQ ID NO: 5018481 - DNA, 20 bp, Homo sapiens
attcaaaatagggtatattt

SEQ ID NO: 5018482 - DNA, 21 bp, Homo sapiens
attcaaattgctgcttggatt

SEQ ID NO: 5018483 - DNA, 20 bp, Homo sapiens
attcaatcagagctccagtt

SEQ ID NO: 5018484 - DNA, 16 bp, Homo sapiens
attcaccccctttcct

SEQ ID NO: 5018485 - DNA, 22 bp, Homo sapiens
attcaccccctttcctggacac

SEQ ID NO: 5018486 - DNA, 14 bp, Homo sapiens
attcagcctgtttg

SEQ ID NO: 5018487 - DNA, 22 bp, Homo sapiens
attcaggaagcagctttcccca

SEQ ID NO: 5018488 - DNA, 23 bp, Homo sapiens
attcccttcctgccagcccctgc

SEQ ID NO: 5018489 - DNA, 14 bp, Homo sapiens
attctaaaaccatt

SEQ ID NO: 5018490 - DNA, 11 bp, Homo sapiens
attctcattgg

SEQ ID NO: 5018491 - DNA, 14 bp, Homo sapiens
attctccctgggcc

SEQ ID NO: 5018492 - DNA, 19 bp, Homo sapiens
attctcgtgagtcatttaa

SEQ ID NO: 5018493 - DNA, 19 bp, Homo sapiens
attctgaatgcttctaagt

SEQ ID NO: 5018494 - DNA, 12 bp, Homo sapiens
attcttgtgctt

SEQ ID NO: 5018495 - DNA, 19 bp, Homo sapiens
attctttccatttgcattt

SEQ ID NO: 5018496 - DNA, 22 bp, Homo sapiens
attgaagcattttataaatcgc

SEQ ID NO: 5018497 - DNA, 19 bp, Homo sapiens
attgagcacctgcaggcgt

SEQ ID NO: 5018498 - DNA, 13 bp, Homo sapiens
attgctgcttgga

SEQ ID NO: 5018499 - DNA, 16 bp, Homo sapiens
attggaaatttagcat

SEQ ID NO: 5018500 - DNA, 22 bp, Homo sapiens
attggaactctactcaacccat

SEQ ID NO: 5018501 - DNA, 23 bp, Homo sapiens
attggaactctactcaacccatt

SEQ ID NO: 5018502 - DNA, 21 bp, Homo sapiens
attggcatggaaatttaaagc

SEQ ID NO: 5018503 - DNA, 22 bp, Homo sapiens
attggcatggaaatttaaagca

SEQ ID NO: 5018504 - DNA, 23 bp, Homo sapiens
attggctgatctatgcctttcaa

SEQ ID NO: 5018505 - DNA, 20 bp, Homo sapiens
attgtagcgtctttcttttt

SEQ ID NO: 5018506 - DNA, 16 bp, Homo sapiens
attgtgcaatgtgtat

SEQ ID NO: 5018507 - DNA, 17 bp, Homo sapiens
attgtgcaatgtgtata

SEQ ID NO: 5018508 - DNA, 16 bp, Homo sapiens
attgttgtccttttca

SEQ ID NO: 5018509 - DNA, 17 bp, Homo sapiens
attgttgtccttttcat

SEQ ID NO: 5018510 - DNA, 12 bp, Homo sapiens
attgtttgctgc

SEQ ID NO: 5018511 - DNA, 15 bp, Homo sapiens
atttaaacacacaga

SEQ ID NO: 5018512 - DNA, 15 bp, Homo sapiens
atttaaagcctcctc

SEQ ID NO: 5018513 - DNA, 24 bp, Homo sapiens
atttaaatgtgtacaatgtacaca

SEQ ID NO: 5018514 - DNA, 18 bp, Homo sapiens
atttaacccccctgtaca

SEQ ID NO: 5018515 - DNA, 11 bp, Homo sapiens
atttaataaag

SEQ ID NO: 5018516 - DNA, 20 bp, Homo sapiens
atttaccctttggccccact

SEQ ID NO: 5018517 - DNA, 23 bp, Homo sapiens
atttagacttggattctttccat

SEQ ID NO: 5018518 - DNA, 22 bp, Homo sapiens
atttataatcacttttttccac

SEQ ID NO: 5018519 - DNA, 23 bp, Homo sapiens
atttataatcacttttttccaca

SEQ ID NO: 5018520 - DNA, 12 bp, Homo sapiens
atttatgtattg

SEQ ID NO: 5018521 - DNA, 18 bp, Homo sapiens
atttatgtattgtgcaat

SEQ ID NO: 5018522 - DNA, 17 bp, Homo sapiens
atttattaaagaaaaaa

SEQ ID NO: 5018523 - DNA, 13 bp, Homo sapiens
atttatttgaatg

SEQ ID NO: 5018524 - DNA, 21 bp, Homo sapiens
atttatttgaatgatttttct

SEQ ID NO: 5018525 - DNA, 17 bp, Homo sapiens
atttcaattcctggccc

SEQ ID NO: 5018526 - DNA, 12 bp, Homo sapiens
atttcacttgtc

SEQ ID NO: 5018527 - DNA, 20 bp, Homo sapiens
ataaccaattcctcatttgt

SEQ ID NO: 5018528 - DNA, 14 bp, Homo sapiens
ataactgaacatcc

SEQ ID NO: 5018529 - DNA, 22 bp, Homo sapiens
ataactgttatttataatcact

SEQ ID NO: 5018530 - DNA, 16 bp, Homo sapiens
ataagttcctttcctt

SEQ ID NO: 5018531 - DNA, 23 bp, Homo sapiens
ataataaattccctggcctttca

SEQ ID NO: 5018532 - DNA, 18 bp, Homo sapiens
ataattgttgttctgtta

SEQ ID NO: 5018533 - DNA, 18 bp, Homo sapiens
atacaacagaaaccagaa

SEQ ID NO: 5018534 - DNA, 21 bp, Homo sapiens
atacagtttatttttaaagat

SEQ ID NO: 5018535 - DNA, 17 bp, Homo sapiens
ataccactctgtaattg

SEQ ID NO: 5018536 - DNA, 18 bp, Homo sapiens
ataccactctgtaattgc

SEQ ID NO: 5018537 - DNA, 22 bp, Homo sapiens
atactaataaactaataattgc

SEQ ID NO: 5018538 - DNA, 20 bp, Homo sapiens
atactgaacatctgagtcct

SEQ ID NO: 5018539 - DNA, 22 bp, Homo sapiens
atactgaacatctgagtcctgg

SEQ ID NO: 5018540 - DNA, 15 bp, Homo sapiens
atactggcctggact

SEQ ID NO: 5018541 - DNA, 13 bp, Homo sapiens
atacttcccaaag

SEQ ID NO: 5018542 - DNA, 15 bp, Homo sapiens
atacttcgacactgt

SEQ ID NO: 5018543 - DNA, 19 bp, Homo sapiens
atacttcgacactgttctt

SEQ ID NO: 5018544 - DNA, 23 bp, Homo sapiens
atagaaaaattcagcaaaccatt

SEQ ID NO: 5018545 - DNA, 20 bp, Homo sapiens
atagacaatttgcacatctt

SEQ ID NO: 5018546 - DNA, 12 bp, Homo sapiens
atagacttggga

SEQ ID NO: 5018547 - DNA, 14 bp, Homo sapiens
atagacttgggatg

SEQ ID NO: 5018548 - DNA, 19 bp, Homo sapiens
atagagtgggacagttcct

SEQ ID NO: 5018549 - DNA, 14 bp, Homo sapiens
atagatgtcttttc

SEQ ID NO: 5018550 - DNA, 13 bp, Homo sapiens
atagccactaacc

SEQ ID NO: 5018551 - DNA, 15 bp, Homo sapiens
atagcccacttacat

SEQ ID NO: 5018552 - DNA, 18 bp, Homo sapiens
atagccctgtcctggtgg

SEQ ID NO: 5018553 - DNA, 23 bp, Homo sapiens
atagccctgtcctggtggtattt

SEQ ID NO: 5018554 - DNA, 14 bp, Homo sapiens
atagcgttcttgta

SEQ ID NO: 5018555 - DNA, 15 bp, Homo sapiens
atagcgttcttgtaa

SEQ ID NO: 5018556 - DNA, 20 bp, Homo sapiens
atagctccccgcttctgcct

SEQ ID NO: 5018557 - DNA, 18 bp, Homo sapiens
atagcttatgaaaagaat

SEQ ID NO: 5018558 - DNA, 15 bp, Homo sapiens
atagttaacacacta

SEQ ID NO: 5018559 - DNA, 17 bp, Homo sapiens
atagttaacacactacc

SEQ ID NO: 5018560 - DNA, 20 bp, Homo sapiens
atagttttcatccataactg

SEQ ID NO: 5018561 - DNA, 22 bp, Homo sapiens
atagttttcatccataactgaa

SEQ ID NO: 5018562 - DNA, 16 bp, Homo sapiens
atataaatatattatt

SEQ ID NO: 5018563 - DNA, 14 bp, Homo sapiens
atataaatgcaaat

SEQ ID NO: 5018564 - DNA, 17 bp, Homo sapiens
atataaatgcaaataac

SEQ ID NO: 5018565 - DNA, 17 bp, Homo sapiens
atataaatggttaaaag

SEQ ID NO: 5018566 - DNA, 22 bp, Homo sapiens
atatagttagctaataaaaagc

SEQ ID NO: 5018567 - DNA, 14 bp, Homo sapiens
atatataaatatat

SEQ ID NO: 5018568 - DNA, 14 bp, Homo sapiens
atatatgtgatgat

SEQ ID NO: 5018569 - DNA, 22 bp, Homo sapiens
atatatttgtttcatttctgca

SEQ ID NO: 5018570 - DNA, 13 bp, Homo sapiens
atatcatcagtat

SEQ ID NO: 5018571 - DNA, 17 bp, Homo sapiens
atatcatcagtattgaa

SEQ ID NO: 5018572 - DNA, 16 bp, Homo sapiens
atatgtagaaggcaca

SEQ ID NO: 5018573 - DNA, 21 bp, Homo sapiens
atatttattgcattgctggta

SEQ ID NO: 5018574 - DNA, 18 bp, Homo sapiens
aaggttctggtgtgaact

SEQ ID NO: 5018575 - DNA, 12 bp, Homo sapiens
aagtaaatacaa

SEQ ID NO: 5018576 - DNA, 13 bp, Homo sapiens
aagtatgttctaa

SEQ ID NO: 5018577 - DNA, 19 bp, Homo sapiens
aagtctctgaagtgaaact

SEQ ID NO: 5018578 - DNA, 13 bp, Homo sapiens
aagtctgtccttg

SEQ ID NO: 5018579 - DNA, 16 bp, Homo sapiens
aagtctgtccttgaag

SEQ ID NO: 5018580 - DNA, 18 bp, Homo sapiens
aagtctgtccttgaagga

SEQ ID NO: 5018581 - DNA, 21 bp, Homo sapiens
aagtctgtccttgaaggacta

SEQ ID NO: 5018582 - DNA, 13 bp, Homo sapiens
aagtctgttttat

SEQ ID NO: 5018583 - DNA, 15 bp, Homo sapiens
aagtctgttttatga

SEQ ID NO: 5018584 - DNA, 17 bp, Homo sapiens
aagtgactgtatctgtg

SEQ ID NO: 5018585 - DNA, 18 bp, Homo sapiens
aagtgactgtatctgtgt

SEQ ID NO: 5018586 - DNA, 14 bp, Homo sapiens
aagtgagcagaaca

SEQ ID NO: 5018587 - DNA, 13 bp, Homo sapiens
aagtgataagtgc

SEQ ID NO: 5018588 - DNA, 17 bp, Homo sapiens
aagtgtaaacaccatag

SEQ ID NO: 5018589 - DNA, 20 bp, Homo sapiens
aagtgttctcatgaagcagg

SEQ ID NO: 5018590 - DNA, 19 bp, Homo sapiens
aagttgagatagttttcat

SEQ ID NO: 5018591 - DNA, 13 bp, Homo sapiens
aagttggaaggat

SEQ ID NO: 5018592 - DNA, 19 bp, Homo sapiens
aagttggaaggatctgctg

SEQ ID NO: 5018593 - DNA, 15 bp, Homo sapiens
aagttgtttgagaaa

SEQ ID NO: 5018594 - DNA, 22 bp, Homo sapiens
aagttgtttgagaaattaagta

SEQ ID NO: 5018595 - DNA, 23 bp, Homo sapiens
aagttttgggtatgtttaatctg

SEQ ID NO: 5018596 - DNA, 13 bp, Homo sapiens
aataaaaagcttt

SEQ ID NO: 5018597 - DNA, 16 bp, Homo sapiens
aataaaaagcttttgt

SEQ ID NO: 5018598 - DNA, 11 bp, Homo sapiens
aataaaagcac

SEQ ID NO: 5018599 - DNA, 12 bp, Homo sapiens
aataaaagcaca

SEQ ID NO: 5018600 - DNA, 15 bp, Homo sapiens
aataaagaaaagatg

SEQ ID NO: 5018601 - DNA, 19 bp, Homo sapiens
aataaagatcatgtaaaag

SEQ ID NO: 5018602 - DNA, 17 bp, Homo sapiens
aataaattggaaatgtg

SEQ ID NO: 5018603 - DNA, 20 bp, Homo sapiens
aataaccaattcctcatttg

SEQ ID NO: 5018604 - DNA, 13 bp, Homo sapiens
aataataaagatc

SEQ ID NO: 5018605 - DNA, 21 bp, Homo sapiens
aataataaagatcatgtaaaa

SEQ ID NO: 5018606 - DNA, 14 bp, Homo sapiens
aataattgttgttc

SEQ ID NO: 5018607 - DNA, 18 bp, Homo sapiens
aataattgttgttctgtt

SEQ ID NO: 5018608 - DNA, 22 bp, Homo sapiens
aataattgttgttctgttaact

SEQ ID NO: 5018609 - DNA, 20 bp, Homo sapiens
aatacaattttttttattag

SEQ ID NO: 5018610 - DNA, 18 bp, Homo sapiens
aataccactctgtaattg

SEQ ID NO: 5018611 - DNA, 19 bp, Homo sapiens
aatacggaagagcaggtga

SEQ ID NO: 5018612 - DNA, 23 bp, Homo sapiens
aatagccactaaccttgcctggt

SEQ ID NO: 5018613 - DNA, 16 bp, Homo sapiens
aatagcgttcttgtaa

SEQ ID NO: 5018614 - DNA, 18 bp, Homo sapiens
aatagcgttcttgtaatt

SEQ ID NO: 5018615 - DNA, 19 bp, Homo sapiens
aatagcgttcttgtaattt

SEQ ID NO: 5018616 - DNA, 16 bp, Homo sapiens
aataggcattaacaca

SEQ ID NO: 5018617 - DNA, 18 bp, Homo sapiens
aatataaagacgttttat

SEQ ID NO: 5018618 - DNA, 12 bp, Homo sapiens
aatataaatgca

SEQ ID NO: 5018619 - DNA, 13 bp, Homo sapiens
aatataaatgcaa

SEQ ID NO: 5018620 - DNA, 18 bp, Homo sapiens
aatataaatgcaaataac

SEQ ID NO: 5018621 - DNA, 19 bp, Homo sapiens
aatataaatgcaaataaca

SEQ ID NO: 5018622 - DNA, 14 bp, Homo sapiens
aatataataatgat

SEQ ID NO: 5018623 - DNA, 21 bp, Homo sapiens
aatatattattacttgtaaat

SEQ ID NO: 5018624 - DNA, 18 bp, Homo sapiens
aatatcatcagtattgaa

SEQ ID NO: 5018625 - DNA, 14 bp, Homo sapiens
aatatcctgtgtaa

SEQ ID NO: 5018626 - DNA, 20 bp, Homo sapiens
aatattttcctcctgagtgc

SEQ ID NO: 5018627 - DNA, 16 bp, Homo sapiens
aatcagagctccagtt

SEQ ID NO: 5018628 - DNA, 23 bp, Homo sapiens
aatcagagctccagtttgcattt

SEQ ID NO: 5018629 - DNA, 15 bp, Homo sapiens
aatcatggtttttct

SEQ ID NO: 5018630 - DNA, 16 bp, Homo sapiens
aatctactcaaagcat

SEQ ID NO: 5018631 - DNA, 22 bp, Homo sapiens
aatgaacaagagaagcattctc

SEQ ID NO: 5018632 - DNA, 24 bp, Homo sapiens
aatgacggtaagtgttctcatgaa

SEQ ID NO: 5018633 - DNA, 17 bp, Homo sapiens
aatgatttttctttaca

SEQ ID NO: 5018634 - DNA, 13 bp, Homo sapiens
aatgcaaataaca

SEQ ID NO: 5018635 - DNA, 16 bp, Homo sapiens
aatgcaaataacaaat

SEQ ID NO: 5018636 - DNA, 16 bp, Homo sapiens
aatgccaaattaaaaa

SEQ ID NO: 5018637 - DNA, 17 bp, Homo sapiens
aatgccaaattaaaaaa

SEQ ID NO: 5018638 - DNA, 23 bp, Homo sapiens
aatgctggctatagatgtctttt

SEQ ID NO: 5018639 - DNA, 21 bp, Homo sapiens
aatgcttctaagtaaatacaa

SEQ ID NO: 5018640 - DNA, 23 bp, Homo sapiens
aatgcttctaagtaaatacaatt

SEQ ID NO: 5018641 - DNA, 23 bp, Homo sapiens
aatggcgtctgctctggtggctt

SEQ ID NO: 5018642 - DNA, 15 bp, Homo sapiens
aatgtaaggctgtgt

SEQ ID NO: 5018643 - DNA, 17 bp, Homo sapiens
aatgtaaggctgtgtaa

SEQ ID NO: 5018644 - DNA, 18 bp, Homo sapiens
aatgtaaggctgtgtaag

SEQ ID NO: 5018645 - DNA, 22 bp, Homo sapiens
aatgtaaggctgtgtaagattt

SEQ ID NO: 5018646 - DNA, 22 bp, Homo sapiens
aatgtacacactggtacttaga

SEQ ID NO: 5018647 - DNA, 14 bp, Homo sapiens
aatgtgtataaaca

SEQ ID NO: 5018648 - DNA, 14 bp, Homo sapiens
aatgtgtctttaga

SEQ ID NO: 5018649 - DNA, 17 bp, Homo sapiens
aatgtgtctttagatag

SEQ ID NO: 5018650 - DNA, 15 bp, Homo sapiens
aattaaaaaagataa

SEQ ID NO: 5018651 - DNA, 18 bp, Homo sapiens
aattaaaaaagataaaca

SEQ ID NO: 5018652 - DNA, 14 bp, Homo sapiens
aattaagtatctga

SEQ ID NO: 5018653 - DNA, 15 bp, Homo sapiens
aattaattgtcatta

SEQ ID NO: 5018654 - DNA, 23 bp, Homo sapiens
aattattacagtgtttatccttt

SEQ ID NO: 5018655 - DNA, 18 bp, Homo sapiens
aattattatttgtgtttt

SEQ ID NO: 5018656 - DNA, 13 bp, Homo sapiens
aattattttcatc

SEQ ID NO: 5018657 - DNA, 15 bp, Homo sapiens
aattcctcatttgtt

SEQ ID NO: 5018658 - DNA, 15 bp, Homo sapiens
aattgttaagatatg

SEQ ID NO: 5018659 - DNA, 12 bp, Homo sapiens
aattgttgttct

SEQ ID NO: 5018660 - DNA, 9 bp, Homo sapiens
aatttaaac

SEQ ID NO: 5018661 - DNA, 16 bp, Homo sapiens
aatttagacttggatt

SEQ ID NO: 5018662 - DNA, 20 bp, Homo sapiens
aatttagacttggattcttt

SEQ ID NO: 5018663 - DNA, 20 bp, Homo sapiens
aattttacacgcttttgtga

SEQ ID NO: 5018664 - DNA, 18 bp, Homo sapiens
aattttgtggttttcgag

SEQ ID NO: 5018665 - DNA, 22 bp, Homo sapiens
aattttttttattagtattgtt

SEQ ID NO: 5018666 - DNA, 13 bp, Homo sapiens
acaaaacaaactc

SEQ ID NO: 5018667 - DNA, 15 bp, Homo sapiens
acaaactttgcatct

SEQ ID NO: 5018668 - DNA, 16 bp, Homo sapiens
acaaaggtttaaatga

SEQ ID NO: 5018669 - DNA, 17 bp, Homo sapiens
acaaaggtttaaatgaa

SEQ ID NO: 5018670 - DNA, 22 bp, Homo sapiens
acaaaggtttaaatgaacaaga

SEQ ID NO: 5018671 - DNA, 22 bp, Homo sapiens
acaacctccattctattttaga

SEQ ID NO: 5018672 - DNA, 16 bp, Homo sapiens
acaactcactcctttt

SEQ ID NO: 5018673 - DNA, 17 bp, Homo sapiens
acaagaaaaataaagaa

SEQ ID NO: 5018674 - DNA, 23 bp, Homo sapiens
acaagaaaaataaagaaaagatg

SEQ ID NO: 5018675 - DNA, 24 bp, Homo sapiens
acaagattggtgtttttttctatg

SEQ ID NO: 5018676 - DNA, 21 bp, Homo sapiens
acaaggacagcccctcctcca

SEQ ID NO: 5018677 - DNA, 12 bp, Homo sapiens
acaagtattttt

SEQ ID NO: 5018678 - DNA, 14 bp, Homo sapiens
acaatttggcaatt

SEQ ID NO: 5018679 - DNA, 18 bp, Homo sapiens
acaatttggcaattttgt

SEQ ID NO: 5018680 - DNA, 24 bp, Homo sapiens
acaattttttttattagtattgtt

SEQ ID NO: 5018681 - DNA, 13 bp, Homo sapiens
acacaactcactc

SEQ ID NO: 5018682 - DNA, 16 bp, Homo sapiens
acacaagattggtgtt

SEQ ID NO: 5018683 - DNA, 18 bp, Homo sapiens
acacaagattggtgtttt

SEQ ID NO: 5018684 - DNA, 19 bp, Homo sapiens
acacaagattggtgttttt

SEQ ID NO: 5018685 - DNA, 21 bp, Homo sapiens
acacaagattggtgttttttt

SEQ ID NO: 5018686 - DNA, 14 bp, Homo sapiens
acacacgagcaaac

SEQ ID NO: 5018687 - DNA, 15 bp, Homo sapiens
acccccacccccagc

SEQ ID NO: 5018688 - DNA, 12 bp, Homo sapiens
acccccagctca

SEQ ID NO: 5018689 - DNA, 14 bp, Homo sapiens
acccccctgtacac

SEQ ID NO: 5018690 - DNA, 22 bp, Homo sapiens
acccccctgtacacaactcact

SEQ ID NO: 5018691 - DNA, 18 bp, Homo sapiens
accccgctgatggagccc

SEQ ID NO: 5018692 - DNA, 23 bp, Homo sapiens
accccgctgatggagccccacct

SEQ ID NO: 5018693 - DNA, 19 bp, Homo sapiens
acccggtgctccctctgtc

SEQ ID NO: 5018694 - DNA, 11 bp, Homo sapiens
accctccccac

SEQ ID NO: 5018695 - DNA, 21 bp, Homo sapiens
accctccccacagtgccaccc

SEQ ID NO: 5018696 - DNA, 11 bp, Homo sapiens
accctcctggc

SEQ ID NO: 5018697 - DNA, 13 bp, Homo sapiens
accctcctggctc

SEQ ID NO: 5018698 - DNA, 15 bp, Homo sapiens
accctctcagctcca

SEQ ID NO: 5018699 - DNA, 16 bp, Homo sapiens
accctggccgccccct

SEQ ID NO: 5018700 - DNA, 17 bp, Homo sapiens
accctggccgccccctg

SEQ ID NO: 5018701 - DNA, 20 bp, Homo sapiens
accctgtactgttctgtgtc

SEQ ID NO: 5018702 - DNA, 22 bp, Homo sapiens
accctgtactgttctgtgtctt

SEQ ID NO: 5018703 - DNA, 16 bp, Homo sapiens
accctgtccggcccag

SEQ ID NO: 5018704 - DNA, 17 bp, Homo sapiens
accctttttctccagct

SEQ ID NO: 5018705 - DNA, 19 bp, Homo sapiens
accgaatgtgtctttagat

SEQ ID NO: 5018706 - DNA, 22 bp, Homo sapiens
accgaatgtgtctttagatagc

SEQ ID NO: 5018707 - DNA, 11 bp, Homo sapiens
accgccccctc

SEQ ID NO: 5018708 - DNA, 12 bp, Homo sapiens
accgccccctcc

SEQ ID NO: 5018709 - DNA, 19 bp, Homo sapiens
accgccccctcctctagct

SEQ ID NO: 5018710 - DNA, 17 bp, Homo sapiens
acctaactcttctttca

SEQ ID NO: 5018711 - DNA, 18 bp, Homo sapiens
acctaactcttctttcat

SEQ ID NO: 5018712 - DNA, 14 bp, Homo sapiens
acctaagtctctgt

SEQ ID NO: 5018713 - DNA, 16 bp, Homo sapiens
acctaagtctctgtga

SEQ ID NO: 5018714 - DNA, 15 bp, Homo sapiens
acctacatgtatttg

SEQ ID NO: 5018715 - DNA, 22 bp, Homo sapiens
acctagctgaatgtttttctaa

SEQ ID NO: 5018716 - DNA, 16 bp, Homo sapiens
acctcaggcagctcaa

SEQ ID NO: 5018717 - DNA, 20 bp, Homo sapiens
acctcctctgtgatttcttt

SEQ ID NO: 5018718 - DNA, 18 bp, Homo sapiens
acctcggggacaccagag

SEQ ID NO: 5018719 - DNA, 17 bp, Homo sapiens
acctgagatttattaaa

SEQ ID NO: 5018720 - DNA, 19 bp, Homo sapiens
acctgagatttattaaaga

SEQ ID NO: 5018721 - DNA, 23 bp, Homo sapiens
acctgattgtattttttttttaa

SEQ ID NO: 5018722 - DNA, 15 bp, Homo sapiens
acctgcacacaggac

SEQ ID NO: 5018723 - DNA, 19 bp, Homo sapiens
acctgcacacaggacagcg

SEQ ID NO: 5018724 - DNA, 21 bp, Homo sapiens
acctgcacacaggacagcggg

SEQ ID NO: 5018725 - DNA, 18 bp, Homo sapiens
acctggtaccctcctggc

SEQ ID NO: 5018726 - DNA, 21 bp, Homo sapiens
acctgtttatgagatgctggt

SEQ ID NO: 5018727 - DNA, 19 bp, Homo sapiens
acctgttttctgaaacaca

SEQ ID NO: 5018728 - DNA, 17 bp, Homo sapiens
accttcagagccagccg

SEQ ID NO: 5018729 - DNA, 18 bp, Homo sapiens
accttgcctggtacagta

SEQ ID NO: 5018730 - DNA, 23 bp, Homo sapiens
acctttcagataactgttattta

SEQ ID NO: 5018731 - DNA, 23 bp, Homo sapiens
acgatacgctactataaagagaa

SEQ ID NO: 5018732 - DNA, 18 bp, Homo sapiens
acgatttttaaaatgtac

SEQ ID NO: 5018733 - DNA, 19 bp, Homo sapiens
acgctactataaagagaag

SEQ ID NO: 5018734 - DNA, 15 bp, Homo sapiens
acgcttgtgacagtg

SEQ ID NO: 5018735 - DNA, 14 bp, Homo sapiens
acgcttttgtgatg

SEQ ID NO: 5018736 - DNA, 19 bp, Homo sapiens
acggagcagttcagagtgg

SEQ ID NO: 5018737 - DNA, 23 bp, Homo sapiens
acggcacctcggggacaccagag

SEQ ID NO: 5018738 - DNA, 19 bp, Homo sapiens
acggctctgtccccagcct

SEQ ID NO: 5018739 - DNA, 11 bp, Homo sapiens
acgtcattcag

SEQ ID NO: 5018740 - DNA, 11 bp, Homo sapiens
acgtgtttaaa

SEQ ID NO: 5018741 - DNA, 14 bp, Homo sapiens
acgttttataagca

SEQ ID NO: 5018742 - DNA, 20 bp, Homo sapiens
acgttttataagcatcatta

SEQ ID NO: 5018743 - DNA, 21 bp, Homo sapiens
acgttttataagcatcattat

SEQ ID NO: 5018744 - DNA, 15 bp, Homo sapiens
actaaccttgcctgg

SEQ ID NO: 5018745 - DNA, 16 bp, Homo sapiens
actaaggatttttcaa

SEQ ID NO: 5018746 - DNA, 21 bp, Homo sapiens
actaaggatttttcaagagat

SEQ ID NO: 5018747 - DNA, 19 bp, Homo sapiens
actaataaactaataattg

SEQ ID NO: 5018748 - DNA, 18 bp, Homo sapiens
actacaaaggtttaaatg

SEQ ID NO: 5018749 - DNA, 23 bp, Homo sapiens
actacaaaggtttaaatgaacaa

SEQ ID NO: 5018750 - DNA, 17 bp, Homo sapiens
actacttgggagcaccg

SEQ ID NO: 5018751 - DNA, 13 bp, Homo sapiens
actataaagagaa

SEQ ID NO: 5018752 - DNA, 13 bp, Homo sapiens
actatatatgtga

SEQ ID NO: 5018753 - DNA, 17 bp, Homo sapiens
actatgcagaggcctgg

SEQ ID NO: 5018754 - DNA, 11 bp, Homo sapiens
actatttaaag

SEQ ID NO: 5018755 - DNA, 20 bp, Homo sapiens
actatttaaagcctcctcat

SEQ ID NO: 5018756 - DNA, 21 bp, Homo sapiens
actccaccatccccaccccac

SEQ ID NO: 5018757 - DNA, 20 bp, Homo sapiens
actccatgtttggtgtttgt

SEQ ID NO: 5018758 - DNA, 16 bp, Homo sapiens
actcctcagggttgag

SEQ ID NO: 5018759 - DNA, 13 bp, Homo sapiens
actcctgaaaaaa

SEQ ID NO: 5018760 - DNA, 14 bp, Homo sapiens
actcctgaaaaaaa

SEQ ID NO: 5018761 - DNA, 16 bp, Homo sapiens
actcctgaaaaaaaac

SEQ ID NO: 5018762 - DNA, 13 bp, Homo sapiens
actcctggtctgt

SEQ ID NO: 5018763 - DNA, 14 bp, Homo sapiens
actccttttaaaga

SEQ ID NO: 5018764 - DNA, 16 bp, Homo sapiens
actcgtgtgcaacaga

SEQ ID NO: 5018765 - DNA, 15 bp, Homo sapiens
actctattctttaac

SEQ ID NO: 5018766 - DNA, 13 bp, Homo sapiens
actctgacaacag

SEQ ID NO: 5018767 - DNA, 17 bp, Homo sapiens
actctgacaacagactt

SEQ ID NO: 5018768 - DNA, 22 bp, Homo sapiens
actctgagtaactggttgctgt

SEQ ID NO: 5018769 - DNA, 12 bp, Homo sapiens
actctgtaattg

SEQ ID NO: 5018770 - DNA, 14 bp, Homo sapiens
actctttggtcgtt

SEQ ID NO: 5018771 - DNA, 22 bp, Homo sapiens
actctttttttgagtgacagct

SEQ ID NO: 5018772 - DNA, 23 bp, Homo sapiens
actctttttttgagtgacagctt

SEQ ID NO: 5018773 - DNA, 24 bp, Homo sapiens
actgaacatctgagtcctggatga

SEQ ID NO: 5018774 - DNA, 23 bp, Homo sapiens
actgaaggggtgcacccacctgt

SEQ ID NO: 5018775 - DNA, 18 bp, Homo sapiens
actgaataccactctgta

SEQ ID NO: 5018776 - DNA, 20 bp, Homo sapiens
actgaataccactctgtaat

SEQ ID NO: 5018777 - DNA, 13 bp, Homo sapiens
actgattgggagg

SEQ ID NO: 5018778 - DNA, 16 bp, Homo sapiens
actgcacagcgtcctg

SEQ ID NO: 5018779 - DNA, 14 bp, Homo sapiens
actgcagtgtggag

SEQ ID NO: 5018780 - DNA, 16 bp, Homo sapiens
actgcattttaccaga

SEQ ID NO: 5018781 - DNA, 21 bp, Homo sapiens
actgccatgtactagttttag

SEQ ID NO: 5018782 - DNA, 19 bp, Homo sapiens
actgccccccgaggctgct

SEQ ID NO: 5018783 - DNA, 20 bp, Homo sapiens
actgccccccgaggctgcta

SEQ ID NO: 5018784 - DNA, 18 bp, Homo sapiens
actgcctaaggccctttg

SEQ ID NO: 5018785 - DNA, 15 bp, Homo sapiens
actgcctgctcccat

SEQ ID NO: 5018786 - DNA, 14 bp, Homo sapiens
actgctcagctctg

SEQ ID NO: 5018787 - DNA, 18 bp, Homo sapiens
actggatgcagaaacagt

SEQ ID NO: 5018788 - DNA, 13 bp, Homo sapiens
actgggctgggcc

SEQ ID NO: 5018789 - DNA, 23 bp, Homo sapiens
actgggctgggcctcgtgcgccc

SEQ ID NO: 5018790 - DNA, 13 bp, Homo sapiens
actgggtgagaga

SEQ ID NO: 5018791 - DNA, 14 bp, Homo sapiens
actgggttcctgca

SEQ ID NO: 5018792 - DNA, 11 bp, Homo sapiens
actgtacagtg

SEQ ID NO: 5018793 - DNA, 12 bp, Homo sapiens
actgtacagtgt

SEQ ID NO: 5018794 - DNA, 14 bp, Homo sapiens
actgtatctgtgta

SEQ ID NO: 5018795 - DNA, 18 bp, Homo sapiens
actgtctttaaaagagag

SEQ ID NO: 5018796 - DNA, 17 bp, Homo sapiens
actgtgacaggcagcag

SEQ ID NO: 5018797 - DNA, 19 bp, Homo sapiens
actgtgacaggcagcagag

SEQ ID NO: 5018798 - DNA, 17 bp, Homo sapiens
actgttatttataatca

SEQ ID NO: 5018799 - DNA, 20 bp, Homo sapiens
actgttatttataatcactt

SEQ ID NO: 5018800 - DNA, 19 bp, Homo sapiens
agtcgcatctcagtgcagg

SEQ ID NO: 5018801 - DNA, 18 bp, Homo sapiens
agtctcagtttgtgtgtc

SEQ ID NO: 5018802 - DNA, 22 bp, Homo sapiens
agtctccaacatgtttctgttt

SEQ ID NO: 5018803 - DNA, 19 bp, Homo sapiens
agtctctgaagtgaaactg

SEQ ID NO: 5018804 - DNA, 12 bp, Homo sapiens
agtcttttgctt

SEQ ID NO: 5018805 - DNA, 14 bp, Homo sapiens
agtgaaataataga

SEQ ID NO: 5018806 - DNA, 19 bp, Homo sapiens
agtgaacattcccagccca

SEQ ID NO: 5018807 - DNA, 16 bp, Homo sapiens
agtgacagctttctgg

SEQ ID NO: 5018808 - DNA, 21 bp, Homo sapiens
agtgacagctttctgggatgt

SEQ ID NO: 5018809 - DNA, 15 bp, Homo sapiens
agtgactgtatctgt

SEQ ID NO: 5018810 - DNA, 17 bp, Homo sapiens
agtgactgtatctgtgt

SEQ ID NO: 5018811 - DNA, 18 bp, Homo sapiens
agtgactgtatctgtgta

SEQ ID NO: 5018812 - DNA, 16 bp, Homo sapiens
agtgagagccagcagc

SEQ ID NO: 5018813 - DNA, 19 bp, Homo sapiens
agtgagcagaacaggtagt

SEQ ID NO: 5018814 - DNA, 15 bp, Homo sapiens
agtgcagggaggaaa

SEQ ID NO: 5018815 - DNA, 21 bp, Homo sapiens
agtgcagggaggaaaagtgca

SEQ ID NO: 5018816 - DNA, 13 bp, Homo sapiens
agtgccactgccc

SEQ ID NO: 5018817 - DNA, 16 bp, Homo sapiens
agtgccctccaggata

SEQ ID NO: 5018818 - DNA, 15 bp, Homo sapiens
agtgccctctcccct

SEQ ID NO: 5018819 - DNA, 19 bp, Homo sapiens
agtgctgttttgttatata

SEQ ID NO: 5018820 - DNA, 23 bp, Homo sapiens
agtgctgttttgttatataattt

SEQ ID NO: 5018821 - DNA, 13 bp, Homo sapiens
agtgcttgctttt

SEQ ID NO: 5018822 - DNA, 23 bp, Homo sapiens
agtgggacagttcctgagaccag

SEQ ID NO: 5018823 - DNA, 18 bp, Homo sapiens
agtggggttatctctgtg

SEQ ID NO: 5018824 - DNA, 15 bp, Homo sapiens
agtgtctttttttgt

SEQ ID NO: 5018825 - DNA, 20 bp, Homo sapiens
agtgtctttttttgtatagt

SEQ ID NO: 5018826 - DNA, 20 bp, Homo sapiens
agtgttctcatgaagcagga

SEQ ID NO: 5018827 - DNA, 17 bp, Homo sapiens
agtgttgagccttttcc

SEQ ID NO: 5018828 - DNA, 12 bp, Homo sapiens
agttaacacact

SEQ ID NO: 5018829 - DNA, 13 bp, Homo sapiens
agttaagcctttg

SEQ ID NO: 5018830 - DNA, 18 bp, Homo sapiens
agttcaccttggaagggc

SEQ ID NO: 5018831 - DNA, 18 bp, Homo sapiens
agttcccacattaaagaa

SEQ ID NO: 5018832 - DNA, 16 bp, Homo sapiens
agttcctgagaccagc

SEQ ID NO: 5018833 - DNA, 20 bp, Homo sapiens
agttctacctcaggcagctc

SEQ ID NO: 5018834 - DNA, 17 bp, Homo sapiens
agttgcagctgttttgt

SEQ ID NO: 5018835 - DNA, 16 bp, Homo sapiens
agttggccagagagcc

SEQ ID NO: 5018836 - DNA, 11 bp, Homo sapiens
agttgtctctg

SEQ ID NO: 5018837 - DNA, 12 bp, Homo sapiens
agttgtctctga

SEQ ID NO: 5018838 - DNA, 16 bp, Homo sapiens
agttgtctctgatgca

SEQ ID NO: 5018839 - DNA, 22 bp, Homo sapiens
agttgtctctgatgcagcttat

SEQ ID NO: 5018840 - DNA, 21 bp, Homo sapiens
agtttagggaacaatttggca

SEQ ID NO: 5018841 - DNA, 24 bp, Homo sapiens
agtttagggaacaatttggcaatt

SEQ ID NO: 5018842 - DNA, 16 bp, Homo sapiens
agtttatttttaaaga

SEQ ID NO: 5018843 - DNA, 17 bp, Homo sapiens
agtttctgtttgattct

SEQ ID NO: 5018844 - DNA, 14 bp, Homo sapiens
agtttgtgtgtctt

SEQ ID NO: 5018845 - DNA, 15 bp, Homo sapiens
agtttgtgtgtctta

SEQ ID NO: 5018846 - DNA, 15 bp, Homo sapiens
agttttgtctgtctc

SEQ ID NO: 5018847 - DNA, 12 bp, Homo sapiens
agttttttcatc

SEQ ID NO: 5018848 - DNA, 14 bp, Homo sapiens
agttttttcatctt

SEQ ID NO: 5018849 - DNA, 18 bp, Homo sapiens
agttttttttttcttgtc

SEQ ID NO: 5018850 - DNA, 16 bp, Homo sapiens
ataaactactctttga

SEQ ID NO: 5018851 - DNA, 16 bp, Homo sapiens
ataaagaaaagatgca

SEQ ID NO: 5018852 - DNA, 17 bp, Homo sapiens
ataaagaaaagatgcac

SEQ ID NO: 5018853 - DNA, 14 bp, Homo sapiens
ataaagcacagctg

SEQ ID NO: 5018854 - DNA, 20 bp, Homo sapiens
ataaagccttggatgtatat

SEQ ID NO: 5018855 - DNA, 16 bp, Homo sapiens
ataaatgattcttagt

SEQ ID NO: 5018856 - DNA, 16 bp, Homo sapiens
ataaatggttaaaaga

SEQ ID NO: 5018857 - DNA, 22 bp, Homo sapiens
ataaatggttaaaagaggtttt

SEQ ID NO: 5018858 - DNA, 20 bp, Homo sapiens
ataacaaatgccaaattaaa

SEQ ID NO: 5018859 - DNA, 18 bp, Homo sapiens
ataactgttatttataat

SEQ ID NO: 5018860 - DNA, 20 bp, Homo sapiens
ataactgttatttataatca

SEQ ID NO: 5018861 - DNA, 15 bp, Homo sapiens
ataagcatcattatt

SEQ ID NO: 5018862 - DNA, 23 bp, Homo sapiens
ataaggcccagagcgaggaaagg

SEQ ID NO: 5018863 - DNA, 23 bp, Homo sapiens
ataatatattctatttttatact

SEQ ID NO: 5018864 - DNA, 16 bp, Homo sapiens
ataattaattgtcatt

SEQ ID NO: 5018865 - DNA, 20 bp, Homo sapiens
ataattcaggaagcagcttt

SEQ ID NO: 5018866 - DNA, 17 bp, Homo sapiens
atacaattttttttatt

SEQ ID NO: 5018867 - DNA, 19 bp, Homo sapiens
ataccctggccgccccctg

SEQ ID NO: 5018868 - DNA, 15 bp, Homo sapiens
atacctacatgtatt

SEQ ID NO: 5018869 - DNA, 15 bp, Homo sapiens
atacgaaataattgt

SEQ ID NO: 5018870 - DNA, 18 bp, Homo sapiens
atacgaaataattgttgt

SEQ ID NO: 5018871 - DNA, 19 bp, Homo sapiens
atacgaaataattgttgtt

SEQ ID NO: 5018872 - DNA, 21 bp, Homo sapiens
atactatttaaagcctcctca

SEQ ID NO: 5018873 - DNA, 23 bp, Homo sapiens
atactgaacatctgagtcctgga

SEQ ID NO: 5018874 - DNA, 22 bp, Homo sapiens
atactgattgggaggtgcgtgt

SEQ ID NO: 5018875 - DNA, 20 bp, Homo sapiens
atactgtttgaggtttttaa

SEQ ID NO: 5018876 - DNA, 10 bp, Homo sapiens
atagaaaaat

SEQ ID NO: 5018877 - DNA, 22 bp, Homo sapiens
atagaaaagtatgttctaacct

SEQ ID NO: 5018878 - DNA, 15 bp, Homo sapiens
atagacttgggatgg

SEQ ID NO: 5018879 - DNA, 12 bp, Homo sapiens
atagcagctttg

SEQ ID NO: 5018880 - DNA, 17 bp, Homo sapiens
atagcagctttgtctct

SEQ ID NO: 5018881 - DNA, 19 bp, Homo sapiens
atagcagctttgtctctgt

SEQ ID NO: 5018882 - DNA, 20 bp, Homo sapiens
atagccactaaccttgcctg

SEQ ID NO: 5018883 - DNA, 13 bp, Homo sapiens
atagcccacttac

SEQ ID NO: 5018884 - DNA, 14 bp, Homo sapiens
atagccctgtcctg

SEQ ID NO: 5018885 - DNA, 15 bp, Homo sapiens
atagccctgtcctgg

SEQ ID NO: 5018886 - DNA, 18 bp, Homo sapiens
atagcgttcttgtaattt

SEQ ID NO: 5018887 - DNA, 16 bp, Homo sapiens
atagttagctaataaa

SEQ ID NO: 5018888 - DNA, 23 bp, Homo sapiens
atagttttcatccataactgaac

SEQ ID NO: 5018889 - DNA, 20 bp, Homo sapiens
atataaagacgttttataag

SEQ ID NO: 5018890 - DNA, 22 bp, Homo sapiens
atataaagacgttttataagca

SEQ ID NO: 5018891 - DNA, 23 bp, Homo sapiens
atataaatgcaaataacaaatgc

SEQ ID NO: 5018892 - DNA, 14 bp, Homo sapiens
atatattattactt

SEQ ID NO: 5018893 - DNA, 19 bp, Homo sapiens
atatatttgtttcatttct

SEQ ID NO: 5018894 - DNA, 20 bp, Homo sapiens
atatgagctttatgtaataa

SEQ ID NO: 5018895 - DNA, 19 bp, Homo sapiens
atatggggatggtagtttt

SEQ ID NO: 5018896 - DNA, 18 bp, Homo sapiens
atattaaattttttgttg

SEQ ID NO: 5018897 - DNA, 17 bp, Homo sapiens
atattattacttgtaaa

SEQ ID NO: 5018898 - DNA, 16 bp, Homo sapiens
atattctaaaaccatt

SEQ ID NO: 5018899 - DNA, 15 bp, Homo sapiens
atattctatttttat

SEQ ID NO: 5018900 - DNA, 23 bp, Homo sapiens
atatttgaaaaaaacttcattct

SEQ ID NO: 5018901 - DNA, 16 bp, Homo sapiens
atcaaacattttgaaa

SEQ ID NO: 5018902 - DNA, 22 bp, Homo sapiens
atcaattttgacttaatgtgat

SEQ ID NO: 5018903 - DNA, 18 bp, Homo sapiens
atcacagtggccacggcc

SEQ ID NO: 5018904 - DNA, 15 bp, Homo sapiens
atcacagttttggtt

SEQ ID NO: 5018905 - DNA, 15 bp, Homo sapiens
atcacatgtggactt

SEQ ID NO: 5018906 - DNA, 14 bp, Homo sapiens
atcacttttttcca

SEQ ID NO: 5018907 - DNA, 15 bp, Homo sapiens
atcagtgccctccag

SEQ ID NO: 5018908 - DNA, 18 bp, Homo sapiens
atcagttaagaaatttca

SEQ ID NO: 5018909 - DNA, 17 bp, Homo sapiens
atcatcagtattgaagc

SEQ ID NO: 5018910 - DNA, 15 bp, Homo sapiens
atcattatttatgta

SEQ ID NO: 5018911 - DNA, 16 bp, Homo sapiens
atcatttcacttgtca

SEQ ID NO: 5018912 - DNA, 21 bp, Homo sapiens
atccaagcaccaccaaacaca

SEQ ID NO: 5018913 - DNA, 15 bp, Homo sapiens
atccataactgaaca

SEQ ID NO: 5018914 - DNA, 17 bp, Homo sapiens
atcccaggatgtacaag

SEQ ID NO: 5018915 - DNA, 14 bp, Homo sapiens
aggaagcaacagct

SEQ ID NO: 5018916 - DNA, 21 bp, Homo sapiens
aggaaggttctggtgtgaact

SEQ ID NO: 5018917 - DNA, 18 bp, Homo sapiens
aggacacgggcctgtcca

SEQ ID NO: 5018918 - DNA, 23 bp, Homo sapiens
aggacacgggcctgtccacaggc

SEQ ID NO: 5018919 - DNA, 17 bp, Homo sapiens
aggacagcccctcctcc

SEQ ID NO: 5018920 - DNA, 17 bp, Homo sapiens
aggactcctgaaaaaaa

SEQ ID NO: 5018921 - DNA, 21 bp, Homo sapiens
aggactgcacagcgtcctgtc

SEQ ID NO: 5018922 - DNA, 18 bp, Homo sapiens
aggactgtgacaggcagc

SEQ ID NO: 5018923 - DNA, 19 bp, Homo sapiens
aggactgtgacaggcagca

SEQ ID NO: 5018924 - DNA, 20 bp, Homo sapiens
aggactgtgacaggcagcag

SEQ ID NO: 5018925 - DNA, 23 bp, Homo sapiens
aggactttgaggcaagtgtgggc

SEQ ID NO: 5018926 - DNA, 15 bp, Homo sapiens
aggagcacggctctg

SEQ ID NO: 5018927 - DNA, 23 bp, Homo sapiens
aggagcacggctctgtccccagc

SEQ ID NO: 5018928 - DNA, 14 bp, Homo sapiens
aggagccccagcta

SEQ ID NO: 5018929 - DNA, 20 bp, Homo sapiens
aggagctgggcccctgcaca

SEQ ID NO: 5018930 - DNA, 14 bp, Homo sapiens
aggaggaatactga

SEQ ID NO: 5018931 - DNA, 21 bp, Homo sapiens
aggaggccctggtcctggcct

SEQ ID NO: 5018932 - DNA, 20 bp, Homo sapiens
aggaggcccttgtcgtggga

SEQ ID NO: 5018933 - DNA, 23 bp, Homo sapiens
aggagggagacactggcccctca

SEQ ID NO: 5018934 - DNA, 21 bp, Homo sapiens
aggagggagcatcagtgccct

SEQ ID NO: 5018935 - DNA, 14 bp, Homo sapiens
aggaggtggagaaa

SEQ ID NO: 5018936 - DNA, 14 bp, Homo sapiens
aggagtttatgttc

SEQ ID NO: 5018937 - DNA, 19 bp, Homo sapiens
aggatatgattaatattat

SEQ ID NO: 5018938 - DNA, 22 bp, Homo sapiens
aggatcagttttttgttttaca

SEQ ID NO: 5018939 - DNA, 13 bp, Homo sapiens
aggatctgctgag

SEQ ID NO: 5018940 - DNA, 15 bp, Homo sapiens
aggatctgctgaggc

SEQ ID NO: 5018941 - DNA, 23 bp, Homo sapiens
aggatctgctgaggcccagtgca

SEQ ID NO: 5018942 - DNA, 18 bp, Homo sapiens
aggatgataagttccttt

SEQ ID NO: 5018943 - DNA, 14 bp, Homo sapiens
aggatgctgcagtg

SEQ ID NO: 5018944 - DNA, 18 bp, Homo sapiens
aggattttaccaaagcat

SEQ ID NO: 5018945 - DNA, 18 bp, Homo sapiens
aggcaaatgactttggac

SEQ ID NO: 5018946 - DNA, 20 bp, Homo sapiens
aggcacacagggcccggcca

SEQ ID NO: 5018947 - DNA, 19 bp, Homo sapiens
aggcatgggtgcaaggaaa

SEQ ID NO: 5018948 - DNA, 20 bp, Homo sapiens
aggcatgggtgcaaggaaaa

SEQ ID NO: 5018949 - DNA, 15 bp, Homo sapiens
aggcatgtcccaccc

SEQ ID NO: 5018950 - DNA, 16 bp, Homo sapiens
aggcatgtcccaccca

SEQ ID NO: 5018951 - DNA, 16 bp, Homo sapiens
aggccaaaggctggtg

SEQ ID NO: 5018952 - DNA, 19 bp, Homo sapiens
aggccagctgccccagcca

SEQ ID NO: 5018953 - DNA, 19 bp, Homo sapiens
aggcccagtgcatatgcaa

SEQ ID NO: 5018954 - DNA, 13 bp, Homo sapiens
aggcccggcctct

SEQ ID NO: 5018955 - DNA, 14 bp, Homo sapiens
aggcccggcctctc

SEQ ID NO: 5018956 - DNA, 15 bp, Homo sapiens
aggcccggcctctca

SEQ ID NO: 5018957 - DNA, 13 bp, Homo sapiens
aggccctgccagt

SEQ ID NO: 5018958 - DNA, 17 bp, Homo sapiens
aggcccttgtcgtggga

SEQ ID NO: 5018959 - DNA, 15 bp, Homo sapiens
aggcctgtccaccct

SEQ ID NO: 5018960 - DNA, 16 bp, Homo sapiens
aggcctgtccaccctg

SEQ ID NO: 5018961 - DNA, 14 bp, Homo sapiens
aggcgggaggaggt

SEQ ID NO: 5018962 - DNA, 14 bp, Homo sapiens
aggcgggcttggaa

SEQ ID NO: 5018963 - DNA, 20 bp, Homo sapiens
aggctgaacttgttttctgg

SEQ ID NO: 5018964 - DNA, 20 bp, Homo sapiens
aggctgacgtgtgagggagg

SEQ ID NO: 5018965 - DNA, 10 bp, Homo sapiens
aggctgctag

SEQ ID NO: 5018966 - DNA, 17 bp, Homo sapiens
aggctgtctggccaggc

SEQ ID NO: 5018967 - DNA, 16 bp, Homo sapiens
agggacatgccctgtg

SEQ ID NO: 5018968 - DNA, 18 bp, Homo sapiens
agggacatgccctgtgtg

SEQ ID NO: 5018969 - DNA, 18 bp, Homo sapiens
agggagcatcagtgccct

SEQ ID NO: 5018970 - DNA, 19 bp, Homo sapiens
agggagttttgtctgtctc

SEQ ID NO: 5018971 - DNA, 15 bp, Homo sapiens
agggcaggcttgggg

SEQ ID NO: 5018972 - DNA, 22 bp, Homo sapiens
agggcagggaccacaccctgta

SEQ ID NO: 5018973 - DNA, 22 bp, Homo sapiens
agggcatgccacgtgggctcat

SEQ ID NO: 5018974 - DNA, 16 bp, Homo sapiens
agggccatgcagacct

SEQ ID NO: 5018975 - DNA, 14 bp, Homo sapiens
agggccccggggcc

SEQ ID NO: 5018976 - DNA, 17 bp, Homo sapiens
agggcccggccacaccc

SEQ ID NO: 5018977 - DNA, 21 bp, Homo sapiens
aggggaagcagaaatccaagc

SEQ ID NO: 5018978 - DNA, 14 bp, Homo sapiens
aggggagggcaggc

SEQ ID NO: 5018979 - DNA, 18 bp, Homo sapiens
aggggcagcctgtgcctg

SEQ ID NO: 5018980 - DNA, 18 bp, Homo sapiens
aggggcggtgcccacacc

SEQ ID NO: 5018981 - DNA, 13 bp, Homo sapiens
aggggctggggcc

SEQ ID NO: 5018982 - DNA, 23 bp, Homo sapiens
aggggctggggccaaataaagtc

SEQ ID NO: 5018983 - DNA, 22 bp, Homo sapiens
agggggaaggtggggtcctgga

SEQ ID NO: 5018984 - DNA, 20 bp, Homo sapiens
aggggttcttgagccagcca

SEQ ID NO: 5018985 - DNA, 13 bp, Homo sapiens
aggtaggaagagc

SEQ ID NO: 5018986 - DNA, 18 bp, Homo sapiens
aggtaggaagcaacagct

SEQ ID NO: 5018987 - DNA, 20 bp, Homo sapiens
aggtagtattacaccaccgg

SEQ ID NO: 5018988 - DNA, 19 bp, Homo sapiens
aggtcaagcccagaaagtg

SEQ ID NO: 5018989 - DNA, 19 bp, Homo sapiens
aggtcacctttattctggc

SEQ ID NO: 5018990 - DNA, 14 bp, Homo sapiens
aggtcactccacca

SEQ ID NO: 5018991 - DNA, 18 bp, Homo sapiens
aggtcactccaccatccc

SEQ ID NO: 5018992 - DNA, 16 bp, Homo sapiens
aggtccagccctggct

SEQ ID NO: 5018993 - DNA, 23 bp, Homo sapiens
aggtctgaaatttttcttcttga

SEQ ID NO: 5018994 - DNA, 18 bp, Homo sapiens
aggtgacaaaccatttcc

SEQ ID NO: 5018995 - DNA, 13 bp, Homo sapiens
aggtgactgtgct

SEQ ID NO: 5018996 - DNA, 14 bp, Homo sapiens
aggtgactgtgctg

SEQ ID NO: 5018997 - DNA, 14 bp, Homo sapiens
aggtgagaaaaaaa

SEQ ID NO: 5018998 - DNA, 16 bp, Homo sapiens
aggtgaggattccaaa

SEQ ID NO: 5018999 - DNA, 20 bp, Homo sapiens
aggtgccgccagctgccgca

SEQ ID NO: 5019000 - DNA, 17 bp, Homo sapiens
aggtgcctgtcccaccc

SEQ ID NO: 5019001 - DNA, 17 bp, Homo sapiens
aggtgtgaggaggaggc

SEQ ID NO: 5019002 - DNA, 17 bp, Homo sapiens
aggttctggtgtgaact

SEQ ID NO: 5019003 - DNA, 17 bp, Homo sapiens
aggttcttgttggtgca

SEQ ID NO: 5019004 - DNA, 18 bp, Homo sapiens
aggttcttgttggtgcac

SEQ ID NO: 5019005 - DNA, 15 bp, Homo sapiens
aggtttaaatgaaca

SEQ ID NO: 5019006 - DNA, 18 bp, Homo sapiens
aggtttgcagtcccaagc

SEQ ID NO: 5019007 - DNA, 13 bp, Homo sapiens
aggtttgcctgtg

SEQ ID NO: 5019008 - DNA, 13 bp, Homo sapiens
aggtttttcttaa

SEQ ID NO: 5019009 - DNA, 22 bp, Homo sapiens
agtaatcaatctactcaaagca

SEQ ID NO: 5019010 - DNA, 15 bp, Homo sapiens
agtaatcccatttcc

SEQ ID NO: 5019011 - DNA, 16 bp, Homo sapiens
agtaccctctcagctc

SEQ ID NO: 5019012 - DNA, 19 bp, Homo sapiens
agtaccctctcagctccag

SEQ ID NO: 5019013 - DNA, 17 bp, Homo sapiens
agtacctgattgtattt

SEQ ID NO: 5019014 - DNA, 18 bp, Homo sapiens
agtacctgattgtatttt

SEQ ID NO: 5019015 - DNA, 13 bp, Homo sapiens
agtacctgggcaa

SEQ ID NO: 5019016 - DNA, 14 bp, Homo sapiens
agtagttttcaaaa

SEQ ID NO: 5019017 - DNA, 17 bp, Homo sapiens
agtatctaacaaaacca

SEQ ID NO: 5019018 - DNA, 18 bp, Homo sapiens
agtatgggggttgtaaat

SEQ ID NO: 5019019 - DNA, 22 bp, Homo sapiens
agtatgttctaacctttacatg

SEQ ID NO: 5019020 - DNA, 18 bp, Homo sapiens
agtattgaagcattttat

SEQ ID NO: 5019021 - DNA, 21 bp, Homo sapiens
agtattgaagcattttataaa

SEQ ID NO: 5019022 - DNA, 22 bp, Homo sapiens
agtattgttgtccttttcatag

SEQ ID NO: 5019023 - DNA, 14 bp, Homo sapiens
agtcaagaagaaaa

SEQ ID NO: 5019024 - DNA, 20 bp, Homo sapiens
agtcatctgtaagagcttgc

SEQ ID NO: 5019025 - DNA, 17 bp, Homo sapiens
agtcatggtggccacgg

SEQ ID NO: 5019026 - DNA, 13 bp, Homo sapiens
agtcattgtatgt

SEQ ID NO: 5019027 - DNA, 19 bp, Homo sapiens
agtccaggaggccctggtc

SEQ ID NO: 5019028 - DNA, 14 bp, Homo sapiens
agtcccaagcggtg

SEQ ID NO: 5019029 - DNA, 19 bp, Homo sapiens
agtcccaagcggtgtctct

SEQ ID NO: 5019030 - DNA, 19 bp, Homo sapiens
agtccccgaggagctgggc

SEQ ID NO: 5019031 - DNA, 19 bp, Homo sapiens
agtcctggatgatactaat

SEQ ID NO: 5019032 - DNA, 15 bp, Homo sapiens
agtccttgcaagaat

SEQ ID NO: 5019033 - DNA, 18 bp, Homo sapiens
agtccttgcaagaatcag

SEQ ID NO: 5019034 - DNA, 19 bp, Homo sapiens
cctgccaagactcctcagg

SEQ ID NO: 5019035 - DNA, 22 bp, Homo sapiens
cctgccccccagcctctggcat

SEQ ID NO: 5019036 - DNA, 16 bp, Homo sapiens
cctgccccttccttta

SEQ ID NO: 5019037 - DNA, 16 bp, Homo sapiens
cctgccggtgggaccc

SEQ ID NO: 5019038 - DNA, 15 bp, Homo sapiens
cctgcctctacccaa

SEQ ID NO: 5019039 - DNA, 15 bp, Homo sapiens
cctgcgcctgtgatg

SEQ ID NO: 5019040 - DNA, 20 bp, Homo sapiens
cctgctcccatcctgtgtgt

SEQ ID NO: 5019041 - DNA, 17 bp, Homo sapiens
cctgctggatgtggagg

SEQ ID NO: 5019042 - DNA, 22 bp, Homo sapiens
cctgctgttggtcctctctctg

SEQ ID NO: 5019043 - DNA, 23 bp, Homo sapiens
cctgctgttggtcctctctctgt

SEQ ID NO: 5019044 - DNA, 15 bp, Homo sapiens
cctgctttggcgggc

SEQ ID NO: 5019045 - DNA, 16 bp, Homo sapiens
cctggacactcagacc

SEQ ID NO: 5019046 - DNA, 14 bp, Homo sapiens
cctggactcctgca

SEQ ID NO: 5019047 - DNA, 14 bp, Homo sapiens
cctggactgttttc

SEQ ID NO: 5019048 - DNA, 22 bp, Homo sapiens
cctggcagggtcatcctgtgct

SEQ ID NO: 5019049 - DNA, 22 bp, Homo sapiens
cctggccccgcctgcctgccac

SEQ ID NO: 5019050 - DNA, 20 bp, Homo sapiens
cctggccgccccctgccccc

SEQ ID NO: 5019051 - DNA, 11 bp, Homo sapiens
cctggcctcct

SEQ ID NO: 5019052 - DNA, 22 bp, Homo sapiens
cctggctccaaaccctcgaggc

SEQ ID NO: 5019053 - DNA, 16 bp, Homo sapiens
cctggctgaaggactg

SEQ ID NO: 5019054 - DNA, 23 bp, Homo sapiens
cctgggacatcaggagactgggc

SEQ ID NO: 5019055 - DNA, 14 bp, Homo sapiens
cctgggctgggtgg

SEQ ID NO: 5019056 - DNA, 17 bp, Homo sapiens
cctggtaccctcctggc

SEQ ID NO: 5019057 - DNA, 15 bp, Homo sapiens
cctggtcctggcctc

SEQ ID NO: 5019058 - DNA, 17 bp, Homo sapiens
cctggtcctggcctcct

SEQ ID NO: 5019059 - DNA, 18 bp, Homo sapiens
cctggtggtattttcaat

SEQ ID NO: 5019060 - DNA, 19 bp, Homo sapiens
cctggtggtattttcaata

SEQ ID NO: 5019061 - DNA, 17 bp, Homo sapiens
cctgtacacaactcact

SEQ ID NO: 5019062 - DNA, 13 bp, Homo sapiens
cctgtccaccctg

SEQ ID NO: 5019063 - DNA, 16 bp, Homo sapiens
cctgtccaccctgcca

SEQ ID NO: 5019064 - DNA, 11 bp, Homo sapiens
cctgtcccacc

SEQ ID NO: 5019065 - DNA, 13 bp, Homo sapiens
cctgtcccacccc

SEQ ID NO: 5019066 - DNA, 20 bp, Homo sapiens
cctgtccggcccagtgccac

SEQ ID NO: 5019067 - DNA, 21 bp, Homo sapiens
cctgtccggcccagtgccact

SEQ ID NO: 5019068 - DNA, 16 bp, Homo sapiens
cctgtgaactgaactc

SEQ ID NO: 5019069 - DNA, 16 bp, Homo sapiens
cctgtgtgttaagctc

SEQ ID NO: 5019070 - DNA, 17 bp, Homo sapiens
cctgtgtgttaagctct

SEQ ID NO: 5019071 - DNA, 15 bp, Homo sapiens
cctgttttctgaaac

SEQ ID NO: 5019072 - DNA, 19 bp, Homo sapiens
cctgttttctgaaacacac

SEQ ID NO: 5019073 - DNA, 14 bp, Homo sapiens
ccttagacctgagg

SEQ ID NO: 5019074 - DNA, 12 bp, Homo sapiens
ccttccagctcc

SEQ ID NO: 5019075 - DNA, 16 bp, Homo sapiens
ccttccagctcctgta

SEQ ID NO: 5019076 - DNA, 15 bp, Homo sapiens
ccttcccatcgctgt

SEQ ID NO: 5019077 - DNA, 13 bp, Homo sapiens
ccttccctccaag

SEQ ID NO: 5019078 - DNA, 18 bp, Homo sapiens
ccttccctccatagccac

SEQ ID NO: 5019079 - DNA, 17 bp, Homo sapiens
ccttcctcatccacccc

SEQ ID NO: 5019080 - DNA, 14 bp, Homo sapiens
ccttcctgaagagt

SEQ ID NO: 5019081 - DNA, 17 bp, Homo sapiens
ccttcctgccagcccct

SEQ ID NO: 5019082 - DNA, 22 bp, Homo sapiens
ccttgagtggggttatctctgt

SEQ ID NO: 5019083 - DNA, 23 bp, Homo sapiens
ccttgagtggggttatctctgtg

SEQ ID NO: 5019084 - DNA, 13 bp, Homo sapiens
ccttgcctggcct

SEQ ID NO: 5019085 - DNA, 15 bp, Homo sapiens
ccttgggtggcccct

SEQ ID NO: 5019086 - DNA, 15 bp, Homo sapiens
cctttacgtgtttaa

SEQ ID NO: 5019087 - DNA, 22 bp, Homo sapiens
cctttgaacttgattgcctatg

SEQ ID NO: 5019088 - DNA, 21 bp, Homo sapiens
cctttgtaaattgtcagatgc

SEQ ID NO: 5019089 - DNA, 12 bp, Homo sapiens
ccttttaaagaa

SEQ ID NO: 5019090 - DNA, 10 bp, Homo sapiens
ccttttcata

SEQ ID NO: 5019091 - DNA, 11 bp, Homo sapiens
ccttttcatag

SEQ ID NO: 5019092 - DNA, 19 bp, Homo sapiens
ccttttcataggtctgaaa

SEQ ID NO: 5019093 - DNA, 22 bp, Homo sapiens
ccttttcataggtctgaaattt

SEQ ID NO: 5019094 - DNA, 22 bp, Homo sapiens
ccttttctagcccgaatacaaa

SEQ ID NO: 5019095 - DNA, 23 bp, Homo sapiens
ccttttgaggagccccagctacc

SEQ ID NO: 5019096 - DNA, 17 bp, Homo sapiens
cgaatgacggtaagtgt

SEQ ID NO: 5019097 - DNA, 18 bp, Homo sapiens
cgaatgtgtctttagata

SEQ ID NO: 5019098 - DNA, 13 bp, Homo sapiens
cgaccgccccctc

SEQ ID NO: 5019099 - DNA, 19 bp, Homo sapiens
cgacttggagactcctggt

SEQ ID NO: 5019100 - DNA, 23 bp, Homo sapiens
cgagagctggccaaagagccttt

SEQ ID NO: 5019101 - DNA, 21 bp, Homo sapiens
cgagattatcgttttcttaaa

SEQ ID NO: 5019102 - DNA, 23 bp, Homo sapiens
cgagcaaacccagaggtggatgt

SEQ ID NO: 5019103 - DNA, 23 bp, Homo sapiens
cgaggaaaggattttaccaaagc

SEQ ID NO: 5019104 - DNA, 13 bp, Homo sapiens
cgaggagctgggc

SEQ ID NO: 5019105 - DNA, 14 bp, Homo sapiens
cgaggagctgggcc

SEQ ID NO: 5019106 - DNA, 15 bp, Homo sapiens
cgaggagctgggccc

SEQ ID NO: 5019107 - DNA, 21 bp, Homo sapiens
cgagggcagggaccacaccct

SEQ ID NO: 5019108 - DNA, 14 bp, Homo sapiens
cgatcccacacagg

SEQ ID NO: 5019109 - DNA, 15 bp, Homo sapiens
cgcacagccacccgt

SEQ ID NO: 5019110 - DNA, 16 bp, Homo sapiens
cgcacagccacccgtg

SEQ ID NO: 5019111 - DNA, 16 bp, Homo sapiens
cgcacgcctctccctg

SEQ ID NO: 5019112 - DNA, 14 bp, Homo sapiens
cgcactctgccccc

SEQ ID NO: 5019113 - DNA, 21 bp, Homo sapiens
cgcaggaactgggctgggcct

SEQ ID NO: 5019114 - DNA, 18 bp, Homo sapiens
cgccaccgccacccgcag

SEQ ID NO: 5019115 - DNA, 23 bp, Homo sapiens
cgccagctgccgcaccagcccga

SEQ ID NO: 5019116 - DNA, 20 bp, Homo sapiens
cgcccacaggaagcctgcag

SEQ ID NO: 5019117 - DNA, 14 bp, Homo sapiens
cgccccctcctcta

SEQ ID NO: 5019118 - DNA, 18 bp, Homo sapiens
cgccgggcaccaactcca

SEQ ID NO: 5019119 - DNA, 14 bp, Homo sapiens
cgcctcccacggca

SEQ ID NO: 5019120 - DNA, 17 bp, Homo sapiens
cgcctctccctgcactc

SEQ ID NO: 5019121 - DNA, 11 bp, Homo sapiens
cgcctgccacc

SEQ ID NO: 5019122 - DNA, 15 bp, Homo sapiens
cgcctgccaccggag

SEQ ID NO: 5019123 - DNA, 17 bp, Homo sapiens
cgcctgccctcatggcc

SEQ ID NO: 5019124 - DNA, 15 bp, Homo sapiens
cgcgggcagccaccc

SEQ ID NO: 5019125 - DNA, 17 bp, Homo sapiens
cgcgggcagccacccaa

SEQ ID NO: 5019126 - DNA, 16 bp, Homo sapiens
cgctactataaagaga

SEQ ID NO: 5019127 - DNA, 13 bp, Homo sapiens
cgctcagcccagc

SEQ ID NO: 5019128 - DNA, 17 bp, Homo sapiens
cgctcccttccctccat

SEQ ID NO: 5019129 - DNA, 13 bp, Homo sapiens
cgctctttgagaa

SEQ ID NO: 5019130 - DNA, 23 bp, Homo sapiens
cgctgagtggggggtcgtgggcc

SEQ ID NO: 5019131 - DNA, 16 bp, Homo sapiens
cgctgatggagcccca

SEQ ID NO: 5019132 - DNA, 15 bp, Homo sapiens
cgctgcccgctcagc

SEQ ID NO: 5019133 - DNA, 20 bp, Homo sapiens
cgctgcccgctcagcccagc

SEQ ID NO: 5019134 - DNA, 23 bp, Homo sapiens
cgctggccgggaccccgagcctg

SEQ ID NO: 5019135 - DNA, 22 bp, Homo sapiens
cggaaagtgagagccagcagca

SEQ ID NO: 5019136 - DNA, 17 bp, Homo sapiens
cggaaggtttttaaaca

SEQ ID NO: 5019137 - DNA, 17 bp, Homo sapiens
cggaggtcactccacca

SEQ ID NO: 5019138 - DNA, 18 bp, Homo sapiens
cggcatgtttccagcaga

SEQ ID NO: 5019139 - DNA, 17 bp, Homo sapiens
cggccacacccagcggc

SEQ ID NO: 5019140 - DNA, 17 bp, Homo sapiens
cggcccagtgccactgc

SEQ ID NO: 5019141 - DNA, 18 bp, Homo sapiens
cggcccagtgccactgcc

SEQ ID NO: 5019142 - DNA, 20 bp, Homo sapiens
cggcccagtgccactgcccc

SEQ ID NO: 5019143 - DNA, 21 bp, Homo sapiens
cggccccccgcacagccaccc

SEQ ID NO: 5019144 - DNA, 22 bp, Homo sapiens
cggccccccgcacagccacccg

SEQ ID NO: 5019145 - DNA, 17 bp, Homo sapiens
cggctccccatgtgtcc

SEQ ID NO: 5019146 - DNA, 14 bp, Homo sapiens
cggctctgtcccca

SEQ ID NO: 5019147 - DNA, 15 bp, Homo sapiens
cggctctgtccccag

SEQ ID NO: 5019148 - DNA, 16 bp, Homo sapiens
cggctctgtccccagc

SEQ ID NO: 5019149 - DNA, 18 bp, Homo sapiens
cggctggggtcccagcag

SEQ ID NO: 5019150 - DNA, 23 bp, Homo sapiens
cggctggggtcccagcagctgcc

SEQ ID NO: 5019151 - DNA, 14 bp, Homo sapiens
cggctgggtctgtg

SEQ ID NO: 5019152 - DNA, 22 bp, Homo sapiens
cggctgtgtgtgcacgcgtgtg

SEQ ID NO: 5019153 - DNA, 19 bp, Homo sapiens
cggcttcatgccagctact

SEQ ID NO: 5019154 - DNA, 21 bp, Homo sapiens
cggcttggatcctgggctggg

SEQ ID NO: 5019155 - DNA, 18 bp, Homo sapiens
cggcttgttcttgcagca

SEQ ID NO: 5019156 - DNA, 23 bp, Homo sapiens
cgggaccccgagcctggctccaa

SEQ ID NO: 5019157 - DNA, 13 bp, Homo sapiens
cgggaggaggtgt

SEQ ID NO: 5019158 - DNA, 22 bp, Homo sapiens
cgggcagccacccaagcctgct

SEQ ID NO: 5019159 - DNA, 23 bp, Homo sapiens
cgggcgcgggcagccacccaagc

SEQ ID NO: 5019160 - DNA, 13 bp, Homo sapiens
cggggacacaggc

SEQ ID NO: 5019161 - DNA, 19 bp, Homo sapiens
cggggcagccccctcacag

SEQ ID NO: 5019162 - DNA, 15 bp, Homo sapiens
cggtaagtgttctca

SEQ ID NO: 5019163 - DNA, 17 bp, Homo sapiens
cggtggtgcccgtgccc

SEQ ID NO: 5019164 - DNA, 20 bp, Homo sapiens
cgtagcgtgcccgtgtgcat

SEQ ID NO: 5019165 - DNA, 20 bp, Homo sapiens
cgtccgaggctgcttcccag

SEQ ID NO: 5019166 - DNA, 23 bp, Homo sapiens
cgtcctgtccacacccagctcag

SEQ ID NO: 5019167 - DNA, 11 bp, Homo sapiens
cgtctcagtgt

SEQ ID NO: 5019168 - DNA, 19 bp, Homo sapiens
cgtgcccccgcctgccacc

SEQ ID NO: 5019169 - DNA, 21 bp, Homo sapiens
cgtgcgcccgtggggtctgcg

SEQ ID NO: 5019170 - DNA, 18 bp, Homo sapiens
cgtgggatggcatttggt

SEQ ID NO: 5019171 - DNA, 18 bp, Homo sapiens
cgtgggccagtccccgag

SEQ ID NO: 5019172 - DNA, 23 bp, Homo sapiens
cgtgggccagtccccgaggagct

SEQ ID NO: 5019173 - DNA, 21 bp, Homo sapiens
cgtgtgggtcccgcactctgc

SEQ ID NO: 5019174 - DNA, 15 bp, Homo sapiens
cgtgttacccactgc

SEQ ID NO: 5019175 - DNA, 16 bp, Homo sapiens
cgtgttctccttttcc

SEQ ID NO: 5019176 - DNA, 18 bp, Homo sapiens
cgttcttgtaattttaca

SEQ ID NO: 5019177 - DNA, 19 bp, Homo sapiens
cgtttgtgttctgttttgt

SEQ ID NO: 5019178 - DNA, 20 bp, Homo sapiens
cgtttgtgttctgttttgtt

SEQ ID NO: 5019179 - DNA, 20 bp, Homo sapiens
cgtttgttccccaagacatt

SEQ ID NO: 5019180 - DNA, 16 bp, Homo sapiens
cgttttataagcatca

SEQ ID NO: 5019181 - DNA, 13 bp, Homo sapiens
ctaaactttcaca

SEQ ID NO: 5019182 - DNA, 14 bp, Homo sapiens
ctaaactttcacac

SEQ ID NO: 5019183 - DNA, 12 bp, Homo sapiens
ctaaataaacat

SEQ ID NO: 5019184 - DNA, 22 bp, Homo sapiens
ctaaatatggactgctcaggaa

SEQ ID NO: 5019185 - DNA, 21 bp, Homo sapiens
ctaaccttgcctggtacagta

SEQ ID NO: 5019186 - DNA, 13 bp, Homo sapiens
ctaacctttacat

SEQ ID NO: 5019187 - DNA, 17 bp, Homo sapiens
ctaacgttgagcccctg

SEQ ID NO: 5019188 - DNA, 20 bp, Homo sapiens
ctaactacaaaggtttaaat

SEQ ID NO: 5019189 - DNA, 17 bp, Homo sapiens
ctaactcttctttcatt

SEQ ID NO: 5019190 - DNA, 20 bp, Homo sapiens
ctaaggatttttcaagagat

SEQ ID NO: 5019191 - DNA, 16 bp, Homo sapiens
ctaagtaaatacaatt

SEQ ID NO: 5019192 - DNA, 17 bp, Homo sapiens
ctaagtaaatacaattt

SEQ ID NO: 5019193 - DNA, 14 bp, Homo sapiens
ctaagtctctgtga

SEQ ID NO: 5019194 - DNA, 18 bp, Homo sapiens
ctaataaaaagcttttgt

SEQ ID NO: 5019195 - DNA, 19 bp, Homo sapiens
ctaataaactaataattgc

SEQ ID NO: 5019196 - DNA, 21 bp, Homo sapiens
ctaataaactaataattgcag

SEQ ID NO: 5019197 - DNA, 17 bp, Homo sapiens
ctacaaaggtttaaatg

SEQ ID NO: 5019198 - DNA, 18 bp, Homo sapiens
ctacaaaggtttaaatga

SEQ ID NO: 5019199 - DNA, 21 bp, Homo sapiens
ctacaaaggtttaaatgaaca

SEQ ID NO: 5019200 - DNA, 12 bp, Homo sapiens
ctacacaccctg

SEQ ID NO: 5019201 - DNA, 16 bp, Homo sapiens
ctaccctttttctcca

SEQ ID NO: 5019202 - DNA, 15 bp, Homo sapiens
ctactataaagagaa

SEQ ID NO: 5019203 - DNA, 13 bp, Homo sapiens
ctactcaaagcat

SEQ ID NO: 5019204 - DNA, 14 bp, Homo sapiens
ctactctttgattt

SEQ ID NO: 5019205 - DNA, 17 bp, Homo sapiens
ctacttcctcctcccca

SEQ ID NO: 5019206 - DNA, 20 bp, Homo sapiens
ctacttcctcctccccactt

SEQ ID NO: 5019207 - DNA, 15 bp, Homo sapiens
ctacttggtttgtgt

SEQ ID NO: 5019208 - DNA, 17 bp, Homo sapiens
ctacttggtttgtgttc

SEQ ID NO: 5019209 - DNA, 18 bp, Homo sapiens
ctagctgaatgtttttct

SEQ ID NO: 5019210 - DNA, 19 bp, Homo sapiens
ctagctgaatgtttttcta

SEQ ID NO: 5019211 - DNA, 14 bp, Homo sapiens
ctagctgtgggggt

SEQ ID NO: 5019212 - DNA, 15 bp, Homo sapiens
ctaggactgcagtgt

SEQ ID NO: 5019213 - DNA, 11 bp, Homo sapiens
ctaggggctgg

SEQ ID NO: 5019214 - DNA, 12 bp, Homo sapiens
ctaggggctggg

SEQ ID NO: 5019215 - DNA, 13 bp, Homo sapiens
ctaggggctgggg

SEQ ID NO: 5019216 - DNA, 14 bp, Homo sapiens
ctagtcttttgctt

SEQ ID NO: 5019217 - DNA, 17 bp, Homo sapiens
ctagtcttttgcttttg

SEQ ID NO: 5019218 - DNA, 20 bp, Homo sapiens
ctagttttagttttctctta

SEQ ID NO: 5019219 - DNA, 16 bp, Homo sapiens
ctatagatgtcttttc

SEQ ID NO: 5019220 - DNA, 22 bp, Homo sapiens
ctatagatgtcttttcccattt

SEQ ID NO: 5019221 - DNA, 23 bp, Homo sapiens
ctatatatgtgatgatctaccag

SEQ ID NO: 5019222 - DNA, 17 bp, Homo sapiens
ctatgaaaatgctggct

SEQ ID NO: 5019223 - DNA, 13 bp, Homo sapiens
ctatgctgtttgt

SEQ ID NO: 5019224 - DNA, 15 bp, Homo sapiens
ctattccaaaaaggt

SEQ ID NO: 5019225 - DNA, 15 bp, Homo sapiens
ctatttaaagcctcc

SEQ ID NO: 5019226 - DNA, 15 bp, Homo sapiens
ctattttagaataaa

SEQ ID NO: 5019227 - DNA, 16 bp, Homo sapiens
ctcaaagagattcgaa

SEQ ID NO: 5019228 - DNA, 20 bp, Homo sapiens
ctcaaagcatgggattatta

SEQ ID NO: 5019229 - DNA, 20 bp, Homo sapiens
ctcaacccattgttgtcaag

SEQ ID NO: 5019230 - DNA, 16 bp, Homo sapiens
ctcaatgaagccagct

SEQ ID NO: 5019231 - DNA, 21 bp, Homo sapiens
ctcaatgagcatgtttagact

SEQ ID NO: 5019232 - DNA, 13 bp, Homo sapiens
ctcaatggactgg

SEQ ID NO: 5019233 - DNA, 17 bp, Homo sapiens
ctcaatggactggaagg

SEQ ID NO: 5019234 - DNA, 20 bp, Homo sapiens
ctcaatggactggaagggga

SEQ ID NO: 5019235 - DNA, 22 bp, Homo sapiens
ctcacagtattgctcacccagt

SEQ ID NO: 5019236 - DNA, 22 bp, Homo sapiens
ctcacccagtgccctctcccct

SEQ ID NO: 5019237 - DNA, 21 bp, Homo sapiens
ctcactcaccccagcgagctc

SEQ ID NO: 5019238 - DNA, 22 bp, Homo sapiens
ctcactgaactccttccccact

SEQ ID NO: 5019239 - DNA, 16 bp, Homo sapiens
ctcagaacatactgat

SEQ ID NO: 5019240 - DNA, 23 bp, Homo sapiens
ctcagaggtttacctagagaaca

SEQ ID NO: 5019241 - DNA, 15 bp, Homo sapiens
ctcagcactgcctgc

SEQ ID NO: 5019242 - DNA, 12 bp, Homo sapiens
ctcagcccagct

SEQ ID NO: 5019243 - DNA, 15 bp, Homo sapiens
ctcagcctctcccct

SEQ ID NO: 5019244 - DNA, 13 bp, Homo sapiens
ctcagctctggtc

SEQ ID NO: 5019245 - DNA, 13 bp, Homo sapiens
ctcaggcagcacc

SEQ ID NO: 5019246 - DNA, 14 bp, Homo sapiens
ctcaggcagctcaa

SEQ ID NO: 5019247 - DNA, 15 bp, Homo sapiens
ctcaggcagctcaag

SEQ ID NO: 5019248 - DNA, 16 bp, Homo sapiens
ctcagtgtgactcctc

SEQ ID NO: 5019249 - DNA, 13 bp, Homo sapiens
ctcatccacccca

SEQ ID NO: 5019250 - DNA, 15 bp, Homo sapiens
ctcatccaccccatc

SEQ ID NO: 5019251 - DNA, 16 bp, Homo sapiens
ctcatgcccagctctc

SEQ ID NO: 5019252 - DNA, 23 bp, Homo sapiens
ctcatgcccagctctctgacgct

SEQ ID NO: 5019253 - DNA, 15 bp, Homo sapiens
ctcatggcccctctg

SEQ ID NO: 5019254 - DNA, 17 bp, Homo sapiens
ctcatggcccctctgac

SEQ ID NO: 5019255 - DNA, 16 bp, Homo sapiens
ctcatgtacataccct

SEQ ID NO: 5019256 - DNA, 22 bp, Homo sapiens
ctcattggaaatttagcattgt

SEQ ID NO: 5019257 - DNA, 15 bp, Homo sapiens
ctccaaaccctcgag

SEQ ID NO: 5019258 - DNA, 20 bp, Homo sapiens
ctccaattaaggattttatg

SEQ ID NO: 5019259 - DNA, 22 bp, Homo sapiens
ctccaattaaggattttatgct

SEQ ID NO: 5019260 - DNA, 19 bp, Homo sapiens
ctccagattctgatgcata

SEQ ID NO: 5019261 - DNA, 17 bp, Homo sapiens
ctccaggtggctctgag

SEQ ID NO: 5019262 - DNA, 16 bp, Homo sapiens
ctccagtttgcatttg

SEQ ID NO: 5019263 - DNA, 14 bp, Homo sapiens
ctccattctatttt

SEQ ID NO: 5019264 - DNA, 16 bp, Homo sapiens
ctcccatcctgtgtgt

SEQ ID NO: 5019265 - DNA, 22 bp, Homo sapiens
ctccccaggccaccccgctgat

SEQ ID NO: 5019266 - DNA, 14 bp, Homo sapiens
ctcccctgtacctt

SEQ ID NO: 5019267 - DNA, 20 bp, Homo sapiens
ctccctattttttttctgtt

SEQ ID NO: 5019268 - DNA, 16 bp, Homo sapiens
ctccctcaactgaagg

SEQ ID NO: 5019269 - DNA, 23 bp, Homo sapiens
ctccctcatcaaggacacgggcc

SEQ ID NO: 5019270 - DNA, 10 bp, Homo sapiens
ctccctgggc

SEQ ID NO: 5019271 - DNA, 12 bp, Homo sapiens
ctccctgggcct

SEQ ID NO: 5019272 - DNA, 18 bp, Homo sapiens
ctcctctagctgtggggg

SEQ ID NO: 5019273 - DNA, 16 bp, Homo sapiens
ctcctgagtgcttgct

SEQ ID NO: 5019274 - DNA, 19 bp, Homo sapiens
ctcctgagtgcttgctttt

SEQ ID NO: 5019275 - DNA, 17 bp, Homo sapiens
ctcctggagctctgtgg

SEQ ID NO: 5019276 - DNA, 19 bp, Homo sapiens
ctcctggatctccctgaga

SEQ ID NO: 5019277 - DNA, 21 bp, Homo sapiens
ctcctggatctccctgagatg

SEQ ID NO: 5019278 - DNA, 14 bp, Homo sapiens
ctcctggtctgtga

SEQ ID NO: 5019279 - DNA, 23 bp, Homo sapiens
ctcctgtaacatactggcctgga

SEQ ID NO: 5019280 - DNA, 19 bp, Homo sapiens
ctccttagacctgagggac

SEQ ID NO: 5019281 - DNA, 17 bp, Homo sapiens
ctccttcccatcgctgt

SEQ ID NO: 5019282 - DNA, 13 bp, Homo sapiens
ctccttttaaaga

SEQ ID NO: 5019283 - DNA, 23 bp, Homo sapiens
ctcgagggcagggaccacaccct

SEQ ID NO: 5019284 - DNA, 18 bp, Homo sapiens
ctcggggacaccagagct

SEQ ID NO: 5019285 - DNA, 15 bp, Homo sapiens
ctcgtgagtcattta

SEQ ID NO: 5019286 - DNA, 19 bp, Homo sapiens
ctcgtttgtgttctgtttt

SEQ ID NO: 5019287 - DNA, 17 bp, Homo sapiens
ctctacatcttctgcct

SEQ ID NO: 5019288 - DNA, 13 bp, Homo sapiens
ctctattctttaa

SEQ ID NO: 5019289 - DNA, 16 bp, Homo sapiens
ctctcaaatccctctc

SEQ ID NO: 5019290 - DNA, 12 bp, Homo sapiens
ctctcagaacat

SEQ ID NO: 5019291 - DNA, 15 bp, Homo sapiens
ctctcagcctcccac

SEQ ID NO: 5019292 - DNA, 21 bp, Homo sapiens
caaagattaaatgtgtcattg

SEQ ID NO: 5019293 - DNA, 19 bp, Homo sapiens
caaagcatgggattattag

SEQ ID NO: 5019294 - DNA, 20 bp, Homo sapiens
caaagtatctaacaaaacca

SEQ ID NO: 5019295 - DNA, 13 bp, Homo sapiens
caaatgcagcttt

SEQ ID NO: 5019296 - DNA, 15 bp, Homo sapiens
caaatgtcttcctgg

SEQ ID NO: 5019297 - DNA, 21 bp, Homo sapiens
caaattaaaaaagataaacac

SEQ ID NO: 5019298 - DNA, 15 bp, Homo sapiens
caaattgctgcttgg

SEQ ID NO: 5019299 - DNA, 20 bp, Homo sapiens
caacaaggtggtgtgatctt

SEQ ID NO: 5019300 - DNA, 17 bp, Homo sapiens
caacagcaaatcacgac

SEQ ID NO: 5019301 - DNA, 15 bp, Homo sapiens
caacagcttcagaaa

SEQ ID NO: 5019302 - DNA, 23 bp, Homo sapiens
caaccagaaacacccctctgtct

SEQ ID NO: 5019303 - DNA, 23 bp, Homo sapiens
caaccagggccccggggcctgtt

SEQ ID NO: 5019304 - DNA, 23 bp, Homo sapiens
caaccatgagtggcatggccacc

SEQ ID NO: 5019305 - DNA, 18 bp, Homo sapiens
caacggccctgcagccag

SEQ ID NO: 5019306 - DNA, 20 bp, Homo sapiens
caacggccctgcagccagct

SEQ ID NO: 5019307 - DNA, 21 bp, Homo sapiens
caacgggattgaagggtcctg

SEQ ID NO: 5019308 - DNA, 23 bp, Homo sapiens
caacgggattgaagggtcctgcc

SEQ ID NO: 5019309 - DNA, 18 bp, Homo sapiens
caacgtgctctttgtttt

SEQ ID NO: 5019310 - DNA, 21 bp, Homo sapiens
caactgcctaaggccctttgt

SEQ ID NO: 5019311 - DNA, 18 bp, Homo sapiens
caactgctcagctctggt

SEQ ID NO: 5019312 - DNA, 23 bp, Homo sapiens
caacttgtattaaagacagaggc

SEQ ID NO: 5019313 - DNA, 14 bp, Homo sapiens
caagaaaaataaag

SEQ ID NO: 5019314 - DNA, 23 bp, Homo sapiens
caagaaaaataaagaaaagatgc

SEQ ID NO: 5019315 - DNA, 21 bp, Homo sapiens
caagaaatggcgtctgctctg

SEQ ID NO: 5019316 - DNA, 18 bp, Homo sapiens
caagaatcagtgcaaaga

SEQ ID NO: 5019317 - DNA, 16 bp, Homo sapiens
caagagaagcattctc

SEQ ID NO: 5019318 - DNA, 21 bp, Homo sapiens
caagagatctttctttccaaa

SEQ ID NO: 5019319 - DNA, 17 bp, Homo sapiens
caagagttcagtgctca

SEQ ID NO: 5019320 - DNA, 20 bp, Homo sapiens
caagattggtgtttttttct

SEQ ID NO: 5019321 - DNA, 22 bp, Homo sapiens
caagattggtgtttttttctat

SEQ ID NO: 5019322 - DNA, 16 bp, Homo sapiens
caagcagtgcctgcct

SEQ ID NO: 5019323 - DNA, 14 bp, Homo sapiens
caagcctgctggct

SEQ ID NO: 5019324 - DNA, 16 bp, Homo sapiens
caagcctgctggctgc

SEQ ID NO: 5019325 - DNA, 16 bp, Homo sapiens
caagcggtgtctctcc

SEQ ID NO: 5019326 - DNA, 15 bp, Homo sapiens
caaggaagaagaaat

SEQ ID NO: 5019327 - DNA, 19 bp, Homo sapiens
caaggaagaagaaatcttt

SEQ ID NO: 5019328 - DNA, 22 bp, Homo sapiens
caagtatggtaggggagggcag

SEQ ID NO: 5019329 - DNA, 11 bp, Homo sapiens
caagtattttt

SEQ ID NO: 5019330 - DNA, 18 bp, Homo sapiens
caagtgactgtatctgtg

SEQ ID NO: 5019331 - DNA, 21 bp, Homo sapiens
caagtgtgggccactgtggtg

SEQ ID NO: 5019332 - DNA, 17 bp, Homo sapiens
caagttgtttgagaaat

SEQ ID NO: 5019333 - DNA, 21 bp, Homo sapiens
caagttgtttgagaaattaag

SEQ ID NO: 5019334 - DNA, 17 bp, Homo sapiens
caatagccactaacctt

SEQ ID NO: 5019335 - DNA, 24 bp, Homo sapiens
caatagccactaaccttgcctggt

SEQ ID NO: 5019336 - DNA, 23 bp, Homo sapiens
caatcagagctccagtttgcatt

SEQ ID NO: 5019337 - DNA, 14 bp, Homo sapiens
caatgaagccagct

SEQ ID NO: 5019338 - DNA, 16 bp, Homo sapiens
caatgtggagcagcag

SEQ ID NO: 5019339 - DNA, 20 bp, Homo sapiens
caatgtggagcagcagccac

SEQ ID NO: 5019340 - DNA, 18 bp, Homo sapiens
caatgtgtataaacaaga

SEQ ID NO: 5019341 - DNA, 13 bp, Homo sapiens
caattcccctctg

SEQ ID NO: 5019342 - DNA, 22 bp, Homo sapiens
caattcctcatttgttcattaa

SEQ ID NO: 5019343 - DNA, 14 bp, Homo sapiens
caattcctggccct

SEQ ID NO: 5019344 - DNA, 16 bp, Homo sapiens
caattcctggccctgt

SEQ ID NO: 5019345 - DNA, 13 bp, Homo sapiens
caatttatttgaa

SEQ ID NO: 5019346 - DNA, 23 bp, Homo sapiens
caatttgcacatcttggctatgt

SEQ ID NO: 5019347 - DNA, 21 bp, Homo sapiens
caatttggtaaaaatgctgct

SEQ ID NO: 5019348 - DNA, 13 bp, Homo sapiens
cacaaattagtta

SEQ ID NO: 5019349 - DNA, 22 bp, Homo sapiens
cacaactcactccttttaaaga

SEQ ID NO: 5019350 - DNA, 19 bp, Homo sapiens
cacaattaaaccgcatgtg

SEQ ID NO: 5019351 - DNA, 18 bp, Homo sapiens
cacacaagaagaagggca

SEQ ID NO: 5019352 - DNA, 15 bp, Homo sapiens
cacacacacaaacct

SEQ ID NO: 5019353 - DNA, 11 bp, Homo sapiens
cacacacacac

SEQ ID NO: 5019354 - DNA, 14 bp, Homo sapiens
cacacacacacaca

SEQ ID NO: 5019355 - DNA, 15 bp, Homo sapiens
cacacacacacacaa

SEQ ID NO: 5019356 - DNA, 17 bp, Homo sapiens
cacacagatacacacac

SEQ ID NO: 5019357 - DNA, 18 bp, Homo sapiens
cacaccaagcagcaacag

SEQ ID NO: 5019358 - DNA, 19 bp, Homo sapiens
cacacgagcaaacccagag

SEQ ID NO: 5019359 - DNA, 21 bp, Homo sapiens
cacactgggtgcgtctccagt

SEQ ID NO: 5019360 - DNA, 18 bp, Homo sapiens
cacacttcaaactacttt

SEQ ID NO: 5019361 - DNA, 16 bp, Homo sapiens
cacagatacacacaca

SEQ ID NO: 5019362 - DNA, 16 bp, Homo sapiens
cacagcaattcctcag

SEQ ID NO: 5019363 - DNA, 18 bp, Homo sapiens
cacagcacaaattagtta

SEQ ID NO: 5019364 - DNA, 23 bp, Homo sapiens
cacagcacaaattagttatatat

SEQ ID NO: 5019365 - DNA, 17 bp, Homo sapiens
cacagccactaaaacac

SEQ ID NO: 5019366 - DNA, 18 bp, Homo sapiens
cacaggcacacagggccc

SEQ ID NO: 5019367 - DNA, 12 bp, Homo sapiens
cacaggccccct

SEQ ID NO: 5019368 - DNA, 13 bp, Homo sapiens
cacaggccccctt

SEQ ID NO: 5019369 - DNA, 21 bp, Homo sapiens
cacaggcccccttgagtgggg

SEQ ID NO: 5019370 - DNA, 17 bp, Homo sapiens
cacaggctccaaactgg

SEQ ID NO: 5019371 - DNA, 19 bp, Homo sapiens
cacaggctccaaactggag

SEQ ID NO: 5019372 - DNA, 22 bp, Homo sapiens
cacagggcccggccacacccag

SEQ ID NO: 5019373 - DNA, 18 bp, Homo sapiens
cacaggtgccgccagctg

SEQ ID NO: 5019374 - DNA, 22 bp, Homo sapiens
cacaggtgccgccagctgccgc

SEQ ID NO: 5019375 - DNA, 16 bp, Homo sapiens
cacagtccaaccagaa

SEQ ID NO: 5019376 - DNA, 14 bp, Homo sapiens
cacagtgccaccca

SEQ ID NO: 5019377 - DNA, 22 bp, Homo sapiens
cacagtggccaagatcacagtg

SEQ ID NO: 5019378 - DNA, 17 bp, Homo sapiens
cacatagcccacttaca

SEQ ID NO: 5019379 - DNA, 20 bp, Homo sapiens
cacatagcccacttacattt

SEQ ID NO: 5019380 - DNA, 20 bp, Homo sapiens
cacatcagcaatttcagaac

SEQ ID NO: 5019381 - DNA, 18 bp, Homo sapiens
cacatgaattattacagt

SEQ ID NO: 5019382 - DNA, 13 bp, Homo sapiens
cacatgtggactt

SEQ ID NO: 5019383 - DNA, 22 bp, Homo sapiens
cacattcaaaatagggtatatt

SEQ ID NO: 5019384 - DNA, 18 bp, Homo sapiens
cacattgtttgctgctat

SEQ ID NO: 5019385 - DNA, 18 bp, Homo sapiens
cacatttaccctttggcc

SEQ ID NO: 5019386 - DNA, 22 bp, Homo sapiens
caccaagttggaacatccttgg

SEQ ID NO: 5019387 - DNA, 15 bp, Homo sapiens
cagctctctgacgct

SEQ ID NO: 5019388 - DNA, 23 bp, Homo sapiens
cagctctggtccaggccctgtgg

SEQ ID NO: 5019389 - DNA, 17 bp, Homo sapiens
cagctgccgcaccagcc

SEQ ID NO: 5019390 - DNA, 21 bp, Homo sapiens
cagctgtgtctgccaaacaca

SEQ ID NO: 5019391 - DNA, 19 bp, Homo sapiens
cagcttatacgaaataatt

SEQ ID NO: 5019392 - DNA, 16 bp, Homo sapiens
cagctttctgggatgt

SEQ ID NO: 5019393 - DNA, 22 bp, Homo sapiens
caggaaacaaggggtctgagga

SEQ ID NO: 5019394 - DNA, 19 bp, Homo sapiens
caggaactgggctgggcct

SEQ ID NO: 5019395 - DNA, 13 bp, Homo sapiens
caggaagcctgca

SEQ ID NO: 5019396 - DNA, 17 bp, Homo sapiens
caggacagcgggaaaaa

SEQ ID NO: 5019397 - DNA, 13 bp, Homo sapiens
caggactggctgt

SEQ ID NO: 5019398 - DNA, 15 bp, Homo sapiens
caggagaagggctgg

SEQ ID NO: 5019399 - DNA, 22 bp, Homo sapiens
caggagactgggctctggctct

SEQ ID NO: 5019400 - DNA, 16 bp, Homo sapiens
caggagcacggctctg

SEQ ID NO: 5019401 - DNA, 16 bp, Homo sapiens
caggaggaatactgaa

SEQ ID NO: 5019402 - DNA, 21 bp, Homo sapiens
caggaggccctggtcctggcc

SEQ ID NO: 5019403 - DNA, 21 bp, Homo sapiens
caggaggcccttgtcgtggga

SEQ ID NO: 5019404 - DNA, 12 bp, Homo sapiens
caggcagcacca

SEQ ID NO: 5019405 - DNA, 15 bp, Homo sapiens
caggcagcaccacac

SEQ ID NO: 5019406 - DNA, 12 bp, Homo sapiens
caggcagcagag

SEQ ID NO: 5019407 - DNA, 21 bp, Homo sapiens
atgtttagactttaacataag

SEQ ID NO: 5019408 - DNA, 20 bp, Homo sapiens
atgttttttccttttcacat

SEQ ID NO: 5019409 - DNA, 21 bp, Homo sapiens
attaaacgatttttaaaatgt

SEQ ID NO: 5019410 - DNA, 16 bp, Homo sapiens
attaaagaaaaaaatg

SEQ ID NO: 5019411 - DNA, 21 bp, Homo sapiens
attaaagaagacctgagaatg

SEQ ID NO: 5019412 - DNA, 19 bp, Homo sapiens
attaaattttttgttgaca

SEQ ID NO: 5019413 - DNA, 17 bp, Homo sapiens
attaacctctcacagtt

SEQ ID NO: 5019414 - DNA, 20 bp, Homo sapiens
attaagaatgaaatactgtt

SEQ ID NO: 5019415 - DNA, 15 bp, Homo sapiens
attaataataaattc

SEQ ID NO: 5019416 - DNA, 16 bp, Homo sapiens
attaatgtacttgttt

SEQ ID NO: 5019417 - DNA, 23 bp, Homo sapiens
attaatgtacttgtttctctgtt

SEQ ID NO: 5019418 - DNA, 13 bp, Homo sapiens
attagaattattt

SEQ ID NO: 5019419 - DNA, 14 bp, Homo sapiens
attagaattattta

SEQ ID NO: 5019420 - DNA, 15 bp, Homo sapiens
attagtattgttgtc

SEQ ID NO: 5019421 - DNA, 12 bp, Homo sapiens
attagttatata

SEQ ID NO: 5019422 - DNA, 17 bp, Homo sapiens
attataacaagtgtgtc

SEQ ID NO: 5019423 - DNA, 19 bp, Homo sapiens
attatcgttttcttaaagt

SEQ ID NO: 5019424 - DNA, 13 bp, Homo sapiens
attattacttgta

SEQ ID NO: 5019425 - DNA, 19 bp, Homo sapiens
attattacttgtaaatata

SEQ ID NO: 5019426 - DNA, 12 bp, Homo sapiens
attatttaaaca

SEQ ID NO: 5019427 - DNA, 12 bp, Homo sapiens
attatttgtgtt

SEQ ID NO: 5019428 - DNA, 12 bp, Homo sapiens
attattttcatc

SEQ ID NO: 5019429 - DNA, 15 bp, Homo sapiens
attcaaattgctgct

SEQ ID NO: 5019430 - DNA, 14 bp, Homo sapiens
attcagcaaaccat

SEQ ID NO: 5019431 - DNA, 15 bp, Homo sapiens
attcagcaaaccatt

SEQ ID NO: 5019432 - DNA, 20 bp, Homo sapiens
attcagccccgggagtggcg

SEQ ID NO: 5019433 - DNA, 16 bp, Homo sapiens
attcattagtcatgtt

SEQ ID NO: 5019434 - DNA, 13 bp, Homo sapiens
attccaaaaacat

SEQ ID NO: 5019435 - DNA, 22 bp, Homo sapiens
attccagtcaaatctgggctca

SEQ ID NO: 5019436 - DNA, 14 bp, Homo sapiens
attcccactgccag

SEQ ID NO: 5019437 - DNA, 15 bp, Homo sapiens
attcccactgccagg

SEQ ID NO: 5019438 - DNA, 23 bp, Homo sapiens
attccccgtctctggttcctccc

SEQ ID NO: 5019439 - DNA, 13 bp, Homo sapiens
attccctggcctt

SEQ ID NO: 5019440 - DNA, 19 bp, Homo sapiens
attccctggcctttcatat

SEQ ID NO: 5019441 - DNA, 21 bp, Homo sapiens
attccctggcctttcatattt

SEQ ID NO: 5019442 - DNA, 13 bp, Homo sapiens
attcctcatttgt

SEQ ID NO: 5019443 - DNA, 19 bp, Homo sapiens
attcctcatttgttcatta

SEQ ID NO: 5019444 - DNA, 18 bp, Homo sapiens
attctattttagaataaa

SEQ ID NO: 5019445 - DNA, 22 bp, Homo sapiens
attctcattggaaatttagcat

SEQ ID NO: 5019446 - DNA, 16 bp, Homo sapiens
attctccctgggcctc

SEQ ID NO: 5019447 - DNA, 17 bp, Homo sapiens
attctgaatgcttctaa

SEQ ID NO: 5019448 - DNA, 15 bp, Homo sapiens
attctttccatttgc

SEQ ID NO: 5019449 - DNA, 20 bp, Homo sapiens
attctttccatttgcatttg

SEQ ID NO: 5019450 - DNA, 22 bp, Homo sapiens
attctttccatttgcatttgtt

SEQ ID NO: 5019451 - DNA, 16 bp, Homo sapiens
attgaaggttttagac

SEQ ID NO: 5019452 - DNA, 18 bp, Homo sapiens
attgccttctctgcccac

SEQ ID NO: 5019453 - DNA, 23 bp, Homo sapiens
attgctcacccagtgccctctcc

SEQ ID NO: 5019454 - DNA, 22 bp, Homo sapiens
attggaaatgtgaatcgcagct

SEQ ID NO: 5019455 - DNA, 23 bp, Homo sapiens
attggcatggaaatttaaagcag

SEQ ID NO: 5019456 - DNA, 15 bp, Homo sapiens
attggttcttgtatt

SEQ ID NO: 5019457 - DNA, 23 bp, Homo sapiens
attgtagtgctttgagagagaaa

SEQ ID NO: 5019458 - DNA, 21 bp, Homo sapiens
attgtgcaatgtgtataaaca

SEQ ID NO: 5019459 - DNA, 13 bp, Homo sapiens
attgttgttctgt

SEQ ID NO: 5019460 - DNA, 14 bp, Homo sapiens
atttaaacacacag

SEQ ID NO: 5019461 - DNA, 11 bp, Homo sapiens
atttaaagcag

SEQ ID NO: 5019462 - DNA, 12 bp, Homo sapiens
atttaaagcagg

SEQ ID NO: 5019463 - DNA, 20 bp, Homo sapiens
atttaaagcaggttcttgtt

SEQ ID NO: 5019464 - DNA, 20 bp, Homo sapiens
atttaacccccctgtacaca

SEQ ID NO: 5019465 - DNA, 14 bp, Homo sapiens
atttaccctttggc

SEQ ID NO: 5019466 - DNA, 19 bp, Homo sapiens
atttagacttggattcttt

SEQ ID NO: 5019467 - DNA, 13 bp, Homo sapiens
atttagcattgta

SEQ ID NO: 5019468 - DNA, 19 bp, Homo sapiens
atttagcattgtagtgctt

SEQ ID NO: 5019469 - DNA, 15 bp, Homo sapiens
atttataatcacttt

SEQ ID NO: 5019470 - DNA, 17 bp, Homo sapiens
atttatctaaatatgga

SEQ ID NO: 5019471 - DNA, 14 bp, Homo sapiens
atttatgtattgtg

SEQ ID NO: 5019472 - DNA, 17 bp, Homo sapiens
atttatgtattgtgcaa

SEQ ID NO: 5019473 - DNA, 13 bp, Homo sapiens
atttattaaagaa

SEQ ID NO: 5019474 - DNA, 15 bp, Homo sapiens
atttattaaagaaaa

SEQ ID NO: 5019475 - DNA, 16 bp, Homo sapiens
atttattaaagaaaaa

SEQ ID NO: 5019476 - DNA, 22 bp, Homo sapiens
atttattgcagaggatgttcat

SEQ ID NO: 5019477 - DNA, 16 bp, Homo sapiens
atttatttgaatgatt

SEQ ID NO: 5019478 - DNA, 16 bp, Homo sapiens
atttcaaacggcctca

SEQ ID NO: 5019479 - DNA, 20 bp, Homo sapiens
atttcaggaggaatactgaa

SEQ ID NO: 5019480 - DNA, 22 bp, Homo sapiens
atttcatacaacagaaaccaga

SEQ ID NO: 5019481 - DNA, 13 bp, Homo sapiens
atttccaacagca

SEQ ID NO: 5019482 - DNA, 17 bp, Homo sapiens
atttgaatgatttttct

SEQ ID NO: 5019483 - DNA, 22 bp, Homo sapiens
atttgaatgatttttctttaca

SEQ ID NO: 5019484 - DNA, 15 bp, Homo sapiens
atttgcatatgtatg

SEQ ID NO: 5019485 - DNA, 17 bp, Homo sapiens
atttgcatatttattgc

SEQ ID NO: 5019486 - DNA, 19 bp, Homo sapiens
atttgcatatttattgcat

SEQ ID NO: 5019487 - DNA, 21 bp, Homo sapiens
atttggtaaaaatgctgctct

SEQ ID NO: 5019488 - DNA, 23 bp, Homo sapiens
atttggtctcaggcagcaccaca

SEQ ID NO: 5019489 - DNA, 21 bp, Homo sapiens
atttgtgttttaatttaaaca

SEQ ID NO: 5019490 - DNA, 13 bp, Homo sapiens
atttgtttatgta

SEQ ID NO: 5019491 - DNA, 17 bp, Homo sapiens
atttgtttatgtaattt

SEQ ID NO: 5019492 - DNA, 19 bp, Homo sapiens
atttgtttatgtaatttca

SEQ ID NO: 5019493 - DNA, 16 bp, Homo sapiens
atttgtttcatttctg

SEQ ID NO: 5019494 - DNA, 16 bp, Homo sapiens
atttgtttttaaactg

SEQ ID NO: 5019495 - DNA, 17 bp, Homo sapiens
atttgtttttaaactgt

SEQ ID NO: 5019496 - DNA, 20 bp, Homo sapiens
attttaaaatagcgttcttg

SEQ ID NO: 5019497 - DNA, 15 bp, Homo sapiens
attttaccaaagcat

SEQ ID NO: 5019498 - DNA, 21 bp, Homo sapiens
attttataaatcgcttttgat

SEQ ID NO: 5019499 - DNA, 12 bp, Homo sapiens
attttatgcttt

SEQ ID NO: 5019500 - DNA, 19 bp, Homo sapiens
attttatgctttaaacatt

SEQ ID NO: 5019501 - DNA, 13 bp, Homo sapiens
attttatgttata

SEQ ID NO: 5019502 - DNA, 18 bp, Homo sapiens
attttatgttatatataa

SEQ ID NO: 5019503 - DNA, 23 bp, Homo sapiens
attttatgttatatataaatata

SEQ ID NO: 5019504 - DNA, 14 bp, Homo sapiens
attttattttcatg

SEQ ID NO: 5019505 - DNA, 17 bp, Homo sapiens
attttcaatagccacta

SEQ ID NO: 5019506 - DNA, 20 bp, Homo sapiens
attttcaatagccactaacc

SEQ ID NO: 5019507 - DNA, 15 bp, Homo sapiens
attttcacataaaat

SEQ ID NO: 5019508 - DNA, 17 bp, Homo sapiens
attttcatccttgtctt

SEQ ID NO: 5019509 - DNA, 19 bp, Homo sapiens
attttcttattgcgctgct

SEQ ID NO: 5019510 - DNA, 21 bp, Homo sapiens
attttcttattgcgctgctac

SEQ ID NO: 5019511 - DNA, 17 bp, Homo sapiens
attttgataccagaagg

SEQ ID NO: 5019512 - DNA, 19 bp, Homo sapiens
attttgataccagaaggga

SEQ ID NO: 5019513 - DNA, 12 bp, Homo sapiens
atttttctaact

SEQ ID NO: 5019514 - DNA, 19 bp, Homo sapiens
atttttctaactacaaagg

SEQ ID NO: 5019515 - DNA, 15 bp, Homo sapiens
atttttctttacaaa

SEQ ID NO: 5019516 - DNA, 17 bp, Homo sapiens
atttttgttagcaaaga

SEQ ID NO: 5019517 - DNA, 21 bp, Homo sapiens
atttttgttagcaaagattaa

SEQ ID NO: 5019518 - DNA, 12 bp, Homo sapiens
attttttgttga

SEQ ID NO: 5019519 - DNA, 14 bp, Homo sapiens
attttttgttgaca

SEQ ID NO: 5019520 - DNA, 18 bp, Homo sapiens
catgaattattacagtgt

SEQ ID NO: 5019521 - DNA, 20 bp, Homo sapiens
catgaattattacagtgttt

SEQ ID NO: 5019522 - DNA, 12 bp, Homo sapiens
catgcaaactct

SEQ ID NO: 5019523 - DNA, 22 bp, Homo sapiens
catgcaaccgggccctctctct

SEQ ID NO: 5019524 - DNA, 20 bp, Homo sapiens
catgcaccaggactggctgt

SEQ ID NO: 5019525 - DNA, 22 bp, Homo sapiens
catgcaccaggactggctgtgt

SEQ ID NO: 5019526 - DNA, 22 bp, Homo sapiens
catgcagacctcatgcccagct

SEQ ID NO: 5019527 - DNA, 22 bp, Homo sapiens
catgcagctgctccccaggcca

SEQ ID NO: 5019528 - DNA, 15 bp, Homo sapiens
catgcaggaggtgga

SEQ ID NO: 5019529 - DNA, 21 bp, Homo sapiens
catgccagctacttcctcctc

SEQ ID NO: 5019530 - DNA, 17 bp, Homo sapiens
catgccctgtgtggctg

SEQ ID NO: 5019531 - DNA, 18 bp, Homo sapiens
catggaaatttaaagcag

SEQ ID NO: 5019532 - DNA, 12 bp, Homo sapiens
catggcccctct

SEQ ID NO: 5019533 - DNA, 16 bp, Homo sapiens
catggcccctctgacc

SEQ ID NO: 5019534 - DNA, 17 bp, Homo sapiens
catggcccctctgacct

SEQ ID NO: 5019535 - DNA, 14 bp, Homo sapiens
catggcctctgcaa

SEQ ID NO: 5019536 - DNA, 11 bp, Homo sapiens
catgggtgggg

SEQ ID NO: 5019537 - DNA, 16 bp, Homo sapiens
catggtggacccagcg

SEQ ID NO: 5019538 - DNA, 17 bp, Homo sapiens
catgtaaccggcatgtt

SEQ ID NO: 5019539 - DNA, 18 bp, Homo sapiens
catgtaaccggcatgttt

SEQ ID NO: 5019540 - DNA, 18 bp, Homo sapiens
catgtatttgtttgcata

SEQ ID NO: 5019541 - DNA, 15 bp, Homo sapiens
catgtttagacttta

SEQ ID NO: 5019542 - DNA, 19 bp, Homo sapiens
cattagaattatttaaaca

SEQ ID NO: 5019543 - DNA, 21 bp, Homo sapiens
cattagtcatgtttatctgct

SEQ ID NO: 5019544 - DNA, 17 bp, Homo sapiens
cattccaaagctttatt

SEQ ID NO: 5019545 - DNA, 17 bp, Homo sapiens
cattctacacagagcag

SEQ ID NO: 5019546 - DNA, 18 bp, Homo sapiens
cattctaggtttgcaaga

SEQ ID NO: 5019547 - DNA, 16 bp, Homo sapiens
cattctattttagaat

SEQ ID NO: 5019548 - DNA, 17 bp, Homo sapiens
cattctattttagaata

SEQ ID NO: 5019549 - DNA, 11 bp, Homo sapiens
cattctgaatg

SEQ ID NO: 5019550 - DNA, 14 bp, Homo sapiens
cattgcaacctcca

SEQ ID NO: 5019551 - DNA, 22 bp, Homo sapiens
cattgctggtagagacccccag

SEQ ID NO: 5019552 - DNA, 23 bp, Homo sapiens
cattgctggtagagacccccagg

SEQ ID NO: 5019553 - DNA, 21 bp, Homo sapiens
cattggaaatttagcattgta

SEQ ID NO: 5019554 - DNA, 19 bp, Homo sapiens
cattggctcagcccgctga

SEQ ID NO: 5019555 - DNA, 15 bp, Homo sapiens
cattggttcttgtat

SEQ ID NO: 5019556 - DNA, 24 bp, Homo sapiens
cattgtagtgctttgagagagaaa

SEQ ID NO: 5019557 - DNA, 13 bp, Homo sapiens
cattgttgtcaag

SEQ ID NO: 5019558 - DNA, 20 bp, Homo sapiens
catttaacccccctgtacac

SEQ ID NO: 5019559 - DNA, 18 bp, Homo sapiens
catttcaattcctggccc

SEQ ID NO: 5019560 - DNA, 19 bp, Homo sapiens
catttccacaccaagcagc

SEQ ID NO: 5019561 - DNA, 12 bp, Homo sapiens
catttctgcaga

SEQ ID NO: 5019562 - DNA, 14 bp, Homo sapiens
catttggtctcagg

SEQ ID NO: 5019563 - DNA, 17 bp, Homo sapiens
catttgttcattaaacg

SEQ ID NO: 5019564 - DNA, 21 bp, Homo sapiens
cattttaaaaacatagaaaaa

SEQ ID NO: 5019565 - DNA, 17 bp, Homo sapiens
cattttataaatcgctt

SEQ ID NO: 5019566 - DNA, 18 bp, Homo sapiens
cattttataaatcgcttt

SEQ ID NO: 5019567 - DNA, 21 bp, Homo sapiens
cattttataaatcgcttttga

SEQ ID NO: 5019568 - DNA, 23 bp, Homo sapiens
cattttataaatcgcttttgata

SEQ ID NO: 5019569 - DNA, 19 bp, Homo sapiens
cattttgaaagtctgtcct

SEQ ID NO: 5019570 - DNA, 23 bp, Homo sapiens
cattttgaatcacatgaattatt

SEQ ID NO: 5019571 - DNA, 23 bp, Homo sapiens
catttttacaccaatttggtaaa

SEQ ID NO: 5019572 - DNA, 15 bp, Homo sapiens
ccaaacaccttccag

SEQ ID NO: 5019573 - DNA, 22 bp, Homo sapiens
ccaaacaccttccagctcctgt

SEQ ID NO: 5019574 - DNA, 17 bp, Homo sapiens
ccaaagagcctttccaa

SEQ ID NO: 5019575 - DNA, 12 bp, Homo sapiens
ccaaagctttat

SEQ ID NO: 5019576 - DNA, 15 bp, Homo sapiens
ccaaattaaaaaaga

SEQ ID NO: 5019577 - DNA, 17 bp, Homo sapiens
ccaaattaaaaaagata

SEQ ID NO: 5019578 - DNA, 18 bp, Homo sapiens
ccaaattaaaaaagataa

SEQ ID NO: 5019579 - DNA, 11 bp, Homo sapiens
ccaacaaacca

SEQ ID NO: 5019580 - DNA, 21 bp, Homo sapiens
ccaacatgtttctgttttgtt

SEQ ID NO: 5019581 - DNA, 18 bp, Homo sapiens
ccaaccctggcacccagg

SEQ ID NO: 5019582 - DNA, 20 bp, Homo sapiens
ccaacggccctgcagccagc

SEQ ID NO: 5019583 - DNA, 23 bp, Homo sapiens
ccaacttgtattaaagacagagg

SEQ ID NO: 5019584 - DNA, 20 bp, Homo sapiens
ccaagagaaggggaagcact

SEQ ID NO: 5019585 - DNA, 18 bp, Homo sapiens
ccaagagtccaggaggcc

SEQ ID NO: 5019586 - DNA, 18 bp, Homo sapiens
ccaagcctgctggctgcg

SEQ ID NO: 5019587 - DNA, 13 bp, Homo sapiens
ccaagggctgccg

SEQ ID NO: 5019588 - DNA, 23 bp, Homo sapiens
ccaatttggtaaaaatgctgctc

SEQ ID NO: 5019589 - DNA, 14 bp, Homo sapiens
ccacacaggctggc

SEQ ID NO: 5019590 - DNA, 15 bp, Homo sapiens
ccacacccagcggcc

SEQ ID NO: 5019591 - DNA, 16 bp, Homo sapiens
ccacacccagctcagc

SEQ ID NO: 5019592 - DNA, 16 bp, Homo sapiens
ccacaccctgtactgt

SEQ ID NO: 5019593 - DNA, 13 bp, Homo sapiens
ccacactccagct

SEQ ID NO: 5019594 - DNA, 22 bp, Homo sapiens
ccacactgggtgcgtctccagt

SEQ ID NO: 5019595 - DNA, 23 bp, Homo sapiens
ccacagcgctggccgggaccccg

SEQ ID NO: 5019596 - DNA, 19 bp, Homo sapiens
ccacaggaagcctgcagtc

SEQ ID NO: 5019597 - DNA, 23 bp, Homo sapiens
ccacaggaagcctgcagtcctgg

SEQ ID NO: 5019598 - DNA, 13 bp, Homo sapiens
ccacattaaagaa

SEQ ID NO: 5019599 - DNA, 13 bp, Homo sapiens
ccaccatccccac

SEQ ID NO: 5019600 - DNA, 16 bp, Homo sapiens
ccacccccagctcaat

SEQ ID NO: 5019601 - DNA, 14 bp, Homo sapiens
ccacccccgccatg

SEQ ID NO: 5019602 - DNA, 20 bp, Homo sapiens
ccaccggaggtcactccacc

SEQ ID NO: 5019603 - DNA, 21 bp, Homo sapiens
ccacctagactgtaaacctct

SEQ ID NO: 5019604 - DNA, 20 bp, Homo sapiens
ccacggcgttgtacctgtag

SEQ ID NO: 5019605 - DNA, 21 bp, Homo sapiens
ccactgccccccgaggctgct

SEQ ID NO: 5019606 - DNA, 21 bp, Homo sapiens
ccacttacatttacaaactga

SEQ ID NO: 5019607 - DNA, 14 bp, Homo sapiens
ccacttctgtgcca

SEQ ID NO: 5019608 - DNA, 13 bp, Homo sapiens
ccactttgaaggg

SEQ ID NO: 5019609 - DNA, 16 bp, Homo sapiens
ccagaaccaattattt

SEQ ID NO: 5019610 - DNA, 13 bp, Homo sapiens
ccagaatttcaaa

SEQ ID NO: 5019611 - DNA, 20 bp, Homo sapiens
ccagacgatgtcttcatacc

SEQ ID NO: 5019612 - DNA, 18 bp, Homo sapiens
ccagactctttttttgag

SEQ ID NO: 5019613 - DNA, 20 bp, Homo sapiens
ccagagaccaggctgtgtcc

SEQ ID NO: 5019614 - DNA, 23 bp, Homo sapiens
ccagagctgccgacttggagact

SEQ ID NO: 5019615 - DNA, 17 bp, Homo sapiens
ccagcaaattgctagtc

SEQ ID NO: 5019616 - DNA, 22 bp, Homo sapiens
ccagcaagcggggatgtccctg

SEQ ID NO: 5019617 - DNA, 21 bp, Homo sapiens
ccagcacggtgactctgtcca

SEQ ID NO: 5019618 - DNA, 20 bp, Homo sapiens
ccagcagctgccaggagcac

SEQ ID NO: 5019619 - DNA, 23 bp, Homo sapiens
ccagcagctgccaggagcacggc

SEQ ID NO: 5019620 - DNA, 19 bp, Homo sapiens
ccagccaacctgggggctt

SEQ ID NO: 5019621 - DNA, 18 bp, Homo sapiens
ccagccctggctgaagga

SEQ ID NO: 5019622 - DNA, 21 bp, Homo sapiens
ccagccctggctgaaggactg

SEQ ID NO: 5019623 - DNA, 14 bp, Homo sapiens
ccagccgtatttta

SEQ ID NO: 5019624 - DNA, 15 bp, Homo sapiens
ccagcctctggcatt

SEQ ID NO: 5019625 - DNA, 16 bp, Homo sapiens
ccagcctgcctggcag

SEQ ID NO: 5019626 - DNA, 18 bp, Homo sapiens
ccagcctgcctggcaggc

SEQ ID NO: 5019627 - DNA, 21 bp, Homo sapiens
ccagcctgcctggcaggctgt

SEQ ID NO: 5019628 - DNA, 21 bp, Homo sapiens
ccagctaccctttttctccag

SEQ ID NO: 5019629 - DNA, 13 bp, Homo sapiens
ccagctctctgac

SEQ ID NO: 5019630 - DNA, 14 bp, Homo sapiens
ccagctctctgacg

SEQ ID NO: 5019631 - DNA, 16 bp, Homo sapiens
ccagctctctgacgct

SEQ ID NO: 5019632 - DNA, 16 bp, Homo sapiens
ccctcatggcccctct

SEQ ID NO: 5019633 - DNA, 21 bp, Homo sapiens
ccctcatggcccctctgacct

SEQ ID NO: 5019634 - DNA, 12 bp, Homo sapiens
ccctcccacagc

SEQ ID NO: 5019635 - DNA, 13 bp, Homo sapiens
ccctccccccaga

SEQ ID NO: 5019636 - DNA, 12 bp, Homo sapiens
ccctcccccttg

SEQ ID NO: 5019637 - DNA, 15 bp, Homo sapiens
ccctcccccttgtcc

SEQ ID NO: 5019638 - DNA, 16 bp, Homo sapiens
ccctcccctctcagaa

SEQ ID NO: 5019639 - DNA, 11 bp, Homo sapiens
ccctcctcctg

SEQ ID NO: 5019640 - DNA, 18 bp, Homo sapiens
ccctcctcctggactcct

SEQ ID NO: 5019641 - DNA, 20 bp, Homo sapiens
ccctcctggagctctgtggg

SEQ ID NO: 5019642 - DNA, 21 bp, Homo sapiens
ccctcctggagctctgtgggt

SEQ ID NO: 5019643 - DNA, 13 bp, Homo sapiens
ccctcctggctct

SEQ ID NO: 5019644 - DNA, 21 bp, Homo sapiens
ccctctcggccaggcattggc

SEQ ID NO: 5019645 - DNA, 14 bp, Homo sapiens
ccctgcacaggcac

SEQ ID NO: 5019646 - DNA, 15 bp, Homo sapiens
ccctgccccccagcc

SEQ ID NO: 5019647 - DNA, 19 bp, Homo sapiens
ccctgcccctcctctccct

SEQ ID NO: 5019648 - DNA, 15 bp, Homo sapiens
ccctgcctctaccca

SEQ ID NO: 5019649 - DNA, 19 bp, Homo sapiens
ccctgcctctacccaacca

SEQ ID NO: 5019650 - DNA, 13 bp, Homo sapiens
ccctgctgtctct

SEQ ID NO: 5019651 - DNA, 17 bp, Homo sapiens
ccctgctgtctctctgg

SEQ ID NO: 5019652 - DNA, 18 bp, Homo sapiens
ccctggccccgcctgcct

SEQ ID NO: 5019653 - DNA, 16 bp, Homo sapiens
ccctggctctgggccg

SEQ ID NO: 5019654 - DNA, 23 bp, Homo sapiens
ccctgggagggacatgcttagca

SEQ ID NO: 5019655 - DNA, 13 bp, Homo sapiens
ccctggtgacatc

SEQ ID NO: 5019656 - DNA, 18 bp, Homo sapiens
ccctgtactgttctgtgt

SEQ ID NO: 5019657 - DNA, 22 bp, Homo sapiens
ccctgtccggcccagtgccact

SEQ ID NO: 5019658 - DNA, 9 bp, Homo sapiens
aaaaaatag

SEQ ID NO: 5019659 - DNA, 15 bp, Homo sapiens
aaaaacatattcttg

SEQ ID NO: 5019660 - DNA, 18 bp, Homo sapiens
aaaaacctgagatttatt

SEQ ID NO: 5019661 - DNA, 17 bp, Homo sapiens
aaaaactacattttgca

SEQ ID NO: 5019662 - DNA, 15 bp, Homo sapiens
aaaaagttgcagctg

SEQ ID NO: 5019663 - DNA, 12 bp, Homo sapiens
aaaaataaagaa

SEQ ID NO: 5019664 - DNA, 23 bp, Homo sapiens
aaaaatatgaccacactccagct

SEQ ID NO: 5019665 - DNA, 23 bp, Homo sapiens
aaaaatcgatgagcgccacctct

SEQ ID NO: 5019666 - DNA, 15 bp, Homo sapiens
aaaacaaactcattc

SEQ ID NO: 5019667 - DNA, 11 bp, Homo sapiens
aaaacatttct

SEQ ID NO: 5019668 - DNA, 18 bp, Homo sapiens
aaaacctgagatttatta

SEQ ID NO: 5019669 - DNA, 22 bp, Homo sapiens
aaaacctgagatttattaaaga

SEQ ID NO: 5019670 - DNA, 18 bp, Homo sapiens
aaaacttcattctcgtga

SEQ ID NO: 5019671 - DNA, 11 bp, Homo sapiens
aaaagaacaat

SEQ ID NO: 5019672 - DNA, 18 bp, Homo sapiens
aaaagatgcactttgctt

SEQ ID NO: 5019673 - DNA, 19 bp, Homo sapiens
aaaagcgtgagcttaaaat

SEQ ID NO: 5019674 - DNA, 21 bp, Homo sapiens
aaaagcgtgagcttaaaatac

SEQ ID NO: 5019675 - DNA, 22 bp, Homo sapiens
aaaaggtatttattgagcacct

SEQ ID NO: 5019676 - DNA, 15 bp, Homo sapiens
aaaagtgcaagtcca

SEQ ID NO: 5019677 - DNA, 13 bp, Homo sapiens
aaaagttggaagg

SEQ ID NO: 5019678 - DNA, 16 bp, Homo sapiens
aaaatagcgttcttgt

SEQ ID NO: 5019679 - DNA, 12 bp, Homo sapiens
aaaatgctgctc

SEQ ID NO: 5019680 - DNA, 16 bp, Homo sapiens
aaaatgtattttatgt

SEQ ID NO: 5019681 - DNA, 18 bp, Homo sapiens
aaaattcagcaaaccatt

SEQ ID NO: 5019682 - DNA, 14 bp, Homo sapiens
aaaattgaaatgta

SEQ ID NO: 5019683 - DNA, 17 bp, Homo sapiens
aaaattgaaatgtaagg

SEQ ID NO: 5019684 - DNA, 21 bp, Homo sapiens
aaacacaagattggtgttttt

SEQ ID NO: 5019685 - DNA, 20 bp, Homo sapiens
aaacacccctctgtctagga

SEQ ID NO: 5019686 - DNA, 11 bp, Homo sapiens
aaacaggcagt

SEQ ID NO: 5019687 - DNA, 21 bp, Homo sapiens
aaacattggttcttgtattaa

SEQ ID NO: 5019688 - DNA, 14 bp, Homo sapiens
aaaccacacaaaga

SEQ ID NO: 5019689 - DNA, 23 bp, Homo sapiens
aaacctgagatttattaaagaaa

SEQ ID NO: 5019690 - DNA, 20 bp, Homo sapiens
aaacgatttttaaaatgtac

SEQ ID NO: 5019691 - DNA, 23 bp, Homo sapiens
aaacggcctcactaggcttctgg

SEQ ID NO: 5019692 - DNA, 15 bp, Homo sapiens
aaactaataattgca

SEQ ID NO: 5019693 - DNA, 20 bp, Homo sapiens
aaactactttgctgctaata

SEQ ID NO: 5019694 - DNA, 21 bp, Homo sapiens
aaactctttggtcgttttttt

SEQ ID NO: 5019695 - DNA, 17 bp, Homo sapiens
aaactgcttgtttccta

SEQ ID NO: 5019696 - DNA, 19 bp, Homo sapiens
aaactgcttgtttcctagc

SEQ ID NO: 5019697 - DNA, 17 bp, Homo sapiens
aaacttagtgacaaaat

SEQ ID NO: 5019698 - DNA, 17 bp, Homo sapiens
aaacttcattctcgtga

SEQ ID NO: 5019699 - DNA, 17 bp, Homo sapiens
aaagaaaagatgcactt

SEQ ID NO: 5019700 - DNA, 20 bp, Homo sapiens
aaagaaaagatgcactttgc

SEQ ID NO: 5019701 - DNA, 18 bp, Homo sapiens
aaagaagacctgagaatg

SEQ ID NO: 5019702 - DNA, 21 bp, Homo sapiens
aaagacatcagtctccaacat

SEQ ID NO: 5019703 - DNA, 20 bp, Homo sapiens
aaagacattgattcagcctg

SEQ ID NO: 5019704 - DNA, 18 bp, Homo sapiens
aaagacgttttataagca

SEQ ID NO: 5019705 - DNA, 11 bp, Homo sapiens
aaagagagaga

SEQ ID NO: 5019706 - DNA, 20 bp, Homo sapiens
aaagagagagagagaaaaaa

SEQ ID NO: 5019707 - DNA, 13 bp, Homo sapiens
aaagagattcgaa

SEQ ID NO: 5019708 - DNA, 14 bp, Homo sapiens
aaagagattcgaat

SEQ ID NO: 5019709 - DNA, 15 bp, Homo sapiens
aaagatcatgtaaaa

SEQ ID NO: 5019710 - DNA, 14 bp, Homo sapiens
aaagatgccacatt

SEQ ID NO: 5019711 - DNA, 19 bp, Homo sapiens
aaagattaaatgtgtcatt

SEQ ID NO: 5019712 - DNA, 12 bp, Homo sapiens
aaagcaaaacat

SEQ ID NO: 5019713 - DNA, 15 bp, Homo sapiens
aaagcaggttcttgt

SEQ ID NO: 5019714 - DNA, 22 bp, Homo sapiens
aaagcgtgagcttaaaatacaa

SEQ ID NO: 5019715 - DNA, 19 bp, Homo sapiens
aaagctttgaatactgtga

SEQ ID NO: 5019716 - DNA, 11 bp, Homo sapiens
aaaggagttta

SEQ ID NO: 5019717 - DNA, 15 bp, Homo sapiens
aaaggagtttatgtt

SEQ ID NO: 5019718 - DNA, 16 bp, Homo sapiens
aaaggattttaccaaa

SEQ ID NO: 5019719 - DNA, 19 bp, Homo sapiens
aaaggtttgcattctcaca

SEQ ID NO: 5019720 - DNA, 19 bp, Homo sapiens
aaagtctgtccttgaagga

SEQ ID NO: 5019721 - DNA, 22 bp, Homo sapiens
aaagtctgtccttgaaggacta

SEQ ID NO: 5019722 - DNA, 15 bp, Homo sapiens
aaagtgataagtgca

SEQ ID NO: 5019723 - DNA, 15 bp, Homo sapiens
aaagtgccagtattt

SEQ ID NO: 5019724 - DNA, 21 bp, Homo sapiens
aaagttattaatattttaatt

SEQ ID NO: 5019725 - DNA, 19 bp, Homo sapiens
aaagttgcagctgttttgt

SEQ ID NO: 5019726 - DNA, 20 bp, Homo sapiens
aaagttgcagctgttttgtt

SEQ ID NO: 5019727 - DNA, 12 bp, Homo sapiens
aaataaaagcac

SEQ ID NO: 5019728 - DNA, 13 bp, Homo sapiens
aaataaaagcaca

SEQ ID NO: 5019729 - DNA, 20 bp, Homo sapiens
aaataacaaatgccaaatta

SEQ ID NO: 5019730 - DNA, 13 bp, Homo sapiens
aaataattgttgt

SEQ ID NO: 5019731 - DNA, 15 bp, Homo sapiens
aaataattgttgttc

SEQ ID NO: 5019732 - DNA, 17 bp, Homo sapiens
aaataattgttgttctg

SEQ ID NO: 5019733 - DNA, 14 bp, Homo sapiens
aaatacaagactgc

SEQ ID NO: 5019734 - DNA, 14 bp, Homo sapiens
aaatactgtttgag

SEQ ID NO: 5019735 - DNA, 15 bp, Homo sapiens
aaatagcgttcttgt

SEQ ID NO: 5019736 - DNA, 18 bp, Homo sapiens
aaatagcgttcttgtaat

SEQ ID NO: 5019737 - DNA, 21 bp, Homo sapiens
aaatagcgttcttgtaatttt

SEQ ID NO: 5019738 - DNA, 16 bp, Homo sapiens
aaatagcttatgaaaa

SEQ ID NO: 5019739 - DNA, 20 bp, Homo sapiens
aaatagggtatattttccta

SEQ ID NO: 5019740 - DNA, 20 bp, Homo sapiens
aaatcgatgagcgccacctc

SEQ ID NO: 5019741 - DNA, 13 bp, Homo sapiens
aaatgctgctctc

SEQ ID NO: 5019742 - DNA, 14 bp, Homo sapiens
aaatggcgtctgct

SEQ ID NO: 5019743 - DNA, 17 bp, Homo sapiens
aaatggcgtctgctctg

SEQ ID NO: 5019744 - DNA, 20 bp, Homo sapiens
aaatgtaaggctgtgtaaga

SEQ ID NO: 5019745 - DNA, 14 bp, Homo sapiens
aaatgtcttcctgg

SEQ ID NO: 5019746 - DNA, 23 bp, Homo sapiens
aaatgtgtacaatgtacacactg

SEQ ID NO: 5019747 - DNA, 14 bp, Homo sapiens
aaattaaaaaagat

SEQ ID NO: 5019748 - DNA, 22 bp, Homo sapiens
aaattcaccccctttcctggac

SEQ ID NO: 5019749 - DNA, 16 bp, Homo sapiens
aaattcagaacagcct

SEQ ID NO: 5019750 - DNA, 15 bp, Homo sapiens
aaattccctggcctt

SEQ ID NO: 5019751 - DNA, 18 bp, Homo sapiens
aaattccctggcctttca

SEQ ID NO: 5019752 - DNA, 13 bp, Homo sapiens
aaattgaaatgta

SEQ ID NO: 5019753 - DNA, 20 bp, Homo sapiens
aaattgaaatgtaaggctgt

SEQ ID NO: 5019754 - DNA, 11 bp, Homo sapiens
aaattttttgt

SEQ ID NO: 5019755 - DNA, 10 bp, Homo sapiens
aacaaaccat

SEQ ID NO: 5019756 - DNA, 19 bp, Homo sapiens
aacaagaaaaataaagaaa

SEQ ID NO: 5019757 - DNA, 17 bp, Homo sapiens
aacaagagaagcattct

SEQ ID NO: 5019758 - DNA, 20 bp, Homo sapiens
aacaatctggaagaaaaaaa

SEQ ID NO: 5019759 - DNA, 18 bp, Homo sapiens
aacaatttggcaattttg

SEQ ID NO: 5019760 - DNA, 21 bp, Homo sapiens
aacacaagattggtgtttttt

SEQ ID NO: 5019761 - DNA, 23 bp, Homo sapiens
aacacaagattggtgtttttttc

SEQ ID NO: 5019762 - DNA, 17 bp, Homo sapiens
aacacactaccgaatgt

SEQ ID NO: 5019763 - DNA, 18 bp, Homo sapiens
aacacagcaattcctcag

SEQ ID NO: 5019764 - DNA, 15 bp, Homo sapiens
aacacccctctgtct

SEQ ID NO: 5019765 - DNA, 17 bp, Homo sapiens
aacaccttccagctcct

SEQ ID NO: 5019766 - DNA, 11 bp, Homo sapiens
aacagacaagt

SEQ ID NO: 5019767 - DNA, 13 bp, Homo sapiens
aacagctcgactt

SEQ ID NO: 5019768 - DNA, 13 bp, Homo sapiens
aacagctgtgtct

SEQ ID NO: 5019769 - DNA, 20 bp, Homo sapiens
aacagcttcagaaagagctc

SEQ ID NO: 5019770 - DNA, 18 bp, Homo sapiens
aacatcgcaatagttttt

SEQ ID NO: 5019771 - DNA, 14 bp, Homo sapiens
aacatctctgcagt

SEQ ID NO: 5019772 - DNA, 15 bp, Homo sapiens
aacatctctgcagtt

SEQ ID NO: 5019773 - DNA, 20 bp, Homo sapiens
aacatgtaaccggcatgttt

SEQ ID NO: 5019774 - DNA, 22 bp, Homo sapiens
aacatgttgtacatttcaccat

SEQ ID NO: 5019775 - DNA, 14 bp, Homo sapiens
aacatgtttctgtt

SEQ ID NO: 5019776 - DNA, 12 bp, Homo sapiens
aacattcccact

SEQ ID NO: 5019777 - DNA, 17 bp, Homo sapiens
aacattcccagcccagc

SEQ ID NO: 5019778 - DNA, 16 bp, Homo sapiens
aacattggttcttgta

SEQ ID NO: 5019779 - DNA, 18 bp, Homo sapiens
aacattggttcttgtatt

SEQ ID NO: 5019780 - DNA, 12 bp, Homo sapiens
aacattgtatta

SEQ ID NO: 5019781 - DNA, 23 bp, Homo sapiens
aacattttgaaagtctgtccttg

SEQ ID NO: 5019782 - DNA, 14 bp, Homo sapiens
aaccaattattttc

SEQ ID NO: 5019783 - DNA, 22 bp, Homo sapiens
aaccagaaaagcaatactgttt

SEQ ID NO: 5019784 - DNA, 22 bp, Homo sapiens
aaccagaaacacccctctgtct

SEQ ID NO: 5019785 - DNA, 17 bp, Homo sapiens
aaccagctcagcactgc

SEQ ID NO: 5019786 - DNA, 20 bp, Homo sapiens
aaccatccagtgacaaacca

SEQ ID NO: 5019787 - DNA, 22 bp, Homo sapiens
aaccatccagtgacaaaccatc

SEQ ID NO: 5019788 - DNA, 23 bp, Homo sapiens
aaccatgagtggcatggccacca

SEQ ID NO: 5019789 - DNA, 21 bp, Homo sapiens
aaccatttccaacagcaacac

SEQ ID NO: 5019790 - DNA, 22 bp, Homo sapiens
aacccagaggtggatgttatga

SEQ ID NO: 5019791 - DNA, 18 bp, Homo sapiens
aacccggtgctccctctg

SEQ ID NO: 5019792 - DNA, 16 bp, Homo sapiens
aaccgcatgtgatctc

SEQ ID NO: 5019793 - DNA, 15 bp, Homo sapiens
aacctgagatttatt

SEQ ID NO: 5019794 - DNA, 13 bp, Homo sapiens
aaccttgcctggt

SEQ ID NO: 5019795 - DNA, 19 bp, Homo sapiens
aaccttgcctggtacagta

SEQ ID NO: 5019796 - DNA, 21 bp, Homo sapiens
aacgagactttccattacaag

SEQ ID NO: 5019797 - DNA, 19 bp, Homo sapiens
aacgatttttaaaatgtac

SEQ ID NO: 5019798 - DNA, 12 bp, Homo sapiens
aacgtcattcag

SEQ ID NO: 5019799 - DNA, 15 bp, Homo sapiens
aactaaactttcaca

SEQ ID NO: 5019800 - DNA, 13 bp, Homo sapiens
aactactctttga

SEQ ID NO: 5019801 - DNA, 17 bp, Homo sapiens
aactcactccttttaaa

SEQ ID NO: 5019802 - DNA, 23 bp, Homo sapiens
aactcatacactcgtatgatact

SEQ ID NO: 5019803 - DNA, 19 bp, Homo sapiens
aactgaaaacaagccatga

SEQ ID NO: 5019804 - DNA, 14 bp, Homo sapiens
aactgaactctgac

SEQ ID NO: 5019805 - DNA, 19 bp, Homo sapiens
aactgaaggggtgcaccca

SEQ ID NO: 5019806 - DNA, 23 bp, Homo sapiens
aactgaaggggtgcacccacctg

SEQ ID NO: 5019807 - DNA, 14 bp, Homo sapiens
aactgaataccact

SEQ ID NO: 5019808 - DNA, 21 bp, Homo sapiens
aactgaataccactctgtaat

SEQ ID NO: 5019809 - DNA, 17 bp, Homo sapiens
aactgcctaaggccctt

SEQ ID NO: 5019810 - DNA, 16 bp, Homo sapiens
aactgggctgaacact

SEQ ID NO: 5019811 - DNA, 14 bp, Homo sapiens
aactgggttcctgc

SEQ ID NO: 5019812 - DNA, 10 bp, Homo sapiens
aactgtacag

SEQ ID NO: 5019813 - DNA, 16 bp, Homo sapiens
aactgtacagtgtctt

SEQ ID NO: 5019814 - DNA, 17 bp, Homo sapiens
aactgtacagtgtcttt

SEQ ID NO: 5019815 - DNA, 18 bp, Homo sapiens
aactgtacagtgtctttt

SEQ ID NO: 5019816 - DNA, 18 bp, Homo sapiens
aactgtctttaaaagaga

SEQ ID NO: 5019817 - DNA, 17 bp, Homo sapiens
aactgttatttataatc

SEQ ID NO: 5019818 - DNA, 22 bp, Homo sapiens
aactgttatttataatcacttt

SEQ ID NO: 5019819 - DNA, 17 bp, Homo sapiens
aacttgtattaaagaca

SEQ ID NO: 5019820 - DNA, 15 bp, Homo sapiens
aagaaaaaaatgtat

SEQ ID NO: 5019821 - DNA, 17 bp, Homo sapiens
aagaaaaaaatgtattt

SEQ ID NO: 5019822 - DNA, 12 bp, Homo sapiens
aagaaaaagatt

SEQ ID NO: 5019823 - DNA, 11 bp, Homo sapiens
aagaaatgatt

SEQ ID NO: 5019824 - DNA, 14 bp, Homo sapiens
aagaagaaaaaggt

SEQ ID NO: 5019825 - DNA, 19 bp, Homo sapiens
aagaagacaaactttgcat

SEQ ID NO: 5019826 - DNA, 19 bp, Homo sapiens
aagaataggcattaacaca

SEQ ID NO: 5019827 - DNA, 18 bp, Homo sapiens
aagacaaactttgcatct

SEQ ID NO: 5019828 - DNA, 15 bp, Homo sapiens
aagacgttttataag

SEQ ID NO: 5019829 - DNA, 19 bp, Homo sapiens
aagagagagagagaaaaaa

SEQ ID NO: 5019830 - DNA, 20 bp, Homo sapiens
aagagagagagagaaaaaaa

SEQ ID NO: 5019831 - DNA, 14 bp, Homo sapiens
aagagatacagagg

SEQ ID NO: 5019832 - DNA, 13 bp, Homo sapiens
aagagattcgaat

SEQ ID NO: 5019833 - DNA, 23 bp, Homo sapiens
aagagcccgcagggccatgcaga

SEQ ID NO: 5019834 - DNA, 17 bp, Homo sapiens
aagagccggtggtgccc

SEQ ID NO: 5019835 - DNA, 14 bp, Homo sapiens
aagagcctttccaa

SEQ ID NO: 5019836 - DNA, 15 bp, Homo sapiens
aagagcttgctccag

SEQ ID NO: 5019837 - DNA, 17 bp, Homo sapiens
aagataaacacaagatt

SEQ ID NO: 5019838 - DNA, 22 bp, Homo sapiens
aagataaacacaagattggtgt

SEQ ID NO: 5019839 - DNA, 16 bp, Homo sapiens
aagatgcactttgctt

SEQ ID NO: 5019840 - DNA, 22 bp, Homo sapiens
aagatgccacattcaaaatagg

SEQ ID NO: 5019841 - DNA, 18 bp, Homo sapiens
aagattaaatgtgtcatt

SEQ ID NO: 5019842 - DNA, 17 bp, Homo sapiens
aagattggtgttttttt

SEQ ID NO: 5019843 - DNA, 19 bp, Homo sapiens
aagattggtgtttttttct

SEQ ID NO: 5019844 - DNA, 23 bp, Homo sapiens
aagattggtgtttttttctatgg

SEQ ID NO: 5019845 - DNA, 16 bp, Homo sapiens
aagatttgctttaatt

SEQ ID NO: 5019846 - DNA, 14 bp, Homo sapiens
aagatttgttttta

SEQ ID NO: 5019847 - DNA, 19 bp, Homo sapiens
aagatttgtttttaaactg

SEQ ID NO: 5019848 - DNA, 21 bp, Homo sapiens
aagcaaaacatctctgcagtt

SEQ ID NO: 5019849 - DNA, 13 bp, Homo sapiens
aagcaaaagaaaa

SEQ ID NO: 5019850 - DNA, 17 bp, Homo sapiens
aagcaatactgtttcca

SEQ ID NO: 5019851 - DNA, 15 bp, Homo sapiens
aagcacaagtacttt

SEQ ID NO: 5019852 - DNA, 15 bp, Homo sapiens
aagcataaaaacatt

SEQ ID NO: 5019853 - DNA, 17 bp, Homo sapiens
aagcataaaaacatttt

SEQ ID NO: 5019854 - DNA, 22 bp, Homo sapiens
aagcataaaaacattttaaaaa

SEQ ID NO: 5019855 - DNA, 15 bp, Homo sapiens
aagcatcattattta

SEQ ID NO: 5019856 - DNA, 17 bp, Homo sapiens
aagcatcattatttatg

SEQ ID NO: 5019857 - DNA, 22 bp, Homo sapiens
aagcatcattatttatgtattg

SEQ ID NO: 5019858 - DNA, 17 bp, Homo sapiens
aagcatgggattattag

SEQ ID NO: 5019859 - DNA, 15 bp, Homo sapiens
aagcattctcattgg

SEQ ID NO: 5019860 - DNA, 22 bp, Homo sapiens
aagcattctcattggaaattta

SEQ ID NO: 5019861 - DNA, 15 bp, Homo sapiens
aagcattttataaat

SEQ ID NO: 5019862 - DNA, 18 bp, Homo sapiens
aagctaataattcttcac

SEQ ID NO: 5019863 - DNA, 15 bp, Homo sapiens
aagctagtcttttgc

SEQ ID NO: 5019864 - DNA, 17 bp, Homo sapiens
aagctagtcttttgctt

SEQ ID NO: 5019865 - DNA, 20 bp, Homo sapiens
aagctagtcttttgcttttg

SEQ ID NO: 5019866 - DNA, 13 bp, Homo sapiens
aagctatttttct

SEQ ID NO: 5019867 - DNA, 20 bp, Homo sapiens
aagctgccgaaccaaaagaa

SEQ ID NO: 5019868 - DNA, 19 bp, Homo sapiens
aagcttttgtctacacacc

SEQ ID NO: 5019869 - DNA, 21 bp, Homo sapiens
aaggaaaccacagtgagcctg

SEQ ID NO: 5019870 - DNA, 14 bp, Homo sapiens
aaggaagaagaaat

SEQ ID NO: 5019871 - DNA, 18 bp, Homo sapiens
aaggactaatagaaaagt

SEQ ID NO: 5019872 - DNA, 19 bp, Homo sapiens
aaggactaatagaaaagta

SEQ ID NO: 5019873 - DNA, 14 bp, Homo sapiens
aaggatatgattaa

SEQ ID NO: 5019874 - DNA, 24 bp, Homo sapiens
aaggatctgctgaggcccagtgca

SEQ ID NO: 5019875 - DNA, 13 bp, Homo sapiens
aaggattttacca

SEQ ID NO: 5019876 - DNA, 17 bp, Homo sapiens
aaggattttaccaaagc

SEQ ID NO: 5019877 - DNA, 18 bp, Homo sapiens
aaggattttaccaaagca

SEQ ID NO: 5019878 - DNA, 19 bp, Homo sapiens
aaggattttaccaaagcat

SEQ ID NO: 5019879 - DNA, 20 bp, Homo sapiens
aaggattttaccaaagcatc

SEQ ID NO: 5019880 - DNA, 13 bp, Homo sapiens
aaggattttatgc

SEQ ID NO: 5019881 - DNA, 16 bp, Homo sapiens
aaggccttgcctggcc

SEQ ID NO: 5019882 - DNA, 19 bp, Homo sapiens
aaggccttgcctggcctga

SEQ ID NO: 5019883 - DNA, 16 bp, Homo sapiens
aaggctgtgtaagatt

SEQ ID NO: 5019884 - DNA, 21 bp, Homo sapiens
aaggctgtgtaagatttgttt

SEQ ID NO: 5019885 - DNA, 22 bp, Homo sapiens
aagggaaagcttcattctcctt

SEQ ID NO: 5019886 - DNA, 21 bp, Homo sapiens
aagggctggggccggggctga

SEQ ID NO: 5019887 - DNA, 13 bp, Homo sapiens
aaggggcttctgg

SEQ ID NO: 5019888 - DNA, 18 bp, Homo sapiens
aaggggtgcacccacctg

SEQ ID NO: 5019889 - DNA, 16 bp, Homo sapiens
aaggtggtgtgatctt

SEQ ID NO: 5019890 - DNA, 18 bp, Homo sapiens
aaggtgtgctagaacaag

SEQ ID NO: 5019891 - DNA, 16 bp, Homo sapiens
aaggtttaaatgaaca

SEQ ID NO: 5019892 - DNA, 13 bp, Homo sapiens
aagtaaatacaat

SEQ ID NO: 5019893 - DNA, 15 bp, Homo sapiens
aagtaaatacaattt

SEQ ID NO: 5019894 - DNA, 18 bp, Homo sapiens
aagtatttttaattaatt

SEQ ID NO: 5019895 - DNA, 12 bp, Homo sapiens
aagtctctgtga

SEQ ID NO: 5019896 - DNA, 14 bp, Homo sapiens
aagtctctgtgaat

SEQ ID NO: 5019897 - DNA, 12 bp, Homo sapiens
aagtctgtttta

SEQ ID NO: 5019898 - DNA, 14 bp, Homo sapiens
aagtctgttttatg

SEQ ID NO: 5019899 - DNA, 16 bp, Homo sapiens
aagtctgttttatgac

SEQ ID NO: 5019900 - DNA, 19 bp, Homo sapiens
aagtctgttttatgacttc

SEQ ID NO: 5019901 - DNA, 23 bp, Homo sapiens
aagtctgttttatgacttcatta

SEQ ID NO: 5019902 - DNA, 11 bp, Homo sapiens
aagtgagcaga

SEQ ID NO: 5019903 - DNA, 15 bp, Homo sapiens
aagtgccagtatttt

SEQ ID NO: 5019904 - DNA, 23 bp, Homo sapiens
aagtgccagtattttaaaatagc

SEQ ID NO: 5019905 - DNA, 22 bp, Homo sapiens
aagtgctgggaattacaggcgt

SEQ ID NO: 5019906 - DNA, 12 bp, Homo sapiens
aagtgttctcat

SEQ ID NO: 5019907 - DNA, 23 bp, Homo sapiens
aagtgttctcatgaagcaggagg

SEQ ID NO: 5019908 - DNA, 18 bp, Homo sapiens
aagttgagatagttttca

SEQ ID NO: 5019909 - DNA, 17 bp, Homo sapiens
aagttgcagctgttttg

SEQ ID NO: 5019910 - DNA, 12 bp, Homo sapiens
aagttggaagga

SEQ ID NO: 5019911 - DNA, 14 bp, Homo sapiens
aagttggaaggatc

SEQ ID NO: 5019912 - DNA, 12 bp, Homo sapiens
aagttgtttgag

SEQ ID NO: 5019913 - DNA, 14 bp, Homo sapiens
aataaactactctt

SEQ ID NO: 5019914 - DNA, 20 bp, Homo sapiens
aataaactactctttgattt

SEQ ID NO: 5019915 - DNA, 13 bp, Homo sapiens
aataaagaaaaga

SEQ ID NO: 5019916 - DNA, 14 bp, Homo sapiens
aataaagaaaagat

SEQ ID NO: 5019917 - DNA, 17 bp, Homo sapiens
aataaagaaaagatgca

SEQ ID NO: 5019918 - DNA, 20 bp, Homo sapiens
aataaagaaaagatgcactt

SEQ ID NO: 5019919 - DNA, 11 bp, Homo sapiens
aataaagtctc

SEQ ID NO: 5019920 - DNA, 18 bp, Homo sapiens
aataaagtctcttcctcc

SEQ ID NO: 5019921 - DNA, 18 bp, Homo sapiens
aataacaaatgccaaatt

SEQ ID NO: 5019922 - DNA, 15 bp, Homo sapiens
aataatgtgaatcat

SEQ ID NO: 5019923 - DNA, 17 bp, Homo sapiens
aataattgttgttctgt

SEQ ID NO: 5019924 - DNA, 13 bp, Homo sapiens
aatacaaccagcc

SEQ ID NO: 5019925 - DNA, 22 bp, Homo sapiens
aatacaagactgccatattaaa

SEQ ID NO: 5019926 - DNA, 20 bp, Homo sapiens
aatagccactaaccttgcct

SEQ ID NO: 5019927 - DNA, 21 bp, Homo sapiens
aatagccactaaccttgcctg

SEQ ID NO: 5019928 - DNA, 14 bp, Homo sapiens
aatagcgttcttgt

SEQ ID NO: 5019929 - DNA, 15 bp, Homo sapiens
aatagcgttcttgta

SEQ ID NO: 5019930 - DNA, 18 bp, Homo sapiens
aatagcttatgaaaagaa

SEQ ID NO: 5019931 - DNA, 19 bp, Homo sapiens
aatagcttatgaaaagaat

SEQ ID NO: 5019932 - DNA, 23 bp, Homo sapiens
aatataaagacgttttataagca

SEQ ID NO: 5019933 - DNA, 22 bp, Homo sapiens
aatataaatgcaaataacaaat

SEQ ID NO: 5019934 - DNA, 16 bp, Homo sapiens
aatatcatcagtattg

SEQ ID NO: 5019935 - DNA, 19 bp, Homo sapiens
aatcaactgggctgaacac

SEQ ID NO: 5019936 - DNA, 12 bp, Homo sapiens
aatcccaggatg

SEQ ID NO: 5019937 - DNA, 17 bp, Homo sapiens
aatctactcaaagcatg

SEQ ID NO: 5019938 - DNA, 16 bp, Homo sapiens
aatctgggccagaatt

SEQ ID NO: 5019939 - DNA, 23 bp, Homo sapiens
aatcttgatcagttaagaaattt

SEQ ID NO: 5019940 - DNA, 13 bp, Homo sapiens
aatgaaatactgt

SEQ ID NO: 5019941 - DNA, 13 bp, Homo sapiens
aatgaacaagaga

SEQ ID NO: 5019942 - DNA, 18 bp, Homo sapiens
aatgaacaagagaagcat

SEQ ID NO: 5019943 - DNA, 14 bp, Homo sapiens
aatgagcatgttta

SEQ ID NO: 5019944 - DNA, 16 bp, Homo sapiens
aatgagcatgtttaga

SEQ ID NO: 5019945 - DNA, 22 bp, Homo sapiens
aatgagcatgtttagactttaa

SEQ ID NO: 5019946 - DNA, 14 bp, Homo sapiens
aatgaggtctgttt

SEQ ID NO: 5019947 - DNA, 21 bp, Homo sapiens
aatgatgatgatgatgatgaa

SEQ ID NO: 5019948 - DNA, 19 bp, Homo sapiens
aatgattcaaattgctgct

SEQ ID NO: 5019949 - DNA, 22 bp, Homo sapiens
aatgattcaaattgctgcttgg

SEQ ID NO: 5019950 - DNA, 21 bp, Homo sapiens
aatgccaaattaaaaaagata

SEQ ID NO: 5019951 - DNA, 18 bp, Homo sapiens
aatgcttctaagtaaata

SEQ ID NO: 5019952 - DNA, 23 bp, Homo sapiens
aatggactggaaggggaagggac

SEQ ID NO: 5019953 - DNA, 20 bp, Homo sapiens
aatggcagttatattttgca

SEQ ID NO: 5019954 - DNA, 18 bp, Homo sapiens
aatggccatgcaggaggt

SEQ ID NO: 5019955 - DNA, 21 bp, Homo sapiens
aatggccatgcaggaggtgga

SEQ ID NO: 5019956 - DNA, 23 bp, Homo sapiens
aatggccatgcaggaggtggaga

SEQ ID NO: 5019957 - DNA, 13 bp, Homo sapiens
aatggttaaaaga

SEQ ID NO: 5019958 - DNA, 19 bp, Homo sapiens
aatgtacttgtttctctgt

SEQ ID NO: 5019959 - DNA, 13 bp, Homo sapiens
aatgtattttatg

SEQ ID NO: 5019960 - DNA, 15 bp, Homo sapiens
aatgtattttatgtt

SEQ ID NO: 5019961 - DNA, 15 bp, Homo sapiens
aatgtcatatactgc

SEQ ID NO: 5019962 - DNA, 18 bp, Homo sapiens
aatgtcatatactgccat

SEQ ID NO: 5019963 - DNA, 19 bp, Homo sapiens
aatgtcatatactgccatg

SEQ ID NO: 5019964 - DNA, 15 bp, Homo sapiens
aatgtgtataaacaa

SEQ ID NO: 5019965 - DNA, 23 bp, Homo sapiens
aatgtgtctttagatagccctgt

SEQ ID NO: 5019966 - DNA, 13 bp, Homo sapiens
aattaaaaaagat

SEQ ID NO: 5019967 - DNA, 19 bp, Homo sapiens
aattaaaaaagataaacac

SEQ ID NO: 5019968 - DNA, 20 bp, Homo sapiens
aattaaaaaagataaacaca

SEQ ID NO: 5019969 - DNA, 24 bp, Homo sapiens
aattaaaaaagataaacacaagat

SEQ ID NO: 5019970 - DNA, 22 bp, Homo sapiens
aattaaggattttatgctttaa

SEQ ID NO: 5019971 - DNA, 14 bp, Homo sapiens
aattattacagtgt

SEQ ID NO: 5019972 - DNA, 15 bp, Homo sapiens
aattattatttgtgt

SEQ ID NO: 5019973 - DNA, 21 bp, Homo sapiens
aattcaccccctttcctggac

SEQ ID NO: 5019974 - DNA, 15 bp, Homo sapiens
aattcagcaaaccat

SEQ ID NO: 5019975 - DNA, 16 bp, Homo sapiens
aattcagcaaaccatt

SEQ ID NO: 5019976 - DNA, 13 bp, Homo sapiens
aattcctcatttg

SEQ ID NO: 5019977 - DNA, 14 bp, Homo sapiens
aattcctcatttgt

SEQ ID NO: 5019978 - DNA, 22 bp, Homo sapiens
aattcttcacctaagtctctgt

SEQ ID NO: 5019979 - DNA, 23 bp, Homo sapiens
aattcttcacctaagtctctgtg

SEQ ID NO: 5019980 - DNA, 18 bp, Homo sapiens
aattcttgtaatttttat

SEQ ID NO: 5019981 - DNA, 16 bp, Homo sapiens
aattgaaatgtaaggc

SEQ ID NO: 5019982 - DNA, 16 bp, Homo sapiens
aattgggccagctttt

SEQ ID NO: 5019983 - DNA, 14 bp, Homo sapiens
aattgttgttctgt

SEQ ID NO: 5019984 - DNA, 17 bp, Homo sapiens
aattgttgttctgttaa

SEQ ID NO: 5019985 - DNA, 19 bp, Homo sapiens
aatttaaacacctcctcat

SEQ ID NO: 5019986 - DNA, 11 bp, Homo sapiens
aatttaaagca

SEQ ID NO: 5019987 - DNA, 22 bp, Homo sapiens
aatttgcacatcttggctatgt

SEQ ID NO: 5019988 - DNA, 15 bp, Homo sapiens
aatttggcaattttg

SEQ ID NO: 5019989 - DNA, 18 bp, Homo sapiens
aatttggtaaaaatgctg

SEQ ID NO: 5019990 - DNA, 19 bp, Homo sapiens
aattttacacgcttttgtg

SEQ ID NO: 5019991 - DNA, 17 bp, Homo sapiens
aattttgacttaatgtg

SEQ ID NO: 5019992 - DNA, 13 bp, Homo sapiens
aatttttcttctt

SEQ ID NO: 5019993 - DNA, 17 bp, Homo sapiens
aattttttgttgacatt

SEQ ID NO: 5019994 - DNA, 20 bp, Homo sapiens
aattttttttattagtattg

SEQ ID NO: 5019995 - DNA, 15 bp, Homo sapiens
acaaaaagacaaaca

SEQ ID NO: 5019996 - DNA, 15 bp, Homo sapiens
acaaaagctttgaat

SEQ ID NO: 5019997 - DNA, 16 bp, Homo sapiens
acaaaccatttccaac

SEQ ID NO: 5019998 - DNA, 15 bp, Homo sapiens
acaaagacattgatt

SEQ ID NO: 5019999 - DNA, 18 bp, Homo sapiens
acaagaaaaataaagaaa

SEQ ID NO: 5020000 - DNA, 20 bp, Homo sapiens
acaagaaaaataaagaaaag

SEQ ID NO: 5020001 - DNA, 15 bp, Homo sapiens
acaagagaagcattc

SEQ ID NO: 5020002 - DNA, 18 bp, Homo sapiens
acaagattggtgtttttt

SEQ ID NO: 5020003 - DNA, 19 bp, Homo sapiens
acaagattggtgttttttt

SEQ ID NO: 5020004 - DNA, 21 bp, Homo sapiens
acaagtcctggatgttgtgtg

SEQ ID NO: 5020005 - DNA, 18 bp, Homo sapiens
acaagtgactgtatctgt

SEQ ID NO: 5020006 - DNA, 19 bp, Homo sapiens
acaagtgactgtatctgtg

SEQ ID NO: 5020007 - DNA, 20 bp, Homo sapiens
acaagtgactgtatctgtgt

SEQ ID NO: 5020008 - DNA, 18 bp, Homo sapiens
acaatctggaagaaaaaa

SEQ ID NO: 5020009 - DNA, 22 bp, Homo sapiens
acaatgtcatatactgccatgt

SEQ ID NO: 5020010 - DNA, 17 bp, Homo sapiens
acaattttttttattag

SEQ ID NO: 5020011 - DNA, 17 bp, Homo sapiens
acacaagattggtgttt

SEQ ID NO: 5020012 - DNA, 20 bp, Homo sapiens
acacaagattggtgtttttt

SEQ ID NO: 5020013 - DNA, 10 bp, Homo sapiens
acacacacac

SEQ ID NO: 5020014 - DNA, 11 bp, Homo sapiens
acacacacaca

SEQ ID NO: 5020015 - DNA, 15 bp, Homo sapiens
acacacacacaaacc

SEQ ID NO: 5020016 - DNA, 12 bp, Homo sapiens
acacacacacac

SEQ ID NO: 5020017 - DNA, 14 bp, Homo sapiens
acacacacacacac

SEQ ID NO: 5020018 - DNA, 15 bp, Homo sapiens
acacacacacacaca

SEQ ID NO: 5020019 - DNA, 15 bp, Homo sapiens
acacacagatacaca

SEQ ID NO: 5020020 - DNA, 20 bp, Homo sapiens
acacactaccgaatgtgtct

SEQ ID NO: 5020021 - DNA, 16 bp, Homo sapiens
acacaggacagcggga

SEQ ID NO: 5020022 - DNA, 14 bp, Homo sapiens
acacagtgtctggc

SEQ ID NO: 5020023 - DNA, 17 bp, Homo sapiens
acacatggtgagcctag

SEQ ID NO: 5020024 - DNA, 13 bp, Homo sapiens
acaccaagcagca

SEQ ID NO: 5020025 - DNA, 16 bp, Homo sapiens
acaccaagcagcaaca

SEQ ID NO: 5020026 - DNA, 16 bp, Homo sapiens
acacccagcggccccc

SEQ ID NO: 5020027 - DNA, 21 bp, Homo sapiens
acacccctctgtctaggactg

SEQ ID NO: 5020028 - DNA, 22 bp, Homo sapiens
acaccctgtactgttctgtgtc

SEQ ID NO: 5020029 - DNA, 18 bp, Homo sapiens
acaccgttcattcaggca

SEQ ID NO: 5020030 - DNA, 20 bp, Homo sapiens
acacctgggcatttggtgag

SEQ ID NO: 5020031 - DNA, 15 bp, Homo sapiens
acacgggcctgtcca

SEQ ID NO: 5020032 - DNA, 18 bp, Homo sapiens
acactaccgaatgtgtct

SEQ ID NO: 5020033 - DNA, 20 bp, Homo sapiens
acactaccgaatgtgtcttt

SEQ ID NO: 5020034 - DNA, 21 bp, Homo sapiens
acactaccgaatgtgtcttta

SEQ ID NO: 5020035 - DNA, 21 bp, Homo sapiens
acactgctgctccagtgcagg

SEQ ID NO: 5020036 - DNA, 14 bp, Homo sapiens
acactggcccctca

SEQ ID NO: 5020037 - DNA, 19 bp, Homo sapiens
acactgggtgcgtctccag

SEQ ID NO: 5020038 - DNA, 16 bp, Homo sapiens
acagaaaccagaaaag

SEQ ID NO: 5020039 - DNA, 12 bp, Homo sapiens
acagagctttcc

SEQ ID NO: 5020040 - DNA, 14 bp, Homo sapiens
acagcccctcctcc

SEQ ID NO: 5020041 - DNA, 12 bp, Homo sapiens
acagctcctccc

SEQ ID NO: 5020042 - DNA, 12 bp, Homo sapiens
acagctgtgtct

SEQ ID NO: 5020043 - DNA, 16 bp, Homo sapiens
acagctgtgtctgcca

SEQ ID NO: 5020044 - DNA, 20 bp, Homo sapiens
acagctttctgggatgtcac

SEQ ID NO: 5020045 - DNA, 21 bp, Homo sapiens
acagctttctgggatgtcaca

SEQ ID NO: 5020046 - DNA, 15 bp, Homo sapiens
acaggacatggatga

SEQ ID NO: 5020047 - DNA, 21 bp, Homo sapiens
acaggcatgggtgcaaggaaa

SEQ ID NO: 5020048 - DNA, 12 bp, Homo sapiens
acaggccccctt

SEQ ID NO: 5020049 - DNA, 17 bp, Homo sapiens
acaggcgggaggaggtg

SEQ ID NO: 5020050 - DNA, 13 bp, Homo sapiens
acagggacatgcc

SEQ ID NO: 5020051 - DNA, 20 bp, Homo sapiens
acagtatgggggttgtaaat

SEQ ID NO: 5020052 - DNA, 12 bp, Homo sapiens
acagtattgctc

SEQ ID NO: 5020053 - DNA, 22 bp, Homo sapiens
acagtattgctcacccagtgcc

SEQ ID NO: 5020054 - DNA, 23 bp, Homo sapiens
acagtgcctcttccagtgaacat

SEQ ID NO: 5020055 - DNA, 13 bp, Homo sapiens
acagtggccacgg

SEQ ID NO: 5020056 - DNA, 12 bp, Homo sapiens
acataagctatt

SEQ ID NO: 5020057 - DNA, 19 bp, Homo sapiens
acataagctatttttctaa

SEQ ID NO: 5020058 - DNA, 20 bp, Homo sapiens
acataagctatttttctaac

SEQ ID NO: 5020059 - DNA, 19 bp, Homo sapiens
acatagcccacttacattt

SEQ ID NO: 5020060 - DNA, 17 bp, Homo sapiens
acatcagcaatttcaga

SEQ ID NO: 5020061 - DNA, 15 bp, Homo sapiens
acatcaggtttttcc

SEQ ID NO: 5020062 - DNA, 16 bp, Homo sapiens
acatcaggtttttccc

SEQ ID NO: 5020063 - DNA, 20 bp, Homo sapiens
acatcagtctccaacatgtt

SEQ ID NO: 5020064 - DNA, 21 bp, Homo sapiens
acatcgcaatagttttttact

SEQ ID NO: 5020065 - DNA, 13 bp, Homo sapiens
acatctctgcagt

SEQ ID NO: 5020066 - DNA, 13 bp, Homo sapiens
acatctcttcctc

SEQ ID NO: 5020067 - DNA, 20 bp, Homo sapiens
acatgaggactctattcttt

SEQ ID NO: 5020068 - DNA, 22 bp, Homo sapiens
acatgaggactctattctttaa

SEQ ID NO: 5020069 - DNA, 17 bp, Homo sapiens
acatgccctgtgtggct

SEQ ID NO: 5020070 - DNA, 13 bp, Homo sapiens
acatgtttctgtt

SEQ ID NO: 5020071 - DNA, 22 bp, Homo sapiens
acatgtttctgttttgttgttt

SEQ ID NO: 5020072 - DNA, 14 bp, Homo sapiens
acattagtctcagt

SEQ ID NO: 5020073 - DNA, 16 bp, Homo sapiens
acattcccagcccagc

SEQ ID NO: 5020074 - DNA, 15 bp, Homo sapiens
acattctgaatgctt

SEQ ID NO: 5020075 - DNA, 16 bp, Homo sapiens
acattggttcttgtat

SEQ ID NO: 5020076 - DNA, 18 bp, Homo sapiens
acattgtttgctgctatt

SEQ ID NO: 5020077 - DNA, 15 bp, Homo sapiens
acatttacaaactga

SEQ ID NO: 5020078 - DNA, 18 bp, Homo sapiens
acattttaaaaacataga

SEQ ID NO: 5020079 - DNA, 17 bp, Homo sapiens
acattttgaaagtctgt

SEQ ID NO: 5020080 - DNA, 19 bp, Homo sapiens
accaacctgaagacaccgt

SEQ ID NO: 5020081 - DNA, 23 bp, Homo sapiens
accaatttggtaaaaatgctgct

SEQ ID NO: 5020082 - DNA, 18 bp, Homo sapiens
accacactgggtgcgtct

SEQ ID NO: 5020083 - DNA, 23 bp, Homo sapiens
accacactgggtgcgtctccagt

SEQ ID NO: 5020084 - DNA, 14 bp, Homo sapiens
accacctttcagat

SEQ ID NO: 5020085 - DNA, 23 bp, Homo sapiens
accactgctctgatgaagaggag

SEQ ID NO: 5020086 - DNA, 15 bp, Homo sapiens
accagaaacacccct

SEQ ID NO: 5020087 - DNA, 21 bp, Homo sapiens
accagaaacacccctctgtct

SEQ ID NO: 5020088 - DNA, 23 bp, Homo sapiens
accagactacttgggagcaccgc

SEQ ID NO: 5020089 - DNA, 11 bp, Homo sapiens
accagccagcg

SEQ ID NO: 5020090 - DNA, 16 bp, Homo sapiens
accagccgtattttac

SEQ ID NO: 5020091 - DNA, 17 bp, Homo sapiens
accagggcctggctggg

SEQ ID NO: 5020092 - DNA, 23 bp, Homo sapiens
accagtggcgttgttgcatgttt

SEQ ID NO: 5020093 - DNA, 17 bp, Homo sapiens
accatccccaccccacc

SEQ ID NO: 5020094 - DNA, 13 bp, Homo sapiens
accatcctggctg

SEQ ID NO: 5020095 - DNA, 14 bp, Homo sapiens
accatcctggctgc

SEQ ID NO: 5020096 - DNA, 22 bp, Homo sapiens
accatgagtggcatggccacca

SEQ ID NO: 5020097 - DNA, 16 bp, Homo sapiens
acccaagcctgctggc

SEQ ID NO: 5020098 - DNA, 17 bp, Homo sapiens
acccaagcctgctggct

SEQ ID NO: 5020099 - DNA, 20 bp, Homo sapiens
acccaagcctgctggctgcg

SEQ ID NO: 5020100 - DNA, 16 bp, Homo sapiens
acccacctgttttctg

SEQ ID NO: 5020101 - DNA, 18 bp, Homo sapiens
acccacttatttttcaag

SEQ ID NO: 5020102 - DNA, 17 bp, Homo sapiens
acccagcggccccccgc

SEQ ID NO: 5020103 - DNA, 17 bp, Homo sapiens
acccatgcagctgctcc

SEQ ID NO: 5020104 - DNA, 18 bp, Homo sapiens
accccagacgatgtcttc

SEQ ID NO: 5020105 - DNA, 13 bp, Homo sapiens
acccccgccatgc

SEQ ID NO: 5020106 - DNA, 15 bp, Homo sapiens
acccctggctctggg

SEQ ID NO: 5020107 - DNA, 17 bp, Homo sapiens
acccgtggggtgctgcc

SEQ ID NO: 5020108 - DNA, 15 bp, Homo sapiens
accctagttctacct

SEQ ID NO: 5020109 - DNA, 18 bp, Homo sapiens
accctcatacacagaaac

SEQ ID NO: 5020110 - DNA, 18 bp, Homo sapiens
accctcgaggcggatctt

SEQ ID NO: 5020111 - DNA, 16 bp, Homo sapiens
accctctcagctccag

SEQ ID NO: 5020112 - DNA, 17 bp, Homo sapiens
accctgccccttgccat

SEQ ID NO: 5020113 - DNA, 19 bp, Homo sapiens
accctggccgccccctgcc

SEQ ID NO: 5020114 - DNA, 15 bp, Homo sapiens
accctgtccggccca

SEQ ID NO: 5020115 - DNA, 19 bp, Homo sapiens
accctgtccggcccagtgc

SEQ ID NO: 5020116 - DNA, 21 bp, Homo sapiens
accctgtccggcccagtgcca

SEQ ID NO: 5020117 - DNA, 16 bp, Homo sapiens
accgaatgtgtcttta

SEQ ID NO: 5020118 - DNA, 15 bp, Homo sapiens
accggaaggttttta

SEQ ID NO: 5020119 - DNA, 13 bp, Homo sapiens
acctacatgtatt

SEQ ID NO: 5020120 - DNA, 14 bp, Homo sapiens
acctacatgtattt

SEQ ID NO: 5020121 - DNA, 18 bp, Homo sapiens
acctagctgaatgttttt

SEQ ID NO: 5020122 - DNA, 19 bp, Homo sapiens
acctagctgaatgtttttc

SEQ ID NO: 5020123 - DNA, 21 bp, Homo sapiens
acctagctgaatgtttttcta

SEQ ID NO: 5020124 - DNA, 17 bp, Homo sapiens
acctcaaccatcctggc

SEQ ID NO: 5020125 - DNA, 21 bp, Homo sapiens
acctcaaccatcctggctgcg

SEQ ID NO: 5020126 - DNA, 15 bp, Homo sapiens
acctcatgcccagct

SEQ ID NO: 5020127 - DNA, 20 bp, Homo sapiens
acctcggggacaccagagct

SEQ ID NO: 5020128 - DNA, 18 bp, Homo sapiens
acctgagatttattaaag

SEQ ID NO: 5020129 - DNA, 14 bp, Homo sapiens
acctgcacacagga

SEQ ID NO: 5020130 - DNA, 23 bp, Homo sapiens
acctgcactggggagcccgtctc

SEQ ID NO: 5020131 - DNA, 13 bp, Homo sapiens
accttccagctcc

SEQ ID NO: 5020132 - DNA, 12 bp, Homo sapiens
accttctgcctt

SEQ ID NO: 5020133 - DNA, 13 bp, Homo sapiens
acctttattctgg

SEQ ID NO: 5020134 - DNA, 17 bp, Homo sapiens
acgaaataattgttgtt

SEQ ID NO: 5020135 - DNA, 23 bp, Homo sapiens
acgaaataattgttgttctgtta

SEQ ID NO: 5020136 - DNA, 18 bp, Homo sapiens
acgctactataaagagaa

SEQ ID NO: 5020137 - DNA, 14 bp, Homo sapiens
acgctccttcctct

SEQ ID NO: 5020138 - DNA, 18 bp, Homo sapiens
acgcttgtgacagtgcct

SEQ ID NO: 5020139 - DNA, 17 bp, Homo sapiens
acggccacggccacagt

SEQ ID NO: 5020140 - DNA, 17 bp, Homo sapiens
acgggcctgtccacagg

SEQ ID NO: 5020141 - DNA, 20 bp, Homo sapiens
acgtccacagagtataaata

SEQ ID NO: 5020142 - DNA, 18 bp, Homo sapiens
acgtgactggcctgctgg

SEQ ID NO: 5020143 - DNA, 23 bp, Homo sapiens
acgtgctctttgttttgtgtctc

SEQ ID NO: 5020144 - DNA, 18 bp, Homo sapiens
acgtggttggggccctgc

SEQ ID NO: 5020145 - DNA, 22 bp, Homo sapiens
acgtgttcattttattttcatg

SEQ ID NO: 5020146 - DNA, 13 bp, Homo sapiens
actaataattgca

SEQ ID NO: 5020147 - DNA, 16 bp, Homo sapiens
actaatagaaaagtat

SEQ ID NO: 5020148 - DNA, 20 bp, Homo sapiens
actacaaaggtttaaatgaa

SEQ ID NO: 5020149 - DNA, 21 bp, Homo sapiens
actacaaaggtttaaatgaac

SEQ ID NO: 5020150 - DNA, 22 bp, Homo sapiens
actacaaaggtttaaatgaaca

SEQ ID NO: 5020151 - DNA, 13 bp, Homo sapiens
actagtgttctgt

SEQ ID NO: 5020152 - DNA, 12 bp, Homo sapiens
actataaagaga

SEQ ID NO: 5020153 - DNA, 18 bp, Homo sapiens
actatgaaaatgctggct

SEQ ID NO: 5020154 - DNA, 22 bp, Homo sapiens
actcaaagcatgggattattag

SEQ ID NO: 5020155 - DNA, 19 bp, Homo sapiens
actcaacccattgttgtca

SEQ ID NO: 5020156 - DNA, 20 bp, Homo sapiens
actcaagagttcagtgctca

SEQ ID NO: 5020157 - DNA, 19 bp, Homo sapiens
actcactccttttaaagaa

SEQ ID NO: 5020158 - DNA, 16 bp, Homo sapiens
actcattcattagtca

SEQ ID NO: 5020159 - DNA, 19 bp, Homo sapiens
actcctcagggttgaggtc

SEQ ID NO: 5020160 - DNA, 19 bp, Homo sapiens
actcctgaaaaaaaacctg

SEQ ID NO: 5020161 - DNA, 23 bp, Homo sapiens
actccttttaaagaaaaaaattg

SEQ ID NO: 5020162 - DNA, 13 bp, Homo sapiens
actctattcttta

SEQ ID NO: 5020163 - DNA, 14 bp, Homo sapiens
actctattctttaa

SEQ ID NO: 5020164 - DNA, 18 bp, Homo sapiens
actctgacaacagacttc

SEQ ID NO: 5020165 - DNA, 20 bp, Homo sapiens
actctgacaacagacttctg

SEQ ID NO: 5020166 - DNA, 14 bp, Homo sapiens
actctgcctgcctg

SEQ ID NO: 5020167 - DNA, 20 bp, Homo sapiens
actcttcagttaagcctttg

SEQ ID NO: 5020168 - DNA, 21 bp, Homo sapiens
actcttcagttaagcctttgg

SEQ ID NO: 5020169 - DNA, 15 bp, Homo sapiens
actctttttttgagt

SEQ ID NO: 5020170 - DNA, 19 bp, Homo sapiens
actgaacatctgagtcctg

SEQ ID NO: 5020171 - DNA, 20 bp, Homo sapiens
actgaactctgacaacagac

SEQ ID NO: 5020172 - DNA, 22 bp, Homo sapiens
actgaaggggtgcacccacctg

SEQ ID NO: 5020173 - DNA, 14 bp, Homo sapiens
actgaataccactc

SEQ ID NO: 5020174 - DNA, 21 bp, Homo sapiens
actgaataccactctgtaatt

SEQ ID NO: 5020175 - DNA, 16 bp, Homo sapiens
actgagtgccttttgg

SEQ ID NO: 5020176 - DNA, 20 bp, Homo sapiens
actgccatgcaccaggactg

SEQ ID NO: 5020177 - DNA, 13 bp, Homo sapiens
actgccccccgag

SEQ ID NO: 5020178 - DNA, 13 bp, Homo sapiens
actgcttgtttcc

SEQ ID NO: 5020179 - DNA, 22 bp, Homo sapiens
actggagcttgaaatagtgtct

SEQ ID NO: 5020180 - DNA, 16 bp, Homo sapiens
actggcctctgctgat

SEQ ID NO: 5020181 - DNA, 23 bp, Homo sapiens
actggcctctgctgatcctccca

SEQ ID NO: 5020182 - DNA, 16 bp, Homo sapiens
actgggacagcccagg

SEQ ID NO: 5020183 - DNA, 16 bp, Homo sapiens
actgggctctggctct

SEQ ID NO: 5020184 - DNA, 16 bp, Homo sapiens
actgggctgaacactc

SEQ ID NO: 5020185 - DNA, 21 bp, Homo sapiens
actgggctgaacactccaatt

SEQ ID NO: 5020186 - DNA, 17 bp, Homo sapiens
actggggagcccgtctc

SEQ ID NO: 5020187 - DNA, 17 bp, Homo sapiens
actggtacttagagttt

SEQ ID NO: 5020188 - DNA, 23 bp, Homo sapiens
actggtacttagagtttctgttt

SEQ ID NO: 5020189 - DNA, 13 bp, Homo sapiens
actggttgctgtg

SEQ ID NO: 5020190 - DNA, 14 bp, Homo sapiens
actggttgctgtgt

SEQ ID NO: 5020191 - DNA, 21 bp, Homo sapiens
actgtcttggctgtggggcta

SEQ ID NO: 5020192 - DNA, 17 bp, Homo sapiens
actgtctttaaaagaga

SEQ ID NO: 5020193 - DNA, 19 bp, Homo sapiens
actgtctttaaaagagaga

SEQ ID NO: 5020194 - DNA, 13 bp, Homo sapiens
actgtgacaggca

SEQ ID NO: 5020195 - DNA, 14 bp, Homo sapiens
actgtgacaggcag

SEQ ID NO: 5020196 - DNA, 15 bp, Homo sapiens
actgtgacaggcagc

SEQ ID NO: 5020197 - DNA, 16 bp, Homo sapiens
actgtgacaggcagca

SEQ ID NO: 5020198 - DNA, 14 bp, Homo sapiens
actgttatttataa

SEQ ID NO: 5020199 - DNA, 15 bp, Homo sapiens
actgttctgtgtctt

SEQ ID NO: 5020200 - DNA, 22 bp, Homo sapiens
actgttttctctcggctcccca

SEQ ID NO: 5020201 - DNA, 23 bp, Homo sapiens
actgttttctctcggctccccat

SEQ ID NO: 5020202 - DNA, 15 bp, Homo sapiens
acttaagcaaaagaa

SEQ ID NO: 5020203 - DNA, 16 bp, Homo sapiens
acttaagcaaaagaaa

SEQ ID NO: 5020204 - DNA, 19 bp, Homo sapiens
acttaagcaaaagaaaaag

SEQ ID NO: 5020205 - DNA, 20 bp, Homo sapiens
acttagaaaaccagctcagc

SEQ ID NO: 5020206 - DNA, 15 bp, Homo sapiens
acttagagtttctgt

SEQ ID NO: 5020207 - DNA, 17 bp, Homo sapiens
acttatttatgaacctg

SEQ ID NO: 5020208 - DNA, 18 bp, Homo sapiens
acttcaaactactttgct

SEQ ID NO: 5020209 - DNA, 17 bp, Homo sapiens
acttcattaataataaa

SEQ ID NO: 5020210 - DNA, 17 bp, Homo sapiens
acttctcttgctttcta

SEQ ID NO: 5020211 - DNA, 21 bp, Homo sapiens
acttgagcgtgaatctgtatc

SEQ ID NO: 5020212 - DNA, 22 bp, Homo sapiens
acttggagactcctggtctgtg

SEQ ID NO: 5020213 - DNA, 12 bp, Homo sapiens
acttgtaaatat

SEQ ID NO: 5020214 - DNA, 14 bp, Homo sapiens
acttgtaaatataa

SEQ ID NO: 5020215 - DNA, 15 bp, Homo sapiens
acttgtaaatataaa

SEQ ID NO: 5020216 - DNA, 17 bp, Homo sapiens
acttgtaaatataaaga

SEQ ID NO: 5020217 - DNA, 21 bp, Homo sapiens
acttgtcaggagtgtgtgtga

SEQ ID NO: 5020218 - DNA, 14 bp, Homo sapiens
acttgttggtgtgg

SEQ ID NO: 5020219 - DNA, 19 bp, Homo sapiens
acttgtttctctgttgtaa

SEQ ID NO: 5020220 - DNA, 19 bp, Homo sapiens
actttaacataagctattt

SEQ ID NO: 5020221 - DNA, 16 bp, Homo sapiens
actttgaaaagttgga

SEQ ID NO: 5020222 - DNA, 19 bp, Homo sapiens
actttgaagggcaagaaat

SEQ ID NO: 5020223 - DNA, 23 bp, Homo sapiens
actttgaagggcaagaaatggcg

SEQ ID NO: 5020224 - DNA, 16 bp, Homo sapiens
actttgctttaatata

SEQ ID NO: 5020225 - DNA, 17 bp, Homo sapiens
actttgctttaatataa

SEQ ID NO: 5020226 - DNA, 21 bp, Homo sapiens
actttgctttaatataaatgc

SEQ ID NO: 5020227 - DNA, 22 bp, Homo sapiens
acttttggttaagtctgtttta

SEQ ID NO: 5020228 - DNA, 16 bp, Homo sapiens
agaaaaaaatgtattt

SEQ ID NO: 5020229 - DNA, 14 bp, Homo sapiens
agaaaaaaattgaa

SEQ ID NO: 5020230 - DNA, 16 bp, Homo sapiens
agaaaaaaattgaaat

SEQ ID NO: 5020231 - DNA, 14 bp, Homo sapiens
agaaaaataaagaa

SEQ ID NO: 5020232 - DNA, 16 bp, Homo sapiens
agaaaaccagctcagc

SEQ ID NO: 5020233 - DNA, 16 bp, Homo sapiens
agaaaagatgcacttt

SEQ ID NO: 5020234 - DNA, 17 bp, Homo sapiens
agaaaagcaatactgtt

SEQ ID NO: 5020235 - DNA, 15 bp, Homo sapiens
agaaaagtatgttct

SEQ ID NO: 5020236 - DNA, 17 bp, Homo sapiens
agaaaagtatgttctaa

SEQ ID NO: 5020237 - DNA, 21 bp, Homo sapiens
agaaaattggaactctactca

SEQ ID NO: 5020238 - DNA, 20 bp, Homo sapiens
agaaacacccctctgtctag

SEQ ID NO: 5020239 - DNA, 21 bp, Homo sapiens
agaaacacccctctgtctagg

SEQ ID NO: 5020240 - DNA, 19 bp, Homo sapiens
agaaatagcttatgaaaag

SEQ ID NO: 5020241 - DNA, 20 bp, Homo sapiens
agaaatagcttatgaaaaga

SEQ ID NO: 5020242 - DNA, 17 bp, Homo sapiens
agaaccagccgtatttt

SEQ ID NO: 5020243 - DNA, 20 bp, Homo sapiens
agaacctgcacacaggacag

SEQ ID NO: 5020244 - DNA, 15 bp, Homo sapiens
agaagacaaactttg

SEQ ID NO: 5020245 - DNA, 16 bp, Homo sapiens
agaagacaaactttgc

SEQ ID NO: 5020246 - DNA, 17 bp, Homo sapiens
agaagacctgagaatgt

SEQ ID NO: 5020247 - DNA, 21 bp, Homo sapiens
agaagagccaagagtccagga

SEQ ID NO: 5020248 - DNA, 12 bp, Homo sapiens
agaagcagctct

SEQ ID NO: 5020249 - DNA, 13 bp, Homo sapiens
agaagcagctctt

SEQ ID NO: 5020250 - DNA, 15 bp, Homo sapiens
agaaggcaaatgact

SEQ ID NO: 5020251 - DNA, 18 bp, Homo sapiens
agaaggcagtagttttca

SEQ ID NO: 5020252 - DNA, 15 bp, Homo sapiens
agaaggggaagcact

SEQ ID NO: 5020253 - DNA, 21 bp, Homo sapiens
agaatgtatccccaaaagcgt

SEQ ID NO: 5020254 - DNA, 23 bp, Homo sapiens
agaattgttgggggtttttttgg

SEQ ID NO: 5020255 - DNA, 18 bp, Homo sapiens
agacaaaaagacaaacat

SEQ ID NO: 5020256 - DNA, 15 bp, Homo sapiens
agacaaactttgcat

SEQ ID NO: 5020257 - DNA, 19 bp, Homo sapiens
agacaacgtgctctttgtt

SEQ ID NO: 5020258 - DNA, 22 bp, Homo sapiens
agacaagtgactgtatctgtgt

SEQ ID NO: 5020259 - DNA, 23 bp, Homo sapiens
agacaagtgactgtatctgtgta

SEQ ID NO: 5020260 - DNA, 18 bp, Homo sapiens
agacaatttgcacatctt

SEQ ID NO: 5020261 - DNA, 13 bp, Homo sapiens
agacaccaccacc

SEQ ID NO: 5020262 - DNA, 19 bp, Homo sapiens
agacaccgttcattcaggc

SEQ ID NO: 5020263 - DNA, 14 bp, Homo sapiens
agacatcagtctcc

SEQ ID NO: 5020264 - DNA, 14 bp, Homo sapiens
agaccaccccgcct

SEQ ID NO: 5020265 - DNA, 15 bp, Homo sapiens
agaccaggctgtgtc

SEQ ID NO: 5020266 - DNA, 16 bp, Homo sapiens
agaccaggctgtgtcc

SEQ ID NO: 5020267 - DNA, 14 bp, Homo sapiens
agacccccaggcct

SEQ ID NO: 5020268 - DNA, 15 bp, Homo sapiens
agacccccaggcctg

SEQ ID NO: 5020269 - DNA, 15 bp, Homo sapiens
agacctcatgcccag

SEQ ID NO: 5020270 - DNA, 20 bp, Homo sapiens
agacctcatgcccagctctc

SEQ ID NO: 5020271 - DNA, 16 bp, Homo sapiens
agacctgagaatgtat

SEQ ID NO: 5020272 - DNA, 17 bp, Homo sapiens
agacctgagggaccctt

SEQ ID NO: 5020273 - DNA, 16 bp, Homo sapiens
agacgatgtcttcata

SEQ ID NO: 5020274 - DNA, 17 bp, Homo sapiens
agacgatttgtcagtta

SEQ ID NO: 5020275 - DNA, 23 bp, Homo sapiens
agacggggtttgccatgctggcc

SEQ ID NO: 5020276 - DNA, 17 bp, Homo sapiens
agactcctggtctgtga

SEQ ID NO: 5020277 - DNA, 21 bp, Homo sapiens
agactctttttttgagtgaca

SEQ ID NO: 5020278 - DNA, 23 bp, Homo sapiens
agactctttttttgagtgacagc

SEQ ID NO: 5020279 - DNA, 21 bp, Homo sapiens
agactgccatattaaattttt

SEQ ID NO: 5020280 - DNA, 20 bp, Homo sapiens
agacttgggatggggaggga

SEQ ID NO: 5020281 - DNA, 14 bp, Homo sapiens
agagacccccaggc

SEQ ID NO: 5020282 - DNA, 20 bp, Homo sapiens
agagacttgggacattgcct

SEQ ID NO: 5020283 - DNA, 14 bp, Homo sapiens
agagagagagaaaa

SEQ ID NO: 5020284 - DNA, 13 bp, Homo sapiens
agagagtttcaaa

SEQ ID NO: 5020285 - DNA, 22 bp, Homo sapiens
agagcaggtgactgtgctgtgc

SEQ ID NO: 5020286 - DNA, 23 bp, Homo sapiens
agagcaggtgactgtgctgtgca

SEQ ID NO: 5020287 - DNA, 11 bp, Homo sapiens
agagccagccg

SEQ ID NO: 5020288 - DNA, 15 bp, Homo sapiens
agagcctttccaaag

SEQ ID NO: 5020289 - DNA, 16 bp, Homo sapiens
agagcgtgagctgagc

SEQ ID NO: 5020290 - DNA, 18 bp, Homo sapiens
agagcgtgagctgagcag

SEQ ID NO: 5020291 - DNA, 20 bp, Homo sapiens
agagcgtgagctgagcaggc

SEQ ID NO: 5020292 - DNA, 22 bp, Homo sapiens
agagcttgctccagattctgat

SEQ ID NO: 5020293 - DNA, 22 bp, Homo sapiens
agaggattaggttccatccttt

SEQ ID NO: 5020294 - DNA, 21 bp, Homo sapiens
agaggcctgggggacccctgg

SEQ ID NO: 5020295 - DNA, 23 bp, Homo sapiens
agagggttttaggtagaaaaaca

SEQ ID NO: 5020296 - DNA, 12 bp, Homo sapiens
agaggtggatgt

SEQ ID NO: 5020297 - DNA, 20 bp, Homo sapiens
agaggtggatgttatgaaca

SEQ ID NO: 5020298 - DNA, 21 bp, Homo sapiens
agagtccaggaggccctggtc

SEQ ID NO: 5020299 - DNA, 16 bp, Homo sapiens
agagtttcaaaagcaa

SEQ ID NO: 5020300 - DNA, 14 bp, Homo sapiens
agagtttctgtttg

SEQ ID NO: 5020301 - DNA, 15 bp, Homo sapiens
agagtttctgtttga

SEQ ID NO: 5020302 - DNA, 18 bp, Homo sapiens
agagtttctgtttgattc

SEQ ID NO: 5020303 - DNA, 22 bp, Homo sapiens
agagtttctgtttgattctttt

SEQ ID NO: 5020304 - DNA, 15 bp, Homo sapiens
agataaacacaagat

SEQ ID NO: 5020305 - DNA, 19 bp, Homo sapiens
agatagccctgtcctggtg

SEQ ID NO: 5020306 - DNA, 23 bp, Homo sapiens
agatccgcaatgtggagcagcag

SEQ ID NO: 5020307 - DNA, 16 bp, Homo sapiens
agatctttctccttga

SEQ ID NO: 5020308 - DNA, 22 bp, Homo sapiens
agatgggcttcccaagggctgc

SEQ ID NO: 5020309 - DNA, 22 bp, Homo sapiens
agatgtcttttcccatttatct

SEQ ID NO: 5020310 - DNA, 14 bp, Homo sapiens
agatgtttcacacc

SEQ ID NO: 5020311 - DNA, 23 bp, Homo sapiens
agatgtttcacaccggaaggttt

SEQ ID NO: 5020312 - DNA, 19 bp, Homo sapiens
agattatcgttttcttaaa

SEQ ID NO: 5020313 - DNA, 14 bp, Homo sapiens
agattctgatgcat

SEQ ID NO: 5020314 - DNA, 15 bp, Homo sapiens
agatttattaaagaa

SEQ ID NO: 5020315 - DNA, 17 bp, Homo sapiens
agatttattaaagaaaa

SEQ ID NO: 5020316 - DNA, 21 bp, Homo sapiens
agatttgtttttaaactgtac

SEQ ID NO: 5020317 - DNA, 22 bp, Homo sapiens
agatttgtttttaaactgtaca

SEQ ID NO: 5020318 - DNA, 16 bp, Homo sapiens
agcaaaacatctctgc

SEQ ID NO: 5020319 - DNA, 17 bp, Homo sapiens
agcaaaccatttttaaa

SEQ ID NO: 5020320 - DNA, 23 bp, Homo sapiens
agcaaaccatttttaaagtagaa

SEQ ID NO: 5020321 - DNA, 13 bp, Homo sapiens
agcaaacccagag

SEQ ID NO: 5020322 - DNA, 14 bp, Homo sapiens
agcaaacccagagg

SEQ ID NO: 5020323 - DNA, 21 bp, Homo sapiens
agcaaagattaaatgtgtcat

SEQ ID NO: 5020324 - DNA, 20 bp, Homo sapiens
agcaaatgtcttcctggatt

SEQ ID NO: 5020325 - DNA, 19 bp, Homo sapiens
agcaataacattcccactg

SEQ ID NO: 5020326 - DNA, 18 bp, Homo sapiens
agcaatactgtttccatt

SEQ ID NO: 5020327 - DNA, 21 bp, Homo sapiens
agcacaaggccttgcctggcc

SEQ ID NO: 5020328 - DNA, 14 bp, Homo sapiens
agcacacacttttg

SEQ ID NO: 5020329 - DNA, 20 bp, Homo sapiens
agcacacacttttggttaag

SEQ ID NO: 5020330 - DNA, 12 bp, Homo sapiens
agcacagcctag

SEQ ID NO: 5020331 - DNA, 14 bp, Homo sapiens
agcaccacactggg

SEQ ID NO: 5020332 - DNA, 15 bp, Homo sapiens
agcacggctctgtcc

SEQ ID NO: 5020333 - DNA, 21 bp, Homo sapiens
agcacggctctgtccccagcc

SEQ ID NO: 5020334 - DNA, 19 bp, Homo sapiens
agcacggtgactctgtcca

SEQ ID NO: 5020335 - DNA, 13 bp, Homo sapiens
agcactgcctgct

SEQ ID NO: 5020336 - DNA, 20 bp, Homo sapiens
agcactgcctgctcccatcc

SEQ ID NO: 5020337 - DNA, 22 bp, Homo sapiens
agcagaacaggtagtattacac

SEQ ID NO: 5020338 - DNA, 19 bp, Homo sapiens
agcagaacctgcacacagg

SEQ ID NO: 5020339 - DNA, 21 bp, Homo sapiens
agcagccactgcacaggagga

SEQ ID NO: 5020340 - DNA, 23 bp, Homo sapiens
agcagcgaccgccccctcctcta

SEQ ID NO: 5020341 - DNA, 15 bp, Homo sapiens
agcagcgagcctgct

SEQ ID NO: 5020342 - DNA, 21 bp, Homo sapiens
agcagctttgtctctgtcaca

SEQ ID NO: 5020343 - DNA, 13 bp, Homo sapiens
agcaggccacact

SEQ ID NO: 5020344 - DNA, 19 bp, Homo sapiens
agcaggtgactgtgctgtg

SEQ ID NO: 5020345 - DNA, 15 bp, Homo sapiens
agcatcacagttttg

SEQ ID NO: 5020346 - DNA, 19 bp, Homo sapiens
agcatcattatttatgtat

SEQ ID NO: 5020347 - DNA, 18 bp, Homo sapiens
agcatgtttagactttaa

SEQ ID NO: 5020348 - DNA, 22 bp, Homo sapiens
agcatgtttagactttaacata

SEQ ID NO: 5020349 - DNA, 13 bp, Homo sapiens
agcattttataaa

SEQ ID NO: 5020350 - DNA, 21 bp, Homo sapiens
agccacccaagcctgctggct

SEQ ID NO: 5020351 - DNA, 21 bp, Homo sapiens
agccacccgtggggtgctgcc

SEQ ID NO: 5020352 - DNA, 15 bp, Homo sapiens
agccagctcacagtg

SEQ ID NO: 5020353 - DNA, 20 bp, Homo sapiens
agccatccctttttttacat

SEQ ID NO: 5020354 - DNA, 20 bp, Homo sapiens
agccatgacttgagaaacaa

SEQ ID NO: 5020355 - DNA, 23 bp, Homo sapiens
agccccctcacagtattgctcac

SEQ ID NO: 5020356 - DNA, 23 bp, Homo sapiens
agccccgccccgttgtgagctgg

SEQ ID NO: 5020357 - DNA, 17 bp, Homo sapiens
agcccctcggctctgga

SEQ ID NO: 5020358 - DNA, 14 bp, Homo sapiens
agcccctgccattg

SEQ ID NO: 5020359 - DNA, 15 bp, Homo sapiens
agcccgaatacaaac

SEQ ID NO: 5020360 - DNA, 14 bp, Homo sapiens
agcccgcagggcca

SEQ ID NO: 5020361 - DNA, 20 bp, Homo sapiens
agcccgcagggccatgcaga

SEQ ID NO: 5020362 - DNA, 16 bp, Homo sapiens
agccctggctgaagga

SEQ ID NO: 5020363 - DNA, 20 bp, Homo sapiens
agcctcctcatcccgtgttc

SEQ ID NO: 5020364 - DNA, 14 bp, Homo sapiens
agcctctcccctgc

SEQ ID NO: 5020365 - DNA, 21 bp, Homo sapiens
agcctctcccctgcctgccct

SEQ ID NO: 5020366 - DNA, 18 bp, Homo sapiens
agcctgacccggaggaaa

SEQ ID NO: 5020367 - DNA, 12 bp, Homo sapiens
agcctgccctcc

SEQ ID NO: 5020368 - DNA, 11 bp, Homo sapiens
agcctgctggc

SEQ ID NO: 5020369 - DNA, 14 bp, Homo sapiens
agcctgctggctgc

SEQ ID NO: 5020370 - DNA, 15 bp, Homo sapiens
agcgaccgccccctc

SEQ ID NO: 5020371 - DNA, 19 bp, Homo sapiens
agcgatgggcccctggccc

SEQ ID NO: 5020372 - DNA, 22 bp, Homo sapiens
agcgctggccgggaccccgagc

SEQ ID NO: 5020373 - DNA, 14 bp, Homo sapiens
agcggcagatgggg

SEQ ID NO: 5020374 - DNA, 19 bp, Homo sapiens
agcgggcaggttctgcctg

SEQ ID NO: 5020375 - DNA, 23 bp, Homo sapiens
agcgggcaggttctgcctgcttt

SEQ ID NO: 5020376 - DNA, 20 bp, Homo sapiens
agcggtgtctctcctgcccc

SEQ ID NO: 5020377 - DNA, 18 bp, Homo sapiens
agcgtctttcttttttgg

SEQ ID NO: 5020378 - DNA, 16 bp, Homo sapiens
agcgtgagctgagcag

SEQ ID NO: 5020379 - DNA, 18 bp, Homo sapiens
agcgttcttgtaatttta

SEQ ID NO: 5020380 - DNA, 18 bp, Homo sapiens
agctaataaaaagctttt

SEQ ID NO: 5020381 - DNA, 21 bp, Homo sapiens
agctaataaaaagcttttgtc

SEQ ID NO: 5020382 - DNA, 17 bp, Homo sapiens
agctacttggtttgtgt

SEQ ID NO: 5020383 - DNA, 21 bp, Homo sapiens
agctacttggtttgtgttctt

SEQ ID NO: 5020384 - DNA, 16 bp, Homo sapiens
agctagtcttttgctt

SEQ ID NO: 5020385 - DNA, 12 bp, Homo sapiens
agctcaatgagc

SEQ ID NO: 5020386 - DNA, 13 bp, Homo sapiens
agctcaatgagca

SEQ ID NO: 5020387 - DNA, 11 bp, Homo sapiens
agctcctgtaa

SEQ ID NO: 5020388 - DNA, 18 bp, Homo sapiens
agctctccccaggcattt

SEQ ID NO: 5020389 - DNA, 22 bp, Homo sapiens
agctctctgacgcttgtgacag

SEQ ID NO: 5020390 - DNA, 17 bp, Homo sapiens
agctgaatgtttttcta

SEQ ID NO: 5020391 - DNA, 20 bp, Homo sapiens
agctgaatgtttttctaaag

SEQ ID NO: 5020392 - DNA, 17 bp, Homo sapiens
agctgccgcaccagccc

SEQ ID NO: 5020393 - DNA, 19 bp, Homo sapiens
agctgctccccaggccacc

SEQ ID NO: 5020394 - DNA, 21 bp, Homo sapiens
agctggccaaagagcctttcc

SEQ ID NO: 5020395 - DNA, 21 bp, Homo sapiens
agctgggagaccctccccaca

SEQ ID NO: 5020396 - DNA, 14 bp, Homo sapiens
agctgggcccctgc

SEQ ID NO: 5020397 - DNA, 15 bp, Homo sapiens
agctgggctctgcaa

SEQ ID NO: 5020398 - DNA, 14 bp, Homo sapiens
agctggggacctgg

SEQ ID NO: 5020399 - DNA, 15 bp, Homo sapiens
agctgtgtctgccaa

SEQ ID NO: 5020400 - DNA, 21 bp, Homo sapiens
agctgtgtctgccaaacacat

SEQ ID NO: 5020401 - DNA, 14 bp, Homo sapiens
agctgttttgttga

SEQ ID NO: 5020402 - DNA, 13 bp, Homo sapiens
agcttaaaataca

SEQ ID NO: 5020403 - DNA, 18 bp, Homo sapiens
agcttaaaatacaagact

SEQ ID NO: 5020404 - DNA, 20 bp, Homo sapiens
agcttgctccagattctgat

SEQ ID NO: 5020405 - DNA, 14 bp, Homo sapiens
agctttatgtaata

SEQ ID NO: 5020406 - DNA, 22 bp, Homo sapiens
agctttatgtaataatgtgaat

SEQ ID NO: 5020407 - DNA, 22 bp, Homo sapiens
agctttccccatgtctcgactc

SEQ ID NO: 5020408 - DNA, 20 bp, Homo sapiens
agctttctgggatgtcacag

SEQ ID NO: 5020409 - DNA, 20 bp, Homo sapiens
aggaaacgagactttccatt

SEQ ID NO: 5020410 - DNA, 19 bp, Homo sapiens
aggaaactgggttcctgca

SEQ ID NO: 5020411 - DNA, 16 bp, Homo sapiens
aggaactgggctgggc

SEQ ID NO: 5020412 - DNA, 19 bp, Homo sapiens
aggaagcctgcagtcctgg

SEQ ID NO: 5020413 - DNA, 20 bp, Homo sapiens
aggaagcctgcagtcctgga

SEQ ID NO: 5020414 - DNA, 14 bp, Homo sapiens
aggaaggttctggt

SEQ ID NO: 5020415 - DNA, 19 bp, Homo sapiens
aggaataaggcccagagcg

SEQ ID NO: 5020416 - DNA, 13 bp, Homo sapiens
aggactaatagaa

SEQ ID NO: 5020417 - DNA, 17 bp, Homo sapiens
aggactaatagaaaagt

SEQ ID NO: 5020418 - DNA, 16 bp, Homo sapiens
aggactgtgacaggca

SEQ ID NO: 5020419 - DNA, 18 bp, Homo sapiens
aggactttgaggcaagtg

SEQ ID NO: 5020420 - DNA, 15 bp, Homo sapiens
aggagaagggctggg

SEQ ID NO: 5020421 - DNA, 21 bp, Homo sapiens
aggagacctggcactggatgc

SEQ ID NO: 5020422 - DNA, 16 bp, Homo sapiens
aggaggccaggccacc

SEQ ID NO: 5020423 - DNA, 20 bp, Homo sapiens
aggaggctcaggtgatctgt

SEQ ID NO: 5020424 - DNA, 21 bp, Homo sapiens
aggaggctcaggtgatctgtt

SEQ ID NO: 5020425 - DNA, 13 bp, Homo sapiens
aggaggtggagaa

SEQ ID NO: 5020426 - DNA, 13 bp, Homo sapiens
aggaggtgtgagg

SEQ ID NO: 5020427 - DNA, 16 bp, Homo sapiens
aggagtgtggccacgt

SEQ ID NO: 5020428 - DNA, 13 bp, Homo sapiens
aggagtgtgtgtg

SEQ ID NO: 5020429 - DNA, 23 bp, Homo sapiens
aggagtttatgttccattaaacg

SEQ ID NO: 5020430 - DNA, 13 bp, Homo sapiens
aggatatgattaa

SEQ ID NO: 5020431 - DNA, 13 bp, Homo sapiens
aggatcagttttt

SEQ ID NO: 5020432 - DNA, 16 bp, Homo sapiens
aggatctgctgaggcc

SEQ ID NO: 5020433 - DNA, 21 bp, Homo sapiens
aggatctgctgaggcccagtg

SEQ ID NO: 5020434 - DNA, 20 bp, Homo sapiens
aggatttggtccgtcataac

SEQ ID NO: 5020435 - DNA, 14 bp, Homo sapiens
aggattttaccaaa

SEQ ID NO: 5020436 - DNA, 11 bp, Homo sapiens
aggattttatg

SEQ ID NO: 5020437 - DNA, 14 bp, Homo sapiens
aggattttatgctt

SEQ ID NO: 5020438 - DNA, 14 bp, Homo sapiens
aggcacaatatggg

SEQ ID NO: 5020439 - DNA, 12 bp, Homo sapiens
aggcacagagct

SEQ ID NO: 5020440 - DNA, 23 bp, Homo sapiens
aggcagggggaaggtggggtcct

SEQ ID NO: 5020441 - DNA, 22 bp, Homo sapiens
aggcatctctgtactttgcttg

SEQ ID NO: 5020442 - DNA, 13 bp, Homo sapiens
aggcattaacaca

SEQ ID NO: 5020443 - DNA, 17 bp, Homo sapiens
aggccaaaggctggtgg

SEQ ID NO: 5020444 - DNA, 21 bp, Homo sapiens
aggccaagcagtgcctgccta

SEQ ID NO: 5020445 - DNA, 21 bp, Homo sapiens
aggccacacttcaaactactt

SEQ ID NO: 5020446 - DNA, 19 bp, Homo sapiens
aggccaccccgctgatgga

SEQ ID NO: 5020447 - DNA, 14 bp, Homo sapiens
aggccaggccaccc

SEQ ID NO: 5020448 - DNA, 20 bp, Homo sapiens
aggccattccccgtctctgg

SEQ ID NO: 5020449 - DNA, 16 bp, Homo sapiens
aggcccagagcgagga

SEQ ID NO: 5020450 - DNA, 20 bp, Homo sapiens
aggccctggtcctggcctcc

SEQ ID NO: 5020451 - DNA, 22 bp, Homo sapiens
aggcctgggggacccctggctc

SEQ ID NO: 5020452 - DNA, 18 bp, Homo sapiens
aggcctgtccaccctgcc

SEQ ID NO: 5020453 - DNA, 18 bp, Homo sapiens
aggccttgcctggcctga

SEQ ID NO: 5020454 - DNA, 22 bp, Homo sapiens
aggctatggacagggcatgcca

SEQ ID NO: 5020455 - DNA, 18 bp, Homo sapiens
aggctctctgtaggcaca

SEQ ID NO: 5020456 - DNA, 21 bp, Homo sapiens
aggctgacacctaactcttct

SEQ ID NO: 5020457 - DNA, 17 bp, Homo sapiens
aggctgtgtaagatttg

SEQ ID NO: 5020458 - DNA, 19 bp, Homo sapiens
aggctgtgtaagatttgtt

SEQ ID NO: 5020459 - DNA, 22 bp, Homo sapiens
aggctgtgtccctcttctcttc

SEQ ID NO: 5020460 - DNA, 23 bp, Homo sapiens
agggaacaatttggcaattttgt

SEQ ID NO: 5020461 - DNA, 22 bp, Homo sapiens
agggacatgccctgtgtggctg

SEQ ID NO: 5020462 - DNA, 16 bp, Homo sapiens
agggaccactgggtga

SEQ ID NO: 5020463 - DNA, 20 bp, Homo sapiens
agggagacactggcccctca

SEQ ID NO: 5020464 - DNA, 12 bp, Homo sapiens
agggagggagtt

SEQ ID NO: 5020465 - DNA, 21 bp, Homo sapiens
agggcaccctagttctacctc

SEQ ID NO: 5020466 - DNA, 17 bp, Homo sapiens
agggcaggcttggggaa

SEQ ID NO: 5020467 - DNA, 13 bp, Homo sapiens
agggcagttttct

SEQ ID NO: 5020468 - DNA, 14 bp, Homo sapiens
agggccatgcagac

SEQ ID NO: 5020469 - DNA, 18 bp, Homo sapiens
agggcccggccacaccca

SEQ ID NO: 5020470 - DNA, 20 bp, Homo sapiens
agggcctcaaaggcccgctc

SEQ ID NO: 5020471 - DNA, 17 bp, Homo sapiens
aggggagggcaggcttg

SEQ ID NO: 5020472 - DNA, 17 bp, Homo sapiens
aggggcagcctgtgcct

SEQ ID NO: 5020473 - DNA, 15 bp, Homo sapiens
aggggtgtggctcct

SEQ ID NO: 5020474 - DNA, 22 bp, Homo sapiens
agggtagaattcaatcagagct

SEQ ID NO: 5020475 - DNA, 23 bp, Homo sapiens
agggtcctgccggtgggaccctg

SEQ ID NO: 5020476 - DNA, 12 bp, Homo sapiens
aggtaccatcct

SEQ ID NO: 5020477 - DNA, 18 bp, Homo sapiens
aggtcacctttattctgg

SEQ ID NO: 5020478 - DNA, 18 bp, Homo sapiens
aggtccagccctggctga

SEQ ID NO: 5020479 - DNA, 21 bp, Homo sapiens
aggtccagccctggctgaagg

SEQ ID NO: 5020480 - DNA, 22 bp, Homo sapiens
aggtccagccctggctgaagga

SEQ ID NO: 5020481 - DNA, 20 bp, Homo sapiens
aggtgacaaaccatttccaa

SEQ ID NO: 5020482 - DNA, 15 bp, Homo sapiens
aggtgactgtgctgt

SEQ ID NO: 5020483 - DNA, 13 bp, Homo sapiens
aggtgagaaaaaa

SEQ ID NO: 5020484 - DNA, 21 bp, Homo sapiens
aggtgatctgtttgaggagag

SEQ ID NO: 5020485 - DNA, 19 bp, Homo sapiens
aggtgcgtgttcagcagaa

SEQ ID NO: 5020486 - DNA, 20 bp, Homo sapiens
aggtgcgtgttcagcagaac

SEQ ID NO: 5020487 - DNA, 22 bp, Homo sapiens
aggtgcgtgttcagcagaacct

SEQ ID NO: 5020488 - DNA, 17 bp, Homo sapiens
aggtgctcccctgacag

SEQ ID NO: 5020489 - DNA, 13 bp, Homo sapiens
aggtgtgaggagg

SEQ ID NO: 5020490 - DNA, 14 bp, Homo sapiens
aggttctgcctgct

SEQ ID NO: 5020491 - DNA, 19 bp, Homo sapiens
aggtttaaatgaacaagag

SEQ ID NO: 5020492 - DNA, 23 bp, Homo sapiens
aggtttgtcgggcaccagccagc

SEQ ID NO: 5020493 - DNA, 18 bp, Homo sapiens
agtacctgggcaagctgg

SEQ ID NO: 5020494 - DNA, 15 bp, Homo sapiens
agtagttttcaaaac

SEQ ID NO: 5020495 - DNA, 14 bp, Homo sapiens
agtattgaagcatt

SEQ ID NO: 5020496 - DNA, 13 bp, Homo sapiens
agtattgttgtcc

SEQ ID NO: 5020497 - DNA, 21 bp, Homo sapiens
agtattgttgtccttttcata

SEQ ID NO: 5020498 - DNA, 24 bp, Homo sapiens
agtattgttgtccttttcataggt

SEQ ID NO: 5020499 - DNA, 17 bp, Homo sapiens
agtattttaaaatagcg

SEQ ID NO: 5020500 - DNA, 15 bp, Homo sapiens
agtcaagaagaaaaa

SEQ ID NO: 5020501 - DNA, 17 bp, Homo sapiens
agtcagggtgaattgtg

SEQ ID NO: 5020502 - DNA, 19 bp, Homo sapiens
agtcatctgtaagagcttg

SEQ ID NO: 5020503 - DNA, 21 bp, Homo sapiens
agtcatctgtaagagcttgct

SEQ ID NO: 5020504 - DNA, 14 bp, Homo sapiens
agtcatgtttatct

SEQ ID NO: 5020505 - DNA, 19 bp, Homo sapiens
agtcatgtttatctgctta

SEQ ID NO: 5020506 - DNA, 17 bp, Homo sapiens
agtcctggatgatacta

SEQ ID NO: 5020507 - DNA, 20 bp, Homo sapiens
agtctcagtttgtgtgtctt

SEQ ID NO: 5020508 - DNA, 15 bp, Homo sapiens
agtctgtcctgtgac

SEQ ID NO: 5020509 - DNA, 12 bp, Homo sapiens
agtctgttttat

SEQ ID NO: 5020510 - DNA, 17 bp, Homo sapiens
agtctgttttatgactt

SEQ ID NO: 5020511 - DNA, 22 bp, Homo sapiens
agtcttttgcttttgcccattt

SEQ ID NO: 5020512 - DNA, 15 bp, Homo sapiens
agtgaacattcccag

SEQ ID NO: 5020513 - DNA, 21 bp, Homo sapiens
agtgaacattcccagcccagc

SEQ ID NO: 5020514 - DNA, 13 bp, Homo sapiens
agtgacaaaccat

SEQ ID NO: 5020515 - DNA, 18 bp, Homo sapiens
agtgacagctttctggga

SEQ ID NO: 5020516 - DNA, 14 bp, Homo sapiens
agtgacctgtttat

SEQ ID NO: 5020517 - DNA, 12 bp, Homo sapiens
agtgagagccag

SEQ ID NO: 5020518 - DNA, 12 bp, Homo sapiens
agtgagcagaac

SEQ ID NO: 5020519 - DNA, 17 bp, Homo sapiens
agtgaggatgctgcagt

SEQ ID NO: 5020520 - DNA, 18 bp, Homo sapiens
agtgaggatgctgcagtg

SEQ ID NO: 5020521 - DNA, 14 bp, Homo sapiens
agtgcatatgcaat

SEQ ID NO: 5020522 - DNA, 22 bp, Homo sapiens
agtgccacccatgcagctgctc

SEQ ID NO: 5020523 - DNA, 12 bp, Homo sapiens
agtgctgtaaaa

SEQ ID NO: 5020524 - DNA, 16 bp, Homo sapiens
agtgctgttttgttat

SEQ ID NO: 5020525 - DNA, 20 bp, Homo sapiens
agtgctgttttgttatataa

SEQ ID NO: 5020526 - DNA, 22 bp, Homo sapiens
agtgctgttttgttatataatt

SEQ ID NO: 5020527 - DNA, 22 bp, Homo sapiens
agtgcttgcttttcatgcaaac

SEQ ID NO: 5020528 - DNA, 18 bp, Homo sapiens
agtggccaagatcacagt

SEQ ID NO: 5020529 - DNA, 22 bp, Homo sapiens
agtggccaagatcacagtggcc

SEQ ID NO: 5020530 - DNA, 16 bp, Homo sapiens
agtggcgcgcgccacc

SEQ ID NO: 5020531 - DNA, 15 bp, Homo sapiens
agtgggacagttcct

SEQ ID NO: 5020532 - DNA, 19 bp, Homo sapiens
agtggggaaggaggccaag

SEQ ID NO: 5020533 - DNA, 18 bp, Homo sapiens
agtggggggtcgtgggcc

SEQ ID NO: 5020534 - DNA, 19 bp, Homo sapiens
agtggggttatctctgtgt

SEQ ID NO: 5020535 - DNA, 21 bp, Homo sapiens
agtgtacacgtctggaccccg

SEQ ID NO: 5020536 - DNA, 16 bp, Homo sapiens
agtgtctattatcaca

SEQ ID NO: 5020537 - DNA, 22 bp, Homo sapiens
agtgtctttttttgtatagtta

SEQ ID NO: 5020538 - DNA, 13 bp, Homo sapiens
agtgtgcccatct

SEQ ID NO: 5020539 - DNA, 18 bp, Homo sapiens
agtgtttatcctttcata

SEQ ID NO: 5020540 - DNA, 20 bp, Homo sapiens
agtgtttatcctttcatata

SEQ ID NO: 5020541 - DNA, 22 bp, Homo sapiens
agttaacacactaccgaatgtg

SEQ ID NO: 5020542 - DNA, 14 bp, Homo sapiens
agttatattttgca

SEQ ID NO: 5020543 - DNA, 16 bp, Homo sapiens
agttcaccttggaagg

SEQ ID NO: 5020544 - DNA, 22 bp, Homo sapiens
agttcctgagtgcgtggatctg

SEQ ID NO: 5020545 - DNA, 22 bp, Homo sapiens
agttctaaaaaaaatgcatatt

SEQ ID NO: 5020546 - DNA, 23 bp, Homo sapiens
agttctacctcaggcagctcaag

SEQ ID NO: 5020547 - DNA, 15 bp, Homo sapiens
agttgaagtttagga

SEQ ID NO: 5020548 - DNA, 17 bp, Homo sapiens
agttgacatgggtgggg

SEQ ID NO: 5020549 - DNA, 22 bp, Homo sapiens
agttgcagctgttttgttgaca

SEQ ID NO: 5020550 - DNA, 15 bp, Homo sapiens
agttggaaggatctg

SEQ ID NO: 5020551 - DNA, 17 bp, Homo sapiens
agttgtctctgatgcag

SEQ ID NO: 5020552 - DNA, 18 bp, Homo sapiens
agtttagggaacaatttg

SEQ ID NO: 5020553 - DNA, 20 bp, Homo sapiens
agtttatttttaaagataga

SEQ ID NO: 5020554 - DNA, 14 bp, Homo sapiens
agtttctgtttgat

SEQ ID NO: 5020555 - DNA, 18 bp, Homo sapiens
agtttctgtttgattctt

SEQ ID NO: 5020556 - DNA, 21 bp, Homo sapiens
agtttggagagtcagatcttt

SEQ ID NO: 5020557 - DNA, 14 bp, Homo sapiens
agttttagttttct

SEQ ID NO: 5020558 - DNA, 21 bp, Homo sapiens
agttttggttgctttaatatc

SEQ ID NO: 5020559 - DNA, 12 bp, Homo sapiens
agttttgtctgt

SEQ ID NO: 5020560 - DNA, 18 bp, Homo sapiens
agtttttacagctgtgtt

SEQ ID NO: 5020561 - DNA, 18 bp, Homo sapiens
agttttttacttctctta

SEQ ID NO: 5020562 - DNA, 19 bp, Homo sapiens
agttttttttttcttgtct

SEQ ID NO: 5020563 - DNA, 22 bp, Homo sapiens
agttttttttttcttgtctata

SEQ ID NO: 5020564 - DNA, 20 bp, Homo sapiens
ataaaagcacaagtactttt

SEQ ID NO: 5020565 - DNA, 16 bp, Homo sapiens
ataaacaagaaaaata

SEQ ID NO: 5020566 - DNA, 22 bp, Homo sapiens
ataaacaagaaaaataaagaaa

SEQ ID NO: 5020567 - DNA, 17 bp, Homo sapiens
ataaactaataattgca

SEQ ID NO: 5020568 - DNA, 19 bp, Homo sapiens
ataaactactctttgattt

SEQ ID NO: 5020569 - DNA, 13 bp, Homo sapiens
ataaagaaaagat

SEQ ID NO: 5020570 - DNA, 14 bp, Homo sapiens
ataaagaaaagatg

SEQ ID NO: 5020571 - DNA, 19 bp, Homo sapiens
ataaagaaaagatgcactt

SEQ ID NO: 5020572 - DNA, 16 bp, Homo sapiens
ataaagacgttttata

SEQ ID NO: 5020573 - DNA, 12 bp, Homo sapiens
ataaagcattta

SEQ ID NO: 5020574 - DNA, 14 bp, Homo sapiens
ataaatcgcttttg

SEQ ID NO: 5020575 - DNA, 19 bp, Homo sapiens
ataaatcgcttttgataat

SEQ ID NO: 5020576 - DNA, 13 bp, Homo sapiens
ataaatgcaaata

SEQ ID NO: 5020577 - DNA, 14 bp, Homo sapiens
ataaatgcaaataa

SEQ ID NO: 5020578 - DNA, 21 bp, Homo sapiens
ataaattccctggcctttcat

SEQ ID NO: 5020579 - DNA, 21 bp, Homo sapiens
ataacaaatgccaaattaaaa

SEQ ID NO: 5020580 - DNA, 19 bp, Homo sapiens
ataagcatcattatttatg

SEQ ID NO: 5020581 - DNA, 18 bp, Homo sapiens
ataagctatttttctaac

SEQ ID NO: 5020582 - DNA, 16 bp, Homo sapiens
ataagtcattgtatgt

SEQ ID NO: 5020583 - DNA, 16 bp, Homo sapiens
ataatgatgatgatga

SEQ ID NO: 5020584 - DNA, 21 bp, Homo sapiens
ataatgctaatttaaagagac

SEQ ID NO: 5020585 - DNA, 21 bp, Homo sapiens
ataattgttgttctgttaact

SEQ ID NO: 5020586 - DNA, 22 bp, Homo sapiens
ataattgttgttctgttaactg

SEQ ID NO: 5020587 - DNA, 14 bp, Homo sapiens
ataccactctgtaa

SEQ ID NO: 5020588 - DNA, 19 bp, Homo sapiens
ataccactctgtaattgca

SEQ ID NO: 5020589 - DNA, 14 bp, Homo sapiens
atacgaaataattg

SEQ ID NO: 5020590 - DNA, 21 bp, Homo sapiens
atacgaaataattgttgttct

SEQ ID NO: 5020591 - DNA, 19 bp, Homo sapiens
atacgctactataaagaga

SEQ ID NO: 5020592 - DNA, 20 bp, Homo sapiens
atacgctactataaagagaa

SEQ ID NO: 5020593 - DNA, 22 bp, Homo sapiens
atactatttaaagcctcctcat

SEQ ID NO: 5020594 - DNA, 22 bp, Homo sapiens
atactcttcctatttttgtagt

SEQ ID NO: 5020595 - DNA, 18 bp, Homo sapiens
atagacccacaagaggca

SEQ ID NO: 5020596 - DNA, 13 bp, Homo sapiens
atagacttgggat

SEQ ID NO: 5020597 - DNA, 13 bp, Homo sapiens
atagatgtctttt

SEQ ID NO: 5020598 - DNA, 17 bp, Homo sapiens
atagatgtcttttccca

SEQ ID NO: 5020599 - DNA, 14 bp, Homo sapiens
atagcatgggaggt

SEQ ID NO: 5020600 - DNA, 23 bp, Homo sapiens
atagccactaaccttgcctggta

SEQ ID NO: 5020601 - DNA, 16 bp, Homo sapiens
atagccctgtcctggt

SEQ ID NO: 5020602 - DNA, 21 bp, Homo sapiens
atagcgctgtttttgttgtgt

SEQ ID NO: 5020603 - DNA, 13 bp, Homo sapiens
atagcgttcttgt

SEQ ID NO: 5020604 - DNA, 17 bp, Homo sapiens
atagcgttcttgtaatt

SEQ ID NO: 5020605 - DNA, 23 bp, Homo sapiens
atagctccccgcttctgcctgca

SEQ ID NO: 5020606 - DNA, 13 bp, Homo sapiens
ataggtctgaaat

SEQ ID NO: 5020607 - DNA, 14 bp, Homo sapiens
ataggtctgaaatt

SEQ ID NO: 5020608 - DNA, 20 bp, Homo sapiens
atagtgtctattatcacatt

SEQ ID NO: 5020609 - DNA, 14 bp, Homo sapiens
atagttaacacact

SEQ ID NO: 5020610 - DNA, 13 bp, Homo sapiens
atagttttcatcc

SEQ ID NO: 5020611 - DNA, 16 bp, Homo sapiens
atataaagacgtttta

SEQ ID NO: 5020612 - DNA, 12 bp, Homo sapiens
atataaatgcaa

SEQ ID NO: 5020613 - DNA, 11 bp, Homo sapiens
atatataaata

SEQ ID NO: 5020614 - DNA, 18 bp, Homo sapiens
atatataaatatattatt

SEQ ID NO: 5020615 - DNA, 20 bp, Homo sapiens
atatatggggatggtagttt

SEQ ID NO: 5020616 - DNA, 22 bp, Homo sapiens
atatatggggatggtagttttt

SEQ ID NO: 5020617 - DNA, 18 bp, Homo sapiens
atatattattacttgtaa

SEQ ID NO: 5020618 - DNA, 21 bp, Homo sapiens
atatatttgtttcatttctgc

SEQ ID NO: 5020619 - DNA, 22 bp, Homo sapiens
atatcatcagtattgaagcatt

SEQ ID NO: 5020620 - DNA, 17 bp, Homo sapiens
atattacggtttgcccc

SEQ ID NO: 5020621 - DNA, 15 bp, Homo sapiens
atattattacttgta

SEQ ID NO: 5020622 - DNA, 17 bp, Homo sapiens
atattggtttatgtagt

SEQ ID NO: 5020623 - DNA, 20 bp, Homo sapiens
atattgttattatataatta

SEQ ID NO: 5020624 - DNA, 15 bp, Homo sapiens
atatttgaaaaaaac

SEQ ID NO: 5020625 - DNA, 13 bp, Homo sapiens
atattttcctcct

SEQ ID NO: 5020626 - DNA, 16 bp, Homo sapiens
atcaaagaaattcaga

SEQ ID NO: 5020627 - DNA, 17 bp, Homo sapiens
atcaaagaaattcagaa

SEQ ID NO: 5020628 - DNA, 22 bp, Homo sapiens
atcacatgaattattacagtgt

SEQ ID NO: 5020629 - DNA, 18 bp, Homo sapiens
atcacattaatctcaaag

SEQ ID NO: 5020630 - DNA, 21 bp, Homo sapiens
atcacattaatctcaaagaga

SEQ ID NO: 5020631 - DNA, 16 bp, Homo sapiens
atcagcaatttcagaa

SEQ ID NO: 5020632 - DNA, 21 bp, Homo sapiens
atcagggtaaaaggtgcaggt

SEQ ID NO: 5020633 - DNA, 22 bp, Homo sapiens
atcagttaagaaatttcacata

SEQ ID NO: 5020634 - DNA, 14 bp, Homo sapiens
atcattatttatgt

SEQ ID NO: 5020635 - DNA, 22 bp, Homo sapiens
atccagcgagagagtttcaaaa

SEQ ID NO: 5020636 - DNA, 16 bp, Homo sapiens
atccctccccagttca

SEQ ID NO: 5020637 - DNA, 16 bp, Homo sapiens
atccctttttttacat

SEQ ID NO: 5020638 - DNA, 18 bp, Homo sapiens
atccgcaatgtggagcag

SEQ ID NO: 5020639 - DNA, 16 bp, Homo sapiens
atcctaggctgacacc

SEQ ID NO: 5020640 - DNA, 20 bp, Homo sapiens
atcctctcaaccacctttca

SEQ ID NO: 5020641 - DNA, 23 bp, Homo sapiens
atcctgtgtaacacttggctctt

SEQ ID NO: 5020642 - DNA, 13 bp, Homo sapiens
atcctgtgtgtta

SEQ ID NO: 5020643 - DNA, 19 bp, Homo sapiens
atcgtccagcgaccttcct

SEQ ID NO: 5020644 - DNA, 22 bp, Homo sapiens
atctaaatatggactgctcagg

SEQ ID NO: 5020645 - DNA, 18 bp, Homo sapiens
atctcagtatgaattatt

SEQ ID NO: 5020646 - DNA, 19 bp, Homo sapiens
atctccgtctcccaaagtg

SEQ ID NO: 5020647 - DNA, 18 bp, Homo sapiens
atctctgcaatcttctca

SEQ ID NO: 5020648 - DNA, 21 bp, Homo sapiens
atctctgcaatcttctcagaa

SEQ ID NO: 5020649 - DNA, 13 bp, Homo sapiens
atctctttcacat

SEQ ID NO: 5020650 - DNA, 14 bp, Homo sapiens
atctgagtcctgga

SEQ ID NO: 5020651 - DNA, 18 bp, Homo sapiens
atctgctcattttgacaa

SEQ ID NO: 5020652 - DNA, 14 bp, Homo sapiens
atctggaagaaaaa

SEQ ID NO: 5020653 - DNA, 17 bp, Homo sapiens
atctgtaagagcttgct

SEQ ID NO: 5020654 - DNA, 21 bp, Homo sapiens
atctgtaagagcttgctccag

SEQ ID NO: 5020655 - DNA, 15 bp, Homo sapiens
atctgtttgaggaga

SEQ ID NO: 5020656 - DNA, 14 bp, Homo sapiens
atctgtttttctca

SEQ ID NO: 5020657 - DNA, 18 bp, Homo sapiens
atcttagatgtttcacac

SEQ ID NO: 5020658 - DNA, 14 bp, Homo sapiens
atcttcagttgtct

SEQ ID NO: 5020659 - DNA, 17 bp, Homo sapiens
atcttcagttgtctctg

SEQ ID NO: 5020660 - DNA, 19 bp, Homo sapiens
atcttcagttgtctctgat

SEQ ID NO: 5020661 - DNA, 21 bp, Homo sapiens
atcttctgccttagtctcagt

SEQ ID NO: 5020662 - DNA, 13 bp, Homo sapiens
atcttggctatgt

SEQ ID NO: 5020663 - DNA, 22 bp, Homo sapiens
atctttctttccaaaacatttc

SEQ ID NO: 5020664 - DNA, 23 bp, Homo sapiens
atctttctttccaaaacatttct

SEQ ID NO: 5020665 - DNA, 22 bp, Homo sapiens
atctttggacagaagcagctct

SEQ ID NO: 5020666 - DNA, 23 bp, Homo sapiens
atctttggacagaagcagctctt

SEQ ID NO: 5020667 - DNA, 15 bp, Homo sapiens
atgaacagctgtgtc

SEQ ID NO: 5020668 - DNA, 17 bp, Homo sapiens
atgaacagctgtgtctg

SEQ ID NO: 5020669 - DNA, 14 bp, Homo sapiens
atgaagcaggaggc

SEQ ID NO: 5020670 - DNA, 15 bp, Homo sapiens
atgaagcaggaggcc

SEQ ID NO: 5020671 - DNA, 12 bp, Homo sapiens
atgaagccagct

SEQ ID NO: 5020672 - DNA, 15 bp, Homo sapiens
atgaccacactccag

SEQ ID NO: 5020673 - DNA, 19 bp, Homo sapiens
atgacggtaagtgttctca

SEQ ID NO: 5020674 - DNA, 20 bp, Homo sapiens
atgacggtaagtgttctcat

SEQ ID NO: 5020675 - DNA, 16 bp, Homo sapiens
atgacttcattaataa

SEQ ID NO: 5020676 - DNA, 12 bp, Homo sapiens
atgagatgctgg

SEQ ID NO: 5020677 - DNA, 21 bp, Homo sapiens
atgagcatgtttagactttaa

SEQ ID NO: 5020678 - DNA, 15 bp, Homo sapiens
atgagcgccacctct

SEQ ID NO: 5020679 - DNA, 18 bp, Homo sapiens
atgagctttatgtaataa

SEQ ID NO: 5020680 - DNA, 14 bp, Homo sapiens
atgaggtctgttta

SEQ ID NO: 5020681 - DNA, 15 bp, Homo sapiens
atgaggtctgtttaa

SEQ ID NO: 5020682 - DNA, 19 bp, Homo sapiens
atgatactaataaactaat

SEQ ID NO: 5020683 - DNA, 18 bp, Homo sapiens
atgatacttcgacactgt

SEQ ID NO: 5020684 - DNA, 23 bp, Homo sapiens
atgatacttcgacactgttctta

SEQ ID NO: 5020685 - DNA, 14 bp, Homo sapiens
atgatgatgaaaac

SEQ ID NO: 5020686 - DNA, 15 bp, Homo sapiens
atgatttttctttac

SEQ ID NO: 5020687 - DNA, 19 bp, Homo sapiens
atgatttttctttacaaaa

SEQ ID NO: 5020688 - DNA, 13 bp, Homo sapiens
atgcaaactcttt

SEQ ID NO: 5020689 - DNA, 22 bp, Homo sapiens
atgcaaactctttggtcgtttt

SEQ ID NO: 5020690 - DNA, 23 bp, Homo sapiens
atgcaacgggattgaagggtcct

SEQ ID NO: 5020691 - DNA, 18 bp, Homo sapiens
atgcaatgtatagtgtct

SEQ ID NO: 5020692 - DNA, 13 bp, Homo sapiens
atgcactttgctt

SEQ ID NO: 5020693 - DNA, 23 bp, Homo sapiens
atgcactttgctttaatataaat

SEQ ID NO: 5020694 - DNA, 20 bp, Homo sapiens
atgcagacctcatgcccagc

SEQ ID NO: 5020695 - DNA, 15 bp, Homo sapiens
atgcagaggcctggg

SEQ ID NO: 5020696 - DNA, 17 bp, Homo sapiens
atgcagctgctccccag

SEQ ID NO: 5020697 - DNA, 15 bp, Homo sapiens
atgcagcttatacga

SEQ ID NO: 5020698 - DNA, 16 bp, Homo sapiens
atgcagcttatacgaa

SEQ ID NO: 5020699 - DNA, 20 bp, Homo sapiens
atgcaggaggtggagaaaat

SEQ ID NO: 5020700 - DNA, 13 bp, Homo sapiens
atgccaaattaaa

SEQ ID NO: 5020701 - DNA, 14 bp, Homo sapiens
atgccaaattaaaa

SEQ ID NO: 5020702 - DNA, 15 bp, Homo sapiens
atgccaaattaaaaa

SEQ ID NO: 5020703 - DNA, 18 bp, Homo sapiens
atgccaaattaaaaaaga

SEQ ID NO: 5020704 - DNA, 22 bp, Homo sapiens
atgccaaattaaaaaagataaa

SEQ ID NO: 5020705 - DNA, 23 bp, Homo sapiens
atgccaagttgtttgagaaatta

SEQ ID NO: 5020706 - DNA, 12 bp, Homo sapiens
atgcccagctct

SEQ ID NO: 5020707 - DNA, 15 bp, Homo sapiens
atgcccagctctctg

SEQ ID NO: 5020708 - DNA, 16 bp, Homo sapiens
atgctaatttaaagag

SEQ ID NO: 5020709 - DNA, 23 bp, Homo sapiens
atgctgaatatacagcaggtgct

SEQ ID NO: 5020710 - DNA, 11 bp, Homo sapiens
atgctgctctc

SEQ ID NO: 5020711 - DNA, 21 bp, Homo sapiens
atgcttctaagtaaatacaat

SEQ ID NO: 5020712 - DNA, 21 bp, Homo sapiens
atgctttaggatgtacagtta

SEQ ID NO: 5020713 - DNA, 18 bp, Homo sapiens
atggacagggcatgccac

SEQ ID NO: 5020714 - DNA, 13 bp, Homo sapiens
atggagacaccac

SEQ ID NO: 5020715 - DNA, 13 bp, Homo sapiens
atggagccccacc

SEQ ID NO: 5020716 - DNA, 15 bp, Homo sapiens
atggcagttatattt

SEQ ID NO: 5020717 - DNA, 15 bp, Homo sapiens
atggccatgcaggag

SEQ ID NO: 5020718 - DNA, 17 bp, Homo sapiens
atggccatgcaggaggt

SEQ ID NO: 5020719 - DNA, 18 bp, Homo sapiens
atggcccctctgacctgc

SEQ ID NO: 5020720 - DNA, 19 bp, Homo sapiens
atggcgtctgctctggtgg

SEQ ID NO: 5020721 - DNA, 19 bp, Homo sapiens
atggtagttttttcatctt

SEQ ID NO: 5020722 - DNA, 18 bp, Homo sapiens
atgtactagtgttctgtt

SEQ ID NO: 5020723 - DNA, 22 bp, Homo sapiens
atgtactagtgttctgtttgtt

SEQ ID NO: 5020724 - DNA, 19 bp, Homo sapiens
atgtattgtgcaatgtgta

SEQ ID NO: 5020725 - DNA, 24 bp, Homo sapiens
atgtattgtgcaatgtgtataaac

SEQ ID NO: 5020726 - DNA, 13 bp, Homo sapiens
atgtattttatgt

SEQ ID NO: 5020727 - DNA, 23 bp, Homo sapiens
atgtcacagtccaaccagaaaca

SEQ ID NO: 5020728 - DNA, 12 bp, Homo sapiens
atgtcccaccca

SEQ ID NO: 5020729 - DNA, 21 bp, Homo sapiens
atgtcttcatacctacatgta

SEQ ID NO: 5020730 - DNA, 16 bp, Homo sapiens
atgtcttttcccattt

SEQ ID NO: 5020731 - DNA, 15 bp, Homo sapiens
atgtgaatcgcagct

SEQ ID NO: 5020732 - DNA, 20 bp, Homo sapiens
atgtgaatcgcagctgtggg

SEQ ID NO: 5020733 - DNA, 22 bp, Homo sapiens
atgtgacatgcccaaggccacg

SEQ ID NO: 5020734 - DNA, 17 bp, Homo sapiens
atgtggggctgagctgg

SEQ ID NO: 5020735 - DNA, 18 bp, Homo sapiens
atgtggggctgagctggg

SEQ ID NO: 5020736 - DNA, 22 bp, Homo sapiens
atgtggtggcacaggccccctt

SEQ ID NO: 5020737 - DNA, 15 bp, Homo sapiens
atgtgtataaacaag

SEQ ID NO: 5020738 - DNA, 17 bp, Homo sapiens
atgttatatataaatat

SEQ ID NO: 5020739 - DNA, 22 bp, Homo sapiens
atgttatatataaatatattat

SEQ ID NO: 5020740 - DNA, 17 bp, Homo sapiens
atgtttaatctgttatg

SEQ ID NO: 5020741 - DNA, 13 bp, Homo sapiens
atgtttccagcag

SEQ ID NO: 5020742 - DNA, 12 bp, Homo sapiens
atgtttgaaatg

SEQ ID NO: 5020743 - DNA, 22 bp, Homo sapiens
atgtttgaaatgaggtctgttt

SEQ ID NO: 5020744 - DNA, 16 bp, Homo sapiens
atgtttttctaaagga

SEQ ID NO: 5020745 - DNA, 22 bp, Homo sapiens
atgttttttccttttcacattt

SEQ ID NO: 5020746 - DNA, 14 bp, Homo sapiens
attaaaaaagataa

SEQ ID NO: 5020747 - DNA, 18 bp, Homo sapiens
attaaaaaagataaacac

SEQ ID NO: 5020748 - DNA, 14 bp, Homo sapiens
attaaacgattttt

SEQ ID NO: 5020749 - DNA, 16 bp, Homo sapiens
attaaacgtcattcag

SEQ ID NO: 5020750 - DNA, 22 bp, Homo sapiens
attaaagaaaaaaatgtatttt

SEQ ID NO: 5020751 - DNA, 13 bp, Homo sapiens
attaaagacagag

SEQ ID NO: 5020752 - DNA, 18 bp, Homo sapiens
attaaattttttgttgac

SEQ ID NO: 5020753 - DNA, 13 bp, Homo sapiens
attaacacaaagg

SEQ ID NO: 5020754 - DNA, 21 bp, Homo sapiens
attaagaatgaaatactgttt

SEQ ID NO: 5020755 - DNA, 22 bp, Homo sapiens
attaagaatgaaatactgtttg

SEQ ID NO: 5020756 - DNA, 20 bp, Homo sapiens
attaaggattttatgcttta

SEQ ID NO: 5020757 - DNA, 17 bp, Homo sapiens
attaaggtcaagcccag

SEQ ID NO: 5020758 - DNA, 14 bp, Homo sapiens
attaatattttaat

SEQ ID NO: 5020759 - DNA, 13 bp, Homo sapiens
attaatctcaaag

SEQ ID NO: 5020760 - DNA, 19 bp, Homo sapiens
attaattgggccagctttt

SEQ ID NO: 5020761 - DNA, 14 bp, Homo sapiens
attacaagtatttt

SEQ ID NO: 5020762 - DNA, 19 bp, Homo sapiens
attacaagtatttttaatt

SEQ ID NO: 5020763 - DNA, 22 bp, Homo sapiens
attacagtgtttatcctttcat

SEQ ID NO: 5020764 - DNA, 21 bp, Homo sapiens
attaccagtggcgttgttgca

SEQ ID NO: 5020765 - DNA, 14 bp, Homo sapiens
attaccatgtaatg

SEQ ID NO: 5020766 - DNA, 15 bp, Homo sapiens
attaccatgtaatgg

SEQ ID NO: 5020767 - DNA, 20 bp, Homo sapiens
attacttgtaaatataaaga

SEQ ID NO: 5020768 - DNA, 21 bp, Homo sapiens
attacttgtaaatataaagac

SEQ ID NO: 5020769 - DNA, 13 bp, Homo sapiens
attaggccagcaa

SEQ ID NO: 5020770 - DNA, 17 bp, Homo sapiens
attagtagttaccacag

SEQ ID NO: 5020771 - DNA, 13 bp, Homo sapiens
attagtattgttg

SEQ ID NO: 5020772 - DNA, 14 bp, Homo sapiens
attagtattgttgt

SEQ ID NO: 5020773 - DNA, 15 bp, Homo sapiens
attagtcatgtttat

SEQ ID NO: 5020774 - DNA, 15 bp, Homo sapiens
attattacagtgttt

SEQ ID NO: 5020775 - DNA, 16 bp, Homo sapiens
attattacttgtaaat

SEQ ID NO: 5020776 - DNA, 22 bp, Homo sapiens
attattacttgtaaatataaag

SEQ ID NO: 5020777 - DNA, 13 bp, Homo sapiens
attatttatgtat

SEQ ID NO: 5020778 - DNA, 14 bp, Homo sapiens
attatttatgtatt

SEQ ID NO: 5020779 - DNA, 23 bp, Homo sapiens
attattttcatccttgtcttatt

SEQ ID NO: 5020780 - DNA, 16 bp, Homo sapiens
attcaaaatgatgtat

SEQ ID NO: 5020781 - DNA, 18 bp, Homo sapiens
attcaaattgctgcttgg

SEQ ID NO: 5020782 - DNA, 21 bp, Homo sapiens
attccaaagctttattaccag

SEQ ID NO: 5020783 - DNA, 23 bp, Homo sapiens
attccaaagctttattaccagtg

SEQ ID NO: 5020784 - DNA, 20 bp, Homo sapiens
attccagtcaaatctgggct

SEQ ID NO: 5020785 - DNA, 15 bp, Homo sapiens
attcccctctgctgc

SEQ ID NO: 5020786 - DNA, 22 bp, Homo sapiens
attcccctctgctgctgtccct

SEQ ID NO: 5020787 - DNA, 19 bp, Homo sapiens
attcccttcctgccagccc

SEQ ID NO: 5020788 - DNA, 23 bp, Homo sapiens
attcctcatttgttcattaaacg

SEQ ID NO: 5020789 - DNA, 13 bp, Homo sapiens
attctacacagag

SEQ ID NO: 5020790 - DNA, 17 bp, Homo sapiens
attctacttctctgttg

SEQ ID NO: 5020791 - DNA, 16 bp, Homo sapiens
attctattttagaata

SEQ ID NO: 5020792 - DNA, 21 bp, Homo sapiens
attctcattggaaatttagca

SEQ ID NO: 5020793 - DNA, 23 bp, Homo sapiens
attctcattggaaatttagcatt

SEQ ID NO: 5020794 - DNA, 16 bp, Homo sapiens
attctgaatgcttcta

SEQ ID NO: 5020795 - DNA, 17 bp, Homo sapiens
attcttaattctctgca

SEQ ID NO: 5020796 - DNA, 22 bp, Homo sapiens
attcttaattctctgcaacact

SEQ ID NO: 5020797 - DNA, 16 bp, Homo sapiens
attctttccatttgca

SEQ ID NO: 5020798 - DNA, 14 bp, Homo sapiens
attgaaatgtaagg

SEQ ID NO: 5020799 - DNA, 21 bp, Homo sapiens
attgcaacctccaccttctgg

SEQ ID NO: 5020800 - DNA, 16 bp, Homo sapiens
attgctcacccagtgc

SEQ ID NO: 5020801 - DNA, 14 bp, Homo sapiens
attgctgcttggat

SEQ ID NO: 5020802 - DNA, 15 bp, Homo sapiens
attggcatggaaatt

SEQ ID NO: 5020803 - DNA, 16 bp, Homo sapiens
attgggccagcttttc

SEQ ID NO: 5020804 - DNA, 18 bp, Homo sapiens
attggtgtttttttctat

SEQ ID NO: 5020805 - DNA, 19 bp, Homo sapiens
attggtgtttttttctatg

SEQ ID NO: 5020806 - DNA, 16 bp, Homo sapiens
attggttcttgtatta

SEQ ID NO: 5020807 - DNA, 14 bp, Homo sapiens
attgtagtgctttg

SEQ ID NO: 5020808 - DNA, 13 bp, Homo sapiens
attgttgtccttt

SEQ ID NO: 5020809 - DNA, 18 bp, Homo sapiens
attgttgtccttttcata

SEQ ID NO: 5020810 - DNA, 14 bp, Homo sapiens
attgttgttctgtt

SEQ ID NO: 5020811 - DNA, 18 bp, Homo sapiens
attgttgttctgttaact

SEQ ID NO: 5020812 - DNA, 21 bp, Homo sapiens
attgttgttctgttaactgaa

SEQ ID NO: 5020813 - DNA, 16 bp, Homo sapiens
atttaaagcaggttct

SEQ ID NO: 5020814 - DNA, 19 bp, Homo sapiens
atttaaagcaggttcttgt

SEQ ID NO: 5020815 - DNA, 15 bp, Homo sapiens
atttaaatgtgtaca

SEQ ID NO: 5020816 - DNA, 19 bp, Homo sapiens
atttaacccccctgtacac

SEQ ID NO: 5020817 - DNA, 21 bp, Homo sapiens
atttaacccccctgtacacaa

SEQ ID NO: 5020818 - DNA, 23 bp, Homo sapiens
atttaacccccctgtacacaact

SEQ ID NO: 5020819 - DNA, 22 bp, Homo sapiens
atttagcattgtagtgctttga

SEQ ID NO: 5020820 - DNA, 19 bp, Homo sapiens
atttatgtattgtgcaatg

SEQ ID NO: 5020821 - DNA, 14 bp, Homo sapiens
atttattaaagaaa

SEQ ID NO: 5020822 - DNA, 18 bp, Homo sapiens
atttattaaagaaaaaaa

SEQ ID NO: 5020823 - DNA, 20 bp, Homo sapiens
atttattaaagaaaaaaatg

SEQ ID NO: 5020824 - DNA, 22 bp, Homo sapiens
atttattaaagaaaaaaatgta

SEQ ID NO: 5020825 - DNA, 23 bp, Homo sapiens
atttattaaagaaaaaaatgtat

SEQ ID NO: 5020826 - DNA, 16 bp, Homo sapiens
atttattgcattgctg

SEQ ID NO: 5020827 - DNA, 19 bp, Homo sapiens
atttcaggaggaatactga

SEQ ID NO: 5020828 - DNA, 22 bp, Homo sapiens
atttcaggaggaatactgaaca

SEQ ID NO: 5020829 - DNA, 20 bp, Homo sapiens
atttccagtgaaatcagtta

SEQ ID NO: 5020830 - DNA, 22 bp, Homo sapiens
atttccccgatgtcccctgcgg

SEQ ID NO: 5020831 - DNA, 17 bp, Homo sapiens
atttgcatatgtatgac

SEQ ID NO: 5020832 - DNA, 12 bp, Homo sapiens
atttgcatttgt

SEQ ID NO: 5020833 - DNA, 14 bp, Homo sapiens
atttggtctcaggc

SEQ ID NO: 5020834 - DNA, 12 bp, Homo sapiens
atttgttcaagt

SEQ ID NO: 5020835 - DNA, 18 bp, Homo sapiens
atttgtttatgtaatttc

SEQ ID NO: 5020836 - DNA, 21 bp, Homo sapiens
atttgtttttaaactgtacag

SEQ ID NO: 5020837 - DNA, 22 bp, Homo sapiens
atttgtttttaaactgtacagt

SEQ ID NO: 5020838 - DNA, 23 bp, Homo sapiens
attttaaaatagcgttcttgtaa

SEQ ID NO: 5020839 - DNA, 13 bp, Homo sapiens
attttaatctaat

SEQ ID NO: 5020840 - DNA, 23 bp, Homo sapiens
attttacatgaagctgtataatt

SEQ ID NO: 5020841 - DNA, 12 bp, Homo sapiens
attttaccaaag

SEQ ID NO: 5020842 - DNA, 18 bp, Homo sapiens
attttaccaaagcatcaa

SEQ ID NO: 5020843 - DNA, 22 bp, Homo sapiens
attttaccaaagcatcaataca

SEQ ID NO: 5020844 - DNA, 18 bp, Homo sapiens
attttagctactatatat

SEQ ID NO: 5020845 - DNA, 16 bp, Homo sapiens
attttataaatcgctt

SEQ ID NO: 5020846 - DNA, 17 bp, Homo sapiens
attttatgctttaaaca

SEQ ID NO: 5020847 - DNA, 15 bp, Homo sapiens
attttatgttatata

SEQ ID NO: 5020848 - DNA, 19 bp, Homo sapiens
attttgaaagtctgtcctt

SEQ ID NO: 5020849 - DNA, 20 bp, Homo sapiens
attttgaaagtctgtccttg

SEQ ID NO: 5020850 - DNA, 15 bp, Homo sapiens
atttttaaagataga

SEQ ID NO: 5020851 - DNA, 14 bp, Homo sapiens
atttttaaagtaga

SEQ ID NO: 5020852 - DNA, 19 bp, Homo sapiens
atttttaaagtagaagagg

SEQ ID NO: 5020853 - DNA, 14 bp, Homo sapiens
atttttcttcttga

SEQ ID NO: 5020854 - DNA, 14 bp, Homo sapiens
atttttctttacaa

SEQ ID NO: 5020855 - DNA, 16 bp, Homo sapiens
atttttctttacaaaa

SEQ ID NO: 5020856 - DNA, 16 bp, Homo sapiens
attttttttattagta

SEQ ID NO: 5020857 - DNA, 23 bp, Homo sapiens
caaaaactttggagtcccctcac

SEQ ID NO: 5020858 - DNA, 19 bp, Homo sapiens
caaaaatctcccagtgaca

SEQ ID NO: 5020859 - DNA, 20 bp, Homo sapiens
caaaaatctcccagtgacaa

SEQ ID NO: 5020860 - DNA, 17 bp, Homo sapiens
caaaacatctctgcagt

SEQ ID NO: 5020861 - DNA, 23 bp, Homo sapiens
caaaagcaaaacatctctgcagt

SEQ ID NO: 5020862 - DNA, 21 bp, Homo sapiens
caaaatagggtatattttcct

SEQ ID NO: 5020863 - DNA, 16 bp, Homo sapiens
caaaatcttgatcagt

SEQ ID NO: 5020864 - DNA, 18 bp, Homo sapiens
caaaatcttgatcagtta

SEQ ID NO: 5020865 - DNA, 12 bp, Homo sapiens
caaacaccttcc

SEQ ID NO: 5020866 - DNA, 14 bp, Homo sapiens
caaaccatttccaa

SEQ ID NO: 5020867 - DNA, 16 bp, Homo sapiens
caaacccagaggtgga

SEQ ID NO: 5020868 - DNA, 20 bp, Homo sapiens
caaactactttgctgctaat

SEQ ID NO: 5020869 - DNA, 12 bp, Homo sapiens
caaactttgcat

SEQ ID NO: 5020870 - DNA, 20 bp, Homo sapiens
caaactttgcatctcagtat

SEQ ID NO: 5020871 - DNA, 19 bp, Homo sapiens
caaagagattcgaatgacg

SEQ ID NO: 5020872 - DNA, 19 bp, Homo sapiens
caaagagcctttccaaaga

SEQ ID NO: 5020873 - DNA, 15 bp, Homo sapiens
caaaggctggtggca

SEQ ID NO: 5020874 - DNA, 22 bp, Homo sapiens
caaagggaccaggggagaggca

SEQ ID NO: 5020875 - DNA, 13 bp, Homo sapiens
caaaggtttaaat

SEQ ID NO: 5020876 - DNA, 20 bp, Homo sapiens
caaaggtttaaatgaacaag

SEQ ID NO: 5020877 - DNA, 17 bp, Homo sapiens
caaagtatctaacaaaa

SEQ ID NO: 5020878 - DNA, 19 bp, Homo sapiens
caaagtatctaacaaaacc

SEQ ID NO: 5020879 - DNA, 12 bp, Homo sapiens
caaataaagtct

SEQ ID NO: 5020880 - DNA, 21 bp, Homo sapiens
caaatctcaatgaagccagct

SEQ ID NO: 5020881 - DNA, 13 bp, Homo sapiens
caaatctgggctc

SEQ ID NO: 5020882 - DNA, 18 bp, Homo sapiens
caaatgtcttcctggatt

SEQ ID NO: 5020883 - DNA, 15 bp, Homo sapiens
caaattagttatata

SEQ ID NO: 5020884 - DNA, 19 bp, Homo sapiens
caacggccctgcagccagc

SEQ ID NO: 5020885 - DNA, 20 bp, Homo sapiens
caacgtgctctttgttttgt

SEQ ID NO: 5020886 - DNA, 15 bp, Homo sapiens
caactcactcctttt

SEQ ID NO: 5020887 - DNA, 17 bp, Homo sapiens
caactcactccttttaa

SEQ ID NO: 5020888 - DNA, 18 bp, Homo sapiens
caactcactccttttaaa

SEQ ID NO: 5020889 - DNA, 22 bp, Homo sapiens
caactcactccttttaaagaaa

SEQ ID NO: 5020890 - DNA, 23 bp, Homo sapiens
caactgaaggggtgcacccacct

SEQ ID NO: 5020891 - DNA, 19 bp, Homo sapiens
caacttctcttgctttcta

SEQ ID NO: 5020892 - DNA, 17 bp, Homo sapiens
caagaaaaataaagaaa

SEQ ID NO: 5020893 - DNA, 19 bp, Homo sapiens
caagaaaaataaagaaaag

SEQ ID NO: 5020894 - DNA, 22 bp, Homo sapiens
caagaaaaataaagaaaagatg

SEQ ID NO: 5020895 - DNA, 12 bp, Homo sapiens
caagaaggattt

SEQ ID NO: 5020896 - DNA, 16 bp, Homo sapiens
caagacatgtggaggg

SEQ ID NO: 5020897 - DNA, 15 bp, Homo sapiens
caagactcctcaggc

SEQ ID NO: 5020898 - DNA, 22 bp, Homo sapiens
caagagaagcattctcattgga

SEQ ID NO: 5020899 - DNA, 19 bp, Homo sapiens
caagagaaggggaagcact

SEQ ID NO: 5020900 - DNA, 13 bp, Homo sapiens
caagcggtgtctc

SEQ ID NO: 5020901 - DNA, 18 bp, Homo sapiens
caaggtggtgtgatctta

SEQ ID NO: 5020902 - DNA, 22 bp, Homo sapiens
caagtagataggaagaaagaag

SEQ ID NO: 5020903 - DNA, 22 bp, Homo sapiens
caagtccattatgtaatagtga

SEQ ID NO: 5020904 - DNA, 21 bp, Homo sapiens
caagtgactgtatctgtgtag

SEQ ID NO: 5020905 - DNA, 22 bp, Homo sapiens
caatagccactaaccttgcctg

SEQ ID NO: 5020906 - DNA, 16 bp, Homo sapiens
caatctactcaaagca

SEQ ID NO: 5020907 - DNA, 12 bp, Homo sapiens
caatgagcatgt

SEQ ID NO: 5020908 - DNA, 18 bp, Homo sapiens
caatgagcatgtttagac

SEQ ID NO: 5020909 - DNA, 20 bp, Homo sapiens
caatgtgtataaacaagaaa

SEQ ID NO: 5020910 - DNA, 22 bp, Homo sapiens
caattaaggattttatgcttta

SEQ ID NO: 5020911 - DNA, 11 bp, Homo sapiens
caattcccctc

SEQ ID NO: 5020912 - DNA, 21 bp, Homo sapiens
caattcctcatttgttcatta

SEQ ID NO: 5020913 - DNA, 14 bp, Homo sapiens
caatttcagaacca

SEQ ID NO: 5020914 - DNA, 23 bp, Homo sapiens
caattttttttattagtattgtt

SEQ ID NO: 5020915 - DNA, 16 bp, Homo sapiens
cacaaattagttatat

SEQ ID NO: 5020916 - DNA, 15 bp, Homo sapiens
cacaagattggtgtt

SEQ ID NO: 5020917 - DNA, 22 bp, Homo sapiens
cacaagattggtgtttttttct

SEQ ID NO: 5020918 - DNA, 18 bp, Homo sapiens
cacacaaaccttctgcct

SEQ ID NO: 5020919 - DNA, 14 bp, Homo sapiens
cacacacaaacctt

SEQ ID NO: 5020920 - DNA, 13 bp, Homo sapiens
cacacacacacac

SEQ ID NO: 5020921 - DNA, 16 bp, Homo sapiens
cacacacacacacaca

SEQ ID NO: 5020922 - DNA, 12 bp, Homo sapiens
cacacacttttg

SEQ ID NO: 5020923 - DNA, 22 bp, Homo sapiens
cacacagggcccggccacaccc

SEQ ID NO: 5020924 - DNA, 21 bp, Homo sapiens
cacaccctgtactgttctgtg

SEQ ID NO: 5020925 - DNA, 23 bp, Homo sapiens
cacacgagcaaacccagaggtgg

SEQ ID NO: 5020926 - DNA, 18 bp, Homo sapiens
cacactaccgaatgtgtc

SEQ ID NO: 5020927 - DNA, 21 bp, Homo sapiens
cacactaccgaatgtgtcttt

SEQ ID NO: 5020928 - DNA, 18 bp, Homo sapiens
cacactggtacttagagt

SEQ ID NO: 5020929 - DNA, 19 bp, Homo sapiens
cacactggtacttagagtt

SEQ ID NO: 5020930 - DNA, 16 bp, Homo sapiens
cacagaaaccaatttt

SEQ ID NO: 5020931 - DNA, 12 bp, Homo sapiens
cacagccacccg

SEQ ID NO: 5020932 - DNA, 15 bp, Homo sapiens
cacagccacccgtgg

SEQ ID NO: 5020933 - DNA, 22 bp, Homo sapiens
cacagccacccgtggggtgctg

SEQ ID NO: 5020934 - DNA, 21 bp, Homo sapiens
cacagcggagtctgtcctgtg

SEQ ID NO: 5020935 - DNA, 10 bp, Homo sapiens
cacagctcct

SEQ ID NO: 5020936 - DNA, 15 bp, Homo sapiens
cacagctcctcccac

SEQ ID NO: 5020937 - DNA, 14 bp, Homo sapiens
cacagctgtagtgg

SEQ ID NO: 5020938 - DNA, 22 bp, Homo sapiens
cacaggaagcctgcagtcctgg

SEQ ID NO: 5020939 - DNA, 17 bp, Homo sapiens
cacaggcttctgagcag

SEQ ID NO: 5020940 - DNA, 18 bp, Homo sapiens
cacaggcttctgagcagc

SEQ ID NO: 5020941 - DNA, 15 bp, Homo sapiens
cacagggcccggcca

SEQ ID NO: 5020942 - DNA, 19 bp, Homo sapiens
cacagtcatggtggccacg

SEQ ID NO: 5020943 - DNA, 13 bp, Homo sapiens
cacagtgccaccc

SEQ ID NO: 5020944 - DNA, 16 bp, Homo sapiens
cacagtgtatgaaggg

SEQ ID NO: 5020945 - DNA, 13 bp, Homo sapiens
cacagtgtctggc

SEQ ID NO: 5020946 - DNA, 16 bp, Homo sapiens
cacattaaagaagacc

SEQ ID NO: 5020947 - DNA, 15 bp, Homo sapiens
cacattaatctcaaa

SEQ ID NO: 5020948 - DNA, 18 bp, Homo sapiens
caccaccccaacaaacca

SEQ ID NO: 5020949 - DNA, 22 bp, Homo sapiens
caccacggcgttgtacctgtag

SEQ ID NO: 5020950 - DNA, 11 bp, Homo sapiens
caccagccagc

SEQ ID NO: 5020951 - DNA, 18 bp, Homo sapiens
caccagggcctggctggg

SEQ ID NO: 5020952 - DNA, 15 bp, Homo sapiens
cacccaagcctgctg

SEQ ID NO: 5020953 - DNA, 20 bp, Homo sapiens
cacccacctgttttctgaaa

SEQ ID NO: 5020954 - DNA, 14 bp, Homo sapiens
cacccagctcagca

SEQ ID NO: 5020955 - DNA, 23 bp, Homo sapiens
cacccagtgccctctcccctcag

SEQ ID NO: 5020956 - DNA, 14 bp, Homo sapiens
cacccatgcagctg

SEQ ID NO: 5020957 - DNA, 16 bp, Homo sapiens
caccccaccccacccc

SEQ ID NO: 5020958 - DNA, 14 bp, Homo sapiens
caccccctttcctg

SEQ ID NO: 5020959 - DNA, 15 bp, Homo sapiens
caccccgctgatgga

SEQ ID NO: 5020960 - DNA, 23 bp, Homo sapiens
cacccctctgtctaggactgcag

SEQ ID NO: 5020961 - DNA, 17 bp, Homo sapiens
caccctaggcagcctgc

SEQ ID NO: 5020962 - DNA, 23 bp, Homo sapiens
caccctgtactgttctgtgtctt

SEQ ID NO: 5020963 - DNA, 15 bp, Homo sapiens
cacctaagtctctgt

SEQ ID NO: 5020964 - DNA, 13 bp, Homo sapiens
cacctagctgaat

SEQ ID NO: 5020965 - DNA, 20 bp, Homo sapiens
cacctcggggacaccagagc

SEQ ID NO: 5020966 - DNA, 21 bp, Homo sapiens
cacctcggggacaccagagct

SEQ ID NO: 5020967 - DNA, 12 bp, Homo sapiens
cacctctttaaa

SEQ ID NO: 5020968 - DNA, 22 bp, Homo sapiens
cacctctttaaaaactcactta

SEQ ID NO: 5020969 - DNA, 15 bp, Homo sapiens
cacctgttttctgaa

SEQ ID NO: 5020970 - DNA, 22 bp, Homo sapiens
caccttagcctgccctcctttc

SEQ ID NO: 5020971 - DNA, 14 bp, Homo sapiens
caccttccagctcc

SEQ ID NO: 5020972 - DNA, 15 bp, Homo sapiens
caccttccagctcct

SEQ ID NO: 5020973 - DNA, 22 bp, Homo sapiens
cacctttcagataactgttatt

SEQ ID NO: 5020974 - DNA, 17 bp, Homo sapiens
cacgagcaaacccagag

SEQ ID NO: 5020975 - DNA, 19 bp, Homo sapiens
cacgagcaaacccagaggt

SEQ ID NO: 5020976 - DNA, 21 bp, Homo sapiens
cacgagcaaacccagaggtgg

SEQ ID NO: 5020977 - DNA, 15 bp, Homo sapiens
cacgcgggggccttg

SEQ ID NO: 5020978 - DNA, 13 bp, Homo sapiens
cacgcttttgtga

SEQ ID NO: 5020979 - DNA, 20 bp, Homo sapiens
cacggagcagttcagagtgg

SEQ ID NO: 5020980 - DNA, 21 bp, Homo sapiens
cacggagcagttcagagtgga

SEQ ID NO: 5020981 - DNA, 13 bp, Homo sapiens
cacggccacagtc

SEQ ID NO: 5020982 - DNA, 15 bp, Homo sapiens
cacggcgttgtacct

SEQ ID NO: 5020983 - DNA, 18 bp, Homo sapiens
cacggctctgtccccagc

SEQ ID NO: 5020984 - DNA, 19 bp, Homo sapiens
cacggctctgtccccagcc

SEQ ID NO: 5020985 - DNA, 20 bp, Homo sapiens
cacggctctgtccccagcct

SEQ ID NO: 5020986 - DNA, 14 bp, Homo sapiens
cacgggcctgtcca

SEQ ID NO: 5020987 - DNA, 24 bp, Homo sapiens
cacgggcctgtccacaggcttctg

SEQ ID NO: 5020988 - DNA, 13 bp, Homo sapiens
cacgtgacagccg

SEQ ID NO: 5020989 - DNA, 16 bp, Homo sapiens
cacgtgggctcatatg

SEQ ID NO: 5020990 - DNA, 23 bp, Homo sapiens
cacgtggttggggccctgccctg

SEQ ID NO: 5020991 - DNA, 23 bp, Homo sapiens
cactaaccttgcctggtacagta

SEQ ID NO: 5020992 - DNA, 15 bp, Homo sapiens
cactccaattaagga

SEQ ID NO: 5020993 - DNA, 17 bp, Homo sapiens
cactccaattaaggatt

SEQ ID NO: 5020994 - DNA, 18 bp, Homo sapiens
cactccaattaaggattt

SEQ ID NO: 5020995 - DNA, 12 bp, Homo sapiens
cactccaccatc

SEQ ID NO: 5020996 - DNA, 13 bp, Homo sapiens
cactccaccatcc

SEQ ID NO: 5020997 - DNA, 20 bp, Homo sapiens
cactcgtgtgcaacagacaa

SEQ ID NO: 5020998 - DNA, 12 bp, Homo sapiens
cactctgcctgc

SEQ ID NO: 5020999 - DNA, 14 bp, Homo sapiens
cactctgcctgcct

SEQ ID NO: 5021000 - DNA, 17 bp, Homo sapiens
cactctgtaattgcaaa

SEQ ID NO: 5021001 - DNA, 17 bp, Homo sapiens
cactgaactccttcccc

SEQ ID NO: 5021002 - DNA, 22 bp, Homo sapiens
cactgccatgcaccaggactgg

SEQ ID NO: 5021003 - DNA, 13 bp, Homo sapiens
cactgcctgctcc

SEQ ID NO: 5021004 - DNA, 13 bp, Homo sapiens
cactggaactcag

SEQ ID NO: 5021005 - DNA, 13 bp, Homo sapiens
cactggcccctca

SEQ ID NO: 5021006 - DNA, 22 bp, Homo sapiens
cactggtacttagagtttctgt

SEQ ID NO: 5021007 - DNA, 13 bp, Homo sapiens
cactgtggtggca

SEQ ID NO: 5021008 - DNA, 17 bp, Homo sapiens
cacttacgtttgtcctt

SEQ ID NO: 5021009 - DNA, 20 bp, Homo sapiens
cacttatttatgaacctgcc

SEQ ID NO: 5021010 - DNA, 14 bp, Homo sapiens
cacttcaaactact

SEQ ID NO: 5021011 - DNA, 16 bp, Homo sapiens
cactttaacacagtgt

SEQ ID NO: 5021012 - DNA, 20 bp, Homo sapiens
cactttataagtcattgtat

SEQ ID NO: 5021013 - DNA, 12 bp, Homo sapiens
cacttttttcca

SEQ ID NO: 5021014 - DNA, 15 bp, Homo sapiens
cagaacacataattc

SEQ ID NO: 5021015 - DNA, 15 bp, Homo sapiens
cagaacatactgatt

SEQ ID NO: 5021016 - DNA, 22 bp, Homo sapiens
cagaacatactgattgggaggt

SEQ ID NO: 5021017 - DNA, 17 bp, Homo sapiens
cagaaccaattattttc

SEQ ID NO: 5021018 - DNA, 19 bp, Homo sapiens
cagaacctgcacacaggac

SEQ ID NO: 5021019 - DNA, 13 bp, Homo sapiens
cagaagcagctct

SEQ ID NO: 5021020 - DNA, 14 bp, Homo sapiens
cagaagcagctctt

SEQ ID NO: 5021021 - DNA, 22 bp, Homo sapiens
cagaatacggaagagcaggtga

SEQ ID NO: 5021022 - DNA, 22 bp, Homo sapiens
cagaatattagtgacctcagct

SEQ ID NO: 5021023 - DNA, 16 bp, Homo sapiens
cagacctcatgcccag

SEQ ID NO: 5021024 - DNA, 17 bp, Homo sapiens
cagacctcatgcccagc

SEQ ID NO: 5021025 - DNA, 22 bp, Homo sapiens
cagactctttttttgagtgaca

SEQ ID NO: 5021026 - DNA, 18 bp, Homo sapiens
cagagacttgggacattg

SEQ ID NO: 5021027 - DNA, 15 bp, Homo sapiens
cagagcgtgagctga

SEQ ID NO: 5021028 - DNA, 21 bp, Homo sapiens
cagaggcagtacctgggcaag

SEQ ID NO: 5021029 - DNA, 18 bp, Homo sapiens
cagaggtggatgttatga

SEQ ID NO: 5021030 - DNA, 19 bp, Homo sapiens
cagagtccttagtggaggg

SEQ ID NO: 5021031 - DNA, 18 bp, Homo sapiens
cagatggactccagcctg

SEQ ID NO: 5021032 - DNA, 19 bp, Homo sapiens
cagatggactccagcctgc

SEQ ID NO: 5021033 - DNA, 19 bp, Homo sapiens
cagatgtggggctgagctg

SEQ ID NO: 5021034 - DNA, 12 bp, Homo sapiens
cagattctgatg

SEQ ID NO: 5021035 - DNA, 21 bp, Homo sapiens
cagcaaaccatttttaaagta

SEQ ID NO: 5021036 - DNA, 24 bp, Homo sapiens
cagcaaaccatttttaaagtagaa

SEQ ID NO: 5021037 - DNA, 20 bp, Homo sapiens
cagcacaaattagttatata

SEQ ID NO: 5021038 - DNA, 22 bp, Homo sapiens
cagcacaaggccttgcctggcc

SEQ ID NO: 5021039 - DNA, 23 bp, Homo sapiens
cagcaccacactgggtgcgtctc

SEQ ID NO: 5021040 - DNA, 15 bp, Homo sapiens
cagcactgcctgctc

SEQ ID NO: 5021041 - DNA, 23 bp, Homo sapiens
cagcactgcctgctcccatcctg

SEQ ID NO: 5021042 - DNA, 19 bp, Homo sapiens
cagcagaacctgcacacag

SEQ ID NO: 5021043 - DNA, 19 bp, Homo sapiens
cagcagagacttgggacat

SEQ ID NO: 5021044 - DNA, 15 bp, Homo sapiens
cagccacccaagcct

SEQ ID NO: 5021045 - DNA, 17 bp, Homo sapiens
cagccacccaagcctgc

SEQ ID NO: 5021046 - DNA, 14 bp, Homo sapiens
cagccactgcacag

SEQ ID NO: 5021047 - DNA, 23 bp, Homo sapiens
cagcccagccccgccccgttgtg

SEQ ID NO: 5021048 - DNA, 17 bp, Homo sapiens
cagccccgggagtggcg

SEQ ID NO: 5021049 - DNA, 14 bp, Homo sapiens
cagcccgctgagtg

SEQ ID NO: 5021050 - DNA, 23 bp, Homo sapiens
cagcctccccctgtcccctctat

SEQ ID NO: 5021051 - DNA, 13 bp, Homo sapiens
cagcctgcctgtc

SEQ ID NO: 5021052 - DNA, 12 bp, Homo sapiens
cagcctgggaaa

SEQ ID NO: 5021053 - DNA, 16 bp, Homo sapiens
cagcgaccgccccctc

SEQ ID NO: 5021054 - DNA, 19 bp, Homo sapiens
cagcgagagagtttcaaaa

SEQ ID NO: 5021055 - DNA, 22 bp, Homo sapiens
cagcgagagagtttcaaaagca

SEQ ID NO: 5021056 - DNA, 13 bp, Homo sapiens
cagcgagcctgct

SEQ ID NO: 5021057 - DNA, 21 bp, Homo sapiens
cagcggagtctgtcctgtgac

SEQ ID NO: 5021058 - DNA, 24 bp, Homo sapiens
cagctaccctttttctccagctgg

SEQ ID NO: 5021059 - DNA, 17 bp, Homo sapiens
cagctacttcctcctcc

SEQ ID NO: 5021060 - DNA, 20 bp, Homo sapiens
cagctcaatggactggaagg

SEQ ID NO: 5021061 - DNA, 20 bp, Homo sapiens
cagctcacagtgctgtgtgc

SEQ ID NO: 5021062 - DNA, 12 bp, Homo sapiens
cagctcagcact

SEQ ID NO: 5021063 - DNA, 15 bp, Homo sapiens
cagctcagcactgcc

SEQ ID NO: 5021064 - DNA, 14 bp, Homo sapiens
cagctcctcccaca

SEQ ID NO: 5021065 - DNA, 20 bp, Homo sapiens
cagctctccccaggcatttg

SEQ ID NO: 5021066 - DNA, 21 bp, Homo sapiens
cagctctccccaggcatttgc

SEQ ID NO: 5021067 - DNA, 16 bp, Homo sapiens
cagctctctgacgctt

SEQ ID NO: 5021068 - DNA, 20 bp, Homo sapiens
cagctctggtccaggccctg

SEQ ID NO: 5021069 - DNA, 15 bp, Homo sapiens
cagctgccaggagca

SEQ ID NO: 5021070 - DNA, 15 bp, Homo sapiens
cagctgccccagcca

SEQ ID NO: 5021071 - DNA, 18 bp, Homo sapiens
cagctgctccccaggcca

SEQ ID NO: 5021072 - DNA, 23 bp, Homo sapiens
cagctgggatcacatgtggactt

SEQ ID NO: 5021073 - DNA, 15 bp, Homo sapiens
cagctgggctctgca

SEQ ID NO: 5021074 - DNA, 17 bp, Homo sapiens
cagctgggctctgcaat

SEQ ID NO: 5021075 - DNA, 11 bp, Homo sapiens
cagctgtgtct

SEQ ID NO: 5021076 - DNA, 15 bp, Homo sapiens
cagctgtgtctgcca

SEQ ID NO: 5021077 - DNA, 22 bp, Homo sapiens
cagctgtgtctgccaaacacat

SEQ ID NO: 5021078 - DNA, 16 bp, Homo sapiens
cagctgttttgttgac

SEQ ID NO: 5021079 - DNA, 22 bp, Homo sapiens
cagctgttttgttgacattctg

SEQ ID NO: 5021080 - DNA, 16 bp, Homo sapiens
cagcttatacgaaata

SEQ ID NO: 5021081 - DNA, 21 bp, Homo sapiens
cagcttatacgaaataattgt

SEQ ID NO: 5021082 - DNA, 22 bp, Homo sapiens
cagctttaaaaaattaatctgg

SEQ ID NO: 5021083 - DNA, 13 bp, Homo sapiens
cagcttttcaaac

SEQ ID NO: 5021084 - DNA, 14 bp, Homo sapiens
caggaactgggctg

SEQ ID NO: 5021085 - DNA, 13 bp, Homo sapiens
caggactgcacag

SEQ ID NO: 5021086 - DNA, 15 bp, Homo sapiens
caggagactgggctc

SEQ ID NO: 5021087 - DNA, 16 bp, Homo sapiens
caggagactgggctct

SEQ ID NO: 5021088 - DNA, 17 bp, Homo sapiens
caggagcacggctctgt

SEQ ID NO: 5021089 - DNA, 13 bp, Homo sapiens
caggaggccctgg

SEQ ID NO: 5021090 - DNA, 13 bp, Homo sapiens
caggaggcccttg

SEQ ID NO: 5021091 - DNA, 14 bp, Homo sapiens
caggaggtggagaa

SEQ ID NO: 5021092 - DNA, 13 bp, Homo sapiens
caggagtgtgtgt

SEQ ID NO: 5021093 - DNA, 13 bp, Homo sapiens
caggatagacttt

SEQ ID NO: 5021094 - DNA, 14 bp, Homo sapiens
caggcacggtttgg

SEQ ID NO: 5021095 - DNA, 18 bp, Homo sapiens
caggcagcaccacactgg

SEQ ID NO: 5021096 - DNA, 11 bp, Homo sapiens
caggcagcaga

SEQ ID NO: 5021097 - DNA, 14 bp, Homo sapiens
caggcagcagagac

SEQ ID NO: 5021098 - DNA, 16 bp, Homo sapiens
caggccacacttcaaa

SEQ ID NO: 5021099 - DNA, 18 bp, Homo sapiens
caggccacacttcaaact

SEQ ID NO: 5021100 - DNA, 21 bp, Homo sapiens
caggccacacttcaaactact

SEQ ID NO: 5021101 - DNA, 21 bp, Homo sapiens
caggccattccccgtctctgg

SEQ ID NO: 5021102 - DNA, 18 bp, Homo sapiens
caggcctcttggcagtca

SEQ ID NO: 5021103 - DNA, 21 bp, Homo sapiens
caggcctgtccaccctgccaa

SEQ ID NO: 5021104 - DNA, 16 bp, Homo sapiens
caggcgggaggaggtg

SEQ ID NO: 5021105 - DNA, 16 bp, Homo sapiens
caggcgtgacctgaca

SEQ ID NO: 5021106 - DNA, 24 bp, Homo sapiens
caggctggtctcgaactgctggat

SEQ ID NO: 5021107 - DNA, 23 bp, Homo sapiens
caggcttctgagcagcgagcctg

SEQ ID NO: 5021108 - DNA, 22 bp, Homo sapiens
cagggaccactgggtgagagag

SEQ ID NO: 5021109 - DNA, 15 bp, Homo sapiens
cagggcatgccacgt

SEQ ID NO: 5021110 - DNA, 12 bp, Homo sapiens
cagggccatgca

SEQ ID NO: 5021111 - DNA, 19 bp, Homo sapiens
caggggttcttgagccagc

SEQ ID NO: 5021112 - DNA, 15 bp, Homo sapiens
cagggtggggaggga

SEQ ID NO: 5021113 - DNA, 22 bp, Homo sapiens
caggtgccgccagctgccgcac

SEQ ID NO: 5021114 - DNA, 23 bp, Homo sapiens
caggtgccgccagctgccgcacc

SEQ ID NO: 5021115 - DNA, 22 bp, Homo sapiens
caggtggctctgaggtgcctgt

SEQ ID NO: 5021116 - DNA, 19 bp, Homo sapiens
caggttcaacccacagcta

SEQ ID NO: 5021117 - DNA, 12 bp, Homo sapiens
caggttcttgtt

SEQ ID NO: 5021118 - DNA, 21 bp, Homo sapiens
caggttcttgttggtgcacag

SEQ ID NO: 5021119 - DNA, 19 bp, Homo sapiens
cagtaccctctcagctcca

SEQ ID NO: 5021120 - DNA, 20 bp, Homo sapiens
cagtaccctctcagctccag

SEQ ID NO: 5021121 - DNA, 24 bp, Homo sapiens
cagtaccctctcagctccaggtgg

SEQ ID NO: 5021122 - DNA, 20 bp, Homo sapiens
cagtacctgattgtattttt

SEQ ID NO: 5021123 - DNA, 16 bp, Homo sapiens
cagtagttttcaaaac

SEQ ID NO: 5021124 - DNA, 18 bp, Homo sapiens
cagtagttttcaaaacac

SEQ ID NO: 5021125 - DNA, 19 bp, Homo sapiens
cagtatgaattattcaatt

SEQ ID NO: 5021126 - DNA, 15 bp, Homo sapiens
cagtatgatttataa

SEQ ID NO: 5021127 - DNA, 15 bp, Homo sapiens
cagtcaaatctgggc

SEQ ID NO: 5021128 - DNA, 17 bp, Homo sapiens
cagtcaaatctgggctc

SEQ ID NO: 5021129 - DNA, 13 bp, Homo sapiens
cagtcaagaagaa

SEQ ID NO: 5021130 - DNA, 16 bp, Homo sapiens
cagtcatctgtaagag

SEQ ID NO: 5021131 - DNA, 14 bp, Homo sapiens
cagtccaaccagaa

SEQ ID NO: 5021132 - DNA, 19 bp, Homo sapiens
cagtcccaagcggtgtctc

SEQ ID NO: 5021133 - DNA, 13 bp, Homo sapiens
cagtccccttccc

SEQ ID NO: 5021134 - DNA, 14 bp, Homo sapiens
cagtccccttccct

SEQ ID NO: 5021135 - DNA, 19 bp, Homo sapiens
cagtctcactgtgggaagg

SEQ ID NO: 5021136 - DNA, 23 bp, Homo sapiens
cagtctcactgtgggaaggccag

SEQ ID NO: 5021137 - DNA, 12 bp, Homo sapiens
cagtgaacattc

SEQ ID NO: 5021138 - DNA, 14 bp, Homo sapiens
cagtgaacattccc

SEQ ID NO: 5021139 - DNA, 15 bp, Homo sapiens
cagtgaacattccca

SEQ ID NO: 5021140 - DNA, 17 bp, Homo sapiens
cagtgaacattcccagc

SEQ ID NO: 5021141 - DNA, 21 bp, Homo sapiens
cagtgaggctgtaaagtggcc

SEQ ID NO: 5021142 - DNA, 21 bp, Homo sapiens
cagtgccacccatgcagctgc

SEQ ID NO: 5021143 - DNA, 22 bp, Homo sapiens
cagtgccctctcccctcagcct

SEQ ID NO: 5021144 - DNA, 20 bp, Homo sapiens
cagtgcctcttccagtgaac

SEQ ID NO: 5021145 - DNA, 23 bp, Homo sapiens
cagtgctcatacgtatctgctca

SEQ ID NO: 5021146 - DNA, 23 bp, Homo sapiens
cagtggccaagatcacagtggcc

SEQ ID NO: 5021147 - DNA, 16 bp, Homo sapiens
cagtgtacacgtctgg

SEQ ID NO: 5021148 - DNA, 21 bp, Homo sapiens
cagtgtacacgtctggacccc

SEQ ID NO: 5021149 - DNA, 12 bp, Homo sapiens
cagtgtcttttt

SEQ ID NO: 5021150 - DNA, 17 bp, Homo sapiens
cagtgtctttttttgta

SEQ ID NO: 5021151 - DNA, 22 bp, Homo sapiens
cagtgtggagttcaccttggaa

SEQ ID NO: 5021152 - DNA, 23 bp, Homo sapiens
cagtgtggagttcaccttggaag

SEQ ID NO: 5021153 - DNA, 15 bp, Homo sapiens
cagttatattttgca

SEQ ID NO: 5021154 - DNA, 18 bp, Homo sapiens
cagttcccacattaaaga

SEQ ID NO: 5021155 - DNA, 17 bp, Homo sapiens
cagttggccagagagcc

SEQ ID NO: 5021156 - DNA, 17 bp, Homo sapiens
cagttgtctctgatgca

SEQ ID NO: 5021157 - DNA, 21 bp, Homo sapiens
cagttgtctctgatgcagctt

SEQ ID NO: 5021158 - DNA, 21 bp, Homo sapiens
cagtttatttttaaagataga

SEQ ID NO: 5021159 - DNA, 15 bp, Homo sapiens
cagtttgtgtgtctt

SEQ ID NO: 5021160 - DNA, 21 bp, Homo sapiens
cagtttgtgtgtcttaattat

SEQ ID NO: 5021161 - DNA, 23 bp, Homo sapiens
cagtttgtgtgtcttaattatta

SEQ ID NO: 5021162 - DNA, 19 bp, Homo sapiens
cagttttggttgctttaat

SEQ ID NO: 5021163 - DNA, 18 bp, Homo sapiens
cagttttttttttcttgt

SEQ ID NO: 5021164 - DNA, 14 bp, Homo sapiens
cataactgaacatc

SEQ ID NO: 5021165 - DNA, 17 bp, Homo sapiens
cataagctatttttcta

SEQ ID NO: 5021166 - DNA, 20 bp, Homo sapiens
cataagctatttttctaact

SEQ ID NO: 5021167 - DNA, 22 bp, Homo sapiens
cataatgctaatttaaagagac

SEQ ID NO: 5021168 - DNA, 17 bp, Homo sapiens
catactgattgggaggt

SEQ ID NO: 5021169 - DNA, 20 bp, Homo sapiens
catactgattgggaggtgcg

SEQ ID NO: 5021170 - DNA, 15 bp, Homo sapiens
catactggcctggac

SEQ ID NO: 5021171 - DNA, 12 bp, Homo sapiens
catagcagcttt

SEQ ID NO: 5021172 - DNA, 21 bp, Homo sapiens
cataggtctgaaatttttctt

SEQ ID NO: 5021173 - DNA, 17 bp, Homo sapiens
catagtagtttttacag

SEQ ID NO: 5021174 - DNA, 23 bp, Homo sapiens
catatatttgtttcatttctgca

SEQ ID NO: 5021175 - DNA, 15 bp, Homo sapiens
catattcttgtgctt

SEQ ID NO: 5021176 - DNA, 14 bp, Homo sapiens
catattgttattat

SEQ ID NO: 5021177 - DNA, 21 bp, Homo sapiens
catatttattgcattgctggt

SEQ ID NO: 5021178 - DNA, 21 bp, Homo sapiens
catcaaggacacgggcctgtc

SEQ ID NO: 5021179 - DNA, 17 bp, Homo sapiens
catcaagttctccccag

SEQ ID NO: 5021180 - DNA, 21 bp, Homo sapiens
catcacagttttggttgcttt

SEQ ID NO: 5021181 - DNA, 19 bp, Homo sapiens
catcattatttatgtattg

SEQ ID NO: 5021182 - DNA, 22 bp, Homo sapiens
catccagcgagagagtttcaaa

SEQ ID NO: 5021183 - DNA, 23 bp, Homo sapiens
catccagcgagagagtttcaaaa

SEQ ID NO: 5021184 - DNA, 23 bp, Homo sapiens
catccagtctcccaacttgtatt

SEQ ID NO: 5021185 - DNA, 12 bp, Homo sapiens
catccatccagg

SEQ ID NO: 5021186 - DNA, 21 bp, Homo sapiens
catcccgtgttctccttttcc

SEQ ID NO: 5021187 - DNA, 13 bp, Homo sapiens
catccctccccag

SEQ ID NO: 5021188 - DNA, 13 bp, Homo sapiens
catcctggctgcg

SEQ ID NO: 5021189 - DNA, 15 bp, Homo sapiens
catcctggctgcggc

SEQ ID NO: 5021190 - DNA, 13 bp, Homo sapiens
catccttgtctta

SEQ ID NO: 5021191 - DNA, 22 bp, Homo sapiens
catccttgtcttattcccttcc

SEQ ID NO: 5021192 - DNA, 17 bp, Homo sapiens
catctcagtatgaatta

SEQ ID NO: 5021193 - DNA, 18 bp, Homo sapiens
catctcagtgctgtaaaa

SEQ ID NO: 5021194 - DNA, 15 bp, Homo sapiens
catctctgcaatctt

SEQ ID NO: 5021195 - DNA, 22 bp, Homo sapiens
catctctgcaatcttctcagaa

SEQ ID NO: 5021196 - DNA, 22 bp, Homo sapiens
catctctgcagtttttcccaag

SEQ ID NO: 5021197 - DNA, 21 bp, Homo sapiens
catctcttcctccgaggccag

SEQ ID NO: 5021198 - DNA, 11 bp, Homo sapiens
catctgctcct

SEQ ID NO: 5021199 - DNA, 14 bp, Homo sapiens
catctgctcctgga

SEQ ID NO: 5021200 - DNA, 16 bp, Homo sapiens
catctgtaagagcttg

SEQ ID NO: 5021201 - DNA, 19 bp, Homo sapiens
catcttgccaagggtccct

SEQ ID NO: 5021202 - DNA, 18 bp, Homo sapiens
catgcaccaggactggct

SEQ ID NO: 5021203 - DNA, 20 bp, Homo sapiens
catgcaccctcatacacaga

SEQ ID NO: 5021204 - DNA, 21 bp, Homo sapiens
catgcagacctcatgcccagc

SEQ ID NO: 5021205 - DNA, 17 bp, Homo sapiens
catgcagctgctcccca

SEQ ID NO: 5021206 - DNA, 13 bp, Homo sapiens
catgcccagctct

SEQ ID NO: 5021207 - DNA, 14 bp, Homo sapiens
catgcccagctctc

SEQ ID NO: 5021208 - DNA, 19 bp, Homo sapiens
catgctgaaggctgaaaga

SEQ ID NO: 5021209 - DNA, 14 bp, Homo sapiens
catggaaagactgg

SEQ ID NO: 5021210 - DNA, 15 bp, Homo sapiens
catggaaatttaaag

SEQ ID NO: 5021211 - DNA, 18 bp, Homo sapiens
catggaaggggcttctgg

SEQ ID NO: 5021212 - DNA, 23 bp, Homo sapiens
catgggaggtgaggattccaaaa

SEQ ID NO: 5021213 - DNA, 21 bp, Homo sapiens
catgtcctttgcgcctgtgac

SEQ ID NO: 5021214 - DNA, 19 bp, Homo sapiens
catgtggaggggcagcctg

SEQ ID NO: 5021215 - DNA, 18 bp, Homo sapiens
catgtggccatggcctct

SEQ ID NO: 5021216 - DNA, 22 bp, Homo sapiens
catgtggtggcacaggccccct

SEQ ID NO: 5021217 - DNA, 20 bp, Homo sapiens
catgtgtgcgtgtctccatg

SEQ ID NO: 5021218 - DNA, 18 bp, Homo sapiens
catgtgttggcagcctct

SEQ ID NO: 5021219 - DNA, 15 bp, Homo sapiens
catgtttatctgctt

SEQ ID NO: 5021220 - DNA, 23 bp, Homo sapiens
catgtttggtgtttgtctgtgtt

SEQ ID NO: 5021221 - DNA, 22 bp, Homo sapiens
cattaaacgatttttaaaatgt

SEQ ID NO: 5021222 - DNA, 14 bp, Homo sapiens
cattaaagaagacc

SEQ ID NO: 5021223 - DNA, 15 bp, Homo sapiens
cattaccatgtaatg

SEQ ID NO: 5021224 - DNA, 16 bp, Homo sapiens
cattatttatgtattg

SEQ ID NO: 5021225 - DNA, 20 bp, Homo sapiens
cattatttttgttagcaaag

SEQ ID NO: 5021226 - DNA, 14 bp, Homo sapiens
cattcccagcccag

SEQ ID NO: 5021227 - DNA, 22 bp, Homo sapiens
cattctacacagagcaggactg

SEQ ID NO: 5021228 - DNA, 15 bp, Homo sapiens
cattctccttgttgt

SEQ ID NO: 5021229 - DNA, 15 bp, Homo sapiens
cattgattcagcctg

SEQ ID NO: 5021230 - DNA, 17 bp, Homo sapiens
cattgctggtagagacc

SEQ ID NO: 5021231 - DNA, 20 bp, Homo sapiens
cattgctggtagagaccccc

SEQ ID NO: 5021232 - DNA, 14 bp, Homo sapiens
cattggttcttgta

SEQ ID NO: 5021233 - DNA, 18 bp, Homo sapiens
cattgtagcgtctttctt

SEQ ID NO: 5021234 - DNA, 19 bp, Homo sapiens
cattgtagcgtctttcttt

SEQ ID NO: 5021235 - DNA, 18 bp, Homo sapiens
cattgtagtgctttgaga

SEQ ID NO: 5021236 - DNA, 20 bp, Homo sapiens
cattgtagtgctttgagaga

SEQ ID NO: 5021237 - DNA, 16 bp, Homo sapiens
catttaaatgtgtaca

SEQ ID NO: 5021238 - DNA, 19 bp, Homo sapiens
catttaacccccctgtaca

SEQ ID NO: 5021239 - DNA, 15 bp, Homo sapiens
catttacaaactgaa

SEQ ID NO: 5021240 - DNA, 16 bp, Homo sapiens
catttacaaactgaag

SEQ ID NO: 5021241 - DNA, 17 bp, Homo sapiens
catttcaattcctggcc

SEQ ID NO: 5021242 - DNA, 19 bp, Homo sapiens
catttcaattcctggccct

SEQ ID NO: 5021243 - DNA, 15 bp, Homo sapiens
catttcaccatggcc

SEQ ID NO: 5021244 - DNA, 16 bp, Homo sapiens
catttcatacaacaga

SEQ ID NO: 5021245 - DNA, 13 bp, Homo sapiens
catttccaacagc

SEQ ID NO: 5021246 - DNA, 21 bp, Homo sapiens
catttggtctcaggcagcacc

SEQ ID NO: 5021247 - DNA, 14 bp, Homo sapiens
catttgttcattaa

SEQ ID NO: 5021248 - DNA, 20 bp, Homo sapiens
catttgtttatgtaatttca

SEQ ID NO: 5021249 - DNA, 11 bp, Homo sapiens
cattttataaa

SEQ ID NO: 5021250 - DNA, 21 bp, Homo sapiens
cattttgaaagtctgtccttg

SEQ ID NO: 5021251 - DNA, 13 bp, Homo sapiens
ccaaaacatttct

SEQ ID NO: 5021252 - DNA, 18 bp, Homo sapiens
ccaaaacatttctggaca

SEQ ID NO: 5021253 - DNA, 16 bp, Homo sapiens
ccaaagagcctttcca

SEQ ID NO: 5021254 - DNA, 12 bp, Homo sapiens
ccaaaggctggt

SEQ ID NO: 5021255 - DNA, 21 bp, Homo sapiens
ccaaaggctggtggcaagtgc

SEQ ID NO: 5021256 - DNA, 14 bp, Homo sapiens
ccaaataaagtctc

SEQ ID NO: 5021257 - DNA, 22 bp, Homo sapiens
ccaaatctcaatgaagccagct

SEQ ID NO: 5021258 - DNA, 13 bp, Homo sapiens
ccaaatgcagctt

SEQ ID NO: 5021259 - DNA, 15 bp, Homo sapiens
ccaaatgcagcttta

SEQ ID NO: 5021260 - DNA, 13 bp, Homo sapiens
ccaaattaaaaaa

SEQ ID NO: 5021261 - DNA, 12 bp, Homo sapiens
ccaacaaaccat

SEQ ID NO: 5021262 - DNA, 16 bp, Homo sapiens
ccaagactcctcaggc

SEQ ID NO: 5021263 - DNA, 17 bp, Homo sapiens
ccaagactcctcaggca

SEQ ID NO: 5021264 - DNA, 17 bp, Homo sapiens
ccaagatcacagtggcc

SEQ ID NO: 5021265 - DNA, 17 bp, Homo sapiens
ccaagcagtgcctgcct

SEQ ID NO: 5021266 - DNA, 18 bp, Homo sapiens
ccaagcagtgcctgccta

SEQ ID NO: 5021267 - DNA, 20 bp, Homo sapiens
ccaagcagtgcctgcctatg

SEQ ID NO: 5021268 - DNA, 22 bp, Homo sapiens
ccaagcctacttttgccattga

SEQ ID NO: 5021269 - DNA, 14 bp, Homo sapiens
ccaagcctgctggc

SEQ ID NO: 5021270 - DNA, 15 bp, Homo sapiens
ccaagcctgctggct

SEQ ID NO: 5021271 - DNA, 23 bp, Homo sapiens
ccaattcctcatttgttcattaa

SEQ ID NO: 5021272 - DNA, 18 bp, Homo sapiens
ccacaattaaaccgcatg

SEQ ID NO: 5021273 - DNA, 19 bp, Homo sapiens
ccacaccctgtactgttct

SEQ ID NO: 5021274 - DNA, 23 bp, Homo sapiens
ccacaccctgtactgttctgtgt

SEQ ID NO: 5021275 - DNA, 17 bp, Homo sapiens
ccacactccagctggga

SEQ ID NO: 5021276 - DNA, 16 bp, Homo sapiens
ccacattaaagaagac

SEQ ID NO: 5021277 - DNA, 15 bp, Homo sapiens
ccacccaagcctgct

SEQ ID NO: 5021278 - DNA, 16 bp, Homo sapiens
ccacccatgcagctgc

SEQ ID NO: 5021279 - DNA, 16 bp, Homo sapiens
ccaccccgctgatgga

SEQ ID NO: 5021280 - DNA, 15 bp, Homo sapiens
ccacccgccgcctcc

SEQ ID NO: 5021281 - DNA, 21 bp, Homo sapiens
ccacccgccgcctcccacggc

SEQ ID NO: 5021282 - DNA, 20 bp, Homo sapiens
ccacccgtggggtgctgccc

SEQ ID NO: 5021283 - DNA, 13 bp, Homo sapiens
ccaccctgccaag

SEQ ID NO: 5021284 - DNA, 16 bp, Homo sapiens
ccacctgttttctgaa

SEQ ID NO: 5021285 - DNA, 12 bp, Homo sapiens
ccaccttctggg

SEQ ID NO: 5021286 - DNA, 23 bp, Homo sapiens
ccacctttcagataactgttatt

SEQ ID NO: 5021287 - DNA, 18 bp, Homo sapiens
ccacgcgggggccttgag

SEQ ID NO: 5021288 - DNA, 22 bp, Homo sapiens
ccacggagcagttcagagtgga

SEQ ID NO: 5021289 - DNA, 23 bp, Homo sapiens
ccactaatcaggaggccaggcca

SEQ ID NO: 5021290 - DNA, 14 bp, Homo sapiens
ccactctgcctgcc

SEQ ID NO: 5021291 - DNA, 15 bp, Homo sapiens
ccactctgcctgcct

SEQ ID NO: 5021292 - DNA, 13 bp, Homo sapiens
ccactctgtaatt

SEQ ID NO: 5021293 - DNA, 14 bp, Homo sapiens
ccactctgtaattg

SEQ ID NO: 5021294 - DNA, 19 bp, Homo sapiens
ccactctgtaattgcaaaa

SEQ ID NO: 5021295 - DNA, 11 bp, Homo sapiens
ccactgccatg

SEQ ID NO: 5021296 - DNA, 15 bp, Homo sapiens
ccactgggtgagaga

SEQ ID NO: 5021297 - DNA, 21 bp, Homo sapiens
ccacttgtccgctgggtggta

SEQ ID NO: 5021298 - DNA, 18 bp, Homo sapiens
ccagaaacacccctctgt

SEQ ID NO: 5021299 - DNA, 19 bp, Homo sapiens
ccagaaacacccctctgtc

SEQ ID NO: 5021300 - DNA, 20 bp, Homo sapiens
ccagaaacacccctctgtct

SEQ ID NO: 5021301 - DNA, 20 bp, Homo sapiens
ccagaacacggctcacgctt

SEQ ID NO: 5021302 - DNA, 16 bp, Homo sapiens
ccagactacttgggag

SEQ ID NO: 5021303 - DNA, 16 bp, Homo sapiens
ccagatggactccagc

SEQ ID NO: 5021304 - DNA, 13 bp, Homo sapiens
ccagattctgatg

SEQ ID NO: 5021305 - DNA, 20 bp, Homo sapiens
ccagcaagcggggatgtccc

SEQ ID NO: 5021306 - DNA, 15 bp, Homo sapiens
ccagcagaagacaaa

SEQ ID NO: 5021307 - DNA, 21 bp, Homo sapiens
ccagccagatggactccagcc

SEQ ID NO: 5021308 - DNA, 17 bp, Homo sapiens
ccagcccgaacaccatt

SEQ ID NO: 5021309 - DNA, 17 bp, Homo sapiens
ccagccctggctgaagg

SEQ ID NO: 5021310 - DNA, 19 bp, Homo sapiens
ccagcctgcctggcaggct

SEQ ID NO: 5021311 - DNA, 20 bp, Homo sapiens
ccagcctgcctggcaggctg

SEQ ID NO: 5021312 - DNA, 20 bp, Homo sapiens
ccagcctgggaaagcccctg

SEQ ID NO: 5021313 - DNA, 21 bp, Homo sapiens
ccagcggccccccgcacagcc

SEQ ID NO: 5021314 - DNA, 17 bp, Homo sapiens
ccagctcaatggactgg

SEQ ID NO: 5021315 - DNA, 13 bp, Homo sapiens
ccagctcacagtg

SEQ ID NO: 5021316 - DNA, 13 bp, Homo sapiens
ccagctcagcact

SEQ ID NO: 5021317 - DNA, 21 bp, Homo sapiens
ccagctcccgctgtggccgca

SEQ ID NO: 5021318 - DNA, 12 bp, Homo sapiens
ccagctctctga

SEQ ID NO: 5021319 - DNA, 19 bp, Homo sapiens
ccagctgggctctgcaatt

SEQ ID NO: 5021320 - DNA, 21 bp, Homo sapiens
ccaggatgataagttcctttc

SEQ ID NO: 5021321 - DNA, 22 bp, Homo sapiens
ccaggatgtacaaggacagccc

SEQ ID NO: 5021322 - DNA, 15 bp, Homo sapiens
ccaggcattggctca

SEQ ID NO: 5021323 - DNA, 18 bp, Homo sapiens
ccaggcattggctcagcc

SEQ ID NO: 5021324 - DNA, 14 bp, Homo sapiens
ccaggccctgccag

SEQ ID NO: 5021325 - DNA, 17 bp, Homo sapiens
ccaggccctgtggcagg

SEQ ID NO: 5021326 - DNA, 21 bp, Homo sapiens
ccaggcctgtccaccctgcca

SEQ ID NO: 5021327 - DNA, 22 bp, Homo sapiens
ccagggaccactgggtgagaga

SEQ ID NO: 5021328 - DNA, 14 bp, Homo sapiens
ccaggggcgaggcc

SEQ ID NO: 5021329 - DNA, 14 bp, Homo sapiens
ccagtattttaaaa

SEQ ID NO: 5021330 - DNA, 16 bp, Homo sapiens
ccagtcaaatctgggc

SEQ ID NO: 5021331 - DNA, 17 bp, Homo sapiens
ccagtcaaatctgggct

SEQ ID NO: 5021332 - DNA, 15 bp, Homo sapiens
ccagtcatctgtaag

SEQ ID NO: 5021333 - DNA, 22 bp, Homo sapiens
ccagtccccgaggagctgggcc

SEQ ID NO: 5021334 - DNA, 19 bp, Homo sapiens
ccagtgcatatgcaatgta

SEQ ID NO: 5021335 - DNA, 13 bp, Homo sapiens
ccagtgccactgc

SEQ ID NO: 5021336 - DNA, 17 bp, Homo sapiens
ccagtgccactgccccc

SEQ ID NO: 5021337 - DNA, 18 bp, Homo sapiens
ccagtgccactgcccccc

SEQ ID NO: 5021338 - DNA, 16 bp, Homo sapiens
ccagtggaggtttgtc

SEQ ID NO: 5021339 - DNA, 20 bp, Homo sapiens
ccagtggcgttgttgcatgt

SEQ ID NO: 5021340 - DNA, 18 bp, Homo sapiens
ccagttcattgcactttg

SEQ ID NO: 5021341 - DNA, 14 bp, Homo sapiens
ccagtttgcatttg

SEQ ID NO: 5021342 - DNA, 15 bp, Homo sapiens
ccagtttgcatttgg

SEQ ID NO: 5021343 - DNA, 12 bp, Homo sapiens
ccataggtcacc

SEQ ID NO: 5021344 - DNA, 12 bp, Homo sapiens
ccatattaaatt

SEQ ID NO: 5021345 - DNA, 22 bp, Homo sapiens
ccatattaaattttttgttgac

SEQ ID NO: 5021346 - DNA, 23 bp, Homo sapiens
ccatattaaattttttgttgaca

SEQ ID NO: 5021347 - DNA, 15 bp, Homo sapiens
ccatccattctggaa

SEQ ID NO: 5021348 - DNA, 13 bp, Homo sapiens
ccatcctggctgc

SEQ ID NO: 5021349 - DNA, 13 bp, Homo sapiens
ccatctgctcctg

SEQ ID NO: 5021350 - DNA, 14 bp, Homo sapiens
ccatctgctcctgg

SEQ ID NO: 5021351 - DNA, 21 bp, Homo sapiens
ccatgcaccctcatacacaga

SEQ ID NO: 5021352 - DNA, 13 bp, Homo sapiens
ccatgcaggaggt

SEQ ID NO: 5021353 - DNA, 14 bp, Homo sapiens
ccatgcaggaggtg

SEQ ID NO: 5021354 - DNA, 23 bp, Homo sapiens
ccatgtaatggcagttatatttt

SEQ ID NO: 5021355 - DNA, 14 bp, Homo sapiens
ccatgtctcgactc

SEQ ID NO: 5021356 - DNA, 15 bp, Homo sapiens
ccatgtctcgactca

SEQ ID NO: 5021357 - DNA, 17 bp, Homo sapiens
ccatgtggtggcacagg

SEQ ID NO: 5021358 - DNA, 10 bp, Homo sapiens
ccattaaacg

SEQ ID NO: 5021359 - DNA, 14 bp, Homo sapiens
ccattctacacaga

SEQ ID NO: 5021360 - DNA, 17 bp, Homo sapiens
ccattctattttagaat

SEQ ID NO: 5021361 - DNA, 19 bp, Homo sapiens
ccattgtagcgtctttctt

SEQ ID NO: 5021362 - DNA, 17 bp, Homo sapiens
ccattgttgtcaaggaa

SEQ ID NO: 5021363 - DNA, 22 bp, Homo sapiens
ccatttgcatttgtttatgtaa

SEQ ID NO: 5021364 - DNA, 23 bp, Homo sapiens
ccattttcttattgcgctgctac

SEQ ID NO: 5021365 - DNA, 17 bp, Homo sapiens
cccaacaaaccatccag

SEQ ID NO: 5021366 - DNA, 16 bp, Homo sapiens
cccaaccagggccccg

SEQ ID NO: 5021367 - DNA, 19 bp, Homo sapiens
cccacagcgctggccggga

SEQ ID NO: 5021368 - DNA, 20 bp, Homo sapiens
cccacaggaagcctgcagtc

SEQ ID NO: 5021369 - DNA, 22 bp, Homo sapiens
cccacaggaagcctgcagtcct

SEQ ID NO: 5021370 - DNA, 14 bp, Homo sapiens
cccacagtgccacc

SEQ ID NO: 5021371 - DNA, 22 bp, Homo sapiens
cccacatgtggccatggcctct

SEQ ID NO: 5021372 - DNA, 13 bp, Homo sapiens
cccacccccagct

SEQ ID NO: 5021373 - DNA, 17 bp, Homo sapiens
cccacccccgccatgca

SEQ ID NO: 5021374 - DNA, 13 bp, Homo sapiens
cccacccgccgcc

SEQ ID NO: 5021375 - DNA, 19 bp, Homo sapiens
cccacggcacctcggggac

SEQ ID NO: 5021376 - DNA, 23 bp, Homo sapiens
cccacggcacctcggggacacca

SEQ ID NO: 5021377 - DNA, 17 bp, Homo sapiens
cccactctgcctgcctg

SEQ ID NO: 5021378 - DNA, 16 bp, Homo sapiens
cccagaccggcttctc

SEQ ID NO: 5021379 - DNA, 15 bp, Homo sapiens
cccagacgatgtctt

SEQ ID NO: 5021380 - DNA, 16 bp, Homo sapiens
cccagaggctgggtga

SEQ ID NO: 5021381 - DNA, 12 bp, Homo sapiens
cccagaggtgga

SEQ ID NO: 5021382 - DNA, 14 bp, Homo sapiens
cccagcagctgcca

SEQ ID NO: 5021383 - DNA, 22 bp, Homo sapiens
cccagccccgccccgttgtgag

SEQ ID NO: 5021384 - DNA, 19 bp, Homo sapiens
cccagcggccccccgcaca

SEQ ID NO: 5021385 - DNA, 11 bp, Homo sapiens
cccagctcaat

SEQ ID NO: 5021386 - DNA, 12 bp, Homo sapiens
cccagctcagca

SEQ ID NO: 5021387 - DNA, 13 bp, Homo sapiens
cccagctctctga

SEQ ID NO: 5021388 - DNA, 13 bp, Homo sapiens
cccaggcctgtcc

SEQ ID NO: 5021389 - DNA, 14 bp, Homo sapiens
cccaggcctgtcca

SEQ ID NO: 5021390 - DNA, 15 bp, Homo sapiens
cccagtgacaacatc

SEQ ID NO: 5021391 - DNA, 17 bp, Homo sapiens
cccagtgccactgcccc

SEQ ID NO: 5021392 - DNA, 14 bp, Homo sapiens
cccatagcagcttt

SEQ ID NO: 5021393 - DNA, 15 bp, Homo sapiens
cccatgcagctgctc

SEQ ID NO: 5021394 - DNA, 16 bp, Homo sapiens
cccatgtctcgactca

SEQ ID NO: 5021395 - DNA, 17 bp, Homo sapiens
cccattttgaatcacat

SEQ ID NO: 5021396 - DNA, 18 bp, Homo sapiens
ccccaaacaccttccagc

SEQ ID NO: 5021397 - DNA, 22 bp, Homo sapiens
ccccaaacaccttccagctcct

SEQ ID NO: 5021398 - DNA, 20 bp, Homo sapiens
ccccacccccagctcaatgg

SEQ ID NO: 5021399 - DNA, 11 bp, Homo sapiens
ccccactctgc

SEQ ID NO: 5021400 - DNA, 13 bp, Homo sapiens
ccccactttgaag

SEQ ID NO: 5021401 - DNA, 13 bp, Homo sapiens
ccccagaggctgg

SEQ ID NO: 5021402 - DNA, 16 bp, Homo sapiens
ccccagcctctggcat

SEQ ID NO: 5021403 - DNA, 15 bp, Homo sapiens
ccccaggcctgtcca

SEQ ID NO: 5021404 - DNA, 16 bp, Homo sapiens
ccccaggcctgtccac

SEQ ID NO: 5021405 - DNA, 14 bp, Homo sapiens
ccccatgtgtcctg

SEQ ID NO: 5021406 - DNA, 16 bp, Homo sapiens
ccccatgtgtcctggt

SEQ ID NO: 5021407 - DNA, 14 bp, Homo sapiens
cccccacccccagc

SEQ ID NO: 5021408 - DNA, 15 bp, Homo sapiens
cccccacccccagct

SEQ ID NO: 5021409 - DNA, 22 bp, Homo sapiens
cccccaggcctgtccaccctgc

SEQ ID NO: 5021410 - DNA, 13 bp, Homo sapiens
ccccccagcctct

SEQ ID NO: 5021411 - DNA, 12 bp, Homo sapiens
cccccctctgtc

SEQ ID NO: 5021412 - DNA, 13 bp, Homo sapiens
cccccgcctgcca

SEQ ID NO: 5021413 - DNA, 16 bp, Homo sapiens
ccccctgccccccagc

SEQ ID NO: 5021414 - DNA, 17 bp, Homo sapiens
ccccgatgtcccctgcg

SEQ ID NO: 5021415 - DNA, 16 bp, Homo sapiens
ccccgcacagccaccc

SEQ ID NO: 5021416 - DNA, 22 bp, Homo sapiens
cccctcatcatagcaataacat

SEQ ID NO: 5021417 - DNA, 14 bp, Homo sapiens
cccctccccccaga

SEQ ID NO: 5021418 - DNA, 19 bp, Homo sapiens
cccctcctctagctgtggg

SEQ ID NO: 5021419 - DNA, 17 bp, Homo sapiens
cccctcggctctggagg

SEQ ID NO: 5021420 - DNA, 11 bp, Homo sapiens
cccctctcaga

SEQ ID NO: 5021421 - DNA, 18 bp, Homo sapiens
cccctctgacctgcactg

SEQ ID NO: 5021422 - DNA, 11 bp, Homo sapiens
cccctgcacag

SEQ ID NO: 5021423 - DNA, 13 bp, Homo sapiens
cccctgcccctcc

SEQ ID NO: 5021424 - DNA, 22 bp, Homo sapiens
cccctgcgggcgcgggcagcca

SEQ ID NO: 5021425 - DNA, 21 bp, Homo sapiens
cccctgctgtctctctgggct

SEQ ID NO: 5021426 - DNA, 12 bp, Homo sapiens
cccctggctctg

SEQ ID NO: 5021427 - DNA, 15 bp, Homo sapiens
ccccttgtcctttcc

SEQ ID NO: 5021428 - DNA, 22 bp, Homo sapiens
cccgaggagctgggcccctgca

SEQ ID NO: 5021429 - DNA, 15 bp, Homo sapiens
cccgaggctgctaga

SEQ ID NO: 5021430 - DNA, 15 bp, Homo sapiens
cccgatgtcccctgc

SEQ ID NO: 5021431 - DNA, 18 bp, Homo sapiens
cccgcacagccacccgtg

SEQ ID NO: 5021432 - DNA, 18 bp, Homo sapiens
cccgcaggaactgggctg

SEQ ID NO: 5021433 - DNA, 22 bp, Homo sapiens
cccgcaggaactgggctgggcc

SEQ ID NO: 5021434 - DNA, 15 bp, Homo sapiens
cccgcagggccatgc

SEQ ID NO: 5021435 - DNA, 18 bp, Homo sapiens
cccgcagggccatgcaga

SEQ ID NO: 5021436 - DNA, 14 bp, Homo sapiens
cccgcctgccaccg

SEQ ID NO: 5021437 - DNA, 13 bp, Homo sapiens
cccgcctgccctc

SEQ ID NO: 5021438 - DNA, 17 bp, Homo sapiens
cccgcctgccctcatgg

SEQ ID NO: 5021439 - DNA, 11 bp, Homo sapiens
cccgcctgcct

SEQ ID NO: 5021440 - DNA, 16 bp, Homo sapiens
cccgcctgcctgccac

SEQ ID NO: 5021441 - DNA, 21 bp, Homo sapiens
cccgctctacatcttctgcct

SEQ ID NO: 5021442 - DNA, 17 bp, Homo sapiens
cccggccacacccagcg

SEQ ID NO: 5021443 - DNA, 13 bp, Homo sapiens
cccggtgctccct

SEQ ID NO: 5021444 - DNA, 20 bp, Homo sapiens
ccctattttttttctgttat

SEQ ID NO: 5021445 - DNA, 23 bp, Homo sapiens
ccctcagcctctcccctgcctgc

SEQ ID NO: 5021446 - DNA, 16 bp, Homo sapiens
ccctccccccagactc

SEQ ID NO: 5021447 - DNA, 17 bp, Homo sapiens
ccctccccccagactct

SEQ ID NO: 5021448 - DNA, 19 bp, Homo sapiens
ccctcctggagctctgtgg

SEQ ID NO: 5021449 - DNA, 23 bp, Homo sapiens
ccctcgaggcggatctttggaca

SEQ ID NO: 5021450 - DNA, 13 bp, Homo sapiens
ccctctcagctcc

SEQ ID NO: 5021451 - DNA, 14 bp, Homo sapiens
ccctctcagctcca

SEQ ID NO: 5021452 - DNA, 15 bp, Homo sapiens
ccctctgacctgcac

SEQ ID NO: 5021453 - DNA, 14 bp, Homo sapiens
ccctctgctgctgt

SEQ ID NO: 5021454 - DNA, 22 bp, Homo sapiens
ccctctgtctaggactgcagtg

SEQ ID NO: 5021455 - DNA, 17 bp, Homo sapiens
ccctctttggctcccct

SEQ ID NO: 5021456 - DNA, 21 bp, Homo sapiens
ccctctttggctcccctgtac

SEQ ID NO: 5021457 - DNA, 20 bp, Homo sapiens
ccctgaagtgagcacagcct

SEQ ID NO: 5021458 - DNA, 17 bp, Homo sapiens
ccctgcactccctcctg

SEQ ID NO: 5021459 - DNA, 16 bp, Homo sapiens
ccctgccccccagcct

SEQ ID NO: 5021460 - DNA, 15 bp, Homo sapiens
ccctgcgcctgtgat

SEQ ID NO: 5021461 - DNA, 17 bp, Homo sapiens
ccctgctcccacagaac

SEQ ID NO: 5021462 - DNA, 14 bp, Homo sapiens
ccctgctgtctctc

SEQ ID NO: 5021463 - DNA, 18 bp, Homo sapiens
ccctgctgtctctctggg

SEQ ID NO: 5021464 - DNA, 19 bp, Homo sapiens
ccctggaggcactgaagtg

SEQ ID NO: 5021465 - DNA, 14 bp, Homo sapiens
ccctggctgaagga

SEQ ID NO: 5021466 - DNA, 23 bp, Homo sapiens
ccctgggacatcaggagactggg

SEQ ID NO: 5021467 - DNA, 19 bp, Homo sapiens
ccctgtaccttttgaggag

SEQ ID NO: 5021468 - DNA, 15 bp, Homo sapiens
ccctgtccggcccag

SEQ ID NO: 5021469 - DNA, 21 bp, Homo sapiens
cccttaccactgctctgatga

SEQ ID NO: 5021470 - DNA, 22 bp, Homo sapiens
cccttatgcccggcgccgggca

SEQ ID NO: 5021471 - DNA, 21 bp, Homo sapiens
cccttcagtaccctctcagct

SEQ ID NO: 5021472 - DNA, 11 bp, Homo sapiens
cccttccttta

SEQ ID NO: 5021473 - DNA, 21 bp, Homo sapiens
cccttgatttaaacacacaga

SEQ ID NO: 5021474 - DNA, 14 bp, Homo sapiens
cccttggacacgct

SEQ ID NO: 5021475 - DNA, 21 bp, Homo sapiens
ccctttggccccactttgaag

SEQ ID NO: 5021476 - DNA, 18 bp, Homo sapiens
ccgaggagctgggcccct

SEQ ID NO: 5021477 - DNA, 23 bp, Homo sapiens
ccgaggagctgggcccctgcaca

SEQ ID NO: 5021478 - DNA, 11 bp, Homo sapiens
ccgaggccagt

SEQ ID NO: 5021479 - DNA, 18 bp, Homo sapiens
ccgcaatgtggagcagca

SEQ ID NO: 5021480 - DNA, 21 bp, Homo sapiens
ccgcaatgtggagcagcagcc

SEQ ID NO: 5021481 - DNA, 17 bp, Homo sapiens
ccgcagggccatgcaga

SEQ ID NO: 5021482 - DNA, 15 bp, Homo sapiens
ccgccagctgccgca

SEQ ID NO: 5021483 - DNA, 12 bp, Homo sapiens
ccgccccctcct

SEQ ID NO: 5021484 - DNA, 17 bp, Homo sapiens
ccgccgcctcccacggc

SEQ ID NO: 5021485 - DNA, 12 bp, Homo sapiens
ccgcctgccacc

SEQ ID NO: 5021486 - DNA, 14 bp, Homo sapiens
ccgcctgccctcat

SEQ ID NO: 5021487 - DNA, 15 bp, Homo sapiens
ccgcctgcctgccac

SEQ ID NO: 5021488 - DNA, 22 bp, Homo sapiens
ccgcgtgcggaggggacagagc

SEQ ID NO: 5021489 - DNA, 20 bp, Homo sapiens
ccgctctacatcttctgcct

SEQ ID NO: 5021490 - DNA, 14 bp, Homo sapiens
ccgctgatggagcc

SEQ ID NO: 5021491 - DNA, 19 bp, Homo sapiens
ccgctgcttccaggctggg

SEQ ID NO: 5021492 - DNA, 21 bp, Homo sapiens
ccgctgtggccgcacgcctct

SEQ ID NO: 5021493 - DNA, 11 bp, Homo sapiens
ccggaagccaa

SEQ ID NO: 5021494 - DNA, 13 bp, Homo sapiens
ccggcccagtgcc

SEQ ID NO: 5021495 - DNA, 22 bp, Homo sapiens
ccggccccctccccccagactc

SEQ ID NO: 5021496 - DNA, 14 bp, Homo sapiens
ccgggcctggggct

SEQ ID NO: 5021497 - DNA, 17 bp, Homo sapiens
ccgggggcagggtgggg

SEQ ID NO: 5021498 - DNA, 23 bp, Homo sapiens
ccggtctatgtcgagagctggcc

SEQ ID NO: 5021499 - DNA, 16 bp, Homo sapiens
ccggtgctccctctgt

SEQ ID NO: 5021500 - DNA, 22 bp, Homo sapiens
ccgtctgtctcagagtcccagg

SEQ ID NO: 5021501 - DNA, 14 bp, Homo sapiens
ccgtgcccgcagga

SEQ ID NO: 5021502 - DNA, 16 bp, Homo sapiens
ccgtgcccgcaggaac

SEQ ID NO: 5021503 - DNA, 19 bp, Homo sapiens
ccgtgcccgcaggaactgg

SEQ ID NO: 5021504 - DNA, 14 bp, Homo sapiens
cctaactcttcttt

SEQ ID NO: 5021505 - DNA, 15 bp, Homo sapiens
cctaagtctctgtga

SEQ ID NO: 5021506 - DNA, 14 bp, Homo sapiens
cctagctgaatgtt

SEQ ID NO: 5021507 - DNA, 15 bp, Homo sapiens
cctagggtggcctga

SEQ ID NO: 5021508 - DNA, 13 bp, Homo sapiens
cctatttttgtag

SEQ ID NO: 5021509 - DNA, 15 bp, Homo sapiens
cctcaaatcgtccag

SEQ ID NO: 5021510 - DNA, 13 bp, Homo sapiens
cctcaactgaagg

SEQ ID NO: 5021511 - DNA, 17 bp, Homo sapiens
cctcacagtattgctca

SEQ ID NO: 5021512 - DNA, 14 bp, Homo sapiens
cctcacctcctcta

SEQ ID NO: 5021513 - DNA, 13 bp, Homo sapiens
cctcaggcagctc

SEQ ID NO: 5021514 - DNA, 14 bp, Homo sapiens
cctcaggcagctca

SEQ ID NO: 5021515 - DNA, 15 bp, Homo sapiens
cctcaggcagctcaa

SEQ ID NO: 5021516 - DNA, 16 bp, Homo sapiens
cctcatgcccagctct

SEQ ID NO: 5021517 - DNA, 18 bp, Homo sapiens
cctccccacagtgccacc

SEQ ID NO: 5021518 - DNA, 14 bp, Homo sapiens
cctccccccagact

SEQ ID NO: 5021519 - DNA, 20 bp, Homo sapiens
cctcctcatgtacataccct

SEQ ID NO: 5021520 - DNA, 14 bp, Homo sapiens
cctcctcctggact

SEQ ID NO: 5021521 - DNA, 13 bp, Homo sapiens
cctcctggactcc

SEQ ID NO: 5021522 - DNA, 23 bp, Homo sapiens
cctcctggagctctgtgggtctc

SEQ ID NO: 5021523 - DNA, 18 bp, Homo sapiens
cctcggggacaccagagc

SEQ ID NO: 5021524 - DNA, 12 bp, Homo sapiens
cctcgtgcgccc

SEQ ID NO: 5021525 - DNA, 19 bp, Homo sapiens
cctctcagaacatactgat

SEQ ID NO: 5021526 - DNA, 15 bp, Homo sapiens
cctctcccctcagcc

SEQ ID NO: 5021527 - DNA, 16 bp, Homo sapiens
cctctcccctcagcct

SEQ ID NO: 5021528 - DNA, 13 bp, Homo sapiens
cctctgaggctga

SEQ ID NO: 5021529 - DNA, 14 bp, Homo sapiens
cctctgctgctgtc

SEQ ID NO: 5021530 - DNA, 20 bp, Homo sapiens
cctctgctgctgtccctccc

SEQ ID NO: 5021531 - DNA, 15 bp, Homo sapiens
cctctgtctaggact

SEQ ID NO: 5021532 - DNA, 17 bp, Homo sapiens
cctcttccagtgaacat

SEQ ID NO: 5021533 - DNA, 14 bp, Homo sapiens
cctctttggctccc

SEQ ID NO: 5021534 - DNA, 15 bp, Homo sapiens
cctgaattctttttc

SEQ ID NO: 5021535 - DNA, 21 bp, Homo sapiens
cctgagatgggcttcccaagg

SEQ ID NO: 5021536 - DNA, 21 bp, Homo sapiens
cctgagatttattaaagaaaa

SEQ ID NO: 5021537 - DNA, 14 bp, Homo sapiens
cctgagtgcttgct

SEQ ID NO: 5021538 - DNA, 15 bp, Homo sapiens
cctgagtgcttgctt

SEQ ID NO: 5021539 - DNA, 17 bp, Homo sapiens
cctgagtgcttgctttt

SEQ ID NO: 5021540 - DNA, 18 bp, Homo sapiens
cctgataaagcacagctg

SEQ ID NO: 5021541 - DNA, 15 bp, Homo sapiens
cctgattgtattttt

SEQ ID NO: 5021542 - DNA, 14 bp, Homo sapiens
cctgcacacaggac

SEQ ID NO: 5021543 - DNA, 21 bp, Homo sapiens
cctgcactccctcctggagct

SEQ ID NO: 5021544 - DNA, 15 bp, Homo sapiens
cctgccaagactcct

SEQ ID NO: 5021545 - DNA, 13 bp, Homo sapiens
cctgccagcccct

SEQ ID NO: 5021546 - DNA, 15 bp, Homo sapiens
cctgccccccagcct

SEQ ID NO: 5021547 - DNA, 22 bp, Homo sapiens
cctgcccctcctctccctcatc

SEQ ID NO: 5021548 - DNA, 21 bp, Homo sapiens
cctgccctcatggcccctctg

SEQ ID NO: 5021549 - DNA, 18 bp, Homo sapiens
cctgccggtgggaccctg

SEQ ID NO: 5021550 - DNA, 12 bp, Homo sapiens
cctgcctgtgct

SEQ ID NO: 5021551 - DNA, 14 bp, Homo sapiens
cctgcgcctgtgat

SEQ ID NO: 5021552 - DNA, 21 bp, Homo sapiens
cctgcgggcgcgggcagccac

SEQ ID NO: 5021553 - DNA, 17 bp, Homo sapiens
cctgctggctgcggccc

SEQ ID NO: 5021554 - DNA, 18 bp, Homo sapiens
cctgctggctgcggcccc

SEQ ID NO: 5021555 - DNA, 18 bp, Homo sapiens
cctgctgtctctctgggc

SEQ ID NO: 5021556 - DNA, 19 bp, Homo sapiens
cctgctgtctctctgggct

SEQ ID NO: 5021557 - DNA, 20 bp, Homo sapiens
cctggaaggacatccatgtt

SEQ ID NO: 5021558 - DNA, 17 bp, Homo sapiens
cctggacactcagacct

SEQ ID NO: 5021559 - DNA, 15 bp, Homo sapiens
cctggagctctgtgg

SEQ ID NO: 5021560 - DNA, 14 bp, Homo sapiens
cctggaggcactga

SEQ ID NO: 5021561 - DNA, 22 bp, Homo sapiens
cctggaggcactgaagtgctta

SEQ ID NO: 5021562 - DNA, 14 bp, Homo sapiens
cctggatctccctg

SEQ ID NO: 5021563 - DNA, 15 bp, Homo sapiens
cctggccccgcctgc

SEQ ID NO: 5021564 - DNA, 14 bp, Homo sapiens
cctggccgccccct

SEQ ID NO: 5021565 - DNA, 15 bp, Homo sapiens
cctggcctttcatat

SEQ ID NO: 5021566 - DNA, 13 bp, Homo sapiens
cctggctctgggc

SEQ ID NO: 5021567 - DNA, 13 bp, Homo sapiens
cctggctgaagga

SEQ ID NO: 5021568 - DNA, 20 bp, Homo sapiens
cctggctgaaggactgtgac

SEQ ID NO: 5021569 - DNA, 22 bp, Homo sapiens
cctgggagggacatgcttagca

SEQ ID NO: 5021570 - DNA, 19 bp, Homo sapiens
cctgggggacccctggctc

SEQ ID NO: 5021571 - DNA, 20 bp, Homo sapiens
cctgggggacccctggctct

SEQ ID NO: 5021572 - DNA, 14 bp, Homo sapiens
cctggtaccctcct

SEQ ID NO: 5021573 - DNA, 19 bp, Homo sapiens
cctggtagtgtagctgtgt

SEQ ID NO: 5021574 - DNA, 22 bp, Homo sapiens
cctggtagtgtagctgtgtggc

SEQ ID NO: 5021575 - DNA, 16 bp, Homo sapiens
cctggtggtattttca

SEQ ID NO: 5021576 - DNA, 21 bp, Homo sapiens
cctggtggtattttcaatagc

SEQ ID NO: 5021577 - DNA, 13 bp, Homo sapiens
cctggttcccgtt

SEQ ID NO: 5021578 - DNA, 22 bp, Homo sapiens
cctggttcccgtttctccacct

SEQ ID NO: 5021579 - DNA, 19 bp, Homo sapiens
cctgtaacatactggcctg

SEQ ID NO: 5021580 - DNA, 23 bp, Homo sapiens
cctgtaacatactggcctggact

SEQ ID NO: 5021581 - DNA, 22 bp, Homo sapiens
cctgtaccttttgaggagcccc

SEQ ID NO: 5021582 - DNA, 18 bp, Homo sapiens
cctgtactgttctgtgtc

SEQ ID NO: 5021583 - DNA, 20 bp, Homo sapiens
cctgtaggcagaggctgccg

SEQ ID NO: 5021584 - DNA, 16 bp, Homo sapiens
cctgtccacacccagc

SEQ ID NO: 5021585 - DNA, 14 bp, Homo sapiens
cctgtccaccctgc

SEQ ID NO: 5021586 - DNA, 14 bp, Homo sapiens
cctgtccggcccag

SEQ ID NO: 5021587 - DNA, 19 bp, Homo sapiens
cctgtccggcccagtgcca

SEQ ID NO: 5021588 - DNA, 14 bp, Homo sapiens
cctgtctcggggct

SEQ ID NO: 5021589 - DNA, 20 bp, Homo sapiens
cctgtctcggggcttgcccc

SEQ ID NO: 5021590 - DNA, 14 bp, Homo sapiens
cctgtgtgtgtgta

SEQ ID NO: 5021591 - DNA, 15 bp, Homo sapiens
cctgttgccagcaga

SEQ ID NO: 5021592 - DNA, 12 bp, Homo sapiens
cctgttttctga

SEQ ID NO: 5021593 - DNA, 12 bp, Homo sapiens
ccttaaaggaag

SEQ ID NO: 5021594 - DNA, 23 bp, Homo sapiens
ccttcagtaccctctcagctcca

SEQ ID NO: 5021595 - DNA, 13 bp, Homo sapiens
ccttccagctcct

SEQ ID NO: 5021596 - DNA, 14 bp, Homo sapiens
ccttcccatcgctg

SEQ ID NO: 5021597 - DNA, 16 bp, Homo sapiens
ccttcctgccagcccc

SEQ ID NO: 5021598 - DNA, 17 bp, Homo sapiens
ccttctgcctttgatgt

SEQ ID NO: 5021599 - DNA, 13 bp, Homo sapiens
ccttgaaggacta

SEQ ID NO: 5021600 - DNA, 18 bp, Homo sapiens
ccttgaaggactaataga

SEQ ID NO: 5021601 - DNA, 14 bp, Homo sapiens
ccttgagtggggtt

SEQ ID NO: 5021602 - DNA, 14 bp, Homo sapiens
ccttgcacatagta

SEQ ID NO: 5021603 - DNA, 11 bp, Homo sapiens
ccttgcctggt

SEQ ID NO: 5021604 - DNA, 12 bp, Homo sapiens
ccttgcctggta

SEQ ID NO: 5021605 - DNA, 11 bp, Homo sapiens
ccttggaaggg

SEQ ID NO: 5021606 - DNA, 13 bp, Homo sapiens
ccttgtcgtggga

SEQ ID NO: 5021607 - DNA, 21 bp, Homo sapiens
ccttgtcttattcccttcctg

SEQ ID NO: 5021608 - DNA, 19 bp, Homo sapiens
cctttacgtgtttaaaaaa

SEQ ID NO: 5021609 - DNA, 12 bp, Homo sapiens
cctttccaaaga

SEQ ID NO: 5021610 - DNA, 13 bp, Homo sapiens
cctttccaaagag

SEQ ID NO: 5021611 - DNA, 13 bp, Homo sapiens
cctttgctctttc

SEQ ID NO: 5021612 - DNA, 12 bp, Homo sapiens
cctttgggtgtg

SEQ ID NO: 5021613 - DNA, 23 bp, Homo sapiens
cctttgtaaattgtcagatgctg

SEQ ID NO: 5021614 - DNA, 22 bp, Homo sapiens
ccttttataggtgagaaaaaaa

SEQ ID NO: 5021615 - DNA, 18 bp, Homo sapiens
ccttttcataggtctgaa

SEQ ID NO: 5021616 - DNA, 12 bp, Homo sapiens
ccttttccatgc

SEQ ID NO: 5021617 - DNA, 21 bp, Homo sapiens
ccttttgaggagccccagcta

SEQ ID NO: 5021618 - DNA, 14 bp, Homo sapiens
cctttttctccagc

SEQ ID NO: 5021619 - DNA, 16 bp, Homo sapiens
cctttttctccagctg

SEQ ID NO: 5021620 - DNA, 16 bp, Homo sapiens
cgaaataattgttgtt

SEQ ID NO: 5021621 - DNA, 20 bp, Homo sapiens
cgaaataattgttgttctgt

SEQ ID NO: 5021622 - DNA, 21 bp, Homo sapiens
cgaaataattgttgttctgtt

SEQ ID NO: 5021623 - DNA, 17 bp, Homo sapiens
cgaaattccaaggccca

SEQ ID NO: 5021624 - DNA, 14 bp, Homo sapiens
cgaatgtgtcttta

SEQ ID NO: 5021625 - DNA, 16 bp, Homo sapiens
cgaatgtgtctttaga

SEQ ID NO: 5021626 - DNA, 14 bp, Homo sapiens
cgagactttccatt

SEQ ID NO: 5021627 - DNA, 20 bp, Homo sapiens
cgagcaaacccagaggtgga

SEQ ID NO: 5021628 - DNA, 15 bp, Homo sapiens
cgagcccctcggctc

SEQ ID NO: 5021629 - DNA, 15 bp, Homo sapiens
cgcaatgtggagcag

SEQ ID NO: 5021630 - DNA, 20 bp, Homo sapiens
cgcaatgtggagcagcagcc

SEQ ID NO: 5021631 - DNA, 12 bp, Homo sapiens
cgcacagccacc

SEQ ID NO: 5021632 - DNA, 20 bp, Homo sapiens
cgcagttttttttttcttgt

SEQ ID NO: 5021633 - DNA, 15 bp, Homo sapiens
cgccagctgccgcac

SEQ ID NO: 5021634 - DNA, 22 bp, Homo sapiens
cgcccacaggaagcctgcagtc

SEQ ID NO: 5021635 - DNA, 19 bp, Homo sapiens
cgccccgttgtgagctgga

SEQ ID NO: 5021636 - DNA, 19 bp, Homo sapiens
cgcccctcccacagcgctg

SEQ ID NO: 5021637 - DNA, 21 bp, Homo sapiens
cgcccctcccacagcgctggc

SEQ ID NO: 5021638 - DNA, 18 bp, Homo sapiens
cgccgcctcccacggcac

SEQ ID NO: 5021639 - DNA, 12 bp, Homo sapiens
cgcctgccaccg

SEQ ID NO: 5021640 - DNA, 18 bp, Homo sapiens
cgcctgcctgccaccctg

SEQ ID NO: 5021641 - DNA, 16 bp, Homo sapiens
cgcctgtgatgctggg

SEQ ID NO: 5021642 - DNA, 14 bp, Homo sapiens
cgctcactgaactc

SEQ ID NO: 5021643 - DNA, 20 bp, Homo sapiens
cgctgatggagccccacctt

SEQ ID NO: 5021644 - DNA, 16 bp, Homo sapiens
cgctgcttccaggctg

SEQ ID NO: 5021645 - DNA, 17 bp, Homo sapiens
cgctgcttccaggctgg

SEQ ID NO: 5021646 - DNA, 18 bp, Homo sapiens
cgctggccgggaccccga

SEQ ID NO: 5021647 - DNA, 13 bp, Homo sapiens
cgctgtcacaggc

SEQ ID NO: 5021648 - DNA, 20 bp, Homo sapiens
cgcttctgtgtatctctttc

SEQ ID NO: 5021649 - DNA, 13 bp, Homo sapiens
cgcttgtgacagt

SEQ ID NO: 5021650 - DNA, 17 bp, Homo sapiens
cgcttgtgacagtgcct

SEQ ID NO: 5021651 - DNA, 22 bp, Homo sapiens
cggaggttgggtgggccggctt

SEQ ID NO: 5021652 - DNA, 11 bp, Homo sapiens
cggcaggacac

SEQ ID NO: 5021653 - DNA, 18 bp, Homo sapiens
cggccacacccagcggcc

SEQ ID NO: 5021654 - DNA, 11 bp, Homo sapiens
cggccaggcat

SEQ ID NO: 5021655 - DNA, 21 bp, Homo sapiens
cggccaggcattggctcagcc

SEQ ID NO: 5021656 - DNA, 17 bp, Homo sapiens
cggccccccgcacagcc

SEQ ID NO: 5021657 - DNA, 19 bp, Homo sapiens
cggccctgcagccagctca

SEQ ID NO: 5021658 - DNA, 16 bp, Homo sapiens
cggctggggtcccagc

SEQ ID NO: 5021659 - DNA, 19 bp, Homo sapiens
cggcttggatcctgggctg

SEQ ID NO: 5021660 - DNA, 15 bp, Homo sapiens
cgggcagccacccaa

SEQ ID NO: 5021661 - DNA, 19 bp, Homo sapiens
cgggcagccacccaagcct

SEQ ID NO: 5021662 - DNA, 16 bp, Homo sapiens
cgggcctgtccacagg

SEQ ID NO: 5021663 - DNA, 20 bp, Homo sapiens
cgggcgcgatcccacacagg

SEQ ID NO: 5021664 - DNA, 14 bp, Homo sapiens
cgggcgcgggcagc

SEQ ID NO: 5021665 - DNA, 14 bp, Homo sapiens
cggtgggtcacaca

SEQ ID NO: 5021666 - DNA, 14 bp, Homo sapiens
cggtggtgcccgtg

SEQ ID NO: 5021667 - DNA, 21 bp, Homo sapiens
cgtccaggttcaacccacagc

SEQ ID NO: 5021668 - DNA, 12 bp, Homo sapiens
cgtctgctctgg

SEQ ID NO: 5021669 - DNA, 19 bp, Homo sapiens
cgtgactggcctgctggat

SEQ ID NO: 5021670 - DNA, 14 bp, Homo sapiens
cgtgagctgagcag

SEQ ID NO: 5021671 - DNA, 22 bp, Homo sapiens
cgtgagcttaaaatacaagact

SEQ ID NO: 5021672 - DNA, 21 bp, Homo sapiens
cgtgccagtcaagaagaaaaa

SEQ ID NO: 5021673 - DNA, 15 bp, Homo sapiens
cgtgcccgcaggaac

SEQ ID NO: 5021674 - DNA, 17 bp, Homo sapiens
cgtgctctttgttttgt

SEQ ID NO: 5021675 - DNA, 22 bp, Homo sapiens
cgtgctctttgttttgtgtctc

SEQ ID NO: 5021676 - DNA, 23 bp, Homo sapiens
cgtgctctttgttttgtgtctct

SEQ ID NO: 5021677 - DNA, 13 bp, Homo sapiens
cgtgttcagcaga

SEQ ID NO: 5021678 - DNA, 15 bp, Homo sapiens
cgtgttcagcagaac

SEQ ID NO: 5021679 - DNA, 20 bp, Homo sapiens
cgttctaggtaggaagagcc

SEQ ID NO: 5021680 - DNA, 15 bp, Homo sapiens
cgttcttgtaatttt

SEQ ID NO: 5021681 - DNA, 20 bp, Homo sapiens
cgttttttttttgtttgttg

SEQ ID NO: 5021682 - DNA, 13 bp, Homo sapiens
ctaaaggagttta

SEQ ID NO: 5021683 - DNA, 17 bp, Homo sapiens
ctaaataaacatgtgcc

SEQ ID NO: 5021684 - DNA, 21 bp, Homo sapiens
ctaacctttacatgaggactc

SEQ ID NO: 5021685 - DNA, 11 bp, Homo sapiens
ctaaggatttt

SEQ ID NO: 5021686 - DNA, 15 bp, Homo sapiens
ctaagtaaatacaat

SEQ ID NO: 5021687 - DNA, 13 bp, Homo sapiens
ctaagtctctgtg

SEQ ID NO: 5021688 - DNA, 17 bp, Homo sapiens
ctaataaaaagcttttg

SEQ ID NO: 5021689 - DNA, 14 bp, Homo sapiens
ctaatttaaagaga

SEQ ID NO: 5021690 - DNA, 15 bp, Homo sapiens
ctaatttaaagagac

SEQ ID NO: 5021691 - DNA, 19 bp, Homo sapiens
ctacaaaggtttaaatgaa

SEQ ID NO: 5021692 - DNA, 23 bp, Homo sapiens
ctacagatgatagaggattttat

SEQ ID NO: 5021693 - DNA, 14 bp, Homo sapiens
ctacatcttctgcc

SEQ ID NO: 5021694 - DNA, 15 bp, Homo sapiens
ctacatcttctgcct

SEQ ID NO: 5021695 - DNA, 18 bp, Homo sapiens
ctaccctttttctccagc

SEQ ID NO: 5021696 - DNA, 17 bp, Homo sapiens
ctacctcaggcagctca

SEQ ID NO: 5021697 - DNA, 18 bp, Homo sapiens
ctacctcaggcagctcaa

SEQ ID NO: 5021698 - DNA, 13 bp, Homo sapiens
ctacttggtttgt

SEQ ID NO: 5021699 - DNA, 16 bp, Homo sapiens
ctagagaacaggtggt

SEQ ID NO: 5021700 - DNA, 16 bp, Homo sapiens
ctagcaaaactcacag

SEQ ID NO: 5021701 - DNA, 21 bp, Homo sapiens
ctagcaagctgccgaaccaaa

SEQ ID NO: 5021702 - DNA, 22 bp, Homo sapiens
ctagcgcagttttttttttctt

SEQ ID NO: 5021703 - DNA, 13 bp, Homo sapiens
ctaggagggagac

SEQ ID NO: 5021704 - DNA, 15 bp, Homo sapiens
ctagtcttttgcttt

SEQ ID NO: 5021705 - DNA, 18 bp, Homo sapiens
ctagtggccgaaccagaa

SEQ ID NO: 5021706 - DNA, 13 bp, Homo sapiens
ctataaagagaag

SEQ ID NO: 5021707 - DNA, 19 bp, Homo sapiens
ctataaagagaagacgaaa

SEQ ID NO: 5021708 - DNA, 11 bp, Homo sapiens
ctataaagcat

SEQ ID NO: 5021709 - DNA, 18 bp, Homo sapiens
ctatatatgtgatgatct

SEQ ID NO: 5021710 - DNA, 23 bp, Homo sapiens
ctatattggtttatgtagtcagt

SEQ ID NO: 5021711 - DNA, 21 bp, Homo sapiens
ctatgacctcgccctccacaa

SEQ ID NO: 5021712 - DNA, 17 bp, Homo sapiens
ctatgcagaggcctggg

SEQ ID NO: 5021713 - DNA, 16 bp, Homo sapiens
ctatgtcgagagctgg

SEQ ID NO: 5021714 - DNA, 18 bp, Homo sapiens
ctatttgcttatttaata

SEQ ID NO: 5021715 - DNA, 12 bp, Homo sapiens
ctatttttctaa

SEQ ID NO: 5021716 - DNA, 15 bp, Homo sapiens
ctatttttctaacta

SEQ ID NO: 5021717 - DNA, 20 bp, Homo sapiens
ctatttttctaactacaaag

SEQ ID NO: 5021718 - DNA, 21 bp, Homo sapiens
ctattttttttctgttatata

SEQ ID NO: 5021719 - DNA, 14 bp, Homo sapiens
ctcaaatccctctc

SEQ ID NO: 5021720 - DNA, 18 bp, Homo sapiens
ctcaaccacctttcagat

SEQ ID NO: 5021721 - DNA, 23 bp, Homo sapiens
ctcaagcagcgaccgccccctcc

SEQ ID NO: 5021722 - DNA, 12 bp, Homo sapiens
ctcaatgagcat

SEQ ID NO: 5021723 - DNA, 19 bp, Homo sapiens
ctcaatgagcatgtttaga

SEQ ID NO: 5021724 - DNA, 13 bp, Homo sapiens
ctcacccagtgcc

SEQ ID NO: 5021725 - DNA, 23 bp, Homo sapiens
ctcacgcttacctcaaccatcct

SEQ ID NO: 5021726 - DNA, 13 bp, Homo sapiens
ctcactcctttta

SEQ ID NO: 5021727 - DNA, 14 bp, Homo sapiens
ctcactccttttaa

SEQ ID NO: 5021728 - DNA, 19 bp, Homo sapiens
ctcactccttttaaagaaa

SEQ ID NO: 5021729 - DNA, 23 bp, Homo sapiens
ctcactgtgggaaggccagctgc

SEQ ID NO: 5021730 - DNA, 10 bp, Homo sapiens
ctcagaacat

SEQ ID NO: 5021731 - DNA, 16 bp, Homo sapiens
ctcagagtcccaggac

SEQ ID NO: 5021732 - DNA, 18 bp, Homo sapiens
ctcagatgcagtttggag

SEQ ID NO: 5021733 - DNA, 18 bp, Homo sapiens
ctcagcactgcctgctcc

SEQ ID NO: 5021734 - DNA, 21 bp, Homo sapiens
ctcagcactgcctgctcccat

SEQ ID NO: 5021735 - DNA, 22 bp, Homo sapiens
ctcagcctactccgctcactga

SEQ ID NO: 5021736 - DNA, 23 bp, Homo sapiens
ctcaggaaacgagactttccatt

SEQ ID NO: 5021737 - DNA, 14 bp, Homo sapiens
ctcaggcagcacca

SEQ ID NO: 5021738 - DNA, 16 bp, Homo sapiens
ctcaggcagcaccaca

SEQ ID NO: 5021739 - DNA, 22 bp, Homo sapiens
ctcaggcagcgtgtgggtcccg

SEQ ID NO: 5021740 - DNA, 16 bp, Homo sapiens
ctcatccaccccatcc

SEQ ID NO: 5021741 - DNA, 16 bp, Homo sapiens
ctcatcccgtgttctc

SEQ ID NO: 5021742 - DNA, 14 bp, Homo sapiens
ctcatgaagcagga

SEQ ID NO: 5021743 - DNA, 17 bp, Homo sapiens
ctcatgaagcaggaggc

SEQ ID NO: 5021744 - DNA, 15 bp, Homo sapiens
ctcatgcccagctct

SEQ ID NO: 5021745 - DNA, 19 bp, Homo sapiens
ctcattggaaatttagcat

SEQ ID NO: 5021746 - DNA, 17 bp, Homo sapiens
ctccaaaccctcgaggc

SEQ ID NO: 5021747 - DNA, 13 bp, Homo sapiens
ctccagattctga

SEQ ID NO: 5021748 - DNA, 17 bp, Homo sapiens
ctccagattctgatgca

SEQ ID NO: 5021749 - DNA, 19 bp, Homo sapiens
ctccagcctgcctggcagg

SEQ ID NO: 5021750 - DNA, 19 bp, Homo sapiens
ctccagctgggctctgcaa

SEQ ID NO: 5021751 - DNA, 20 bp, Homo sapiens
ctccagctgggctctgcaat

SEQ ID NO: 5021752 - DNA, 15 bp, Homo sapiens
ctcccatcctgtgtg

SEQ ID NO: 5021753 - DNA, 18 bp, Homo sapiens
ctccccacagtgccaccc

SEQ ID NO: 5021754 - DNA, 19 bp, Homo sapiens
ctccccaggcatttgccaa

SEQ ID NO: 5021755 - DNA, 11 bp, Homo sapiens
ctccccagttc

SEQ ID NO: 5021756 - DNA, 18 bp, Homo sapiens
ctccccatgtgtcctggt

SEQ ID NO: 5021757 - DNA, 21 bp, Homo sapiens
ctccccatgtgtcctggttcc

SEQ ID NO: 5021758 - DNA, 14 bp, Homo sapiens
ctccccgcttctgc

SEQ ID NO: 5021759 - DNA, 12 bp, Homo sapiens
ctcccctcagcc

SEQ ID NO: 5021760 - DNA, 15 bp, Homo sapiens
ctcccctcagcctct

SEQ ID NO: 5021761 - DNA, 21 bp, Homo sapiens
ctcccctcagcctctcccctg

SEQ ID NO: 5021762 - DNA, 14 bp, Homo sapiens
ctcccctctcagaa

SEQ ID NO: 5021763 - DNA, 22 bp, Homo sapiens
ctccccttgatttaaacacaca

SEQ ID NO: 5021764 - DNA, 19 bp, Homo sapiens
ctcccggaggttgggtggg

SEQ ID NO: 5021765 - DNA, 20 bp, Homo sapiens
ctcccgggggcagggtgggg

SEQ ID NO: 5021766 - DNA, 19 bp, Homo sapiens
ctccctattttttttctgt

SEQ ID NO: 5021767 - DNA, 22 bp, Homo sapiens
ctccctattttttttctgttat

SEQ ID NO: 5021768 - DNA, 15 bp, Homo sapiens
ctccctcaactgaag

SEQ ID NO: 5021769 - DNA, 22 bp, Homo sapiens
ctccctcatcaaggacacgggc

SEQ ID NO: 5021770 - DNA, 17 bp, Homo sapiens
ctccctcccctctcaga

SEQ ID NO: 5021771 - DNA, 18 bp, Homo sapiens
ctccctcccctctcagaa

SEQ ID NO: 5021772 - DNA, 20 bp, Homo sapiens
ctccctgcactccctcctgg

SEQ ID NO: 5021773 - DNA, 17 bp, Homo sapiens
ctccgtcccccaaacat

SEQ ID NO: 5021774 - DNA, 23 bp, Homo sapiens
ctcctcagggttgaggtccagcc

SEQ ID NO: 5021775 - DNA, 21 bp, Homo sapiens
ctcctgaaaaaaaacctgaga

SEQ ID NO: 5021776 - DNA, 23 bp, Homo sapiens
ctcctgatccgtccgaggctgct

SEQ ID NO: 5021777 - DNA, 14 bp, Homo sapiens
ctcctgcctgtgct

SEQ ID NO: 5021778 - DNA, 12 bp, Homo sapiens
ctcctggactcc

SEQ ID NO: 5021779 - DNA, 15 bp, Homo sapiens
ctcctggactcctgc

SEQ ID NO: 5021780 - DNA, 19 bp, Homo sapiens
ctcctggagctctgtgggt

SEQ ID NO: 5021781 - DNA, 15 bp, Homo sapiens
ctcctggatctccct

SEQ ID NO: 5021782 - DNA, 16 bp, Homo sapiens
ctcctggatctccctg

SEQ ID NO: 5021783 - DNA, 16 bp, Homo sapiens
ctccttcccatcgctg

SEQ ID NO: 5021784 - DNA, 15 bp, Homo sapiens
ctccttccccacttc

SEQ ID NO: 5021785 - DNA, 20 bp, Homo sapiens
ctccttgaatatctttcgat

SEQ ID NO: 5021786 - DNA, 13 bp, Homo sapiens
ctcggctctggag

SEQ ID NO: 5021787 - DNA, 21 bp, Homo sapiens
ctcggcttggatcctgggctg

SEQ ID NO: 5021788 - DNA, 14 bp, Homo sapiens
ctcgtcctcgtttg

SEQ ID NO: 5021789 - DNA, 20 bp, Homo sapiens
ctcgtgagtcatttaaatgt

SEQ ID NO: 5021790 - DNA, 15 bp, Homo sapiens
ctctacatcttctgc

SEQ ID NO: 5021791 - DNA, 14 bp, Homo sapiens
ctctcagcctccca

SEQ ID NO: 5021792 - DNA, 12 bp, Homo sapiens
ctctcagctcca

SEQ ID NO: 5021793 - DNA, 21 bp, Homo sapiens
ctctccaactgcctaaggccc

SEQ ID NO: 5021794 - DNA, 22 bp, Homo sapiens
ctctccctgcactccctcctgg

SEQ ID NO: 5021795 - DNA, 17 bp, Homo sapiens
ctctcggctccccatgt

SEQ ID NO: 5021796 - DNA, 16 bp, Homo sapiens
ctctctgacctttcat

SEQ ID NO: 5021797 - DNA, 23 bp, Homo sapiens
ctctctgacgcttgtgacagtgc

SEQ ID NO: 5021798 - DNA, 23 bp, Homo sapiens
ctctctgtggggctgaattgcca

SEQ ID NO: 5021799 - DNA, 16 bp, Homo sapiens
ctctgacaacagactt

SEQ ID NO: 5021800 - DNA, 14 bp, Homo sapiens
ctctgacctgcact

SEQ ID NO: 5021801 - DNA, 14 bp, Homo sapiens
ctctgacctttcat

SEQ ID NO: 5021802 - DNA, 20 bp, Homo sapiens
ctctgacgcttgtgacagtg

SEQ ID NO: 5021803 - DNA, 23 bp, Homo sapiens
ctctgacgcttgtgacagtgcct

SEQ ID NO: 5021804 - DNA, 19 bp, Homo sapiens
ctctgacttaagcaaaaga

SEQ ID NO: 5021805 - DNA, 22 bp, Homo sapiens
ctctgacttaagcaaaagaaaa

SEQ ID NO: 5021806 - DNA, 15 bp, Homo sapiens
ctctgaggtgcctgt

SEQ ID NO: 5021807 - DNA, 14 bp, Homo sapiens
ctctgcaacacttt

SEQ ID NO: 5021808 - DNA, 19 bp, Homo sapiens
ctctgcaattcccctctgc

SEQ ID NO: 5021809 - DNA, 21 bp, Homo sapiens
ctctgcaattcccctctgctg

SEQ ID NO: 5021810 - DNA, 23 bp, Homo sapiens
ctctgcaattcccctctgctgct

SEQ ID NO: 5021811 - DNA, 18 bp, Homo sapiens
ctctgctattaggccagc

SEQ ID NO: 5021812 - DNA, 21 bp, Homo sapiens
ctctgctgctgtccctccccc

SEQ ID NO: 5021813 - DNA, 11 bp, Homo sapiens
ctctggctctg

SEQ ID NO: 5021814 - DNA, 21 bp, Homo sapiens
ctctgggccgggcctggggct

SEQ ID NO: 5021815 - DNA, 14 bp, Homo sapiens
ctctgtaattgcaa

SEQ ID NO: 5021816 - DNA, 23 bp, Homo sapiens
ctctgtctaggactgcagtgtgg

SEQ ID NO: 5021817 - DNA, 22 bp, Homo sapiens
ctctgtgagcatcacagttttg

SEQ ID NO: 5021818 - DNA, 16 bp, Homo sapiens
ctctgtgggtctctgg

SEQ ID NO: 5021819 - DNA, 22 bp, Homo sapiens
ctctgttgccaaggctggagtg

SEQ ID NO: 5021820 - DNA, 20 bp, Homo sapiens
ctcttcagttaagcctttgg

SEQ ID NO: 5021821 - DNA, 22 bp, Homo sapiens
ctcttccagtgaacattcccag

SEQ ID NO: 5021822 - DNA, 19 bp, Homo sapiens
ctcttctttcatttcttct

SEQ ID NO: 5021823 - DNA, 18 bp, Homo sapiens
ctcttgatacccccctct

SEQ ID NO: 5021824 - DNA, 21 bp, Homo sapiens
ctcttgatacccccctctgtc

SEQ ID NO: 5021825 - DNA, 15 bp, Homo sapiens
ctctttcacattgtt

SEQ ID NO: 5021826 - DNA, 12 bp, Homo sapiens
ctctttgagaaa

SEQ ID NO: 5021827 - DNA, 18 bp, Homo sapiens
ctctttggctcccctgta

SEQ ID NO: 5021828 - DNA, 21 bp, Homo sapiens
ctctttggtggcatggaaggg

SEQ ID NO: 5021829 - DNA, 13 bp, Homo sapiens
ctctttttttgag

SEQ ID NO: 5021830 - DNA, 16 bp, Homo sapiens
ctctttttttgagtga

SEQ ID NO: 5021831 - DNA, 14 bp, Homo sapiens
ctgaaacacacgag

SEQ ID NO: 5021832 - DNA, 12 bp, Homo sapiens
ctgaaattcaga

SEQ ID NO: 5021833 - DNA, 16 bp, Homo sapiens
ctgaaatttttcttct

SEQ ID NO: 5021834 - DNA, 15 bp, Homo sapiens
ctgaacatctgagtc

SEQ ID NO: 5021835 - DNA, 17 bp, Homo sapiens
ctgaactccttccccac

SEQ ID NO: 5021836 - DNA, 18 bp, Homo sapiens
ctgaactccttccccact

SEQ ID NO: 5021837 - DNA, 16 bp, Homo sapiens
ctgaactctgacaaca

SEQ ID NO: 5021838 - DNA, 17 bp, Homo sapiens
ctgaactctgacaacag

SEQ ID NO: 5021839 - DNA, 13 bp, Homo sapiens
ctgaaggactgtg

SEQ ID NO: 5021840 - DNA, 22 bp, Homo sapiens
ctgaaggactgtgacaggcagc

SEQ ID NO: 5021841 - DNA, 18 bp, Homo sapiens
ctgaaggggtgcacccac

SEQ ID NO: 5021842 - DNA, 17 bp, Homo sapiens
ctgaagtgaaactgctt

SEQ ID NO: 5021843 - DNA, 15 bp, Homo sapiens
ctgaataccactctg

SEQ ID NO: 5021844 - DNA, 18 bp, Homo sapiens
ctgaataccactctgtaa

SEQ ID NO: 5021845 - DNA, 20 bp, Homo sapiens
ctgaataccactctgtaatt

SEQ ID NO: 5021846 - DNA, 17 bp, Homo sapiens
ctgaatatacagcaggt

SEQ ID NO: 5021847 - DNA, 15 bp, Homo sapiens
ctgacaacagacttc

SEQ ID NO: 5021848 - DNA, 16 bp, Homo sapiens
ctgacacctaactctt

SEQ ID NO: 5021849 - DNA, 21 bp, Homo sapiens
ctgacagggacatgccctgtg

SEQ ID NO: 5021850 - DNA, 22 bp, Homo sapiens
ctgacagggacatgccctgtgt

SEQ ID NO: 5021851 - DNA, 22 bp, Homo sapiens
ctgaccccaaacaccttccagc

SEQ ID NO: 5021852 - DNA, 20 bp, Homo sapiens
ctgacttaagcaaaagaaaa

SEQ ID NO: 5021853 - DNA, 20 bp, Homo sapiens
ctgagatgggcttcccaagg

SEQ ID NO: 5021854 - DNA, 14 bp, Homo sapiens
ctgagatttattaa

SEQ ID NO: 5021855 - DNA, 19 bp, Homo sapiens
ctgagatttattaaagaaa

SEQ ID NO: 5021856 - DNA, 16 bp, Homo sapiens
ctgagcagcgagcctg

SEQ ID NO: 5021857 - DNA, 13 bp, Homo sapiens
ctgagctggggaa

SEQ ID NO: 5021858 - DNA, 14 bp, Homo sapiens
ctgaggcccagtgc

SEQ ID NO: 5021859 - DNA, 13 bp, Homo sapiens
ctgagggaccctt

SEQ ID NO: 5021860 - DNA, 17 bp, Homo sapiens
ctgaggtgcctgtccca

SEQ ID NO: 5021861 - DNA, 22 bp, Homo sapiens
ctgaggtgcctgtcccaccccc

SEQ ID NO: 5021862 - DNA, 16 bp, Homo sapiens
ctgagtgccttttggt

SEQ ID NO: 5021863 - DNA, 22 bp, Homo sapiens
ctgataaattaacctctcacag

SEQ ID NO: 5021864 - DNA, 12 bp, Homo sapiens
ctgatgcagctt

SEQ ID NO: 5021865 - DNA, 19 bp, Homo sapiens
ctgatgccaagttgtttga

SEQ ID NO: 5021866 - DNA, 12 bp, Homo sapiens
ctgatggagccc

SEQ ID NO: 5021867 - DNA, 17 bp, Homo sapiens
ctgattgggaggtgcgt

SEQ ID NO: 5021868 - DNA, 21 bp, Homo sapiens
ctgcaactgctcagctctggt

SEQ ID NO: 5021869 - DNA, 22 bp, Homo sapiens
ctgcaatcttctcagaaggcaa

SEQ ID NO: 5021870 - DNA, 18 bp, Homo sapiens
ctgcaatgaagtctctga

SEQ ID NO: 5021871 - DNA, 21 bp, Homo sapiens
ctgcaatgaagtctctgaagt

SEQ ID NO: 5021872 - DNA, 15 bp, Homo sapiens
ctgcaattcccctct

SEQ ID NO: 5021873 - DNA, 16 bp, Homo sapiens
ctgcaattcccctctg

SEQ ID NO: 5021874 - DNA, 11 bp, Homo sapiens
ctgcacacagg

SEQ ID NO: 5021875 - DNA, 16 bp, Homo sapiens
ctgcacacaggacagc

SEQ ID NO: 5021876 - DNA, 22 bp, Homo sapiens
ctgcacacgctccttcctctga

SEQ ID NO: 5021877 - DNA, 20 bp, Homo sapiens
ctgcactccctcctggagct

SEQ ID NO: 5021878 - DNA, 19 bp, Homo sapiens
ctgcagtttgagacaggag

SEQ ID NO: 5021879 - DNA, 19 bp, Homo sapiens
ctgccaagactcctcaggc

SEQ ID NO: 5021880 - DNA, 21 bp, Homo sapiens
ctgccaccctgccccttgcca

SEQ ID NO: 5021881 - DNA, 14 bp, Homo sapiens
ctgccagcccctgc

SEQ ID NO: 5021882 - DNA, 20 bp, Homo sapiens
ctgccaggagcacggctctg

SEQ ID NO: 5021883 - DNA, 18 bp, Homo sapiens
ctgccagtctcactgtgg

SEQ ID NO: 5021884 - DNA, 21 bp, Homo sapiens
ctgccatgcaccaggactggc

SEQ ID NO: 5021885 - DNA, 16 bp, Homo sapiens
ctgccccccagcctct

SEQ ID NO: 5021886 - DNA, 13 bp, Homo sapiens
ctgccccccgagg

SEQ ID NO: 5021887 - DNA, 21 bp, Homo sapiens
ctgccccccgaggctgctaga

SEQ ID NO: 5021888 - DNA, 22 bp, Homo sapiens
ctgccccttcctttaaaaaact

SEQ ID NO: 5021889 - DNA, 17 bp, Homo sapiens
ctgccctggcagggtca

SEQ ID NO: 5021890 - DNA, 15 bp, Homo sapiens
ctgccgacttggaga

SEQ ID NO: 5021891 - DNA, 22 bp, Homo sapiens
ctgccgacttggagactcctgg

SEQ ID NO: 5021892 - DNA, 16 bp, Homo sapiens
ctgccgagacagaccc

SEQ ID NO: 5021893 - DNA, 19 bp, Homo sapiens
ctgccgagacagaccctct

SEQ ID NO: 5021894 - DNA, 19 bp, Homo sapiens
ctgccgctgcttccaggct

SEQ ID NO: 5021895 - DNA, 23 bp, Homo sapiens
ctgccggggcagccccctcacag

SEQ ID NO: 5021896 - DNA, 13 bp, Homo sapiens
ctgcctgctccca

SEQ ID NO: 5021897 - DNA, 12 bp, Homo sapiens
ctgcctggcagg

SEQ ID NO: 5021898 - DNA, 12 bp, Homo sapiens
ctgcctgtgctg

SEQ ID NO: 5021899 - DNA, 16 bp, Homo sapiens
ctgccttagtctcagt

SEQ ID NO: 5021900 - DNA, 20 bp, Homo sapiens
ctgccttagtctcagtttgt

SEQ ID NO: 5021901 - DNA, 20 bp, Homo sapiens
ctgcgggcgcgggcagccac

SEQ ID NO: 5021902 - DNA, 23 bp, Homo sapiens
ctgctaatattttcctcctgagt

SEQ ID NO: 5021903 - DNA, 21 bp, Homo sapiens
ctgctaccgttgacttccagg

SEQ ID NO: 5021904 - DNA, 14 bp, Homo sapiens
ctgctcagctctgg

SEQ ID NO: 5021905 - DNA, 17 bp, Homo sapiens
ctgctcaggaaacgaga

SEQ ID NO: 5021906 - DNA, 14 bp, Homo sapiens
ctgctcccatcctg

SEQ ID NO: 5021907 - DNA, 18 bp, Homo sapiens
ctgctcccatcctgtgtg

SEQ ID NO: 5021908 - DNA, 17 bp, Homo sapiens
ctgctccccaggccacc

SEQ ID NO: 5021909 - DNA, 19 bp, Homo sapiens
ctgctctcagcctcccaca

SEQ ID NO: 5021910 - DNA, 12 bp, Homo sapiens
ctgctctgatga

SEQ ID NO: 5021911 - DNA, 13 bp, Homo sapiens
ctgctctggtggc

SEQ ID NO: 5021912 - DNA, 21 bp, Homo sapiens
ctgctctggtggcttaagtga

SEQ ID NO: 5021913 - DNA, 15 bp, Homo sapiens
ctgctgaggcccagt

SEQ ID NO: 5021914 - DNA, 19 bp, Homo sapiens
ctgctgaggcccagtgcat

SEQ ID NO: 5021915 - DNA, 14 bp, Homo sapiens
ctgctgctgctgtg

SEQ ID NO: 5021916 - DNA, 17 bp, Homo sapiens
ctgctgtccctccccct

SEQ ID NO: 5021917 - DNA, 14 bp, Homo sapiens
ctgctgtctctctg

SEQ ID NO: 5021918 - DNA, 15 bp, Homo sapiens
ctgctgtctctctgg

SEQ ID NO: 5021919 - DNA, 17 bp, Homo sapiens
ctgctgtctctctgggc

SEQ ID NO: 5021920 - DNA, 22 bp, Homo sapiens
ctgctgttggtcctctctctgt

SEQ ID NO: 5021921 - DNA, 14 bp, Homo sapiens
ctgctgtttcctag

SEQ ID NO: 5021922 - DNA, 22 bp, Homo sapiens
ctgctgtttcctagcgcagcca

SEQ ID NO: 5021923 - DNA, 18 bp, Homo sapiens
ctggaagaaaaaaaccac

SEQ ID NO: 5021924 - DNA, 17 bp, Homo sapiens
ctggacactcagacctg

SEQ ID NO: 5021925 - DNA, 20 bp, Homo sapiens
ctggacagtacctgattgta

SEQ ID NO: 5021926 - DNA, 19 bp, Homo sapiens
ctggacctagggtggcctg

SEQ ID NO: 5021927 - DNA, 13 bp, Homo sapiens
ctggagcagacca

SEQ ID NO: 5021928 - DNA, 18 bp, Homo sapiens
ctggagcagaccaccccg

SEQ ID NO: 5021929 - DNA, 14 bp, Homo sapiens
ctggatagacttgg

SEQ ID NO: 5021930 - DNA, 22 bp, Homo sapiens
ctggatagacttgggatgggga

SEQ ID NO: 5021931 - DNA, 18 bp, Homo sapiens
ctggatgatactaataaa

SEQ ID NO: 5021932 - DNA, 23 bp, Homo sapiens
ctggatgatactaataaactaat

SEQ ID NO: 5021933 - DNA, 18 bp, Homo sapiens
ctggcattagaattattt

SEQ ID NO: 5021934 - DNA, 20 bp, Homo sapiens
ctggcattagaattatttaa

SEQ ID NO: 5021935 - DNA, 22 bp, Homo sapiens
ctggcattagaattatttaaac

SEQ ID NO: 5021936 - DNA, 20 bp, Homo sapiens
ctggccccgcctgcctgcca

SEQ ID NO: 5021937 - DNA, 14 bp, Homo sapiens
ctggccgccccctg

SEQ ID NO: 5021938 - DNA, 13 bp, Homo sapiens
ctggcctgctgga

SEQ ID NO: 5021939 - DNA, 18 bp, Homo sapiens
ctggcctggactgttttc

SEQ ID NO: 5021940 - DNA, 19 bp, Homo sapiens
ctggcggctggggtcccag

SEQ ID NO: 5021941 - DNA, 22 bp, Homo sapiens
ctggcggctggggtcccagcag

SEQ ID NO: 5021942 - DNA, 19 bp, Homo sapiens
ctggctccaaaccctcgag

SEQ ID NO: 5021943 - DNA, 20 bp, Homo sapiens
ctggctccaaaccctcgagg

SEQ ID NO: 5021944 - DNA, 12 bp, Homo sapiens
ctggctctgggc

SEQ ID NO: 5021945 - DNA, 14 bp, Homo sapiens
ctggctctgggccg

SEQ ID NO: 5021946 - DNA, 20 bp, Homo sapiens
ctggctcttgatacccccct

SEQ ID NO: 5021947 - DNA, 22 bp, Homo sapiens
ctggctcttgatacccccctct

SEQ ID NO: 5021948 - DNA, 23 bp, Homo sapiens
ctggctcttgatacccccctctg

SEQ ID NO: 5021949 - DNA, 12 bp, Homo sapiens
ctggctgaagga

SEQ ID NO: 5021950 - DNA, 19 bp, Homo sapiens
ctgggaacaccataggtca

SEQ ID NO: 5021951 - DNA, 19 bp, Homo sapiens
ctgggacatcaggagactg

SEQ ID NO: 5021952 - DNA, 20 bp, Homo sapiens
ctgggacatcaggagactgg

SEQ ID NO: 5021953 - DNA, 21 bp, Homo sapiens
ctgggacatcaggagactggg

SEQ ID NO: 5021954 - DNA, 12 bp, Homo sapiens
ctgggagaccct

SEQ ID NO: 5021955 - DNA, 21 bp, Homo sapiens
ctgggagtagttgtctttcct

SEQ ID NO: 5021956 - DNA, 15 bp, Homo sapiens
ctgggatgtcacagt

SEQ ID NO: 5021957 - DNA, 18 bp, Homo sapiens
ctgggatgtcacagtcca

SEQ ID NO: 5021958 - DNA, 18 bp, Homo sapiens
ctgggcatttggtgagag

SEQ ID NO: 5021959 - DNA, 12 bp, Homo sapiens
ctgggccagaat

SEQ ID NO: 5021960 - DNA, 16 bp, Homo sapiens
ctgggccgggcctggg

SEQ ID NO: 5021961 - DNA, 17 bp, Homo sapiens
ctgggccgggcctgggg

SEQ ID NO: 5021962 - DNA, 20 bp, Homo sapiens
ctgggcctcagtgtgcccat

SEQ ID NO: 5021963 - DNA, 23 bp, Homo sapiens
ctgggctctgcaattcccctctg

SEQ ID NO: 5021964 - DNA, 14 bp, Homo sapiens
ctgggctctggctc

SEQ ID NO: 5021965 - DNA, 18 bp, Homo sapiens
ctggggccaaataaagtc

SEQ ID NO: 5021966 - DNA, 17 bp, Homo sapiens
ctgggggacccctggct

SEQ ID NO: 5021967 - DNA, 21 bp, Homo sapiens
ctgggggacccctggctctgg

SEQ ID NO: 5021968 - DNA, 16 bp, Homo sapiens
ctggggtcccagcagc

SEQ ID NO: 5021969 - DNA, 17 bp, Homo sapiens
ctgggtctcagtgtcct

SEQ ID NO: 5021970 - DNA, 18 bp, Homo sapiens
ctgggtctcagtgtcctc

SEQ ID NO: 5021971 - DNA, 16 bp, Homo sapiens
ctgggtgcgtctccag

SEQ ID NO: 5021972 - DNA, 16 bp, Homo sapiens
ctgggtggtaccctct

SEQ ID NO: 5021973 - DNA, 15 bp, Homo sapiens
ctggtaccctcctgg

SEQ ID NO: 5021974 - DNA, 15 bp, Homo sapiens
ctggtagagaccccc

SEQ ID NO: 5021975 - DNA, 16 bp, Homo sapiens
ctggtagagaccccca

SEQ ID NO: 5021976 - DNA, 17 bp, Homo sapiens
ctggtctgtgaagagcc

SEQ ID NO: 5021977 - DNA, 22 bp, Homo sapiens
ctggtctgtgaagagccggtgg

SEQ ID NO: 5021978 - DNA, 19 bp, Homo sapiens
ctggtggcttaagtgagca

SEQ ID NO: 5021979 - DNA, 21 bp, Homo sapiens
ctggtggcttaagtgagcaga

SEQ ID NO: 5021980 - DNA, 15 bp, Homo sapiens
ctggtggtattttca

SEQ ID NO: 5021981 - DNA, 17 bp, Homo sapiens
ctggtgtgaactaaact

SEQ ID NO: 5021982 - DNA, 21 bp, Homo sapiens
ctggttcccgtttctccacct

SEQ ID NO: 5021983 - DNA, 14 bp, Homo sapiens
ctgtaactgtcagt

SEQ ID NO: 5021984 - DNA, 16 bp, Homo sapiens
ctgtacacaactcact

SEQ ID NO: 5021985 - DNA, 22 bp, Homo sapiens
ctgtacacaactcactcctttt

SEQ ID NO: 5021986 - DNA, 21 bp, Homo sapiens
ctgtacagtgtctttttttgt

SEQ ID NO: 5021987 - DNA, 23 bp, Homo sapiens
ctgtaccttttgaggagccccag

SEQ ID NO: 5021988 - DNA, 15 bp, Homo sapiens
ctgtaggcagaggct

SEQ ID NO: 5021989 - DNA, 17 bp, Homo sapiens
ctgtaggcagaggctgc

SEQ ID NO: 5021990 - DNA, 20 bp, Homo sapiens
ctgtccacacccagctcagc

SEQ ID NO: 5021991 - DNA, 13 bp, Homo sapiens
ctgtccaccctgc

SEQ ID NO: 5021992 - DNA, 21 bp, Homo sapiens
ctgtccagctcccgctgtggc

SEQ ID NO: 5021993 - DNA, 16 bp, Homo sapiens
ctgtcccacccccacc

SEQ ID NO: 5021994 - DNA, 15 bp, Homo sapiens
ctgtccccagcctgg

SEQ ID NO: 5021995 - DNA, 16 bp, Homo sapiens
ctgtccccagcctggg

SEQ ID NO: 5021996 - DNA, 17 bp, Homo sapiens
ctgtccggcccagtgcc

SEQ ID NO: 5021997 - DNA, 19 bp, Homo sapiens
ctgtcctggtggtattttc

SEQ ID NO: 5021998 - DNA, 17 bp, Homo sapiens
ctgtccttgaaggacta

SEQ ID NO: 5021999 - DNA, 20 bp, Homo sapiens
ctgtccttgaaggactaata

SEQ ID NO: 5022000 - DNA, 15 bp, Homo sapiens
ctgtcgtgatggggc

SEQ ID NO: 5022001 - DNA, 13 bp, Homo sapiens
ctgtctaggactg

SEQ ID NO: 5022002 - DNA, 13 bp, Homo sapiens
ctgtctctctggg

SEQ ID NO: 5022003 - DNA, 14 bp, Homo sapiens
ctgtcttggctgtg

SEQ ID NO: 5022004 - DNA, 16 bp, Homo sapiens
ctgtgacaggcagcag

SEQ ID NO: 5022005 - DNA, 17 bp, Homo sapiens
ctgtgacaggcagcaga

SEQ ID NO: 5022006 - DNA, 13 bp, Homo sapiens
ctgtgcagctctc

SEQ ID NO: 5022007 - DNA, 17 bp, Homo sapiens
ctgtgcatttctggttg

SEQ ID NO: 5022008 - DNA, 20 bp, Homo sapiens
ctgtggggctaggggctggg

SEQ ID NO: 5022009 - DNA, 12 bp, Homo sapiens
ctgtggggctga

SEQ ID NO: 5022010 - DNA, 18 bp, Homo sapiens
ctgtgtaaccttgggtgg

SEQ ID NO: 5022011 - DNA, 18 bp, Homo sapiens
ctgtgtaagatttgtttt

SEQ ID NO: 5022012 - DNA, 17 bp, Homo sapiens
ctgtgtgttaagctctg

SEQ ID NO: 5022013 - DNA, 18 bp, Homo sapiens
ctgtgtgttaagctctgc

SEQ ID NO: 5022014 - DNA, 20 bp, Homo sapiens
ctgtgtgttaagctctgcta

SEQ ID NO: 5022015 - DNA, 15 bp, Homo sapiens
ctgttaactgaatac

SEQ ID NO: 5022016 - DNA, 19 bp, Homo sapiens
ctgttaactgaataccact

SEQ ID NO: 5022017 - DNA, 20 bp, Homo sapiens
ctgttatttataatcacttt

SEQ ID NO: 5022018 - DNA, 11 bp, Homo sapiens
ctgttctgtgt

SEQ ID NO: 5022019 - DNA, 13 bp, Homo sapiens
ctgttcttagctc

SEQ ID NO: 5022020 - DNA, 23 bp, Homo sapiens
ctgttcttagctcaatgagcatg

SEQ ID NO: 5022021 - DNA, 19 bp, Homo sapiens
ctgttggtcctctctctgt

SEQ ID NO: 5022022 - DNA, 13 bp, Homo sapiens
ctgtttgttattg

SEQ ID NO: 5022023 - DNA, 14 bp, Homo sapiens
ctgttttatgactt

SEQ ID NO: 5022024 - DNA, 15 bp, Homo sapiens
ctgttttatgacttc

SEQ ID NO: 5022025 - DNA, 16 bp, Homo sapiens
ctgttttatgacttca

SEQ ID NO: 5022026 - DNA, 21 bp, Homo sapiens
ctgttttctctcggctcccca

SEQ ID NO: 5022027 - DNA, 13 bp, Homo sapiens
ctgttttgttgac

SEQ ID NO: 5022028 - DNA, 22 bp, Homo sapiens
ctgttttgttgacattctgaat

SEQ ID NO: 5022029 - DNA, 23 bp, Homo sapiens
ctgttttgtttcgctctttgaga

SEQ ID NO: 5022030 - DNA, 14 bp, Homo sapiens
ctgtttttgttgtg

SEQ ID NO: 5022031 - DNA, 12 bp, Homo sapiens
cttaaaatacaa

SEQ ID NO: 5022032 - DNA, 14 bp, Homo sapiens
cttaaaatacaaga

SEQ ID NO: 5022033 - DNA, 16 bp, Homo sapiens
cttaaagtgccagtat

SEQ ID NO: 5022034 - DNA, 22 bp, Homo sapiens
cttaaataataaagatcatgta

SEQ ID NO: 5022035 - DNA, 18 bp, Homo sapiens
cttaagcaaaagaaaaag

SEQ ID NO: 5022036 - DNA, 19 bp, Homo sapiens
cttaagtgagcagaacagg

SEQ ID NO: 5022037 - DNA, 11 bp, Homo sapiens
cttaattatta

SEQ ID NO: 5022038 - DNA, 19 bp, Homo sapiens
cttaattattatttgtgtt

SEQ ID NO: 5022039 - DNA, 18 bp, Homo sapiens
cttagaaaaccagctcag

SEQ ID NO: 5022040 - DNA, 21 bp, Homo sapiens
cttagaaaaccagctcagcac

SEQ ID NO: 5022041 - DNA, 17 bp, Homo sapiens
cttagagtttctgtttg

SEQ ID NO: 5022042 - DNA, 22 bp, Homo sapiens
cttagagtttctgtttgattct

SEQ ID NO: 5022043 - DNA, 16 bp, Homo sapiens
cttagctcaatgagca

SEQ ID NO: 5022044 - DNA, 13 bp, Homo sapiens
cttaggattctaa

SEQ ID NO: 5022045 - DNA, 20 bp, Homo sapiens
cttaggtggctctgggaatg

SEQ ID NO: 5022046 - DNA, 13 bp, Homo sapiens
cttatgaaaagaa

SEQ ID NO: 5022047 - DNA, 18 bp, Homo sapiens
cttatgaaaagaattgtt

SEQ ID NO: 5022048 - DNA, 14 bp, Homo sapiens
cttatggatgtccc

SEQ ID NO: 5022049 - DNA, 18 bp, Homo sapiens
cttatggatgtccccagc

SEQ ID NO: 5022050 - DNA, 21 bp, Homo sapiens
cttatggatgtccccagcaga

SEQ ID NO: 5022051 - DNA, 14 bp, Homo sapiens
cttattcccttcct

SEQ ID NO: 5022052 - DNA, 17 bp, Homo sapiens
cttattgcgctgctacc

SEQ ID NO: 5022053 - DNA, 14 bp, Homo sapiens
cttcaaactacttt

SEQ ID NO: 5022054 - DNA, 17 bp, Homo sapiens
cttcaaagcaaatgtct

SEQ ID NO: 5022055 - DNA, 15 bp, Homo sapiens
cttcaccctggagcc

SEQ ID NO: 5022056 - DNA, 16 bp, Homo sapiens
cttcagaaagagctca

SEQ ID NO: 5022057 - DNA, 19 bp, Homo sapiens
cttcagtaccctctcagct

SEQ ID NO: 5022058 - DNA, 18 bp, Homo sapiens
cttcagttaagcctttgg

SEQ ID NO: 5022059 - DNA, 14 bp, Homo sapiens
cttcagttgtctct

SEQ ID NO: 5022060 - DNA, 17 bp, Homo sapiens
cttcagttgtctctgat

SEQ ID NO: 5022061 - DNA, 13 bp, Homo sapiens
cttcattctcctt

SEQ ID NO: 5022062 - DNA, 23 bp, Homo sapiens
cttccaccaagttggaacatcct

SEQ ID NO: 5022063 - DNA, 16 bp, Homo sapiens
cttccatctctgactt

SEQ ID NO: 5022064 - DNA, 17 bp, Homo sapiens
cttcccaagggctgccg

SEQ ID NO: 5022065 - DNA, 20 bp, Homo sapiens
cttccccacttctgtgccac

SEQ ID NO: 5022066 - DNA, 22 bp, Homo sapiens
cttcctcatccaccccatccct

SEQ ID NO: 5022067 - DNA, 17 bp, Homo sapiens
cttcctcctccccactt

SEQ ID NO: 5022068 - DNA, 16 bp, Homo sapiens
cttcctctgaggctga

SEQ ID NO: 5022069 - DNA, 15 bp, Homo sapiens
cttcctgccagcccc

SEQ ID NO: 5022070 - DNA, 22 bp, Homo sapiens
cttcctgccagcccctgccatt

SEQ ID NO: 5022071 - DNA, 17 bp, Homo sapiens
cttctaagtaaatacaa

SEQ ID NO: 5022072 - DNA, 22 bp, Homo sapiens
cttctcagaaggcaaatgactt

SEQ ID NO: 5022073 - DNA, 21 bp, Homo sapiens
cttctcggcttggatcctggg

SEQ ID NO: 5022074 - DNA, 21 bp, Homo sapiens
cttctcgtcctcgtttgtgtt

SEQ ID NO: 5022075 - DNA, 22 bp, Homo sapiens
cttctgtgtatctctttcacat

SEQ ID NO: 5022076 - DNA, 23 bp, Homo sapiens
cttgagtggggttatctctgtgt

SEQ ID NO: 5022077 - DNA, 19 bp, Homo sapiens
cttgatacccccctctgtc

SEQ ID NO: 5022078 - DNA, 22 bp, Homo sapiens
cttgatcagttaagaaatttca

SEQ ID NO: 5022079 - DNA, 18 bp, Homo sapiens
cttgcaagaatcagtgca

SEQ ID NO: 5022080 - DNA, 22 bp, Homo sapiens
cttgcaagaatcagtgcaaaga

SEQ ID NO: 5022081 - DNA, 21 bp, Homo sapiens
cttgccaagggtccctgtgtg

SEQ ID NO: 5022082 - DNA, 22 bp, Homo sapiens
cttgccccactctgcctgcctg

SEQ ID NO: 5022083 - DNA, 16 bp, Homo sapiens
cttgcctggtacagta

SEQ ID NO: 5022084 - DNA, 17 bp, Homo sapiens
cttgctccagattctga

SEQ ID NO: 5022085 - DNA, 13 bp, Homo sapiens
cttgcttttcatg

SEQ ID NO: 5022086 - DNA, 19 bp, Homo sapiens
cttgcttttcatgcaaact

SEQ ID NO: 5022087 - DNA, 21 bp, Homo sapiens
cttggaagggcgttctaggta

SEQ ID NO: 5022088 - DNA, 14 bp, Homo sapiens
cttggagactcctg

SEQ ID NO: 5022089 - DNA, 15 bp, Homo sapiens
cttggatgtatatgt

SEQ ID NO: 5022090 - DNA, 21 bp, Homo sapiens
cttggattctttccatttgca

SEQ ID NO: 5022091 - DNA, 16 bp, Homo sapiens
cttggctgtggggcta

SEQ ID NO: 5022092 - DNA, 17 bp, Homo sapiens
cttggctgtggggctag

SEQ ID NO: 5022093 - DNA, 20 bp, Homo sapiens
cttggggaaaatggccatgc

SEQ ID NO: 5022094 - DNA, 23 bp, Homo sapiens
cttggggaaaatggccatgcagg

SEQ ID NO: 5022095 - DNA, 18 bp, Homo sapiens
cttggtctttctgtgctt

SEQ ID NO: 5022096 - DNA, 17 bp, Homo sapiens
cttgtaaatataaagac

SEQ ID NO: 5022097 - DNA, 17 bp, Homo sapiens
cttgtattaaagacaga

SEQ ID NO: 5022098 - DNA, 15 bp, Homo sapiens
cttgtattaagaatg

SEQ ID NO: 5022099 - DNA, 15 bp, Homo sapiens
cttgtcgtgggatgg

SEQ ID NO: 5022100 - DNA, 14 bp, Homo sapiens
cttgtgacagtgcc

SEQ ID NO: 5022101 - DNA, 17 bp, Homo sapiens
cttgtgacagtgcctct

SEQ ID NO: 5022102 - DNA, 17 bp, Homo sapiens
cttgttcttgcagcatt

SEQ ID NO: 5022103 - DNA, 22 bp, Homo sapiens
ctttaaaagagagagagagaaa

SEQ ID NO: 5022104 - DNA, 21 bp, Homo sapiens
ctttaactcccattaccatgt

SEQ ID NO: 5022105 - DNA, 16 bp, Homo sapiens
ctttacaaaacaaact

SEQ ID NO: 5022106 - DNA, 19 bp, Homo sapiens
ctttagatagccctgtcct

SEQ ID NO: 5022107 - DNA, 14 bp, Homo sapiens
ctttcacagctcct

SEQ ID NO: 5022108 - DNA, 22 bp, Homo sapiens
ctttcacattgtttgctgctat

SEQ ID NO: 5022109 - DNA, 14 bp, Homo sapiens
ctttcatattttag

SEQ ID NO: 5022110 - DNA, 15 bp, Homo sapiens
ctttcatttcttcta

SEQ ID NO: 5022111 - DNA, 17 bp, Homo sapiens
ctttccaaaacatttct

SEQ ID NO: 5022112 - DNA, 21 bp, Homo sapiens
ctttccccatgtctcgactca

SEQ ID NO: 5022113 - DNA, 21 bp, Homo sapiens
ctttctccctcaactgaaggg

SEQ ID NO: 5022114 - DNA, 12 bp, Homo sapiens
ctttctgggatg

SEQ ID NO: 5022115 - DNA, 18 bp, Homo sapiens
ctttctgggatgtcacag

SEQ ID NO: 5022116 - DNA, 22 bp, Homo sapiens
ctttctgggatgtcacagtcca

SEQ ID NO: 5022117 - DNA, 14 bp, Homo sapiens
ctttctgtctgctt

SEQ ID NO: 5022118 - DNA, 21 bp, Homo sapiens
ctttctttgcaccaaagacat

SEQ ID NO: 5022119 - DNA, 18 bp, Homo sapiens
ctttgaaaagttggaagg

SEQ ID NO: 5022120 - DNA, 19 bp, Homo sapiens
ctttgaaaagttggaagga

SEQ ID NO: 5022121 - DNA, 13 bp, Homo sapiens
ctttgaagggcaa

SEQ ID NO: 5022122 - DNA, 12 bp, Homo sapiens
ctttgagagaga

SEQ ID NO: 5022123 - DNA, 15 bp, Homo sapiens
ctttgagagagaaag

SEQ ID NO: 5022124 - DNA, 14 bp, Homo sapiens
ctttgcaccaaaga

SEQ ID NO: 5022125 - DNA, 16 bp, Homo sapiens
ctttgctttaatataa

SEQ ID NO: 5022126 - DNA, 21 bp, Homo sapiens
ctttgctttaatataaatgca

SEQ ID NO: 5022127 - DNA, 19 bp, Homo sapiens
ctttggacagaagcagctc

SEQ ID NO: 5022128 - DNA, 14 bp, Homo sapiens
ctttggagtcccct

SEQ ID NO: 5022129 - DNA, 17 bp, Homo sapiens
ctttggccccactttga

SEQ ID NO: 5022130 - DNA, 19 bp, Homo sapiens
ctttggccccactttgaag

SEQ ID NO: 5022131 - DNA, 14 bp, Homo sapiens
ctttggtccttcaa

SEQ ID NO: 5022132 - DNA, 17 bp, Homo sapiens
ctttgttttactgtctt

SEQ ID NO: 5022133 - DNA, 17 bp, Homo sapiens
ctttgttttgtgtctct

SEQ ID NO: 5022134 - DNA, 18 bp, Homo sapiens
ctttgttttgtgtctctt

SEQ ID NO: 5022135 - DNA, 22 bp, Homo sapiens
cttttaaagaaaaaaattgaaa

SEQ ID NO: 5022136 - DNA, 19 bp, Homo sapiens
cttttcacatttttaaaag

SEQ ID NO: 5022137 - DNA, 18 bp, Homo sapiens
cttttcataggtctgaaa

SEQ ID NO: 5022138 - DNA, 20 bp, Homo sapiens
cttttcataggtctgaaatt

SEQ ID NO: 5022139 - DNA, 13 bp, Homo sapiens
cttttcatgcaaa

SEQ ID NO: 5022140 - DNA, 14 bp, Homo sapiens
cttttcatgcaaac

SEQ ID NO: 5022141 - DNA, 17 bp, Homo sapiens
cttttcatgcaaactct

SEQ ID NO: 5022142 - DNA, 20 bp, Homo sapiens
cttttccctctttggctccc

SEQ ID NO: 5022143 - DNA, 16 bp, Homo sapiens
cttttcctctctcccg

SEQ ID NO: 5022144 - DNA, 18 bp, Homo sapiens
cttttcctctctcccgga

SEQ ID NO: 5022145 - DNA, 14 bp, Homo sapiens
cttttctttaaaga

SEQ ID NO: 5022146 - DNA, 20 bp, Homo sapiens
cttttggttaagtctgtttt

SEQ ID NO: 5022147 - DNA, 19 bp, Homo sapiens
cttttgtctacacaccctg

SEQ ID NO: 5022148 - DNA, 16 bp, Homo sapiens
ctttttcactttgaaa

SEQ ID NO: 5022149 - DNA, 21 bp, Homo sapiens
ctttttctccagctgggctct

SEQ ID NO: 5022150 - DNA, 20 bp, Homo sapiens
ctttttttgagtgacagctt

SEQ ID NO: 5022151 - DNA, 21 bp, Homo sapiens
ctttttttgtatagttaacac

SEQ ID NO: 5022152 - DNA, 16 bp, Homo sapiens
gaaaaaaaccacacaa

SEQ ID NO: 5022153 - DNA, 14 bp, Homo sapiens
gaaaaaaacttcat

SEQ ID NO: 5022154 - DNA, 19 bp, Homo sapiens
gaaaaataaagaaaagatg

SEQ ID NO: 5022155 - DNA, 20 bp, Homo sapiens
gaaaaattcagcaaaccatt

SEQ ID NO: 5022156 - DNA, 16 bp, Homo sapiens
gaaaactaaggatttt

SEQ ID NO: 5022157 - DNA, 16 bp, Homo sapiens
gaaaagtgcaagtcca

SEQ ID NO: 5022158 - DNA, 20 bp, Homo sapiens
gaaaagttggaaggatctgc

SEQ ID NO: 5022159 - DNA, 11 bp, Homo sapiens
gaaaatcagca

SEQ ID NO: 5022160 - DNA, 15 bp, Homo sapiens
gaaaatggccatgca

SEQ ID NO: 5022161 - DNA, 18 bp, Homo sapiens
gaaaatggccatgcagga

SEQ ID NO: 5022162 - DNA, 17 bp, Homo sapiens
gaaacacccctctgtct

SEQ ID NO: 5022163 - DNA, 17 bp, Homo sapiens
gaaacatttcctttgaa

SEQ ID NO: 5022164 - DNA, 18 bp, Homo sapiens
gaaaccacagtgagcctg

SEQ ID NO: 5022165 - DNA, 17 bp, Homo sapiens
gaaactgggttcctgca

SEQ ID NO: 5022166 - DNA, 20 bp, Homo sapiens
gaaagactgggacagcccag

SEQ ID NO: 5022167 - DNA, 18 bp, Homo sapiens
gaaataatagaatgagca

SEQ ID NO: 5022168 - DNA, 15 bp, Homo sapiens
gaaataattgttgtt

SEQ ID NO: 5022169 - DNA, 20 bp, Homo sapiens
gaaataattgttgttctgtt

SEQ ID NO: 5022170 - DNA, 19 bp, Homo sapiens
gaaatactgtttgaggttt

SEQ ID NO: 5022171 - DNA, 19 bp, Homo sapiens
gaaatagcttatgaaaaga

SEQ ID NO: 5022172 - DNA, 17 bp, Homo sapiens
gaaatgaggtctgttta

SEQ ID NO: 5022173 - DNA, 21 bp, Homo sapiens
gaaatgattcaaattgctgct

SEQ ID NO: 5022174 - DNA, 22 bp, Homo sapiens
gaaatgattcaaattgctgctt

SEQ ID NO: 5022175 - DNA, 18 bp, Homo sapiens
gaaatggcgtctgctctg

SEQ ID NO: 5022176 - DNA, 24 bp, Homo sapiens
gaaatggcgtctgctctggtggct

SEQ ID NO: 5022177 - DNA, 14 bp, Homo sapiens
gaaatttagcattg

SEQ ID NO: 5022178 - DNA, 18 bp, Homo sapiens
gaaatttcacatagccca

SEQ ID NO: 5022179 - DNA, 17 bp, Homo sapiens
gaacacataattcagga

SEQ ID NO: 5022180 - DNA, 17 bp, Homo sapiens
gaacagataatccctgt

SEQ ID NO: 5022181 - DNA, 12 bp, Homo sapiens
gaacagctgtgt

SEQ ID NO: 5022182 - DNA, 16 bp, Homo sapiens
gaacagctgtgtctgc

SEQ ID NO: 5022183 - DNA, 19 bp, Homo sapiens
gaacagctgtgtctgccaa

SEQ ID NO: 5022184 - DNA, 16 bp, Homo sapiens
gaacaggtggttttta

SEQ ID NO: 5022185 - DNA, 18 bp, Homo sapiens
gaacatctgagtcctgga

SEQ ID NO: 5022186 - DNA, 13 bp, Homo sapiens
gaacattcccagc

SEQ ID NO: 5022187 - DNA, 20 bp, Homo sapiens
gaaccagccgtattttacat

SEQ ID NO: 5022188 - DNA, 16 bp, Homo sapiens
gaacctgcacacagga

SEQ ID NO: 5022189 - DNA, 16 bp, Homo sapiens
gaactaaactttcaca

SEQ ID NO: 5022190 - DNA, 20 bp, Homo sapiens
gaactctgacaacagacttc

SEQ ID NO: 5022191 - DNA, 11 bp, Homo sapiens
gaactgggctg

SEQ ID NO: 5022192 - DNA, 14 bp, Homo sapiens
gaactgggctgggc

SEQ ID NO: 5022193 - DNA, 13 bp, Homo sapiens
gaacttgattgcc

SEQ ID NO: 5022194 - DNA, 20 bp, Homo sapiens
gaagacaaaaagacaaacat

SEQ ID NO: 5022195 - DNA, 12 bp, Homo sapiens
gaagacaaactt

SEQ ID NO: 5022196 - DNA, 14 bp, Homo sapiens
gaagacctgagaat

SEQ ID NO: 5022197 - DNA, 17 bp, Homo sapiens
gaagacctgagaatgta

SEQ ID NO: 5022198 - DNA, 21 bp, Homo sapiens
gaagcattctcattggaaatt

SEQ ID NO: 5022199 - DNA, 22 bp, Homo sapiens
gaagccatccctttttttacat

SEQ ID NO: 5022200 - DNA, 19 bp, Homo sapiens
gaaggactaatagaaaagt

SEQ ID NO: 5022201 - DNA, 21 bp, Homo sapiens
gaaggactgtgacaggcagca

SEQ ID NO: 5022202 - DNA, 22 bp, Homo sapiens
gaaggactgtgacaggcagcag

SEQ ID NO: 5022203 - DNA, 14 bp, Homo sapiens
gaaggatctgctga

SEQ ID NO: 5022204 - DNA, 15 bp, Homo sapiens
gaaggatctgctgag

SEQ ID NO: 5022205 - DNA, 14 bp, Homo sapiens
gaagggcaagaaat

SEQ ID NO: 5022206 - DNA, 22 bp, Homo sapiens
gaaggggcctcaccgagtgggg

SEQ ID NO: 5022207 - DNA, 15 bp, Homo sapiens
gaagggtcctgccgg

SEQ ID NO: 5022208 - DNA, 20 bp, Homo sapiens
gaaggttctggtgtgaacta

SEQ ID NO: 5022209 - DNA, 21 bp, Homo sapiens
gaagtctctgaagtgaaactg

SEQ ID NO: 5022210 - DNA, 19 bp, Homo sapiens
gaataccactctgtaattg

SEQ ID NO: 5022211 - DNA, 23 bp, Homo sapiens
gaataccactctgtaattgcaaa

SEQ ID NO: 5022212 - DNA, 15 bp, Homo sapiens
gaatacggaagagca

SEQ ID NO: 5022213 - DNA, 20 bp, Homo sapiens
gaataggcattaacacaaag

SEQ ID NO: 5022214 - DNA, 22 bp, Homo sapiens
gaatatacagcaggtgctcaat

SEQ ID NO: 5022215 - DNA, 19 bp, Homo sapiens
gaatatgagctttatgtaa

SEQ ID NO: 5022216 - DNA, 15 bp, Homo sapiens
gaatcagtgcaaaga

SEQ ID NO: 5022217 - DNA, 18 bp, Homo sapiens
gaatgaaatactgtttga

SEQ ID NO: 5022218 - DNA, 19 bp, Homo sapiens
gaatgacggtaagtgttct

SEQ ID NO: 5022219 - DNA, 22 bp, Homo sapiens
gaatgcttctaagtaaatacaa

SEQ ID NO: 5022220 - DNA, 23 bp, Homo sapiens
gaatgcttctaagtaaatacaat

SEQ ID NO: 5022221 - DNA, 15 bp, Homo sapiens
gaatgtgtctttaga

SEQ ID NO: 5022222 - DNA, 14 bp, Homo sapiens
gaatgtttttctaa

SEQ ID NO: 5022223 - DNA, 19 bp, Homo sapiens
gaattattacagtgtttat

SEQ ID NO: 5022224 - DNA, 23 bp, Homo sapiens
gaattgccaggggcgaggccctt

SEQ ID NO: 5022225 - DNA, 17 bp, Homo sapiens
gaatttcccacataccc

SEQ ID NO: 5022226 - DNA, 15 bp, Homo sapiens
gacaaactttgcatc

SEQ ID NO: 5022227 - DNA, 12 bp, Homo sapiens
gacaaagtgcct

SEQ ID NO: 5022228 - DNA, 19 bp, Homo sapiens
gacaagtgactgtatctgt

SEQ ID NO: 5022229 - DNA, 15 bp, Homo sapiens
gacaccagagctgcc

SEQ ID NO: 5022230 - DNA, 16 bp, Homo sapiens
gacacctaactcttct

SEQ ID NO: 5022231 - DNA, 18 bp, Homo sapiens
gacacctaactcttcttt

SEQ ID NO: 5022232 - DNA, 18 bp, Homo sapiens
gacacgggcctgtccaca

SEQ ID NO: 5022233 - DNA, 20 bp, Homo sapiens
gacacgggcctgtccacagg

SEQ ID NO: 5022234 - DNA, 15 bp, Homo sapiens
gacactcagacctga

SEQ ID NO: 5022235 - DNA, 15 bp, Homo sapiens
gacactggcccctca

SEQ ID NO: 5022236 - DNA, 12 bp, Homo sapiens
gacactgttctt

SEQ ID NO: 5022237 - DNA, 16 bp, Homo sapiens
gacagaagcagctctt

SEQ ID NO: 5022238 - DNA, 20 bp, Homo sapiens
gacagcctccccctgtcccc

SEQ ID NO: 5022239 - DNA, 13 bp, Homo sapiens
gacagcgggaaaa

SEQ ID NO: 5022240 - DNA, 13 bp, Homo sapiens
gacagctttctgg

SEQ ID NO: 5022241 - DNA, 13 bp, Homo sapiens
gacaggcagcaga

SEQ ID NO: 5022242 - DNA, 20 bp, Homo sapiens
gacagtgcctcttccagtga

SEQ ID NO: 5022243 - DNA, 14 bp, Homo sapiens
gacatgccctgtgt

SEQ ID NO: 5022244 - DNA, 17 bp, Homo sapiens
gacatgccctgtgtggc

SEQ ID NO: 5022245 - DNA, 12 bp, Homo sapiens
gacattctgaat

SEQ ID NO: 5022246 - DNA, 15 bp, Homo sapiens
gacattctgaatgct

SEQ ID NO: 5022247 - DNA, 14 bp, Homo sapiens
gaccacactccagc

SEQ ID NO: 5022248 - DNA, 18 bp, Homo sapiens
gaccaccccgcctgccct

SEQ ID NO: 5022249 - DNA, 19 bp, Homo sapiens
gaccaccccgcctgccctc

SEQ ID NO: 5022250 - DNA, 14 bp, Homo sapiens
gaccaggctgtgtc

SEQ ID NO: 5022251 - DNA, 13 bp, Homo sapiens
gaccaggggagag

SEQ ID NO: 5022252 - DNA, 16 bp, Homo sapiens
gaccaggggagaggca

SEQ ID NO: 5022253 - DNA, 23 bp, Homo sapiens
gaccccaaacaccttccagctcc

SEQ ID NO: 5022254 - DNA, 17 bp, Homo sapiens
gaccctgtccggcccag

SEQ ID NO: 5022255 - DNA, 12 bp, Homo sapiens
gacctcatgccc

SEQ ID NO: 5022256 - DNA, 19 bp, Homo sapiens
gacctcatgcccagctctc

SEQ ID NO: 5022257 - DNA, 22 bp, Homo sapiens
gacctcatgcccagctctctga

SEQ ID NO: 5022258 - DNA, 20 bp, Homo sapiens
gacctgcactggggagcccg

SEQ ID NO: 5022259 - DNA, 22 bp, Homo sapiens
gacctggcactggatgcagaaa

SEQ ID NO: 5022260 - DNA, 12 bp, Homo sapiens
gaccttcctcat

SEQ ID NO: 5022261 - DNA, 23 bp, Homo sapiens
gaccttcctcatccaccccatcc

SEQ ID NO: 5022262 - DNA, 18 bp, Homo sapiens
gacgcttgtgacagtgcc

SEQ ID NO: 5022263 - DNA, 16 bp, Homo sapiens
gacgttttataagcat

SEQ ID NO: 5022264 - DNA, 22 bp, Homo sapiens
gacgttttataagcatcattat

SEQ ID NO: 5022265 - DNA, 19 bp, Homo sapiens
gactatgaaaatgctggct

SEQ ID NO: 5022266 - DNA, 17 bp, Homo sapiens
gactatgcagaggcctg

SEQ ID NO: 5022267 - DNA, 22 bp, Homo sapiens
gactatttgcttatttaataaa

SEQ ID NO: 5022268 - DNA, 20 bp, Homo sapiens
gactccagcctgcctggcag

SEQ ID NO: 5022269 - DNA, 15 bp, Homo sapiens
gactctattctttaa

SEQ ID NO: 5022270 - DNA, 14 bp, Homo sapiens
gactgattggcctg

SEQ ID NO: 5022271 - DNA, 12 bp, Homo sapiens
gactgcagtgtg

SEQ ID NO: 5022272 - DNA, 15 bp, Homo sapiens
gactgcagtgtggag

SEQ ID NO: 5022273 - DNA, 12 bp, Homo sapiens
gactgggctctg

SEQ ID NO: 5022274 - DNA, 15 bp, Homo sapiens
gactgtatctgtgta

SEQ ID NO: 5022275 - DNA, 17 bp, Homo sapiens
gactgtatctgtgtaga

SEQ ID NO: 5022276 - DNA, 19 bp, Homo sapiens
gactgtatctgtgtagact

SEQ ID NO: 5022277 - DNA, 15 bp, Homo sapiens
gacttaatgtgatta

SEQ ID NO: 5022278 - DNA, 19 bp, Homo sapiens
gacttgagaaacaaataat

SEQ ID NO: 5022279 - DNA, 12 bp, Homo sapiens
gacttgggatgg

SEQ ID NO: 5022280 - DNA, 14 bp, Homo sapiens
gactttaacataag

SEQ ID NO: 5022281 - DNA, 14 bp, Homo sapiens
gactttccattaca

SEQ ID NO: 5022282 - DNA, 13 bp, Homo sapiens
gagaaaaaaacaa

SEQ ID NO: 5022283 - DNA, 23 bp, Homo sapiens
gagaaatagcttatgaaaagaat

SEQ ID NO: 5022284 - DNA, 17 bp, Homo sapiens
gagacactggcccctca

SEQ ID NO: 5022285 - DNA, 17 bp, Homo sapiens
gagaccaggctgtgtcc

SEQ ID NO: 5022286 - DNA, 13 bp, Homo sapiens
gagacccccaggc

SEQ ID NO: 5022287 - DNA, 20 bp, Homo sapiens
gagaccctccccacagtgcc

SEQ ID NO: 5022288 - DNA, 22 bp, Homo sapiens
gagacggcgattttcgggctga

SEQ ID NO: 5022289 - DNA, 23 bp, Homo sapiens
gagactcctggtctgtgaagagc

SEQ ID NO: 5022290 - DNA, 12 bp, Homo sapiens
gagagagaggct

SEQ ID NO: 5022291 - DNA, 14 bp, Homo sapiens
gagagagtttcaaa

SEQ ID NO: 5022292 - DNA, 14 bp, Homo sapiens
gagagtcaaagctg

SEQ ID NO: 5022293 - DNA, 12 bp, Homo sapiens
gagagtttcaaa

SEQ ID NO: 5022294 - DNA, 15 bp, Homo sapiens
gagatagttttcatc

SEQ ID NO: 5022295 - DNA, 19 bp, Homo sapiens
gagatggcagattcccact

SEQ ID NO: 5022296 - DNA, 14 bp, Homo sapiens
gagatgggcttccc

SEQ ID NO: 5022297 - DNA, 16 bp, Homo sapiens
gagatgggcttcccaa

SEQ ID NO: 5022298 - DNA, 17 bp, Homo sapiens
gagatgggcttcccaag

SEQ ID NO: 5022299 - DNA, 16 bp, Homo sapiens
gagcacctgcaggcgt

SEQ ID NO: 5022300 - DNA, 14 bp, Homo sapiens
gagcagcgagcctg

SEQ ID NO: 5022301 - DNA, 23 bp, Homo sapiens
gagcaggtgactgtgctgtgcag

SEQ ID NO: 5022302 - DNA, 20 bp, Homo sapiens
gagcattttgataccagaag

SEQ ID NO: 5022303 - DNA, 11 bp, Homo sapiens
gagccccacct

SEQ ID NO: 5022304 - DNA, 16 bp, Homo sapiens
gagccccagctaccct

SEQ ID NO: 5022305 - DNA, 15 bp, Homo sapiens
gagcccctcggctct

SEQ ID NO: 5022306 - DNA, 18 bp, Homo sapiens
gagcccctcggctctgga

SEQ ID NO: 5022307 - DNA, 22 bp, Homo sapiens
gagcccgcagggccatgcagac

SEQ ID NO: 5022308 - DNA, 16 bp, Homo sapiens
gagcctggtgctgctg

SEQ ID NO: 5022309 - DNA, 23 bp, Homo sapiens
gagccttttccctctttggctcc

SEQ ID NO: 5022310 - DNA, 12 bp, Homo sapiens
gagcgccacctc

SEQ ID NO: 5022311 - DNA, 16 bp, Homo sapiens
gagcgtgaatctgtat

SEQ ID NO: 5022312 - DNA, 23 bp, Homo sapiens
gagctctcaaatccctctccaac

SEQ ID NO: 5022313 - DNA, 18 bp, Homo sapiens
gagctggatagacttggg

SEQ ID NO: 5022314 - DNA, 19 bp, Homo sapiens
gagctggatagacttggga

SEQ ID NO: 5022315 - DNA, 21 bp, Homo sapiens
gagctggatagacttgggatg

SEQ ID NO: 5022316 - DNA, 23 bp, Homo sapiens
gagctggccaaagagcctttcca

SEQ ID NO: 5022317 - DNA, 14 bp, Homo sapiens
gagctgggagaccc

SEQ ID NO: 5022318 - DNA, 13 bp, Homo sapiens
gagctgggcccct

SEQ ID NO: 5022319 - DNA, 15 bp, Homo sapiens
gagctgggcccctgc

SEQ ID NO: 5022320 - DNA, 19 bp, Homo sapiens
gagctgggcccctgcacag

SEQ ID NO: 5022321 - DNA, 15 bp, Homo sapiens
gagcttgctccagat

SEQ ID NO: 5022322 - DNA, 22 bp, Homo sapiens
gagcttgctccagattctgatg

SEQ ID NO: 5022323 - DNA, 13 bp, Homo sapiens
gaggaaaagtgca

SEQ ID NO: 5022324 - DNA, 20 bp, Homo sapiens
gaggacaggcgggaggaggt

SEQ ID NO: 5022325 - DNA, 14 bp, Homo sapiens
gaggagcagctctc

SEQ ID NO: 5022326 - DNA, 14 bp, Homo sapiens
gaggagccccagct

SEQ ID NO: 5022327 - DNA, 14 bp, Homo sapiens
gaggagctgggccc

SEQ ID NO: 5022328 - DNA, 15 bp, Homo sapiens
gaggaggtgtgagga

SEQ ID NO: 5022329 - DNA, 18 bp, Homo sapiens
gaggccaaaggctggtgg

SEQ ID NO: 5022330 - DNA, 13 bp, Homo sapiens
gaggcccggcctc

SEQ ID NO: 5022331 - DNA, 18 bp, Homo sapiens
gaggcccttgtcgtggga

SEQ ID NO: 5022332 - DNA, 18 bp, Homo sapiens
gaggcctgggggacccct

SEQ ID NO: 5022333 - DNA, 21 bp, Homo sapiens
gaggctcaggtgatctgtttg

SEQ ID NO: 5022334 - DNA, 23 bp, Homo sapiens
gagggacatgcttagcagtcccc

SEQ ID NO: 5022335 - DNA, 13 bp, Homo sapiens
gagggcaggcttg

SEQ ID NO: 5022336 - DNA, 19 bp, Homo sapiens
gaggggcagcctgtgcctg

SEQ ID NO: 5022337 - DNA, 21 bp, Homo sapiens
gaggggtgtggctccttccca

SEQ ID NO: 5022338 - DNA, 20 bp, Homo sapiens
gaggtccagccctggctgaa

SEQ ID NO: 5022339 - DNA, 20 bp, Homo sapiens
gaggtgcgtgttcagcagaa

SEQ ID NO: 5022340 - DNA, 12 bp, Homo sapiens
gaggtggagaaa

SEQ ID NO: 5022341 - DNA, 19 bp, Homo sapiens
gaggtttgcagtcccaagc

SEQ ID NO: 5022342 - DNA, 21 bp, Homo sapiens
gagtcaaagctgaccatggat

SEQ ID NO: 5022343 - DNA, 12 bp, Homo sapiens
gagtcacactca

SEQ ID NO: 5022344 - DNA, 13 bp, Homo sapiens
gagtcatttaaat

SEQ ID NO: 5022345 - DNA, 14 bp, Homo sapiens
gagtcctgggaggt

SEQ ID NO: 5022346 - DNA, 22 bp, Homo sapiens
gagtgacagctttctgggatgt

SEQ ID NO: 5022347 - DNA, 20 bp, Homo sapiens
gagtggcgcgcgccaccacg

SEQ ID NO: 5022348 - DNA, 14 bp, Homo sapiens
gagttcaccttgga

SEQ ID NO: 5022349 - DNA, 20 bp, Homo sapiens
gagttcaccttggaagggcg

SEQ ID NO: 5022350 - DNA, 13 bp, Homo sapiens
gatacacacacac

SEQ ID NO: 5022351 - DNA, 19 bp, Homo sapiens
gatacttcgacactgttct

SEQ ID NO: 5022352 - DNA, 19 bp, Homo sapiens
gataggaagaaagaagaca

SEQ ID NO: 5022353 - DNA, 14 bp, Homo sapiens
gatagttttcatcc

SEQ ID NO: 5022354 - DNA, 22 bp, Homo sapiens
gatagttttcatccataactga

SEQ ID NO: 5022355 - DNA, 13 bp, Homo sapiens
gatcacagtggcc

SEQ ID NO: 5022356 - DNA, 21 bp, Homo sapiens
gatcagttaagaaatttcaca

SEQ ID NO: 5022357 - DNA, 15 bp, Homo sapiens
gatcccacacaggct

SEQ ID NO: 5022358 - DNA, 13 bp, Homo sapiens
gatcggcaggaca

SEQ ID NO: 5022359 - DNA, 17 bp, Homo sapiens
gatctgctgaggcccag

SEQ ID NO: 5022360 - DNA, 19 bp, Homo sapiens
gatctttctttccaaaaca

SEQ ID NO: 5022361 - DNA, 13 bp, Homo sapiens
gatctttggacag

SEQ ID NO: 5022362 - DNA, 14 bp, Homo sapiens
gatgcagcttatac

SEQ ID NO: 5022363 - DNA, 20 bp, Homo sapiens
gatgcctgtgaactgaactc

SEQ ID NO: 5022364 - DNA, 21 bp, Homo sapiens
gatgctgggcacttcatctga

SEQ ID NO: 5022365 - DNA, 14 bp, Homo sapiens
gatggagccccacc

SEQ ID NO: 5022366 - DNA, 22 bp, Homo sapiens
gatggcatttggtctcaggcag

SEQ ID NO: 5022367 - DNA, 17 bp, Homo sapiens
gatgggcccctggcccc

SEQ ID NO: 5022368 - DNA, 13 bp, Homo sapiens
gatgggcttccca

SEQ ID NO: 5022369 - DNA, 15 bp, Homo sapiens
gatgggcttcccaag

SEQ ID NO: 5022370 - DNA, 17 bp, Homo sapiens
gatggtagttttttcat

SEQ ID NO: 5022371 - DNA, 20 bp, Homo sapiens
gatgtatgttgaagcctttg

SEQ ID NO: 5022372 - DNA, 13 bp, Homo sapiens
gatgtccccagca

SEQ ID NO: 5022373 - DNA, 20 bp, Homo sapiens
gatgtgcttgttaactgagt

SEQ ID NO: 5022374 - DNA, 13 bp, Homo sapiens
gatgtggggctga

SEQ ID NO: 5022375 - DNA, 19 bp, Homo sapiens
gatgttatgaacagctgtg

SEQ ID NO: 5022376 - DNA, 13 bp, Homo sapiens
gattatcgttttc

SEQ ID NO: 5022377 - DNA, 17 bp, Homo sapiens
gattctttccatttgca

SEQ ID NO: 5022378 - DNA, 18 bp, Homo sapiens
gattctttccatttgcat

SEQ ID NO: 5022379 - DNA, 19 bp, Homo sapiens
gattctttccatttgcatt

SEQ ID NO: 5022380 - DNA, 16 bp, Homo sapiens
gatttaaacacacaga

SEQ ID NO: 5022381 - DNA, 16 bp, Homo sapiens
gatttattaaagaaaa

SEQ ID NO: 5022382 - DNA, 21 bp, Homo sapiens
gatttgtttttaaactgtaca

SEQ ID NO: 5022383 - DNA, 13 bp, Homo sapiens
gattttatgcttt

SEQ ID NO: 5022384 - DNA, 16 bp, Homo sapiens
gatttttaaaatgtac

SEQ ID NO: 5022385 - DNA, 15 bp, Homo sapiens
gcaaaactcacagag

SEQ ID NO: 5022386 - DNA, 12 bp, Homo sapiens
gcaaaagaaaaa

SEQ ID NO: 5022387 - DNA, 22 bp, Homo sapiens
gcaaacccagaggtggatgtta

SEQ ID NO: 5022388 - DNA, 22 bp, Homo sapiens
gcaaactctttggtcgtttttt

SEQ ID NO: 5022389 - DNA, 23 bp, Homo sapiens
gcaaactctttggtcgttttttt

SEQ ID NO: 5022390 - DNA, 16 bp, Homo sapiens
gcaaccgggccctctc

SEQ ID NO: 5022391 - DNA, 20 bp, Homo sapiens
gcaactgctcagctctggtc

SEQ ID NO: 5022392 - DNA, 23 bp, Homo sapiens
gcaagaaatggcgtctgctctgg

SEQ ID NO: 5022393 - DNA, 22 bp, Homo sapiens
gcaagggcacaagtcctggatg

SEQ ID NO: 5022394 - DNA, 18 bp, Homo sapiens
gcaagtctgagggtctgg

SEQ ID NO: 5022395 - DNA, 16 bp, Homo sapiens
gcaatagttttttact

SEQ ID NO: 5022396 - DNA, 23 bp, Homo sapiens
gcaatgtggagcagcagccactg

SEQ ID NO: 5022397 - DNA, 18 bp, Homo sapiens
gcaattcccctctgctgc

SEQ ID NO: 5022398 - DNA, 13 bp, Homo sapiens
gcacacaggacag

SEQ ID NO: 5022399 - DNA, 19 bp, Homo sapiens
gcacacagggcccggccac

SEQ ID NO: 5022400 - DNA, 20 bp, Homo sapiens
gcacacagggcccggccaca

SEQ ID NO: 5022401 - DNA, 23 bp, Homo sapiens
gcacacagggcccggccacaccc

SEQ ID NO: 5022402 - DNA, 22 bp, Homo sapiens
gcacagcacaaattagttatat

SEQ ID NO: 5022403 - DNA, 16 bp, Homo sapiens
gcacagccacccgtgg

SEQ ID NO: 5022404 - DNA, 23 bp, Homo sapiens
gcacagccacccgtggggtgctg

SEQ ID NO: 5022405 - DNA, 13 bp, Homo sapiens
gcacaggaggagg

SEQ ID NO: 5022406 - DNA, 12 bp, Homo sapiens
gcaccaaagaca

SEQ ID NO: 5022407 - DNA, 22 bp, Homo sapiens
gcaccaaagacatcagtctcca

SEQ ID NO: 5022408 - DNA, 23 bp, Homo sapiens
gcaccacactgggtgcgtctcca

SEQ ID NO: 5022409 - DNA, 12 bp, Homo sapiens
gcaccagccagc

SEQ ID NO: 5022410 - DNA, 19 bp, Homo sapiens
gcaccagccagcgtagcag

SEQ ID NO: 5022411 - DNA, 13 bp, Homo sapiens
gcacccacctgtt

SEQ ID NO: 5022412 - DNA, 16 bp, Homo sapiens
gcaccctaggcagcct

SEQ ID NO: 5022413 - DNA, 14 bp, Homo sapiens
gcacctcggggaca

SEQ ID NO: 5022414 - DNA, 15 bp, Homo sapiens
gcacgcgtgtgcagg

SEQ ID NO: 5022415 - DNA, 19 bp, Homo sapiens
gcactaacgttgagcccct

SEQ ID NO: 5022416 - DNA, 20 bp, Homo sapiens
gcactaacgttgagcccctg

SEQ ID NO: 5022417 - DNA, 14 bp, Homo sapiens
gcactctgccccca

SEQ ID NO: 5022418 - DNA, 19 bp, Homo sapiens
gcactgcctgctcccatcc

SEQ ID NO: 5022419 - DNA, 18 bp, Homo sapiens
gcactggggagcccgtct

SEQ ID NO: 5022420 - DNA, 17 bp, Homo sapiens
gcactttgctttaatat

SEQ ID NO: 5022421 - DNA, 20 bp, Homo sapiens
gcactttgctttaatataaa

SEQ ID NO: 5022422 - DNA, 21 bp, Homo sapiens
gcactttgctttaatataaat

SEQ ID NO: 5022423 - DNA, 23 bp, Homo sapiens
gcagaacaggtagtattacacca

SEQ ID NO: 5022424 - DNA, 15 bp, Homo sapiens
gcagaacctgcacac

SEQ ID NO: 5022425 - DNA, 16 bp, Homo sapiens
gcagaagacaaaaaga

SEQ ID NO: 5022426 - DNA, 13 bp, Homo sapiens
gcagaccaccccg

SEQ ID NO: 5022427 - DNA, 21 bp, Homo sapiens
gcagaccaccccgcctgccct

SEQ ID NO: 5022428 - DNA, 14 bp, Homo sapiens
gcagacctcatgcc

SEQ ID NO: 5022429 - DNA, 21 bp, Homo sapiens
gcagagaggtttgcagtccca

SEQ ID NO: 5022430 - DNA, 16 bp, Homo sapiens
gcagaggatgttcata

SEQ ID NO: 5022431 - DNA, 21 bp, Homo sapiens
gcagaggcagtacctgggcaa

SEQ ID NO: 5022432 - DNA, 15 bp, Homo sapiens
gcagcaccacactgg

SEQ ID NO: 5022433 - DNA, 19 bp, Homo sapiens
gcagccacccaagcctgct

SEQ ID NO: 5022434 - DNA, 22 bp, Homo sapiens
gcagccacccaagcctgctggc

SEQ ID NO: 5022435 - DNA, 15 bp, Homo sapiens
gcagcctgtgcctgc

SEQ ID NO: 5022436 - DNA, 14 bp, Homo sapiens
gcagcgaccgcccc

SEQ ID NO: 5022437 - DNA, 16 bp, Homo sapiens
gcagcgtgtgggtccc

SEQ ID NO: 5022438 - DNA, 23 bp, Homo sapiens
gcagctcaagcagcgaccgcccc

SEQ ID NO: 5022439 - DNA, 21 bp, Homo sapiens
gcagctgccaggagcacggct

SEQ ID NO: 5022440 - DNA, 15 bp, Homo sapiens
gcagctgctccccag

SEQ ID NO: 5022441 - DNA, 17 bp, Homo sapiens
gcagctgttttgttgac

SEQ ID NO: 5022442 - DNA, 16 bp, Homo sapiens
gcaggaactgggctgg

SEQ ID NO: 5022443 - DNA, 19 bp, Homo sapiens
gcaggaactgggctgggcc

SEQ ID NO: 5022444 - DNA, 19 bp, Homo sapiens
gcaggactttgaggcaagt

SEQ ID NO: 5022445 - DNA, 21 bp, Homo sapiens
gcaggagcggcagatggggag

SEQ ID NO: 5022446 - DNA, 21 bp, Homo sapiens
gcaggccacacttcaaactac

SEQ ID NO: 5022447 - DNA, 15 bp, Homo sapiens
gcaggcttggggaaa

SEQ ID NO: 5022448 - DNA, 21 bp, Homo sapiens
gcaggcttggggaaaatggcc

SEQ ID NO: 5022449 - DNA, 15 bp, Homo sapiens
gcagggccatgcaga

SEQ ID NO: 5022450 - DNA, 16 bp, Homo sapiens
gcagggccatgcagac

SEQ ID NO: 5022451 - DNA, 19 bp, Homo sapiens
gcagtacctgggcaagctg

SEQ ID NO: 5022452 - DNA, 14 bp, Homo sapiens
gcagtccccttccc

SEQ ID NO: 5022453 - DNA, 13 bp, Homo sapiens
gcagttatatttt

SEQ ID NO: 5022454 - DNA, 21 bp, Homo sapiens
gcagttcccacattaaagaag

SEQ ID NO: 5022455 - DNA, 11 bp, Homo sapiens
gcagttttttt

SEQ ID NO: 5022456 - DNA, 23 bp, Homo sapiens
gcagttttttttttcttgtctat

SEQ ID NO: 5022457 - DNA, 21 bp, Homo sapiens
gcataggtgatctcatttaat

SEQ ID NO: 5022458 - DNA, 21 bp, Homo sapiens
gcatatttattgcattgctgg

SEQ ID NO: 5022459 - DNA, 17 bp, Homo sapiens
gcatcattatttatgta

SEQ ID NO: 5022460 - DNA, 17 bp, Homo sapiens
gcatctcagtatgaatt

SEQ ID NO: 5022461 - DNA, 19 bp, Homo sapiens
gcatggaaatttaaagcag

SEQ ID NO: 5022462 - DNA, 11 bp, Homo sapiens
gcatggaaggg

SEQ ID NO: 5022463 - DNA, 14 bp, Homo sapiens
gcatggaaggggct

SEQ ID NO: 5022464 - DNA, 18 bp, Homo sapiens
gcatggaaggggcttctg

SEQ ID NO: 5022465 - DNA, 13 bp, Homo sapiens
gcatgtcccaccc

SEQ ID NO: 5022466 - DNA, 17 bp, Homo sapiens
gcatgtcccacccaccc

SEQ ID NO: 5022467 - DNA, 13 bp, Homo sapiens
gcatgtgatctcc

SEQ ID NO: 5022468 - DNA, 15 bp, Homo sapiens
gcatgtttccagcag

SEQ ID NO: 5022469 - DNA, 18 bp, Homo sapiens
gcattctcattggaaatt

SEQ ID NO: 5022470 - DNA, 17 bp, Homo sapiens
gcatttcaattcctggc

SEQ ID NO: 5022471 - DNA, 17 bp, Homo sapiens
gcatttggtctcaggca

SEQ ID NO: 5022472 - DNA, 19 bp, Homo sapiens
gcatttggtctcaggcagc

SEQ ID NO: 5022473 - DNA, 21 bp, Homo sapiens
gcatttggtgagagtcaaagc

SEQ ID NO: 5022474 - DNA, 20 bp, Homo sapiens
gcatttgtttatgtaatttc

SEQ ID NO: 5022475 - DNA, 15 bp, Homo sapiens
gccaaagagcctttc

SEQ ID NO: 5022476 - DNA, 16 bp, Homo sapiens
gccaaagagcctttcc

SEQ ID NO: 5022477 - DNA, 20 bp, Homo sapiens
gccaaaggctggtggcaagt

SEQ ID NO: 5022478 - DNA, 21 bp, Homo sapiens
gccaaattaaaaaagataaac

SEQ ID NO: 5022479 - DNA, 18 bp, Homo sapiens
gccaacggcaacagcatg

SEQ ID NO: 5022480 - DNA, 17 bp, Homo sapiens
gccaactggtgtttgaa

SEQ ID NO: 5022481 - DNA, 15 bp, Homo sapiens
gccaagactcctcag

SEQ ID NO: 5022482 - DNA, 21 bp, Homo sapiens
gccaagatcacagtggccacg

SEQ ID NO: 5022483 - DNA, 12 bp, Homo sapiens
gccacacccagc

SEQ ID NO: 5022484 - DNA, 17 bp, Homo sapiens
gccacacccagcggccc

SEQ ID NO: 5022485 - DNA, 17 bp, Homo sapiens
gccacagtcatggtggc

SEQ ID NO: 5022486 - DNA, 18 bp, Homo sapiens
gccacccaagcctgctgg

SEQ ID NO: 5022487 - DNA, 20 bp, Homo sapiens
gccacccaagcctgctggct

SEQ ID NO: 5022488 - DNA, 22 bp, Homo sapiens
gccacccatgcagctgctcccc

SEQ ID NO: 5022489 - DNA, 22 bp, Homo sapiens
gccacccgtggggtgctgccct

SEQ ID NO: 5022490 - DNA, 13 bp, Homo sapiens
gccaccctgcccc

SEQ ID NO: 5022491 - DNA, 20 bp, Homo sapiens
gccaccggaggtcactccac

SEQ ID NO: 5022492 - DNA, 15 bp, Homo sapiens
gccacggccacagtc

SEQ ID NO: 5022493 - DNA, 22 bp, Homo sapiens
gccactaaccttgcctggtaca

SEQ ID NO: 5022494 - DNA, 13 bp, Homo sapiens
gccactgcccccc

SEQ ID NO: 5022495 - DNA, 18 bp, Homo sapiens
gccactgccccccgaggc

SEQ ID NO: 5022496 - DNA, 16 bp, Homo sapiens
gccactgtggtggcag

SEQ ID NO: 5022497 - DNA, 21 bp, Homo sapiens
gccagagagcctggtgctgct

SEQ ID NO: 5022498 - DNA, 17 bp, Homo sapiens
gccagagccttaataaa

SEQ ID NO: 5022499 - DNA, 16 bp, Homo sapiens
gccagccaggccctgc

SEQ ID NO: 5022500 - DNA, 10 bp, Homo sapiens
gccagcccct

SEQ ID NO: 5022501 - DNA, 23 bp, Homo sapiens
gccagctacttcctcctccccac

SEQ ID NO: 5022502 - DNA, 19 bp, Homo sapiens
gccagctcacagtgctgtg

SEQ ID NO: 5022503 - DNA, 17 bp, Homo sapiens
gccagctgccccagcca

SEQ ID NO: 5022504 - DNA, 18 bp, Homo sapiens
gccagctgccccagccag

SEQ ID NO: 5022505 - DNA, 19 bp, Homo sapiens
gccaggagcacggctctgt

SEQ ID NO: 5022506 - DNA, 15 bp, Homo sapiens
gccagtattttaaaa

SEQ ID NO: 5022507 - DNA, 16 bp, Homo sapiens
gccatattaaattttt

SEQ ID NO: 5022508 - DNA, 23 bp, Homo sapiens
gccatattaaattttttgttgac

SEQ ID NO: 5022509 - DNA, 15 bp, Homo sapiens
gccatccattctgga

SEQ ID NO: 5022510 - DNA, 22 bp, Homo sapiens
gccatgcagacctcatgcccag

SEQ ID NO: 5022511 - DNA, 13 bp, Homo sapiens
gccatgcaggagg

SEQ ID NO: 5022512 - DNA, 14 bp, Homo sapiens
gccatggcctctgc

SEQ ID NO: 5022513 - DNA, 15 bp, Homo sapiens
gccatgtactagttt

SEQ ID NO: 5022514 - DNA, 18 bp, Homo sapiens
gccattccccgtctctgg

SEQ ID NO: 5022515 - DNA, 22 bp, Homo sapiens
gcccacaccagggcctggctgg

SEQ ID NO: 5022516 - DNA, 19 bp, Homo sapiens
gcccacttacatttacaaa

SEQ ID NO: 5022517 - DNA, 16 bp, Homo sapiens
gcccagaccggcttct

SEQ ID NO: 5022518 - DNA, 15 bp, Homo sapiens
gcccagctctctgac

SEQ ID NO: 5022519 - DNA, 14 bp, Homo sapiens
gccccactctgcct

SEQ ID NO: 5022520 - DNA, 17 bp, Homo sapiens
gccccactctgcctgcc

SEQ ID NO: 5022521 - DNA, 16 bp, Homo sapiens
gccccccgaggctgct

SEQ ID NO: 5022522 - DNA, 19 bp, Homo sapiens
gccccccgcacagccaccc

SEQ ID NO: 5022523 - DNA, 19 bp, Homo sapiens
gccccctcctctagctgtg

SEQ ID NO: 5022524 - DNA, 20 bp, Homo sapiens
gccccctcctctagctgtgg

SEQ ID NO: 5022525 - DNA, 21 bp, Homo sapiens
gccccctcctctagctgtggg

SEQ ID NO: 5022526 - DNA, 16 bp, Homo sapiens
gcccctgcacaggcac

SEQ ID NO: 5022527 - DNA, 20 bp, Homo sapiens
gcccctgctgtctctctggg

SEQ ID NO: 5022528 - DNA, 21 bp, Homo sapiens
gcccctgctgtctctctgggc

SEQ ID NO: 5022529 - DNA, 22 bp, Homo sapiens
gcccctggccccgcctgcctgc

SEQ ID NO: 5022530 - DNA, 14 bp, Homo sapiens
gccccttcctttaa

SEQ ID NO: 5022531 - DNA, 15 bp, Homo sapiens
gccccttggacacgc

SEQ ID NO: 5022532 - DNA, 13 bp, Homo sapiens
gcccctttataaa

SEQ ID NO: 5022533 - DNA, 21 bp, Homo sapiens
gcccgaatacaaacacctgga

SEQ ID NO: 5022534 - DNA, 20 bp, Homo sapiens
gcccgcaggaactgggctgg

SEQ ID NO: 5022535 - DNA, 23 bp, Homo sapiens
gcccgcaggaactgggctgggcc

SEQ ID NO: 5022536 - DNA, 22 bp, Homo sapiens
gcccgcagggccatgcagacct

SEQ ID NO: 5022537 - DNA, 16 bp, Homo sapiens
gcccggcgccgggcac

SEQ ID NO: 5022538 - DNA, 21 bp, Homo sapiens
gcccggcgccgggcaccaact

SEQ ID NO: 5022539 - DNA, 16 bp, Homo sapiens
gcccgtgcccgcagga

SEQ ID NO: 5022540 - DNA, 23 bp, Homo sapiens
gcccgtggggtctgcgcttggtc

SEQ ID NO: 5022541 - DNA, 16 bp, Homo sapiens
gccctcatggcccctc

SEQ ID NO: 5022542 - DNA, 17 bp, Homo sapiens
gccctctctctgcggca

SEQ ID NO: 5022543 - DNA, 15 bp, Homo sapiens
gccctgccctggcag

SEQ ID NO: 5022544 - DNA, 14 bp, Homo sapiens
gccctggctgaagg

SEQ ID NO: 5022545 - DNA, 16 bp, Homo sapiens
gccctggctgaaggac

SEQ ID NO: 5022546 - DNA, 17 bp, Homo sapiens
gccctggtcctggcctc

SEQ ID NO: 5022547 - DNA, 15 bp, Homo sapiens
gccgaaccaaaagaa

SEQ ID NO: 5022548 - DNA, 15 bp, Homo sapiens
gccgcacgcctctcc

SEQ ID NO: 5022549 - DNA, 16 bp, Homo sapiens
gccgccagctgccgca

SEQ ID NO: 5022550 - DNA, 17 bp, Homo sapiens
gccgccagctgccgcac

SEQ ID NO: 5022551 - DNA, 17 bp, Homo sapiens
gccgccccctgcccccc

SEQ ID NO: 5022552 - DNA, 13 bp, Homo sapiens
gccgcctcccacg

SEQ ID NO: 5022553 - DNA, 19 bp, Homo sapiens
gccgggaccccgagcctgg

SEQ ID NO: 5022554 - DNA, 23 bp, Homo sapiens
gccgggaccccgagcctggctcc

SEQ ID NO: 5022555 - DNA, 15 bp, Homo sapiens
gccggggcagccccc

SEQ ID NO: 5022556 - DNA, 15 bp, Homo sapiens
gcctcaaaggcccgc

SEQ ID NO: 5022557 - DNA, 12 bp, Homo sapiens
gcctcctcatcc

SEQ ID NO: 5022558 - DNA, 17 bp, Homo sapiens
gcctctcccctgcctgc

SEQ ID NO: 5022559 - DNA, 20 bp, Homo sapiens
gcctctgcaactgctcagct

SEQ ID NO: 5022560 - DNA, 19 bp, Homo sapiens
gcctctgctgatcctccca

SEQ ID NO: 5022561 - DNA, 14 bp, Homo sapiens
gcctcttccagtga

SEQ ID NO: 5022562 - DNA, 19 bp, Homo sapiens
gcctgcagggaataacata

SEQ ID NO: 5022563 - DNA, 20 bp, Homo sapiens
gcctgcctatgaaatttcaa

SEQ ID NO: 5022564 - DNA, 21 bp, Homo sapiens
gcctgctcccatcctgtgtgt

SEQ ID NO: 5022565 - DNA, 13 bp, Homo sapiens
gcctgctggctgc

SEQ ID NO: 5022566 - DNA, 14 bp, Homo sapiens
gcctgctggctgcg

SEQ ID NO: 5022567 - DNA, 19 bp, Homo sapiens
gcctgctggctgcggcccc

SEQ ID NO: 5022568 - DNA, 12 bp, Homo sapiens
gcctggcctgat

SEQ ID NO: 5022569 - DNA, 16 bp, Homo sapiens
gcctgggaaagcccct

SEQ ID NO: 5022570 - DNA, 18 bp, Homo sapiens
gcctgggaaagcccctgc

SEQ ID NO: 5022571 - DNA, 13 bp, Homo sapiens
gcctggtgctgct

SEQ ID NO: 5022572 - DNA, 20 bp, Homo sapiens
gcctgtccacaggcttctga

SEQ ID NO: 5022573 - DNA, 18 bp, Homo sapiens
gcctgtccaccctgccaa

SEQ ID NO: 5022574 - DNA, 17 bp, Homo sapiens
gcctgtgaactgaactc

SEQ ID NO: 5022575 - DNA, 18 bp, Homo sapiens
gccttagtctcagtttgt

SEQ ID NO: 5022576 - DNA, 13 bp, Homo sapiens
gccttttccctct

SEQ ID NO: 5022577 - DNA, 15 bp, Homo sapiens
gcgaccgccccctcc

SEQ ID NO: 5022578 - DNA, 17 bp, Homo sapiens
gcgagagagtttcaaaa

SEQ ID NO: 5022579 - DNA, 19 bp, Homo sapiens
gcgagcccctcggctctgg

SEQ ID NO: 5022580 - DNA, 23 bp, Homo sapiens
gcgagctctcaaatccctctcca

SEQ ID NO: 5022581 - DNA, 22 bp, Homo sapiens
gcgcagttttttttttcttgtc

SEQ ID NO: 5022582 - DNA, 12 bp, Homo sapiens
gcgcctgtgacc

SEQ ID NO: 5022583 - DNA, 18 bp, Homo sapiens
gcgctgtttttgttgtgt

SEQ ID NO: 5022584 - DNA, 18 bp, Homo sapiens
gcggccccccgcacagcc

SEQ ID NO: 5022585 - DNA, 22 bp, Homo sapiens
gcggccccctctcggccaggca

SEQ ID NO: 5022586 - DNA, 17 bp, Homo sapiens
gcggctggggtcccagc

SEQ ID NO: 5022587 - DNA, 18 bp, Homo sapiens
gcggctggggtcccagca

SEQ ID NO: 5022588 - DNA, 20 bp, Homo sapiens
gcggctggggtcccagcagc

SEQ ID NO: 5022589 - DNA, 14 bp, Homo sapiens
gcgggacacaggct

SEQ ID NO: 5022590 - DNA, 23 bp, Homo sapiens
gcggttatgaaattcaccccctt

SEQ ID NO: 5022591 - DNA, 20 bp, Homo sapiens
gcgtagcgtgcccgtgtgca

SEQ ID NO: 5022592 - DNA, 12 bp, Homo sapiens
gcgtgagcttaa

SEQ ID NO: 5022593 - DNA, 23 bp, Homo sapiens
gcgtgagcttaaaatacaagact

SEQ ID NO: 5022594 - DNA, 11 bp, Homo sapiens
gcgttcttgta

SEQ ID NO: 5022595 - DNA, 17 bp, Homo sapiens
gcgttcttgtaatttta

SEQ ID NO: 5022596 - DNA, 19 bp, Homo sapiens
gcgttgttgcatgtttgaa

SEQ ID NO: 5022597 - DNA, 12 bp, Homo sapiens
gctaaataaaca

SEQ ID NO: 5022598 - DNA, 21 bp, Homo sapiens
gctaataaaaagcttttgtct

SEQ ID NO: 5022599 - DNA, 18 bp, Homo sapiens
gctaccctttttctccag

SEQ ID NO: 5022600 - DNA, 20 bp, Homo sapiens
gctaccctttttctccagct

SEQ ID NO: 5022601 - DNA, 14 bp, Homo sapiens
gctaccgttgactt

SEQ ID NO: 5022602 - DNA, 12 bp, Homo sapiens
gctagtcttttg

SEQ ID NO: 5022603 - DNA, 16 bp, Homo sapiens
gctatagatgtctttt

SEQ ID NO: 5022604 - DNA, 21 bp, Homo sapiens
gctatagatgtcttttcccat

SEQ ID NO: 5022605 - DNA, 22 bp, Homo sapiens
gctcaagcagcgaccgccccct

SEQ ID NO: 5022606 - DNA, 14 bp, Homo sapiens
gctcaatgagcatg

SEQ ID NO: 5022607 - DNA, 19 bp, Homo sapiens
gctcaatgagcatgtttag

SEQ ID NO: 5022608 - DNA, 20 bp, Homo sapiens
gctcaatgagcatgtttaga

SEQ ID NO: 5022609 - DNA, 17 bp, Homo sapiens
gctcaatggactggaag

SEQ ID NO: 5022610 - DNA, 13 bp, Homo sapiens
gctcactcacccc

SEQ ID NO: 5022611 - DNA, 18 bp, Homo sapiens
gctcagcactgcctgctc

SEQ ID NO: 5022612 - DNA, 19 bp, Homo sapiens
gctcagcactgcctgctcc

SEQ ID NO: 5022613 - DNA, 20 bp, Homo sapiens
gctcagcactgcctgctccc

SEQ ID NO: 5022614 - DNA, 18 bp, Homo sapiens
gctcagcccgctgagtgg

SEQ ID NO: 5022615 - DNA, 14 bp, Homo sapiens
gctcagctctggtc

SEQ ID NO: 5022616 - DNA, 16 bp, Homo sapiens
gctccaaaccccaggg

SEQ ID NO: 5022617 - DNA, 19 bp, Homo sapiens
gctccaaaccctcgaggcg

SEQ ID NO: 5022618 - DNA, 17 bp, Homo sapiens
gctccagattctgatgc

SEQ ID NO: 5022619 - DNA, 15 bp, Homo sapiens
gctccaggtggctct

SEQ ID NO: 5022620 - DNA, 18 bp, Homo sapiens
gctccaggtggctctgag

SEQ ID NO: 5022621 - DNA, 14 bp, Homo sapiens
gctccccatgtgtc

SEQ ID NO: 5022622 - DNA, 15 bp, Homo sapiens
gctccgaaattccaa

SEQ ID NO: 5022623 - DNA, 20 bp, Homo sapiens
gctccgaaattccaaggccc

SEQ ID NO: 5022624 - DNA, 21 bp, Homo sapiens
gctctctgtaggcacagagct

SEQ ID NO: 5022625 - DNA, 18 bp, Homo sapiens
gctctgcaattcccctct

SEQ ID NO: 5022626 - DNA, 16 bp, Homo sapiens
gctctggtccaggccc

SEQ ID NO: 5022627 - DNA, 22 bp, Homo sapiens
gctctggtggcttaagtgagca

SEQ ID NO: 5022628 - DNA, 15 bp, Homo sapiens
gctctgtgggtctct

SEQ ID NO: 5022629 - DNA, 19 bp, Homo sapiens
gctcttgatacccccctct

SEQ ID NO: 5022630 - DNA, 23 bp, Homo sapiens
gctcttgatacccccctctgtct

SEQ ID NO: 5022631 - DNA, 18 bp, Homo sapiens
gctcttggtacctgtggg

SEQ ID NO: 5022632 - DNA, 21 bp, Homo sapiens
gctgaacactccaattaagga

SEQ ID NO: 5022633 - DNA, 23 bp, Homo sapiens
gctgaacactccaattaaggatt

SEQ ID NO: 5022634 - DNA, 13 bp, Homo sapiens
gctgaaggactgt

SEQ ID NO: 5022635 - DNA, 13 bp, Homo sapiens
gctgaatgttttt

SEQ ID NO: 5022636 - DNA, 14 bp, Homo sapiens
gctgagcaggccac

SEQ ID NO: 5022637 - DNA, 13 bp, Homo sapiens
gctgaggcccagt

SEQ ID NO: 5022638 - DNA, 13 bp, Homo sapiens
gctgccaggagca

SEQ ID NO: 5022639 - DNA, 16 bp, Homo sapiens
gctgccccagccagat

SEQ ID NO: 5022640 - DNA, 20 bp, Homo sapiens
gctgcccgctcagcccagct

SEQ ID NO: 5022641 - DNA, 16 bp, Homo sapiens
gctgccgcaccagccc

SEQ ID NO: 5022642 - DNA, 19 bp, Homo sapiens
gctgccggggcagccccct

SEQ ID NO: 5022643 - DNA, 18 bp, Homo sapiens
gctgctaatattttcctc

SEQ ID NO: 5022644 - DNA, 21 bp, Homo sapiens
gctgctaatattttcctcctg

SEQ ID NO: 5022645 - DNA, 24 bp, Homo sapiens
gctgctaatattttcctcctgagt

SEQ ID NO: 5022646 - DNA, 15 bp, Homo sapiens
gctgctgtccctccc

SEQ ID NO: 5022647 - DNA, 15 bp, Homo sapiens
gctgcttccaggctg

SEQ ID NO: 5022648 - DNA, 18 bp, Homo sapiens
gctgcttccaggctgggc

SEQ ID NO: 5022649 - DNA, 20 bp, Homo sapiens
gctgcttcccagaggagcag

SEQ ID NO: 5022650 - DNA, 16 bp, Homo sapiens
gctggatagacttggg

SEQ ID NO: 5022651 - DNA, 14 bp, Homo sapiens
gctggctgcggccc

SEQ ID NO: 5022652 - DNA, 17 bp, Homo sapiens
gctggctgcggccccct

SEQ ID NO: 5022653 - DNA, 18 bp, Homo sapiens
gctgggaattacaggcgt

SEQ ID NO: 5022654 - DNA, 20 bp, Homo sapiens
gctgggcccctgcacaggca

SEQ ID NO: 5022655 - DNA, 13 bp, Homo sapiens
gctgggctctgca

SEQ ID NO: 5022656 - DNA, 23 bp, Homo sapiens
gctggggacctggtaccctcctg

SEQ ID NO: 5022657 - DNA, 16 bp, Homo sapiens
gctggggtcccagcag

SEQ ID NO: 5022658 - DNA, 17 bp, Homo sapiens
gctgggtggtaccctct

SEQ ID NO: 5022659 - DNA, 13 bp, Homo sapiens
gctgtcacaggcg

SEQ ID NO: 5022660 - DNA, 16 bp, Homo sapiens
gctgtgcagctctcta

SEQ ID NO: 5022661 - DNA, 21 bp, Homo sapiens
gctgtggccgcacgcctctcc

SEQ ID NO: 5022662 - DNA, 13 bp, Homo sapiens
gctgtgtctgcca

SEQ ID NO: 5022663 - DNA, 14 bp, Homo sapiens
gctgtgtctgccaa

SEQ ID NO: 5022664 - DNA, 21 bp, Homo sapiens
gctgtgtctgccaaacacatt

SEQ ID NO: 5022665 - DNA, 14 bp, Homo sapiens
gctgttttgttata

SEQ ID NO: 5022666 - DNA, 16 bp, Homo sapiens
gctgttttgttatata

SEQ ID NO: 5022667 - DNA, 15 bp, Homo sapiens
gctgtttttgttgtg

SEQ ID NO: 5022668 - DNA, 20 bp, Homo sapiens
gcttaagtgagcagaacagg

SEQ ID NO: 5022669 - DNA, 18 bp, Homo sapiens
gcttatacgaaataattg

SEQ ID NO: 5022670 - DNA, 14 bp, Homo sapiens
gcttcatgccagct

SEQ ID NO: 5022671 - DNA, 15 bp, Homo sapiens
gcttcattctccttg

SEQ ID NO: 5022672 - DNA, 15 bp, Homo sapiens
gcttccaggctgggc

SEQ ID NO: 5022673 - DNA, 19 bp, Homo sapiens
gcttccaggctgggcagca

SEQ ID NO: 5022674 - DNA, 18 bp, Homo sapiens
gcttcccaagggctgccg

SEQ ID NO: 5022675 - DNA, 21 bp, Homo sapiens
gcttctaagtaaatacaattt

SEQ ID NO: 5022676 - DNA, 21 bp, Homo sapiens
gcttctgagcagcgagcctgc

SEQ ID NO: 5022677 - DNA, 12 bp, Homo sapiens
gcttctgcctgc

SEQ ID NO: 5022678 - DNA, 22 bp, Homo sapiens
gcttgccccactctgcctgcct

SEQ ID NO: 5022679 - DNA, 12 bp, Homo sapiens
gcttgctccaga

SEQ ID NO: 5022680 - DNA, 21 bp, Homo sapiens
gcttggaacccggtgctccct

SEQ ID NO: 5022681 - DNA, 12 bp, Homo sapiens
gcttggggaaaa

SEQ ID NO: 5022682 - DNA, 12 bp, Homo sapiens
gcttgtgacagt

SEQ ID NO: 5022683 - DNA, 14 bp, Homo sapiens
gctttaatataaat

SEQ ID NO: 5022684 - DNA, 15 bp, Homo sapiens
gctttaatataaatg

SEQ ID NO: 5022685 - DNA, 16 bp, Homo sapiens
gctttaatataaatgc

SEQ ID NO: 5022686 - DNA, 21 bp, Homo sapiens
gctttaatataaatgcaaata

SEQ ID NO: 5022687 - DNA, 18 bp, Homo sapiens
gctttctatgctgtttgt

SEQ ID NO: 5022688 - DNA, 22 bp, Homo sapiens
gctttctgggatgtcacagtcc

SEQ ID NO: 5022689 - DNA, 13 bp, Homo sapiens
gcttttcaaacaa

SEQ ID NO: 5022690 - DNA, 18 bp, Homo sapiens
gcttttcatgcaaactct

SEQ ID NO: 5022691 - DNA, 17 bp, Homo sapiens
ggaaaatggccatgcag

SEQ ID NO: 5022692 - DNA, 19 bp, Homo sapiens
ggaaaggattttaccaaag

SEQ ID NO: 5022693 - DNA, 14 bp, Homo sapiens
ggaaatttagcatt

SEQ ID NO: 5022694 - DNA, 18 bp, Homo sapiens
ggaacaaggagtcagaca

SEQ ID NO: 5022695 - DNA, 12 bp, Homo sapiens
ggaactgggctg

SEQ ID NO: 5022696 - DNA, 20 bp, Homo sapiens
ggaagagcaggtgactgtgc

SEQ ID NO: 5022697 - DNA, 20 bp, Homo sapiens
ggaagcatattgttattata

SEQ ID NO: 5022698 - DNA, 23 bp, Homo sapiens
ggaagccatccctttttttacat

SEQ ID NO: 5022699 - DNA, 14 bp, Homo sapiens
ggaagcctgcagtc

SEQ ID NO: 5022700 - DNA, 15 bp, Homo sapiens
ggaagctagtctttt

SEQ ID NO: 5022701 - DNA, 17 bp, Homo sapiens
ggaaggatctgctgagg

SEQ ID NO: 5022702 - DNA, 19 bp, Homo sapiens
ggaaggatctgctgaggcc

SEQ ID NO: 5022703 - DNA, 23 bp, Homo sapiens
ggacacgctcagtggggcagagg

SEQ ID NO: 5022704 - DNA, 15 bp, Homo sapiens
ggacagcccctcctc

SEQ ID NO: 5022705 - DNA, 15 bp, Homo sapiens
ggacatgccctgtgt

SEQ ID NO: 5022706 - DNA, 17 bp, Homo sapiens
ggacccagcgggcaggt

SEQ ID NO: 5022707 - DNA, 20 bp, Homo sapiens
ggaccccgtttcatttttac

SEQ ID NO: 5022708 - DNA, 14 bp, Homo sapiens
ggacccctggctct

SEQ ID NO: 5022709 - DNA, 22 bp, Homo sapiens
ggaccctgtccggcccagtgcc

SEQ ID NO: 5022710 - DNA, 17 bp, Homo sapiens
ggacctggtaccctcct

SEQ ID NO: 5022711 - DNA, 16 bp, Homo sapiens
ggactgctcaggaaac

SEQ ID NO: 5022712 - DNA, 21 bp, Homo sapiens
ggactgtgacaggcagcagag

SEQ ID NO: 5022713 - DNA, 22 bp, Homo sapiens
ggacttagaaaaccagctcagc

SEQ ID NO: 5022714 - DNA, 13 bp, Homo sapiens
ggagaagggctgg

SEQ ID NO: 5022715 - DNA, 20 bp, Homo sapiens
ggagacactggcccctcaaa

SEQ ID NO: 5022716 - DNA, 15 bp, Homo sapiens
ggagaccctccccac

SEQ ID NO: 5022717 - DNA, 15 bp, Homo sapiens
ggagcagaccacccc

SEQ ID NO: 5022718 - DNA, 17 bp, Homo sapiens
ggagccccagctaccct

SEQ ID NO: 5022719 - DNA, 12 bp, Homo sapiens
ggagctgggaga

SEQ ID NO: 5022720 - DNA, 17 bp, Homo sapiens
ggagctgggcccctgca

SEQ ID NO: 5022721 - DNA, 19 bp, Homo sapiens
ggaggcccttgtcgtggga

SEQ ID NO: 5022722 - DNA, 11 bp, Homo sapiens
ggaggctctct

SEQ ID NO: 5022723 - DNA, 18 bp, Homo sapiens
ggagggcaggcttgggga

SEQ ID NO: 5022724 - DNA, 15 bp, Homo sapiens
ggaggtcactccacc

SEQ ID NO: 5022725 - DNA, 20 bp, Homo sapiens
ggaggtgcgtgttcagcaga

SEQ ID NO: 5022726 - DNA, 12 bp, Homo sapiens
ggaggtgtgagg

SEQ ID NO: 5022727 - DNA, 13 bp, Homo sapiens
ggagtcccctcac

SEQ ID NO: 5022728 - DNA, 17 bp, Homo sapiens
ggagtgtgtgtgagtgt

SEQ ID NO: 5022729 - DNA, 14 bp, Homo sapiens
ggatagacttggga

SEQ ID NO: 5022730 - DNA, 21 bp, Homo sapiens
ggatctttggacagaagcagc

SEQ ID NO: 5022731 - DNA, 17 bp, Homo sapiens
ggatgcattcgagatgg

SEQ ID NO: 5022732 - DNA, 13 bp, Homo sapiens
ggatgtccccagc

SEQ ID NO: 5022733 - DNA, 14 bp, Homo sapiens
ggatgtccccagca

SEQ ID NO: 5022734 - DNA, 16 bp, Homo sapiens
ggatgtccccagcaga

SEQ ID NO: 5022735 - DNA, 16 bp, Homo sapiens
ggatgttatgaacagc

SEQ ID NO: 5022736 - DNA, 20 bp, Homo sapiens
ggatgttatgaacagctgtg

SEQ ID NO: 5022737 - DNA, 14 bp, Homo sapiens
ggattctttccatt

SEQ ID NO: 5022738 - DNA, 18 bp, Homo sapiens
ggcacctcggggacacca

SEQ ID NO: 5022739 - DNA, 20 bp, Homo sapiens
ggcacctcggggacaccaga

SEQ ID NO: 5022740 - DNA, 16 bp, Homo sapiens
ggcagatgtggggctg

SEQ ID NO: 5022741 - DNA, 16 bp, Homo sapiens
ggcagattcccactgc

SEQ ID NO: 5022742 - DNA, 12 bp, Homo sapiens
ggcagccaccca

SEQ ID NO: 5022743 - DNA, 22 bp, Homo sapiens
ggcagccacccaagcctgctgg

SEQ ID NO: 5022744 - DNA, 14 bp, Homo sapiens
ggcagcctgtgcct

SEQ ID NO: 5022745 - DNA, 16 bp, Homo sapiens
ggcaggcttggggaaa

SEQ ID NO: 5022746 - DNA, 14 bp, Homo sapiens
ggcagggaccacac

SEQ ID NO: 5022747 - DNA, 14 bp, Homo sapiens
ggcagggtgaccct

SEQ ID NO: 5022748 - DNA, 21 bp, Homo sapiens
ggcaggtatgatcggcaggac

SEQ ID NO: 5022749 - DNA, 21 bp, Homo sapiens
ggcatgatctgatccccaaga

SEQ ID NO: 5022750 - DNA, 16 bp, Homo sapiens
ggcatgtcccacccac

SEQ ID NO: 5022751 - DNA, 16 bp, Homo sapiens
ggcatgtttccagcag

SEQ ID NO: 5022752 - DNA, 17 bp, Homo sapiens
ggccacacttcaaacta

SEQ ID NO: 5022753 - DNA, 21 bp, Homo sapiens
ggccagatgcacatccctgga

SEQ ID NO: 5022754 - DNA, 19 bp, Homo sapiens
ggccagctgccccagccag

SEQ ID NO: 5022755 - DNA, 16 bp, Homo sapiens
ggccagtacctttcca

SEQ ID NO: 5022756 - DNA, 16 bp, Homo sapiens
ggccatctgctcctgg

SEQ ID NO: 5022757 - DNA, 12 bp, Homo sapiens
ggccatgcagac

SEQ ID NO: 5022758 - DNA, 15 bp, Homo sapiens
ggccatgcagacctc

SEQ ID NO: 5022759 - DNA, 23 bp, Homo sapiens
ggccatgcaggaggtggagaaaa

SEQ ID NO: 5022760 - DNA, 15 bp, Homo sapiens
ggccatggcctctgc

SEQ ID NO: 5022761 - DNA, 17 bp, Homo sapiens
ggcccacgtggttgggg

SEQ ID NO: 5022762 - DNA, 19 bp, Homo sapiens
ggcccagtgccactgcccc

SEQ ID NO: 5022763 - DNA, 19 bp, Homo sapiens
ggcccctgctgtctctctg

SEQ ID NO: 5022764 - DNA, 20 bp, Homo sapiens
ggcccggccacacccagcgg

SEQ ID NO: 5022765 - DNA, 16 bp, Homo sapiens
ggccctgcagccagct

SEQ ID NO: 5022766 - DNA, 17 bp, Homo sapiens
ggccctggtcctggcct

SEQ ID NO: 5022767 - DNA, 18 bp, Homo sapiens
ggccctggtcctggcctc

SEQ ID NO: 5022768 - DNA, 14 bp, Homo sapiens
ggccctgttctcct

SEQ ID NO: 5022769 - DNA, 16 bp, Homo sapiens
ggcccttcctctttgg

SEQ ID NO: 5022770 - DNA, 22 bp, Homo sapiens
ggccgggaccccgagcctggct

SEQ ID NO: 5022771 - DNA, 14 bp, Homo sapiens
ggccgggcctgggg

SEQ ID NO: 5022772 - DNA, 15 bp, Homo sapiens
ggcctcgtgcgcccg

SEQ ID NO: 5022773 - DNA, 23 bp, Homo sapiens
ggcctctgcaactgctcagctct

SEQ ID NO: 5022774 - DNA, 20 bp, Homo sapiens
ggcctgggggacccctggct

SEQ ID NO: 5022775 - DNA, 15 bp, Homo sapiens
ggccttgcctggcct

SEQ ID NO: 5022776 - DNA, 16 bp, Homo sapiens
ggcggcgggcggctgg

SEQ ID NO: 5022777 - DNA, 18 bp, Homo sapiens
ggcggctggggtcccagc

SEQ ID NO: 5022778 - DNA, 19 bp, Homo sapiens
ggcgggacacaggctccaa

SEQ ID NO: 5022779 - DNA, 15 bp, Homo sapiens
ggcgtctgctctggt

SEQ ID NO: 5022780 - DNA, 18 bp, Homo sapiens
ggcgtgagccaccaaacc

SEQ ID NO: 5022781 - DNA, 13 bp, Homo sapiens
ggctaggggctgg

SEQ ID NO: 5022782 - DNA, 15 bp, Homo sapiens
ggctaggggctgggg

SEQ ID NO: 5022783 - DNA, 17 bp, Homo sapiens
ggctatagatgtctttt

SEQ ID NO: 5022784 - DNA, 17 bp, Homo sapiens
ggctccaaaccctcgag

SEQ ID NO: 5022785 - DNA, 20 bp, Homo sapiens
ggctctgaggtgcctgtccc

SEQ ID NO: 5022786 - DNA, 19 bp, Homo sapiens
ggctctgcaattcccctct

SEQ ID NO: 5022787 - DNA, 20 bp, Homo sapiens
ggctctgcaattcccctctg

SEQ ID NO: 5022788 - DNA, 14 bp, Homo sapiens
ggctctgtccccag

SEQ ID NO: 5022789 - DNA, 17 bp, Homo sapiens
ggctctgtccccagcct

SEQ ID NO: 5022790 - DNA, 23 bp, Homo sapiens
ggctctgttcggcctttgggtgt

SEQ ID NO: 5022791 - DNA, 20 bp, Homo sapiens
ggctcttgatacccccctct

SEQ ID NO: 5022792 - DNA, 13 bp, Homo sapiens
ggctgaaggactg

SEQ ID NO: 5022793 - DNA, 15 bp, Homo sapiens
ggctgacgtgtgagg

SEQ ID NO: 5022794 - DNA, 23 bp, Homo sapiens
ggctgagggtgcccttttccagc

SEQ ID NO: 5022795 - DNA, 19 bp, Homo sapiens
ggctgccgagacagaccct

SEQ ID NO: 5022796 - DNA, 22 bp, Homo sapiens
ggctgccgagacagaccctctg

SEQ ID NO: 5022797 - DNA, 20 bp, Homo sapiens
ggctggagtgcagtggcgca

SEQ ID NO: 5022798 - DNA, 19 bp, Homo sapiens
ggctgggcctcgtgcgccc

SEQ ID NO: 5022799 - DNA, 14 bp, Homo sapiens
ggctggtggcaagt

SEQ ID NO: 5022800 - DNA, 12 bp, Homo sapiens
ggcttcccaagg

SEQ ID NO: 5022801 - DNA, 14 bp, Homo sapiens
ggcttctgagcagc

SEQ ID NO: 5022802 - DNA, 22 bp, Homo sapiens
ggcttctgagcagcgagcctgc

SEQ ID NO: 5022803 - DNA, 17 bp, Homo sapiens
ggcttgccccactctgc

SEQ ID NO: 5022804 - DNA, 23 bp, Homo sapiens
ggcttggggaaaatggccatgca

SEQ ID NO: 5022805 - DNA, 22 bp, Homo sapiens
gggaaaatggccatgcaggagg

SEQ ID NO: 5022806 - DNA, 15 bp, Homo sapiens
gggaagctagtcttt

SEQ ID NO: 5022807 - DNA, 14 bp, Homo sapiens
gggaaggggcggtg

SEQ ID NO: 5022808 - DNA, 14 bp, Homo sapiens
gggaatgggagagg

SEQ ID NO: 5022809 - DNA, 19 bp, Homo sapiens
gggacatgcttagcagtcc

SEQ ID NO: 5022810 - DNA, 16 bp, Homo sapiens
gggaccccgagcctgg

SEQ ID NO: 5022811 - DNA, 19 bp, Homo sapiens
gggagacagttgagagcgg

SEQ ID NO: 5022812 - DNA, 11 bp, Homo sapiens
gggagggaggg

SEQ ID NO: 5022813 - DNA, 22 bp, Homo sapiens
gggatggcatttggtctcaggc

SEQ ID NO: 5022814 - DNA, 14 bp, Homo sapiens
gggcaaacaggcag

SEQ ID NO: 5022815 - DNA, 18 bp, Homo sapiens
gggcagccacccaagcct

SEQ ID NO: 5022816 - DNA, 22 bp, Homo sapiens
gggcagccacccaagcctgctg

SEQ ID NO: 5022817 - DNA, 16 bp, Homo sapiens
gggcaggcttggggaa

SEQ ID NO: 5022818 - DNA, 16 bp, Homo sapiens
gggcccggccacaccc

SEQ ID NO: 5022819 - DNA, 13 bp, Homo sapiens
gggccggggctga

SEQ ID NO: 5022820 - DNA, 20 bp, Homo sapiens
gggcctcaccgagtgggggc

SEQ ID NO: 5022821 - DNA, 20 bp, Homo sapiens
gggcctcagtgtgcccatct

SEQ ID NO: 5022822 - DNA, 13 bp, Homo sapiens
gggcctggggctc

SEQ ID NO: 5022823 - DNA, 16 bp, Homo sapiens
gggcctgtccacaggc

SEQ ID NO: 5022824 - DNA, 23 bp, Homo sapiens
gggcctgtccacaggcttctgag

SEQ ID NO: 5022825 - DNA, 12 bp, Homo sapiens
gggcggctgggt

SEQ ID NO: 5022826 - DNA, 22 bp, Homo sapiens
gggctccgaaattccaaggccc

SEQ ID NO: 5022827 - DNA, 20 bp, Homo sapiens
gggctctgcaattcccctct

SEQ ID NO: 5022828 - DNA, 13 bp, Homo sapiens
gggctctggctct

SEQ ID NO: 5022829 - DNA, 16 bp, Homo sapiens
gggcttcccaagggct

SEQ ID NO: 5022830 - DNA, 15 bp, Homo sapiens
gggctttagggacct

SEQ ID NO: 5022831 - DNA, 23 bp, Homo sapiens
ggggaaaatggccatgcaggagg

SEQ ID NO: 5022832 - DNA, 12 bp, Homo sapiens
ggggagggcagg

SEQ ID NO: 5022833 - DNA, 12 bp, Homo sapiens
ggggcagccccc

SEQ ID NO: 5022834 - DNA, 19 bp, Homo sapiens
ggggctaggggctggggcc

SEQ ID NO: 5022835 - DNA, 23 bp, Homo sapiens
ggggctgaattgccaggggcgag

SEQ ID NO: 5022836 - DNA, 17 bp, Homo sapiens
ggggctggcactgactg

SEQ ID NO: 5022837 - DNA, 21 bp, Homo sapiens
ggggctggggccaaataaagt

SEQ ID NO: 5022838 - DNA, 21 bp, Homo sapiens
ggggcttctggacctagggtg

SEQ ID NO: 5022839 - DNA, 13 bp, Homo sapiens
ggggggacagtgc

SEQ ID NO: 5022840 - DNA, 15 bp, Homo sapiens
ggggttatctctgtg

SEQ ID NO: 5022841 - DNA, 18 bp, Homo sapiens
gggtctgcgcttggtctt

SEQ ID NO: 5022842 - DNA, 12 bp, Homo sapiens
gggtgagagagg

SEQ ID NO: 5022843 - DNA, 13 bp, Homo sapiens
gggttatctctgt

SEQ ID NO: 5022844 - DNA, 23 bp, Homo sapiens
gggttgtaaattggcatggaaat

SEQ ID NO: 5022845 - DNA, 17 bp, Homo sapiens
ggtaaaaatgctgctct

SEQ ID NO: 5022846 - DNA, 23 bp, Homo sapiens
ggtaagtgttctcatgaagcagg

SEQ ID NO: 5022847 - DNA, 17 bp, Homo sapiens
ggtcattggtctccgag

SEQ ID NO: 5022848 - DNA, 20 bp, Homo sapiens
ggtcccgcactctgccccca

SEQ ID NO: 5022849 - DNA, 12 bp, Homo sapiens
ggtcctctctct

SEQ ID NO: 5022850 - DNA, 22 bp, Homo sapiens
ggtcctctctctgtggggctga

SEQ ID NO: 5022851 - DNA, 21 bp, Homo sapiens
ggtcctggagcagaccacccc

SEQ ID NO: 5022852 - DNA, 22 bp, Homo sapiens
ggtctatgtcgagagctggcca

SEQ ID NO: 5022853 - DNA, 22 bp, Homo sapiens
ggtgcacagcacaaattagtta

SEQ ID NO: 5022854 - DNA, 15 bp, Homo sapiens
ggtgcacccacctgt

SEQ ID NO: 5022855 - DNA, 13 bp, Homo sapiens
ggtgcctgtccca

SEQ ID NO: 5022856 - DNA, 20 bp, Homo sapiens
ggtgcgtgttcagcagaacc

SEQ ID NO: 5022857 - DNA, 21 bp, Homo sapiens
ggtggagaaaattggaactct

SEQ ID NO: 5022858 - DNA, 18 bp, Homo sapiens
ggtggatgttatgaacag

SEQ ID NO: 5022859 - DNA, 17 bp, Homo sapiens
ggtggcacaggccccct

SEQ ID NO: 5022860 - DNA, 18 bp, Homo sapiens
ggtggcacaggccccctt

SEQ ID NO: 5022861 - DNA, 18 bp, Homo sapiens
ggtggcagtggaggtggg

SEQ ID NO: 5022862 - DNA, 22 bp, Homo sapiens
ggtggcccctgctgtctctctg

SEQ ID NO: 5022863 - DNA, 23 bp, Homo sapiens
ggtggcccctgctgtctctctgg

SEQ ID NO: 5022864 - DNA, 23 bp, Homo sapiens
ggtggcttaagtgagcagaacag

SEQ ID NO: 5022865 - DNA, 19 bp, Homo sapiens
ggtggtcactggaactcag

SEQ ID NO: 5022866 - DNA, 14 bp, Homo sapiens
ggtggtgcccgtgc

SEQ ID NO: 5022867 - DNA, 13 bp, Homo sapiens
ggttaagtctgtt

SEQ ID NO: 5022868 - DNA, 13 bp, Homo sapiens
ggttctgcctgct

SEQ ID NO: 5022869 - DNA, 10 bp, Homo sapiens
ggttcttgtt

SEQ ID NO: 5022870 - DNA, 14 bp, Homo sapiens
ggttcttgttggtg

SEQ ID NO: 5022871 - DNA, 16 bp, Homo sapiens
gtaaaaatgctgctct

SEQ ID NO: 5022872 - DNA, 14 bp, Homo sapiens
gtaaatataaagac

SEQ ID NO: 5022873 - DNA, 15 bp, Homo sapiens
gtaaatataaagacg

SEQ ID NO: 5022874 - DNA, 15 bp, Homo sapiens
gtaactggttgctgt

SEQ ID NO: 5022875 - DNA, 16 bp, Homo sapiens
gtaagagcttgctcca

SEQ ID NO: 5022876 - DNA, 13 bp, Homo sapiens
gtaaggctgtgta

SEQ ID NO: 5022877 - DNA, 14 bp, Homo sapiens
gtaaggctgtgtaa

SEQ ID NO: 5022878 - DNA, 23 bp, Homo sapiens
gtaaggtgtcttaatactgtcct

SEQ ID NO: 5022879 - DNA, 22 bp, Homo sapiens
gtaagtgttctcatgaagcagg

SEQ ID NO: 5022880 - DNA, 23 bp, Homo sapiens
gtaatggcagttatattttgcag

SEQ ID NO: 5022881 - DNA, 21 bp, Homo sapiens
gtacagtatgggggttgtaaa

SEQ ID NO: 5022882 - DNA, 13 bp, Homo sapiens
gtacagtgtcttt

SEQ ID NO: 5022883 - DNA, 20 bp, Homo sapiens
gtacagtgtctttttttgta

SEQ ID NO: 5022884 - DNA, 22 bp, Homo sapiens
gtacagtgtctttttttgtata

SEQ ID NO: 5022885 - DNA, 22 bp, Homo sapiens
gtacataccctggccgccccct

SEQ ID NO: 5022886 - DNA, 17 bp, Homo sapiens
gtaccctcctggctctt

SEQ ID NO: 5022887 - DNA, 18 bp, Homo sapiens
gtaccctctcagctccag

SEQ ID NO: 5022888 - DNA, 19 bp, Homo sapiens
gtaccctctcagctccagg

SEQ ID NO: 5022889 - DNA, 15 bp, Homo sapiens
gtaccctctggaggg

SEQ ID NO: 5022890 - DNA, 15 bp, Homo sapiens
gtacctgggcaagct

SEQ ID NO: 5022891 - DNA, 17 bp, Homo sapiens
gtactagtgttctgttt

SEQ ID NO: 5022892 - DNA, 16 bp, Homo sapiens
gtagagacccccaggc

SEQ ID NO: 5022893 - DNA, 21 bp, Homo sapiens
gtagattttaaaagttattaa

SEQ ID NO: 5022894 - DNA, 14 bp, Homo sapiens
gtaggcagaggctg

SEQ ID NO: 5022895 - DNA, 16 bp, Homo sapiens
gtaggggagggcaggc

SEQ ID NO: 5022896 - DNA, 21 bp, Homo sapiens
gtaggggagggcaggcttggg

SEQ ID NO: 5022897 - DNA, 13 bp, Homo sapiens
gtagtgctttgag

SEQ ID NO: 5022898 - DNA, 15 bp, Homo sapiens
gtagtgtagctgtgt

SEQ ID NO: 5022899 - DNA, 12 bp, Homo sapiens
gtagttgtcttt

SEQ ID NO: 5022900 - DNA, 16 bp, Homo sapiens
gtagttgtctttcctg

SEQ ID NO: 5022901 - DNA, 22 bp, Homo sapiens
gtataaacaagaaaaataaaga

SEQ ID NO: 5022902 - DNA, 20 bp, Homo sapiens
gtatctctttcacattgttt

SEQ ID NO: 5022903 - DNA, 22 bp, Homo sapiens
gtatctctttcacattgtttgc

SEQ ID NO: 5022904 - DNA, 13 bp, Homo sapiens
gtattaaagacag

SEQ ID NO: 5022905 - DNA, 13 bp, Homo sapiens
gtattgaagcatt

SEQ ID NO: 5022906 - DNA, 22 bp, Homo sapiens
gtattgaagcattttataaatc

SEQ ID NO: 5022907 - DNA, 17 bp, Homo sapiens
gtattgtgcaatgtgta

SEQ ID NO: 5022908 - DNA, 22 bp, Homo sapiens
gtattgtgcaatgtgtataaac

SEQ ID NO: 5022909 - DNA, 13 bp, Homo sapiens
gtattgttgtcct

SEQ ID NO: 5022910 - DNA, 18 bp, Homo sapiens
gtattgttgtccttttca

SEQ ID NO: 5022911 - DNA, 12 bp, Homo sapiens
gtatttgtttgc

SEQ ID NO: 5022912 - DNA, 13 bp, Homo sapiens
gtattttatgtta

SEQ ID NO: 5022913 - DNA, 22 bp, Homo sapiens
gtattttatgttatatataaat

SEQ ID NO: 5022914 - DNA, 17 bp, Homo sapiens
gtattttcaatagccac

SEQ ID NO: 5022915 - DNA, 16 bp, Homo sapiens
gtcaaatctgggctca

SEQ ID NO: 5022916 - DNA, 15 bp, Homo sapiens
gtcaagaagaaaaag

SEQ ID NO: 5022917 - DNA, 19 bp, Homo sapiens
gtcactccaccatccccac

SEQ ID NO: 5022918 - DNA, 17 bp, Homo sapiens
gtcatatactgccatgt

SEQ ID NO: 5022919 - DNA, 22 bp, Homo sapiens
gtcatatactgccatgtactag

SEQ ID NO: 5022920 - DNA, 17 bp, Homo sapiens
gtcatcctcaggaacca

SEQ ID NO: 5022921 - DNA, 23 bp, Homo sapiens
gtcatctgtaagagcttgctcca

SEQ ID NO: 5022922 - DNA, 15 bp, Homo sapiens
gtcattgtatgttat

SEQ ID NO: 5022923 - DNA, 15 bp, Homo sapiens
gtccaaccagaaaca

SEQ ID NO: 5022924 - DNA, 14 bp, Homo sapiens
gtccaccctgccaa

SEQ ID NO: 5022925 - DNA, 20 bp, Homo sapiens
gtccagccctggctgaagga

SEQ ID NO: 5022926 - DNA, 24 bp, Homo sapiens
gtccagctcccgctgtggccgcac

SEQ ID NO: 5022927 - DNA, 11 bp, Homo sapiens
gtcccagcagc

SEQ ID NO: 5022928 - DNA, 22 bp, Homo sapiens
gtcccagcagctgccaggagca

SEQ ID NO: 5022929 - DNA, 18 bp, Homo sapiens
gtccccagagaccaggct

SEQ ID NO: 5022930 - DNA, 12 bp, Homo sapiens
gtcccctcacct

SEQ ID NO: 5022931 - DNA, 12 bp, Homo sapiens
gtcccctgcggg

SEQ ID NO: 5022932 - DNA, 20 bp, Homo sapiens
gtcccctgcgggcgcgggca

SEQ ID NO: 5022933 - DNA, 14 bp, Homo sapiens
gtcccgcactctgc

SEQ ID NO: 5022934 - DNA, 17 bp, Homo sapiens
gtcctgccggtgggacc

SEQ ID NO: 5022935 - DNA, 19 bp, Homo sapiens
gtcctggagcagaccaccc

SEQ ID NO: 5022936 - DNA, 13 bp, Homo sapiens
gtccttcaaaggc

SEQ ID NO: 5022937 - DNA, 11 bp, Homo sapiens
gtcctttccct

SEQ ID NO: 5022938 - DNA, 18 bp, Homo sapiens
gtcctttgcgcctgtgac

SEQ ID NO: 5022939 - DNA, 21 bp, Homo sapiens
gtccttttcataggtctgaaa

SEQ ID NO: 5022940 - DNA, 22 bp, Homo sapiens
gtccttttcataggtctgaaat

SEQ ID NO: 5022941 - DNA, 16 bp, Homo sapiens
gtcgagagctggccaa

SEQ ID NO: 5022942 - DNA, 12 bp, Homo sapiens
gtctcaggcagc

SEQ ID NO: 5022943 - DNA, 23 bp, Homo sapiens
gtctcaggcagcaccacactggg

SEQ ID NO: 5022944 - DNA, 15 bp, Homo sapiens
gtctcagtgaagact

SEQ ID NO: 5022945 - DNA, 18 bp, Homo sapiens
gtctcagtttgtgtgtct

SEQ ID NO: 5022946 - DNA, 19 bp, Homo sapiens
gtctcagtttgtgtgtctt

SEQ ID NO: 5022947 - DNA, 22 bp, Homo sapiens
gtctcttatggatgtccccagc

SEQ ID NO: 5022948 - DNA, 13 bp, Homo sapiens
gtctgaaattttt

SEQ ID NO: 5022949 - DNA, 13 bp, Homo sapiens
gtctgccaaacac

SEQ ID NO: 5022950 - DNA, 15 bp, Homo sapiens
gtctgccaaacacat

SEQ ID NO: 5022951 - DNA, 15 bp, Homo sapiens
gtctgccccacatgt

SEQ ID NO: 5022952 - DNA, 17 bp, Homo sapiens
gtctgctaaataaacat

SEQ ID NO: 5022953 - DNA, 13 bp, Homo sapiens
gtctgttttatga

SEQ ID NO: 5022954 - DNA, 15 bp, Homo sapiens
gtctgttttatgact

SEQ ID NO: 5022955 - DNA, 18 bp, Homo sapiens
gtcttaattattatttgt

SEQ ID NO: 5022956 - DNA, 23 bp, Homo sapiens
gtcttcatacctacatgtatttg

SEQ ID NO: 5022957 - DNA, 21 bp, Homo sapiens
gtctttagatagccctgtcct

SEQ ID NO: 5022958 - DNA, 24 bp, Homo sapiens
gtctttagatagccctgtcctggt

SEQ ID NO: 5022959 - DNA, 16 bp, Homo sapiens
gtctttcctggcacta

SEQ ID NO: 5022960 - DNA, 17 bp, Homo sapiens
gtgaaaatgttttacat

SEQ ID NO: 5022961 - DNA, 22 bp, Homo sapiens
gtgaaataccaacctgaagaca

SEQ ID NO: 5022962 - DNA, 15 bp, Homo sapiens
gtgaagagccggtgg

SEQ ID NO: 5022963 - DNA, 16 bp, Homo sapiens
gtgacaggcagcagag

SEQ ID NO: 5022964 - DNA, 23 bp, Homo sapiens
gtgacataatatattctattttt

SEQ ID NO: 5022965 - DNA, 19 bp, Homo sapiens
gtgacatgcccaaggccac

SEQ ID NO: 5022966 - DNA, 16 bp, Homo sapiens
gtgactctgtccagct

SEQ ID NO: 5022967 - DNA, 15 bp, Homo sapiens
gtgactgtatctgtg

SEQ ID NO: 5022968 - DNA, 22 bp, Homo sapiens
gtgactgtgctgtgcagctctc

SEQ ID NO: 5022969 - DNA, 15 bp, Homo sapiens
gtgagagccagcagc

SEQ ID NO: 5022970 - DNA, 16 bp, Homo sapiens
gtgagcagaacaggta

SEQ ID NO: 5022971 - DNA, 17 bp, Homo sapiens
gtgagcaggctgtgagt

SEQ ID NO: 5022972 - DNA, 17 bp, Homo sapiens
gtgagcctagccctggg

SEQ ID NO: 5022973 - DNA, 13 bp, Homo sapiens
gtgagctgagcag

SEQ ID NO: 5022974 - DNA, 17 bp, Homo sapiens
gtgagctgagcaggcca

SEQ ID NO: 5022975 - DNA, 19 bp, Homo sapiens
gtgagctggatagacttgg

SEQ ID NO: 5022976 - DNA, 20 bp, Homo sapiens
gtgagctggatagacttggg

SEQ ID NO: 5022977 - DNA, 23 bp, Homo sapiens
gtgagctggatagacttgggatg

SEQ ID NO: 5022978 - DNA, 15 bp, Homo sapiens
gtgagggtcccatgt

SEQ ID NO: 5022979 - DNA, 16 bp, Homo sapiens
gtgagggtcccatgtg

SEQ ID NO: 5022980 - DNA, 14 bp, Homo sapiens
gtgagtcatttaaa

SEQ ID NO: 5022981 - DNA, 22 bp, Homo sapiens
gtgagtcatttaaatgtgtaca

SEQ ID NO: 5022982 - DNA, 23 bp, Homo sapiens
gtgatggagtgctgttttgttat

SEQ ID NO: 5022983 - DNA, 19 bp, Homo sapiens
gtgcaatgtgtataaacaa

SEQ ID NO: 5022984 - DNA, 14 bp, Homo sapiens
gtgcacccacctgt

SEQ ID NO: 5022985 - DNA, 23 bp, Homo sapiens
gtgccactgccccccgaggctgc

SEQ ID NO: 5022986 - DNA, 18 bp, Homo sapiens
gtgccagtattttaaaat

SEQ ID NO: 5022987 - DNA, 17 bp, Homo sapiens
gtgccagtcaagaagaa

SEQ ID NO: 5022988 - DNA, 21 bp, Homo sapiens
gtgcccacaccggggacaggc

SEQ ID NO: 5022989 - DNA, 15 bp, Homo sapiens
gtgccgccagctgcc

SEQ ID NO: 5022990 - DNA, 13 bp, Homo sapiens
gtggacttttatt

SEQ ID NO: 5022991 - DNA, 18 bp, Homo sapiens
gtggagaggcccggcctc

SEQ ID NO: 5022992 - DNA, 15 bp, Homo sapiens
gtggagcagcagcca

SEQ ID NO: 5022993 - DNA, 16 bp, Homo sapiens
gtggcacaggccccct

SEQ ID NO: 5022994 - DNA, 23 bp, Homo sapiens
gtggcatttcaattcctggccct

SEQ ID NO: 5022995 - DNA, 14 bp, Homo sapiens
gtggccacggccac

SEQ ID NO: 5022996 - DNA, 16 bp, Homo sapiens
gtggccatggcctctg

SEQ ID NO: 5022997 - DNA, 23 bp, Homo sapiens
gtggcccctgctgtctctctggg

SEQ ID NO: 5022998 - DNA, 14 bp, Homo sapiens
gtgggaaggccagc

SEQ ID NO: 5022999 - DNA, 13 bp, Homo sapiens
gtggggcagaggc

SEQ ID NO: 5023000 - DNA, 18 bp, Homo sapiens
gtggggctaggggctggg

SEQ ID NO: 5023001 - DNA, 21 bp, Homo sapiens
gtggggctaggggctggggcc

SEQ ID NO: 5023002 - DNA, 15 bp, Homo sapiens
gtggggtgctgccct

SEQ ID NO: 5023003 - DNA, 11 bp, Homo sapiens
gtggggtggga

SEQ ID NO: 5023004 - DNA, 15 bp, Homo sapiens
gtggggttctaggca

SEQ ID NO: 5023005 - DNA, 14 bp, Homo sapiens
gtgggtctctggaa

SEQ ID NO: 5023006 - DNA, 12 bp, Homo sapiens
gtgtataaacaa

SEQ ID NO: 5023007 - DNA, 14 bp, Homo sapiens
gtgtataaacaaga

SEQ ID NO: 5023008 - DNA, 19 bp, Homo sapiens
gtgtataaacaagaaaaat

SEQ ID NO: 5023009 - DNA, 18 bp, Homo sapiens
gtgtctttcacagctcct

SEQ ID NO: 5023010 - DNA, 21 bp, Homo sapiens
gtgtgatcttaatatatttga

SEQ ID NO: 5023011 - DNA, 13 bp, Homo sapiens
gtgtgcaggagcg

SEQ ID NO: 5023012 - DNA, 19 bp, Homo sapiens
gtgtggagttcaccttgga

SEQ ID NO: 5023013 - DNA, 21 bp, Homo sapiens
gtgtgtcttaattattatttg

SEQ ID NO: 5023014 - DNA, 16 bp, Homo sapiens
gtgttatcacctagct

SEQ ID NO: 5023015 - DNA, 16 bp, Homo sapiens
gtgttcagcagaacct

SEQ ID NO: 5023016 - DNA, 16 bp, Homo sapiens
gtgttctcatgaagca

SEQ ID NO: 5023017 - DNA, 21 bp, Homo sapiens
gtgttctcatgaagcaggagg

SEQ ID NO: 5023018 - DNA, 23 bp, Homo sapiens
gtgttctgtttgttattgttttg

SEQ ID NO: 5023019 - DNA, 14 bp, Homo sapiens
gtgtttgtctgtgt

SEQ ID NO: 5023020 - DNA, 13 bp, Homo sapiens
gtgttttaattta

SEQ ID NO: 5023021 - DNA, 14 bp, Homo sapiens
gtgttttaatttaa

SEQ ID NO: 5023022 - DNA, 21 bp, Homo sapiens
gttaaaagaggtttttcttaa

SEQ ID NO: 5023023 - DNA, 14 bp, Homo sapiens
gttaactgaatacc

SEQ ID NO: 5023024 - DNA, 20 bp, Homo sapiens
gttaactgaataccactctg

SEQ ID NO: 5023025 - DNA, 13 bp, Homo sapiens
gttaagcctttgg

SEQ ID NO: 5023026 - DNA, 19 bp, Homo sapiens
gttaatatttataggtcac

SEQ ID NO: 5023027 - DNA, 16 bp, Homo sapiens
gttacccactgccatg

SEQ ID NO: 5023028 - DNA, 17 bp, Homo sapiens
gttacccactgccatgc

SEQ ID NO: 5023029 - DNA, 10 bp, Homo sapiens
gttatataaa

SEQ ID NO: 5023030 - DNA, 12 bp, Homo sapiens
gttatataaatg

SEQ ID NO: 5023031 - DNA, 12 bp, Homo sapiens
gttatataattt

SEQ ID NO: 5023032 - DNA, 20 bp, Homo sapiens
gttatgaaattcaccccctt

SEQ ID NO: 5023033 - DNA, 12 bp, Homo sapiens
gttatgaacagc

SEQ ID NO: 5023034 - DNA, 17 bp, Homo sapiens
gttatgaacagctgtgt

SEQ ID NO: 5023035 - DNA, 21 bp, Homo sapiens
gttatgaacagctgtgtctgc

SEQ ID NO: 5023036 - DNA, 20 bp, Homo sapiens
gttatttataatcacttttt

SEQ ID NO: 5023037 - DNA, 14 bp, Homo sapiens
gttcccgtttctcc

SEQ ID NO: 5023038 - DNA, 20 bp, Homo sapiens
gttctacctcaggcagctca

SEQ ID NO: 5023039 - DNA, 21 bp, Homo sapiens
gttctacctcaggcagctcaa

SEQ ID NO: 5023040 - DNA, 17 bp, Homo sapiens
gttctagcgcagttttt

SEQ ID NO: 5023041 - DNA, 13 bp, Homo sapiens
gttctccttttcc

SEQ ID NO: 5023042 - DNA, 15 bp, Homo sapiens
gttctggtgtgaact

SEQ ID NO: 5023043 - DNA, 13 bp, Homo sapiens
gttctgtgtcttt

SEQ ID NO: 5023044 - DNA, 18 bp, Homo sapiens
gttctgtttgttattgtt

SEQ ID NO: 5023045 - DNA, 16 bp, Homo sapiens
gttctgttttgtttcg

SEQ ID NO: 5023046 - DNA, 17 bp, Homo sapiens
gttcttagctcaatgag

SEQ ID NO: 5023047 - DNA, 17 bp, Homo sapiens
gttcttgtattaagaat

SEQ ID NO: 5023048 - DNA, 21 bp, Homo sapiens
gttcttgtattaagaatgaaa

SEQ ID NO: 5023049 - DNA, 15 bp, Homo sapiens
gttcttgttggtgca

SEQ ID NO: 5023050 - DNA, 13 bp, Homo sapiens
gttgaagcctttg

SEQ ID NO: 5023051 - DNA, 15 bp, Homo sapiens
gttgacattctgaat

SEQ ID NO: 5023052 - DNA, 21 bp, Homo sapiens
gttgaggtccagccctggctg

SEQ ID NO: 5023053 - DNA, 22 bp, Homo sapiens
gttgaggtccagccctggctga

SEQ ID NO: 5023054 - DNA, 14 bp, Homo sapiens
gttggaaggatctg

SEQ ID NO: 5023055 - DNA, 18 bp, Homo sapiens
gttgggaacagcatggag

SEQ ID NO: 5023056 - DNA, 16 bp, Homo sapiens
gttggtcctctctctg

SEQ ID NO: 5023057 - DNA, 12 bp, Homo sapiens
gttggttttctt

SEQ ID NO: 5023058 - DNA, 22 bp, Homo sapiens
gttgtaaattggcatggaaatt

SEQ ID NO: 5023059 - DNA, 15 bp, Homo sapiens
gttgtcaaggaagaa

SEQ ID NO: 5023060 - DNA, 16 bp, Homo sapiens
gttgtcaaggaagaag

SEQ ID NO: 5023061 - DNA, 20 bp, Homo sapiens
gttgtcaaggaagaagaaat

SEQ ID NO: 5023062 - DNA, 13 bp, Homo sapiens
gttgtgagctgga

SEQ ID NO: 5023063 - DNA, 18 bp, Homo sapiens
gttgtttgagaaattaag

SEQ ID NO: 5023064 - DNA, 23 bp, Homo sapiens
gtttaaatgaacaagagaagcat

SEQ ID NO: 5023065 - DNA, 14 bp, Homo sapiens
gtttaatctgttat

SEQ ID NO: 5023066 - DNA, 19 bp, Homo sapiens
gtttcaaaagcaaaacatc

SEQ ID NO: 5023067 - DNA, 17 bp, Homo sapiens
gtttccagcagaagaca

SEQ ID NO: 5023068 - DNA, 22 bp, Homo sapiens
gtttgaaatgaggtctgtttaa

SEQ ID NO: 5023069 - DNA, 16 bp, Homo sapiens
gtttgcagtcccaagc

SEQ ID NO: 5023070 - DNA, 14 bp, Homo sapiens
gtttgcataggtga

SEQ ID NO: 5023071 - DNA, 11 bp, Homo sapiens
gtttgcctgtg

SEQ ID NO: 5023072 - DNA, 21 bp, Homo sapiens
gtttgtcctttttcactttga

SEQ ID NO: 5023073 - DNA, 14 bp, Homo sapiens
gtttgtgtgtctta

SEQ ID NO: 5023074 - DNA, 18 bp, Homo sapiens
gtttgttccccaagacat

SEQ ID NO: 5023075 - DNA, 12 bp, Homo sapiens
gttttataagca

SEQ ID NO: 5023076 - DNA, 13 bp, Homo sapiens
gttttatgacttc

SEQ ID NO: 5023077 - DNA, 15 bp, Homo sapiens
gttttcaaaacacat

SEQ ID NO: 5023078 - DNA, 16 bp, Homo sapiens
gttttcaggtccagag

SEQ ID NO: 5023079 - DNA, 21 bp, Homo sapiens
gttttcatccataactgaaca

SEQ ID NO: 5023080 - DNA, 14 bp, Homo sapiens
gttttgtgtctctt

SEQ ID NO: 5023081 - DNA, 16 bp, Homo sapiens
gttttgtgtctcttat

SEQ ID NO: 5023082 - DNA, 17 bp, Homo sapiens
gttttgttgacattctg

SEQ ID NO: 5023083 - DNA, 21 bp, Homo sapiens
gttttgttgacattctgaatg

SEQ ID NO: 5023084 - DNA, 22 bp, Homo sapiens
gttttgttgacattctgaatgc

SEQ ID NO: 5023085 - DNA, 13 bp, Homo sapiens
gttttgttgtttg

SEQ ID NO: 5023086 - DNA, 14 bp, Homo sapiens
gtttttaaactgta

SEQ ID NO: 5023087 - DNA, 15 bp, Homo sapiens
gtttttaaactgtac

SEQ ID NO: 5023088 - DNA, 16 bp, Homo sapiens
gtttttaaactgtaca

SEQ ID NO: 5023089 - DNA, 18 bp, Homo sapiens
gtttttaaactgtacagt

SEQ ID NO: 5023090 - DNA, 11 bp, Homo sapiens
gtttttacagc

SEQ ID NO: 5023091 - DNA, 20 bp, Homo sapiens
gtttttctaaaggagtttat

SEQ ID NO: 5023092 - DNA, 20 bp, Homo sapiens
gtttttcttaaataataaag

SEQ ID NO: 5023093 - DNA, 21 bp, Homo sapiens
gtttttcttaaataataaaga

SEQ ID NO: 5023094 - DNA, 11 bp, Homo sapiens
gttttttcatc

SEQ ID NO: 5023095 - DNA, 13 bp, Homo sapiens
gttttttcctttg

SEQ ID NO: 5023096 - DNA, 16 bp, Homo sapiens
gttttttttttgtttg

SEQ ID NO: 5023097 - DNA, 17 bp, Homo sapiens
gttttttttttgtttgt

SEQ ID NO: 5023098 - DNA, 13 bp, Homo sapiens
taaaaaagataaa

SEQ ID NO: 5023099 - DNA, 17 bp, Homo sapiens
taaaaaagataaacaca

SEQ ID NO: 5023100 - DNA, 17 bp, Homo sapiens
taaaaagcttttgtcta

SEQ ID NO: 5023101 - DNA, 16 bp, Homo sapiens
taaaagagagagagag

SEQ ID NO: 5023102 - DNA, 21 bp, Homo sapiens
taaaagaggtttttcttaaat

SEQ ID NO: 5023103 - DNA, 20 bp, Homo sapiens
taaaagcacaagtacttttg

SEQ ID NO: 5023104 - DNA, 17 bp, Homo sapiens
taaaaggtgcaggtgtg

SEQ ID NO: 5023105 - DNA, 17 bp, Homo sapiens
taaaatagcgttcttgt

SEQ ID NO: 5023106 - DNA, 13 bp, Homo sapiens
taaacaagaaaaa

SEQ ID NO: 5023107 - DNA, 21 bp, Homo sapiens
taaacaagaaaaataaagaaa

SEQ ID NO: 5023108 - DNA, 22 bp, Homo sapiens
taaacacaagattggtgttttt

SEQ ID NO: 5023109 - DNA, 12 bp, Homo sapiens
taaacacacaga

SEQ ID NO: 5023110 - DNA, 20 bp, Homo sapiens
taaacgatttttaaaatgta

SEQ ID NO: 5023111 - DNA, 14 bp, Homo sapiens
taaactactctttg

SEQ ID NO: 5023112 - DNA, 15 bp, Homo sapiens
taaactactctttga

SEQ ID NO: 5023113 - DNA, 13 bp, Homo sapiens
taaactgtacagt

SEQ ID NO: 5023114 - DNA, 15 bp, Homo sapiens
taaactgtacagtgt

SEQ ID NO: 5023115 - DNA, 17 bp, Homo sapiens
taaagaaaaaaatgtat

SEQ ID NO: 5023116 - DNA, 15 bp, Homo sapiens
taaagaaaaaaattg

SEQ ID NO: 5023117 - DNA, 16 bp, Homo sapiens
taaagaaaaaaattga

SEQ ID NO: 5023118 - DNA, 20 bp, Homo sapiens
taaagaaaaaaattgaaatg

SEQ ID NO: 5023119 - DNA, 23 bp, Homo sapiens
taaagaaaaaaattgaaatgtaa

SEQ ID NO: 5023120 - DNA, 15 bp, Homo sapiens
taaagaaaagatgca

SEQ ID NO: 5023121 - DNA, 18 bp, Homo sapiens
taaagaaaagatgcactt

SEQ ID NO: 5023122 - DNA, 12 bp, Homo sapiens
taaagaagacct

SEQ ID NO: 5023123 - DNA, 16 bp, Homo sapiens
taaagaagacctgaga

SEQ ID NO: 5023124 - DNA, 21 bp, Homo sapiens
taaagaagacctgagaatgta

SEQ ID NO: 5023125 - DNA, 16 bp, Homo sapiens
taaagacgttttataa

SEQ ID NO: 5023126 - DNA, 21 bp, Homo sapiens
taaagacgttttataagcatc

SEQ ID NO: 5023127 - DNA, 12 bp, Homo sapiens
taaagagaagac

SEQ ID NO: 5023128 - DNA, 20 bp, Homo sapiens
taaagcatttaacccccctg

SEQ ID NO: 5023129 - DNA, 15 bp, Homo sapiens
taaagtgccagtatt

SEQ ID NO: 5023130 - DNA, 13 bp, Homo sapiens
taaataaaagcac

SEQ ID NO: 5023131 - DNA, 19 bp, Homo sapiens
taaatacaattttttttat

SEQ ID NO: 5023132 - DNA, 12 bp, Homo sapiens
taaatataaaga

SEQ ID NO: 5023133 - DNA, 13 bp, Homo sapiens
taaatatattatt

SEQ ID NO: 5023134 - DNA, 18 bp, Homo sapiens
taaatcgcttttgataat

SEQ ID NO: 5023135 - DNA, 15 bp, Homo sapiens
taaatgaacaagaga

SEQ ID NO: 5023136 - DNA, 23 bp, Homo sapiens
taaatgaacaagagaagcattct

SEQ ID NO: 5023137 - DNA, 15 bp, Homo sapiens
taaatgcaaataaca

SEQ ID NO: 5023138 - DNA, 16 bp, Homo sapiens
taaatgcaaataacaa

SEQ ID NO: 5023139 - DNA, 18 bp, Homo sapiens
taaattcccaacttctct

SEQ ID NO: 5023140 - DNA, 20 bp, Homo sapiens
taaattttttgttgacatta

SEQ ID NO: 5023141 - DNA, 20 bp, Homo sapiens
taacacactaccgaatgtgt

SEQ ID NO: 5023142 - DNA, 22 bp, Homo sapiens
taacacactaccgaatgtgtct

SEQ ID NO: 5023143 - DNA, 13 bp, Homo sapiens
taacacagtgtct

SEQ ID NO: 5023144 - DNA, 19 bp, Homo sapiens
taacataagctatttttct

SEQ ID NO: 5023145 - DNA, 16 bp, Homo sapiens
taacattcccactgcc

SEQ ID NO: 5023146 - DNA, 21 bp, Homo sapiens
taaccggcatgtttccagcag

SEQ ID NO: 5023147 - DNA, 16 bp, Homo sapiens
taaccttgcctggtac

SEQ ID NO: 5023148 - DNA, 16 bp, Homo sapiens
taacgttgagcccctg

SEQ ID NO: 5023149 - DNA, 23 bp, Homo sapiens
taactgaacatccaaaatcttga

SEQ ID NO: 5023150 - DNA, 22 bp, Homo sapiens
taactgaataccactctgtaat

SEQ ID NO: 5023151 - DNA, 13 bp, Homo sapiens
taagaatgaaata

SEQ ID NO: 5023152 - DNA, 20 bp, Homo sapiens
taagatttgtttttaaactg

SEQ ID NO: 5023153 - DNA, 19 bp, Homo sapiens
taagcatcattatttatgt

SEQ ID NO: 5023154 - DNA, 22 bp, Homo sapiens
taagcatcattatttatgtatt

SEQ ID NO: 5023155 - DNA, 14 bp, Homo sapiens
taagctatttttct

SEQ ID NO: 5023156 - DNA, 21 bp, Homo sapiens
taagctatttttctaactaca

SEQ ID NO: 5023157 - DNA, 19 bp, Homo sapiens
taaggaaactgggttcctg

SEQ ID NO: 5023158 - DNA, 19 bp, Homo sapiens
taaggatatgattaatatt

SEQ ID NO: 5023159 - DNA, 12 bp, Homo sapiens
taaggattttat

SEQ ID NO: 5023160 - DNA, 16 bp, Homo sapiens
taagtaaatacaattt

SEQ ID NO: 5023161 - DNA, 16 bp, Homo sapiens
taagtatctgacatct

SEQ ID NO: 5023162 - DNA, 12 bp, Homo sapiens
taagtctctgtg

SEQ ID NO: 5023163 - DNA, 21 bp, Homo sapiens
taagtctgttttatgacttca

SEQ ID NO: 5023164 - DNA, 20 bp, Homo sapiens
taagtgttctcatgaagcag

SEQ ID NO: 5023165 - DNA, 21 bp, Homo sapiens
taagttgagatagttttcatc

SEQ ID NO: 5023166 - DNA, 15 bp, Homo sapiens
taataaaaagctttt

SEQ ID NO: 5023167 - DNA, 16 bp, Homo sapiens
taataaagatcatgta

SEQ ID NO: 5023168 - DNA, 17 bp, Homo sapiens
taataaagatcatgtaa

SEQ ID NO: 5023169 - DNA, 23 bp, Homo sapiens
taatctgggccagaatttcaaac

SEQ ID NO: 5023170 - DNA, 15 bp, Homo sapiens
taattaattgtcatt

SEQ ID NO: 5023171 - DNA, 17 bp, Homo sapiens
taattacatatttgcat

SEQ ID NO: 5023172 - DNA, 13 bp, Homo sapiens
taattctaaggaa

SEQ ID NO: 5023173 - DNA, 19 bp, Homo sapiens
taattgttgttctgttaac

SEQ ID NO: 5023174 - DNA, 21 bp, Homo sapiens
taattgttgttctgttaactg

SEQ ID NO: 5023175 - DNA, 23 bp, Homo sapiens
taattgttgttctgttaactgaa

SEQ ID NO: 5023176 - DNA, 19 bp, Homo sapiens
taatttaaacacctcctca

SEQ ID NO: 5023177 - DNA, 14 bp, Homo sapiens
taatttaaagagac

SEQ ID NO: 5023178 - DNA, 21 bp, Homo sapiens
taatttcaggaggaatactga

SEQ ID NO: 5023179 - DNA, 14 bp, Homo sapiens
tacaaaggtttaaa

SEQ ID NO: 5023180 - DNA, 19 bp, Homo sapiens
tacaaaggtttaaatgaac

SEQ ID NO: 5023181 - DNA, 23 bp, Homo sapiens
tacaacagaaaccagaaaagcaa

SEQ ID NO: 5023182 - DNA, 16 bp, Homo sapiens
tacaagactgccatat

SEQ ID NO: 5023183 - DNA, 19 bp, Homo sapiens
tacaagactgccatattaa

SEQ ID NO: 5023184 - DNA, 20 bp, Homo sapiens
tacaagactgccatattaaa

SEQ ID NO: 5023185 - DNA, 14 bp, Homo sapiens
tacaaggacagccc

SEQ ID NO: 5023186 - DNA, 19 bp, Homo sapiens
tacaagtatttttaattaa

SEQ ID NO: 5023187 - DNA, 18 bp, Homo sapiens
tacaattttttttattag

SEQ ID NO: 5023188 - DNA, 21 bp, Homo sapiens
tacaattttttttattagtat

SEQ ID NO: 5023189 - DNA, 14 bp, Homo sapiens
tacacaactcactc

SEQ ID NO: 5023190 - DNA, 18 bp, Homo sapiens
tacacagagcaggactgc

SEQ ID NO: 5023191 - DNA, 12 bp, Homo sapiens
tacagctgtgtt

SEQ ID NO: 5023192 - DNA, 21 bp, Homo sapiens
tacagtatgggggttgtaaat

SEQ ID NO: 5023193 - DNA, 22 bp, Homo sapiens
tacataccctggccgccccctg

SEQ ID NO: 5023194 - DNA, 14 bp, Homo sapiens
tacatcttctgcct

SEQ ID NO: 5023195 - DNA, 23 bp, Homo sapiens
tacatgaggactctattctttaa

SEQ ID NO: 5023196 - DNA, 14 bp, Homo sapiens
tacattgagcattt

SEQ ID NO: 5023197 - DNA, 15 bp, Homo sapiens
tacatttacaaactg

SEQ ID NO: 5023198 - DNA, 17 bp, Homo sapiens
tacatttacaaactgaa

SEQ ID NO: 5023199 - DNA, 18 bp, Homo sapiens
tacatttacaaactgaag

SEQ ID NO: 5023200 - DNA, 18 bp, Homo sapiens
tacatttcatacaacaga

SEQ ID NO: 5023201 - DNA, 13 bp, Homo sapiens
taccactctgtaa

SEQ ID NO: 5023202 - DNA, 15 bp, Homo sapiens
taccactctgtaatt

SEQ ID NO: 5023203 - DNA, 17 bp, Homo sapiens
taccactctgtaattgc

SEQ ID NO: 5023204 - DNA, 18 bp, Homo sapiens
taccactctgtaattgca

SEQ ID NO: 5023205 - DNA, 13 bp, Homo sapiens
taccagaagggaa

SEQ ID NO: 5023206 - DNA, 23 bp, Homo sapiens
tacccaaccagggccccggggcc

SEQ ID NO: 5023207 - DNA, 13 bp, Homo sapiens
tacccactgccat

SEQ ID NO: 5023208 - DNA, 21 bp, Homo sapiens
taccctctcagctccaggtgg

SEQ ID NO: 5023209 - DNA, 12 bp, Homo sapiens
taccctctgggt

SEQ ID NO: 5023210 - DNA, 17 bp, Homo sapiens
taccctttttctccagc

SEQ ID NO: 5023211 - DNA, 14 bp, Homo sapiens
taccgaatgtgtct

SEQ ID NO: 5023212 - DNA, 17 bp, Homo sapiens
taccgaatgtgtcttta

SEQ ID NO: 5023213 - DNA, 14 bp, Homo sapiens
tacctgattgtatt

SEQ ID NO: 5023214 - DNA, 20 bp, Homo sapiens
tacgaaataattgttgttct

SEQ ID NO: 5023215 - DNA, 22 bp, Homo sapiens
tacgaaataattgttgttctgt

SEQ ID NO: 5023216 - DNA, 16 bp, Homo sapiens
tacgtgttcattttat

SEQ ID NO: 5023217 - DNA, 14 bp, Homo sapiens
tactaataaactaa

SEQ ID NO: 5023218 - DNA, 16 bp, Homo sapiens
tactaataaactaata

SEQ ID NO: 5023219 - DNA, 14 bp, Homo sapiens
tactagtgttctgt

SEQ ID NO: 5023220 - DNA, 16 bp, Homo sapiens
tactagtgttctgttt

SEQ ID NO: 5023221 - DNA, 13 bp, Homo sapiens
tactataaagaga

SEQ ID NO: 5023222 - DNA, 11 bp, Homo sapiens
tactatttaaa

SEQ ID NO: 5023223 - DNA, 19 bp, Homo sapiens
tactatttaaagcctcctc

SEQ ID NO: 5023224 - DNA, 22 bp, Homo sapiens
tactatttaaagcctcctcatc

SEQ ID NO: 5023225 - DNA, 18 bp, Homo sapiens
tactcttatagacaacat

SEQ ID NO: 5023226 - DNA, 19 bp, Homo sapiens
tactgaacatctgagtcct

SEQ ID NO: 5023227 - DNA, 21 bp, Homo sapiens
tactgccatgtactagtttta

SEQ ID NO: 5023228 - DNA, 18 bp, Homo sapiens
tactgtaactgtcagtgt

SEQ ID NO: 5023229 - DNA, 14 bp, Homo sapiens
tacttcctcctccc

SEQ ID NO: 5023230 - DNA, 14 bp, Homo sapiens
tacttggtttgtgt

SEQ ID NO: 5023231 - DNA, 15 bp, Homo sapiens
tacttgtaaatataa

SEQ ID NO: 5023232 - DNA, 18 bp, Homo sapiens
tagaaaagtatgttctaa

SEQ ID NO: 5023233 - DNA, 22 bp, Homo sapiens
tagaatcaaacattttgaaagt

SEQ ID NO: 5023234 - DNA, 12 bp, Homo sapiens
tagaattattta

SEQ ID NO: 5023235 - DNA, 15 bp, Homo sapiens
tagaattatttaaac

SEQ ID NO: 5023236 - DNA, 15 bp, Homo sapiens
tagagacccccaggc

SEQ ID NO: 5023237 - DNA, 20 bp, Homo sapiens
tagagtttctgtttgattct

SEQ ID NO: 5023238 - DNA, 23 bp, Homo sapiens
tagagtttctgtttgattctttt

SEQ ID NO: 5023239 - DNA, 23 bp, Homo sapiens
tagatagccctgtcctggtggta

SEQ ID NO: 5023240 - DNA, 13 bp, Homo sapiens
tagatgtcttttc

SEQ ID NO: 5023241 - DNA, 20 bp, Homo sapiens
tagatgtcttttcccattta

SEQ ID NO: 5023242 - DNA, 14 bp, Homo sapiens
tagattaggaaggt

SEQ ID NO: 5023243 - DNA, 21 bp, Homo sapiens
tagcccacttacatttacaaa

SEQ ID NO: 5023244 - DNA, 17 bp, Homo sapiens
tagcgttcttgtaattt

SEQ ID NO: 5023245 - DNA, 18 bp, Homo sapiens
tagcgttcttgtaatttt

SEQ ID NO: 5023246 - DNA, 22 bp, Homo sapiens
tagctaataaaaagcttttgtc

SEQ ID NO: 5023247 - DNA, 17 bp, Homo sapiens
tagctcaatgagcatgt

SEQ ID NO: 5023248 - DNA, 21 bp, Homo sapiens
tagctccccgcttctgcctgc

SEQ ID NO: 5023249 - DNA, 18 bp, Homo sapiens
tagctgaatgtttttcta

SEQ ID NO: 5023250 - DNA, 14 bp, Homo sapiens
tagctgtgggggtg

SEQ ID NO: 5023251 - DNA, 16 bp, Homo sapiens
tagcttatgaaaagaa

SEQ ID NO: 5023252 - DNA, 14 bp, Homo sapiens
taggactgcagtgt

SEQ ID NO: 5023253 - DNA, 16 bp, Homo sapiens
taggcagcctgcaggg

SEQ ID NO: 5023254 - DNA, 17 bp, Homo sapiens
taggcatctctgtactt

SEQ ID NO: 5023255 - DNA, 18 bp, Homo sapiens
taggcattaacacaaagg

SEQ ID NO: 5023256 - DNA, 20 bp, Homo sapiens
taggcattaacacaaaggag

SEQ ID NO: 5023257 - DNA, 13 bp, Homo sapiens
taggccagcaagc

SEQ ID NO: 5023258 - DNA, 21 bp, Homo sapiens
taggctgacacctaactcttc

SEQ ID NO: 5023259 - DNA, 23 bp, Homo sapiens
taggctgacacctaactcttctt

SEQ ID NO: 5023260 - DNA, 14 bp, Homo sapiens
tagggaacaatttg

SEQ ID NO: 5023261 - DNA, 14 bp, Homo sapiens
taggtctgaaattt

SEQ ID NO: 5023262 - DNA, 18 bp, Homo sapiens
taggtctgaaatttttct

SEQ ID NO: 5023263 - DNA, 15 bp, Homo sapiens
taggtgagaaaaaaa

SEQ ID NO: 5023264 - DNA, 21 bp, Homo sapiens
taggtgatctcatttaatcct

SEQ ID NO: 5023265 - DNA, 15 bp, Homo sapiens
tagtattacaccacc

SEQ ID NO: 5023266 - DNA, 17 bp, Homo sapiens
tagtattgttgtccttt

SEQ ID NO: 5023267 - DNA, 21 bp, Homo sapiens
tagtattgttgtccttttcat

SEQ ID NO: 5023268 - DNA, 22 bp, Homo sapiens
tagtattgttgtccttttcata

SEQ ID NO: 5023269 - DNA, 18 bp, Homo sapiens
tagtctcagtgaagacta

SEQ ID NO: 5023270 - DNA, 19 bp, Homo sapiens
tagtctcagtttgtgtgtc

SEQ ID NO: 5023271 - DNA, 12 bp, Homo sapiens
tagtgctttgag

SEQ ID NO: 5023272 - DNA, 15 bp, Homo sapiens
tagtgctttgagaga

SEQ ID NO: 5023273 - DNA, 15 bp, Homo sapiens
tagtgttctgtttgt

SEQ ID NO: 5023274 - DNA, 14 bp, Homo sapiens
tagttttagttttc

SEQ ID NO: 5023275 - DNA, 12 bp, Homo sapiens
tagttttcaaaa

SEQ ID NO: 5023276 - DNA, 13 bp, Homo sapiens
tagttttttcatc

SEQ ID NO: 5023277 - DNA, 13 bp, Homo sapiens
tataaacaagaaa

SEQ ID NO: 5023278 - DNA, 19 bp, Homo sapiens
tataaacaagaaaaataaa

SEQ ID NO: 5023279 - DNA, 22 bp, Homo sapiens
tataaacaagaaaaataaagaa

SEQ ID NO: 5023280 - DNA, 15 bp, Homo sapiens
tataaatatattatt

SEQ ID NO: 5023281 - DNA, 19 bp, Homo sapiens
tataaatcgcttttgataa

SEQ ID NO: 5023282 - DNA, 20 bp, Homo sapiens
tataaatcgcttttgataat

SEQ ID NO: 5023283 - DNA, 16 bp, Homo sapiens
tataaatgcaaataac

SEQ ID NO: 5023284 - DNA, 18 bp, Homo sapiens
tataaatgcaaataacaa

SEQ ID NO: 5023285 - DNA, 13 bp, Homo sapiens
tatagttaacaca

SEQ ID NO: 5023286 - DNA, 16 bp, Homo sapiens
tatatgtgatgatcta

SEQ ID NO: 5023287 - DNA, 17 bp, Homo sapiens
tatattaatgtacttgt

SEQ ID NO: 5023288 - DNA, 12 bp, Homo sapiens
tatattattact

SEQ ID NO: 5023289 - DNA, 16 bp, Homo sapiens
tatattattacttgta

SEQ ID NO: 5023290 - DNA, 18 bp, Homo sapiens
tatcacattaatctcaaa

SEQ ID NO: 5023291 - DNA, 22 bp, Homo sapiens
tatcacattaatctcaaagaga

SEQ ID NO: 5023292 - DNA, 16 bp, Homo sapiens
tatcacctagctgaat

SEQ ID NO: 5023293 - DNA, 14 bp, Homo sapiens
tatcatcagtattg

SEQ ID NO: 5023294 - DNA, 17 bp, Homo sapiens
tatgaacagctgtgtct

SEQ ID NO: 5023295 - DNA, 14 bp, Homo sapiens
tatgaccacactcc

SEQ ID NO: 5023296 - DNA, 20 bp, Homo sapiens
tatgacttcattaataataa

SEQ ID NO: 5023297 - DNA, 15 bp, Homo sapiens
tatgctttaaacatt

SEQ ID NO: 5023298 - DNA, 18 bp, Homo sapiens
tatggaagttgcataatt

SEQ ID NO: 5023299 - DNA, 17 bp, Homo sapiens
tatggggatggtagttt

SEQ ID NO: 5023300 - DNA, 15 bp, Homo sapiens
tatgtaataatgtga

SEQ ID NO: 5023301 - DNA, 16 bp, Homo sapiens
tatgtaataatgtgaa

SEQ ID NO: 5023302 - DNA, 19 bp, Homo sapiens
tatgttatatataaatata

SEQ ID NO: 5023303 - DNA, 21 bp, Homo sapiens
tattaaagaaaaaaatgtatt

SEQ ID NO: 5023304 - DNA, 23 bp, Homo sapiens
tattaaattttttgttgacatta

SEQ ID NO: 5023305 - DNA, 22 bp, Homo sapiens
tattacaccaccggccccctcc

SEQ ID NO: 5023306 - DNA, 15 bp, Homo sapiens
tattacagtgtttat

SEQ ID NO: 5023307 - DNA, 21 bp, Homo sapiens
tattagaatcaaacattttga

SEQ ID NO: 5023308 - DNA, 23 bp, Homo sapiens
tattagaatcaaacattttgaaa

SEQ ID NO: 5023309 - DNA, 17 bp, Homo sapiens
tattagtattgttgtcc

SEQ ID NO: 5023310 - DNA, 19 bp, Homo sapiens
tattagtattgttgtcctt

SEQ ID NO: 5023311 - DNA, 20 bp, Homo sapiens
tattagtattgttgtccttt

SEQ ID NO: 5023312 - DNA, 21 bp, Homo sapiens
tattagtgacctcagctttga

SEQ ID NO: 5023313 - DNA, 22 bp, Homo sapiens
tattatcacattaatctcaaag

SEQ ID NO: 5023314 - DNA, 17 bp, Homo sapiens
tattattaatataataa

SEQ ID NO: 5023315 - DNA, 15 bp, Homo sapiens
tattctaaaaccatt

SEQ ID NO: 5023316 - DNA, 15 bp, Homo sapiens
tattgaagcatttta

SEQ ID NO: 5023317 - DNA, 16 bp, Homo sapiens
tattgaagcattttat

SEQ ID NO: 5023318 - DNA, 19 bp, Homo sapiens
tattgaagcattttataaa

SEQ ID NO: 5023319 - DNA, 16 bp, Homo sapiens
tattgtgcaatgtgta

SEQ ID NO: 5023320 - DNA, 16 bp, Homo sapiens
tattgttgtccttttc

SEQ ID NO: 5023321 - DNA, 22 bp, Homo sapiens
tattgttgtccttttcataggt

SEQ ID NO: 5023322 - DNA, 17 bp, Homo sapiens
tatttataatcactttt

SEQ ID NO: 5023323 - DNA, 14 bp, Homo sapiens
tatttattgcattg

SEQ ID NO: 5023324 - DNA, 22 bp, Homo sapiens
tattttaaaatagcgttcttgt

SEQ ID NO: 5023325 - DNA, 16 bp, Homo sapiens
tattttagaataaatt

SEQ ID NO: 5023326 - DNA, 19 bp, Homo sapiens
tattttcaatagccactaa

SEQ ID NO: 5023327 - DNA, 19 bp, Homo sapiens
tattttcatccttgtctta

SEQ ID NO: 5023328 - DNA, 21 bp, Homo sapiens
tattttcctatattacggttt

SEQ ID NO: 5023329 - DNA, 21 bp, Homo sapiens
tattttgcagttcccacatta

SEQ ID NO: 5023330 - DNA, 21 bp, Homo sapiens
tattttgttttgtgcagagat

SEQ ID NO: 5023331 - DNA, 14 bp, Homo sapiens
tatttttaattaat

SEQ ID NO: 5023332 - DNA, 14 bp, Homo sapiens
tatttttgtagtga

SEQ ID NO: 5023333 - DNA, 14 bp, Homo sapiens
tattttttttctgt

SEQ ID NO: 5023334 - DNA, 22 bp, Homo sapiens
tcaaaaactttggagtcccctc

SEQ ID NO: 5023335 - DNA, 15 bp, Homo sapiens
tcaaacattttgaaa

SEQ ID NO: 5023336 - DNA, 23 bp, Homo sapiens
tcaaacggcctcactaggcttct

SEQ ID NO: 5023337 - DNA, 20 bp, Homo sapiens
tcaaactactttgctgctaa

SEQ ID NO: 5023338 - DNA, 17 bp, Homo sapiens
tcaaagaaattcagaac

SEQ ID NO: 5023339 - DNA, 16 bp, Homo sapiens
tcaaagagattcgaat

SEQ ID NO: 5023340 - DNA, 21 bp, Homo sapiens
tcaaagcatgggattattaga

SEQ ID NO: 5023341 - DNA, 14 bp, Homo sapiens
tcaaatctgggctc

SEQ ID NO: 5023342 - DNA, 12 bp, Homo sapiens
tcaaattgctgc

SEQ ID NO: 5023343 - DNA, 13 bp, Homo sapiens
tcaaccatcctgg

SEQ ID NO: 5023344 - DNA, 22 bp, Homo sapiens
tcaacccattgttgtcaaggaa

SEQ ID NO: 5023345 - DNA, 12 bp, Homo sapiens
tcaactgggctg

SEQ ID NO: 5023346 - DNA, 11 bp, Homo sapiens
tcaagaaatga

SEQ ID NO: 5023347 - DNA, 21 bp, Homo sapiens
tcaagagatctttctttccaa

SEQ ID NO: 5023348 - DNA, 18 bp, Homo sapiens
tcaagcagcgaccgcccc

SEQ ID NO: 5023349 - DNA, 23 bp, Homo sapiens
tcaagcagcgaccgccccctcct

SEQ ID NO: 5023350 - DNA, 15 bp, Homo sapiens
tcaagcccagaaagt

SEQ ID NO: 5023351 - DNA, 16 bp, Homo sapiens
tcaaggaagaagaaat

SEQ ID NO: 5023352 - DNA, 21 bp, Homo sapiens
tcaaggacacgggcctgtcca

SEQ ID NO: 5023353 - DNA, 21 bp, Homo sapiens
tcaagttttgggtatgtttaa

SEQ ID NO: 5023354 - DNA, 13 bp, Homo sapiens
tcaatgagcatgt

SEQ ID NO: 5023355 - DNA, 21 bp, Homo sapiens
tcaatgagcatgtttagactt

SEQ ID NO: 5023356 - DNA, 13 bp, Homo sapiens
tcaattttgactt

SEQ ID NO: 5023357 - DNA, 18 bp, Homo sapiens
tcaattttgacttaatgt

SEQ ID NO: 5023358 - DNA, 14 bp, Homo sapiens
tcacagctcctccc

SEQ ID NO: 5023359 - DNA, 15 bp, Homo sapiens
tcacagtccaaccag

SEQ ID NO: 5023360 - DNA, 18 bp, Homo sapiens
tcacagtggccacggcca

SEQ ID NO: 5023361 - DNA, 20 bp, Homo sapiens
tcacagttttggttgcttta

SEQ ID NO: 5023362 - DNA, 18 bp, Homo sapiens
tcacataaaatagatttt

SEQ ID NO: 5023363 - DNA, 21 bp, Homo sapiens
tcacatgaattattacagtgt

SEQ ID NO: 5023364 - DNA, 18 bp, Homo sapiens
tcacattgtttgctgcta

SEQ ID NO: 5023365 - DNA, 19 bp, Homo sapiens
tcacattgtttgctgctat

SEQ ID NO: 5023366 - DNA, 16 bp, Homo sapiens
tcaccgagtgggggca

SEQ ID NO: 5023367 - DNA, 17 bp, Homo sapiens
tcacctaagtctctgtg

SEQ ID NO: 5023368 - DNA, 16 bp, Homo sapiens
tcacctagctgaatgt

SEQ ID NO: 5023369 - DNA, 20 bp, Homo sapiens
tcacctagctgaatgttttt

SEQ ID NO: 5023370 - DNA, 22 bp, Homo sapiens
tcacctagctgaatgtttttct

SEQ ID NO: 5023371 - DNA, 23 bp, Homo sapiens
tcacgagcctttgtttttctcca

SEQ ID NO: 5023372 - DNA, 13 bp, Homo sapiens
tcactccttttaa

SEQ ID NO: 5023373 - DNA, 14 bp, Homo sapiens
tcactggaactcag

SEQ ID NO: 5023374 - DNA, 18 bp, Homo sapiens
tcacttacgtttgtcctt

SEQ ID NO: 5023375 - DNA, 13 bp, Homo sapiens
tcacttagccatg

SEQ ID NO: 5023376 - DNA, 14 bp, Homo sapiens
tcacttccttgccc

SEQ ID NO: 5023377 - DNA, 19 bp, Homo sapiens
tcacttgtcaggagtgtgt

SEQ ID NO: 5023378 - DNA, 11 bp, Homo sapiens
tcactttgaaa

SEQ ID NO: 5023379 - DNA, 22 bp, Homo sapiens
tcactttgaaaagttggaagga

SEQ ID NO: 5023380 - DNA, 15 bp, Homo sapiens
tcacttttttccaca

SEQ ID NO: 5023381 - DNA, 19 bp, Homo sapiens
tcagaacagcctgcctgtc

SEQ ID NO: 5023382 - DNA, 18 bp, Homo sapiens
tcagaaggcaaatgactt

SEQ ID NO: 5023383 - DNA, 19 bp, Homo sapiens
tcagaaggcaaatgacttt

SEQ ID NO: 5023384 - DNA, 22 bp, Homo sapiens
tcagataactgttatttataat

SEQ ID NO: 5023385 - DNA, 16 bp, Homo sapiens
tcagatgcagtttgga

SEQ ID NO: 5023386 - DNA, 20 bp, Homo sapiens
tcagcaaaccatttttaaag

SEQ ID NO: 5023387 - DNA, 16 bp, Homo sapiens
tcagcaatttcagaac

SEQ ID NO: 5023388 - DNA, 18 bp, Homo sapiens
tcagcactgcctgctccc

SEQ ID NO: 5023389 - DNA, 22 bp, Homo sapiens
tcagcactgcctgctcccatcc

SEQ ID NO: 5023390 - DNA, 20 bp, Homo sapiens
tcagcagaacctgcacacag

SEQ ID NO: 5023391 - DNA, 22 bp, Homo sapiens
tcagcagaacctgcacacagga

SEQ ID NO: 5023392 - DNA, 21 bp, Homo sapiens
tcaggaaacgagactttccat

SEQ ID NO: 5023393 - DNA, 15 bp, Homo sapiens
tcaggcagcaccaca

SEQ ID NO: 5023394 - DNA, 20 bp, Homo sapiens
tcagtgccctccaggataga

SEQ ID NO: 5023395 - DNA, 20 bp, Homo sapiens
tcagtggggcccatggatgt

SEQ ID NO: 5023396 - DNA, 17 bp, Homo sapiens
tcagttaagcctttgga

SEQ ID NO: 5023397 - DNA, 15 bp, Homo sapiens
tcagttactcttcag

SEQ ID NO: 5023398 - DNA, 13 bp, Homo sapiens
tcagttgtctctg

SEQ ID NO: 5023399 - DNA, 15 bp, Homo sapiens
tcagtttgtgtgtct

SEQ ID NO: 5023400 - DNA, 18 bp, Homo sapiens
tcagttttttgttttaca

SEQ ID NO: 5023401 - DNA, 19 bp, Homo sapiens
tcataatgggggtaaagtt

SEQ ID NO: 5023402 - DNA, 22 bp, Homo sapiens
tcataggtctgaaatttttctt

SEQ ID NO: 5023403 - DNA, 22 bp, Homo sapiens
tcatagtagtttttacagctgt

SEQ ID NO: 5023404 - DNA, 18 bp, Homo sapiens
tcatattctaaaaccatt

SEQ ID NO: 5023405 - DNA, 14 bp, Homo sapiens
tcatccaccccatc

SEQ ID NO: 5023406 - DNA, 16 bp, Homo sapiens
tcatccaccccatccc

SEQ ID NO: 5023407 - DNA, 13 bp, Homo sapiens
tcatccatccagg

SEQ ID NO: 5023408 - DNA, 15 bp, Homo sapiens
tcatcctgtgctcgg

SEQ ID NO: 5023409 - DNA, 13 bp, Homo sapiens
tcatccttgtctt

SEQ ID NO: 5023410 - DNA, 14 bp, Homo sapiens
tcatccttgtctta

SEQ ID NO: 5023411 - DNA, 21 bp, Homo sapiens
tcatctgattggacaggcatg

SEQ ID NO: 5023412 - DNA, 22 bp, Homo sapiens
tcatctgtaagagcttgctcca

SEQ ID NO: 5023413 - DNA, 21 bp, Homo sapiens
tcatgccagctacttcctcct

SEQ ID NO: 5023414 - DNA, 16 bp, Homo sapiens
tcattatttatgtatt

SEQ ID NO: 5023415 - DNA, 17 bp, Homo sapiens
tcattatttatgtattg

SEQ ID NO: 5023416 - DNA, 16 bp, Homo sapiens
tcattctcgtgagtca

SEQ ID NO: 5023417 - DNA, 20 bp, Homo sapiens
tcattgcaacctccaccttc

SEQ ID NO: 5023418 - DNA, 15 bp, Homo sapiens
tcattggaaatttag

SEQ ID NO: 5023419 - DNA, 19 bp, Homo sapiens
tcattggaaatttagcatt

SEQ ID NO: 5023420 - DNA, 20 bp, Homo sapiens
tcatttctgcagatggaaag

SEQ ID NO: 5023421 - DNA, 13 bp, Homo sapiens
tccaaagctttat

SEQ ID NO: 5023422 - DNA, 14 bp, Homo sapiens
tccaaatgcagctt

SEQ ID NO: 5023423 - DNA, 21 bp, Homo sapiens
tccaactgcctaaggcccttt

SEQ ID NO: 5023424 - DNA, 17 bp, Homo sapiens
tccaattaaggatttta

SEQ ID NO: 5023425 - DNA, 16 bp, Homo sapiens
tccacaggcttctgag

SEQ ID NO: 5023426 - DNA, 18 bp, Homo sapiens
tccacataaggaaactgg

SEQ ID NO: 5023427 - DNA, 20 bp, Homo sapiens
tccaccctgccaagactcct

SEQ ID NO: 5023428 - DNA, 15 bp, Homo sapiens
tccaccttctgggtt

SEQ ID NO: 5023429 - DNA, 18 bp, Homo sapiens
tccagattctgatgcata

SEQ ID NO: 5023430 - DNA, 17 bp, Homo sapiens
tccagcagaagacaaaa

SEQ ID NO: 5023431 - DNA, 23 bp, Homo sapiens
tccagcagaagacaaaaagacaa

SEQ ID NO: 5023432 - DNA, 15 bp, Homo sapiens
tccagccctggctga

SEQ ID NO: 5023433 - DNA, 21 bp, Homo sapiens
tccagccctggctgaaggact

SEQ ID NO: 5023434 - DNA, 22 bp, Homo sapiens
tccagggaccactgggtgagag

SEQ ID NO: 5023435 - DNA, 18 bp, Homo sapiens
tccagtcaaatctgggct

SEQ ID NO: 5023436 - DNA, 17 bp, Homo sapiens
tccagtggaggtttgtc

SEQ ID NO: 5023437 - DNA, 16 bp, Homo sapiens
tccatccaggccattc

SEQ ID NO: 5023438 - DNA, 21 bp, Homo sapiens
tccatgcaccctcatacacag

SEQ ID NO: 5023439 - DNA, 14 bp, Homo sapiens
tccatggattttgg

SEQ ID NO: 5023440 - DNA, 12 bp, Homo sapiens
tccatttgcatt

SEQ ID NO: 5023441 - DNA, 16 bp, Homo sapiens
tccatttgcatttgtt

SEQ ID NO: 5023442 - DNA, 15 bp, Homo sapiens
tcccacccacccgcc

SEQ ID NO: 5023443 - DNA, 23 bp, Homo sapiens
tcccacccacccgccgcctccca

SEQ ID NO: 5023444 - DNA, 18 bp, Homo sapiens
tcccacccccacccccag

SEQ ID NO: 5023445 - DNA, 16 bp, Homo sapiens
tcccagaggagcagct

SEQ ID NO: 5023446 - DNA, 14 bp, Homo sapiens
tcccagtgacaaca

SEQ ID NO: 5023447 - DNA, 13 bp, Homo sapiens
tcccatcgctgtc

SEQ ID NO: 5023448 - DNA, 17 bp, Homo sapiens
tcccatttatctaaata

SEQ ID NO: 5023449 - DNA, 19 bp, Homo sapiens
tccccaaaagcgtgagctt

SEQ ID NO: 5023450 - DNA, 15 bp, Homo sapiens
tccccacagtgccac

SEQ ID NO: 5023451 - DNA, 17 bp, Homo sapiens
tccccacagtgccaccc

SEQ ID NO: 5023452 - DNA, 17 bp, Homo sapiens
tccccacttctgtgcca

SEQ ID NO: 5023453 - DNA, 21 bp, Homo sapiens
tccccacttgtccgctgggtg

SEQ ID NO: 5023454 - DNA, 15 bp, Homo sapiens
tccccaggcatttgc

SEQ ID NO: 5023455 - DNA, 17 bp, Homo sapiens
tccccgaggagctgggc

SEQ ID NO: 5023456 - DNA, 23 bp, Homo sapiens
tccccgaggagctgggcccctgc

SEQ ID NO: 5023457 - DNA, 21 bp, Homo sapiens
tccccgatgtcccctgcgggc

SEQ ID NO: 5023458 - DNA, 16 bp, Homo sapiens
tcccctctcagaacat

SEQ ID NO: 5023459 - DNA, 23 bp, Homo sapiens
tcccctctcagaacatactgatt

SEQ ID NO: 5023460 - DNA, 13 bp, Homo sapiens
tcccctctgctgc

SEQ ID NO: 5023461 - DNA, 17 bp, Homo sapiens
tcccctctgctgctgtc

SEQ ID NO: 5023462 - DNA, 19 bp, Homo sapiens
tcccctgccccttccttta

SEQ ID NO: 5023463 - DNA, 18 bp, Homo sapiens
tcccgcactctgccccca

SEQ ID NO: 5023464 - DNA, 18 bp, Homo sapiens
tcccggaggttgggtggg

SEQ ID NO: 5023465 - DNA, 21 bp, Homo sapiens
tcccgtacgtgttcattttat

SEQ ID NO: 5023466 - DNA, 20 bp, Homo sapiens
tcccgtttctccacctagac

SEQ ID NO: 5023467 - DNA, 21 bp, Homo sapiens
tccctattttttttctgttat

SEQ ID NO: 5023468 - DNA, 18 bp, Homo sapiens
tccctctttggctcccct

SEQ ID NO: 5023469 - DNA, 13 bp, Homo sapiens
tccctgagatggg

SEQ ID NO: 5023470 - DNA, 21 bp, Homo sapiens
tccctgcgcctgtgatgctgg

SEQ ID NO: 5023471 - DNA, 13 bp, Homo sapiens
tccctgggcctca

SEQ ID NO: 5023472 - DNA, 20 bp, Homo sapiens
tcccttcagtaccctctcag

SEQ ID NO: 5023473 - DNA, 23 bp, Homo sapiens
tccgcaatgtggagcagcagcca

SEQ ID NO: 5023474 - DNA, 20 bp, Homo sapiens
tccggcccagtgccactgcc

SEQ ID NO: 5023475 - DNA, 18 bp, Homo sapiens
tccggtgtttaagacatt

SEQ ID NO: 5023476 - DNA, 16 bp, Homo sapiens
tccgtggttgccctag

SEQ ID NO: 5023477 - DNA, 17 bp, Homo sapiens
tcctagcacacactttt

SEQ ID NO: 5023478 - DNA, 18 bp, Homo sapiens
tcctagcacacacttttg

SEQ ID NO: 5023479 - DNA, 18 bp, Homo sapiens
tcctcatccaccccatcc

SEQ ID NO: 5023480 - DNA, 16 bp, Homo sapiens
tcctcccctcctcctg

SEQ ID NO: 5023481 - DNA, 15 bp, Homo sapiens
tcctctagctgtggg

SEQ ID NO: 5023482 - DNA, 20 bp, Homo sapiens
tcctctcaaccacctttcag

SEQ ID NO: 5023483 - DNA, 20 bp, Homo sapiens
tcctgataaagcacagctgt

SEQ ID NO: 5023484 - DNA, 21 bp, Homo sapiens
tcctgataaagcacagctgta

SEQ ID NO: 5023485 - DNA, 15 bp, Homo sapiens
tcctgcaatgaagtc

SEQ ID NO: 5023486 - DNA, 21 bp, Homo sapiens
tcctgcacacgctccttcctc

SEQ ID NO: 5023487 - DNA, 16 bp, Homo sapiens
tcctgccggtgggacc

SEQ ID NO: 5023488 - DNA, 16 bp, Homo sapiens
tcctgcctaaggctga

SEQ ID NO: 5023489 - DNA, 18 bp, Homo sapiens
tcctggagcagaccaccc

SEQ ID NO: 5023490 - DNA, 23 bp, Homo sapiens
tcctggctcttgatacccccctc

SEQ ID NO: 5023491 - DNA, 22 bp, Homo sapiens
tcctggctgcggcgtctgtctg

SEQ ID NO: 5023492 - DNA, 19 bp, Homo sapiens
tcctggtggtattttcaat

SEQ ID NO: 5023493 - DNA, 21 bp, Homo sapiens
tcctggtggtattttcaatag

SEQ ID NO: 5023494 - DNA, 17 bp, Homo sapiens
tcctgtccacacccagc

SEQ ID NO: 5023495 - DNA, 14 bp, Homo sapiens
tcctgtccttttaa

SEQ ID NO: 5023496 - DNA, 14 bp, Homo sapiens
tcctgtgtaacact

SEQ ID NO: 5023497 - DNA, 22 bp, Homo sapiens
tcctgtgtgttaagctctgcta

SEQ ID NO: 5023498 - DNA, 18 bp, Homo sapiens
tccttagacctgagggac

SEQ ID NO: 5023499 - DNA, 16 bp, Homo sapiens
tccttcctctgaggct

SEQ ID NO: 5023500 - DNA, 14 bp, Homo sapiens
tccttgttgttggt

SEQ ID NO: 5023501 - DNA, 14 bp, Homo sapiens
tcctttacgtgttt

SEQ ID NO: 5023502 - DNA, 16 bp, Homo sapiens
tcctttacgtgtttaa

SEQ ID NO: 5023503 - DNA, 17 bp, Homo sapiens
tcctttgcgcctgtgac

SEQ ID NO: 5023504 - DNA, 23 bp, Homo sapiens
tccttttaaagaaaaaaattgaa

SEQ ID NO: 5023505 - DNA, 15 bp, Homo sapiens
tccttttataggtga

SEQ ID NO: 5023506 - DNA, 14 bp, Homo sapiens
tccttttcataggt

SEQ ID NO: 5023507 - DNA, 15 bp, Homo sapiens
tccttttcctctctc

SEQ ID NO: 5023508 - DNA, 15 bp, Homo sapiens
tcgagagctggccaa

SEQ ID NO: 5023509 - DNA, 21 bp, Homo sapiens
tcgagatggcagattcccact

SEQ ID NO: 5023510 - DNA, 17 bp, Homo sapiens
tcgaggcggatctttgg

SEQ ID NO: 5023511 - DNA, 12 bp, Homo sapiens
tcgcagctgtgg

SEQ ID NO: 5023512 - DNA, 16 bp, Homo sapiens
tcgctagggccaaggt

SEQ ID NO: 5023513 - DNA, 15 bp, Homo sapiens
tcgctctttgagaaa

SEQ ID NO: 5023514 - DNA, 19 bp, Homo sapiens
tcggccaggcattggctca

SEQ ID NO: 5023515 - DNA, 19 bp, Homo sapiens
tcggctccccatgtgtcct

SEQ ID NO: 5023516 - DNA, 12 bp, Homo sapiens
tcggctctggag

SEQ ID NO: 5023517 - DNA, 17 bp, Homo sapiens
tcggcttggatcctggg

SEQ ID NO: 5023518 - DNA, 19 bp, Homo sapiens
tcggcttggatcctgggct

SEQ ID NO: 5023519 - DNA, 16 bp, Homo sapiens
tcgggcaccagccagc

SEQ ID NO: 5023520 - DNA, 18 bp, Homo sapiens
tcgtatgatacttcgaca

SEQ ID NO: 5023521 - DNA, 17 bp, Homo sapiens
tcgtgtgcaacagacaa

SEQ ID NO: 5023522 - DNA, 20 bp, Homo sapiens
tcgttttttttttgtttgtt

SEQ ID NO: 5023523 - DNA, 13 bp, Homo sapiens
tctaaaggagttt

SEQ ID NO: 5023524 - DNA, 16 bp, Homo sapiens
tctaacctttacatga

SEQ ID NO: 5023525 - DNA, 22 bp, Homo sapiens
tctaacctttacatgaggactc

SEQ ID NO: 5023526 - DNA, 19 bp, Homo sapiens
tctaagtaaatacaatttt

SEQ ID NO: 5023527 - DNA, 20 bp, Homo sapiens
tctaagtaaatacaattttt

SEQ ID NO: 5023528 - DNA, 17 bp, Homo sapiens
tctacaactcatacact

SEQ ID NO: 5023529 - DNA, 16 bp, Homo sapiens
tctacatcttctgcct

SEQ ID NO: 5023530 - DNA, 17 bp, Homo sapiens
tctacatcttctgcctt

SEQ ID NO: 5023531 - DNA, 20 bp, Homo sapiens
tctacattgagcatttgaaa

SEQ ID NO: 5023532 - DNA, 19 bp, Homo sapiens
tctacctcaggcagctcaa

SEQ ID NO: 5023533 - DNA, 16 bp, Homo sapiens
tctaggactgcagtgt

SEQ ID NO: 5023534 - DNA, 20 bp, Homo sapiens
tctaggactgcagtgtggag

SEQ ID NO: 5023535 - DNA, 19 bp, Homo sapiens
tctaggagggagacactgg

SEQ ID NO: 5023536 - DNA, 21 bp, Homo sapiens
tctatgctgtttgtagtgaaa

SEQ ID NO: 5023537 - DNA, 17 bp, Homo sapiens
tctcaaagagattcgaa

SEQ ID NO: 5023538 - DNA, 23 bp, Homo sapiens
tctcaaatccctctccaactgcc

SEQ ID NO: 5023539 - DNA, 17 bp, Homo sapiens
tctcaaccacctttcag

SEQ ID NO: 5023540 - DNA, 16 bp, Homo sapiens
tctcaatgaagccagc

SEQ ID NO: 5023541 - DNA, 16 bp, Homo sapiens
tctcagaacatactga

SEQ ID NO: 5023542 - DNA, 21 bp, Homo sapiens
tctcagaaggcaaatgacttt

SEQ ID NO: 5023543 - DNA, 16 bp, Homo sapiens
tctcagctccaggtgg

SEQ ID NO: 5023544 - DNA, 19 bp, Homo sapiens
tctcaggcagcaccacact

SEQ ID NO: 5023545 - DNA, 20 bp, Homo sapiens
tctcagtgaagactatgaaa

SEQ ID NO: 5023546 - DNA, 11 bp, Homo sapiens
tctcagtgtcc

SEQ ID NO: 5023547 - DNA, 18 bp, Homo sapiens
tctcagtgttgagccttt

SEQ ID NO: 5023548 - DNA, 23 bp, Homo sapiens
tctcattggaaatttagcattgt

SEQ ID NO: 5023549 - DNA, 16 bp, Homo sapiens
tctcatttaatcctct

SEQ ID NO: 5023550 - DNA, 17 bp, Homo sapiens
tctccagctgggctctg

SEQ ID NO: 5023551 - DNA, 21 bp, Homo sapiens
tctccagctgggctctgcaat

SEQ ID NO: 5023552 - DNA, 20 bp, Homo sapiens
tctccccaggcatttgccaa

SEQ ID NO: 5023553 - DNA, 17 bp, Homo sapiens
tctccctcaactgaagg

SEQ ID NO: 5023554 - DNA, 18 bp, Homo sapiens
tctccctcccctctcaga

SEQ ID NO: 5023555 - DNA, 23 bp, Homo sapiens
tctccctcccctctcagaacata

SEQ ID NO: 5023556 - DNA, 12 bp, Homo sapiens
tctccgagagag

SEQ ID NO: 5023557 - DNA, 17 bp, Homo sapiens
tctccttttcctctctc

SEQ ID NO: 5023558 - DNA, 19 bp, Homo sapiens
tctccttttcctctctccc

SEQ ID NO: 5023559 - DNA, 21 bp, Homo sapiens
tctcggctccccatgtgtcct

SEQ ID NO: 5023560 - DNA, 14 bp, Homo sapiens
tctcgggagaggat

SEQ ID NO: 5023561 - DNA, 13 bp, Homo sapiens
tctcggggcttgc

SEQ ID NO: 5023562 - DNA, 20 bp, Homo sapiens
tctcttatggatgtccccag

SEQ ID NO: 5023563 - DNA, 22 bp, Homo sapiens
tctctttcacattgtttgctgc

SEQ ID NO: 5023564 - DNA, 15 bp, Homo sapiens
tctgaaatttttctt

SEQ ID NO: 5023565 - DNA, 20 bp, Homo sapiens
tctgaaatttttcttcttga

SEQ ID NO: 5023566 - DNA, 13 bp, Homo sapiens
tctgaatgcttct

SEQ ID NO: 5023567 - DNA, 17 bp, Homo sapiens
tctgaatgcttctaagt

SEQ ID NO: 5023568 - DNA, 15 bp, Homo sapiens
tctgacaacagactt

SEQ ID NO: 5023569 - DNA, 12 bp, Homo sapiens
tctgacatctct

SEQ ID NO: 5023570 - DNA, 20 bp, Homo sapiens
tctgacgcttgtgacagtgc

SEQ ID NO: 5023571 - DNA, 18 bp, Homo sapiens
tctgagcagcgagcctgc

SEQ ID NO: 5023572 - DNA, 21 bp, Homo sapiens
tctgagcagcgagcctgctag

SEQ ID NO: 5023573 - DNA, 13 bp, Homo sapiens
tctgatgcagctt

SEQ ID NO: 5023574 - DNA, 17 bp, Homo sapiens
tctgatgcagcttatac

SEQ ID NO: 5023575 - DNA, 14 bp, Homo sapiens
tctgcaacactttg

SEQ ID NO: 5023576 - DNA, 14 bp, Homo sapiens
tctgcaactgctca

SEQ ID NO: 5023577 - DNA, 20 bp, Homo sapiens
tctgcaattcccctctgctg

SEQ ID NO: 5023578 - DNA, 14 bp, Homo sapiens
tctgccaaacacat

SEQ ID NO: 5023579 - DNA, 16 bp, Homo sapiens
tctgctaaataaacat

SEQ ID NO: 5023580 - DNA, 18 bp, Homo sapiens
tctgctcattttgacaaa

SEQ ID NO: 5023581 - DNA, 22 bp, Homo sapiens
tctgctcattttgacaaagtgc

SEQ ID NO: 5023582 - DNA, 12 bp, Homo sapiens
tctgctcctgga

SEQ ID NO: 5023583 - DNA, 19 bp, Homo sapiens
tctgctgaggcccagtgca

SEQ ID NO: 5023584 - DNA, 20 bp, Homo sapiens
tctgctgaggcccagtgcat

SEQ ID NO: 5023585 - DNA, 18 bp, Homo sapiens
tctgctgctgtccctccc

SEQ ID NO: 5023586 - DNA, 15 bp, Homo sapiens
tctgggccagaattt

SEQ ID NO: 5023587 - DNA, 20 bp, Homo sapiens
tctgggcggcgggcggctgg

SEQ ID NO: 5023588 - DNA, 17 bp, Homo sapiens
tctgggtctcagtgtcc

SEQ ID NO: 5023589 - DNA, 21 bp, Homo sapiens
tctggttcctcccctcctcct

SEQ ID NO: 5023590 - DNA, 21 bp, Homo sapiens
tctgtccagctcccgctgtgg

SEQ ID NO: 5023591 - DNA, 18 bp, Homo sapiens
tctgtccttgaaggacta

SEQ ID NO: 5023592 - DNA, 15 bp, Homo sapiens
tctgtgggtctctgg

SEQ ID NO: 5023593 - DNA, 20 bp, Homo sapiens
tctgttaactgaataccact

SEQ ID NO: 5023594 - DNA, 18 bp, Homo sapiens
tctgttatataaatggtt

SEQ ID NO: 5023595 - DNA, 13 bp, Homo sapiens
tctgtttgattct

SEQ ID NO: 5023596 - DNA, 15 bp, Homo sapiens
tctgttttatgactt

SEQ ID NO: 5023597 - DNA, 19 bp, Homo sapiens
tcttaaagtgccagtattt

SEQ ID NO: 5023598 - DNA, 19 bp, Homo sapiens
tcttaaataataaagatca

SEQ ID NO: 5023599 - DNA, 15 bp, Homo sapiens
tcttaatatatttga

SEQ ID NO: 5023600 - DNA, 20 bp, Homo sapiens
tcttaattattatttgtgtt

SEQ ID NO: 5023601 - DNA, 21 bp, Homo sapiens
tcttagctcaatgagcatgtt

SEQ ID NO: 5023602 - DNA, 20 bp, Homo sapiens
tcttattcccttcctgccag

SEQ ID NO: 5023603 - DNA, 19 bp, Homo sapiens
tcttcacctaagtctctgt

SEQ ID NO: 5023604 - DNA, 22 bp, Homo sapiens
tcttcagttaagcctttggaaa

SEQ ID NO: 5023605 - DNA, 18 bp, Homo sapiens
tcttcatacctacatgta

SEQ ID NO: 5023606 - DNA, 18 bp, Homo sapiens
tcttcctccgaggccagt

SEQ ID NO: 5023607 - DNA, 20 bp, Homo sapiens
tcttgatacccccctctgtc

SEQ ID NO: 5023608 - DNA, 16 bp, Homo sapiens
tcttgatcagttaaga

SEQ ID NO: 5023609 - DNA, 17 bp, Homo sapiens
tcttgatcagttaagaa

SEQ ID NO: 5023610 - DNA, 15 bp, Homo sapiens
tcttgtctataaagc

SEQ ID NO: 5023611 - DNA, 15 bp, Homo sapiens
tcttgtgaaggcagg

SEQ ID NO: 5023612 - DNA, 16 bp, Homo sapiens
tcttgttggtgcacag

SEQ ID NO: 5023613 - DNA, 15 bp, Homo sapiens
tctttaaaagagaga

SEQ ID NO: 5023614 - DNA, 17 bp, Homo sapiens
tctttaaaagagagaga

SEQ ID NO: 5023615 - DNA, 23 bp, Homo sapiens
tctttacaaaacaaactcattca

SEQ ID NO: 5023616 - DNA, 23 bp, Homo sapiens
tctttagatagccctgtcctggt

SEQ ID NO: 5023617 - DNA, 19 bp, Homo sapiens
tctttcacagctcctccca

SEQ ID NO: 5023618 - DNA, 22 bp, Homo sapiens
tctttcacattgtttgctgcta

SEQ ID NO: 5023619 - DNA, 14 bp, Homo sapiens
tctttccatttgca

SEQ ID NO: 5023620 - DNA, 22 bp, Homo sapiens
tctttccatttgcatttgttta

SEQ ID NO: 5023621 - DNA, 21 bp, Homo sapiens
tctttctccttgaatatcttt

SEQ ID NO: 5023622 - DNA, 15 bp, Homo sapiens
tctttgcaccaaaga

SEQ ID NO: 5023623 - DNA, 19 bp, Homo sapiens
tctttggacagaagcagct

SEQ ID NO: 5023624 - DNA, 19 bp, Homo sapiens
tctttgttttgtgtctctt

SEQ ID NO: 5023625 - DNA, 18 bp, Homo sapiens
tcttttagatcctaagtc

SEQ ID NO: 5023626 - DNA, 16 bp, Homo sapiens
tcttttcccatttatc

SEQ ID NO: 5023627 - DNA, 20 bp, Homo sapiens
tcttttcccatttatctaaa

SEQ ID NO: 5023628 - DNA, 13 bp, Homo sapiens
tcttttgcttttg

SEQ ID NO: 5023629 - DNA, 19 bp, Homo sapiens
tcttttttaataaactact

SEQ ID NO: 5023630 - DNA, 19 bp, Homo sapiens
tctttttttgagtgacagc

SEQ ID NO: 5023631 - DNA, 20 bp, Homo sapiens
tctttttttgagtgacagct

SEQ ID NO: 5023632 - DNA, 15 bp, Homo sapiens
tctttttttgtatag

SEQ ID NO: 5023633 - DNA, 21 bp, Homo sapiens
tgaaaaaaaacctgagattta

SEQ ID NO: 5023634 - DNA, 15 bp, Homo sapiens
tgaaaaaaacttcat

SEQ ID NO: 5023635 - DNA, 21 bp, Homo sapiens
tgaaaaaaattttagaacagt

SEQ ID NO: 5023636 - DNA, 17 bp, Homo sapiens
tgaaaactaaggatttt

SEQ ID NO: 5023637 - DNA, 15 bp, Homo sapiens
tgaaaagttggaagg

SEQ ID NO: 5023638 - DNA, 23 bp, Homo sapiens
tgaaaagttggaaggatctgctg

SEQ ID NO: 5023639 - DNA, 12 bp, Homo sapiens
tgaaaatgctgg

SEQ ID NO: 5023640 - DNA, 13 bp, Homo sapiens
tgaaacacacgag

SEQ ID NO: 5023641 - DNA, 18 bp, Homo sapiens
tgaaactgcttgtttcct

SEQ ID NO: 5023642 - DNA, 22 bp, Homo sapiens
tgaaactgcttgtttcctagca

SEQ ID NO: 5023643 - DNA, 12 bp, Homo sapiens
tgaaagtctgtc

SEQ ID NO: 5023644 - DNA, 14 bp, Homo sapiens
tgaaatactgtttg

SEQ ID NO: 5023645 - DNA, 14 bp, Homo sapiens
tgaaatagtgtctg

SEQ ID NO: 5023646 - DNA, 18 bp, Homo sapiens
tgaaatgaggtctgttta

SEQ ID NO: 5023647 - DNA, 15 bp, Homo sapiens
tgaaatttttcttct

SEQ ID NO: 5023648 - DNA, 18 bp, Homo sapiens
tgaacaagagaagcattc

SEQ ID NO: 5023649 - DNA, 23 bp, Homo sapiens
tgaacactccaattaaggatttt

SEQ ID NO: 5023650 - DNA, 15 bp, Homo sapiens
tgaacagctgtgtct

SEQ ID NO: 5023651 - DNA, 17 bp, Homo sapiens
tgaacagctgtgtctgc

SEQ ID NO: 5023652 - DNA, 17 bp, Homo sapiens
tgaacatctgagtcctg

SEQ ID NO: 5023653 - DNA, 20 bp, Homo sapiens
tgaacatctgagtcctggat

SEQ ID NO: 5023654 - DNA, 16 bp, Homo sapiens
tgaaccacgcgggggc

SEQ ID NO: 5023655 - DNA, 17 bp, Homo sapiens
tgaactccttccccact

SEQ ID NO: 5023656 - DNA, 17 bp, Homo sapiens
tgaactgaactctgaca

SEQ ID NO: 5023657 - DNA, 19 bp, Homo sapiens
tgaactgaactctgacaac

SEQ ID NO: 5023658 - DNA, 19 bp, Homo sapiens
tgaacttgattgcctatgg

SEQ ID NO: 5023659 - DNA, 18 bp, Homo sapiens
tgaagcattttataaatc

SEQ ID NO: 5023660 - DNA, 23 bp, Homo sapiens
tgaagccagctcacagtgctgtg

SEQ ID NO: 5023661 - DNA, 12 bp, Homo sapiens
tgaagcctttgt

SEQ ID NO: 5023662 - DNA, 12 bp, Homo sapiens
tgaaggactgtg

SEQ ID NO: 5023663 - DNA, 14 bp, Homo sapiens
tgaaggactgtgac

SEQ ID NO: 5023664 - DNA, 23 bp, Homo sapiens
tgaaggactgtgacaggcagcag

SEQ ID NO: 5023665 - DNA, 19 bp, Homo sapiens
tgaagggcaagaaatggcg

SEQ ID NO: 5023666 - DNA, 22 bp, Homo sapiens
tgaaggggtgcacccacctgtt

SEQ ID NO: 5023667 - DNA, 19 bp, Homo sapiens
tgaagtctctgaagtgaaa

SEQ ID NO: 5023668 - DNA, 16 bp, Homo sapiens
tgaataccactctgta

SEQ ID NO: 5023669 - DNA, 15 bp, Homo sapiens
tgaatactgtgaaaa

SEQ ID NO: 5023670 - DNA, 14 bp, Homo sapiens
tgaatcacatgaat

SEQ ID NO: 5023671 - DNA, 16 bp, Homo sapiens
tgaatcgcagctgtgg

SEQ ID NO: 5023672 - DNA, 18 bp, Homo sapiens
tgaatgtttttctaaagg

SEQ ID NO: 5023673 - DNA, 20 bp, Homo sapiens
tgaatgtttttctaaaggag

SEQ ID NO: 5023674 - DNA, 13 bp, Homo sapiens
tgaattgtgaaat

SEQ ID NO: 5023675 - DNA, 19 bp, Homo sapiens
tgacaaaccatttccaaca

SEQ ID NO: 5023676 - DNA, 15 bp, Homo sapiens
tgacaacagacttct

SEQ ID NO: 5023677 - DNA, 19 bp, Homo sapiens
tgacaacagacttctgaaa

SEQ ID NO: 5023678 - DNA, 15 bp, Homo sapiens
tgacacctaactctt

SEQ ID NO: 5023679 - DNA, 16 bp, Homo sapiens
tgacaggcagcagaga

SEQ ID NO: 5023680 - DNA, 19 bp, Homo sapiens
tgacagggacatgccctgt

SEQ ID NO: 5023681 - DNA, 16 bp, Homo sapiens
tgacataatatattct

SEQ ID NO: 5023682 - DNA, 23 bp, Homo sapiens
tgacatctctgcaatcttctcag

SEQ ID NO: 5023683 - DNA, 14 bp, Homo sapiens
tgacatgggtgggg

SEQ ID NO: 5023684 - DNA, 19 bp, Homo sapiens
tgacatgtgttggcagcct

SEQ ID NO: 5023685 - DNA, 18 bp, Homo sapiens
tgacattctgaatgcttc

SEQ ID NO: 5023686 - DNA, 19 bp, Homo sapiens
tgacattctgaatgcttct

SEQ ID NO: 5023687 - DNA, 20 bp, Homo sapiens
tgacattctgaatgcttcta

SEQ ID NO: 5023688 - DNA, 20 bp, Homo sapiens
tgaccacactccagctggga

SEQ ID NO: 5023689 - DNA, 21 bp, Homo sapiens
tgaccccaaacaccttccagc

SEQ ID NO: 5023690 - DNA, 22 bp, Homo sapiens
tgaccccaaacaccttccagct

SEQ ID NO: 5023691 - DNA, 18 bp, Homo sapiens
tgactcgagtcacactca

SEQ ID NO: 5023692 - DNA, 18 bp, Homo sapiens
tgactgtatctgtgtaga

SEQ ID NO: 5023693 - DNA, 16 bp, Homo sapiens
tgagatagttttcatc

SEQ ID NO: 5023694 - DNA, 18 bp, Homo sapiens
tgagatagttttcatcca

SEQ ID NO: 5023695 - DNA, 13 bp, Homo sapiens
tgagatgctggtt

SEQ ID NO: 5023696 - DNA, 15 bp, Homo sapiens
tgagattattttaat

SEQ ID NO: 5023697 - DNA, 17 bp, Homo sapiens
tgagcacagcctagggc

SEQ ID NO: 5023698 - DNA, 12 bp, Homo sapiens
tgagcagaacag

SEQ ID NO: 5023699 - DNA, 13 bp, Homo sapiens
tgagcagaacagg

SEQ ID NO: 5023700 - DNA, 15 bp, Homo sapiens
tgagcatcacagttt

SEQ ID NO: 5023701 - DNA, 16 bp, Homo sapiens
tgagcatcacagtttt

SEQ ID NO: 5023702 - DNA, 17 bp, Homo sapiens
tgagcatcacagttttg

SEQ ID NO: 5023703 - DNA, 24 bp, Homo sapiens
tgagcatgtttagactttaacata

SEQ ID NO: 5023704 - DNA, 13 bp, Homo sapiens
tgagcgccacctc

SEQ ID NO: 5023705 - DNA, 19 bp, Homo sapiens
tgagctggatagacttggg

SEQ ID NO: 5023706 - DNA, 16 bp, Homo sapiens
tgagcttaaaatacaa

SEQ ID NO: 5023707 - DNA, 22 bp, Homo sapiens
tgaggacttgggcgggacacag

SEQ ID NO: 5023708 - DNA, 11 bp, Homo sapiens
tgaggagcccc

SEQ ID NO: 5023709 - DNA, 14 bp, Homo sapiens
tgaggattccaaaa

SEQ ID NO: 5023710 - DNA, 15 bp, Homo sapiens
tgaggcaagtgtggg

SEQ ID NO: 5023711 - DNA, 20 bp, Homo sapiens
tgagggagctgggagaccct

SEQ ID NO: 5023712 - DNA, 23 bp, Homo sapiens
tgagggaggacaggcgggaggag

SEQ ID NO: 5023713 - DNA, 23 bp, Homo sapiens
tgaggtccagccctggctgaagg

SEQ ID NO: 5023714 - DNA, 14 bp, Homo sapiens
tgaggtctgtttaa

SEQ ID NO: 5023715 - DNA, 21 bp, Homo sapiens
tgagtcctggatgatactaat

SEQ ID NO: 5023716 - DNA, 20 bp, Homo sapiens
tgagtgacagctttctggga

SEQ ID NO: 5023717 - DNA, 15 bp, Homo sapiens
tgagtggcatggcca

SEQ ID NO: 5023718 - DNA, 21 bp, Homo sapiens
tgagtggggttatctctgtgt

SEQ ID NO: 5023719 - DNA, 22 bp, Homo sapiens
tgagtggggttatctctgtgtt

SEQ ID NO: 5023720 - DNA, 23 bp, Homo sapiens
tgagtttgggccccagaggctgg

SEQ ID NO: 5023721 - DNA, 23 bp, Homo sapiens
tgataagttcctttccttttctt

SEQ ID NO: 5023722 - DNA, 14 bp, Homo sapiens
tgatactaataaac

SEQ ID NO: 5023723 - DNA, 17 bp, Homo sapiens
tgatacttcgacactgt

SEQ ID NO: 5023724 - DNA, 18 bp, Homo sapiens
tgatacttcgacactgtt

SEQ ID NO: 5023725 - DNA, 22 bp, Homo sapiens
tgatctcatttaatcctctcaa

SEQ ID NO: 5023726 - DNA, 15 bp, Homo sapiens
tgatgatgaaaacta

SEQ ID NO: 5023727 - DNA, 13 bp, Homo sapiens
tgatgatgatgaa

SEQ ID NO: 5023728 - DNA, 16 bp, Homo sapiens
tgatgatgatgatgat

SEQ ID NO: 5023729 - DNA, 15 bp, Homo sapiens
tgatgccaagttgtt

SEQ ID NO: 5023730 - DNA, 14 bp, Homo sapiens
tgatggagccccac

SEQ ID NO: 5023731 - DNA, 16 bp, Homo sapiens
tgatggagccccacct

SEQ ID NO: 5023732 - DNA, 14 bp, Homo sapiens
tgatggagtgctgt

SEQ ID NO: 5023733 - DNA, 15 bp, Homo sapiens
tgattcagcaaaaat

SEQ ID NO: 5023734 - DNA, 17 bp, Homo sapiens
tgatttgcctgtaattt

SEQ ID NO: 5023735 - DNA, 20 bp, Homo sapiens
tgcaaactctttggtcgttt

SEQ ID NO: 5023736 - DNA, 13 bp, Homo sapiens
tgcaaataacaaa

SEQ ID NO: 5023737 - DNA, 16 bp, Homo sapiens
tgcaaccgggccctct

SEQ ID NO: 5023738 - DNA, 21 bp, Homo sapiens
tgcaactgctcagctctggtc

SEQ ID NO: 5023739 - DNA, 22 bp, Homo sapiens
tgcaatgaagtctctgaagtga

SEQ ID NO: 5023740 - DNA, 18 bp, Homo sapiens
tgcaatgtgtataaacaa

SEQ ID NO: 5023741 - DNA, 20 bp, Homo sapiens
tgcaatgtgtataaacaaga

SEQ ID NO: 5023742 - DNA, 21 bp, Homo sapiens
tgcaatgtgtataaacaagaa

SEQ ID NO: 5023743 - DNA, 18 bp, Homo sapiens
tgcaattcccctctgctg

SEQ ID NO: 5023744 - DNA, 14 bp, Homo sapiens
tgcacacaggacag

SEQ ID NO: 5023745 - DNA, 16 bp, Homo sapiens
tgcacacaggacagcg

SEQ ID NO: 5023746 - DNA, 18 bp, Homo sapiens
tgcacaggcacacagggc

SEQ ID NO: 5023747 - DNA, 12 bp, Homo sapiens
tgcacatccctg

SEQ ID NO: 5023748 - DNA, 24 bp, Homo sapiens
tgcacatcttggctatgtaattct

SEQ ID NO: 5023749 - DNA, 18 bp, Homo sapiens
tgcaccaggactggctgt

SEQ ID NO: 5023750 - DNA, 20 bp, Homo sapiens
tgcacccacctgttttctga

SEQ ID NO: 5023751 - DNA, 20 bp, Homo sapiens
tgcactggggagcccgtctc

SEQ ID NO: 5023752 - DNA, 17 bp, Homo sapiens
tgcactttgctttaata

SEQ ID NO: 5023753 - DNA, 20 bp, Homo sapiens
tgcactttgctttaatataa

SEQ ID NO: 5023754 - DNA, 22 bp, Homo sapiens
tgcactttgctttaatataaat

SEQ ID NO: 5023755 - DNA, 22 bp, Homo sapiens
tgcagacctcatgcccagctct

SEQ ID NO: 5023756 - DNA, 18 bp, Homo sapiens
tgcagctgttttgttgac

SEQ ID NO: 5023757 - DNA, 13 bp, Homo sapiens
tgcaggaggtgga

SEQ ID NO: 5023758 - DNA, 13 bp, Homo sapiens
tgcagtcccaagc

SEQ ID NO: 5023759 - DNA, 12 bp, Homo sapiens
tgcagtgtggag

SEQ ID NO: 5023760 - DNA, 16 bp, Homo sapiens
tgcagtttttcccaag

SEQ ID NO: 5023761 - DNA, 14 bp, Homo sapiens
tgcatatgcaatgt

SEQ ID NO: 5023762 - DNA, 12 bp, Homo sapiens
tgcatatgtatg

SEQ ID NO: 5023763 - DNA, 22 bp, Homo sapiens
tgcatatttattgcattgctgg

SEQ ID NO: 5023764 - DNA, 23 bp, Homo sapiens
tgcatgtcctttgcgcctgtgac

SEQ ID NO: 5023765 - DNA, 11 bp, Homo sapiens
tgcattgctgg

SEQ ID NO: 5023766 - DNA, 18 bp, Homo sapiens
tgcatttgtttatgtaat

SEQ ID NO: 5023767 - DNA, 19 bp, Homo sapiens
tgcatttgtttatgtaatt

SEQ ID NO: 5023768 - DNA, 20 bp, Homo sapiens
tgcatttgtttatgtaattt

SEQ ID NO: 5023769 - DNA, 21 bp, Homo sapiens
tgcatttgtttatgtaatttc

SEQ ID NO: 5023770 - DNA, 16 bp, Homo sapiens
tgccaagggaggcgga

SEQ ID NO: 5023771 - DNA, 21 bp, Homo sapiens
tgccaccggaggtcactccac

SEQ ID NO: 5023772 - DNA, 18 bp, Homo sapiens
tgccactgccccccgagg

SEQ ID NO: 5023773 - DNA, 13 bp, Homo sapiens
tgcccaaggccac

SEQ ID NO: 5023774 - DNA, 15 bp, Homo sapiens
tgcccagctctctga

SEQ ID NO: 5023775 - DNA, 14 bp, Homo sapiens
tgccccccagcctc

SEQ ID NO: 5023776 - DNA, 15 bp, Homo sapiens
tgccccccagcctct

SEQ ID NO: 5023777 - DNA, 19 bp, Homo sapiens
tgccccccagcctctggca

SEQ ID NO: 5023778 - DNA, 17 bp, Homo sapiens
tgccccccgaggctgct

SEQ ID NO: 5023779 - DNA, 18 bp, Homo sapiens
tgccccccgaggctgcta

SEQ ID NO: 5023780 - DNA, 16 bp, Homo sapiens
tgcccccgcctgccac

SEQ ID NO: 5023781 - DNA, 17 bp, Homo sapiens
tgcccccgcctgccacc

SEQ ID NO: 5023782 - DNA, 17 bp, Homo sapiens
tgccctcatggcccctc

SEQ ID NO: 5023783 - DNA, 23 bp, Homo sapiens
tgccctggcagggtcatcctgtg

SEQ ID NO: 5023784 - DNA, 17 bp, Homo sapiens
tgccgcaccagcccgaa

SEQ ID NO: 5023785 - DNA, 16 bp, Homo sapiens
tgccggggcagccccc

SEQ ID NO: 5023786 - DNA, 18 bp, Homo sapiens
tgcctgcctttgtgtcag

SEQ ID NO: 5023787 - DNA, 14 bp, Homo sapiens
tgcctgctcccatc

SEQ ID NO: 5023788 - DNA, 22 bp, Homo sapiens
tgcctgctcccatcctgtgtgt

SEQ ID NO: 5023789 - DNA, 15 bp, Homo sapiens
tgcctggcaggctgt

SEQ ID NO: 5023790 - DNA, 19 bp, Homo sapiens
tgcctgtcccacccccacc

SEQ ID NO: 5023791 - DNA, 14 bp, Homo sapiens
tgcctgtgaactga

SEQ ID NO: 5023792 - DNA, 18 bp, Homo sapiens
tgcctgtgaactgaactc

SEQ ID NO: 5023793 - DNA, 15 bp, Homo sapiens
tgccttagtctcagt

SEQ ID NO: 5023794 - DNA, 16 bp, Homo sapiens
tgccttagtctcagtt

SEQ ID NO: 5023795 - DNA, 20 bp, Homo sapiens
tgccttagtctcagtttgtg

SEQ ID NO: 5023796 - DNA, 13 bp, Homo sapiens
tgcgtctccagtc

SEQ ID NO: 5023797 - DNA, 16 bp, Homo sapiens
tgcgtgttcagcagaa

SEQ ID NO: 5023798 - DNA, 20 bp, Homo sapiens
tgctaatattttcctcctga

SEQ ID NO: 5023799 - DNA, 16 bp, Homo sapiens
tgctaatttaaagaga

SEQ ID NO: 5023800 - DNA, 17 bp, Homo sapiens
tgctaatttaaagagac

SEQ ID NO: 5023801 - DNA, 21 bp, Homo sapiens
tgctcaataaatgattcttag

SEQ ID NO: 5023802 - DNA, 19 bp, Homo sapiens
tgctcacccagtgccctct

SEQ ID NO: 5023803 - DNA, 12 bp, Homo sapiens
tgctccctctgt

SEQ ID NO: 5023804 - DNA, 19 bp, Homo sapiens
tgctctcagcctcccacaa

SEQ ID NO: 5023805 - DNA, 19 bp, Homo sapiens
tgctctgatgaagaggagt

SEQ ID NO: 5023806 - DNA, 22 bp, Homo sapiens
tgctctggtggcttaagtgagc

SEQ ID NO: 5023807 - DNA, 13 bp, Homo sapiens
tgctgctgtccct

SEQ ID NO: 5023808 - DNA, 14 bp, Homo sapiens
tgctggctgcggcc

SEQ ID NO: 5023809 - DNA, 13 bp, Homo sapiens
tgctggttttcta

SEQ ID NO: 5023810 - DNA, 13 bp, Homo sapiens
tgctgtccctccc

SEQ ID NO: 5023811 - DNA, 13 bp, Homo sapiens
tgctgtctctctg

SEQ ID NO: 5023812 - DNA, 18 bp, Homo sapiens
tgctgtctctctgggctg

SEQ ID NO: 5023813 - DNA, 20 bp, Homo sapiens
tgctgttggtcctctctctg

SEQ ID NO: 5023814 - DNA, 16 bp, Homo sapiens
tgctgttttgttatat

SEQ ID NO: 5023815 - DNA, 19 bp, Homo sapiens
tgctgttttgttatataat

SEQ ID NO: 5023816 - DNA, 15 bp, Homo sapiens
tgcttccaggctggg

SEQ ID NO: 5023817 - DNA, 22 bp, Homo sapiens
tgcttcccagaggagcagctct

SEQ ID NO: 5023818 - DNA, 22 bp, Homo sapiens
tgcttctaagtaaatacaattt

SEQ ID NO: 5023819 - DNA, 23 bp, Homo sapiens
tgcttgcttttcatgcaaactct

SEQ ID NO: 5023820 - DNA, 16 bp, Homo sapiens
tgcttgttaactgagt

SEQ ID NO: 5023821 - DNA, 14 bp, Homo sapiens
tgcttgtttcctag

SEQ ID NO: 5023822 - DNA, 12 bp, Homo sapiens
tgctttaaacat

SEQ ID NO: 5023823 - DNA, 15 bp, Homo sapiens
tgctttaatatcatc

SEQ ID NO: 5023824 - DNA, 20 bp, Homo sapiens
tgctttaatatcatcagtat

SEQ ID NO: 5023825 - DNA, 19 bp, Homo sapiens
tgctttaattgttaagata

SEQ ID NO: 5023826 - DNA, 15 bp, Homo sapiens
tgctttgagagagaa

SEQ ID NO: 5023827 - DNA, 20 bp, Homo sapiens
tgcttttcatgcaaactctt

SEQ ID NO: 5023828 - DNA, 17 bp, Homo sapiens
tggaaacagctcgactt

SEQ ID NO: 5023829 - DNA, 14 bp, Homo sapiens
tggaaatacacagt

SEQ ID NO: 5023830 - DNA, 15 bp, Homo sapiens
tggaaatacacagtg

SEQ ID NO: 5023831 - DNA, 18 bp, Homo sapiens
tggaaatttagcattgta

SEQ ID NO: 5023832 - DNA, 21 bp, Homo sapiens
tggaagaaaaaaaccacacaa

SEQ ID NO: 5023833 - DNA, 23 bp, Homo sapiens
tggaaggggacacgtgacagccg

SEQ ID NO: 5023834 - DNA, 15 bp, Homo sapiens
tggacacgctcagtg

SEQ ID NO: 5023835 - DNA, 14 bp, Homo sapiens
tggactccagcctg

SEQ ID NO: 5023836 - DNA, 14 bp, Homo sapiens
tggactggaagggg

SEQ ID NO: 5023837 - DNA, 12 bp, Homo sapiens
tggagacaccac

SEQ ID NO: 5023838 - DNA, 17 bp, Homo sapiens
tggagactcctggtctg

SEQ ID NO: 5023839 - DNA, 20 bp, Homo sapiens
tggagaggcccggcctctca

SEQ ID NO: 5023840 - DNA, 16 bp, Homo sapiens
tggagagtcagatctt

SEQ ID NO: 5023841 - DNA, 13 bp, Homo sapiens
tggagcagaccac

SEQ ID NO: 5023842 - DNA, 23 bp, Homo sapiens
tggagcagcagccactgcacagg

SEQ ID NO: 5023843 - DNA, 13 bp, Homo sapiens
tggagccccacct

SEQ ID NO: 5023844 - DNA, 18 bp, Homo sapiens
tggagccccaccttgtct

SEQ ID NO: 5023845 - DNA, 19 bp, Homo sapiens
tggagccccaccttgtctg

SEQ ID NO: 5023846 - DNA, 23 bp, Homo sapiens
tggagctctgtgggtctctggaa

SEQ ID NO: 5023847 - DNA, 22 bp, Homo sapiens
tggagcttgaaatagtgtctga

SEQ ID NO: 5023848 - DNA, 17 bp, Homo sapiens
tggaggatcagtttttt

SEQ ID NO: 5023849 - DNA, 16 bp, Homo sapiens
tggaggcagatgtggg

SEQ ID NO: 5023850 - DNA, 20 bp, Homo sapiens
tggaggcagatgtggggctg

SEQ ID NO: 5023851 - DNA, 14 bp, Homo sapiens
tggagtcccctcac

SEQ ID NO: 5023852 - DNA, 15 bp, Homo sapiens
tggagtcccctcacc

SEQ ID NO: 5023853 - DNA, 21 bp, Homo sapiens
tggagtcccctcacctcctct

SEQ ID NO: 5023854 - DNA, 16 bp, Homo sapiens
tggagtgctgttttgt

SEQ ID NO: 5023855 - DNA, 17 bp, Homo sapiens
tggagttcaccttggaa

SEQ ID NO: 5023856 - DNA, 18 bp, Homo sapiens
tggatagacttgggatgg

SEQ ID NO: 5023857 - DNA, 22 bp, Homo sapiens
tggatagacttgggatggggag

SEQ ID NO: 5023858 - DNA, 14 bp, Homo sapiens
tggatcctgggctg

SEQ ID NO: 5023859 - DNA, 16 bp, Homo sapiens
tggatgatactaataa

SEQ ID NO: 5023860 - DNA, 20 bp, Homo sapiens
tggatgatactaataaacta

SEQ ID NO: 5023861 - DNA, 14 bp, Homo sapiens
tggatgtccccagc

SEQ ID NO: 5023862 - DNA, 16 bp, Homo sapiens
tggatgtccccagcag

SEQ ID NO: 5023863 - DNA, 16 bp, Homo sapiens
tggatgttatgaacag

SEQ ID NO: 5023864 - DNA, 20 bp, Homo sapiens
tggatgttatgaacagctgt

SEQ ID NO: 5023865 - DNA, 15 bp, Homo sapiens
tggatgttgtgtgta

SEQ ID NO: 5023866 - DNA, 19 bp, Homo sapiens
tggcaagagtgtggaggct

SEQ ID NO: 5023867 - DNA, 16 bp, Homo sapiens
tggcacaggccccctt

SEQ ID NO: 5023868 - DNA, 19 bp, Homo sapiens
tggcactgactgggcatag

SEQ ID NO: 5023869 - DNA, 19 bp, Homo sapiens
tggcatggaaatttaaagc

SEQ ID NO: 5023870 - DNA, 14 bp, Homo sapiens
tggccaaagagcct

SEQ ID NO: 5023871 - DNA, 20 bp, Homo sapiens
tggccaaagagcctttccaa

SEQ ID NO: 5023872 - DNA, 13 bp, Homo sapiens
tggccagagagcc

SEQ ID NO: 5023873 - DNA, 23 bp, Homo sapiens
tggccagagagcctggtgctgct

SEQ ID NO: 5023874 - DNA, 19 bp, Homo sapiens
tggccaggcctcttggcag

SEQ ID NO: 5023875 - DNA, 14 bp, Homo sapiens
tggccatctgctcc

SEQ ID NO: 5023876 - DNA, 19 bp, Homo sapiens
tggccatgcaggaggtgga

SEQ ID NO: 5023877 - DNA, 17 bp, Homo sapiens
tggccatggcctctgca

SEQ ID NO: 5023878 - DNA, 16 bp, Homo sapiens
tggccccactttgaag

SEQ ID NO: 5023879 - DNA, 21 bp, Homo sapiens
tggcccctgctgtctctctgg

SEQ ID NO: 5023880 - DNA, 21 bp, Homo sapiens
tggccctgttctcctccccaa

SEQ ID NO: 5023881 - DNA, 17 bp, Homo sapiens
tggccgcacgcctctcc

SEQ ID NO: 5023882 - DNA, 23 bp, Homo sapiens
tggccgccccctgccccccagcc

SEQ ID NO: 5023883 - DNA, 15 bp, Homo sapiens
tggccgggaccccga

SEQ ID NO: 5023884 - DNA, 17 bp, Homo sapiens
tggccgggaccccgagc

SEQ ID NO: 5023885 - DNA, 21 bp, Homo sapiens
tggcctctgctgatcctccca

SEQ ID NO: 5023886 - DNA, 15 bp, Homo sapiens
tggcctgctggatgt

SEQ ID NO: 5023887 - DNA, 20 bp, Homo sapiens
tggcggctggggtcccagca

SEQ ID NO: 5023888 - DNA, 21 bp, Homo sapiens
tggcggctggggtcccagcag

SEQ ID NO: 5023889 - DNA, 13 bp, Homo sapiens
tggcgtctgctct

SEQ ID NO: 5023890 - DNA, 14 bp, Homo sapiens
tggcgtctgctctg

SEQ ID NO: 5023891 - DNA, 15 bp, Homo sapiens
tggctagtccttgtt

SEQ ID NO: 5023892 - DNA, 18 bp, Homo sapiens
tggctatagatgtctttt

SEQ ID NO: 5023893 - DNA, 17 bp, Homo sapiens
tggctccttcccatcgc

SEQ ID NO: 5023894 - DNA, 23 bp, Homo sapiens
tggctcttgatacccccctctgt

SEQ ID NO: 5023895 - DNA, 16 bp, Homo sapiens
tggctgaaggactgtg

SEQ ID NO: 5023896 - DNA, 19 bp, Homo sapiens
tggcttaagtgagcagaac

SEQ ID NO: 5023897 - DNA, 20 bp, Homo sapiens
tggcttaagtgagcagaaca

SEQ ID NO: 5023898 - DNA, 16 bp, Homo sapiens
tgggactggcctctgc

SEQ ID NO: 5023899 - DNA, 22 bp, Homo sapiens
tgggaggtgcgtgttcagcaga

SEQ ID NO: 5023900 - DNA, 12 bp, Homo sapiens
tgggatggggag

SEQ ID NO: 5023901 - DNA, 16 bp, Homo sapiens
tgggatgtcacagtcc

SEQ ID NO: 5023902 - DNA, 18 bp, Homo sapiens
tgggatgtcacagtccaa

SEQ ID NO: 5023903 - DNA, 14 bp, Homo sapiens
tgggcaaacaggca

SEQ ID NO: 5023904 - DNA, 17 bp, Homo sapiens
tgggcatttggtgagag

SEQ ID NO: 5023905 - DNA, 18 bp, Homo sapiens
tgggccagaatttcaaac

SEQ ID NO: 5023906 - DNA, 14 bp, Homo sapiens
tgggcccctggccc

SEQ ID NO: 5023907 - DNA, 15 bp, Homo sapiens
tgggccgggcctggg

SEQ ID NO: 5023908 - DNA, 19 bp, Homo sapiens
tgggccgggcctggggctc

SEQ ID NO: 5023909 - DNA, 19 bp, Homo sapiens
tggggaaaatggccatgca

SEQ ID NO: 5023910 - DNA, 23 bp, Homo sapiens
tggggaaaatggccatgcaggag

SEQ ID NO: 5023911 - DNA, 18 bp, Homo sapiens
tggggacctggtaccctc

SEQ ID NO: 5023912 - DNA, 16 bp, Homo sapiens
tggggagacagttgag

SEQ ID NO: 5023913 - DNA, 19 bp, Homo sapiens
tggggagcccgtctcagtg

SEQ ID NO: 5023914 - DNA, 21 bp, Homo sapiens
tggggagcccgtctcagtgtt

SEQ ID NO: 5023915 - DNA, 16 bp, Homo sapiens
tggggagggagcctcg

SEQ ID NO: 5023916 - DNA, 22 bp, Homo sapiens
tggggatggtagttttttcatc

SEQ ID NO: 5023917 - DNA, 17 bp, Homo sapiens
tggggctaggggctggg

SEQ ID NO: 5023918 - DNA, 21 bp, Homo sapiens
tgggggagtagatctttctag

SEQ ID NO: 5023919 - DNA, 15 bp, Homo sapiens
tgggggtgagggtcc

SEQ ID NO: 5023920 - DNA, 12 bp, Homo sapiens
tgggggtttttt

SEQ ID NO: 5023921 - DNA, 14 bp, Homo sapiens
tggggtcccagcag

SEQ ID NO: 5023922 - DNA, 15 bp, Homo sapiens
tggggtcccagcagc

SEQ ID NO: 5023923 - DNA, 14 bp, Homo sapiens
tggggtgctgccct

SEQ ID NO: 5023924 - DNA, 19 bp, Homo sapiens
tggggttatctctgtgtta

SEQ ID NO: 5023925 - DNA, 21 bp, Homo sapiens
tgggtagaaagagatacagag

SEQ ID NO: 5023926 - DNA, 15 bp, Homo sapiens
tgggtctcagtgtcc

SEQ ID NO: 5023927 - DNA, 13 bp, Homo sapiens
tgggtgagagagg

SEQ ID NO: 5023928 - DNA, 15 bp, Homo sapiens
tgggtgcgtctccag

SEQ ID NO: 5023929 - DNA, 19 bp, Homo sapiens
tgggtgcgtctccagtcat

SEQ ID NO: 5023930 - DNA, 18 bp, Homo sapiens
tgggtggtaccctctgga

SEQ ID NO: 5023931 - DNA, 17 bp, Homo sapiens
tggtaaaaatgctgctc

SEQ ID NO: 5023932 - DNA, 19 bp, Homo sapiens
tggtaaaaatgctgctctc

SEQ ID NO: 5023933 - DNA, 22 bp, Homo sapiens
tggtacagtatgggggttgtaa

SEQ ID NO: 5023934 - DNA, 24 bp, Homo sapiens
tggtacttagagtttctgtttgat

SEQ ID NO: 5023935 - DNA, 16 bp, Homo sapiens
tggtagagacccccag

SEQ ID NO: 5023936 - DNA, 17 bp, Homo sapiens
tggtaggggagggcagg

SEQ ID NO: 5023937 - DNA, 21 bp, Homo sapiens
tggtaggggagggcaggcttg

SEQ ID NO: 5023938 - DNA, 21 bp, Homo sapiens
tggtagtgtagctgtgtggct

SEQ ID NO: 5023939 - DNA, 16 bp, Homo sapiens
tggtagttttttcatc

SEQ ID NO: 5023940 - DNA, 17 bp, Homo sapiens
tggtagttttttcatct

SEQ ID NO: 5023941 - DNA, 17 bp, Homo sapiens
tggtattttcaatagcc

SEQ ID NO: 5023942 - DNA, 20 bp, Homo sapiens
tggtattttcaatagccact

SEQ ID NO: 5023943 - DNA, 14 bp, Homo sapiens
tggtcctctctctg

SEQ ID NO: 5023944 - DNA, 16 bp, Homo sapiens
tggtcctctctctgtg

SEQ ID NO: 5023945 - DNA, 23 bp, Homo sapiens
tggtcctctctctgtggggctga

SEQ ID NO: 5023946 - DNA, 13 bp, Homo sapiens
tggtcgttttttt

SEQ ID NO: 5023947 - DNA, 22 bp, Homo sapiens
tggtcgttttttttttgtttgt

SEQ ID NO: 5023948 - DNA, 14 bp, Homo sapiens
tggtctttctgtgc

SEQ ID NO: 5023949 - DNA, 16 bp, Homo sapiens
tggtgagagtcaaagc

SEQ ID NO: 5023950 - DNA, 19 bp, Homo sapiens
tggtgagcctagccctggg

SEQ ID NO: 5023951 - DNA, 15 bp, Homo sapiens
tggtggcatggaagg

SEQ ID NO: 5023952 - DNA, 22 bp, Homo sapiens
tggtggcttaagtgagcagaac

SEQ ID NO: 5023953 - DNA, 16 bp, Homo sapiens
tggtggtattttcaat

SEQ ID NO: 5023954 - DNA, 22 bp, Homo sapiens
tggtgtgaactaaactttcaca

SEQ ID NO: 5023955 - DNA, 22 bp, Homo sapiens
tggtgtgatcttaatatatttg

SEQ ID NO: 5023956 - DNA, 15 bp, Homo sapiens
tggttaagtctgttt

SEQ ID NO: 5023957 - DNA, 14 bp, Homo sapiens
tggttcttgtatta

SEQ ID NO: 5023958 - DNA, 14 bp, Homo sapiens
tggttgctttaata

SEQ ID NO: 5023959 - DNA, 19 bp, Homo sapiens
tggttggggccctgccctg

SEQ ID NO: 5023960 - DNA, 17 bp, Homo sapiens
tgtaaaggggcagctga

SEQ ID NO: 5023961 - DNA, 12 bp, Homo sapiens
tgtaaatataaa

SEQ ID NO: 5023962 - DNA, 17 bp, Homo sapiens
tgtaaatataaagacgt

SEQ ID NO: 5023963 - DNA, 22 bp, Homo sapiens
tgtaagaataggcattaacaca

SEQ ID NO: 5023964 - DNA, 19 bp, Homo sapiens
tgtaagagcttgctccaga

SEQ ID NO: 5023965 - DNA, 14 bp, Homo sapiens
tgtaaggctgtgta

SEQ ID NO: 5023966 - DNA, 23 bp, Homo sapiens
tgtaatttcaggaggaatactga

SEQ ID NO: 5023967 - DNA, 16 bp, Homo sapiens
tgtacaaggacagccc

SEQ ID NO: 5023968 - DNA, 15 bp, Homo sapiens
tgtacacaactcact

SEQ ID NO: 5023969 - DNA, 22 bp, Homo sapiens
tgtacacactggtacttagagt

SEQ ID NO: 5023970 - DNA, 20 bp, Homo sapiens
tgtacaggaagtagttctaa

SEQ ID NO: 5023971 - DNA, 14 bp, Homo sapiens
tgtacagtgtcttt

SEQ ID NO: 5023972 - DNA, 23 bp, Homo sapiens
tgtacagtgtctttttttgtata

SEQ ID NO: 5023973 - DNA, 14 bp, Homo sapiens
tgtacttgtttgca

SEQ ID NO: 5023974 - DNA, 13 bp, Homo sapiens
tgtagaaggcaca

SEQ ID NO: 5023975 - DNA, 18 bp, Homo sapiens
tgtaggcacagagctgca

SEQ ID NO: 5023976 - DNA, 15 bp, Homo sapiens
tgtatagttaacaca

SEQ ID NO: 5023977 - DNA, 17 bp, Homo sapiens
tgtatagttaacacact

SEQ ID NO: 5023978 - DNA, 16 bp, Homo sapiens
tgtatctgtgtagact

SEQ ID NO: 5023979 - DNA, 14 bp, Homo sapiens
tgtattacagatgc

SEQ ID NO: 5023980 - DNA, 18 bp, Homo sapiens
tgtattgtgcaatgtgta

SEQ ID NO: 5023981 - DNA, 14 bp, Homo sapiens
tgtatttgtttgca

SEQ ID NO: 5023982 - DNA, 15 bp, Homo sapiens
tgtatttgtttgcat

SEQ ID NO: 5023983 - DNA, 14 bp, Homo sapiens
tgtattttatgtta

SEQ ID NO: 5023984 - DNA, 16 bp, Homo sapiens
tgtcatatactgccat

SEQ ID NO: 5023985 - DNA, 15 bp, Homo sapiens
tgtcatctcagtgct

SEQ ID NO: 5023986 - DNA, 23 bp, Homo sapiens
tgtcattatttttgttagcaaag

SEQ ID NO: 5023987 - DNA, 13 bp, Homo sapiens
tgtcattggaagc

SEQ ID NO: 5023988 - DNA, 18 bp, Homo sapiens
tgtccacaggcttctgag

SEQ ID NO: 5023989 - DNA, 12 bp, Homo sapiens
tgtcccacccac

SEQ ID NO: 5023990 - DNA, 22 bp, Homo sapiens
tgtcccacccccacccccagct

SEQ ID NO: 5023991 - DNA, 19 bp, Homo sapiens
tgtcctggtggtattttca

SEQ ID NO: 5023992 - DNA, 15 bp, Homo sapiens
tgtcctggttcccgt

SEQ ID NO: 5023993 - DNA, 15 bp, Homo sapiens
tgtcctttttcactt

SEQ ID NO: 5023994 - DNA, 17 bp, Homo sapiens
tgtcgagagctggccaa

SEQ ID NO: 5023995 - DNA, 14 bp, Homo sapiens
tgtcgtgggatggc

SEQ ID NO: 5023996 - DNA, 16 bp, Homo sapiens
tgtctctcctgcccct

SEQ ID NO: 5023997 - DNA, 12 bp, Homo sapiens
tgtctctctggg

SEQ ID NO: 5023998 - DNA, 22 bp, Homo sapiens
tgtctcttatggatgtccccag

SEQ ID NO: 5023999 - DNA, 17 bp, Homo sapiens
tgtctgctaaataaaca

SEQ ID NO: 5024000 - DNA, 16 bp, Homo sapiens
tgtctttaaaagagag

SEQ ID NO: 5024001 - DNA, 14 bp, Homo sapiens
tgtgaactgaactc

SEQ ID NO: 5024002 - DNA, 17 bp, Homo sapiens
tgtgaatcgcagctgtg

SEQ ID NO: 5024003 - DNA, 13 bp, Homo sapiens
tgtgacagtgcct

SEQ ID NO: 5024004 - DNA, 14 bp, Homo sapiens
tgtgacagtgcctc

SEQ ID NO: 5024005 - DNA, 14 bp, Homo sapiens
tgtgcaacagacaa

SEQ ID NO: 5024006 - DNA, 16 bp, Homo sapiens
tgtgcaatgtgtataa

SEQ ID NO: 5024007 - DNA, 17 bp, Homo sapiens
tgtgcacttatttatga

SEQ ID NO: 5024008 - DNA, 13 bp, Homo sapiens
tgtgctagaacaa

SEQ ID NO: 5024009 - DNA, 22 bp, Homo sapiens
tgtgcttggatttgcatattta

SEQ ID NO: 5024010 - DNA, 14 bp, Homo sapiens
tgtgcttgttaact

SEQ ID NO: 5024011 - DNA, 21 bp, Homo sapiens
tgtgcttttcctgataaagca

SEQ ID NO: 5024012 - DNA, 22 bp, Homo sapiens
tgtggaggggcagcctgtgcct

SEQ ID NO: 5024013 - DNA, 18 bp, Homo sapiens
tgtggagttcaccttgga

SEQ ID NO: 5024014 - DNA, 20 bp, Homo sapiens
tgtggagttcaccttggaag

SEQ ID NO: 5024015 - DNA, 17 bp, Homo sapiens
tgtggccatggcctctg

SEQ ID NO: 5024016 - DNA, 15 bp, Homo sapiens
tgtgggaaggccagc

SEQ ID NO: 5024017 - DNA, 17 bp, Homo sapiens
tgtggggctgagctggg

SEQ ID NO: 5024018 - DNA, 14 bp, Homo sapiens
tgtgggtctctgga

SEQ ID NO: 5024019 - DNA, 18 bp, Homo sapiens
tgtgtaacacttggctct

SEQ ID NO: 5024020 - DNA, 17 bp, Homo sapiens
tgtgtacaatgtacaca

SEQ ID NO: 5024021 - DNA, 13 bp, Homo sapiens
tgtgtataaacaa

SEQ ID NO: 5024022 - DNA, 21 bp, Homo sapiens
tgtgtataaacaagaaaaata

SEQ ID NO: 5024023 - DNA, 14 bp, Homo sapiens
tgtgtcttaattat

SEQ ID NO: 5024024 - DNA, 20 bp, Homo sapiens
tgtgtgttaagctctgctat

SEQ ID NO: 5024025 - DNA, 19 bp, Homo sapiens
tgtgttaagctctgctatt

SEQ ID NO: 5024026 - DNA, 21 bp, Homo sapiens
tgtgttaagctctgctattag

SEQ ID NO: 5024027 - DNA, 15 bp, Homo sapiens
tgttaactgaatacc

SEQ ID NO: 5024028 - DNA, 13 bp, Homo sapiens
tgttagcaaagat

SEQ ID NO: 5024029 - DNA, 14 bp, Homo sapiens
tgttatataaatgg

SEQ ID NO: 5024030 - DNA, 17 bp, Homo sapiens
tgttatgaacagctgtg

SEQ ID NO: 5024031 - DNA, 20 bp, Homo sapiens
tgttatgaacagctgtgtct

SEQ ID NO: 5024032 - DNA, 16 bp, Homo sapiens
tgttcagcagaacctg

SEQ ID NO: 5024033 - DNA, 16 bp, Homo sapiens
tgttctaacctttaca

SEQ ID NO: 5024034 - DNA, 14 bp, Homo sapiens
tgttctgtgtcttt

SEQ ID NO: 5024035 - DNA, 19 bp, Homo sapiens
tgttctgttaactgaatac

SEQ ID NO: 5024036 - DNA, 21 bp, Homo sapiens
tgttctgttaactgaatacca

SEQ ID NO: 5024037 - DNA, 20 bp, Homo sapiens
tgttctttggaaatacacag

SEQ ID NO: 5024038 - DNA, 17 bp, Homo sapiens
tgttgaagggaggtggc

SEQ ID NO: 5024039 - DNA, 15 bp, Homo sapiens
tgttgacattctgaa

SEQ ID NO: 5024040 - DNA, 18 bp, Homo sapiens
tgttgagccttttccctc

SEQ ID NO: 5024041 - DNA, 19 bp, Homo sapiens
tgttggttgttttttcctt

SEQ ID NO: 5024042 - DNA, 22 bp, Homo sapiens
tgttgtccttttcataggtctg

SEQ ID NO: 5024043 - DNA, 11 bp, Homo sapiens
tgttgttctgt

SEQ ID NO: 5024044 - DNA, 18 bp, Homo sapiens
tgttgttctgttaactga

SEQ ID NO: 5024045 - DNA, 20 bp, Homo sapiens
tgtttaatctgttatgtact

SEQ ID NO: 5024046 - DNA, 18 bp, Homo sapiens
tgtttagactttaacata

SEQ ID NO: 5024047 - DNA, 19 bp, Homo sapiens
tgtttagactttaacataa

SEQ ID NO: 5024048 - DNA, 21 bp, Homo sapiens
tgtttatcctttcatatagtt

SEQ ID NO: 5024049 - DNA, 15 bp, Homo sapiens
tgtttcatttctgca

SEQ ID NO: 5024050 - DNA, 21 bp, Homo sapiens
tgtttccagcagaagacaaaa

SEQ ID NO: 5024051 - DNA, 12 bp, Homo sapiens
tgttttgttgac

SEQ ID NO: 5024052 - DNA, 20 bp, Homo sapiens
tgttttgttgacattctgaa

SEQ ID NO: 5024053 - DNA, 18 bp, Homo sapiens
tgtttttaaactgtacag

SEQ ID NO: 5024054 - DNA, 14 bp, Homo sapiens
tgtttttgttgtgt

SEQ ID NO: 5024055 - DNA, 15 bp, Homo sapiens
tgtttttgttgtgtg

SEQ ID NO: 5024056 - DNA, 12 bp, Homo sapiens
ttaaaaaagata

SEQ ID NO: 5024057 - DNA, 17 bp, Homo sapiens
ttaaaatacaagactgc

SEQ ID NO: 5024058 - DNA, 12 bp, Homo sapiens
ttaaacacacag

SEQ ID NO: 5024059 - DNA, 16 bp, Homo sapiens
ttaaacacctcctcat

SEQ ID NO: 5024060 - DNA, 14 bp, Homo sapiens
ttaaactgtacagt

SEQ ID NO: 5024061 - DNA, 20 bp, Homo sapiens
ttaaagaaaaaaatgtattt

SEQ ID NO: 5024062 - DNA, 21 bp, Homo sapiens
ttaaagaaaaaaatgtatttt

SEQ ID NO: 5024063 - DNA, 12 bp, Homo sapiens
ttaaagacagag

SEQ ID NO: 5024064 - DNA, 20 bp, Homo sapiens
ttaaagcaggttcttgttgg

SEQ ID NO: 5024065 - DNA, 14 bp, Homo sapiens
ttaaagcctcctca

SEQ ID NO: 5024066 - DNA, 20 bp, Homo sapiens
ttaaaggaaggttctggtgt

SEQ ID NO: 5024067 - DNA, 13 bp, Homo sapiens
ttaaagtgccagt

SEQ ID NO: 5024068 - DNA, 17 bp, Homo sapiens
ttaaatgaacaagagaa

SEQ ID NO: 5024069 - DNA, 18 bp, Homo sapiens
ttaaatgaacaagagaag

SEQ ID NO: 5024070 - DNA, 22 bp, Homo sapiens
ttaaatgaacaagagaagcatt

SEQ ID NO: 5024071 - DNA, 17 bp, Homo sapiens
ttaacacagtgtctggc

SEQ ID NO: 5024072 - DNA, 15 bp, Homo sapiens
ttaacataagctatt

SEQ ID NO: 5024073 - DNA, 14 bp, Homo sapiens
ttaacccccctgta

SEQ ID NO: 5024074 - DNA, 20 bp, Homo sapiens
ttaacccccctgtacacaac

SEQ ID NO: 5024075 - DNA, 14 bp, Homo sapiens
ttaagaatgaaata

SEQ ID NO: 5024076 - DNA, 18 bp, Homo sapiens
ttaagacatttttggaag

SEQ ID NO: 5024077 - DNA, 19 bp, Homo sapiens
ttaagcaaaagaaaaagat

SEQ ID NO: 5024078 - DNA, 15 bp, Homo sapiens
ttaagcctttggaaa

SEQ ID NO: 5024079 - DNA, 18 bp, Homo sapiens
ttaaggattttatgcttt

SEQ ID NO: 5024080 - DNA, 14 bp, Homo sapiens
ttaagtctgtttta

SEQ ID NO: 5024081 - DNA, 21 bp, Homo sapiens
ttaagtctgttttatgacttc

SEQ ID NO: 5024082 - DNA, 14 bp, Homo sapiens
ttaagtgagcagaa

SEQ ID NO: 5024083 - DNA, 23 bp, Homo sapiens
ttaataaacgtccacagagtata

SEQ ID NO: 5024084 - DNA, 14 bp, Homo sapiens
ttaataaactactc

SEQ ID NO: 5024085 - DNA, 22 bp, Homo sapiens
ttaataaagacgatttgtcagt

SEQ ID NO: 5024086 - DNA, 14 bp, Homo sapiens
ttaataataaattc

SEQ ID NO: 5024087 - DNA, 23 bp, Homo sapiens
ttaataataaattccctggcctt

SEQ ID NO: 5024088 - DNA, 15 bp, Homo sapiens
ttaatatcatcagta

SEQ ID NO: 5024089 - DNA, 22 bp, Homo sapiens
ttaatatttataggtcactttg

SEQ ID NO: 5024090 - DNA, 21 bp, Homo sapiens
ttaatctcaaagagattcgaa

SEQ ID NO: 5024091 - DNA, 18 bp, Homo sapiens
ttaattgggccagctttt

SEQ ID NO: 5024092 - DNA, 22 bp, Homo sapiens
ttaattgggccagcttttcaaa

SEQ ID NO: 5024093 - DNA, 17 bp, Homo sapiens
ttacaaaacaaactcat

SEQ ID NO: 5024094 - DNA, 16 bp, Homo sapiens
ttacaaactgaagagt

SEQ ID NO: 5024095 - DNA, 17 bp, Homo sapiens
ttacatttacaaactga

SEQ ID NO: 5024096 - DNA, 10 bp, Homo sapiens
ttacatttca

SEQ ID NO: 5024097 - DNA, 18 bp, Homo sapiens
ttacccactgccatgcac

SEQ ID NO: 5024098 - DNA, 17 bp, Homo sapiens
ttacgtgtttaaaaaaa

SEQ ID NO: 5024099 - DNA, 19 bp, Homo sapiens
ttactgtaactgtcagtgt

SEQ ID NO: 5024100 - DNA, 18 bp, Homo sapiens
ttagaatcaaacattttg

SEQ ID NO: 5024101 - DNA, 12 bp, Homo sapiens
ttagaattattt

SEQ ID NO: 5024102 - DNA, 13 bp, Homo sapiens
ttagaattattta

SEQ ID NO: 5024103 - DNA, 15 bp, Homo sapiens
ttagactttaacata

SEQ ID NO: 5024104 - DNA, 21 bp, Homo sapiens
ttagactttaacataagctat

SEQ ID NO: 5024105 - DNA, 13 bp, Homo sapiens
ttagagtttctgt

SEQ ID NO: 5024106 - DNA, 18 bp, Homo sapiens
ttagagtttctgtttgat

SEQ ID NO: 5024107 - DNA, 15 bp, Homo sapiens
ttagatgtttcacac

SEQ ID NO: 5024108 - DNA, 16 bp, Homo sapiens
ttagctactatatatg

SEQ ID NO: 5024109 - DNA, 17 bp, Homo sapiens
ttagctcaatgagcatg

SEQ ID NO: 5024110 - DNA, 18 bp, Homo sapiens
ttagtattgttgtccttt

SEQ ID NO: 5024111 - DNA, 21 bp, Homo sapiens
ttagtctcagtttgtgtgtct

SEQ ID NO: 5024112 - DNA, 19 bp, Homo sapiens
ttagtgacctcagctttga

SEQ ID NO: 5024113 - DNA, 21 bp, Homo sapiens
ttataagcatcattatttatg

SEQ ID NO: 5024114 - DNA, 18 bp, Homo sapiens
ttataccccaataatcaa

SEQ ID NO: 5024115 - DNA, 19 bp, Homo sapiens
ttatactcttcctattttt

SEQ ID NO: 5024116 - DNA, 19 bp, Homo sapiens
ttatattaatgtacttgtt

SEQ ID NO: 5024117 - DNA, 15 bp, Homo sapiens
ttatcctttcatata

SEQ ID NO: 5024118 - DNA, 18 bp, Homo sapiens
ttatcgttttcttaaagt

SEQ ID NO: 5024119 - DNA, 19 bp, Homo sapiens
ttatgaaattcaccccctt

SEQ ID NO: 5024120 - DNA, 19 bp, Homo sapiens
ttatgacttcattaataat

SEQ ID NO: 5024121 - DNA, 14 bp, Homo sapiens
ttatgctttaaaca

SEQ ID NO: 5024122 - DNA, 17 bp, Homo sapiens
ttatgtaataatgtgaa

SEQ ID NO: 5024123 - DNA, 21 bp, Homo sapiens
ttatgtaataatgtgaatcat

SEQ ID NO: 5024124 - DNA, 20 bp, Homo sapiens
ttatgtattgtgcaatgtgt

SEQ ID NO: 5024125 - DNA, 22 bp, Homo sapiens
ttatgtcaaactgtcttggctg

SEQ ID NO: 5024126 - DNA, 13 bp, Homo sapiens
ttattaatataat

SEQ ID NO: 5024127 - DNA, 23 bp, Homo sapiens
ttattacagggcattcaaatggg

SEQ ID NO: 5024128 - DNA, 12 bp, Homo sapiens
ttattacagtgt

SEQ ID NO: 5024129 - DNA, 13 bp, Homo sapiens
ttattacagtgtt

SEQ ID NO: 5024130 - DNA, 20 bp, Homo sapiens
ttattagaatcaaacatttt

SEQ ID NO: 5024131 - DNA, 23 bp, Homo sapiens
ttattcccttcctgccagcccct

SEQ ID NO: 5024132 - DNA, 23 bp, Homo sapiens
ttatttgagacagggaaagggtc

SEQ ID NO: 5024133 - DNA, 21 bp, Homo sapiens
ttatttttgttagcaaagatt

SEQ ID NO: 5024134 - DNA, 19 bp, Homo sapiens
ttcaaatgggctgctgctt

SEQ ID NO: 5024135 - DNA, 17 bp, Homo sapiens
ttcaaattgctgcttgg

SEQ ID NO: 5024136 - DNA, 16 bp, Homo sapiens
ttcaaggttttaaaac

SEQ ID NO: 5024137 - DNA, 15 bp, Homo sapiens
ttcaatagccactaa

SEQ ID NO: 5024138 - DNA, 12 bp, Homo sapiens
ttcacagctcct

SEQ ID NO: 5024139 - DNA, 13 bp, Homo sapiens
ttcacagctcctc

SEQ ID NO: 5024140 - DNA, 19 bp, Homo sapiens
ttcacataaaatagatttt

SEQ ID NO: 5024141 - DNA, 23 bp, Homo sapiens
ttcacatagcccacttacattta

SEQ ID NO: 5024142 - DNA, 19 bp, Homo sapiens
ttcacattgtttgctgcta

SEQ ID NO: 5024143 - DNA, 20 bp, Homo sapiens
ttcacattgtttgctgctat

SEQ ID NO: 5024144 - DNA, 17 bp, Homo sapiens
ttcaccatggccccctc

SEQ ID NO: 5024145 - DNA, 19 bp, Homo sapiens
ttcaccccctttcctggac

SEQ ID NO: 5024146 - DNA, 19 bp, Homo sapiens
ttcacctaagtctctgtga

SEQ ID NO: 5024147 - DNA, 23 bp, Homo sapiens
ttcactcaagagttcagtgctca

SEQ ID NO: 5024148 - DNA, 17 bp, Homo sapiens
ttcagataactgttatt

SEQ ID NO: 5024149 - DNA, 13 bp, Homo sapiens
ttcagcaaaccat

SEQ ID NO: 5024150 - DNA, 15 bp, Homo sapiens
ttcataggtctgaaa

SEQ ID NO: 5024151 - DNA, 17 bp, Homo sapiens
ttcataggtctgaaatt

SEQ ID NO: 5024152 - DNA, 17 bp, Homo sapiens
ttcatcttcagttgtct

SEQ ID NO: 5024153 - DNA, 22 bp, Homo sapiens
ttcatgccagctacttcctcct

SEQ ID NO: 5024154 - DNA, 16 bp, Homo sapiens
ttcattagtcatgttt

SEQ ID NO: 5024155 - DNA, 21 bp, Homo sapiens
ttcattctcgtgagtcattta

SEQ ID NO: 5024156 - DNA, 12 bp, Homo sapiens
ttcatttctgca

SEQ ID NO: 5024157 - DNA, 11 bp, Homo sapiens
ttccaacagca

SEQ ID NO: 5024158 - DNA, 11 bp, Homo sapiens
ttccagctcct

SEQ ID NO: 5024159 - DNA, 12 bp, Homo sapiens
ttccatttccaa

SEQ ID NO: 5024160 - DNA, 17 bp, Homo sapiens
ttccatttgcatttgtt

SEQ ID NO: 5024161 - DNA, 14 bp, Homo sapiens
ttcccatcgctgtc

SEQ ID NO: 5024162 - DNA, 15 bp, Homo sapiens
ttcccatcgctgtca

SEQ ID NO: 5024163 - DNA, 19 bp, Homo sapiens
ttccccgatgtcccctgcg

SEQ ID NO: 5024164 - DNA, 18 bp, Homo sapiens
ttcccctctgctgctgtc

SEQ ID NO: 5024165 - DNA, 17 bp, Homo sapiens
ttcccgtttctccacct

SEQ ID NO: 5024166 - DNA, 20 bp, Homo sapiens
ttccctctttggctcccctg

SEQ ID NO: 5024167 - DNA, 19 bp, Homo sapiens
ttccctgcgcctgtgatgc

SEQ ID NO: 5024168 - DNA, 22 bp, Homo sapiens
ttcccttcagtaccctctcagc

SEQ ID NO: 5024169 - DNA, 18 bp, Homo sapiens
ttcctcatccaccccatc

SEQ ID NO: 5024170 - DNA, 12 bp, Homo sapiens
ttcctcatttgt

SEQ ID NO: 5024171 - DNA, 17 bp, Homo sapiens
ttcctcatttgttcatt

SEQ ID NO: 5024172 - DNA, 23 bp, Homo sapiens
ttcctcatttgttcattaaacgt

SEQ ID NO: 5024173 - DNA, 20 bp, Homo sapiens
ttcctgccagcccctgccat

SEQ ID NO: 5024174 - DNA, 22 bp, Homo sapiens
ttcctgtaaagaaacatttcct

SEQ ID NO: 5024175 - DNA, 14 bp, Homo sapiens
ttcctttccttttc

SEQ ID NO: 5024176 - DNA, 16 bp, Homo sapiens
ttctaaaggagtttat

SEQ ID NO: 5024177 - DNA, 17 bp, Homo sapiens
ttctaatggaatggttt

SEQ ID NO: 5024178 - DNA, 18 bp, Homo sapiens
ttctcagaaggcaaatga

SEQ ID NO: 5024179 - DNA, 20 bp, Homo sapiens
ttctccagctgggctctgca

SEQ ID NO: 5024180 - DNA, 15 bp, Homo sapiens
ttctctgcccacagt

SEQ ID NO: 5024181 - DNA, 21 bp, Homo sapiens
ttctcttaggtggctctggga

SEQ ID NO: 5024182 - DNA, 23 bp, Homo sapiens
ttctcttccctgcgcctgtgatg

SEQ ID NO: 5024183 - DNA, 18 bp, Homo sapiens
ttctgaatgcttctaagt

SEQ ID NO: 5024184 - DNA, 23 bp, Homo sapiens
ttctgaatgcttctaagtaaata

SEQ ID NO: 5024185 - DNA, 22 bp, Homo sapiens
ttctgagcagcgagcctgctag

SEQ ID NO: 5024186 - DNA, 10 bp, Homo sapiens
ttctgccttt

SEQ ID NO: 5024187 - DNA, 16 bp, Homo sapiens
ttctgcctttgatgtt

SEQ ID NO: 5024188 - DNA, 18 bp, Homo sapiens
ttctggaatttgttcaag

SEQ ID NO: 5024189 - DNA, 15 bp, Homo sapiens
ttctgggatgtcaca

SEQ ID NO: 5024190 - DNA, 20 bp, Homo sapiens
ttctggtgtgaactaaactt

SEQ ID NO: 5024191 - DNA, 21 bp, Homo sapiens
ttctgtgtatctctttcacat

SEQ ID NO: 5024192 - DNA, 14 bp, Homo sapiens
ttctgtttgattct

SEQ ID NO: 5024193 - DNA, 15 bp, Homo sapiens
ttctgtttgattctt

SEQ ID NO: 5024194 - DNA, 17 bp, Homo sapiens
ttctgttttgtttcgct

SEQ ID NO: 5024195 - DNA, 13 bp, Homo sapiens
ttcttagtgactt

SEQ ID NO: 5024196 - DNA, 22 bp, Homo sapiens
ttcttcacctaagtctctgtga

SEQ ID NO: 5024197 - DNA, 21 bp, Homo sapiens
ttcttgaggggaagctagtct

SEQ ID NO: 5024198 - DNA, 13 bp, Homo sapiens
ttcttgtaatttt

SEQ ID NO: 5024199 - DNA, 22 bp, Homo sapiens
ttcttgtctataaagcatttaa

SEQ ID NO: 5024200 - DNA, 14 bp, Homo sapiens
ttcttgttggtgca

SEQ ID NO: 5024201 - DNA, 22 bp, Homo sapiens
ttctttaaagaagttgaagttt

SEQ ID NO: 5024202 - DNA, 20 bp, Homo sapiens
ttctttacaaaacaaactca

SEQ ID NO: 5024203 - DNA, 14 bp, Homo sapiens
ttctttcatttctt

SEQ ID NO: 5024204 - DNA, 19 bp, Homo sapiens
ttctttccaaaacatttct

SEQ ID NO: 5024205 - DNA, 21 bp, Homo sapiens
ttctttgcaccaaagacatca

SEQ ID NO: 5024206 - DNA, 22 bp, Homo sapiens
ttctttgcaccaaagacatcag

SEQ ID NO: 5024207 - DNA, 23 bp, Homo sapiens
ttcttttttggccatctgctcct

SEQ ID NO: 5024208 - DNA, 20 bp, Homo sapiens
ttgaaaaaaacttcattctc

SEQ ID NO: 5024209 - DNA, 17 bp, Homo sapiens
ttgaaatgtaaggctgt

SEQ ID NO: 5024210 - DNA, 14 bp, Homo sapiens
ttgaagcattttat

SEQ ID NO: 5024211 - DNA, 21 bp, Homo sapiens
ttgaaggactaatagaaaagt

SEQ ID NO: 5024212 - DNA, 19 bp, Homo sapiens
ttgaagggcaagaaatggc

SEQ ID NO: 5024213 - DNA, 22 bp, Homo sapiens
ttgaatatctttcgataaacaa

SEQ ID NO: 5024214 - DNA, 15 bp, Homo sapiens
ttgaatcacatgaat

SEQ ID NO: 5024215 - DNA, 20 bp, Homo sapiens
ttgaatgatttttctttaca

SEQ ID NO: 5024216 - DNA, 14 bp, Homo sapiens
ttgacaaagtgcct

SEQ ID NO: 5024217 - DNA, 15 bp, Homo sapiens
ttgacatgggtgggg

SEQ ID NO: 5024218 - DNA, 14 bp, Homo sapiens
ttgacattctgaat

SEQ ID NO: 5024219 - DNA, 15 bp, Homo sapiens
ttgacattctgaatg

SEQ ID NO: 5024220 - DNA, 16 bp, Homo sapiens
ttgacattctgaatgc

SEQ ID NO: 5024221 - DNA, 20 bp, Homo sapiens
ttgagaaacaaataatttgt

SEQ ID NO: 5024222 - DNA, 21 bp, Homo sapiens
ttgaggtccagccctggctga

SEQ ID NO: 5024223 - DNA, 14 bp, Homo sapiens
ttgagtgacagctt

SEQ ID NO: 5024224 - DNA, 13 bp, Homo sapiens
ttgatacccccct

SEQ ID NO: 5024225 - DNA, 12 bp, Homo sapiens
ttgatcagttaa

SEQ ID NO: 5024226 - DNA, 18 bp, Homo sapiens
ttgatcagttaagaaatt

SEQ ID NO: 5024227 - DNA, 15 bp, Homo sapiens
ttgatgttacagatt

SEQ ID NO: 5024228 - DNA, 14 bp, Homo sapiens
ttgcaagaatcagt

SEQ ID NO: 5024229 - DNA, 15 bp, Homo sapiens
ttgcacatcttggct

SEQ ID NO: 5024230 - DNA, 17 bp, Homo sapiens
ttgcagctgttttgttg

SEQ ID NO: 5024231 - DNA, 20 bp, Homo sapiens
ttgcagctgttttgttgaca

SEQ ID NO: 5024232 - DNA, 13 bp, Homo sapiens
ttgcatgtttgaa

SEQ ID NO: 5024233 - DNA, 20 bp, Homo sapiens
ttgcatttgtttatgtaatt

SEQ ID NO: 5024234 - DNA, 11 bp, Homo sapiens
ttgcctggcct

SEQ ID NO: 5024235 - DNA, 12 bp, Homo sapiens
ttgcctggtaca

SEQ ID NO: 5024236 - DNA, 15 bp, Homo sapiens
ttgcctggtacagta

SEQ ID NO: 5024237 - DNA, 13 bp, Homo sapiens
ttgctcacccagt

SEQ ID NO: 5024238 - DNA, 20 bp, Homo sapiens
ttgctccagattctgatgca

SEQ ID NO: 5024239 - DNA, 15 bp, Homo sapiens
ttgctgcttggattt

SEQ ID NO: 5024240 - DNA, 23 bp, Homo sapiens
ttgctggtagagacccccaggcc

SEQ ID NO: 5024241 - DNA, 16 bp, Homo sapiens
ttgcttatttaataaa

SEQ ID NO: 5024242 - DNA, 23 bp, Homo sapiens
ttgctttaatataaatgcaaata

SEQ ID NO: 5024243 - DNA, 18 bp, Homo sapiens
ttgctttaattgttaaga

SEQ ID NO: 5024244 - DNA, 16 bp, Homo sapiens
ttggaaatttagcatt

SEQ ID NO: 5024245 - DNA, 22 bp, Homo sapiens
ttggaactctactcaacccatt

SEQ ID NO: 5024246 - DNA, 17 bp, Homo sapiens
ttggaaggatctgctga

SEQ ID NO: 5024247 - DNA, 18 bp, Homo sapiens
ttggaaggatctgctgag

SEQ ID NO: 5024248 - DNA, 20 bp, Homo sapiens
ttggaaggatctgctgaggc

SEQ ID NO: 5024249 - DNA, 20 bp, Homo sapiens
ttggattctttccatttgca

SEQ ID NO: 5024250 - DNA, 12 bp, Homo sapiens
ttggcaattttg

SEQ ID NO: 5024251 - DNA, 21 bp, Homo sapiens
ttggcatggaaatttaaagca

SEQ ID NO: 5024252 - DNA, 17 bp, Homo sapiens
ttggctcagcccgctga

SEQ ID NO: 5024253 - DNA, 19 bp, Homo sapiens
ttgggaatatccatgtact

SEQ ID NO: 5024254 - DNA, 18 bp, Homo sapiens
ttgggccagcttttcaaa

SEQ ID NO: 5024255 - DNA, 18 bp, Homo sapiens
ttgggccccagaggctgg

SEQ ID NO: 5024256 - DNA, 14 bp, Homo sapiens
ttggtaaaaatgct

SEQ ID NO: 5024257 - DNA, 19 bp, Homo sapiens
ttggtaaaaatgctgctct

SEQ ID NO: 5024258 - DNA, 14 bp, Homo sapiens
ttggtcctctctct

SEQ ID NO: 5024259 - DNA, 13 bp, Homo sapiens
ttggtcgtttttt

SEQ ID NO: 5024260 - DNA, 21 bp, Homo sapiens
ttggtctcaggcagcaccaca

SEQ ID NO: 5024261 - DNA, 12 bp, Homo sapiens
ttggtgtttttt

SEQ ID NO: 5024262 - DNA, 16 bp, Homo sapiens
ttggttaagtctgttt

SEQ ID NO: 5024263 - DNA, 18 bp, Homo sapiens
ttggttctagcgcagttt

SEQ ID NO: 5024264 - DNA, 13 bp, Homo sapiens
ttggttttcttct

SEQ ID NO: 5024265 - DNA, 13 bp, Homo sapiens
ttgtaaatataaa

SEQ ID NO: 5024266 - DNA, 22 bp, Homo sapiens
ttgtaattttacacgcttttgt

SEQ ID NO: 5024267 - DNA, 13 bp, Homo sapiens
ttgtatagttaac

SEQ ID NO: 5024268 - DNA, 18 bp, Homo sapiens
ttgtatagttaacacact

SEQ ID NO: 5024269 - DNA, 15 bp, Homo sapiens
ttgtcctttcccttc

SEQ ID NO: 5024270 - DNA, 17 bp, Homo sapiens
ttgtcctttcccttcag

SEQ ID NO: 5024271 - DNA, 18 bp, Homo sapiens
ttgtctacacaccctgca

SEQ ID NO: 5024272 - DNA, 15 bp, Homo sapiens
ttgtctctgatgcag

SEQ ID NO: 5024273 - DNA, 21 bp, Homo sapiens
ttgtctctgatgcagcttata

SEQ ID NO: 5024274 - DNA, 11 bp, Homo sapiens
ttgtctgtctc

SEQ ID NO: 5024275 - DNA, 14 bp, Homo sapiens
ttgtcttattccct

SEQ ID NO: 5024276 - DNA, 12 bp, Homo sapiens
ttgtgagctgga

SEQ ID NO: 5024277 - DNA, 14 bp, Homo sapiens
ttgtgctacagatg

SEQ ID NO: 5024278 - DNA, 15 bp, Homo sapiens
ttgtgtctcttatgg

SEQ ID NO: 5024279 - DNA, 19 bp, Homo sapiens
ttgtgttcttcttcatatt

SEQ ID NO: 5024280 - DNA, 23 bp, Homo sapiens
ttgttattatataattacatatt

SEQ ID NO: 5024281 - DNA, 13 bp, Homo sapiens
ttgttcaagtttt

SEQ ID NO: 5024282 - DNA, 14 bp, Homo sapiens
ttgttctgttaact

SEQ ID NO: 5024283 - DNA, 16 bp, Homo sapiens
ttgttggttggttttc

SEQ ID NO: 5024284 - DNA, 14 bp, Homo sapiens
ttgttgtccttttc

SEQ ID NO: 5024285 - DNA, 16 bp, Homo sapiens
ttgttgtccttttcat

SEQ ID NO: 5024286 - DNA, 19 bp, Homo sapiens
ttgtttcgctctttgagaa

SEQ ID NO: 5024287 - DNA, 18 bp, Homo sapiens
tttaaaaacatagaaaaa

SEQ ID NO: 5024288 - DNA, 19 bp, Homo sapiens
tttaaaagttattaatatt

SEQ ID NO: 5024289 - DNA, 23 bp, Homo sapiens
tttaaaatagcgttcttgtaatt

SEQ ID NO: 5024290 - DNA, 22 bp, Homo sapiens
tttaaagaaaaaaattgaaatg

SEQ ID NO: 5024291 - DNA, 19 bp, Homo sapiens
tttaaataaaagcacaagt

SEQ ID NO: 5024292 - DNA, 14 bp, Homo sapiens
tttaacataagcta

SEQ ID NO: 5024293 - DNA, 17 bp, Homo sapiens
tttaacataagctattt

SEQ ID NO: 5024294 - DNA, 20 bp, Homo sapiens
tttaactcccattaccatgt

SEQ ID NO: 5024295 - DNA, 21 bp, Homo sapiens
tttaataaactactctttgat

SEQ ID NO: 5024296 - DNA, 15 bp, Homo sapiens
tttaatataaatgca

SEQ ID NO: 5024297 - DNA, 20 bp, Homo sapiens
tttaatataaatgcaaataa

SEQ ID NO: 5024298 - DNA, 22 bp, Homo sapiens
tttaattaattgggccagcttt

SEQ ID NO: 5024299 - DNA, 18 bp, Homo sapiens
tttaattgttaagatatg

SEQ ID NO: 5024300 - DNA, 18 bp, Homo sapiens
tttacaaaacaaactcat

SEQ ID NO: 5024301 - DNA, 15 bp, Homo sapiens
tttacaaactgaaga

SEQ ID NO: 5024302 - DNA, 15 bp, Homo sapiens
tttacacgcttttgt

SEQ ID NO: 5024303 - DNA, 17 bp, Homo sapiens
tttacacgcttttgtga

SEQ ID NO: 5024304 - DNA, 16 bp, Homo sapiens
tttacatgaggactct

SEQ ID NO: 5024305 - DNA, 10 bp, Homo sapiens
tttacatttc

SEQ ID NO: 5024306 - DNA, 12 bp, Homo sapiens
tttaccaaagca

SEQ ID NO: 5024307 - DNA, 15 bp, Homo sapiens
tttaccaaagcatca

SEQ ID NO: 5024308 - DNA, 18 bp, Homo sapiens
tttactgtaactgtcagt

SEQ ID NO: 5024309 - DNA, 13 bp, Homo sapiens
tttagaaccagcc

SEQ ID NO: 5024310 - DNA, 21 bp, Homo sapiens
tttagacttggattctttcca

SEQ ID NO: 5024311 - DNA, 15 bp, Homo sapiens
tttagactttaacat

SEQ ID NO: 5024312 - DNA, 13 bp, Homo sapiens
tttagatagccct

SEQ ID NO: 5024313 - DNA, 22 bp, Homo sapiens
tttagatagccctgtcctggtg

SEQ ID NO: 5024314 - DNA, 23 bp, Homo sapiens
tttagatagccctgtcctggtgg

SEQ ID NO: 5024315 - DNA, 12 bp, Homo sapiens
tttagcattgta

SEQ ID NO: 5024316 - DNA, 23 bp, Homo sapiens
tttagctactatatatgtgatga

SEQ ID NO: 5024317 - DNA, 17 bp, Homo sapiens
tttagggaacaatttgg

SEQ ID NO: 5024318 - DNA, 19 bp, Homo sapiens
tttataaatcgcttttgat

SEQ ID NO: 5024319 - DNA, 17 bp, Homo sapiens
tttataagcatcattat

SEQ ID NO: 5024320 - DNA, 22 bp, Homo sapiens
tttataagcatcattatttatg

SEQ ID NO: 5024321 - DNA, 20 bp, Homo sapiens
tttatgagatgctggttttc

SEQ ID NO: 5024322 - DNA, 12 bp, Homo sapiens
tttatgctttaa

SEQ ID NO: 5024323 - DNA, 13 bp, Homo sapiens
tttatttccagtg

SEQ ID NO: 5024324 - DNA, 13 bp, Homo sapiens
tttcaatagccac

SEQ ID NO: 5024325 - DNA, 20 bp, Homo sapiens
tttcacaccggaaggttttt

SEQ ID NO: 5024326 - DNA, 13 bp, Homo sapiens
tttcacagctcct

SEQ ID NO: 5024327 - DNA, 21 bp, Homo sapiens
tttcacatagcccacttacat

SEQ ID NO: 5024328 - DNA, 15 bp, Homo sapiens
tttcacattgtttgc

SEQ ID NO: 5024329 - DNA, 15 bp, Homo sapiens
tttcactttgaaaag

SEQ ID NO: 5024330 - DNA, 16 bp, Homo sapiens
tttcataggtctgaaa

SEQ ID NO: 5024331 - DNA, 17 bp, Homo sapiens
tttcataggtctgaaat

SEQ ID NO: 5024332 - DNA, 15 bp, Homo sapiens
tttcatatagttagc

SEQ ID NO: 5024333 - DNA, 16 bp, Homo sapiens
tttcatccataactga

SEQ ID NO: 5024334 - DNA, 20 bp, Homo sapiens
tttcatccataactgaacat

SEQ ID NO: 5024335 - DNA, 15 bp, Homo sapiens
tttcatccttgtctt

SEQ ID NO: 5024336 - DNA, 13 bp, Homo sapiens
tttcatgcaaact

SEQ ID NO: 5024337 - DNA, 16 bp, Homo sapiens
tttcatttcttctaca

SEQ ID NO: 5024338 - DNA, 23 bp, Homo sapiens
tttcatttcttctacaactcata

SEQ ID NO: 5024339 - DNA, 21 bp, Homo sapiens
tttccaaaacatttctggaca

SEQ ID NO: 5024340 - DNA, 20 bp, Homo sapiens
tttccacataaggaaactgg

SEQ ID NO: 5024341 - DNA, 21 bp, Homo sapiens
tttccagcagaagacaaaaag

SEQ ID NO: 5024342 - DNA, 23 bp, Homo sapiens
tttccatgcaccctcatacacag

SEQ ID NO: 5024343 - DNA, 21 bp, Homo sapiens
tttccatttgcatttgtttat

SEQ ID NO: 5024344 - DNA, 22 bp, Homo sapiens
tttcctgtaaagaaacatttcc

SEQ ID NO: 5024345 - DNA, 13 bp, Homo sapiens
tttcctttgctct

SEQ ID NO: 5024346 - DNA, 20 bp, Homo sapiens
tttcgataaacaacaaggtg

SEQ ID NO: 5024347 - DNA, 15 bp, Homo sapiens
tttcgggctgagaag

SEQ ID NO: 5024348 - DNA, 20 bp, Homo sapiens
tttctaatggaatggtttgg

SEQ ID NO: 5024349 - DNA, 14 bp, Homo sapiens
tttctctgttgtaa

SEQ ID NO: 5024350 - DNA, 21 bp, Homo sapiens
tttctcttagaacattgtatt

SEQ ID NO: 5024351 - DNA, 14 bp, Homo sapiens
tttctgtgcttgga

SEQ ID NO: 5024352 - DNA, 13 bp, Homo sapiens
tttcttaaagtgc

SEQ ID NO: 5024353 - DNA, 21 bp, Homo sapiens
tttcttaaagtgccagtattt

SEQ ID NO: 5024354 - DNA, 12 bp, Homo sapiens
tttcttaaataa

SEQ ID NO: 5024355 - DNA, 13 bp, Homo sapiens
tttcttaaataat

SEQ ID NO: 5024356 - DNA, 17 bp, Homo sapiens
tttgaaaagttggaagg

SEQ ID NO: 5024357 - DNA, 20 bp, Homo sapiens
tttgaaatgaggtctgttta

SEQ ID NO: 5024358 - DNA, 18 bp, Homo sapiens
tttgaatcacatgaatta

SEQ ID NO: 5024359 - DNA, 16 bp, Homo sapiens
tttgagaaattaagta

SEQ ID NO: 5024360 - DNA, 20 bp, Homo sapiens
tttgaggtttttaagcctta

SEQ ID NO: 5024361 - DNA, 16 bp, Homo sapiens
tttgcaccaaagacat

SEQ ID NO: 5024362 - DNA, 15 bp, Homo sapiens
tttgcatatgtatga

SEQ ID NO: 5024363 - DNA, 13 bp, Homo sapiens
tttgcatctcagt

SEQ ID NO: 5024364 - DNA, 12 bp, Homo sapiens
tttgcatttgtt

SEQ ID NO: 5024365 - DNA, 20 bp, Homo sapiens
tttgcatttgtttatgtaat

SEQ ID NO: 5024366 - DNA, 14 bp, Homo sapiens
tttgcccctttata

SEQ ID NO: 5024367 - DNA, 20 bp, Homo sapiens
tttgctgctaatattttcct

SEQ ID NO: 5024368 - DNA, 21 bp, Homo sapiens
tttgcttgctcatatgcatgt

SEQ ID NO: 5024369 - DNA, 23 bp, Homo sapiens
tttgctttaatataaatgcaaat

SEQ ID NO: 5024370 - DNA, 16 bp, Homo sapiens
tttggcaattttgtgg

SEQ ID NO: 5024371 - DNA, 22 bp, Homo sapiens
tttgggtatgtttaatctgtta

SEQ ID NO: 5024372 - DNA, 21 bp, Homo sapiens
tttggtgagagtcaaagctga

SEQ ID NO: 5024373 - DNA, 18 bp, Homo sapiens
tttggttaagtctgtttt

SEQ ID NO: 5024374 - DNA, 16 bp, Homo sapiens
tttgtagtgaaataat

SEQ ID NO: 5024375 - DNA, 20 bp, Homo sapiens
tttgtgtctcttatggatgt

SEQ ID NO: 5024376 - DNA, 13 bp, Homo sapiens
tttgtgttctgtt

SEQ ID NO: 5024377 - DNA, 17 bp, Homo sapiens
tttgttcaagttttggg

SEQ ID NO: 5024378 - DNA, 23 bp, Homo sapiens
tttgttcaagttttgggtatgtt

SEQ ID NO: 5024379 - DNA, 14 bp, Homo sapiens
tttgttgacattag

SEQ ID NO: 5024380 - DNA, 17 bp, Homo sapiens
tttgttgacattctgaa

SEQ ID NO: 5024381 - DNA, 15 bp, Homo sapiens
tttgtttatgtaatt

SEQ ID NO: 5024382 - DNA, 13 bp, Homo sapiens
tttgttttgtgtc

SEQ ID NO: 5024383 - DNA, 21 bp, Homo sapiens
tttgtttttcaagaaatgatt

SEQ ID NO: 5024384 - DNA, 13 bp, Homo sapiens
ttttaaaagaaca

SEQ ID NO: 5024385 - DNA, 13 bp, Homo sapiens
ttttaaaatgtac

SEQ ID NO: 5024386 - DNA, 14 bp, Homo sapiens
ttttaaactgtaca

SEQ ID NO: 5024387 - DNA, 15 bp, Homo sapiens
ttttaaactgtacag

SEQ ID NO: 5024388 - DNA, 23 bp, Homo sapiens
ttttaaagaaaaaaattgaaatg

SEQ ID NO: 5024389 - DNA, 12 bp, Homo sapiens
ttttaataaact

SEQ ID NO: 5024390 - DNA, 14 bp, Homo sapiens
ttttaccaaagcat

SEQ ID NO: 5024391 - DNA, 11 bp, Homo sapiens
ttttagaacag

SEQ ID NO: 5024392 - DNA, 13 bp, Homo sapiens
ttttcaagaaatg

SEQ ID NO: 5024393 - DNA, 14 bp, Homo sapiens
ttttcaatagccac

SEQ ID NO: 5024394 - DNA, 17 bp, Homo sapiens
ttttcatgcaaactctt

SEQ ID NO: 5024395 - DNA, 18 bp, Homo sapiens
ttttctagcccgaataca

SEQ ID NO: 5024396 - DNA, 14 bp, Homo sapiens
ttttcttaaataat

SEQ ID NO: 5024397 - DNA, 13 bp, Homo sapiens
ttttcttgtctat

SEQ ID NO: 5024398 - DNA, 20 bp, Homo sapiens
ttttctttacaaaacaaact

SEQ ID NO: 5024399 - DNA, 17 bp, Homo sapiens
ttttgacttaatgtgat

SEQ ID NO: 5024400 - DNA, 20 bp, Homo sapiens
ttttgtatagttaacacact

SEQ ID NO: 5024401 - DNA, 15 bp, Homo sapiens
ttttgttagcaaaga

SEQ ID NO: 5024402 - DNA, 15 bp, Homo sapiens
tttttaaactgtaca

SEQ ID NO: 5024403 - DNA, 15 bp, Homo sapiens
tttttaataaactac

SEQ ID NO: 5024404 - DNA, 14 bp, Homo sapiens
tttttaattaattg

SEQ ID NO: 5024405 - DNA, 13 bp, Homo sapiens
tttttacatttca

SEQ ID NO: 5024406 - DNA, 18 bp, Homo sapiens
tttttattagtattgttg

SEQ ID NO: 5024407 - DNA, 14 bp, Homo sapiens
tttttcaagagatc

SEQ ID NO: 5024408 - DNA, 15 bp, Homo sapiens
tttttcactttgaaa

SEQ ID NO: 5024409 - DNA, 15 bp, Homo sapiens
tttttcatcttcagt

SEQ ID NO: 5024410 - DNA, 15 bp, Homo sapiens
tttttctaactacaa

SEQ ID NO: 5024411 - DNA, 14 bp, Homo sapiens
tttttctgttatat

SEQ ID NO: 5024412 - DNA, 12 bp, Homo sapiens
tttttcttgtct

SEQ ID NO: 5024413 - DNA, 17 bp, Homo sapiens
tttttcttgtctataaa

SEQ ID NO: 5024414 - DNA, 15 bp, Homo sapiens
tttttgagtgacagc

SEQ ID NO: 5024415 - DNA, 12 bp, Homo sapiens
tttttgttgaca

SEQ ID NO: 5024416 - DNA, 17 bp, Homo sapiens
tttttgttttacaatgt

SEQ ID NO: 5024417 - DNA, 11 bp, Homo sapiens
ttttttcatct

SEQ ID NO: 5024418 - DNA, 18 bp, Homo sapiens
ttttttgttttacaatgt

SEQ ID NO: 5024419 - DNA, 14 bp, Homo sapiens
aaaaaaaagttgca

SEQ ID NO: 5024420 - DNA, 19 bp, Homo sapiens
aaaaaaacctgagatttat

SEQ ID NO: 5024421 - DNA, 19 bp, Homo sapiens
aaaaaaattgaaatgtaag

SEQ ID NO: 5024422 - DNA, 20 bp, Homo sapiens
aaaaaagttgcagctgtttt

SEQ ID NO: 5024423 - DNA, 16 bp, Homo sapiens
aaaaaccacacaaaga

SEQ ID NO: 5024424 - DNA, 20 bp, Homo sapiens
aaaaactgtctttaaaagag

SEQ ID NO: 5024425 - DNA, 13 bp, Homo sapiens
aaaaagacaaaca

SEQ ID NO: 5024426 - DNA, 19 bp, Homo sapiens
aaaaagataaacacaagat

SEQ ID NO: 5024427 - DNA, 20 bp, Homo sapiens
aaaaagcataaaaacatttt

SEQ ID NO: 5024428 - DNA, 12 bp, Homo sapiens
aaaaatgctgct

SEQ ID NO: 5024429 - DNA, 22 bp, Homo sapiens
aaaaattgaaatgtaaggctgt

SEQ ID NO: 5024430 - DNA, 20 bp, Homo sapiens
aaaactaaggatttttcaag

SEQ ID NO: 5024431 - DNA, 12 bp, Homo sapiens
aaaactacattt

SEQ ID NO: 5024432 - DNA, 20 bp, Homo sapiens
aacataagctatttttctaa

SEQ ID NO: 5024433 - DNA, 22 bp, Homo sapiens
aacataagctatttttctaact

SEQ ID NO: 5024434 - DNA, 14 bp, Homo sapiens
aacatactgattgg

SEQ ID NO: 5024435 - DNA, 13 bp, Homo sapiens
aacatagaaaaat

SEQ ID NO: 5024436 - DNA, 20 bp, Homo sapiens
aacatgaaagtctagaaata

SEQ ID NO: 5024437 - DNA, 15 bp, Homo sapiens
aaccacacaaagaca

SEQ ID NO: 5024438 - DNA, 15 bp, Homo sapiens
aaccagaaaagcaat

SEQ ID NO: 5024439 - DNA, 19 bp, Homo sapiens
aaccagaaacacccctctg

SEQ ID NO: 5024440 - DNA, 21 bp, Homo sapiens
aaccagggccccggggcctgt

SEQ ID NO: 5024441 - DNA, 23 bp, Homo sapiens
aaccattccatttccaagcactt

SEQ ID NO: 5024442 - DNA, 12 bp, Homo sapiens
aaccatttccaa

SEQ ID NO: 5024443 - DNA, 13 bp, Homo sapiens
aaccatttccaac

SEQ ID NO: 5024444 - DNA, 15 bp, Homo sapiens
aacccccctgtacac

SEQ ID NO: 5024445 - DNA, 18 bp, Homo sapiens
aacctctcacttcaccct

SEQ ID NO: 5024446 - DNA, 20 bp, Homo sapiens
aacctgagatttattaaaga

SEQ ID NO: 5024447 - DNA, 21 bp, Homo sapiens
aacctgagatttattaaagaa

SEQ ID NO: 5024448 - DNA, 22 bp, Homo sapiens
aacctgagatttattaaagaaa

SEQ ID NO: 5024449 - DNA, 20 bp, Homo sapiens
aacctgcacacaggacagcg

SEQ ID NO: 5024450 - DNA, 16 bp, Homo sapiens
aacgagactttccatt

SEQ ID NO: 5024451 - DNA, 15 bp, Homo sapiens
aacgatttttaaaat

SEQ ID NO: 5024452 - DNA, 19 bp, Homo sapiens
aacggccctgcagccagct

SEQ ID NO: 5024453 - DNA, 17 bp, Homo sapiens
aacgtgctctttgtttt

SEQ ID NO: 5024454 - DNA, 19 bp, Homo sapiens
aacgtgctctttgttttgt

SEQ ID NO: 5024455 - DNA, 15 bp, Homo sapiens
aactaaggatttttc

SEQ ID NO: 5024456 - DNA, 16 bp, Homo sapiens
aactacaaaggtttaa

SEQ ID NO: 5024457 - DNA, 17 bp, Homo sapiens
aactacaaaggtttaaa

SEQ ID NO: 5024458 - DNA, 21 bp, Homo sapiens
aactacaaaggtttaaatgaa

SEQ ID NO: 5024459 - DNA, 19 bp, Homo sapiens
aactactttgctgctaata

SEQ ID NO: 5024460 - DNA, 16 bp, Homo sapiens
aactagaaaattctaa

SEQ ID NO: 5024461 - DNA, 21 bp, Homo sapiens
aactcccattaccatgtaatg

SEQ ID NO: 5024462 - DNA, 19 bp, Homo sapiens
aactctactcaacccattg

SEQ ID NO: 5024463 - DNA, 16 bp, Homo sapiens
aactctgacaacagac

SEQ ID NO: 5024464 - DNA, 23 bp, Homo sapiens
aactctgacaacagacttctgaa

SEQ ID NO: 5024465 - DNA, 10 bp, Homo sapiens
aactgaaggg

SEQ ID NO: 5024466 - DNA, 15 bp, Homo sapiens
aactgaataccactc

SEQ ID NO: 5024467 - DNA, 24 bp, Homo sapiens
aactgaataccactctgtaattgc

SEQ ID NO: 5024468 - DNA, 11 bp, Homo sapiens
aactgtacagt

SEQ ID NO: 5024469 - DNA, 19 bp, Homo sapiens
aacttctcttgctttctat

SEQ ID NO: 5024470 - DNA, 19 bp, Homo sapiens
aacttgagcgtgaatctgt

SEQ ID NO: 5024471 - DNA, 16 bp, Homo sapiens
aagaaaaaaatgtatt

SEQ ID NO: 5024472 - DNA, 23 bp, Homo sapiens
aagaaatgattcaaattgctgct

SEQ ID NO: 5024473 - DNA, 11 bp, Homo sapiens
aagaaatggcg

SEQ ID NO: 5024474 - DNA, 21 bp, Homo sapiens
aagaaatggcgtctgctctgg

SEQ ID NO: 5024475 - DNA, 22 bp, Homo sapiens
aagaattgttgggggttttttt

SEQ ID NO: 5024476 - DNA, 23 bp, Homo sapiens
aagaccccttaccactgctctga

SEQ ID NO: 5024477 - DNA, 15 bp, Homo sapiens
aagacctgagaatgt

SEQ ID NO: 5024478 - DNA, 18 bp, Homo sapiens
aagacgttttataagcat

SEQ ID NO: 5024479 - DNA, 17 bp, Homo sapiens
aagactatgaaaatgct

SEQ ID NO: 5024480 - DNA, 14 bp, Homo sapiens
aagagatctttctt

SEQ ID NO: 5024481 - DNA, 20 bp, Homo sapiens
aagagatctttctttccaaa

SEQ ID NO: 5024482 - DNA, 22 bp, Homo sapiens
aagagcttgctccagattctga

SEQ ID NO: 5024483 - DNA, 16 bp, Homo sapiens
aagatagatcctttta

SEQ ID NO: 5024484 - DNA, 18 bp, Homo sapiens
aagatgcactttgcttta

SEQ ID NO: 5024485 - DNA, 17 bp, Homo sapiens
aagattcaatcccagga

SEQ ID NO: 5024486 - DNA, 16 bp, Homo sapiens
aagatttgtttttaaa

SEQ ID NO: 5024487 - DNA, 17 bp, Homo sapiens
aagatttgtttttaaac

SEQ ID NO: 5024488 - DNA, 23 bp, Homo sapiens
aagatttgtttttaaactgtaca

SEQ ID NO: 5024489 - DNA, 15 bp, Homo sapiens
aagcaaaagaaaaag

SEQ ID NO: 5024490 - DNA, 14 bp, Homo sapiens
aagcaatactgttt

SEQ ID NO: 5024491 - DNA, 17 bp, Homo sapiens
aagcacaagtacttttg

SEQ ID NO: 5024492 - DNA, 16 bp, Homo sapiens
aagcagaaatccaagc

SEQ ID NO: 5024493 - DNA, 15 bp, Homo sapiens
aagcaggaggccctt

SEQ ID NO: 5024494 - DNA, 17 bp, Homo sapiens
aagcatattgttattat

SEQ ID NO: 5024495 - DNA, 23 bp, Homo sapiens
aagcatattgttattatataatt

SEQ ID NO: 5024496 - DNA, 14 bp, Homo sapiens
aagcatcattattt

SEQ ID NO: 5024497 - DNA, 18 bp, Homo sapiens
aagcatcattatttatgt

SEQ ID NO: 5024498 - DNA, 21 bp, Homo sapiens
aagcatcattatttatgtatt

SEQ ID NO: 5024499 - DNA, 23 bp, Homo sapiens
aagcatcattatttatgtattgt

SEQ ID NO: 5024500 - DNA, 17 bp, Homo sapiens
aagcattctcattggaa

SEQ ID NO: 5024501 - DNA, 18 bp, Homo sapiens
aagcattctcattggaaa

SEQ ID NO: 5024502 - DNA, 22 bp, Homo sapiens
aagcatttaacccccctgtaca

SEQ ID NO: 5024503 - DNA, 23 bp, Homo sapiens
aagcatttaacccccctgtacac

SEQ ID NO: 5024504 - DNA, 14 bp, Homo sapiens
aagcattttataaa

SEQ ID NO: 5024505 - DNA, 22 bp, Homo sapiens
aagcctgctggctgcggccccc

SEQ ID NO: 5024506 - DNA, 10 bp, Homo sapiens
aagcctttgt

SEQ ID NO: 5024507 - DNA, 14 bp, Homo sapiens
aagcggtgtctctc

SEQ ID NO: 5024508 - DNA, 12 bp, Homo sapiens
aagctagtcttt

SEQ ID NO: 5024509 - DNA, 14 bp, Homo sapiens
aagctagtcttttg

SEQ ID NO: 5024510 - DNA, 21 bp, Homo sapiens
aagctagtcttttgcttttgc

SEQ ID NO: 5024511 - DNA, 16 bp, Homo sapiens
aagctatttttctaac

SEQ ID NO: 5024512 - DNA, 23 bp, Homo sapiens
aagctggcggctggggtcccagc

SEQ ID NO: 5024513 - DNA, 16 bp, Homo sapiens
aagctttattaccagt

SEQ ID NO: 5024514 - DNA, 21 bp, Homo sapiens
aagctttattaccagtggcgt

SEQ ID NO: 5024515 - DNA, 20 bp, Homo sapiens
aagctttgaatactgtgaaa

SEQ ID NO: 5024516 - DNA, 22 bp, Homo sapiens
aagcttttgtctacacaccctg

SEQ ID NO: 5024517 - DNA, 16 bp, Homo sapiens
aaggaaggttctggtg

SEQ ID NO: 5024518 - DNA, 20 bp, Homo sapiens
aaggagtcagacattttaag

SEQ ID NO: 5024519 - DNA, 12 bp, Homo sapiens
aaggagtttatg

SEQ ID NO: 5024520 - DNA, 14 bp, Homo sapiens
aaggagtttatgtt

SEQ ID NO: 5024521 - DNA, 17 bp, Homo sapiens
aaggagtttatgttcca

SEQ ID NO: 5024522 - DNA, 12 bp, Homo sapiens
aaggatctgctg

SEQ ID NO: 5024523 - DNA, 16 bp, Homo sapiens
aaggatctgctgaggc

SEQ ID NO: 5024524 - DNA, 14 bp, Homo sapiens
aaggattttaccaa

SEQ ID NO: 5024525 - DNA, 20 bp, Homo sapiens
aaggattttatgctttaaac

SEQ ID NO: 5024526 - DNA, 21 bp, Homo sapiens
aaggattttatgctttaaaca

SEQ ID NO: 5024527 - DNA, 18 bp, Homo sapiens
aaggatttttcaagagat

SEQ ID NO: 5024528 - DNA, 14 bp, Homo sapiens
aaggcaaatgactt

SEQ ID NO: 5024529 - DNA, 18 bp, Homo sapiens
aaggcagtagttttcaaa

SEQ ID NO: 5024530 - DNA, 20 bp, Homo sapiens
aaggcagtagttttcaaaac

SEQ ID NO: 5024531 - DNA, 13 bp, Homo sapiens
aaggctaaaaagt

SEQ ID NO: 5024532 - DNA, 14 bp, Homo sapiens
aaggctgtgtaaga

SEQ ID NO: 5024533 - DNA, 18 bp, Homo sapiens
aaggggaagcactcgtgt

SEQ ID NO: 5024534 - DNA, 19 bp, Homo sapiens
aaggggtgcacccacctgt

SEQ ID NO: 5024535 - DNA, 17 bp, Homo sapiens
aagtaaatacaattttt

SEQ ID NO: 5024536 - DNA, 12 bp, Homo sapiens
aagtagaagagg

SEQ ID NO: 5024537 - DNA, 18 bp, Homo sapiens
aagtcacgttgttttcag

SEQ ID NO: 5024538 - DNA, 23 bp, Homo sapiens
aagtccattatgtaatagtgaca

SEQ ID NO: 5024539 - DNA, 11 bp, Homo sapiens
aagtctctgtg

SEQ ID NO: 5024540 - DNA, 18 bp, Homo sapiens
aagtctgttttatgactt

SEQ ID NO: 5024541 - DNA, 20 bp, Homo sapiens
aagtctgttttatgacttca

SEQ ID NO: 5024542 - DNA, 16 bp, Homo sapiens
aagtgagcagaacagg

SEQ ID NO: 5024543 - DNA, 17 bp, Homo sapiens
aagtgagcagaacaggt

SEQ ID NO: 5024544 - DNA, 20 bp, Homo sapiens
aagtgcagggaggaaaagtg

SEQ ID NO: 5024545 - DNA, 19 bp, Homo sapiens
acaaggccttgcctggcct

SEQ ID NO: 5024546 - DNA, 15 bp, Homo sapiens
acaagtatttttaat

SEQ ID NO: 5024547 - DNA, 20 bp, Homo sapiens
acaagtcctggatgttgtgt

SEQ ID NO: 5024548 - DNA, 22 bp, Homo sapiens
acaagtgactgtatctgtgtag

SEQ ID NO: 5024549 - DNA, 14 bp, Homo sapiens
acaatgtacacact

SEQ ID NO: 5024550 - DNA, 18 bp, Homo sapiens
acaattaaaccgcatgtg

SEQ ID NO: 5024551 - DNA, 20 bp, Homo sapiens
acaatttggcaattttgtgg

SEQ ID NO: 5024552 - DNA, 18 bp, Homo sapiens
acaattttttttattagt

SEQ ID NO: 5024553 - DNA, 22 bp, Homo sapiens
acacaagaagaagggcacccta

SEQ ID NO: 5024554 - DNA, 23 bp, Homo sapiens
acacaagattggtgtttttttct

SEQ ID NO: 5024555 - DNA, 10 bp, Homo sapiens
acacacacaa

SEQ ID NO: 5024556 - DNA, 13 bp, Homo sapiens
acacacacaaacc

SEQ ID NO: 5024557 - DNA, 13 bp, Homo sapiens
acacacacacaca

SEQ ID NO: 5024558 - DNA, 19 bp, Homo sapiens
acacacgagcaaacccaga

SEQ ID NO: 5024559 - DNA, 20 bp, Homo sapiens
acacacgagcaaacccagag

SEQ ID NO: 5024560 - DNA, 22 bp, Homo sapiens
acacactaccgaatgtgtcttt

SEQ ID NO: 5024561 - DNA, 16 bp, Homo sapiens
acacactggtacttag

SEQ ID NO: 5024562 - DNA, 23 bp, Homo sapiens
acacacttttggttaagtctgtt

SEQ ID NO: 5024563 - DNA, 16 bp, Homo sapiens
acacagatacacacac

SEQ ID NO: 5024564 - DNA, 22 bp, Homo sapiens
acacagtgctgaccagacagcc

SEQ ID NO: 5024565 - DNA, 11 bp, Homo sapiens
acacagtgtct

SEQ ID NO: 5024566 - DNA, 19 bp, Homo sapiens
acacatagttaaaaaagaa

SEQ ID NO: 5024567 - DNA, 23 bp, Homo sapiens
acaccaatttggtaaaaatgctg

SEQ ID NO: 5024568 - DNA, 21 bp, Homo sapiens
acaccccagacgatgtcttca

SEQ ID NO: 5024569 - DNA, 21 bp, Homo sapiens
acaccttagcctgccctcctt

SEQ ID NO: 5024570 - DNA, 16 bp, Homo sapiens
acaccttccagctcct

SEQ ID NO: 5024571 - DNA, 20 bp, Homo sapiens
acaccttccagctcctgtaa

SEQ ID NO: 5024572 - DNA, 20 bp, Homo sapiens
acacgagcaaacccagaggt

SEQ ID NO: 5024573 - DNA, 16 bp, Homo sapiens
acacgctccttcctct

SEQ ID NO: 5024574 - DNA, 17 bp, Homo sapiens
acacgctccttcctctg

SEQ ID NO: 5024575 - DNA, 23 bp, Homo sapiens
acactaccgaatgtgtctttaga

SEQ ID NO: 5024576 - DNA, 18 bp, Homo sapiens
acactccaattaaggatt

SEQ ID NO: 5024577 - DNA, 13 bp, Homo sapiens
acactggcccctc

SEQ ID NO: 5024578 - DNA, 15 bp, Homo sapiens
acactgggtgcgtct

SEQ ID NO: 5024579 - DNA, 16 bp, Homo sapiens
acacttcaaactactt

SEQ ID NO: 5024580 - DNA, 21 bp, Homo sapiens
acagaacacataattcaggaa

SEQ ID NO: 5024581 - DNA, 15 bp, Homo sapiens
acagaagcagctctt

SEQ ID NO: 5024582 - DNA, 19 bp, Homo sapiens
acagaatacggaagagcag

SEQ ID NO: 5024583 - DNA, 14 bp, Homo sapiens
acagacttctgaaa

SEQ ID NO: 5024584 - DNA, 23 bp, Homo sapiens
acagagcgtgagctgagcaggcc

SEQ ID NO: 5024585 - DNA, 18 bp, Homo sapiens
acagatgccttttttgta

SEQ ID NO: 5024586 - DNA, 17 bp, Homo sapiens
acagcaattcctcaggc

SEQ ID NO: 5024587 - DNA, 19 bp, Homo sapiens
acagcaattcctcaggcta

SEQ ID NO: 5024588 - DNA, 11 bp, Homo sapiens
acagccacccg

SEQ ID NO: 5024589 - DNA, 23 bp, Homo sapiens
acagccacccgtggggtgctgcc

SEQ ID NO: 5024590 - DNA, 18 bp, Homo sapiens
acagccgtttgttcccca

SEQ ID NO: 5024591 - DNA, 13 bp, Homo sapiens
acagcttcagaaa

SEQ ID NO: 5024592 - DNA, 22 bp, Homo sapiens
acagctttctgggatgtcacag

SEQ ID NO: 5024593 - DNA, 16 bp, Homo sapiens
acaggaagtagttcta

SEQ ID NO: 5024594 - DNA, 18 bp, Homo sapiens
acaggaagtagttctaaa

SEQ ID NO: 5024595 - DNA, 14 bp, Homo sapiens
acaggaggaggtga

SEQ ID NO: 5024596 - DNA, 17 bp, Homo sapiens
acaggcacacagggccc

SEQ ID NO: 5024597 - DNA, 22 bp, Homo sapiens
acaggcatgggtgcaaggaaaa

SEQ ID NO: 5024598 - DNA, 21 bp, Homo sapiens
acaggcccccttgagtggggt

SEQ ID NO: 5024599 - DNA, 14 bp, Homo sapiens
acaggctggcgggg

SEQ ID NO: 5024600 - DNA, 17 bp, Homo sapiens
acaggcttctgagcagc

SEQ ID NO: 5024601 - DNA, 18 bp, Homo sapiens
acaggcttctgagcagcg

SEQ ID NO: 5024602 - DNA, 23 bp, Homo sapiens
acaggcttctgagcagcgagcct

SEQ ID NO: 5024603 - DNA, 19 bp, Homo sapiens
acaggtgccgccagctgcc

SEQ ID NO: 5024604 - DNA, 22 bp, Homo sapiens
acaggtgccgccagctgccgca

SEQ ID NO: 5024605 - DNA, 17 bp, Homo sapiens
acagtacctgattgtat

SEQ ID NO: 5024606 - DNA, 19 bp, Homo sapiens
acagtacctgattgtattt

SEQ ID NO: 5024607 - DNA, 21 bp, Homo sapiens
acagtatgggggttgtaaatt

SEQ ID NO: 5024608 - DNA, 22 bp, Homo sapiens
acagtatgggggttgtaaattg

SEQ ID NO: 5024609 - DNA, 15 bp, Homo sapiens
acagtattgctcacc

SEQ ID NO: 5024610 - DNA, 16 bp, Homo sapiens
acagtcatggtggcca

SEQ ID NO: 5024611 - DNA, 14 bp, Homo sapiens
acagtccaaccaga

SEQ ID NO: 5024612 - DNA, 20 bp, Homo sapiens
acagtccaaccagaaacacc

SEQ ID NO: 5024613 - DNA, 10 bp, Homo sapiens
acagtgcccc

SEQ ID NO: 5024614 - DNA, 12 bp, Homo sapiens
acagtgcctctt

SEQ ID NO: 5024615 - DNA, 22 bp, Homo sapiens
acagtgcctcttccagtgaaca

SEQ ID NO: 5024616 - DNA, 11 bp, Homo sapiens
acagtgtcttt

SEQ ID NO: 5024617 - DNA, 12 bp, Homo sapiens
acagtgtctttt

SEQ ID NO: 5024618 - DNA, 19 bp, Homo sapiens
acagtgtctttttttgtat

SEQ ID NO: 5024619 - DNA, 18 bp, Homo sapiens
acagtgtttatcctttca

SEQ ID NO: 5024620 - DNA, 24 bp, Homo sapiens
acagttttggttgctttaatatca

SEQ ID NO: 5024621 - DNA, 20 bp, Homo sapiens
acataccctggccgccccct

SEQ ID NO: 5024622 - DNA, 16 bp, Homo sapiens
acatagcccacttaca

SEQ ID NO: 5024623 - DNA, 19 bp, Homo sapiens
acatcagcaatttcagaac

SEQ ID NO: 5024624 - DNA, 21 bp, Homo sapiens
acatcaggagactgggctctg

SEQ ID NO: 5024625 - DNA, 23 bp, Homo sapiens
acatcaggagactgggctctggc

SEQ ID NO: 5024626 - DNA, 22 bp, Homo sapiens
acatcgcaatagttttttactt

SEQ ID NO: 5024627 - DNA, 17 bp, Homo sapiens
acatgaagctgtataat

SEQ ID NO: 5024628 - DNA, 19 bp, Homo sapiens
acatgaattattacagtgt

SEQ ID NO: 5024629 - DNA, 21 bp, Homo sapiens
acatgaattattacagtgttt

SEQ ID NO: 5024630 - DNA, 21 bp, Homo sapiens
acatgaggactctattcttta

SEQ ID NO: 5024631 - DNA, 14 bp, Homo sapiens
acatgccctgtgtg

SEQ ID NO: 5024632 - DNA, 12 bp, Homo sapiens
acatgggtgggg

SEQ ID NO: 5024633 - DNA, 20 bp, Homo sapiens
acatggtgagcctagccctg

SEQ ID NO: 5024634 - DNA, 12 bp, Homo sapiens
acatgtatttgt

SEQ ID NO: 5024635 - DNA, 17 bp, Homo sapiens
acatgtatttgtttgca

SEQ ID NO: 5024636 - DNA, 11 bp, Homo sapiens
acattaaagaa

SEQ ID NO: 5024637 - DNA, 15 bp, Homo sapiens
acattaatctcaaag

SEQ ID NO: 5024638 - DNA, 21 bp, Homo sapiens
acattctgaatgcttctaagt

SEQ ID NO: 5024639 - DNA, 17 bp, Homo sapiens
acattgtttgctgctat

SEQ ID NO: 5024640 - DNA, 17 bp, Homo sapiens
acatttacaaactgaag

SEQ ID NO: 5024641 - DNA, 20 bp, Homo sapiens
acatttcaccatggccccct

SEQ ID NO: 5024642 - DNA, 15 bp, Homo sapiens
acatttctggacagt

SEQ ID NO: 5024643 - DNA, 20 bp, Homo sapiens
accaaaagggaggctctctg

SEQ ID NO: 5024644 - DNA, 13 bp, Homo sapiens
accaaagacatca

SEQ ID NO: 5024645 - DNA, 17 bp, Homo sapiens
accaaagacatcagtct

SEQ ID NO: 5024646 - DNA, 24 bp, Homo sapiens
accaaagcatcaatacaaccagcc

SEQ ID NO: 5024647 - DNA, 22 bp, Homo sapiens
accaatttggtaaaaatgctgc

SEQ ID NO: 5024648 - DNA, 22 bp, Homo sapiens
accacactgggtgcgtctccag

SEQ ID NO: 5024649 - DNA, 23 bp, Homo sapiens
accacagaatacggaagagcagg

SEQ ID NO: 5024650 - DNA, 19 bp, Homo sapiens
accacagtgagcctgagag

SEQ ID NO: 5024651 - DNA, 18 bp, Homo sapiens
accaccccaacaaaccat

SEQ ID NO: 5024652 - DNA, 22 bp, Homo sapiens
accaccccgcctgccctcatgg

SEQ ID NO: 5024653 - DNA, 15 bp, Homo sapiens
accactgctctgatg

SEQ ID NO: 5024654 - DNA, 13 bp, Homo sapiens
accagaaaagcaa

SEQ ID NO: 5024655 - DNA, 17 bp, Homo sapiens
accagaaacacccctct

SEQ ID NO: 5024656 - DNA, 19 bp, Homo sapiens
accagaaccaattattttc

SEQ ID NO: 5024657 - DNA, 22 bp, Homo sapiens
agcaataacattcccactgcca

SEQ ID NO: 5024658 - DNA, 22 bp, Homo sapiens
agcaccaccaaacacagtgtat

SEQ ID NO: 5024659 - DNA, 16 bp, Homo sapiens
agcaccctaggcagcc

SEQ ID NO: 5024660 - DNA, 20 bp, Homo sapiens
agcacggctctgtccccagc

SEQ ID NO: 5024661 - DNA, 14 bp, Homo sapiens
agcactcgtgtgca

SEQ ID NO: 5024662 - DNA, 19 bp, Homo sapiens
agcactgcctgctcccatc

SEQ ID NO: 5024663 - DNA, 21 bp, Homo sapiens
agcactgcctgctcccatcct

SEQ ID NO: 5024664 - DNA, 20 bp, Homo sapiens
agcactttaacacagtgtct

SEQ ID NO: 5024665 - DNA, 15 bp, Homo sapiens
agcagaacaggtagt

SEQ ID NO: 5024666 - DNA, 16 bp, Homo sapiens
agcagaacctgcacac

SEQ ID NO: 5024667 - DNA, 18 bp, Homo sapiens
agcagaacctgcacacag

SEQ ID NO: 5024668 - DNA, 22 bp, Homo sapiens
agcagaacctgcacacaggaca

SEQ ID NO: 5024669 - DNA, 13 bp, Homo sapiens
agcagaagacaaa

SEQ ID NO: 5024670 - DNA, 22 bp, Homo sapiens
agcagaccaccccgcctgccct

SEQ ID NO: 5024671 - DNA, 18 bp, Homo sapiens
agcagcgaccgccccctc

SEQ ID NO: 5024672 - DNA, 14 bp, Homo sapiens
agcagcgagcctgc

SEQ ID NO: 5024673 - DNA, 18 bp, Homo sapiens
agcagctgccaggagcac

SEQ ID NO: 5024674 - DNA, 16 bp, Homo sapiens
agcagctttgtctctg

SEQ ID NO: 5024675 - DNA, 21 bp, Homo sapiens
agcaggaggcccttgtcgtgg

SEQ ID NO: 5024676 - DNA, 14 bp, Homo sapiens
agcaggttcttgtt

SEQ ID NO: 5024677 - DNA, 16 bp, Homo sapiens
agcagtccccttccct

SEQ ID NO: 5024678 - DNA, 22 bp, Homo sapiens
agcagtccccttccctccaaga

SEQ ID NO: 5024679 - DNA, 20 bp, Homo sapiens
agcatcaagttctccccagg

SEQ ID NO: 5024680 - DNA, 18 bp, Homo sapiens
agcatcattatttatgta

SEQ ID NO: 5024681 - DNA, 12 bp, Homo sapiens
agcatgtttaga

SEQ ID NO: 5024682 - DNA, 23 bp, Homo sapiens
agcatgtttagactttaacataa

SEQ ID NO: 5024683 - DNA, 22 bp, Homo sapiens
agcattctcattggaaatttag

SEQ ID NO: 5024684 - DNA, 15 bp, Homo sapiens
agcattgtagtgctt

SEQ ID NO: 5024685 - DNA, 18 bp, Homo sapiens
agcattgtagtgctttga

SEQ ID NO: 5024686 - DNA, 20 bp, Homo sapiens
agcattgtagtgctttgaga

SEQ ID NO: 5024687 - DNA, 23 bp, Homo sapiens
agcatttaacccccctgtacaca

SEQ ID NO: 5024688 - DNA, 20 bp, Homo sapiens
agccacccaagcctgctggc

SEQ ID NO: 5024689 - DNA, 22 bp, Homo sapiens
agccactaaccttgcctggtac

SEQ ID NO: 5024690 - DNA, 22 bp, Homo sapiens
agccagatggactccagcctgc

SEQ ID NO: 5024691 - DNA, 18 bp, Homo sapiens
agccagcagcaaaaacta

SEQ ID NO: 5024692 - DNA, 18 bp, Homo sapiens
agcccagaaagtgataag

SEQ ID NO: 5024693 - DNA, 14 bp, Homo sapiens
agcccagccccgcc

SEQ ID NO: 5024694 - DNA, 11 bp, Homo sapiens
agccccacctt

SEQ ID NO: 5024695 - DNA, 11 bp, Homo sapiens
agccccctcac

SEQ ID NO: 5024696 - DNA, 14 bp, Homo sapiens
agccccctcacagt

SEQ ID NO: 5024697 - DNA, 22 bp, Homo sapiens
agccccctcacagtattgctca

SEQ ID NO: 5024698 - DNA, 14 bp, Homo sapiens
agcccctcggctct

SEQ ID NO: 5024699 - DNA, 21 bp, Homo sapiens
agcccgaacaccattgaggga

SEQ ID NO: 5024700 - DNA, 14 bp, Homo sapiens
agcccgtctcagtg

SEQ ID NO: 5024701 - DNA, 15 bp, Homo sapiens
agcccgtctcagtgt

SEQ ID NO: 5024702 - DNA, 18 bp, Homo sapiens
agccctggctgaaggact

SEQ ID NO: 5024703 - DNA, 14 bp, Homo sapiens
agccctgtcctggt

SEQ ID NO: 5024704 - DNA, 21 bp, Homo sapiens
agccctgtcctggtggtattt

SEQ ID NO: 5024705 - DNA, 23 bp, Homo sapiens
agccctgtcctggtggtattttc

SEQ ID NO: 5024706 - DNA, 14 bp, Homo sapiens
agccggtggtgccc

SEQ ID NO: 5024707 - DNA, 15 bp, Homo sapiens
agccgtattttacat

SEQ ID NO: 5024708 - DNA, 23 bp, Homo sapiens
agccgtttgttccccaagacatt

SEQ ID NO: 5024709 - DNA, 15 bp, Homo sapiens
agcctcagcctactc

SEQ ID NO: 5024710 - DNA, 11 bp, Homo sapiens
agcctcccaca

SEQ ID NO: 5024711 - DNA, 23 bp, Homo sapiens
agcctccctattttttttctgtt

SEQ ID NO: 5024712 - DNA, 17 bp, Homo sapiens
agcctgacccggaggaa

SEQ ID NO: 5024713 - DNA, 19 bp, Homo sapiens
agcctgacccggaggaaag

SEQ ID NO: 5024714 - DNA, 12 bp, Homo sapiens
agcctgctggct

SEQ ID NO: 5024715 - DNA, 14 bp, Homo sapiens
agcctggtgctgct

SEQ ID NO: 5024716 - DNA, 15 bp, Homo sapiens
agcctggtgctgctg

SEQ ID NO: 5024717 - DNA, 16 bp, Homo sapiens
agcctggtgctgctgc

SEQ ID NO: 5024718 - DNA, 12 bp, Homo sapiens
agccttaataaa

SEQ ID NO: 5024719 - DNA, 18 bp, Homo sapiens
agcctttgtttttctcca

SEQ ID NO: 5024720 - DNA, 14 bp, Homo sapiens
agcgaccgccccct

SEQ ID NO: 5024721 - DNA, 19 bp, Homo sapiens
agcgaggaaaggattttac

SEQ ID NO: 5024722 - DNA, 18 bp, Homo sapiens
agcgatgggcccctggcc

SEQ ID NO: 5024723 - DNA, 23 bp, Homo sapiens
agcggccccccgcacagccaccc

SEQ ID NO: 5024724 - DNA, 14 bp, Homo sapiens
agcggtgtctctcc

SEQ ID NO: 5024725 - DNA, 12 bp, Homo sapiens
agcgtgagctta

SEQ ID NO: 5024726 - DNA, 11 bp, Homo sapiens
agcgttcttgt

SEQ ID NO: 5024727 - DNA, 22 bp, Homo sapiens
agctaataattcttcacctaag

SEQ ID NO: 5024728 - DNA, 20 bp, Homo sapiens
agctaccctttttctccagc

SEQ ID NO: 5024729 - DNA, 21 bp, Homo sapiens
agctaccctttttctccagct

SEQ ID NO: 5024730 - DNA, 23 bp, Homo sapiens
agctagtcttttgcttttgccca

SEQ ID NO: 5024731 - DNA, 13 bp, Homo sapiens
agctatttttcta

SEQ ID NO: 5024732 - DNA, 17 bp, Homo sapiens
agctatttttctaacta

SEQ ID NO: 5024733 - DNA, 17 bp, Homo sapiens
agctcaatgagcatgtt

SEQ ID NO: 5024734 - DNA, 20 bp, Homo sapiens
agctcagcactgcctgctcc

SEQ ID NO: 5024735 - DNA, 23 bp, Homo sapiens
agctcagcactgcctgctcccat

SEQ ID NO: 5024736 - DNA, 20 bp, Homo sapiens
agctccccgcttctgcctgc

SEQ ID NO: 5024737 - DNA, 13 bp, Homo sapiens
agctctctgacgc

SEQ ID NO: 5024738 - DNA, 19 bp, Homo sapiens
agctctgtgggtctctgga

SEQ ID NO: 5024739 - DNA, 15 bp, Homo sapiens
agctgaatgtttttc

SEQ ID NO: 5024740 - DNA, 14 bp, Homo sapiens
agctgccccagcca

SEQ ID NO: 5024741 - DNA, 22 bp, Homo sapiens
agctgccgcaccagcccgaaca

SEQ ID NO: 5024742 - DNA, 20 bp, Homo sapiens
agctggatagacttgggatg

SEQ ID NO: 5024743 - DNA, 22 bp, Homo sapiens
agctggccaaagagcctttcca

SEQ ID NO: 5024744 - DNA, 20 bp, Homo sapiens
agctgggagaccctccccac

SEQ ID NO: 5024745 - DNA, 22 bp, Homo sapiens
agctgggatcacatgtggactt

SEQ ID NO: 5024746 - DNA, 22 bp, Homo sapiens
agctgggcccctgcacaggcac

SEQ ID NO: 5024747 - DNA, 11 bp, Homo sapiens
agctgtagtgg

SEQ ID NO: 5024748 - DNA, 23 bp, Homo sapiens
agctgtataattaattgtcatta

SEQ ID NO: 5024749 - DNA, 15 bp, Homo sapiens
agcttaaaatacaag

SEQ ID NO: 5024750 - DNA, 20 bp, Homo sapiens
agcttaaaatacaagactgc

SEQ ID NO: 5024751 - DNA, 15 bp, Homo sapiens
agcttatgaaaagaa

SEQ ID NO: 5024752 - DNA, 21 bp, Homo sapiens
agcttcattctccttgttgtt

SEQ ID NO: 5024753 - DNA, 21 bp, Homo sapiens
agcttgaaatagtgtctgatg

SEQ ID NO: 5024754 - DNA, 19 bp, Homo sapiens
agcttgctccagattctga

SEQ ID NO: 5024755 - DNA, 21 bp, Homo sapiens
agcttgctccagattctgatg

SEQ ID NO: 5024756 - DNA, 21 bp, Homo sapiens
aggaaaggattttaccaaagc

SEQ ID NO: 5024757 - DNA, 13 bp, Homo sapiens
aggaactgggctg

SEQ ID NO: 5024758 - DNA, 16 bp, Homo sapiens
aggaaggttctggtgt

SEQ ID NO: 5024759 - DNA, 15 bp, Homo sapiens
aggaaggtttttaag

SEQ ID NO: 5024760 - DNA, 21 bp, Homo sapiens
aggaagtgttgaagggaggtg

SEQ ID NO: 5024761 - DNA, 17 bp, Homo sapiens
aggaatactgaacatct

SEQ ID NO: 5024762 - DNA, 20 bp, Homo sapiens
aggacaggcgggaggaggtg

SEQ ID NO: 5024763 - DNA, 14 bp, Homo sapiens
aggactcctgaaaa

SEQ ID NO: 5024764 - DNA, 23 bp, Homo sapiens
aggactgcacagcgtcctgtcca

SEQ ID NO: 5024765 - DNA, 16 bp, Homo sapiens
aggactgcagtgtgga

SEQ ID NO: 5024766 - DNA, 17 bp, Homo sapiens
aggactgtgacaggcag

SEQ ID NO: 5024767 - DNA, 18 bp, Homo sapiens
aggagaagggctggggcc

SEQ ID NO: 5024768 - DNA, 12 bp, Homo sapiens
aggagctgggcc

SEQ ID NO: 5024769 - DNA, 16 bp, Homo sapiens
atctatgcctttcaac

SEQ ID NO: 5024770 - DNA, 17 bp, Homo sapiens
atctcagtgctgtaaaa

SEQ ID NO: 5024771 - DNA, 13 bp, Homo sapiens
atctgagtcctgg

SEQ ID NO: 5024772 - DNA, 17 bp, Homo sapiens
atctgagtcctggatga

SEQ ID NO: 5024773 - DNA, 16 bp, Homo sapiens
atcttaatatatttga

SEQ ID NO: 5024774 - DNA, 16 bp, Homo sapiens
atcttcagttgtctct

SEQ ID NO: 5024775 - DNA, 17 bp, Homo sapiens
atctttcgataaacaac

SEQ ID NO: 5024776 - DNA, 19 bp, Homo sapiens
atctttctccctcaactga

SEQ ID NO: 5024777 - DNA, 22 bp, Homo sapiens
atctttctccttgaatatcttt

SEQ ID NO: 5024778 - DNA, 20 bp, Homo sapiens
atctttctttccaaaacatt

SEQ ID NO: 5024779 - DNA, 17 bp, Homo sapiens
atgaaatactatttaaa

SEQ ID NO: 5024780 - DNA, 14 bp, Homo sapiens
atgaacaagagaag

SEQ ID NO: 5024781 - DNA, 22 bp, Homo sapiens
atgaagctgtataattaattgt

SEQ ID NO: 5024782 - DNA, 14 bp, Homo sapiens
atgaagtctctgaa

SEQ ID NO: 5024783 - DNA, 18 bp, Homo sapiens
atgacggtaagtgttctc

SEQ ID NO: 5024784 - DNA, 23 bp, Homo sapiens
atgacgtgactggcctgctggat

SEQ ID NO: 5024785 - DNA, 11 bp, Homo sapiens
atgactttgga

SEQ ID NO: 5024786 - DNA, 14 bp, Homo sapiens
atgagcatgtttag

SEQ ID NO: 5024787 - DNA, 19 bp, Homo sapiens
atgaggactctattcttta

SEQ ID NO: 5024788 - DNA, 23 bp, Homo sapiens
atgatgtatgttgaagcctttgt

SEQ ID NO: 5024789 - DNA, 16 bp, Homo sapiens
atgcaaactctttggt

SEQ ID NO: 5024790 - DNA, 12 bp, Homo sapiens
atgcactttgct

SEQ ID NO: 5024791 - DNA, 16 bp, Homo sapiens
atgcagctgctcccca

SEQ ID NO: 5024792 - DNA, 14 bp, Homo sapiens
atgcaggaggtgga

SEQ ID NO: 5024793 - DNA, 22 bp, Homo sapiens
atgcaggaggtggagaaaattg

SEQ ID NO: 5024794 - DNA, 14 bp, Homo sapiens
atgccaagttgttt

SEQ ID NO: 5024795 - DNA, 16 bp, Homo sapiens
atgccagctacttcct

SEQ ID NO: 5024796 - DNA, 16 bp, Homo sapiens
atgccttttttgtagt

SEQ ID NO: 5024797 - DNA, 22 bp, Homo sapiens
atgctgctctcagcctcccaca

SEQ ID NO: 5024798 - DNA, 22 bp, Homo sapiens
atgctgtttgtagtgaaataat

SEQ ID NO: 5024799 - DNA, 19 bp, Homo sapiens
atgcttctaagtaaataca

SEQ ID NO: 5024800 - DNA, 15 bp, Homo sapiens
atggaaatttaaagc

SEQ ID NO: 5024801 - DNA, 22 bp, Homo sapiens
atggagccccaccttgtctgct

SEQ ID NO: 5024802 - DNA, 12 bp, Homo sapiens
atggagtgctgt

SEQ ID NO: 5024803 - DNA, 13 bp, Homo sapiens
atggagtgctgtt

SEQ ID NO: 5024804 - DNA, 19 bp, Homo sapiens
atggcatttggtctcaggc

SEQ ID NO: 5024805 - DNA, 11 bp, Homo sapiens
atggcccctct

SEQ ID NO: 5024806 - DNA, 13 bp, Homo sapiens
atggcgtctgctc

SEQ ID NO: 5024807 - DNA, 15 bp, Homo sapiens
atggcgtctgctctg

SEQ ID NO: 5024808 - DNA, 15 bp, Homo sapiens
atgggactggcctct

SEQ ID NO: 5024809 - DNA, 14 bp, Homo sapiens
atgggcccctggcc

SEQ ID NO: 5024810 - DNA, 22 bp, Homo sapiens
atggggagacagttgagagcgg

SEQ ID NO: 5024811 - DNA, 14 bp, Homo sapiens
atgggggtaaagtt

SEQ ID NO: 5024812 - DNA, 16 bp, Homo sapiens
atgggtgcaaggaaaa

SEQ ID NO: 5024813 - DNA, 16 bp, Homo sapiens
atggtaggggagggca

SEQ ID NO: 5024814 - DNA, 17 bp, Homo sapiens
atggtagttttttcatc

SEQ ID NO: 5024815 - DNA, 16 bp, Homo sapiens
atgtaatggcagttat

SEQ ID NO: 5024816 - DNA, 17 bp, Homo sapiens
atgtaatggcagttata

SEQ ID NO: 5024817 - DNA, 21 bp, Homo sapiens
atgtaatttcaggaggaatac

SEQ ID NO: 5024818 - DNA, 21 bp, Homo sapiens
atgtactagttttagttttct

SEQ ID NO: 5024819 - DNA, 19 bp, Homo sapiens
atgtacttgtttctctgtt

SEQ ID NO: 5024820 - DNA, 14 bp, Homo sapiens
atgtatagtgtcta

SEQ ID NO: 5024821 - DNA, 15 bp, Homo sapiens
atgtattgtgcaatg

SEQ ID NO: 5024822 - DNA, 18 bp, Homo sapiens
atgtattgtgcaatgtgt

SEQ ID NO: 5024823 - DNA, 18 bp, Homo sapiens
atgtattttatgttatat

SEQ ID NO: 5024824 - DNA, 14 bp, Homo sapiens
atgtcgagagctgg

SEQ ID NO: 5024825 - DNA, 13 bp, Homo sapiens
atgtcttcctgga

SEQ ID NO: 5024826 - DNA, 21 bp, Homo sapiens
atgtcttttcccatttatcta

SEQ ID NO: 5024827 - DNA, 21 bp, Homo sapiens
atgtgcagactgattggcctg

SEQ ID NO: 5024828 - DNA, 16 bp, Homo sapiens
atgtggagcagcagcc

SEQ ID NO: 5024829 - DNA, 13 bp, Homo sapiens
atgtggggctgag

SEQ ID NO: 5024830 - DNA, 20 bp, Homo sapiens
atgtgtacaatgtacacact

SEQ ID NO: 5024831 - DNA, 13 bp, Homo sapiens
atgtgtctttaga

SEQ ID NO: 5024832 - DNA, 14 bp, Homo sapiens
atgttatatataaa

SEQ ID NO: 5024833 - DNA, 18 bp, Homo sapiens
atgttatatataaatata

SEQ ID NO: 5024834 - DNA, 19 bp, Homo sapiens
atgttatatataaatatat

SEQ ID NO: 5024835 - DNA, 17 bp, Homo sapiens
atgttatgaacagctgt

SEQ ID NO: 5024836 - DNA, 22 bp, Homo sapiens
atgttatgaacagctgtgtctg

SEQ ID NO: 5024837 - DNA, 17 bp, Homo sapiens
atgttctaacctttaca

SEQ ID NO: 5024838 - DNA, 17 bp, Homo sapiens
atgtttagactttaaca

SEQ ID NO: 5024839 - DNA, 19 bp, Homo sapiens
atgtttagactttaacata

SEQ ID NO: 5024840 - DNA, 14 bp, Homo sapiens
atgtttatctgctt

SEQ ID NO: 5024841 - DNA, 21 bp, Homo sapiens
atgtttcacaccggaaggttt

SEQ ID NO: 5024842 - DNA, 14 bp, Homo sapiens
attaaaccgcatgt

SEQ ID NO: 5024843 - DNA, 15 bp, Homo sapiens
attaaacgattttta

SEQ ID NO: 5024844 - DNA, 22 bp, Homo sapiens
attaaacgatttttaaaatgta

SEQ ID NO: 5024845 - DNA, 17 bp, Homo sapiens
attaaagaaaaaaatgt

SEQ ID NO: 5024846 - DNA, 19 bp, Homo sapiens
attaaagaaaaaaatgtat

SEQ ID NO: 5024847 - DNA, 21 bp, Homo sapiens
attaaagaaaaaaatgtattt

SEQ ID NO: 5024848 - DNA, 16 bp, Homo sapiens
attaaagaagacctga

SEQ ID NO: 5024849 - DNA, 22 bp, Homo sapiens
attaaagaagacctgagaatgt

SEQ ID NO: 5024850 - DNA, 16 bp, Homo sapiens
attaaatgtgtcattg

SEQ ID NO: 5024851 - DNA, 17 bp, Homo sapiens
attaaattttttgttga

SEQ ID NO: 5024852 - DNA, 15 bp, Homo sapiens
attaaggattttatg

SEQ ID NO: 5024853 - DNA, 22 bp, Homo sapiens
attaattgggccagcttttcaa

SEQ ID NO: 5024854 - DNA, 14 bp, Homo sapiens
attaattgtcatta

SEQ ID NO: 5024855 - DNA, 21 bp, Homo sapiens
attacaccaccggccccctcc

SEQ ID NO: 5024856 - DNA, 21 bp, Homo sapiens
attacaggcgtgagccaccaa

SEQ ID NO: 5024857 - DNA, 14 bp, Homo sapiens
attacagtgtttat

SEQ ID NO: 5024858 - DNA, 16 bp, Homo sapiens
attacttgtaaatata

SEQ ID NO: 5024859 - DNA, 17 bp, Homo sapiens
attacttgtaaatataa

SEQ ID NO: 5024860 - DNA, 18 bp, Homo sapiens
attacttgtaaatataaa

SEQ ID NO: 5024861 - DNA, 19 bp, Homo sapiens
attagaatcaaacattttg

SEQ ID NO: 5024862 - DNA, 21 bp, Homo sapiens
attagaatcaaacattttgaa

SEQ ID NO: 5024863 - DNA, 16 bp, Homo sapiens
attagctaattagaaa

SEQ ID NO: 5024864 - DNA, 17 bp, Homo sapiens
attagtattgttgtcct

SEQ ID NO: 5024865 - DNA, 23 bp, Homo sapiens
attatcacattaatctcaaagag

SEQ ID NO: 5024866 - DNA, 20 bp, Homo sapiens
attatcgttttcttaaagtg

SEQ ID NO: 5024867 - DNA, 17 bp, Homo sapiens
attattacttgtaaata

SEQ ID NO: 5024868 - DNA, 20 bp, Homo sapiens
attattacttgtaaatataa

SEQ ID NO: 5024869 - DNA, 23 bp, Homo sapiens
attattacttgtaaatataaaga

SEQ ID NO: 5024870 - DNA, 17 bp, Homo sapiens
attattagaatcaaaca

SEQ ID NO: 5024871 - DNA, 15 bp, Homo sapiens
attattatttgtgtt

SEQ ID NO: 5024872 - DNA, 11 bp, Homo sapiens
attatttaaac

SEQ ID NO: 5024873 - DNA, 12 bp, Homo sapiens
attatttatgta

SEQ ID NO: 5024874 - DNA, 15 bp, Homo sapiens
attatttatgtattg

SEQ ID NO: 5024875 - DNA, 15 bp, Homo sapiens
attatttgtgtttta

SEQ ID NO: 5024876 - DNA, 22 bp, Homo sapiens
attatttgtgttttaatttaaa

SEQ ID NO: 5024877 - DNA, 20 bp, Homo sapiens
attatttttgttagcaaaga

SEQ ID NO: 5024878 - DNA, 18 bp, Homo sapiens
attcaaaatagggtatat

SEQ ID NO: 5024879 - DNA, 16 bp, Homo sapiens
attcaaattgctgctt

SEQ ID NO: 5024880 - DNA, 15 bp, Homo sapiens
attcattagtcatgt

SEQ ID NO: 5024881 - DNA, 15 bp, Homo sapiens
attccaaagctttat

SEQ ID NO: 5024882 - DNA, 18 bp, Homo sapiens
caatagccactaaccttg

SEQ ID NO: 5024883 - DNA, 16 bp, Homo sapiens
caatagttttttactt

SEQ ID NO: 5024884 - DNA, 21 bp, Homo sapiens
caatagttttttacttctctt

SEQ ID NO: 5024885 - DNA, 17 bp, Homo sapiens
caatctactcaaagcat

SEQ ID NO: 5024886 - DNA, 16 bp, Homo sapiens
caatctggaagaaaaa

SEQ ID NO: 5024887 - DNA, 17 bp, Homo sapiens
caatctggaagaaaaaa

SEQ ID NO: 5024888 - DNA, 21 bp, Homo sapiens
caatgaagccagctcacagtg

SEQ ID NO: 5024889 - DNA, 14 bp, Homo sapiens
caatgagcatgttt

SEQ ID NO: 5024890 - DNA, 21 bp, Homo sapiens
caatgtcatatactgccatgt

SEQ ID NO: 5024891 - DNA, 15 bp, Homo sapiens
caatgtgcagactga

SEQ ID NO: 5024892 - DNA, 18 bp, Homo sapiens
caatgtggagcagcagcc

SEQ ID NO: 5024893 - DNA, 16 bp, Homo sapiens
caatgtgtataaacaa

SEQ ID NO: 5024894 - DNA, 23 bp, Homo sapiens
caatgtgtataaacaagaaaaat

SEQ ID NO: 5024895 - DNA, 17 bp, Homo sapiens
caattaaaccgcatgtg

SEQ ID NO: 5024896 - DNA, 20 bp, Homo sapiens
caattaaggattttatgctt

SEQ ID NO: 5024897 - DNA, 21 bp, Homo sapiens
caattaaggattttatgcttt

SEQ ID NO: 5024898 - DNA, 19 bp, Homo sapiens
caatttggcaattttgtgg

SEQ ID NO: 5024899 - DNA, 22 bp, Homo sapiens
caatttggtaaaaatgctgctc

SEQ ID NO: 5024900 - DNA, 17 bp, Homo sapiens
caattttttttattagt

SEQ ID NO: 5024901 - DNA, 17 bp, Homo sapiens
cacaaaccttctgcctt

SEQ ID NO: 5024902 - DNA, 23 bp, Homo sapiens
cacaactcactccttttaaagaa

SEQ ID NO: 5024903 - DNA, 17 bp, Homo sapiens
cacaagattggtgtttt

SEQ ID NO: 5024904 - DNA, 9 bp, Homo sapiens
cacacacac

SEQ ID NO: 5024905 - DNA, 10 bp, Homo sapiens
cacacacaca

SEQ ID NO: 5024906 - DNA, 13 bp, Homo sapiens
cacacacacacaa

SEQ ID NO: 5024907 - DNA, 14 bp, Homo sapiens
cacacacacacaaa

SEQ ID NO: 5024908 - DNA, 18 bp, Homo sapiens
cacacagatacacacaca

SEQ ID NO: 5024909 - DNA, 14 bp, Homo sapiens
cacacaggacagcg

SEQ ID NO: 5024910 - DNA, 15 bp, Homo sapiens
cacacctgggcattt

SEQ ID NO: 5024911 - DNA, 18 bp, Homo sapiens
cacacgcactgcgcctgt

SEQ ID NO: 5024912 - DNA, 16 bp, Homo sapiens
cacactaccgaatgtg

SEQ ID NO: 5024913 - DNA, 22 bp, Homo sapiens
cacactaccgaatgtgtcttta

SEQ ID NO: 5024914 - DNA, 14 bp, Homo sapiens
cacactccagctgg

SEQ ID NO: 5024915 - DNA, 20 bp, Homo sapiens
cacactgggtgcgtctccag

SEQ ID NO: 5024916 - DNA, 16 bp, Homo sapiens
cacactggtacttaga

SEQ ID NO: 5024917 - DNA, 13 bp, Homo sapiens
cacacttcaaact

SEQ ID NO: 5024918 - DNA, 16 bp, Homo sapiens
cacagagtataaataa

SEQ ID NO: 5024919 - DNA, 18 bp, Homo sapiens
cacagcaattcctcaggc

SEQ ID NO: 5024920 - DNA, 14 bp, Homo sapiens
cacagcacaaatta

SEQ ID NO: 5024921 - DNA, 16 bp, Homo sapiens
cacagcacaaattagt

SEQ ID NO: 5024922 - DNA, 20 bp, Homo sapiens
cacagccactaaaacacaaa

SEQ ID NO: 5024923 - DNA, 19 bp, Homo sapiens
cacagcgtcctgtccacac

SEQ ID NO: 5024924 - DNA, 20 bp, Homo sapiens
cacagctacttggtttgtgt

SEQ ID NO: 5024925 - DNA, 15 bp, Homo sapiens
cacaggacagcggga

SEQ ID NO: 5024926 - DNA, 22 bp, Homo sapiens
cacaggcccccttgagtggggt

SEQ ID NO: 5024927 - DNA, 15 bp, Homo sapiens
cacagtattgctcac

SEQ ID NO: 5024928 - DNA, 13 bp, Homo sapiens
cacagtggccacg

SEQ ID NO: 5024929 - DNA, 23 bp, Homo sapiens
cacagttttggttgctttaatat

SEQ ID NO: 5024930 - DNA, 21 bp, Homo sapiens
cacatcttggctatgtaattc

SEQ ID NO: 5024931 - DNA, 22 bp, Homo sapiens
cacatgaattattacagtgttt

SEQ ID NO: 5024932 - DNA, 17 bp, Homo sapiens
cacattaatctcaaaga

SEQ ID NO: 5024933 - DNA, 19 bp, Homo sapiens
cacattaatctcaaagaga

SEQ ID NO: 5024934 - DNA, 19 bp, Homo sapiens
cacattgtttgctgctatt

SEQ ID NO: 5024935 - DNA, 14 bp, Homo sapiens
caccaaagacatca

SEQ ID NO: 5024936 - DNA, 23 bp, Homo sapiens
caccaatttggtaaaaatgctgc

SEQ ID NO: 5024937 - DNA, 18 bp, Homo sapiens
caccaccacggtggtcac

SEQ ID NO: 5024938 - DNA, 13 bp, Homo sapiens
caccagagctgcc

SEQ ID NO: 5024939 - DNA, 16 bp, Homo sapiens
caccaggactggctgt

SEQ ID NO: 5024940 - DNA, 17 bp, Homo sapiens
cacccaagcctgctggc

SEQ ID NO: 5024941 - DNA, 18 bp, Homo sapiens
cacccaagcctgctggct

SEQ ID NO: 5024942 - DNA, 20 bp, Homo sapiens
cacccaagcctgctggctgc

SEQ ID NO: 5024943 - DNA, 24 bp, Homo sapiens
cacccacccgccgcctcccacggc

SEQ ID NO: 5024944 - DNA, 16 bp, Homo sapiens
cacccagtgccctctc

SEQ ID NO: 5024945 - DNA, 17 bp, Homo sapiens
cacccatgcagctgctc

SEQ ID NO: 5024946 - DNA, 10 bp, Homo sapiens
caccccaccc

SEQ ID NO: 5024947 - DNA, 23 bp, Homo sapiens
caccccgctgatggagccccacc

SEQ ID NO: 5024948 - DNA, 13 bp, Homo sapiens
cacccctctgtct

SEQ ID NO: 5024949 - DNA, 22 bp, Homo sapiens
cacccctctgtctaggactgca

SEQ ID NO: 5024950 - DNA, 17 bp, Homo sapiens
cacccgtggggtgctgc

SEQ ID NO: 5024951 - DNA, 18 bp, Homo sapiens
cacccgtggggtgctgcc

SEQ ID NO: 5024952 - DNA, 17 bp, Homo sapiens
caccctgataggaagag

SEQ ID NO: 5024953 - DNA, 20 bp, Homo sapiens
caccctgcctctacccaacc

SEQ ID NO: 5024954 - DNA, 21 bp, Homo sapiens
caccctgcctctacccaacca

SEQ ID NO: 5024955 - DNA, 12 bp, Homo sapiens
caccgagtgggg

SEQ ID NO: 5024956 - DNA, 21 bp, Homo sapiens
caccgcggcgcttcccagcac

SEQ ID NO: 5024957 - DNA, 19 bp, Homo sapiens
caccggaggtcactccacc

SEQ ID NO: 5024958 - DNA, 14 bp, Homo sapiens
caccgttcattcag

SEQ ID NO: 5024959 - DNA, 15 bp, Homo sapiens
cacctaactcttctt

SEQ ID NO: 5024960 - DNA, 17 bp, Homo sapiens
cacctaagtctctgtga

SEQ ID NO: 5024961 - DNA, 14 bp, Homo sapiens
cacctagctgaatg

SEQ ID NO: 5024962 - DNA, 18 bp, Homo sapiens
cacctagctgaatgtttt

SEQ ID NO: 5024963 - DNA, 19 bp, Homo sapiens
cacctagctgaatgttttt

SEQ ID NO: 5024964 - DNA, 21 bp, Homo sapiens
cacctagctgaatgtttttct

SEQ ID NO: 5024965 - DNA, 22 bp, Homo sapiens
cacctagctgaatgtttttcta

SEQ ID NO: 5024966 - DNA, 14 bp, Homo sapiens
cacctcctcatgta

SEQ ID NO: 5024967 - DNA, 15 bp, Homo sapiens
cacctcggggacacc

SEQ ID NO: 5024968 - DNA, 19 bp, Homo sapiens
cacctgtaggcagaggctg

SEQ ID NO: 5024969 - DNA, 16 bp, Homo sapiens
cacctgttttctgaaa

SEQ ID NO: 5024970 - DNA, 20 bp, Homo sapiens
cacctgttttctgaaacaca

SEQ ID NO: 5024971 - DNA, 14 bp, Homo sapiens
cacgagcaaaccca

SEQ ID NO: 5024972 - DNA, 20 bp, Homo sapiens
cacgagcaaacccagaggtg

SEQ ID NO: 5024973 - DNA, 18 bp, Homo sapiens
cacgggcctgtccacagg

SEQ ID NO: 5024974 - DNA, 20 bp, Homo sapiens
cacggtgactctgtccagct

SEQ ID NO: 5024975 - DNA, 20 bp, Homo sapiens
cactaccgaatgtgtcttta

SEQ ID NO: 5024976 - DNA, 14 bp, Homo sapiens
cactaggcttctgg

SEQ ID NO: 5024977 - DNA, 22 bp, Homo sapiens
cactccctcctggagctctgtg

SEQ ID NO: 5024978 - DNA, 15 bp, Homo sapiens
cactccttttaaaga

SEQ ID NO: 5024979 - DNA, 13 bp, Homo sapiens
cactctgcctgcc

SEQ ID NO: 5024980 - DNA, 20 bp, Homo sapiens
cactctgtaattgcaaaaaa

SEQ ID NO: 5024981 - DNA, 14 bp, Homo sapiens
cactgccccccgag

SEQ ID NO: 5024982 - DNA, 19 bp, Homo sapiens
cactgccccccgaggctgc

SEQ ID NO: 5024983 - DNA, 20 bp, Homo sapiens
cactgccccccgaggctgct

SEQ ID NO: 5024984 - DNA, 19 bp, Homo sapiens
cactgcctgctcccatcct

SEQ ID NO: 5024985 - DNA, 20 bp, Homo sapiens
cactgcctgctcccatcctg

SEQ ID NO: 5024986 - DNA, 21 bp, Homo sapiens
cactggggagcccgtctcagt

SEQ ID NO: 5024987 - DNA, 18 bp, Homo sapiens
cactgggtgcgtctccag

SEQ ID NO: 5024988 - DNA, 19 bp, Homo sapiens
cactgggtgcgtctccagt

SEQ ID NO: 5024989 - DNA, 17 bp, Homo sapiens
cactgtgggaaggccag

SEQ ID NO: 5024990 - DNA, 20 bp, Homo sapiens
cactgtgggaaggccagctg

SEQ ID NO: 5024991 - DNA, 21 bp, Homo sapiens
cactgttcttagctcaatgag

SEQ ID NO: 5024992 - DNA, 23 bp, Homo sapiens
cactgttcttagctcaatgagca

SEQ ID NO: 5024993 - DNA, 14 bp, Homo sapiens
cacttacatttaca

SEQ ID NO: 5024994 - DNA, 17 bp, Homo sapiens
cagggccatgcagacct

SEQ ID NO: 5024995 - DNA, 18 bp, Homo sapiens
cagggccatgcagacctc

SEQ ID NO: 5024996 - DNA, 19 bp, Homo sapiens
caggggagaggcattgcct

SEQ ID NO: 5024997 - DNA, 20 bp, Homo sapiens
caggtagtattacaccaccg

SEQ ID NO: 5024998 - DNA, 16 bp, Homo sapiens
caggtgccgccagctg

SEQ ID NO: 5024999 - DNA, 14 bp, Homo sapiens
caggtgctcccctg

SEQ ID NO: 5025000 - DNA, 18 bp, Homo sapiens
caggttcttgttggtgca

SEQ ID NO: 5025001 - DNA, 14 bp, Homo sapiens
cagtaccctctcag

SEQ ID NO: 5025002 - DNA, 22 bp, Homo sapiens
cagtaccctctcagctccaggt

SEQ ID NO: 5025003 - DNA, 15 bp, Homo sapiens
cagtagttttcaaaa

SEQ ID NO: 5025004 - DNA, 21 bp, Homo sapiens
cagtatgaaaatcagcatgcc

SEQ ID NO: 5025005 - DNA, 20 bp, Homo sapiens
cagtatgggggttgtaaatt

SEQ ID NO: 5025006 - DNA, 23 bp, Homo sapiens
cagtatgggggttgtaaattggc

SEQ ID NO: 5025007 - DNA, 15 bp, Homo sapiens
cagtattgaagcatt

SEQ ID NO: 5025008 - DNA, 16 bp, Homo sapiens
cagtattgaagcattt

SEQ ID NO: 5025009 - DNA, 15 bp, Homo sapiens
cagtattgctcaccc

SEQ ID NO: 5025010 - DNA, 20 bp, Homo sapiens
cagtcatggtggccacggcc

SEQ ID NO: 5025011 - DNA, 13 bp, Homo sapiens
cagtccccgagga

SEQ ID NO: 5025012 - DNA, 21 bp, Homo sapiens
cagtctacattgagcatttga

SEQ ID NO: 5025013 - DNA, 20 bp, Homo sapiens
cagtgaacattcccagccca

SEQ ID NO: 5025014 - DNA, 15 bp, Homo sapiens
cagtgaagactatga

SEQ ID NO: 5025015 - DNA, 14 bp, Homo sapiens
cagtgacaaaccat

SEQ ID NO: 5025016 - DNA, 17 bp, Homo sapiens
cagtgcatatgcaatgt

SEQ ID NO: 5025017 - DNA, 12 bp, Homo sapiens
cagtgccaccca

SEQ ID NO: 5025018 - DNA, 14 bp, Homo sapiens
cagtgccacccatg

SEQ ID NO: 5025019 - DNA, 20 bp, Homo sapiens
cagtgccacccatgcagctg

SEQ ID NO: 5025020 - DNA, 17 bp, Homo sapiens
cagtgccactgcccccc

SEQ ID NO: 5025021 - DNA, 15 bp, Homo sapiens
cagtggaggtttgtc

SEQ ID NO: 5025022 - DNA, 14 bp, Homo sapiens
cagtggccacggcc

SEQ ID NO: 5025023 - DNA, 19 bp, Homo sapiens
cagtggcgttgttgcatgt

SEQ ID NO: 5025024 - DNA, 19 bp, Homo sapiens
cagtgtctttttttgtata

SEQ ID NO: 5025025 - DNA, 21 bp, Homo sapiens
cagtgtctttttttgtatagt

SEQ ID NO: 5025026 - DNA, 14 bp, Homo sapiens
cagtgtgcccatct

SEQ ID NO: 5025027 - DNA, 18 bp, Homo sapiens
cagtgtttatcctttcat

SEQ ID NO: 5025028 - DNA, 14 bp, Homo sapiens
cagttaagcctttg

SEQ ID NO: 5025029 - DNA, 20 bp, Homo sapiens
cagttaagcctttggaaaca

SEQ ID NO: 5025030 - DNA, 16 bp, Homo sapiens
cagttatattttgcag

SEQ ID NO: 5025031 - DNA, 15 bp, Homo sapiens
cagttcattgcactt

SEQ ID NO: 5025032 - DNA, 19 bp, Homo sapiens
cagttcccacattaaagaa

SEQ ID NO: 5025033 - DNA, 19 bp, Homo sapiens
cagttcctgagaccagcca

SEQ ID NO: 5025034 - DNA, 16 bp, Homo sapiens
cagttggccagagagc

SEQ ID NO: 5025035 - DNA, 14 bp, Homo sapiens
cagttgtctctgat

SEQ ID NO: 5025036 - DNA, 22 bp, Homo sapiens
cagttgtctctgatgcagctta

SEQ ID NO: 5025037 - DNA, 18 bp, Homo sapiens
cagtttatttttaaagat

SEQ ID NO: 5025038 - DNA, 20 bp, Homo sapiens
cagtttgtggcatcttgcca

SEQ ID NO: 5025039 - DNA, 19 bp, Homo sapiens
cagttttttttttcttgtc

SEQ ID NO: 5025040 - DNA, 22 bp, Homo sapiens
cataacccaaggtaccatccta

SEQ ID NO: 5025041 - DNA, 17 bp, Homo sapiens
cataaggaaactgggtt

SEQ ID NO: 5025042 - DNA, 21 bp, Homo sapiens
cataaggccagtatgatttat

SEQ ID NO: 5025043 - DNA, 18 bp, Homo sapiens
cataatgctaatttaaag

SEQ ID NO: 5025044 - DNA, 17 bp, Homo sapiens
catacaacagaaaccag

SEQ ID NO: 5025045 - DNA, 23 bp, Homo sapiens
catactgattgggaggtgcgtgt

SEQ ID NO: 5025046 - DNA, 15 bp, Homo sapiens
catatttgcatatgt

SEQ ID NO: 5025047 - DNA, 19 bp, Homo sapiens
catatttgcatatgtatga

SEQ ID NO: 5025048 - DNA, 20 bp, Homo sapiens
catcaaggacacgggcctgt

SEQ ID NO: 5025049 - DNA, 16 bp, Homo sapiens
catcagtattgaagca

SEQ ID NO: 5025050 - DNA, 20 bp, Homo sapiens
catcagtattgaagcatttt

SEQ ID NO: 5025051 - DNA, 21 bp, Homo sapiens
catcatggaaagactgggaca

SEQ ID NO: 5025052 - DNA, 12 bp, Homo sapiens
catcatttcact

SEQ ID NO: 5025053 - DNA, 15 bp, Homo sapiens
catcatttcacttgt

SEQ ID NO: 5025054 - DNA, 17 bp, Homo sapiens
catccaaaatcttgatc

SEQ ID NO: 5025055 - DNA, 12 bp, Homo sapiens
catccaccccat

SEQ ID NO: 5025056 - DNA, 18 bp, Homo sapiens
catccagcgagagagttt

SEQ ID NO: 5025057 - DNA, 19 bp, Homo sapiens
catccagtgacaaaccatc

SEQ ID NO: 5025058 - DNA, 14 bp, Homo sapiens
catccccaccccac

SEQ ID NO: 5025059 - DNA, 14 bp, Homo sapiens
catcccgtgttctc

SEQ ID NO: 5025060 - DNA, 17 bp, Homo sapiens
catcccgtgttctcctt

SEQ ID NO: 5025061 - DNA, 14 bp, Homo sapiens
catccctccccagt

SEQ ID NO: 5025062 - DNA, 17 bp, Homo sapiens
catcctaggctgacacc

SEQ ID NO: 5025063 - DNA, 12 bp, Homo sapiens
catcctggctgc

SEQ ID NO: 5025064 - DNA, 15 bp, Homo sapiens
catcctttacgtgtt

SEQ ID NO: 5025065 - DNA, 20 bp, Homo sapiens
catcgcaatagttttttact

SEQ ID NO: 5025066 - DNA, 21 bp, Homo sapiens
catctccgtctcccaaagtgc

SEQ ID NO: 5025067 - DNA, 10 bp, Homo sapiens
catctgctcc

SEQ ID NO: 5025068 - DNA, 17 bp, Homo sapiens
catctgtaagagcttgc

SEQ ID NO: 5025069 - DNA, 13 bp, Homo sapiens
catcttctgcctt

SEQ ID NO: 5025070 - DNA, 17 bp, Homo sapiens
catcttctgccttagtc

SEQ ID NO: 5025071 - DNA, 17 bp, Homo sapiens
catgaattattacagtg

SEQ ID NO: 5025072 - DNA, 21 bp, Homo sapiens
catgaggactctattctttaa

SEQ ID NO: 5025073 - DNA, 14 bp, Homo sapiens
catgcaaactcttt

SEQ ID NO: 5025074 - DNA, 16 bp, Homo sapiens
catgcaccctcataca

SEQ ID NO: 5025075 - DNA, 16 bp, Homo sapiens
catgcagacctcatgc

SEQ ID NO: 5025076 - DNA, 23 bp, Homo sapiens
catgcagctgctccccaggccac

SEQ ID NO: 5025077 - DNA, 24 bp, Homo sapiens
catgcagctgctccccaggccacc

SEQ ID NO: 5025078 - DNA, 11 bp, Homo sapiens
catgcaggagg

SEQ ID NO: 5025079 - DNA, 15 bp, Homo sapiens
catgcccagctctct

SEQ ID NO: 5025080 - DNA, 17 bp, Homo sapiens
catgcccagctctctga

SEQ ID NO: 5025081 - DNA, 19 bp, Homo sapiens
catgcccagctctctgacg

SEQ ID NO: 5025082 - DNA, 13 bp, Homo sapiens
catgccctgtgtg

SEQ ID NO: 5025083 - DNA, 19 bp, Homo sapiens
catggaaatttaaagcagg

SEQ ID NO: 5025084 - DNA, 21 bp, Homo sapiens
catggaaatttaaagcaggtt

SEQ ID NO: 5025085 - DNA, 21 bp, Homo sapiens
catggaaggggcttctggacc

SEQ ID NO: 5025086 - DNA, 16 bp, Homo sapiens
catgggattattagaa

SEQ ID NO: 5025087 - DNA, 15 bp, Homo sapiens
catggtgagcctagc

SEQ ID NO: 5025088 - DNA, 19 bp, Homo sapiens
catggtgagcctagccctg

SEQ ID NO: 5025089 - DNA, 22 bp, Homo sapiens
catggtggacccagcgggcagg

SEQ ID NO: 5025090 - DNA, 22 bp, Homo sapiens
catgtactagttttagttttct

SEQ ID NO: 5025091 - DNA, 21 bp, Homo sapiens
catgtacttgtttgcaagcag

SEQ ID NO: 5025092 - DNA, 17 bp, Homo sapiens
catgtcccacccacccg

SEQ ID NO: 5025093 - DNA, 19 bp, Homo sapiens
catgtcctttgcgcctgtg

SEQ ID NO: 5025094 - DNA, 14 bp, Homo sapiens
catgtctcgactca

SEQ ID NO: 5025095 - DNA, 20 bp, Homo sapiens
catgtgattaccctctgggt

SEQ ID NO: 5025096 - DNA, 20 bp, Homo sapiens
catgtggccatggcctctgc

SEQ ID NO: 5025097 - DNA, 23 bp, Homo sapiens
catgtggtggcacaggccccctt

SEQ ID NO: 5025098 - DNA, 21 bp, Homo sapiens
catgtgtcctggttcccgttt

SEQ ID NO: 5025099 - DNA, 19 bp, Homo sapiens
catgtttagactttaacat

SEQ ID NO: 5025100 - DNA, 14 bp, Homo sapiens
catgtttccagcag

SEQ ID NO: 5025101 - DNA, 17 bp, Homo sapiens
cattaaacgtcattcag

SEQ ID NO: 5025102 - DNA, 11 bp, Homo sapiens
cattaaagaag

SEQ ID NO: 5025103 - DNA, 15 bp, Homo sapiens
cattaaagaagacct

SEQ ID NO: 5025104 - DNA, 13 bp, Homo sapiens
cattaacacaaag

SEQ ID NO: 5025105 - DNA, 14 bp, Homo sapiens
cattaataataaat

SEQ ID NO: 5025106 - DNA, 16 bp, Homo sapiens
cattaatctcaaagag

SEQ ID NO: 5025107 - DNA, 15 bp, Homo sapiens
ccctccccccagact

SEQ ID NO: 5025108 - DNA, 19 bp, Homo sapiens
ccctcctctagctgtgggg

SEQ ID NO: 5025109 - DNA, 11 bp, Homo sapiens
ccctctcagaa

SEQ ID NO: 5025110 - DNA, 17 bp, Homo sapiens
ccctctcagctccaggt

SEQ ID NO: 5025111 - DNA, 23 bp, Homo sapiens
ccctctccaactgcctaaggccc

SEQ ID NO: 5025112 - DNA, 15 bp, Homo sapiens
ccctctgctgctgtc

SEQ ID NO: 5025113 - DNA, 21 bp, Homo sapiens
ccctctggaggggtgtggctc

SEQ ID NO: 5025114 - DNA, 15 bp, Homo sapiens
ccctctgtcatcctc

SEQ ID NO: 5025115 - DNA, 19 bp, Homo sapiens
ccctctttggctcccctgt

SEQ ID NO: 5025116 - DNA, 20 bp, Homo sapiens
ccctgacagtccctcctctc

SEQ ID NO: 5025117 - DNA, 22 bp, Homo sapiens
ccctgcacaggcacacagggcc

SEQ ID NO: 5025118 - DNA, 18 bp, Homo sapiens
ccctgccaagactcctca

SEQ ID NO: 5025119 - DNA, 12 bp, Homo sapiens
ccctgcccccca

SEQ ID NO: 5025120 - DNA, 18 bp, Homo sapiens
ccctgcgggcgcgggcag

SEQ ID NO: 5025121 - DNA, 24 bp, Homo sapiens
ccctgcgggcgcgggcagccaccc

SEQ ID NO: 5025122 - DNA, 19 bp, Homo sapiens
ccctgctgtctctctgggc

SEQ ID NO: 5025123 - DNA, 22 bp, Homo sapiens
ccctgctgtctctctgggctgc

SEQ ID NO: 5025124 - DNA, 21 bp, Homo sapiens
ccctggaaggacatccatgtt

SEQ ID NO: 5025125 - DNA, 15 bp, Homo sapiens
ccctggccgccccct

SEQ ID NO: 5025126 - DNA, 15 bp, Homo sapiens
ccctggctgaaggac

SEQ ID NO: 5025127 - DNA, 18 bp, Homo sapiens
ccctggctgaaggactgt

SEQ ID NO: 5025128 - DNA, 19 bp, Homo sapiens
ccctggctgaaggactgtg

SEQ ID NO: 5025129 - DNA, 15 bp, Homo sapiens
ccctggtcctggcct

SEQ ID NO: 5025130 - DNA, 23 bp, Homo sapiens
ccctggtcctggcctccttcccc

SEQ ID NO: 5025131 - DNA, 18 bp, Homo sapiens
ccctgtacacaactcact

SEQ ID NO: 5025132 - DNA, 14 bp, Homo sapiens
ccctgtcctggtgg

SEQ ID NO: 5025133 - DNA, 19 bp, Homo sapiens
cccttcagtaccctctcag

SEQ ID NO: 5025134 - DNA, 14 bp, Homo sapiens
cccttcctctttgg

SEQ ID NO: 5025135 - DNA, 15 bp, Homo sapiens
cccttcctctttggt

SEQ ID NO: 5025136 - DNA, 19 bp, Homo sapiens
cccttgatttaaacacaca

SEQ ID NO: 5025137 - DNA, 19 bp, Homo sapiens
cccttgccatccattctgg

SEQ ID NO: 5025138 - DNA, 16 bp, Homo sapiens
cccttttccagcctca

SEQ ID NO: 5025139 - DNA, 14 bp, Homo sapiens
ccgaatgtgtcttt

SEQ ID NO: 5025140 - DNA, 13 bp, Homo sapiens
ccgagaagaacag

SEQ ID NO: 5025141 - DNA, 16 bp, Homo sapiens
ccgagcctggctccaa

SEQ ID NO: 5025142 - DNA, 14 bp, Homo sapiens
ccgcactctgcccc

SEQ ID NO: 5025143 - DNA, 14 bp, Homo sapiens
ccgcagggccatgc

SEQ ID NO: 5025144 - DNA, 20 bp, Homo sapiens
ccgcagggccatgcagacct

SEQ ID NO: 5025145 - DNA, 15 bp, Homo sapiens
ccgccgcctcccacg

SEQ ID NO: 5025146 - DNA, 18 bp, Homo sapiens
ccgccgcctcccacggca

SEQ ID NO: 5025147 - DNA, 15 bp, Homo sapiens
ccgcctcccacggca

SEQ ID NO: 5025148 - DNA, 13 bp, Homo sapiens
ccgcctgccaccg

SEQ ID NO: 5025149 - DNA, 17 bp, Homo sapiens
ccgctgatggagcccca

SEQ ID NO: 5025150 - DNA, 16 bp, Homo sapiens
ccggaggtcactccac

SEQ ID NO: 5025151 - DNA, 16 bp, Homo sapiens
ccggcccagtgccact

SEQ ID NO: 5025152 - DNA, 13 bp, Homo sapiens
ccggcgccgggca

SEQ ID NO: 5025153 - DNA, 14 bp, Homo sapiens
ccggcttctcggct

SEQ ID NO: 5025154 - DNA, 18 bp, Homo sapiens
ccggtgggaccctgtccg

SEQ ID NO: 5025155 - DNA, 16 bp, Homo sapiens
ccgtctcccaaagtgc

SEQ ID NO: 5025156 - DNA, 21 bp, Homo sapiens
ccgtgcccccgcctgccaccg

SEQ ID NO: 5025157 - DNA, 18 bp, Homo sapiens
ccgtggggtctgcgcttg

SEQ ID NO: 5025158 - DNA, 13 bp, Homo sapiens
ccgttgtgagctg

SEQ ID NO: 5025159 - DNA, 15 bp, Homo sapiens
ccgttgtgagctgga

SEQ ID NO: 5025160 - DNA, 15 bp, Homo sapiens
cctaactcttctttc

SEQ ID NO: 5025161 - DNA, 13 bp, Homo sapiens
cctaagtctctgt

SEQ ID NO: 5025162 - DNA, 14 bp, Homo sapiens
cctaagtctctgtg

SEQ ID NO: 5025163 - DNA, 19 bp, Homo sapiens
cctagactgtaaacctctc

SEQ ID NO: 5025164 - DNA, 15 bp, Homo sapiens
cctagccctgggaca

SEQ ID NO: 5025165 - DNA, 20 bp, Homo sapiens
cctagctgaatgtttttcta

SEQ ID NO: 5025166 - DNA, 21 bp, Homo sapiens
cctagctgaatgtttttctaa

SEQ ID NO: 5025167 - DNA, 22 bp, Homo sapiens
cctagctgaatgtttttctaaa

SEQ ID NO: 5025168 - DNA, 19 bp, Homo sapiens
cctaggcagcctgcaggga

SEQ ID NO: 5025169 - DNA, 18 bp, Homo sapiens
cctcaccgagtgggggca

SEQ ID NO: 5025170 - DNA, 21 bp, Homo sapiens
cctcactaggcttctggttga

SEQ ID NO: 5025171 - DNA, 13 bp, Homo sapiens
cctcatgcccagc

SEQ ID NO: 5025172 - DNA, 14 bp, Homo sapiens
cctcatgcccagct

SEQ ID NO: 5025173 - DNA, 17 bp, Homo sapiens
cctcatgcccagctctc

SEQ ID NO: 5025174 - DNA, 22 bp, Homo sapiens
cctcatggcccctctgacctgc

SEQ ID NO: 5025175 - DNA, 20 bp, Homo sapiens
cctccattctattttagaat

SEQ ID NO: 5025176 - DNA, 14 bp, Homo sapiens
cctcccacggcacc

SEQ ID NO: 5025177 - DNA, 19 bp, Homo sapiens
cctccccacagtgccaccc

SEQ ID NO: 5025178 - DNA, 20 bp, Homo sapiens
cctcctcatcccgtgttctc

SEQ ID NO: 5025179 - DNA, 12 bp, Homo sapiens
cctcctcatgta

SEQ ID NO: 5025180 - DNA, 21 bp, Homo sapiens
cctcctcatgtacataccctg

SEQ ID NO: 5025181 - DNA, 13 bp, Homo sapiens
cctcctccccact

SEQ ID NO: 5025182 - DNA, 14 bp, Homo sapiens
cctcctccccactt

SEQ ID NO: 5025183 - DNA, 19 bp, Homo sapiens
cctcggggacaccagagct

SEQ ID NO: 5025184 - DNA, 13 bp, Homo sapiens
cctcgtttgtgtt

SEQ ID NO: 5025185 - DNA, 13 bp, Homo sapiens
cctctcagctcca

SEQ ID NO: 5025186 - DNA, 15 bp, Homo sapiens
cctctcccctgcctg

SEQ ID NO: 5025187 - DNA, 18 bp, Homo sapiens
cctctcccctgcctgccc

SEQ ID NO: 5025188 - DNA, 15 bp, Homo sapiens
cctctcggccaggca

SEQ ID NO: 5025189 - DNA, 11 bp, Homo sapiens
cctctctctgt

SEQ ID NO: 5025190 - DNA, 17 bp, Homo sapiens
cctctctctgtggggct

SEQ ID NO: 5025191 - DNA, 16 bp, Homo sapiens
cctctgacctgcactg

SEQ ID NO: 5025192 - DNA, 17 bp, Homo sapiens
cctctggaggggtgtgg

SEQ ID NO: 5025193 - DNA, 21 bp, Homo sapiens
cctctggcattagaattattt

SEQ ID NO: 5025194 - DNA, 14 bp, Homo sapiens
cctctgggtctcag

SEQ ID NO: 5025195 - DNA, 20 bp, Homo sapiens
cctctgggtctcagtgtcct

SEQ ID NO: 5025196 - DNA, 21 bp, Homo sapiens
cctctgtctaggactgcagtg

SEQ ID NO: 5025197 - DNA, 22 bp, Homo sapiens
cctctgtctaggactgcagtgt

SEQ ID NO: 5025198 - DNA, 19 bp, Homo sapiens
cctctgttgccaaggctgg

SEQ ID NO: 5025199 - DNA, 15 bp, Homo sapiens
cctcttccagtgaac

SEQ ID NO: 5025200 - DNA, 18 bp, Homo sapiens
cctcttccagtgaacatt

SEQ ID NO: 5025201 - DNA, 19 bp, Homo sapiens
cctctttggctcccctgta

SEQ ID NO: 5025202 - DNA, 18 bp, Homo sapiens
cctgagatgggcttccca

SEQ ID NO: 5025203 - DNA, 14 bp, Homo sapiens
cctgagatttatta

SEQ ID NO: 5025204 - DNA, 15 bp, Homo sapiens
cctgagatttattaa

SEQ ID NO: 5025205 - DNA, 19 bp, Homo sapiens
cctgagatttattaaagaa

SEQ ID NO: 5025206 - DNA, 14 bp, Homo sapiens
cctgagtgcgtgga

SEQ ID NO: 5025207 - DNA, 22 bp, Homo sapiens
cctgatccgtccgaggctgctt

SEQ ID NO: 5025208 - DNA, 18 bp, Homo sapiens
cctgcacacaggacagcg

SEQ ID NO: 5025209 - DNA, 17 bp, Homo sapiens
cctgcacaggcacacag

SEQ ID NO: 5025210 - DNA, 18 bp, Homo sapiens
cctgcactccctcctgga

SEQ ID NO: 5025211 - DNA, 20 bp, Homo sapiens
cctgcactccctcctggagc

SEQ ID NO: 5025212 - DNA, 22 bp, Homo sapiens
cctgccaccggaggtcactcca

SEQ ID NO: 5025213 - DNA, 17 bp, Homo sapiens
cctgccccccagcctct

SEQ ID NO: 5025214 - DNA, 13 bp, Homo sapiens
cctgcctgccacc

SEQ ID NO: 5025215 - DNA, 16 bp, Homo sapiens
cctgcctgccctggtg

SEQ ID NO: 5025216 - DNA, 17 bp, Homo sapiens
cctgcgggcgcgggcag

SEQ ID NO: 5025217 - DNA, 12 bp, Homo sapiens
cctgctggatgt

SEQ ID NO: 5025218 - DNA, 21 bp, Homo sapiens
cctgctggctgcggccccctc

SEQ ID NO: 5025219 - DNA, 16 bp, Homo sapiens
cctgctgtctctctgg

SEQ ID NO: 5025220 - DNA, 22 bp, Homo sapiens
cctggaaggacatccatgttcc

SEQ ID NO: 5025221 - DNA, 14 bp, Homo sapiens
cgtgctctttgttt

SEQ ID NO: 5025222 - DNA, 16 bp, Homo sapiens
cgtgctctttgttttg

SEQ ID NO: 5025223 - DNA, 22 bp, Homo sapiens
cgtggcatttcaattcctggcc

SEQ ID NO: 5025224 - DNA, 20 bp, Homo sapiens
cgtgttcagcagaacctgca

SEQ ID NO: 5025225 - DNA, 18 bp, Homo sapiens
cgttctaggtaggaagag

SEQ ID NO: 5025226 - DNA, 13 bp, Homo sapiens
cgttcttgtaatt

SEQ ID NO: 5025227 - DNA, 12 bp, Homo sapiens
cgttgtgagctg

SEQ ID NO: 5025228 - DNA, 20 bp, Homo sapiens
cgttgttgcatgtttgaaat

SEQ ID NO: 5025229 - DNA, 18 bp, Homo sapiens
cgtttctccacctagact

SEQ ID NO: 5025230 - DNA, 22 bp, Homo sapiens
cgtttctccacctagactgtaa

SEQ ID NO: 5025231 - DNA, 11 bp, Homo sapiens
cgtttgtgttc

SEQ ID NO: 5025232 - DNA, 14 bp, Homo sapiens
cgttttcttaaagt

SEQ ID NO: 5025233 - DNA, 20 bp, Homo sapiens
ctaaaaaaaatgcatattaa

SEQ ID NO: 5025234 - DNA, 22 bp, Homo sapiens
ctaagagtgctgggcattttta

SEQ ID NO: 5025235 - DNA, 14 bp, Homo sapiens
ctaaggctgaactt

SEQ ID NO: 5025236 - DNA, 18 bp, Homo sapiens
ctaagtaaatacaatttt

SEQ ID NO: 5025237 - DNA, 12 bp, Homo sapiens
ctaagtctctgt

SEQ ID NO: 5025238 - DNA, 22 bp, Homo sapiens
ctaataaaaagcttttgtctac

SEQ ID NO: 5025239 - DNA, 15 bp, Homo sapiens
ctaataaactaataa

SEQ ID NO: 5025240 - DNA, 17 bp, Homo sapiens
ctaataaactaataatt

SEQ ID NO: 5025241 - DNA, 18 bp, Homo sapiens
ctaataaactaataattg

SEQ ID NO: 5025242 - DNA, 18 bp, Homo sapiens
ctaatagaaaagtatgtt

SEQ ID NO: 5025243 - DNA, 16 bp, Homo sapiens
ctacatcttctgcctt

SEQ ID NO: 5025244 - DNA, 18 bp, Homo sapiens
ctacattgagcatttgaa

SEQ ID NO: 5025245 - DNA, 19 bp, Homo sapiens
ctaccctttttctccagct

SEQ ID NO: 5025246 - DNA, 18 bp, Homo sapiens
ctaccgaatgtgtcttta

SEQ ID NO: 5025247 - DNA, 14 bp, Homo sapiens
ctactataaagaga

SEQ ID NO: 5025248 - DNA, 17 bp, Homo sapiens
ctactataaagagaaga

SEQ ID NO: 5025249 - DNA, 12 bp, Homo sapiens
ctactctttgat

SEQ ID NO: 5025250 - DNA, 13 bp, Homo sapiens
ctacttcctcctc

SEQ ID NO: 5025251 - DNA, 12 bp, Homo sapiens
ctacttctctgt

SEQ ID NO: 5025252 - DNA, 16 bp, Homo sapiens
ctagcccgaatacaaa

SEQ ID NO: 5025253 - DNA, 14 bp, Homo sapiens
ctagcgcagttttt

SEQ ID NO: 5025254 - DNA, 17 bp, Homo sapiens
ctagctgaatgtttttc

SEQ ID NO: 5025255 - DNA, 20 bp, Homo sapiens
ctagctgaatgtttttctaa

SEQ ID NO: 5025256 - DNA, 22 bp, Homo sapiens
ctaggagggagacactggcccc

SEQ ID NO: 5025257 - DNA, 23 bp, Homo sapiens
ctaggagggagacactggcccct

SEQ ID NO: 5025258 - DNA, 12 bp, Homo sapiens
ctaggcagcctg

SEQ ID NO: 5025259 - DNA, 17 bp, Homo sapiens
ctaggcatctctgtact

SEQ ID NO: 5025260 - DNA, 15 bp, Homo sapiens
ctaggtaggaagagc

SEQ ID NO: 5025261 - DNA, 16 bp, Homo sapiens
ctaggtaggaagagcc

SEQ ID NO: 5025262 - DNA, 12 bp, Homo sapiens
ctagtccttgtt

SEQ ID NO: 5025263 - DNA, 13 bp, Homo sapiens
ctagtcttttgct

SEQ ID NO: 5025264 - DNA, 18 bp, Homo sapiens
ctagtgttctgtttgtta

SEQ ID NO: 5025265 - DNA, 13 bp, Homo sapiens
ctataaagcattt

SEQ ID NO: 5025266 - DNA, 15 bp, Homo sapiens
ctataaagcatttaa

SEQ ID NO: 5025267 - DNA, 14 bp, Homo sapiens
ctatagatgtcttt

SEQ ID NO: 5025268 - DNA, 18 bp, Homo sapiens
ctatgctgtttgtagtga

SEQ ID NO: 5025269 - DNA, 17 bp, Homo sapiens
ctatgtcgagagctggc

SEQ ID NO: 5025270 - DNA, 22 bp, Homo sapiens
ctattctttaactcccattacc

SEQ ID NO: 5025271 - DNA, 21 bp, Homo sapiens
ctattggaggatcagtttttt

SEQ ID NO: 5025272 - DNA, 19 bp, Homo sapiens
ctatttgcttatttaataa

SEQ ID NO: 5025273 - DNA, 19 bp, Homo sapiens
ctcaaatcgtccagcgacc

SEQ ID NO: 5025274 - DNA, 16 bp, Homo sapiens
ctcaacccattgttgt

SEQ ID NO: 5025275 - DNA, 13 bp, Homo sapiens
ctcaactgaaggg

SEQ ID NO: 5025276 - DNA, 23 bp, Homo sapiens
ctcaactgaaggggtgcacccac

SEQ ID NO: 5025277 - DNA, 16 bp, Homo sapiens
ctcaataaatgattct

SEQ ID NO: 5025278 - DNA, 13 bp, Homo sapiens
ctcaatgagcatg

SEQ ID NO: 5025279 - DNA, 14 bp, Homo sapiens
ctcaatgagcatgt

SEQ ID NO: 5025280 - DNA, 15 bp, Homo sapiens
ctcaatgagcatgtt

SEQ ID NO: 5025281 - DNA, 14 bp, Homo sapiens
ctcacccagtgccc

SEQ ID NO: 5025282 - DNA, 20 bp, Homo sapiens
ctcactaggcttctggttga

SEQ ID NO: 5025283 - DNA, 18 bp, Homo sapiens
ctcactccttttaaagaa

SEQ ID NO: 5025284 - DNA, 24 bp, Homo sapiens
ctcactgtgggaaggccagctgcc

SEQ ID NO: 5025285 - DNA, 19 bp, Homo sapiens
ctcagaaggcaaatgactt

SEQ ID NO: 5025286 - DNA, 16 bp, Homo sapiens
ctcagcactgcctgct

SEQ ID NO: 5025287 - DNA, 17 bp, Homo sapiens
ctcagcactgcctgctc

SEQ ID NO: 5025288 - DNA, 16 bp, Homo sapiens
ctcagcccgctgagtg

SEQ ID NO: 5025289 - DNA, 21 bp, Homo sapiens
ctcagcctctcccctgcctgc

SEQ ID NO: 5025290 - DNA, 19 bp, Homo sapiens
ctcagctctggtccaggcc

SEQ ID NO: 5025291 - DNA, 22 bp, Homo sapiens
ctcagctctggtccaggccctg

SEQ ID NO: 5025292 - DNA, 20 bp, Homo sapiens
ctcaggcagcaccacactgg

SEQ ID NO: 5025293 - DNA, 14 bp, Homo sapiens
ctcagtgaagacta

SEQ ID NO: 5025294 - DNA, 22 bp, Homo sapiens
ctcagtttgtgtgtcttaatta

SEQ ID NO: 5025295 - DNA, 19 bp, Homo sapiens
ctcatccaccccatccctc

SEQ ID NO: 5025296 - DNA, 24 bp, Homo sapiens
ctcatccaccccatccctccccag

SEQ ID NO: 5025297 - DNA, 14 bp, Homo sapiens
ctcatgcccagctc

SEQ ID NO: 5025298 - DNA, 14 bp, Homo sapiens
ctcatggcccctct

SEQ ID NO: 5025299 - DNA, 20 bp, Homo sapiens
ctcatggcccctctgacctg

SEQ ID NO: 5025300 - DNA, 21 bp, Homo sapiens
ctcatgttttttccttttcac

SEQ ID NO: 5025301 - DNA, 16 bp, Homo sapiens
ctcattggaaatttag

SEQ ID NO: 5025302 - DNA, 18 bp, Homo sapiens
ctcattggaaatttagca

SEQ ID NO: 5025303 - DNA, 20 bp, Homo sapiens
ctcattggaaatttagcatt

SEQ ID NO: 5025304 - DNA, 17 bp, Homo sapiens
ctcatttgttcattaaa

SEQ ID NO: 5025305 - DNA, 20 bp, Homo sapiens
ctcattttgacaaagtgcct

SEQ ID NO: 5025306 - DNA, 23 bp, Homo sapiens
ctccaaatctcaatgaagccagc

SEQ ID NO: 5025307 - DNA, 19 bp, Homo sapiens
ctccaactgcctaaggccc

SEQ ID NO: 5025308 - DNA, 15 bp, Homo sapiens
ctccaccatccccac

SEQ ID NO: 5025309 - DNA, 17 bp, Homo sapiens
ctccaccatccccaccc

SEQ ID NO: 5025310 - DNA, 15 bp, Homo sapiens
ctccacctagactgt

SEQ ID NO: 5025311 - DNA, 14 bp, Homo sapiens
ctccagattctgat

SEQ ID NO: 5025312 - DNA, 15 bp, Homo sapiens
ctccagattctgatg

SEQ ID NO: 5025313 - DNA, 15 bp, Homo sapiens
ctccagctgggctct

SEQ ID NO: 5025314 - DNA, 22 bp, Homo sapiens
ctccagtcatctgtaagagctt

SEQ ID NO: 5025315 - DNA, 17 bp, Homo sapiens
ctccattctattttaga

SEQ ID NO: 5025316 - DNA, 18 bp, Homo sapiens
ctcccacggcacctcggg

SEQ ID NO: 5025317 - DNA, 13 bp, Homo sapiens
ctcccatcctgtg

SEQ ID NO: 5025318 - DNA, 19 bp, Homo sapiens
ctcccatcctgtgtgttaa

SEQ ID NO: 5025319 - DNA, 17 bp, Homo sapiens
ctccccacagtgccacc

SEQ ID NO: 5025320 - DNA, 14 bp, Homo sapiens
ctccccaggccacc

SEQ ID NO: 5025321 - DNA, 15 bp, Homo sapiens
ctccccaggccaccc

SEQ ID NO: 5025322 - DNA, 14 bp, Homo sapiens
ctccccatgtgtcc

SEQ ID NO: 5025323 - DNA, 15 bp, Homo sapiens
ctccccccagactct

SEQ ID NO: 5025324 - DNA, 16 bp, Homo sapiens
ctccccccagactctt

SEQ ID NO: 5025325 - DNA, 13 bp, Homo sapiens
ctcccctcagcct

SEQ ID NO: 5025326 - DNA, 12 bp, Homo sapiens
ctcccctcctcc

SEQ ID NO: 5025327 - DNA, 20 bp, Homo sapiens
ctcccctcctcctggactcc

SEQ ID NO: 5025328 - DNA, 22 bp, Homo sapiens
ctcccctctcagaacatactga

SEQ ID NO: 5025329 - DNA, 23 bp, Homo sapiens
ctccccttgatttaaacacacag

SEQ ID NO: 5025330 - DNA, 20 bp, Homo sapiens
ctcccggaggttgggtgggc

SEQ ID NO: 5025331 - DNA, 17 bp, Homo sapiens
ctccctattttttttct

SEQ ID NO: 5025332 - DNA, 12 bp, Homo sapiens
ctccctcaactg

SEQ ID NO: 5025333 - DNA, 19 bp, Homo sapiens
ctccctcccctctcagaac

SEQ ID NO: 5025334 - DNA, 19 bp, Homo sapiens
ctgccatgtactagtttta

SEQ ID NO: 5025335 - DNA, 21 bp, Homo sapiens
ctgccccacatgtggccatgg

SEQ ID NO: 5025336 - DNA, 12 bp, Homo sapiens
ctgccccccagc

SEQ ID NO: 5025337 - DNA, 19 bp, Homo sapiens
ctgccccccgaggctgcta

SEQ ID NO: 5025338 - DNA, 22 bp, Homo sapiens
ctgccccttggacacgctcagt

SEQ ID NO: 5025339 - DNA, 12 bp, Homo sapiens
ctgccctcatgg

SEQ ID NO: 5025340 - DNA, 19 bp, Homo sapiens
ctgccctcatggcccctct

SEQ ID NO: 5025341 - DNA, 23 bp, Homo sapiens
ctgccgacttggagactcctggt

SEQ ID NO: 5025342 - DNA, 21 bp, Homo sapiens
ctgccgagacagaccctctgc

SEQ ID NO: 5025343 - DNA, 14 bp, Homo sapiens
ctgccgcaccagcc

SEQ ID NO: 5025344 - DNA, 17 bp, Homo sapiens
ctgccggggcagccccc

SEQ ID NO: 5025345 - DNA, 22 bp, Homo sapiens
ctgccggtgggaccctgtccgg

SEQ ID NO: 5025346 - DNA, 19 bp, Homo sapiens
ctgcctaaggccctttgtg

SEQ ID NO: 5025347 - DNA, 17 bp, Homo sapiens
ctgcctgccaccctgcc

SEQ ID NO: 5025348 - DNA, 15 bp, Homo sapiens
ctgcctgctcccatc

SEQ ID NO: 5025349 - DNA, 13 bp, Homo sapiens
ctgcctgctttgg

SEQ ID NO: 5025350 - DNA, 20 bp, Homo sapiens
ctgcgtgccagtcaagaaga

SEQ ID NO: 5025351 - DNA, 15 bp, Homo sapiens
ctgctaaataaacat

SEQ ID NO: 5025352 - DNA, 21 bp, Homo sapiens
ctgctattaggccagcaagcg

SEQ ID NO: 5025353 - DNA, 17 bp, Homo sapiens
ctgctcagctctggtcc

SEQ ID NO: 5025354 - DNA, 22 bp, Homo sapiens
ctgctcattttgacaaagtgcc

SEQ ID NO: 5025355 - DNA, 21 bp, Homo sapiens
ctgctctattccaaaaaggtt

SEQ ID NO: 5025356 - DNA, 11 bp, Homo sapiens
ctgctgaggcc

SEQ ID NO: 5025357 - DNA, 13 bp, Homo sapiens
ctgctgaggccca

SEQ ID NO: 5025358 - DNA, 14 bp, Homo sapiens
ctgctgctgtccct

SEQ ID NO: 5025359 - DNA, 11 bp, Homo sapiens
ctgctggctgc

SEQ ID NO: 5025360 - DNA, 14 bp, Homo sapiens
ctgctggctgcggc

SEQ ID NO: 5025361 - DNA, 20 bp, Homo sapiens
ctgctgtccctcccccttgt

SEQ ID NO: 5025362 - DNA, 12 bp, Homo sapiens
ctgcttcccaga

SEQ ID NO: 5025363 - DNA, 13 bp, Homo sapiens
ctgcttgtttcct

SEQ ID NO: 5025364 - DNA, 14 bp, Homo sapiens
ctgcttgtttccta

SEQ ID NO: 5025365 - DNA, 21 bp, Homo sapiens
ctggaactcagtgtgactcct

SEQ ID NO: 5025366 - DNA, 20 bp, Homo sapiens
ctggacctagggtggcctga

SEQ ID NO: 5025367 - DNA, 16 bp, Homo sapiens
ctggaggggtgtggct

SEQ ID NO: 5025368 - DNA, 20 bp, Homo sapiens
ctggaggggtgtggctcctt

SEQ ID NO: 5025369 - DNA, 15 bp, Homo sapiens
ctggatgatactaat

SEQ ID NO: 5025370 - DNA, 16 bp, Homo sapiens
ctggatgatactaata

SEQ ID NO: 5025371 - DNA, 22 bp, Homo sapiens
ctggatgatactaataaactaa

SEQ ID NO: 5025372 - DNA, 14 bp, Homo sapiens
ctggcagaggaggg

SEQ ID NO: 5025373 - DNA, 20 bp, Homo sapiens
ctggccaaagagcctttcca

SEQ ID NO: 5025374 - DNA, 21 bp, Homo sapiens
ctggccaaagagcctttccaa

SEQ ID NO: 5025375 - DNA, 14 bp, Homo sapiens
ctggccccgcctgc

SEQ ID NO: 5025376 - DNA, 15 bp, Homo sapiens
ctggccccgcctgcc

SEQ ID NO: 5025377 - DNA, 16 bp, Homo sapiens
ctggccccgcctgcct

SEQ ID NO: 5025378 - DNA, 18 bp, Homo sapiens
ctggccccgcctgcctgc

SEQ ID NO: 5025379 - DNA, 13 bp, Homo sapiens
ctggccgccccct

SEQ ID NO: 5025380 - DNA, 15 bp, Homo sapiens
ctggcctccttcccc

SEQ ID NO: 5025381 - DNA, 14 bp, Homo sapiens
ctggcctttcatat

SEQ ID NO: 5025382 - DNA, 18 bp, Homo sapiens
ctggcggctggggtccca

SEQ ID NO: 5025383 - DNA, 18 bp, Homo sapiens
ctggctatagatgtcttt

SEQ ID NO: 5025384 - DNA, 19 bp, Homo sapiens
ctggctatagatgtctttt

SEQ ID NO: 5025385 - DNA, 16 bp, Homo sapiens
ctggctgaaggactgt

SEQ ID NO: 5025386 - DNA, 20 bp, Homo sapiens
ctggctgtgtaaccttgggt

SEQ ID NO: 5025387 - DNA, 18 bp, Homo sapiens
ctgggaaagcccctgccc

SEQ ID NO: 5025388 - DNA, 15 bp, Homo sapiens
ctgggaatgggagag

SEQ ID NO: 5025389 - DNA, 23 bp, Homo sapiens
ctgggagtagttgtctttcctgg

SEQ ID NO: 5025390 - DNA, 20 bp, Homo sapiens
ctgggatcacatgtggactt

SEQ ID NO: 5025391 - DNA, 15 bp, Homo sapiens
ctgggcaagctggcg

SEQ ID NO: 5025392 - DNA, 16 bp, Homo sapiens
ctgggcccctgcacag

SEQ ID NO: 5025393 - DNA, 21 bp, Homo sapiens
ctgggcctcgtgcgcccgtgg

SEQ ID NO: 5025394 - DNA, 22 bp, Homo sapiens
ctgggcggcgggcggctgggtc

SEQ ID NO: 5025395 - DNA, 22 bp, Homo sapiens
ctgggctctgcaattcccctct

SEQ ID NO: 5025396 - DNA, 17 bp, Homo sapiens
ctgggctgcagagtctg

SEQ ID NO: 5025397 - DNA, 22 bp, Homo sapiens
ctgggctgggtggcccctgtct

SEQ ID NO: 5025398 - DNA, 22 bp, Homo sapiens
ctggggacctggtaccctcctg

SEQ ID NO: 5025399 - DNA, 15 bp, Homo sapiens
ctggggccaaataaa

SEQ ID NO: 5025400 - DNA, 16 bp, Homo sapiens
ctggggctccgaaatt

SEQ ID NO: 5025401 - DNA, 23 bp, Homo sapiens
ctgggggacccctggctctgggc

SEQ ID NO: 5025402 - DNA, 15 bp, Homo sapiens
ctggggtcccagcag

SEQ ID NO: 5025403 - DNA, 20 bp, Homo sapiens
ctggggtcccagcagctgcc

SEQ ID NO: 5025404 - DNA, 16 bp, Homo sapiens
ctgggtctcagtgtcc

SEQ ID NO: 5025405 - DNA, 17 bp, Homo sapiens
ctgggtgcgtctccagt

SEQ ID NO: 5025406 - DNA, 19 bp, Homo sapiens
ctgggtggtaccctctgga

SEQ ID NO: 5025407 - DNA, 23 bp, Homo sapiens
ctggtacagtatgggggttgtaa

SEQ ID NO: 5025408 - DNA, 14 bp, Homo sapiens
ctggtaccctcctg

SEQ ID NO: 5025409 - DNA, 18 bp, Homo sapiens
ctggtagagacccccagg

SEQ ID NO: 5025410 - DNA, 16 bp, Homo sapiens
ctggtagtgtagctgt

SEQ ID NO: 5025411 - DNA, 16 bp, Homo sapiens
ctggtccaggccctgt

SEQ ID NO: 5025412 - DNA, 12 bp, Homo sapiens
ctggtgctgctg

SEQ ID NO: 5025413 - DNA, 16 bp, Homo sapiens
ctggtgtgaactaaac

SEQ ID NO: 5025414 - DNA, 15 bp, Homo sapiens
ctgtaaaaactgtgg

SEQ ID NO: 5025415 - DNA, 19 bp, Homo sapiens
ctgtaaagaaacatttcct

SEQ ID NO: 5025416 - DNA, 12 bp, Homo sapiens
ctgtaagagctt

SEQ ID NO: 5025417 - DNA, 13 bp, Homo sapiens
ctgtaagagcttg

SEQ ID NO: 5025418 - DNA, 20 bp, Homo sapiens
ctgtaagagcttgctccaga

SEQ ID NO: 5025419 - DNA, 14 bp, Homo sapiens
ctgtaattgcaaaa

SEQ ID NO: 5025420 - DNA, 20 bp, Homo sapiens
ctgtacacaactcactcctt

SEQ ID NO: 5025421 - DNA, 17 bp, Homo sapiens
ctgtactgttctgtgtc

SEQ ID NO: 5025422 - DNA, 16 bp, Homo sapiens
ctgtaggcacagagct

SEQ ID NO: 5025423 - DNA, 20 bp, Homo sapiens
ctgtataattaattgtcatt

SEQ ID NO: 5025424 - DNA, 15 bp, Homo sapiens
ctgtccacacccagc

SEQ ID NO: 5025425 - DNA, 17 bp, Homo sapiens
ctgtccacaggcttctg

SEQ ID NO: 5025426 - DNA, 22 bp, Homo sapiens
ctgtccacaggcttctgagcag

SEQ ID NO: 5025427 - DNA, 16 bp, Homo sapiens
ctgtccaccctgccaa

SEQ ID NO: 5025428 - DNA, 23 bp, Homo sapiens
ctgtccaccctgccaagactcct

SEQ ID NO: 5025429 - DNA, 12 bp, Homo sapiens
ctgtccccagcc

SEQ ID NO: 5025430 - DNA, 15 bp, Homo sapiens
ctgtccctccccctt

SEQ ID NO: 5025431 - DNA, 18 bp, Homo sapiens
ctgtccggcccagtgcca

SEQ ID NO: 5025432 - DNA, 12 bp, Homo sapiens
ctgtcctgccta

SEQ ID NO: 5025433 - DNA, 14 bp, Homo sapiens
ctgtcctggtggta

SEQ ID NO: 5025434 - DNA, 21 bp, Homo sapiens
ctgtcctggtggtattttcaa

SEQ ID NO: 5025435 - DNA, 15 bp, Homo sapiens
ctgtctaggactgca

SEQ ID NO: 5025436 - DNA, 19 bp, Homo sapiens
ctgtctaggactgcagtgt

SEQ ID NO: 5025437 - DNA, 15 bp, Homo sapiens
ctgtctctctgggct

SEQ ID NO: 5025438 - DNA, 21 bp, Homo sapiens
ctgtctgaaccacgcgggggc

SEQ ID NO: 5025439 - DNA, 17 bp, Homo sapiens
ctgtctttaaaagagag

SEQ ID NO: 5025440 - DNA, 18 bp, Homo sapiens
ctgtctttaaaagagaga

SEQ ID NO: 5025441 - DNA, 13 bp, Homo sapiens
ctgtgaactgaac

SEQ ID NO: 5025442 - DNA, 16 bp, Homo sapiens
ctgtgaactgaactct

SEQ ID NO: 5025443 - DNA, 21 bp, Homo sapiens
ctgtgaagagccggtggtgcc

SEQ ID NO: 5025444 - DNA, 23 bp, Homo sapiens
ctgtgaagagccggtggtgcccg

SEQ ID NO: 5025445 - DNA, 15 bp, Homo sapiens
ctgtgacaggcagca

SEQ ID NO: 5025446 - DNA, 16 bp, Homo sapiens
ctgtgagcatcacagt

SEQ ID NO: 5025447 - DNA, 14 bp, Homo sapiens
gaatgtgtctttag

SEQ ID NO: 5025448 - DNA, 22 bp, Homo sapiens
gaattacaggcgtgagccacca

SEQ ID NO: 5025449 - DNA, 14 bp, Homo sapiens
gacaaagtgcctca

SEQ ID NO: 5025450 - DNA, 20 bp, Homo sapiens
gacaagtgactgtatctgtg

SEQ ID NO: 5025451 - DNA, 13 bp, Homo sapiens
gacaccagagctg

SEQ ID NO: 5025452 - DNA, 15 bp, Homo sapiens
gacacgggcctgtcc

SEQ ID NO: 5025453 - DNA, 13 bp, Homo sapiens
gacactcagacct

SEQ ID NO: 5025454 - DNA, 13 bp, Homo sapiens
gacactggcccct

SEQ ID NO: 5025455 - DNA, 22 bp, Homo sapiens
gacactgttcttagctcaatga

SEQ ID NO: 5025456 - DNA, 14 bp, Homo sapiens
gacagaccctctgc

SEQ ID NO: 5025457 - DNA, 17 bp, Homo sapiens
gacagaccctctgccgc

SEQ ID NO: 5025458 - DNA, 23 bp, Homo sapiens
gacagagcgtgagctgagcaggc

SEQ ID NO: 5025459 - DNA, 21 bp, Homo sapiens
gacaggagacctggcactgga

SEQ ID NO: 5025460 - DNA, 14 bp, Homo sapiens
gacaggcagcagag

SEQ ID NO: 5025461 - DNA, 11 bp, Homo sapiens
gacagtgcccc

SEQ ID NO: 5025462 - DNA, 18 bp, Homo sapiens
gacagtgccccgggaacc

SEQ ID NO: 5025463 - DNA, 17 bp, Homo sapiens
gacagtgcctcttccag

SEQ ID NO: 5025464 - DNA, 16 bp, Homo sapiens
gacatcaggtttttcc

SEQ ID NO: 5025465 - DNA, 14 bp, Homo sapiens
gacattctgaatgc

SEQ ID NO: 5025466 - DNA, 22 bp, Homo sapiens
gaccacactccagctgggatca

SEQ ID NO: 5025467 - DNA, 20 bp, Homo sapiens
gaccaccccgcctgccctca

SEQ ID NO: 5025468 - DNA, 20 bp, Homo sapiens
gaccccgagcctggctccaa

SEQ ID NO: 5025469 - DNA, 16 bp, Homo sapiens
gacccctggctctggg

SEQ ID NO: 5025470 - DNA, 22 bp, Homo sapiens
gaccctccccacagtgccaccc

SEQ ID NO: 5025471 - DNA, 23 bp, Homo sapiens
gaccctgtccggcccagtgccac

SEQ ID NO: 5025472 - DNA, 15 bp, Homo sapiens
gaccgccccctcctc

SEQ ID NO: 5025473 - DNA, 16 bp, Homo sapiens
gacctcatgcccagct

SEQ ID NO: 5025474 - DNA, 23 bp, Homo sapiens
gacctcatgcccagctctctgac

SEQ ID NO: 5025475 - DNA, 16 bp, Homo sapiens
gacctgagaatgtatc

SEQ ID NO: 5025476 - DNA, 17 bp, Homo sapiens
gacctgagggacccttc

SEQ ID NO: 5025477 - DNA, 18 bp, Homo sapiens
gacctggcactggatgca

SEQ ID NO: 5025478 - DNA, 17 bp, Homo sapiens
gacctggtaccctcctg

SEQ ID NO: 5025479 - DNA, 19 bp, Homo sapiens
gacctggtaccctcctggc

SEQ ID NO: 5025480 - DNA, 18 bp, Homo sapiens
gacctgttgccagcagat

SEQ ID NO: 5025481 - DNA, 20 bp, Homo sapiens
gacgtgttacccactgccat

SEQ ID NO: 5025482 - DNA, 22 bp, Homo sapiens
gacgtgttacccactgccatgc

SEQ ID NO: 5025483 - DNA, 22 bp, Homo sapiens
gactatgcagaggcctggggga

SEQ ID NO: 5025484 - DNA, 14 bp, Homo sapiens
gactcctggtctgt

SEQ ID NO: 5025485 - DNA, 16 bp, Homo sapiens
gactctttttttgagt

SEQ ID NO: 5025486 - DNA, 21 bp, Homo sapiens
gactgcagtgtggagttcacc

SEQ ID NO: 5025487 - DNA, 15 bp, Homo sapiens
gactgggctctggct

SEQ ID NO: 5025488 - DNA, 14 bp, Homo sapiens
gactgtatctgtgt

SEQ ID NO: 5025489 - DNA, 12 bp, Homo sapiens
gactgtgctgtg

SEQ ID NO: 5025490 - DNA, 19 bp, Homo sapiens
gactgttttctctcggctc

SEQ ID NO: 5025491 - DNA, 21 bp, Homo sapiens
gactgttttctctcggctccc

SEQ ID NO: 5025492 - DNA, 19 bp, Homo sapiens
gacttggagactcctggtc

SEQ ID NO: 5025493 - DNA, 20 bp, Homo sapiens
gacttggagactcctggtct

SEQ ID NO: 5025494 - DNA, 18 bp, Homo sapiens
gacttttatttccagtga

SEQ ID NO: 5025495 - DNA, 18 bp, Homo sapiens
gagaacaggtggttttta

SEQ ID NO: 5025496 - DNA, 21 bp, Homo sapiens
gagaaggcagtagttttcaaa

SEQ ID NO: 5025497 - DNA, 16 bp, Homo sapiens
gagaagggctggggcc

SEQ ID NO: 5025498 - DNA, 15 bp, Homo sapiens
gagactcctggtctg

SEQ ID NO: 5025499 - DNA, 16 bp, Homo sapiens
gagactcctggtctgt

SEQ ID NO: 5025500 - DNA, 16 bp, Homo sapiens
gagactgggctctggc

SEQ ID NO: 5025501 - DNA, 16 bp, Homo sapiens
gagagaaaggactcct

SEQ ID NO: 5025502 - DNA, 11 bp, Homo sapiens
gagagagaaaa

SEQ ID NO: 5025503 - DNA, 13 bp, Homo sapiens
gagagagaaaaaa

SEQ ID NO: 5025504 - DNA, 14 bp, Homo sapiens
gagagccagcagca

SEQ ID NO: 5025505 - DNA, 17 bp, Homo sapiens
gagagcctggtgctgct

SEQ ID NO: 5025506 - DNA, 19 bp, Homo sapiens
gagagcctggtgctgctgc

SEQ ID NO: 5025507 - DNA, 18 bp, Homo sapiens
gagaggaggtttgcctgt

SEQ ID NO: 5025508 - DNA, 18 bp, Homo sapiens
gagaggccaaaggctggt

SEQ ID NO: 5025509 - DNA, 20 bp, Homo sapiens
gagaggtttgcagtcccaag

SEQ ID NO: 5025510 - DNA, 16 bp, Homo sapiens
gagatagttttcatcc

SEQ ID NO: 5025511 - DNA, 16 bp, Homo sapiens
gagatttattaaagaa

SEQ ID NO: 5025512 - DNA, 17 bp, Homo sapiens
gagatttattaaagaaa

SEQ ID NO: 5025513 - DNA, 13 bp, Homo sapiens
gagcaaacccaga

SEQ ID NO: 5025514 - DNA, 14 bp, Homo sapiens
gagcaaacccagag

SEQ ID NO: 5025515 - DNA, 18 bp, Homo sapiens
gagcaaacccagaggtgg

SEQ ID NO: 5025516 - DNA, 22 bp, Homo sapiens
gagcacaagaggagatccaggg

SEQ ID NO: 5025517 - DNA, 22 bp, Homo sapiens
gagcaccgcctgtgaaatacca

SEQ ID NO: 5025518 - DNA, 14 bp, Homo sapiens
gagcccgcagggcc

SEQ ID NO: 5025519 - DNA, 21 bp, Homo sapiens
gagcccgcagggccatgcaga

SEQ ID NO: 5025520 - DNA, 16 bp, Homo sapiens
gagccggtggtgcccg

SEQ ID NO: 5025521 - DNA, 13 bp, Homo sapiens
gagcgaggaaagg

SEQ ID NO: 5025522 - DNA, 13 bp, Homo sapiens
gagcggtggggga

SEQ ID NO: 5025523 - DNA, 20 bp, Homo sapiens
gagctctgtgggtctctgga

SEQ ID NO: 5025524 - DNA, 19 bp, Homo sapiens
gagctggccaaagagcctt

SEQ ID NO: 5025525 - DNA, 12 bp, Homo sapiens
gagctgggcccc

SEQ ID NO: 5025526 - DNA, 19 bp, Homo sapiens
gagctggggacctggtacc

SEQ ID NO: 5025527 - DNA, 17 bp, Homo sapiens
gagcttaaaatacaaga

SEQ ID NO: 5025528 - DNA, 13 bp, Homo sapiens
gagcttgctccag

SEQ ID NO: 5025529 - DNA, 14 bp, Homo sapiens
gagcttgctccaga

SEQ ID NO: 5025530 - DNA, 21 bp, Homo sapiens
gagcttgctccagattctgat

SEQ ID NO: 5025531 - DNA, 22 bp, Homo sapiens
gaggaaaggattttaccaaagc

SEQ ID NO: 5025532 - DNA, 22 bp, Homo sapiens
gaggaaccaggagaagggctgg

SEQ ID NO: 5025533 - DNA, 17 bp, Homo sapiens
gaggaatactgaacatc

SEQ ID NO: 5025534 - DNA, 16 bp, Homo sapiens
gaggagctgggcccct

SEQ ID NO: 5025535 - DNA, 23 bp, Homo sapiens
gaggaggtgacaaaccatttcca

SEQ ID NO: 5025536 - DNA, 16 bp, Homo sapiens
gaggatgctgcagtga

SEQ ID NO: 5025537 - DNA, 18 bp, Homo sapiens
gaggcactgaagtgctta

SEQ ID NO: 5025538 - DNA, 21 bp, Homo sapiens
gaggcatcatggaaagactgg

SEQ ID NO: 5025539 - DNA, 19 bp, Homo sapiens
gaggccaaaggctggtggc

SEQ ID NO: 5025540 - DNA, 20 bp, Homo sapiens
gaggccaagcagtgcctgcc

SEQ ID NO: 5025541 - DNA, 19 bp, Homo sapiens
gaggccctggtcctggcct

SEQ ID NO: 5025542 - DNA, 23 bp, Homo sapiens
gaggcccttgtcgtgggatggca

SEQ ID NO: 5025543 - DNA, 23 bp, Homo sapiens
gaggctgccgagacagaccctct

SEQ ID NO: 5025544 - DNA, 16 bp, Homo sapiens
gaggctgcttcccaga

SEQ ID NO: 5025545 - DNA, 13 bp, Homo sapiens
gagggagctggga

SEQ ID NO: 5025546 - DNA, 16 bp, Homo sapiens
gagggagttttgtctg

SEQ ID NO: 5025547 - DNA, 22 bp, Homo sapiens
gagggagttttgtctgtctccc

SEQ ID NO: 5025548 - DNA, 18 bp, Homo sapiens
gagggcaggcttggggaa

SEQ ID NO: 5025549 - DNA, 16 bp, Homo sapiens
gagggcggagccggcc

SEQ ID NO: 5025550 - DNA, 16 bp, Homo sapiens
gaggggaaggggcggt

SEQ ID NO: 5025551 - DNA, 21 bp, Homo sapiens
gagggttttaggtagaaaaac

SEQ ID NO: 5025552 - DNA, 21 bp, Homo sapiens
gaggtcactccaccatcccca

SEQ ID NO: 5025553 - DNA, 17 bp, Homo sapiens
gaggtccagccctggct

SEQ ID NO: 5025554 - DNA, 22 bp, Homo sapiens
gaggtccagccctggctgaagg

SEQ ID NO: 5025555 - DNA, 13 bp, Homo sapiens
gaggtgcctgtcc

SEQ ID NO: 5025556 - DNA, 15 bp, Homo sapiens
gaggtgcctgtccca

SEQ ID NO: 5025557 - DNA, 20 bp, Homo sapiens
gagtcatttaaatgtgtaca

SEQ ID NO: 5025558 - DNA, 17 bp, Homo sapiens
gagtcccctcacctcct

SEQ ID NO: 5025559 - DNA, 19 bp, Homo sapiens
gagtcctggatgatactaa

SEQ ID NO: 5025560 - DNA, 21 bp, Homo sapiens
gcagtgtggagttcaccttgg

SEQ ID NO: 5025561 - DNA, 16 bp, Homo sapiens
gcagttatattttgca

SEQ ID NO: 5025562 - DNA, 14 bp, Homo sapiens
gcagttggccagag

SEQ ID NO: 5025563 - DNA, 20 bp, Homo sapiens
gcagttttttttttcttgtc

SEQ ID NO: 5025564 - DNA, 13 bp, Homo sapiens
gcatatcataatg

SEQ ID NO: 5025565 - DNA, 15 bp, Homo sapiens
gcatatgtatgactc

SEQ ID NO: 5025566 - DNA, 22 bp, Homo sapiens
gcatatttattgcattgctggt

SEQ ID NO: 5025567 - DNA, 12 bp, Homo sapiens
gcatcacagttt

SEQ ID NO: 5025568 - DNA, 23 bp, Homo sapiens
gcatcagtgccctccaggataga

SEQ ID NO: 5025569 - DNA, 20 bp, Homo sapiens
gcatcattatttatgtattg

SEQ ID NO: 5025570 - DNA, 14 bp, Homo sapiens
gcatctctgtactt

SEQ ID NO: 5025571 - DNA, 17 bp, Homo sapiens
gcatggaaatttaaagc

SEQ ID NO: 5025572 - DNA, 23 bp, Homo sapiens
gcatggaaatttaaagcaggttc

SEQ ID NO: 5025573 - DNA, 14 bp, Homo sapiens
gcatgggaggtgag

SEQ ID NO: 5025574 - DNA, 19 bp, Homo sapiens
gcatgtcccacccacccgc

SEQ ID NO: 5025575 - DNA, 15 bp, Homo sapiens
gcattagaattattt

SEQ ID NO: 5025576 - DNA, 17 bp, Homo sapiens
gcattagaattatttaa

SEQ ID NO: 5025577 - DNA, 18 bp, Homo sapiens
gcattagaattatttaaa

SEQ ID NO: 5025578 - DNA, 17 bp, Homo sapiens
gcatttgaaaggtgtgc

SEQ ID NO: 5025579 - DNA, 15 bp, Homo sapiens
gcatttggtgagagt

SEQ ID NO: 5025580 - DNA, 19 bp, Homo sapiens
gcatttgtttatgtaattt

SEQ ID NO: 5025581 - DNA, 13 bp, Homo sapiens
gcattttataaat

SEQ ID NO: 5025582 - DNA, 12 bp, Homo sapiens
gccaaattaaaa

SEQ ID NO: 5025583 - DNA, 12 bp, Homo sapiens
gccaagactcct

SEQ ID NO: 5025584 - DNA, 15 bp, Homo sapiens
gccaagatcacagtg

SEQ ID NO: 5025585 - DNA, 16 bp, Homo sapiens
gccacccaagcctgct

SEQ ID NO: 5025586 - DNA, 17 bp, Homo sapiens
gccacccaagcctgctg

SEQ ID NO: 5025587 - DNA, 19 bp, Homo sapiens
gccacccaagcctgctggc

SEQ ID NO: 5025588 - DNA, 21 bp, Homo sapiens
gccacccatgcagctgctccc

SEQ ID NO: 5025589 - DNA, 20 bp, Homo sapiens
gccacccgtggggtgctgcc

SEQ ID NO: 5025590 - DNA, 19 bp, Homo sapiens
gccactaaccttgcctggt

SEQ ID NO: 5025591 - DNA, 22 bp, Homo sapiens
gccagatgcacatccctggaag

SEQ ID NO: 5025592 - DNA, 22 bp, Homo sapiens
gccagatggactccagcctgcc

SEQ ID NO: 5025593 - DNA, 15 bp, Homo sapiens
gccagccaggccctg

SEQ ID NO: 5025594 - DNA, 17 bp, Homo sapiens
gccagctcacagtgctg

SEQ ID NO: 5025595 - DNA, 14 bp, Homo sapiens
gccagctgccgcac

SEQ ID NO: 5025596 - DNA, 14 bp, Homo sapiens
gccagcttttcaaa

SEQ ID NO: 5025597 - DNA, 19 bp, Homo sapiens
gccaggcaggcgggcgcca

SEQ ID NO: 5025598 - DNA, 15 bp, Homo sapiens
gccaggctggtctcg

SEQ ID NO: 5025599 - DNA, 13 bp, Homo sapiens
gccaggggcgagg

SEQ ID NO: 5025600 - DNA, 14 bp, Homo sapiens
gccagtattttaaa

SEQ ID NO: 5025601 - DNA, 18 bp, Homo sapiens
gccagtcaagaagaaaaa

SEQ ID NO: 5025602 - DNA, 20 bp, Homo sapiens
gccatattaaattttttgtt

SEQ ID NO: 5025603 - DNA, 21 bp, Homo sapiens
gccatgctggccaggctggtc

SEQ ID NO: 5025604 - DNA, 12 bp, Homo sapiens
gccatggcctct

SEQ ID NO: 5025605 - DNA, 17 bp, Homo sapiens
gccattccccgtctctg

SEQ ID NO: 5025606 - DNA, 17 bp, Homo sapiens
gccattgacttcttccc

SEQ ID NO: 5025607 - DNA, 14 bp, Homo sapiens
gcccagctctctga

SEQ ID NO: 5025608 - DNA, 20 bp, Homo sapiens
gcccagtgcatatgcaatgt

SEQ ID NO: 5025609 - DNA, 17 bp, Homo sapiens
gccccaccttgtctgct

SEQ ID NO: 5025610 - DNA, 18 bp, Homo sapiens
gccccactttgaagggca

SEQ ID NO: 5025611 - DNA, 19 bp, Homo sapiens
gccccactttgaagggcaa

SEQ ID NO: 5025612 - DNA, 16 bp, Homo sapiens
gccccccagcctctgg

SEQ ID NO: 5025613 - DNA, 17 bp, Homo sapiens
gccccccgaggctgcta

SEQ ID NO: 5025614 - DNA, 23 bp, Homo sapiens
gccccctcacagtattgctcacc

SEQ ID NO: 5025615 - DNA, 15 bp, Homo sapiens
gccccctccccccag

SEQ ID NO: 5025616 - DNA, 16 bp, Homo sapiens
gccccctcctctagct

SEQ ID NO: 5025617 - DNA, 20 bp, Homo sapiens
gccccctctcggccaggcat

SEQ ID NO: 5025618 - DNA, 14 bp, Homo sapiens
gccccctgcccccc

SEQ ID NO: 5025619 - DNA, 18 bp, Homo sapiens
gccccctgccccccagcc

SEQ ID NO: 5025620 - DNA, 15 bp, Homo sapiens
gccccgccccgttgt

SEQ ID NO: 5025621 - DNA, 15 bp, Homo sapiens
gccccggggcctgtt

SEQ ID NO: 5025622 - DNA, 18 bp, Homo sapiens
gccccgttgtgagctgga

SEQ ID NO: 5025623 - DNA, 21 bp, Homo sapiens
gccccgttgtgagctggatag

SEQ ID NO: 5025624 - DNA, 19 bp, Homo sapiens
gcccctcggctctggaggc

SEQ ID NO: 5025625 - DNA, 21 bp, Homo sapiens
gcccctgccattgtagcgtct

SEQ ID NO: 5025626 - DNA, 20 bp, Homo sapiens
gcccctggccccgcctgcct

SEQ ID NO: 5025627 - DNA, 15 bp, Homo sapiens
gcccctgtctcgggg

SEQ ID NO: 5025628 - DNA, 12 bp, Homo sapiens
gcccctttataa

SEQ ID NO: 5025629 - DNA, 13 bp, Homo sapiens
gcccgcagggcca

SEQ ID NO: 5025630 - DNA, 13 bp, Homo sapiens
gcccgtctcagtg

SEQ ID NO: 5025631 - DNA, 23 bp, Homo sapiens
gcccgtgcccccgcctgccaccg

SEQ ID NO: 5025632 - DNA, 19 bp, Homo sapiens
gcccgtgcccgcaggaact

SEQ ID NO: 5025633 - DNA, 17 bp, Homo sapiens
gcccgtggggtctgcgc

SEQ ID NO: 5025634 - DNA, 20 bp, Homo sapiens
gccctctcccctcagcctct

SEQ ID NO: 5025635 - DNA, 15 bp, Homo sapiens
gccctgcagccagct

SEQ ID NO: 5025636 - DNA, 17 bp, Homo sapiens
gccctgccctggcaggg

SEQ ID NO: 5025637 - DNA, 14 bp, Homo sapiens
gccctggtcctggc

SEQ ID NO: 5025638 - DNA, 19 bp, Homo sapiens
gccctggtcctggcctcct

SEQ ID NO: 5025639 - DNA, 13 bp, Homo sapiens
gccctgtcctggt

SEQ ID NO: 5025640 - DNA, 17 bp, Homo sapiens
gccctgttctcctcccc

SEQ ID NO: 5025641 - DNA, 18 bp, Homo sapiens
gcccttgtcgtgggatgg

SEQ ID NO: 5025642 - DNA, 20 bp, Homo sapiens
gcccttgtcgtgggatggca

SEQ ID NO: 5025643 - DNA, 11 bp, Homo sapiens
gccgccagctg

SEQ ID NO: 5025644 - DNA, 23 bp, Homo sapiens
gccgccccctgccccccagcctc

SEQ ID NO: 5025645 - DNA, 18 bp, Homo sapiens
gccgctgcccgctcagcc

SEQ ID NO: 5025646 - DNA, 19 bp, Homo sapiens
gccgctgcttccaggctgg

SEQ ID NO: 5025647 - DNA, 19 bp, Homo sapiens
gccggcttcatgccagcta

SEQ ID NO: 5025648 - DNA, 18 bp, Homo sapiens
gccgggaccccgagcctg

SEQ ID NO: 5025649 - DNA, 13 bp, Homo sapiens
gccggtgggaccc

SEQ ID NO: 5025650 - DNA, 23 bp, Homo sapiens
gccgtattttacatgaagctgta

SEQ ID NO: 5025651 - DNA, 16 bp, Homo sapiens
gcctaaggctgaactt

SEQ ID NO: 5025652 - DNA, 17 bp, Homo sapiens
gcctcaaaggcccgctc

SEQ ID NO: 5025653 - DNA, 16 bp, Homo sapiens
gcctcagtgtgcccat

SEQ ID NO: 5025654 - DNA, 15 bp, Homo sapiens
gcctcctcatcccgt

SEQ ID NO: 5025655 - DNA, 22 bp, Homo sapiens
gcctcctcatcccgtgttctcc

SEQ ID NO: 5025656 - DNA, 16 bp, Homo sapiens
gcctctacccaaccag

SEQ ID NO: 5025657 - DNA, 21 bp, Homo sapiens
gcctctacccaaccagggccc

SEQ ID NO: 5025658 - DNA, 17 bp, Homo sapiens
gcctctgcaactgctca

SEQ ID NO: 5025659 - DNA, 22 bp, Homo sapiens
gcctctgcaactgctcagctct

SEQ ID NO: 5025660 - DNA, 16 bp, Homo sapiens
gcctgccaccggaggt

SEQ ID NO: 5025661 - DNA, 20 bp, Homo sapiens
gcctgccctcatggcccctc

SEQ ID NO: 5025662 - DNA, 22 bp, Homo sapiens
gcctgccctcatggcccctctg

SEQ ID NO: 5025663 - DNA, 12 bp, Homo sapiens
gcctgccctggt

SEQ ID NO: 5025664 - DNA, 22 bp, Homo sapiens
gcctgctgttggtcctctctct

SEQ ID NO: 5025665 - DNA, 20 bp, Homo sapiens
gcctgggggacccctggctc

SEQ ID NO: 5025666 - DNA, 22 bp, Homo sapiens
gcctgggggacccctggctctg

SEQ ID NO: 5025667 - DNA, 14 bp, Homo sapiens
gcctggttagaggc

SEQ ID NO: 5025668 - DNA, 15 bp, Homo sapiens
gcctgtccaccctgc

SEQ ID NO: 5025669 - DNA, 20 bp, Homo sapiens
gcctgtcccacccccacccc

SEQ ID NO: 5025670 - DNA, 15 bp, Homo sapiens
gccttagtctcagtt

SEQ ID NO: 5025671 - DNA, 22 bp, Homo sapiens
gccttagtctcagtttgtgtgt

SEQ ID NO: 5025672 - DNA, 15 bp, Homo sapiens
gccttgcctggcctg

SEQ ID NO: 5025673 - DNA, 21 bp, Homo sapiens
ggccccccgcacagccacccg

SEQ ID NO: 5025674 - DNA, 19 bp, Homo sapiens
ggccccctccccccagact

SEQ ID NO: 5025675 - DNA, 16 bp, Homo sapiens
ggcccctgctgtctct

SEQ ID NO: 5025676 - DNA, 18 bp, Homo sapiens
ggcccctgctgtctctct

SEQ ID NO: 5025677 - DNA, 21 bp, Homo sapiens
ggcccctgctgtctctctggg

SEQ ID NO: 5025678 - DNA, 21 bp, Homo sapiens
ggcccggccacacccagcggc

SEQ ID NO: 5025679 - DNA, 16 bp, Homo sapiens
ggccgcacgcctctcc

SEQ ID NO: 5025680 - DNA, 23 bp, Homo sapiens
ggccgggaccccgagcctggctc

SEQ ID NO: 5025681 - DNA, 19 bp, Homo sapiens
ggcctcaaaggcccgctct

SEQ ID NO: 5025682 - DNA, 19 bp, Homo sapiens
ggcctcactaggcttctgg

SEQ ID NO: 5025683 - DNA, 13 bp, Homo sapiens
ggcctcttggcag

SEQ ID NO: 5025684 - DNA, 15 bp, Homo sapiens
ggcctgtccacaggc

SEQ ID NO: 5025685 - DNA, 17 bp, Homo sapiens
ggccttgcctggcctga

SEQ ID NO: 5025686 - DNA, 19 bp, Homo sapiens
ggcggctggggtcccagca

SEQ ID NO: 5025687 - DNA, 12 bp, Homo sapiens
ggcgtctgctct

SEQ ID NO: 5025688 - DNA, 13 bp, Homo sapiens
ggcgtctgctctg

SEQ ID NO: 5025689 - DNA, 23 bp, Homo sapiens
ggctacaccttagcctgccctcc

SEQ ID NO: 5025690 - DNA, 19 bp, Homo sapiens
ggctatagatgtcttttcc

SEQ ID NO: 5025691 - DNA, 17 bp, Homo sapiens
ggctccccatgtgtcct

SEQ ID NO: 5025692 - DNA, 17 bp, Homo sapiens
ggctctgaggtgcctgt

SEQ ID NO: 5025693 - DNA, 19 bp, Homo sapiens
ggctctgaggtgcctgtcc

SEQ ID NO: 5025694 - DNA, 18 bp, Homo sapiens
ggctctgtccccagcctg

SEQ ID NO: 5025695 - DNA, 14 bp, Homo sapiens
ggctgcggccccct

SEQ ID NO: 5025696 - DNA, 16 bp, Homo sapiens
ggctgcttcccagagg

SEQ ID NO: 5025697 - DNA, 21 bp, Homo sapiens
ggctggagtgcagtggcgcaa

SEQ ID NO: 5025698 - DNA, 16 bp, Homo sapiens
ggctggggtcccagca

SEQ ID NO: 5025699 - DNA, 17 bp, Homo sapiens
ggctggggtcccagcag

SEQ ID NO: 5025700 - DNA, 11 bp, Homo sapiens
ggctgtgtgtg

SEQ ID NO: 5025701 - DNA, 15 bp, Homo sapiens
ggcttcatgccagct

SEQ ID NO: 5025702 - DNA, 20 bp, Homo sapiens
ggcttcccaagggctgccgg

SEQ ID NO: 5025703 - DNA, 16 bp, Homo sapiens
gggaaagcccctgccc

SEQ ID NO: 5025704 - DNA, 14 bp, Homo sapiens
gggaacaatttggc

SEQ ID NO: 5025705 - DNA, 14 bp, Homo sapiens
gggacaccagagct

SEQ ID NO: 5025706 - DNA, 17 bp, Homo sapiens
gggacaccagagctgcc

SEQ ID NO: 5025707 - DNA, 19 bp, Homo sapiens
gggacatcaggagactggg

SEQ ID NO: 5025708 - DNA, 16 bp, Homo sapiens
gggaccactgggtgag

SEQ ID NO: 5025709 - DNA, 17 bp, Homo sapiens
gggaccactgggtgaga

SEQ ID NO: 5025710 - DNA, 20 bp, Homo sapiens
gggaccccgagcctggctcc

SEQ ID NO: 5025711 - DNA, 21 bp, Homo sapiens
gggacctggtaccctcctggc

SEQ ID NO: 5025712 - DNA, 22 bp, Homo sapiens
gggaccttaagtgatttgcctg

SEQ ID NO: 5025713 - DNA, 14 bp, Homo sapiens
gggatggtagtttt

SEQ ID NO: 5025714 - DNA, 15 bp, Homo sapiens
gggcaaacaggcagt

SEQ ID NO: 5025715 - DNA, 15 bp, Homo sapiens
gggcaccagccagcg

SEQ ID NO: 5025716 - DNA, 14 bp, Homo sapiens
gggcagggtgaccc

SEQ ID NO: 5025717 - DNA, 16 bp, Homo sapiens
gggccctctctctgcg

SEQ ID NO: 5025718 - DNA, 19 bp, Homo sapiens
gggcctcaaaggcccgctc

SEQ ID NO: 5025719 - DNA, 20 bp, Homo sapiens
gggcctcaaaggcccgctct

SEQ ID NO: 5025720 - DNA, 21 bp, Homo sapiens
gggcctcagtgtgcccatctg

SEQ ID NO: 5025721 - DNA, 18 bp, Homo sapiens
gggcgcgatcccacacag

SEQ ID NO: 5025722 - DNA, 16 bp, Homo sapiens
gggctaggggctgggg

SEQ ID NO: 5025723 - DNA, 21 bp, Homo sapiens
gggctctgcaattcccctctg

SEQ ID NO: 5025724 - DNA, 13 bp, Homo sapiens
gggcttcccaagg

SEQ ID NO: 5025725 - DNA, 15 bp, Homo sapiens
ggggacaccagagct

SEQ ID NO: 5025726 - DNA, 21 bp, Homo sapiens
ggggacccctggctctgggcc

SEQ ID NO: 5025727 - DNA, 16 bp, Homo sapiens
ggggagacagttgaga

SEQ ID NO: 5025728 - DNA, 14 bp, Homo sapiens
ggggccctgccctg

SEQ ID NO: 5025729 - DNA, 16 bp, Homo sapiens
ggggctaggggctggg

SEQ ID NO: 5025730 - DNA, 14 bp, Homo sapiens
ggggctgagctggg

SEQ ID NO: 5025731 - DNA, 15 bp, Homo sapiens
ggggggacagtgccc

SEQ ID NO: 5025732 - DNA, 12 bp, Homo sapiens
ggggtcccagca

SEQ ID NO: 5025733 - DNA, 14 bp, Homo sapiens
ggggtcccagcagc

SEQ ID NO: 5025734 - DNA, 18 bp, Homo sapiens
ggggtcccagcagctgcc

SEQ ID NO: 5025735 - DNA, 20 bp, Homo sapiens
ggggtgtttgggaggctgcg

SEQ ID NO: 5025736 - DNA, 22 bp, Homo sapiens
gggtatgtttaatctgttatgt

SEQ ID NO: 5025737 - DNA, 15 bp, Homo sapiens
gggtctcagtgtcct

SEQ ID NO: 5025738 - DNA, 12 bp, Homo sapiens
gggtctctggaa

SEQ ID NO: 5025739 - DNA, 23 bp, Homo sapiens
gggtctgggcggcgggcggctgg

SEQ ID NO: 5025740 - DNA, 13 bp, Homo sapiens
gggtgaagagctt

SEQ ID NO: 5025741 - DNA, 13 bp, Homo sapiens
gggtgagagagga

SEQ ID NO: 5025742 - DNA, 11 bp, Homo sapiens
gggttcctgca

SEQ ID NO: 5025743 - DNA, 22 bp, Homo sapiens
gggttctaggcatctctgtact

SEQ ID NO: 5025744 - DNA, 13 bp, Homo sapiens
ggtacttagagtt

SEQ ID NO: 5025745 - DNA, 16 bp, Homo sapiens
ggtagagacccccagg

SEQ ID NO: 5025746 - DNA, 14 bp, Homo sapiens
ggtaggggagggca

SEQ ID NO: 5025747 - DNA, 17 bp, Homo sapiens
ggtcactccaccatccc

SEQ ID NO: 5025748 - DNA, 18 bp, Homo sapiens
ggtccaggccctgtggca

SEQ ID NO: 5025749 - DNA, 12 bp, Homo sapiens
ggtcccagcagc

SEQ ID NO: 5025750 - DNA, 19 bp, Homo sapiens
ggtctatgtcgagagctgg

SEQ ID NO: 5025751 - DNA, 20 bp, Homo sapiens
ggtctatgtcgagagctggc

SEQ ID NO: 5025752 - DNA, 23 bp, Homo sapiens
ggtctatgtcgagagctggccaa

SEQ ID NO: 5025753 - DNA, 15 bp, Homo sapiens
ggtctccgagagagg

SEQ ID NO: 5025754 - DNA, 22 bp, Homo sapiens
ggtctgggcggcgggcggctgg

SEQ ID NO: 5025755 - DNA, 16 bp, Homo sapiens
ggtctgtgcatttctg

SEQ ID NO: 5025756 - DNA, 15 bp, Homo sapiens
ggtctgtttaaagtg

SEQ ID NO: 5025757 - DNA, 17 bp, Homo sapiens
ggtcttagttctggttg

SEQ ID NO: 5025758 - DNA, 18 bp, Homo sapiens
ggtgacatcaggtttttc

SEQ ID NO: 5025759 - DNA, 13 bp, Homo sapiens
ggtgactctgtcc

SEQ ID NO: 5025760 - DNA, 16 bp, Homo sapiens
ggtgactgtgctgtgc

SEQ ID NO: 5025761 - DNA, 17 bp, Homo sapiens
ggtgagagtcaaagctg

SEQ ID NO: 5025762 - DNA, 21 bp, Homo sapiens
ggtgcccacaccggggacagg

SEQ ID NO: 5025763 - DNA, 16 bp, Homo sapiens
ggtgcgtgttcagcag

SEQ ID NO: 5025764 - DNA, 21 bp, Homo sapiens
ggtggatgttatgaacagctg

SEQ ID NO: 5025765 - DNA, 22 bp, Homo sapiens
ggtggattctccctgggcctca

SEQ ID NO: 5025766 - DNA, 12 bp, Homo sapiens
ggtggcaagtgc

SEQ ID NO: 5025767 - DNA, 15 bp, Homo sapiens
ggtggcagtggaggt

SEQ ID NO: 5025768 - DNA, 23 bp, Homo sapiens
ggtggctctgggaatgggagagg

SEQ ID NO: 5025769 - DNA, 14 bp, Homo sapiens
ggtggggtcctgga

SEQ ID NO: 5025770 - DNA, 20 bp, Homo sapiens
ggtggggtgagggcttgagg

SEQ ID NO: 5025771 - DNA, 16 bp, Homo sapiens
ggtggtaccctctgga

SEQ ID NO: 5025772 - DNA, 22 bp, Homo sapiens
ggtgttaggcatgtcccaccca

SEQ ID NO: 5025773 - DNA, 14 bp, Homo sapiens
ggttatctctgtgt

SEQ ID NO: 5025774 - DNA, 18 bp, Homo sapiens
ggttctaggcatctctgt

SEQ ID NO: 5025775 - DNA, 20 bp, Homo sapiens
ggttctctctgacctttcat

SEQ ID NO: 5025776 - DNA, 22 bp, Homo sapiens
ggttcttgagccagccaggccc

SEQ ID NO: 5025777 - DNA, 14 bp, Homo sapiens
ggttcttgtattaa

SEQ ID NO: 5025778 - DNA, 21 bp, Homo sapiens
ggttgaggtccagccctggct

SEQ ID NO: 5025779 - DNA, 17 bp, Homo sapiens
ggtttaaatgaacaaga

SEQ ID NO: 5025780 - DNA, 22 bp, Homo sapiens
ggtttaaatgaacaagagaagc

SEQ ID NO: 5025781 - DNA, 20 bp, Homo sapiens
ggtttatgtagtcagttgca

SEQ ID NO: 5025782 - DNA, 14 bp, Homo sapiens
ggtttgtgttcttc

SEQ ID NO: 5025783 - DNA, 18 bp, Homo sapiens
ggttttagacccatagca

SEQ ID NO: 5025784 - DNA, 13 bp, Homo sapiens
gtaaaaatgctgc

SEQ ID NO: 5025785 - DNA, 18 bp, Homo sapiens
gtaaaaatgctgctctca

SEQ ID NO: 5025786 - DNA, 12 bp, Homo sapiens
gtttgctgctat

SEQ ID NO: 5025787 - DNA, 14 bp, Homo sapiens
gttttaatttaaac

SEQ ID NO: 5025788 - DNA, 19 bp, Homo sapiens
gttttacattccatttcat

SEQ ID NO: 5025789 - DNA, 17 bp, Homo sapiens
gttttaggtagaaaaac

SEQ ID NO: 5025790 - DNA, 18 bp, Homo sapiens
gttttatgacttcattaa

SEQ ID NO: 5025791 - DNA, 19 bp, Homo sapiens
gttttcatccataactgaa

SEQ ID NO: 5025792 - DNA, 20 bp, Homo sapiens
gttttcatccataactgaac

SEQ ID NO: 5025793 - DNA, 20 bp, Homo sapiens
gttttctcctgcctgtgctg

SEQ ID NO: 5025794 - DNA, 19 bp, Homo sapiens
gttttctctcggctcccca

SEQ ID NO: 5025795 - DNA, 17 bp, Homo sapiens
gttttctgaaacacacg

SEQ ID NO: 5025796 - DNA, 17 bp, Homo sapiens
gttttgttatataattt

SEQ ID NO: 5025797 - DNA, 22 bp, Homo sapiens
gtttttaaactgtacagtgtct

SEQ ID NO: 5025798 - DNA, 17 bp, Homo sapiens
gttttttttttcttgtc

SEQ ID NO: 5025799 - DNA, 21 bp, Homo sapiens
gttttttttttcttgtctata

SEQ ID NO: 5025800 - DNA, 23 bp, Homo sapiens
gttttttttttttttatgtgatc

SEQ ID NO: 5025801 - DNA, 12 bp, Homo sapiens
taaaaaagataa

SEQ ID NO: 5025802 - DNA, 16 bp, Homo sapiens
taaaaaagataaacac

SEQ ID NO: 5025803 - DNA, 22 bp, Homo sapiens
taaaaagctccaaatgcagctt

SEQ ID NO: 5025804 - DNA, 19 bp, Homo sapiens
taaaagagagagagagaaa

SEQ ID NO: 5025805 - DNA, 18 bp, Homo sapiens
taaaagaggtttttctta

SEQ ID NO: 5025806 - DNA, 19 bp, Homo sapiens
taaaagaggtttttcttaa

SEQ ID NO: 5025807 - DNA, 17 bp, Homo sapiens
taaaagttattaatatt

SEQ ID NO: 5025808 - DNA, 19 bp, Homo sapiens
taaaatagcgttcttgtaa

SEQ ID NO: 5025809 - DNA, 17 bp, Homo sapiens
taaacaagaaaaataaa

SEQ ID NO: 5025810 - DNA, 21 bp, Homo sapiens
taaacacacagatacacacac

SEQ ID NO: 5025811 - DNA, 18 bp, Homo sapiens
taaacgatttttaaaatg

SEQ ID NO: 5025812 - DNA, 17 bp, Homo sapiens
taaactaataattgcag

SEQ ID NO: 5025813 - DNA, 17 bp, Homo sapiens
taaactgtacagtgtct

SEQ ID NO: 5025814 - DNA, 16 bp, Homo sapiens
taaagaaaaaaatgta

SEQ ID NO: 5025815 - DNA, 12 bp, Homo sapiens
taaagaaaagat

SEQ ID NO: 5025816 - DNA, 13 bp, Homo sapiens
taaagaaaagatg

SEQ ID NO: 5025817 - DNA, 14 bp, Homo sapiens
taaagaaacatttc

SEQ ID NO: 5025818 - DNA, 23 bp, Homo sapiens
taaagacgttttataagcatcat

SEQ ID NO: 5025819 - DNA, 12 bp, Homo sapiens
taaagcctcctc

SEQ ID NO: 5025820 - DNA, 15 bp, Homo sapiens
taaaggagtttatgt

SEQ ID NO: 5025821 - DNA, 18 bp, Homo sapiens
taaagtagaagagggttt

SEQ ID NO: 5025822 - DNA, 14 bp, Homo sapiens
taaagttaagttga

SEQ ID NO: 5025823 - DNA, 14 bp, Homo sapiens
taaataaaagcaca

SEQ ID NO: 5025824 - DNA, 22 bp, Homo sapiens
taaataaaagcacaagtacttt

SEQ ID NO: 5025825 - DNA, 23 bp, Homo sapiens
taaataaccaattcctcatttgt

SEQ ID NO: 5025826 - DNA, 13 bp, Homo sapiens
taaatataaagac

SEQ ID NO: 5025827 - DNA, 17 bp, Homo sapiens
taaatataaagacgttt

SEQ ID NO: 5025828 - DNA, 22 bp, Homo sapiens
taaatatattattacttgtaaa

SEQ ID NO: 5025829 - DNA, 21 bp, Homo sapiens
taaatatggactgctcaggaa

SEQ ID NO: 5025830 - DNA, 23 bp, Homo sapiens
taaatatggactgctcaggaaac

SEQ ID NO: 5025831 - DNA, 16 bp, Homo sapiens
taaatgaacaagagaa

SEQ ID NO: 5025832 - DNA, 17 bp, Homo sapiens
taaatgaacaagagaag

SEQ ID NO: 5025833 - DNA, 17 bp, Homo sapiens
taaatgattcttagtga

SEQ ID NO: 5025834 - DNA, 16 bp, Homo sapiens
taaatgggaattctca

SEQ ID NO: 5025835 - DNA, 14 bp, Homo sapiens
taaatggttaaaag

SEQ ID NO: 5025836 - DNA, 17 bp, Homo sapiens
taaattcccaacttctc

SEQ ID NO: 5025837 - DNA, 16 bp, Homo sapiens
taaattttttgttgac

SEQ ID NO: 5025838 - DNA, 19 bp, Homo sapiens
taaccaattcctcatttgt

SEQ ID NO: 5025839 - DNA, 21 bp, Homo sapiens
taaccttgcctggtacagtat

SEQ ID NO: 5025840 - DNA, 22 bp, Homo sapiens
taactacaaaggtttaaatgaa

SEQ ID NO: 5025841 - DNA, 21 bp, Homo sapiens
taactgaataccactctgtaa

SEQ ID NO: 5025842 - DNA, 16 bp, Homo sapiens
taactgagtgcctttt

SEQ ID NO: 5025843 - DNA, 17 bp, Homo sapiens
taactgagtgccttttg

SEQ ID NO: 5025844 - DNA, 19 bp, Homo sapiens
taactggttgctgtgtcat

SEQ ID NO: 5025845 - DNA, 17 bp, Homo sapiens
taactgttatttataat

SEQ ID NO: 5025846 - DNA, 21 bp, Homo sapiens
taactgttatttataatcact

SEQ ID NO: 5025847 - DNA, 17 bp, Homo sapiens
taagacatttttggaag

SEQ ID NO: 5025848 - DNA, 16 bp, Homo sapiens
taagagcttgctccag

SEQ ID NO: 5025849 - DNA, 14 bp, Homo sapiens
taagagtgctgggc

SEQ ID NO: 5025850 - DNA, 12 bp, Homo sapiens
taagatttgttt

SEQ ID NO: 5025851 - DNA, 18 bp, Homo sapiens
taagatttgtttttaaac

SEQ ID NO: 5025852 - DNA, 15 bp, Homo sapiens
taagcaaaagaaaaa

SEQ ID NO: 5025853 - DNA, 22 bp, Homo sapiens
taagcactttaacacagtgtct

SEQ ID NO: 5025854 - DNA, 21 bp, Homo sapiens
taagcatcattatttatgtat

SEQ ID NO: 5025855 - DNA, 17 bp, Homo sapiens
taagccagttcacttag

SEQ ID NO: 5025856 - DNA, 17 bp, Homo sapiens
taaggattttatgcttt

SEQ ID NO: 5025857 - DNA, 22 bp, Homo sapiens
taaggattttatgctttaaaca

SEQ ID NO: 5025858 - DNA, 16 bp, Homo sapiens
taaggctgtgtaagat

SEQ ID NO: 5025859 - DNA, 13 bp, Homo sapiens
taagtctgtttta

SEQ ID NO: 5025860 - DNA, 16 bp, Homo sapiens
taagtgagcagaacag

SEQ ID NO: 5025861 - DNA, 17 bp, Homo sapiens
taagtgatttgcctgta

SEQ ID NO: 5025862 - DNA, 23 bp, Homo sapiens
taagtgcagggaggaaaagtgca

SEQ ID NO: 5025863 - DNA, 22 bp, Homo sapiens
taagttgagatagttttcatcc

SEQ ID NO: 5025864 - DNA, 19 bp, Homo sapiens
taataaactaataattgca

SEQ ID NO: 5025865 - DNA, 13 bp, Homo sapiens
taataatgtgaat

SEQ ID NO: 5025866 - DNA, 17 bp, Homo sapiens
taatagaaaagtatgtt

SEQ ID NO: 5025867 - DNA, 12 bp, Homo sapiens
taatataaatgc

SEQ ID NO: 5025868 - DNA, 16 bp, Homo sapiens
taatataaatgcaaat

SEQ ID NO: 5025869 - DNA, 23 bp, Homo sapiens
taatatcatcagtattgaagcat

SEQ ID NO: 5025870 - DNA, 16 bp, Homo sapiens
taatcacttttttcca

SEQ ID NO: 5025871 - DNA, 17 bp, Homo sapiens
taatcacttttttccac

SEQ ID NO: 5025872 - DNA, 18 bp, Homo sapiens
taatcacttttttccaca

SEQ ID NO: 5025873 - DNA, 23 bp, Homo sapiens
taatcctctcaaccacctttcag

SEQ ID NO: 5025874 - DNA, 21 bp, Homo sapiens
taatctcaaagagattcgaat

SEQ ID NO: 5025875 - DNA, 18 bp, Homo sapiens
taatctgggccagaattt

SEQ ID NO: 5025876 - DNA, 13 bp, Homo sapiens
taatctgttatgt

SEQ ID NO: 5025877 - DNA, 20 bp, Homo sapiens
taatctgttatgtactagtg

SEQ ID NO: 5025878 - DNA, 21 bp, Homo sapiens
taatgttgggtagaaagagat

SEQ ID NO: 5025879 - DNA, 21 bp, Homo sapiens
taattaattgggccagctttt

SEQ ID NO: 5025880 - DNA, 13 bp, Homo sapiens
taattctctgcaa

SEQ ID NO: 5025881 - DNA, 21 bp, Homo sapiens
taattgggccagcttttcaaa

SEQ ID NO: 5025882 - DNA, 20 bp, Homo sapiens
taattgttaagatatgatgt

SEQ ID NO: 5025883 - DNA, 14 bp, Homo sapiens
taattgttgttctg

SEQ ID NO: 5025884 - DNA, 16 bp, Homo sapiens
taattgttgttctgtt

SEQ ID NO: 5025885 - DNA, 13 bp, Homo sapiens
taatttaaagaga

SEQ ID NO: 5025886 - DNA, 17 bp, Homo sapiens
taatttagacttggatt

SEQ ID NO: 5025887 - DNA, 19 bp, Homo sapiens
taattttacacgcttttgt

SEQ ID NO: 5025888 - DNA, 20 bp, Homo sapiens
taattttacacgcttttgtg

SEQ ID NO: 5025889 - DNA, 17 bp, Homo sapiens
tacaaacacctggactt

SEQ ID NO: 5025890 - DNA, 21 bp, Homo sapiens
tacaacagaaaccagaaaagc

SEQ ID NO: 5025891 - DNA, 17 bp, Homo sapiens
tacaactcatacactcg

SEQ ID NO: 5025892 - DNA, 18 bp, Homo sapiens
tacaagtatttttaatta

SEQ ID NO: 5025893 - DNA, 19 bp, Homo sapiens
tacaattttttttattagt

SEQ ID NO: 5025894 - DNA, 13 bp, Homo sapiens
tacacaactcact

SEQ ID NO: 5025895 - DNA, 13 bp, Homo sapiens
tacacacacacac

SEQ ID NO: 5025896 - DNA, 17 bp, Homo sapiens
tacacgcttttgtgatg

SEQ ID NO: 5025897 - DNA, 16 bp, Homo sapiens
tacacgtctggacccc

SEQ ID NO: 5025898 - DNA, 16 bp, Homo sapiens
tacaggcgtgagccac

SEQ ID NO: 5025899 - DNA, 22 bp, Homo sapiens
tccagcgagagagtttcaaaag

SEQ ID NO: 5025900 - DNA, 13 bp, Homo sapiens
tccagctcctgta

SEQ ID NO: 5025901 - DNA, 20 bp, Homo sapiens
tccaggttcaacccacagct

SEQ ID NO: 5025902 - DNA, 20 bp, Homo sapiens
tccagtcaaatctgggctca

SEQ ID NO: 5025903 - DNA, 23 bp, Homo sapiens
tccagtcatctgtaagagcttgc

SEQ ID NO: 5025904 - DNA, 15 bp, Homo sapiens
tccagtgaacattcc

SEQ ID NO: 5025905 - DNA, 23 bp, Homo sapiens
tccagtgaacattcccagcccag

SEQ ID NO: 5025906 - DNA, 22 bp, Homo sapiens
tccagtggaggtttgtcgggca

SEQ ID NO: 5025907 - DNA, 17 bp, Homo sapiens
tccatgtacttgtttgc

SEQ ID NO: 5025908 - DNA, 15 bp, Homo sapiens
tccatttgcatttgt

SEQ ID NO: 5025909 - DNA, 21 bp, Homo sapiens
tcccaacttctcttgctttct

SEQ ID NO: 5025910 - DNA, 22 bp, Homo sapiens
tcccaagagaaggggaagcact

SEQ ID NO: 5025911 - DNA, 16 bp, Homo sapiens
tcccaagcggtgtctc

SEQ ID NO: 5025912 - DNA, 13 bp, Homo sapiens
tcccacagcgctg

SEQ ID NO: 5025913 - DNA, 12 bp, Homo sapiens
tcccactgccag

SEQ ID NO: 5025914 - DNA, 12 bp, Homo sapiens
tcccagtgacaa

SEQ ID NO: 5025915 - DNA, 16 bp, Homo sapiens
tcccatcctgtgtgtt

SEQ ID NO: 5025916 - DNA, 13 bp, Homo sapiens
tccccaccccacc

SEQ ID NO: 5025917 - DNA, 14 bp, Homo sapiens
tccccaggccaccc

SEQ ID NO: 5025918 - DNA, 19 bp, Homo sapiens
tccccatccagcgagagag

SEQ ID NO: 5025919 - DNA, 13 bp, Homo sapiens
tccccccagactc

SEQ ID NO: 5025920 - DNA, 20 bp, Homo sapiens
tccccgatgtcccctgcggg

SEQ ID NO: 5025921 - DNA, 14 bp, Homo sapiens
tcccctctgctgct

SEQ ID NO: 5025922 - DNA, 15 bp, Homo sapiens
tcccctctgctgctg

SEQ ID NO: 5025923 - DNA, 18 bp, Homo sapiens
tcccctgcctgccctggt

SEQ ID NO: 5025924 - DNA, 16 bp, Homo sapiens
tcccgcactctgcccc

SEQ ID NO: 5025925 - DNA, 17 bp, Homo sapiens
tcccgcactctgccccc

SEQ ID NO: 5025926 - DNA, 15 bp, Homo sapiens
tcccgtgttctcctt

SEQ ID NO: 5025927 - DNA, 13 bp, Homo sapiens
tccctcccctctc

SEQ ID NO: 5025928 - DNA, 17 bp, Homo sapiens
tccctcccctctcagaa

SEQ ID NO: 5025929 - DNA, 21 bp, Homo sapiens
tccctcctggagctctgtggg

SEQ ID NO: 5025930 - DNA, 18 bp, Homo sapiens
tccctctgggccaatgct

SEQ ID NO: 5025931 - DNA, 17 bp, Homo sapiens
tccctgcgcctgtgatg

SEQ ID NO: 5025932 - DNA, 18 bp, Homo sapiens
tccctggaaggacatcca

SEQ ID NO: 5025933 - DNA, 24 bp, Homo sapiens
tccctggcctttcatattttagct

SEQ ID NO: 5025934 - DNA, 23 bp, Homo sapiens
tccctgggagggacatgcttagc

SEQ ID NO: 5025935 - DNA, 16 bp, Homo sapiens
tcccttcagtaccctc

SEQ ID NO: 5025936 - DNA, 15 bp, Homo sapiens
tcccttcctgccagc

SEQ ID NO: 5025937 - DNA, 19 bp, Homo sapiens
tccctttttttacatttca

SEQ ID NO: 5025938 - DNA, 22 bp, Homo sapiens
tccgtaggtagatgtgtaacct

SEQ ID NO: 5025939 - DNA, 16 bp, Homo sapiens
tcctaagagtgctggg

SEQ ID NO: 5025940 - DNA, 19 bp, Homo sapiens
tcctaagagtgctgggcat

SEQ ID NO: 5025941 - DNA, 14 bp, Homo sapiens
tcctcgtttgtgtt

SEQ ID NO: 5025942 - DNA, 21 bp, Homo sapiens
tcctctcaaccacctttcaga

SEQ ID NO: 5025943 - DNA, 15 bp, Homo sapiens
tcctgataaagcaca

SEQ ID NO: 5025944 - DNA, 18 bp, Homo sapiens
tcctgcaatgaagtctct

SEQ ID NO: 5025945 - DNA, 20 bp, Homo sapiens
tcctgcaatgaagtctctga

SEQ ID NO: 5025946 - DNA, 22 bp, Homo sapiens
tcctgcacacgctccttcctct

SEQ ID NO: 5025947 - DNA, 13 bp, Homo sapiens
tcctgccagcccc

SEQ ID NO: 5025948 - DNA, 23 bp, Homo sapiens
tcctgccggtgggaccctgtccg

SEQ ID NO: 5025949 - DNA, 17 bp, Homo sapiens
tcctggacactcagacc

SEQ ID NO: 5025950 - DNA, 17 bp, Homo sapiens
tcctggcctccttcccc

SEQ ID NO: 5025951 - DNA, 20 bp, Homo sapiens
tcctgggctgggtggcccct

SEQ ID NO: 5025952 - DNA, 16 bp, Homo sapiens
tcctggtggtattttc

SEQ ID NO: 5025953 - DNA, 18 bp, Homo sapiens
tcctggtggtattttcaa

SEQ ID NO: 5025954 - DNA, 15 bp, Homo sapiens
tcctggttcccgttt

SEQ ID NO: 5025955 - DNA, 21 bp, Homo sapiens
tcctggttcccgtttctccac

SEQ ID NO: 5025956 - DNA, 19 bp, Homo sapiens
tcctgtccacacccagctc

SEQ ID NO: 5025957 - DNA, 22 bp, Homo sapiens
tcctgtccacacccagctcagc

SEQ ID NO: 5025958 - DNA, 22 bp, Homo sapiens
tcctgtgtaacacttggctctt

SEQ ID NO: 5025959 - DNA, 18 bp, Homo sapiens
tcctgtgtgttaagctct

SEQ ID NO: 5025960 - DNA, 19 bp, Homo sapiens
tcctgtgtgttaagctctg

SEQ ID NO: 5025961 - DNA, 21 bp, Homo sapiens
tcctgtgtgttaagctctgct

SEQ ID NO: 5025962 - DNA, 21 bp, Homo sapiens
tccttgaaggactaatagaaa

SEQ ID NO: 5025963 - DNA, 14 bp, Homo sapiens
tccttttaaagaaa

SEQ ID NO: 5025964 - DNA, 12 bp, Homo sapiens
tccttttcacat

SEQ ID NO: 5025965 - DNA, 21 bp, Homo sapiens
tccttttcataggtctgaaat

SEQ ID NO: 5025966 - DNA, 22 bp, Homo sapiens
tcgacactgttcttagctcaat

SEQ ID NO: 5025967 - DNA, 21 bp, Homo sapiens
tcgagagctggccaaagagcc

SEQ ID NO: 5025968 - DNA, 20 bp, Homo sapiens
tcgagattatcgttttctta

SEQ ID NO: 5025969 - DNA, 21 bp, Homo sapiens
tcgtatgatacttcgacactg

SEQ ID NO: 5025970 - DNA, 22 bp, Homo sapiens
tcgtatgatacttcgacactgt

SEQ ID NO: 5025971 - DNA, 19 bp, Homo sapiens
tcgtcctcgtttgtgttct

SEQ ID NO: 5025972 - DNA, 14 bp, Homo sapiens
tcgtgagtcattta

SEQ ID NO: 5025973 - DNA, 19 bp, Homo sapiens
tcgtgagtcatttaaatgt

SEQ ID NO: 5025974 - DNA, 19 bp, Homo sapiens
tcgtgtgcaacagacaagt

SEQ ID NO: 5025975 - DNA, 13 bp, Homo sapiens
tcgttttcttaaa

SEQ ID NO: 5025976 - DNA, 17 bp, Homo sapiens
tctaaaggagtttatgt

SEQ ID NO: 5025977 - DNA, 14 bp, Homo sapiens
tctaacctttacat

SEQ ID NO: 5025978 - DNA, 15 bp, Homo sapiens
tctaagtaaatacaa

SEQ ID NO: 5025979 - DNA, 20 bp, Homo sapiens
tctactcaacccattgttgt

SEQ ID NO: 5025980 - DNA, 14 bp, Homo sapiens
tctaggtaggaaga

SEQ ID NO: 5025981 - DNA, 20 bp, Homo sapiens
tctaggtaggaagagcccgc

SEQ ID NO: 5025982 - DNA, 14 bp, Homo sapiens
tctataaagcattt

SEQ ID NO: 5025983 - DNA, 11 bp, Homo sapiens
tctcagaacat

SEQ ID NO: 5025984 - DNA, 11 bp, Homo sapiens
tctcaggcagc

SEQ ID NO: 5025985 - DNA, 19 bp, Homo sapiens
tctcagtttgtgtgtctta

SEQ ID NO: 5025986 - DNA, 16 bp, Homo sapiens
tctcatgaagcaggag

SEQ ID NO: 5025987 - DNA, 20 bp, Homo sapiens
tctcattggaaatttagcat

SEQ ID NO: 5025988 - DNA, 11 bp, Homo sapiens
tctccagctgg

SEQ ID NO: 5025989 - DNA, 23 bp, Homo sapiens
tctccctcaactgaaggggtgca

SEQ ID NO: 5025990 - DNA, 17 bp, Homo sapiens
tctccctcccctctcag

SEQ ID NO: 5025991 - DNA, 22 bp, Homo sapiens
tctccctgagatgggcttccca

SEQ ID NO: 5025992 - DNA, 18 bp, Homo sapiens
tctccgtctcccaaagtg

SEQ ID NO: 5025993 - DNA, 13 bp, Homo sapiens
tctcggccaggca

SEQ ID NO: 5025994 - DNA, 19 bp, Homo sapiens
tctcgtcctcgtttgtgtt

SEQ ID NO: 5025995 - DNA, 20 bp, Homo sapiens
tctcgtgagtcatttaaatg

SEQ ID NO: 5025996 - DNA, 20 bp, Homo sapiens
tctctcggctccccatgtgt

SEQ ID NO: 5025997 - DNA, 18 bp, Homo sapiens
tctctgacgcttgtgaca

SEQ ID NO: 5025998 - DNA, 19 bp, Homo sapiens
tctctgacgcttgtgacag

SEQ ID NO: 5025999 - DNA, 23 bp, Homo sapiens
tctctgacgcttgtgacagtgcc

SEQ ID NO: 5026000 - DNA, 13 bp, Homo sapiens
tctctgcaacact

SEQ ID NO: 5026001 - DNA, 19 bp, Homo sapiens
tctctgcagtttttcccaa

SEQ ID NO: 5026002 - DNA, 10 bp, Homo sapiens
tctctgtgtt

SEQ ID NO: 5026003 - DNA, 16 bp, Homo sapiens
tctcttatggatgtcc

SEQ ID NO: 5026004 - DNA, 17 bp, Homo sapiens
tctcttccctgcgcctg

SEQ ID NO: 5026005 - DNA, 14 bp, Homo sapiens
tctgaaacacacga

SEQ ID NO: 5026006 - DNA, 17 bp, Homo sapiens
tctgaaacacacgagca

SEQ ID NO: 5026007 - DNA, 14 bp, Homo sapiens
tctgaaatttttct

SEQ ID NO: 5026008 - DNA, 17 bp, Homo sapiens
tctgaaatttttcttct

SEQ ID NO: 5026009 - DNA, 16 bp, Homo sapiens
tctgaagtgaaactgc

SEQ ID NO: 5026010 - DNA, 18 bp, Homo sapiens
tctgaagtgaaactgctt

SEQ ID NO: 5026011 - DNA, 22 bp, Homo sapiens
tctgaagtgaaactgcttgttt

SEQ ID NO: 5026012 - DNA, 14 bp, Homo sapiens
tctgacatctctgc

SEQ ID NO: 5026013 - DNA, 16 bp, Homo sapiens
tctgacatctctgcaa

SEQ ID NO: 5026014 - DNA, 20 bp, Homo sapiens
tctgacttaagcaaaagaaa

SEQ ID NO: 5026015 - DNA, 17 bp, Homo sapiens
tctgagcagcgagcctg

SEQ ID NO: 5026016 - DNA, 19 bp, Homo sapiens
tctgagcagcgagcctgct

SEQ ID NO: 5026017 - DNA, 11 bp, Homo sapiens
tctgaggctga

SEQ ID NO: 5026018 - DNA, 23 bp, Homo sapiens
tctgaggctgaaattcagaatat

SEQ ID NO: 5026019 - DNA, 21 bp, Homo sapiens
tctgaggtgcctgtcccaccc

SEQ ID NO: 5026020 - DNA, 20 bp, Homo sapiens
tctgagtaactggttgctgt

SEQ ID NO: 5026021 - DNA, 16 bp, Homo sapiens
tctgatgcagcttata

SEQ ID NO: 5026022 - DNA, 22 bp, Homo sapiens
tctgcaactgctcagctctggt

SEQ ID NO: 5026023 - DNA, 13 bp, Homo sapiens
tctgcctgcctgc

SEQ ID NO: 5026024 - DNA, 15 bp, Homo sapiens
tctgccttagtctca

SEQ ID NO: 5026025 - DNA, 19 bp, Homo sapiens
tctgccttagtctcagttt

SEQ ID NO: 5026026 - DNA, 14 bp, Homo sapiens
tctgcggcagagtc

SEQ ID NO: 5026027 - DNA, 22 bp, Homo sapiens
tctgctgatcctcccaggcttc

SEQ ID NO: 5026028 - DNA, 13 bp, Homo sapiens
tctggaagaaaaa

SEQ ID NO: 5026029 - DNA, 23 bp, Homo sapiens
tctggacagtacctgattgtatt

SEQ ID NO: 5026030 - DNA, 21 bp, Homo sapiens
tctggaccccgtttcattttt

SEQ ID NO: 5026031 - DNA, 11 bp, Homo sapiens
tctggccaggc

SEQ ID NO: 5026032 - DNA, 18 bp, Homo sapiens
tctgggaatgggagaggg

SEQ ID NO: 5026033 - DNA, 12 bp, Homo sapiens
tctggtggctta

SEQ ID NO: 5026034 - DNA, 20 bp, Homo sapiens
tctggttcctcccctcctcc

SEQ ID NO: 5026035 - DNA, 13 bp, Homo sapiens
tctgtaagagctt

SEQ ID NO: 5026036 - DNA, 16 bp, Homo sapiens
tctgtaagagcttgct

SEQ ID NO: 5026037 - DNA, 22 bp, Homo sapiens
tctgtaagagcttgctccagat

SEQ ID NO: 5026038 - DNA, 13 bp, Homo sapiens
tctgtaattgcaa

SEQ ID NO: 5026039 - DNA, 18 bp, Homo sapiens
tctgtaggcacagagctg

SEQ ID NO: 5026040 - DNA, 13 bp, Homo sapiens
tctgtcctgtgac

SEQ ID NO: 5026041 - DNA, 15 bp, Homo sapiens
tctgtccttgaagga

SEQ ID NO: 5026042 - DNA, 22 bp, Homo sapiens
tctgtctccctcccctctcaga

SEQ ID NO: 5026043 - DNA, 17 bp, Homo sapiens
tctgtgggtctctggaa

SEQ ID NO: 5026044 - DNA, 15 bp, Homo sapiens
tctgttatataaatg

SEQ ID NO: 5026045 - DNA, 16 bp, Homo sapiens
tctgtttgattctttt

SEQ ID NO: 5026046 - DNA, 21 bp, Homo sapiens
tctgttttgtttcgctctttg

SEQ ID NO: 5026047 - DNA, 14 bp, Homo sapiens
tcttaattctctgc

SEQ ID NO: 5026048 - DNA, 18 bp, Homo sapiens
tcttagctcaatgagcat

SEQ ID NO: 5026049 - DNA, 19 bp, Homo sapiens
tcttagctcaatgagcatg

SEQ ID NO: 5026050 - DNA, 14 bp, Homo sapiens
tcttagtagatttt

SEQ ID NO: 5026051 - DNA, 19 bp, Homo sapiens
tcttatggatgtccccagc

SEQ ID NO: 5026052 - DNA, 16 bp, Homo sapiens
tcttcagttgtctctg

SEQ ID NO: 5026053 - DNA, 21 bp, Homo sapiens
tcttccagtgaacattcccag

SEQ ID NO: 5026054 - DNA, 13 bp, Homo sapiens
tcttctcggggac

SEQ ID NO: 5026055 - DNA, 22 bp, Homo sapiens
tcttcttctcgtcctcgtttgt

SEQ ID NO: 5026056 - DNA, 16 bp, Homo sapiens
tcttgagccagccagg

SEQ ID NO: 5026057 - DNA, 17 bp, Homo sapiens
tcttgatacccccctct

SEQ ID NO: 5026058 - DNA, 18 bp, Homo sapiens
tcttgatcagttaagaaa

SEQ ID NO: 5026059 - DNA, 13 bp, Homo sapiens
tcttgctttctat

SEQ ID NO: 5026060 - DNA, 11 bp, Homo sapiens
tcttgtaattt

SEQ ID NO: 5026061 - DNA, 13 bp, Homo sapiens
tcttgtctataaa

SEQ ID NO: 5026062 - DNA, 16 bp, Homo sapiens
tctttaaaagagagag

SEQ ID NO: 5026063 - DNA, 22 bp, Homo sapiens
tctttacaaaacaaactcattc

SEQ ID NO: 5026064 - DNA, 20 bp, Homo sapiens
tctttagatagccctgtcct

SEQ ID NO: 5026065 - DNA, 18 bp, Homo sapiens
tctttcacagctcctccc

SEQ ID NO: 5026066 - DNA, 16 bp, Homo sapiens
tctttcatttcttcta

SEQ ID NO: 5026067 - DNA, 15 bp, Homo sapiens
tctttccaaaacatt

SEQ ID NO: 5026068 - DNA, 18 bp, Homo sapiens
tctttccaaaacatttct

SEQ ID NO: 5026069 - DNA, 13 bp, Homo sapiens
tctttctccctca

SEQ ID NO: 5026070 - DNA, 18 bp, Homo sapiens
tctttctttccaaaacat

SEQ ID NO: 5026071 - DNA, 22 bp, Homo sapiens
tctttctttccaaaacatttct

SEQ ID NO: 5026072 - DNA, 21 bp, Homo sapiens
tctttggacagaagcagctct

SEQ ID NO: 5026073 - DNA, 22 bp, Homo sapiens
tctttggacagaagcagctctt

SEQ ID NO: 5026074 - DNA, 14 bp, Homo sapiens
tctttggctcccct

SEQ ID NO: 5026075 - DNA, 16 bp, Homo sapiens
tctttgttttgtgtct

SEQ ID NO: 5026076 - DNA, 18 bp, Homo sapiens
tctttgttttgtgtctct

SEQ ID NO: 5026077 - DNA, 20 bp, Homo sapiens
tctttgttttgtgtctctta

SEQ ID NO: 5026078 - DNA, 21 bp, Homo sapiens
tcttttcccatttatctaaat

SEQ ID NO: 5026079 - DNA, 22 bp, Homo sapiens
tcttttttggccatctgctcct

SEQ ID NO: 5026080 - DNA, 17 bp, Homo sapiens
tctttttttgtatagtt

SEQ ID NO: 5026081 - DNA, 18 bp, Homo sapiens
tctttttttgtatagtta

SEQ ID NO: 5026082 - DNA, 16 bp, Homo sapiens
tgaaaactaaggattt

SEQ ID NO: 5026083 - DNA, 13 bp, Homo sapiens
tgaaaagaattgt

SEQ ID NO: 5026084 - DNA, 21 bp, Homo sapiens
tgaaacacacgagcaaaccca

SEQ ID NO: 5026085 - DNA, 23 bp, Homo sapiens
tgaaagtctgtccttgaaggact

SEQ ID NO: 5026086 - DNA, 16 bp, Homo sapiens
tgaaatactgtttgag

SEQ ID NO: 5026087 - DNA, 23 bp, Homo sapiens
tgaaatagacccacaagaggcag

SEQ ID NO: 5026088 - DNA, 16 bp, Homo sapiens
tgaaatcagttactct

SEQ ID NO: 5026089 - DNA, 15 bp, Homo sapiens
tgaaatgtaaggctg

SEQ ID NO: 5026090 - DNA, 20 bp, Homo sapiens
tgaaatgtaaggctgtgtaa

SEQ ID NO: 5026091 - DNA, 21 bp, Homo sapiens
tgaaattcagagcaagttcct

SEQ ID NO: 5026092 - DNA, 16 bp, Homo sapiens
tgaacaagagaagcat

SEQ ID NO: 5026093 - DNA, 18 bp, Homo sapiens
tgaacactccaattaagg

SEQ ID NO: 5026094 - DNA, 17 bp, Homo sapiens
tgaacattcccagccca

SEQ ID NO: 5026095 - DNA, 12 bp, Homo sapiens
tgaacctgccct

SEQ ID NO: 5026096 - DNA, 17 bp, Homo sapiens
tgaactaaactttcaca

SEQ ID NO: 5026097 - DNA, 18 bp, Homo sapiens
tgaactccttccccactt

SEQ ID NO: 5026098 - DNA, 14 bp, Homo sapiens
tgaactgaactctg

SEQ ID NO: 5026099 - DNA, 16 bp, Homo sapiens
tgaagactatgaaaat

SEQ ID NO: 5026100 - DNA, 22 bp, Homo sapiens
tgaagagccggtggtgcccgtg

SEQ ID NO: 5026101 - DNA, 14 bp, Homo sapiens
tgaagcattttata

SEQ ID NO: 5026102 - DNA, 15 bp, Homo sapiens
tgaagcattttataa

SEQ ID NO: 5026103 - DNA, 22 bp, Homo sapiens
tgaagcattttataaatcgctt

SEQ ID NO: 5026104 - DNA, 11 bp, Homo sapiens
tgaagccagct

SEQ ID NO: 5026105 - DNA, 15 bp, Homo sapiens
tgaagggcaagaaat

SEQ ID NO: 5026106 - DNA, 21 bp, Homo sapiens
tgaaggggtgcacccacctgt

SEQ ID NO: 5026107 - DNA, 17 bp, Homo sapiens
tgaagtgagcacagcct

SEQ ID NO: 5026108 - DNA, 17 bp, Homo sapiens
tgaataccactctgtaa

SEQ ID NO: 5026109 - DNA, 23 bp, Homo sapiens
tgaataccactctgtaattgcaa

SEQ ID NO: 5026110 - DNA, 21 bp, Homo sapiens
tgaatatacagcaggtgctca

SEQ ID NO: 5026111 - DNA, 14 bp, Homo sapiens
tgaatatctttcga

SEQ ID NO: 5026112 - DNA, 17 bp, Homo sapiens
tgaatcagccagtctca

SEQ ID NO: 5026113 - DNA, 19 bp, Homo sapiens
tgaatcatggtttttctta

SEQ ID NO: 5026114 - DNA, 16 bp, Homo sapiens
tgaatgatttttcttt

SEQ ID NO: 5026115 - DNA, 15 bp, Homo sapiens
tgaatgtttttctaa

SEQ ID NO: 5026116 - DNA, 14 bp, Homo sapiens
tgaattattacagt

SEQ ID NO: 5026117 - DNA, 16 bp, Homo sapiens
tgaattattacagtgt

SEQ ID NO: 5026118 - DNA, 17 bp, Homo sapiens
tgaattattacagtgtt

SEQ ID NO: 5026119 - DNA, 13 bp, Homo sapiens
tgaattattcaat

SEQ ID NO: 5026120 - DNA, 15 bp, Homo sapiens
tgaattattcaattt

SEQ ID NO: 5026121 - DNA, 17 bp, Homo sapiens
tgacaaaccatttccaa

SEQ ID NO: 5026122 - DNA, 13 bp, Homo sapiens
tgacaacctccat

SEQ ID NO: 5026123 - DNA, 18 bp, Homo sapiens
tgacacctaactcttctt

SEQ ID NO: 5026124 - DNA, 14 bp, Homo sapiens
tgacagctttctgg

SEQ ID NO: 5026125 - DNA, 18 bp, Homo sapiens
tggcgtctgctctggtgg

SEQ ID NO: 5026126 - DNA, 20 bp, Homo sapiens
tggcgtctgctctggtggct

SEQ ID NO: 5026127 - DNA, 19 bp, Homo sapiens
tggctatagatgtcttttc

SEQ ID NO: 5026128 - DNA, 16 bp, Homo sapiens
tggctccaaaccctcg

SEQ ID NO: 5026129 - DNA, 20 bp, Homo sapiens
tggctccaaaccctcgaggc

SEQ ID NO: 5026130 - DNA, 20 bp, Homo sapiens
tggctctgaggtgcctgtcc

SEQ ID NO: 5026131 - DNA, 21 bp, Homo sapiens
tggctctgaggtgcctgtccc

SEQ ID NO: 5026132 - DNA, 22 bp, Homo sapiens
tgggaaagcccctgcccctcct

SEQ ID NO: 5026133 - DNA, 21 bp, Homo sapiens
tgggaacagcatggaggcaga

SEQ ID NO: 5026134 - DNA, 15 bp, Homo sapiens
tgggaaggccagctg

SEQ ID NO: 5026135 - DNA, 22 bp, Homo sapiens
tgggaccctgtccggcccagtg

SEQ ID NO: 5026136 - DNA, 14 bp, Homo sapiens
tgggaggtgcgtgt

SEQ ID NO: 5026137 - DNA, 18 bp, Homo sapiens
tgggaggtgcgtgttcag

SEQ ID NO: 5026138 - DNA, 21 bp, Homo sapiens
tgggaggtgcgtgttcagcag

SEQ ID NO: 5026139 - DNA, 23 bp, Homo sapiens
tgggaggtgcgtgttcagcagaa

SEQ ID NO: 5026140 - DNA, 17 bp, Homo sapiens
tgggatgtcacagtcca

SEQ ID NO: 5026141 - DNA, 22 bp, Homo sapiens
tgggcaagctggcggctggggt

SEQ ID NO: 5026142 - DNA, 17 bp, Homo sapiens
tgggccagaatttcaaa

SEQ ID NO: 5026143 - DNA, 18 bp, Homo sapiens
tgggccagtccccgagga

SEQ ID NO: 5026144 - DNA, 13 bp, Homo sapiens
tgggcccctgcac

SEQ ID NO: 5026145 - DNA, 21 bp, Homo sapiens
tgggccggcttcatgccagct

SEQ ID NO: 5026146 - DNA, 22 bp, Homo sapiens
tgggcctcagtgtgcccatctg

SEQ ID NO: 5026147 - DNA, 20 bp, Homo sapiens
tgggctctgcaattcccctc

SEQ ID NO: 5026148 - DNA, 14 bp, Homo sapiens
tgggctctggctct

SEQ ID NO: 5026149 - DNA, 19 bp, Homo sapiens
tgggctgaacactccaatt

SEQ ID NO: 5026150 - DNA, 20 bp, Homo sapiens
tgggctgcagagtctgcccc

SEQ ID NO: 5026151 - DNA, 22 bp, Homo sapiens
tggggaaaatggccatgcagga

SEQ ID NO: 5026152 - DNA, 21 bp, Homo sapiens
tggggagacagttgagagcgg

SEQ ID NO: 5026153 - DNA, 15 bp, Homo sapiens
tggggccggggctga

SEQ ID NO: 5026154 - DNA, 18 bp, Homo sapiens
tgggggttgtaaattggc

SEQ ID NO: 5026155 - DNA, 20 bp, Homo sapiens
tggggtcctggagcagacca

SEQ ID NO: 5026156 - DNA, 14 bp, Homo sapiens
tggggtctgacccc

SEQ ID NO: 5026157 - DNA, 18 bp, Homo sapiens
tggggttatctctgtgtt

SEQ ID NO: 5026158 - DNA, 18 bp, Homo sapiens
tgggtcccgcactctgcc

SEQ ID NO: 5026159 - DNA, 14 bp, Homo sapiens
tgggtctgtgcatt

SEQ ID NO: 5026160 - DNA, 22 bp, Homo sapiens
tgggtgttatcacctagctgaa

SEQ ID NO: 5026161 - DNA, 15 bp, Homo sapiens
tggtaccctcctggc

SEQ ID NO: 5026162 - DNA, 16 bp, Homo sapiens
tggtaccctcctggct

SEQ ID NO: 5026163 - DNA, 16 bp, Homo sapiens
tggtaggggagggcag

SEQ ID NO: 5026164 - DNA, 23 bp, Homo sapiens
tggtaggggagggcaggcttggg

SEQ ID NO: 5026165 - DNA, 18 bp, Homo sapiens
tggtgacatcaggttttt

SEQ ID NO: 5026166 - DNA, 22 bp, Homo sapiens
tggtgacatcaggtttttcccg

SEQ ID NO: 5026167 - DNA, 17 bp, Homo sapiens
tggtgagagtcaaagct

SEQ ID NO: 5026168 - DNA, 18 bp, Homo sapiens
tggtgagagtcaaagctg

SEQ ID NO: 5026169 - DNA, 19 bp, Homo sapiens
tggtgagagtcaaagctga

SEQ ID NO: 5026170 - DNA, 17 bp, Homo sapiens
tggtgcccgtgcccgca

SEQ ID NO: 5026171 - DNA, 21 bp, Homo sapiens
tggtggagaggcccggcctct

SEQ ID NO: 5026172 - DNA, 19 bp, Homo sapiens
tggtggcttaagtgagcag

SEQ ID NO: 5026173 - DNA, 12 bp, Homo sapiens
tggtgtgatctt

SEQ ID NO: 5026174 - DNA, 20 bp, Homo sapiens
tggttcccgtttctccacct

SEQ ID NO: 5026175 - DNA, 19 bp, Homo sapiens
tggttcttgtattaagaat

SEQ ID NO: 5026176 - DNA, 18 bp, Homo sapiens
tggttgctttaatatcat

SEQ ID NO: 5026177 - DNA, 15 bp, Homo sapiens
tgtaaaggggcagct

SEQ ID NO: 5026178 - DNA, 12 bp, Homo sapiens
tgtaaattggca

SEQ ID NO: 5026179 - DNA, 14 bp, Homo sapiens
tgtaaccttgggtg

SEQ ID NO: 5026180 - DNA, 21 bp, Homo sapiens
tgtaaccttgggtggcccctg

SEQ ID NO: 5026181 - DNA, 21 bp, Homo sapiens
tgtaagatttgtttttaaact

SEQ ID NO: 5026182 - DNA, 23 bp, Homo sapiens
tgtaagatttgtttttaaactgt

SEQ ID NO: 5026183 - DNA, 23 bp, Homo sapiens
tgtaattttacacgcttttgtga

SEQ ID NO: 5026184 - DNA, 23 bp, Homo sapiens
tgtacaaggacagcccctcctcc

SEQ ID NO: 5026185 - DNA, 18 bp, Homo sapiens
tgtacaatgtacacactg

SEQ ID NO: 5026186 - DNA, 19 bp, Homo sapiens
tgtacaggaagtagttcta

SEQ ID NO: 5026187 - DNA, 21 bp, Homo sapiens
tgtaccttttgaggagcccca

SEQ ID NO: 5026188 - DNA, 22 bp, Homo sapiens
tgtaccttttgaggagccccag

SEQ ID NO: 5026189 - DNA, 19 bp, Homo sapiens
tgtactgttctgtgtcttt

SEQ ID NO: 5026190 - DNA, 22 bp, Homo sapiens
tgtacttggagtattggggtct

SEQ ID NO: 5026191 - DNA, 16 bp, Homo sapiens
tgtataaacaagaaaa

SEQ ID NO: 5026192 - DNA, 16 bp, Homo sapiens
tgtataagtccttgca

SEQ ID NO: 5026193 - DNA, 19 bp, Homo sapiens
tgtataagtccttgcaaga

SEQ ID NO: 5026194 - DNA, 21 bp, Homo sapiens
tgtatagtgtctattatcaca

SEQ ID NO: 5026195 - DNA, 11 bp, Homo sapiens
tgtatctgtgt

SEQ ID NO: 5026196 - DNA, 13 bp, Homo sapiens
tgtatctgtgtag

SEQ ID NO: 5026197 - DNA, 12 bp, Homo sapiens
tgtattaagaat

SEQ ID NO: 5026198 - DNA, 15 bp, Homo sapiens
tgtattgtgcaatgt

SEQ ID NO: 5026199 - DNA, 20 bp, Homo sapiens
tgtcaaactgaaattcagag

SEQ ID NO: 5026200 - DNA, 20 bp, Homo sapiens
tgtcacagtccaaccagaaa

SEQ ID NO: 5026201 - DNA, 22 bp, Homo sapiens
tgtcacagtccaaccagaaaca

SEQ ID NO: 5026202 - DNA, 14 bp, Homo sapiens
tgtcattggaagcc

SEQ ID NO: 5026203 - DNA, 15 bp, Homo sapiens
tgtccacacccagct

SEQ ID NO: 5026204 - DNA, 17 bp, Homo sapiens
tgtccagctcccgctgt

SEQ ID NO: 5026205 - DNA, 15 bp, Homo sapiens
tgtccgctgggtggt

SEQ ID NO: 5026206 - DNA, 15 bp, Homo sapiens
tgtccggcccagtgc

SEQ ID NO: 5026207 - DNA, 19 bp, Homo sapiens
tgtccggcccagtgccact

SEQ ID NO: 5026208 - DNA, 22 bp, Homo sapiens
tgtcctgcctaaggctgaactt

SEQ ID NO: 5026209 - DNA, 18 bp, Homo sapiens
tgtcctggtggtattttc

SEQ ID NO: 5026210 - DNA, 20 bp, Homo sapiens
tgtccttgaaggactaatag

SEQ ID NO: 5026211 - DNA, 13 bp, Homo sapiens
tgtcctttccctt

SEQ ID NO: 5026212 - DNA, 23 bp, Homo sapiens
tgtcctttcccttcagtaccctc

SEQ ID NO: 5026213 - DNA, 22 bp, Homo sapiens
tgtccttttcataggtctgaaa

SEQ ID NO: 5026214 - DNA, 18 bp, Homo sapiens
tgtcctttttcactttga

SEQ ID NO: 5026215 - DNA, 15 bp, Homo sapiens
tgtcgggcaccagcc

SEQ ID NO: 5026216 - DNA, 13 bp, Homo sapiens
tgtcgtgggatgg

SEQ ID NO: 5026217 - DNA, 17 bp, Homo sapiens
tgtctaggactgcagtg

SEQ ID NO: 5026218 - DNA, 19 bp, Homo sapiens
tgtctaggactgcagtgtg

SEQ ID NO: 5026219 - DNA, 14 bp, Homo sapiens
tgtctataaagcat

SEQ ID NO: 5026220 - DNA, 18 bp, Homo sapiens
tgtctattatcacattaa

SEQ ID NO: 5026221 - DNA, 17 bp, Homo sapiens
tgtctccctcccctctc

SEQ ID NO: 5026222 - DNA, 23 bp, Homo sapiens
tgtctccctcccctctcagaaca

SEQ ID NO: 5026223 - DNA, 17 bp, Homo sapiens
tgtctctcctgcccctt

SEQ ID NO: 5026224 - DNA, 19 bp, Homo sapiens
tgtctctgatgcagcttat

SEQ ID NO: 5026225 - DNA, 20 bp, Homo sapiens
tgtctctgatgcagcttata

SEQ ID NO: 5026226 - DNA, 15 bp, Homo sapiens
tgtctggccaggcct

SEQ ID NO: 5026227 - DNA, 15 bp, Homo sapiens
tgtctttagatagcc

SEQ ID NO: 5026228 - DNA, 20 bp, Homo sapiens
tgtcttttcccatttatcta

SEQ ID NO: 5026229 - DNA, 14 bp, Homo sapiens
tgtctttttttgta

SEQ ID NO: 5026230 - DNA, 22 bp, Homo sapiens
tgtctttttttgtatagttaac

SEQ ID NO: 5026231 - DNA, 23 bp, Homo sapiens
tgtctttttttgtatagttaaca

SEQ ID NO: 5026232 - DNA, 14 bp, Homo sapiens
tgtgaactaaactt

SEQ ID NO: 5026233 - DNA, 14 bp, Homo sapiens
tgtgaatcgcagct

SEQ ID NO: 5026234 - DNA, 19 bp, Homo sapiens
tgtgaatcgcagctgtggg

SEQ ID NO: 5026235 - DNA, 19 bp, Homo sapiens
tgtgaattgaaatgttcgt

SEQ ID NO: 5026236 - DNA, 15 bp, Homo sapiens
tgtgacaggcagcag

SEQ ID NO: 5026237 - DNA, 21 bp, Homo sapiens
ttacttgtaaatataaagacg

SEQ ID NO: 5026238 - DNA, 23 bp, Homo sapiens
ttagaaaaccagctcagcactgc

SEQ ID NO: 5026239 - DNA, 13 bp, Homo sapiens
ttagaataaattc

SEQ ID NO: 5026240 - DNA, 16 bp, Homo sapiens
ttagaataaattccca

SEQ ID NO: 5026241 - DNA, 17 bp, Homo sapiens
ttagaatcaaacatttt

SEQ ID NO: 5026242 - DNA, 16 bp, Homo sapiens
ttagactttaacataa

SEQ ID NO: 5026243 - DNA, 22 bp, Homo sapiens
ttagactttaacataagctatt

SEQ ID NO: 5026244 - DNA, 17 bp, Homo sapiens
ttagagtttctgtttga

SEQ ID NO: 5026245 - DNA, 17 bp, Homo sapiens
ttagatagccctgtcct

SEQ ID NO: 5026246 - DNA, 17 bp, Homo sapiens
ttagcatcaagttctcc

SEQ ID NO: 5026247 - DNA, 23 bp, Homo sapiens
ttagctaataaaaagcttttgtc

SEQ ID NO: 5026248 - DNA, 22 bp, Homo sapiens
ttaggttccatcctttacgtgt

SEQ ID NO: 5026249 - DNA, 16 bp, Homo sapiens
ttagtattgttgtcct

SEQ ID NO: 5026250 - DNA, 17 bp, Homo sapiens
ttagtattgttgtcctt

SEQ ID NO: 5026251 - DNA, 20 bp, Homo sapiens
ttagtattgttgtccttttc

SEQ ID NO: 5026252 - DNA, 22 bp, Homo sapiens
ttagtattgttgtccttttcat

SEQ ID NO: 5026253 - DNA, 22 bp, Homo sapiens
ttagtctcagtttgtgtgtctt

SEQ ID NO: 5026254 - DNA, 23 bp, Homo sapiens
ttagtctcagtttgtgtgtctta

SEQ ID NO: 5026255 - DNA, 14 bp, Homo sapiens
ttataaatcgcttt

SEQ ID NO: 5026256 - DNA, 18 bp, Homo sapiens
ttataaatcgcttttgat

SEQ ID NO: 5026257 - DNA, 17 bp, Homo sapiens
ttataagcatcattatt

SEQ ID NO: 5026258 - DNA, 18 bp, Homo sapiens
ttataagtcattgtatgt

SEQ ID NO: 5026259 - DNA, 14 bp, Homo sapiens
ttatacgaaataat

SEQ ID NO: 5026260 - DNA, 18 bp, Homo sapiens
ttatatataaatatatta

SEQ ID NO: 5026261 - DNA, 16 bp, Homo sapiens
ttatcgttttcttaaa

SEQ ID NO: 5026262 - DNA, 11 bp, Homo sapiens
ttatgaacagc

SEQ ID NO: 5026263 - DNA, 22 bp, Homo sapiens
ttatgacttcattaataataaa

SEQ ID NO: 5026264 - DNA, 11 bp, Homo sapiens
ttatgtaattt

SEQ ID NO: 5026265 - DNA, 20 bp, Homo sapiens
ttatgtactagtgttctgtt

SEQ ID NO: 5026266 - DNA, 16 bp, Homo sapiens
ttatgttatatataaa

SEQ ID NO: 5026267 - DNA, 13 bp, Homo sapiens
ttattaaagaaaa

SEQ ID NO: 5026268 - DNA, 20 bp, Homo sapiens
ttattaaagaaaaaaatgta

SEQ ID NO: 5026269 - DNA, 22 bp, Homo sapiens
ttattaaagaaaaaaatgtatt

SEQ ID NO: 5026270 - DNA, 23 bp, Homo sapiens
ttattaaagaaaaaaatgtattt

SEQ ID NO: 5026271 - DNA, 15 bp, Homo sapiens
ttattacttgtaaat

SEQ ID NO: 5026272 - DNA, 18 bp, Homo sapiens
ttattagtattgttgtcc

SEQ ID NO: 5026273 - DNA, 17 bp, Homo sapiens
ttattcaatttatttga

SEQ ID NO: 5026274 - DNA, 15 bp, Homo sapiens
ttattgcgctgctac

SEQ ID NO: 5026275 - DNA, 14 bp, Homo sapiens
ttatttttaaagat

SEQ ID NO: 5026276 - DNA, 12 bp, Homo sapiens
ttcaaactactt

SEQ ID NO: 5026277 - DNA, 13 bp, Homo sapiens
ttcaaactacttt

SEQ ID NO: 5026278 - DNA, 15 bp, Homo sapiens
ttcaaagcaaatgtc

SEQ ID NO: 5026279 - DNA, 18 bp, Homo sapiens
ttcaaattgctgcttgga

SEQ ID NO: 5026280 - DNA, 20 bp, Homo sapiens
ttcaagttttgggtatgttt

SEQ ID NO: 5026281 - DNA, 23 bp, Homo sapiens
ttcaatcagagctccagtttgca

SEQ ID NO: 5026282 - DNA, 15 bp, Homo sapiens
ttcacagctcctccc

SEQ ID NO: 5026283 - DNA, 16 bp, Homo sapiens
ttcaccatggccccct

SEQ ID NO: 5026284 - DNA, 21 bp, Homo sapiens
ttcacctaagtctctgtgaat

SEQ ID NO: 5026285 - DNA, 15 bp, Homo sapiens
ttcaccttggaaggg

SEQ ID NO: 5026286 - DNA, 23 bp, Homo sapiens
ttcactttgaaaagttggaagga

SEQ ID NO: 5026287 - DNA, 13 bp, Homo sapiens
ttcagcagaacct

SEQ ID NO: 5026288 - DNA, 23 bp, Homo sapiens
ttcagcagaacctgcacacagga

SEQ ID NO: 5026289 - DNA, 21 bp, Homo sapiens
ttcagtaccctctcagctcca

SEQ ID NO: 5026290 - DNA, 15 bp, Homo sapiens
ttcagttgtctctga

SEQ ID NO: 5026291 - DNA, 16 bp, Homo sapiens
ttcatacctacatgta

SEQ ID NO: 5026292 - DNA, 17 bp, Homo sapiens
ttcatagatgcaggagg

SEQ ID NO: 5026293 - DNA, 21 bp, Homo sapiens
ttcatatagttagctaataaa

SEQ ID NO: 5026294 - DNA, 15 bp, Homo sapiens
ttcatccataactga

SEQ ID NO: 5026295 - DNA, 17 bp, Homo sapiens
ttcatccataactgaac

SEQ ID NO: 5026296 - DNA, 16 bp, Homo sapiens
ttcatcgtaaagtgct

SEQ ID NO: 5026297 - DNA, 20 bp, Homo sapiens
ttcatgcaaactctttggtc

SEQ ID NO: 5026298 - DNA, 21 bp, Homo sapiens
ttcattaataataaattccct

SEQ ID NO: 5026299 - DNA, 12 bp, Homo sapiens
ttcattctcctt

SEQ ID NO: 5026300 - DNA, 14 bp, Homo sapiens
ttccagctcctgta

SEQ ID NO: 5026301 - DNA, 22 bp, Homo sapiens
ttccagtgaaatcagttactct

SEQ ID NO: 5026302 - DNA, 14 bp, Homo sapiens
ttccatggattttg

SEQ ID NO: 5026303 - DNA, 23 bp, Homo sapiens
ttccattacaagtatttttaatt

SEQ ID NO: 5026304 - DNA, 14 bp, Homo sapiens
ttccatttcatttg

SEQ ID NO: 5026305 - DNA, 16 bp, Homo sapiens
ttcccaagggctgccg

SEQ ID NO: 5026306 - DNA, 16 bp, Homo sapiens
ttcccacattaaagaa

SEQ ID NO: 5026307 - DNA, 21 bp, Homo sapiens
ttccccgatgtcccctgcggg

SEQ ID NO: 5026308 - DNA, 14 bp, Homo sapiens
ttcccgtttctcca

SEQ ID NO: 5026309 - DNA, 12 bp, Homo sapiens
ttccctggcctt

SEQ ID NO: 5026310 - DNA, 19 bp, Homo sapiens
ttcccttcagtaccctctc

SEQ ID NO: 5026311 - DNA, 15 bp, Homo sapiens
ttcccttcctgccag

SEQ ID NO: 5026312 - DNA, 20 bp, Homo sapiens
ttccgtaggtagatgtgtaa

SEQ ID NO: 5026313 - DNA, 17 bp, Homo sapiens
ttcctagcacacacttt

SEQ ID NO: 5026314 - DNA, 19 bp, Homo sapiens
ttcctagcacacacttttg

SEQ ID NO: 5026315 - DNA, 13 bp, Homo sapiens
ttcctcatttgtt

SEQ ID NO: 5026316 - DNA, 20 bp, Homo sapiens
ttcctcatttgttcattaaa

SEQ ID NO: 5026317 - DNA, 21 bp, Homo sapiens
ttcctctgaggctgaaattca

SEQ ID NO: 5026318 - DNA, 21 bp, Homo sapiens
ttcctgcaatgaagtctctga

SEQ ID NO: 5026319 - DNA, 15 bp, Homo sapiens
ttcctggacactcag

SEQ ID NO: 5026320 - DNA, 20 bp, Homo sapiens
ttccttcaaagcaaatgtct

SEQ ID NO: 5026321 - DNA, 15 bp, Homo sapiens
ttcctttaaaaaact

SEQ ID NO: 5026322 - DNA, 22 bp, Homo sapiens
ttcctttgaacttgattgccta

SEQ ID NO: 5026323 - DNA, 14 bp, Homo sapiens
ttcgacactgttct

SEQ ID NO: 5026324 - DNA, 22 bp, Homo sapiens
ttcgagatcatcacttccttgc

SEQ ID NO: 5026325 - DNA, 20 bp, Homo sapiens
ttcgataaacaacaaggtgg

SEQ ID NO: 5026326 - DNA, 14 bp, Homo sapiens
ttctaaggaatatg

SEQ ID NO: 5026327 - DNA, 15 bp, Homo sapiens
ttctaagtaaataca

SEQ ID NO: 5026328 - DNA, 21 bp, Homo sapiens
ttctacaactcatacactcgt

SEQ ID NO: 5026329 - DNA, 18 bp, Homo sapiens
ttctacccaacggccctg

SEQ ID NO: 5026330 - DNA, 18 bp, Homo sapiens
ttctagcccgaatacaaa

SEQ ID NO: 5026331 - DNA, 16 bp, Homo sapiens
ttctagcgcagttttt

SEQ ID NO: 5026332 - DNA, 20 bp, Homo sapiens
ttctaggcatctctgtactt

SEQ ID NO: 5026333 - DNA, 21 bp, Homo sapiens
ttctcagaaggcaaatgactt

SEQ ID NO: 5026334 - DNA, 21 bp, Homo sapiens
ttctccacctagactgtaaac

SEQ ID NO: 5026335 - DNA, 21 bp, Homo sapiens
ttctcctgcctgtgctgtgac

SEQ ID NO: 5026336 - DNA, 21 bp, Homo sapiens
ttctccttgaatatctttcga

SEQ ID NO: 5026337 - DNA, 18 bp, Homo sapiens
ttctccttttcctctctc

SEQ ID NO: 5026338 - DNA, 19 bp, Homo sapiens
ttctcgtcctcgtttgtgt

SEQ ID NO: 5026339 - DNA, 22 bp, Homo sapiens
ttctcttaggtggctctgggaa

SEQ ID NO: 5026340 - DNA, 15 bp, Homo sapiens
ttctgaaacacacga

SEQ ID NO: 5026341 - DNA, 23 bp, Homo sapiens
ttctgcctttgatgttacagatt

SEQ ID NO: 5026342 - DNA, 17 bp, Homo sapiens
ttctggaatttgttcaa

SEQ ID NO: 5026343 - DNA, 20 bp, Homo sapiens
ttctggaatttgttcaagtt

SEQ ID NO: 5026344 - DNA, 15 bp, Homo sapiens
ttctggcagaggagg

SEQ ID NO: 5026345 - DNA, 12 bp, Homo sapiens
ttctggtgtgaa

SEQ ID NO: 5026346 - DNA, 16 bp, Homo sapiens
ttctgtgcttggattt

SEQ ID NO: 5026347 - DNA, 23 bp, Homo sapiens
ttctgtgtctttcacagctcctc

SEQ ID NO: 5026348 - DNA, 14 bp, Homo sapiens
ttctgttaactgaa

SEQ ID NO: 5026349 - DNA, 21 bp, Homo sapiens
tttttgtatagttaacacact

SEQ ID NO: 5026350 - DNA, 15 bp, Homo sapiens
tttttgttagcaaag

SEQ ID NO: 5026351 - DNA, 13 bp, Homo sapiens
tttttgttgacat

SEQ ID NO: 5026352 - DNA, 12 bp, Homo sapiens
ttttttgtagtt

SEQ ID NO: 5026353 - DNA, 15 bp, Homo sapiens
ttttttgtatagtta

SEQ ID NO: 5026354 - DNA, 12 bp, Homo sapiens
ttttttgttgac

SEQ ID NO: 5026355 - DNA, 14 bp, Homo sapiens
gaccttcctcatcc

SEQ ID NO: 5026356 - DNA, 22 bp, Homo sapiens
gaccttcctcatccaccccatc

SEQ ID NO: 5026357 - DNA, 16 bp, Homo sapiens
gacgcttgtgacagtg

SEQ ID NO: 5026358 - DNA, 21 bp, Homo sapiens
gacgcttgtgacagtgcctct

SEQ ID NO: 5026359 - DNA, 13 bp, Homo sapiens
gacgctttgtctg

SEQ ID NO: 5026360 - DNA, 23 bp, Homo sapiens
gactcctgcacacgctccttcct

SEQ ID NO: 5026361 - DNA, 17 bp, Homo sapiens
cccttaccactgctctg

SEQ ID NO: 5026362 - DNA, 20 bp, Homo sapiens
cccttgatttaaacacacag

SEQ ID NO: 5026363 - DNA, 15 bp, Homo sapiens
ccctttttctccagc

SEQ ID NO: 5026364 - DNA, 18 bp, Homo sapiens
ccctttttttacatttca

SEQ ID NO: 5026365 - DNA, 15 bp, Homo sapiens
ccgaatgtgtcttta

SEQ ID NO: 5026366 - DNA, 17 bp, Homo sapiens
ccgacttggagactcct

SEQ ID NO: 5026367 - DNA, 19 bp, Homo sapiens
ccgacttggagactcctgg

SEQ ID NO: 5026368 - DNA, 24 bp, Homo sapiens
ccgacttggagactcctggtctgt

SEQ ID NO: 5026369 - DNA, 19 bp, Homo sapiens
ccgagcctggctccaaacc

SEQ ID NO: 5026370 - DNA, 15 bp, Homo sapiens
ccgaggagctgggcc

SEQ ID NO: 5026371 - DNA, 14 bp, Homo sapiens
ccgaggctgctaga

SEQ ID NO: 5026372 - DNA, 21 bp, Homo sapiens
ccgcaccagcccgaacaccat

SEQ ID NO: 5026373 - DNA, 18 bp, Homo sapiens
ccgcacgcctctccctgc

SEQ ID NO: 5026374 - DNA, 18 bp, Homo sapiens
ccgcaggaactgggctgg

SEQ ID NO: 5026375 - DNA, 11 bp, Homo sapiens
ccgcagggcca

SEQ ID NO: 5026376 - DNA, 14 bp, Homo sapiens
ccgccagctgccgc

SEQ ID NO: 5026377 - DNA, 17 bp, Homo sapiens
ccgccagctgccgcacc

SEQ ID NO: 5026378 - DNA, 16 bp, Homo sapiens
ccgcctgccctcatgg

SEQ ID NO: 5026379 - DNA, 19 bp, Homo sapiens
ccgctctacatcttctgcc

SEQ ID NO: 5026380 - DNA, 22 bp, Homo sapiens
ccggaagccaaacctctgtgag

SEQ ID NO: 5026381 - DNA, 18 bp, Homo sapiens
ccggcatgtttccagcag

SEQ ID NO: 5026382 - DNA, 23 bp, Homo sapiens
ccggccccctccccccagactct

SEQ ID NO: 5026383 - DNA, 18 bp, Homo sapiens
ccgggaccccgagcctgg

SEQ ID NO: 5026384 - DNA, 11 bp, Homo sapiens
ccggggctgag

SEQ ID NO: 5026385 - DNA, 22 bp, Homo sapiens
ccggtctatgtcgagagctggc

SEQ ID NO: 5026386 - DNA, 13 bp, Homo sapiens
ccggtggtgcccg

SEQ ID NO: 5026387 - DNA, 15 bp, Homo sapiens
ccgtggggtgctgcc

SEQ ID NO: 5026388 - DNA, 16 bp, Homo sapiens
ccgtggggtgctgccc

SEQ ID NO: 5026389 - DNA, 19 bp, Homo sapiens
ccgtggggtgctgccctta

SEQ ID NO: 5026390 - DNA, 12 bp, Homo sapiens
ccgttgtgagct

SEQ ID NO: 5026391 - DNA, 22 bp, Homo sapiens
cctaacaccccctagcaaaact

SEQ ID NO: 5026392 - DNA, 17 bp, Homo sapiens
cctactccgctcactga

SEQ ID NO: 5026393 - DNA, 15 bp, Homo sapiens
cctaggcagcctgca

SEQ ID NO: 5026394 - DNA, 22 bp, Homo sapiens
cctcacagtattgctcacccag

SEQ ID NO: 5026395 - DNA, 13 bp, Homo sapiens
cctcacctcctct

SEQ ID NO: 5026396 - DNA, 12 bp, Homo sapiens
cctcagcctctc

SEQ ID NO: 5026397 - DNA, 23 bp, Homo sapiens
cctcaggcagcgtgtgggtcccg

SEQ ID NO: 5026398 - DNA, 20 bp, Homo sapiens
cctcatcccgtgttctcctt

SEQ ID NO: 5026399 - DNA, 19 bp, Homo sapiens
cctcatgcccagctctctg

SEQ ID NO: 5026400 - DNA, 20 bp, Homo sapiens
cctcatgcccagctctctga

SEQ ID NO: 5026401 - DNA, 15 bp, Homo sapiens
cctcatggcccctct

SEQ ID NO: 5026402 - DNA, 16 bp, Homo sapiens
cctcatggcccctctg

SEQ ID NO: 5026403 - DNA, 15 bp, Homo sapiens
cctcatttgttcatt

SEQ ID NO: 5026404 - DNA, 14 bp, Homo sapiens
cctccatagccacg

SEQ ID NO: 5026405 - DNA, 14 bp, Homo sapiens
cctccccctgtccc

SEQ ID NO: 5026406 - DNA, 15 bp, Homo sapiens
cctcccctcctcctg

SEQ ID NO: 5026407 - DNA, 14 bp, Homo sapiens
cctcccctctcaga

SEQ ID NO: 5026408 - DNA, 15 bp, Homo sapiens
cctcccctctcagaa

SEQ ID NO: 5026409 - DNA, 18 bp, Homo sapiens
cctcccctctcagaacat

SEQ ID NO: 5026410 - DNA, 14 bp, Homo sapiens
cctccgaggccagt

SEQ ID NO: 5026411 - DNA, 13 bp, Homo sapiens
cctcctcatcccg

SEQ ID NO: 5026412 - DNA, 20 bp, Homo sapiens
cctcctggagctctgtgggt

SEQ ID NO: 5026413 - DNA, 15 bp, Homo sapiens
cctcggctctggagg

SEQ ID NO: 5026414 - DNA, 14 bp, Homo sapiens
cctcggggacacca

SEQ ID NO: 5026415 - DNA, 15 bp, Homo sapiens
cctcgtttgtgttct

SEQ ID NO: 5026416 - DNA, 14 bp, Homo sapiens
cctctcagaacata

SEQ ID NO: 5026417 - DNA, 16 bp, Homo sapiens
cctctcagctccaggt

SEQ ID NO: 5026418 - DNA, 18 bp, Homo sapiens
cctctcagctccaggtgg

SEQ ID NO: 5026419 - DNA, 18 bp, Homo sapiens
cctctcccctcagcctct

SEQ ID NO: 5026420 - DNA, 16 bp, Homo sapiens
cctctcgagggcaggg

SEQ ID NO: 5026421 - DNA, 14 bp, Homo sapiens
cctctgacctgcac

SEQ ID NO: 5026422 - DNA, 16 bp, Homo sapiens
cctctgcaactgctca

SEQ ID NO: 5026423 - DNA, 22 bp, Homo sapiens
cctctgccgctgcttccaggct

SEQ ID NO: 5026424 - DNA, 18 bp, Homo sapiens
cctctgctgatcctccca

SEQ ID NO: 5026425 - DNA, 19 bp, Homo sapiens
cctctgctgctgtccctcc

SEQ ID NO: 5026426 - DNA, 20 bp, Homo sapiens
cctctggaggggtgtggctc

SEQ ID NO: 5026427 - DNA, 22 bp, Homo sapiens
cctctggaggggtgtggctcct

SEQ ID NO: 5026428 - DNA, 23 bp, Homo sapiens
cctctggcattagaattatttaa

SEQ ID NO: 5026429 - DNA, 19 bp, Homo sapiens
cctctgggtctcagtgtcc

SEQ ID NO: 5026430 - DNA, 22 bp, Homo sapiens
cctctgggtctcagtgtcctca

SEQ ID NO: 5026431 - DNA, 22 bp, Homo sapiens
cctctgtcttgtgaaggcaggg

SEQ ID NO: 5026432 - DNA, 22 bp, Homo sapiens
cctctgttgccaaggctggagt

SEQ ID NO: 5026433 - DNA, 18 bp, Homo sapiens
cctctttggctcccctgt

SEQ ID NO: 5026434 - DNA, 22 bp, Homo sapiens
cctgagaccagccaacctgggg

SEQ ID NO: 5026435 - DNA, 18 bp, Homo sapiens
cctgagatacttcccaaa

SEQ ID NO: 5026436 - DNA, 19 bp, Homo sapiens
cctgagtgcttgcttttca

SEQ ID NO: 5026437 - DNA, 17 bp, Homo sapiens
cctgataaagcacagct

SEQ ID NO: 5026438 - DNA, 21 bp, Homo sapiens
cctgatccgtccgaggctgct

SEQ ID NO: 5026439 - DNA, 11 bp, Homo sapiens
cctgcacacag

SEQ ID NO: 5026440 - DNA, 16 bp, Homo sapiens
cctgcacacaggacag

SEQ ID NO: 5026441 - DNA, 21 bp, Homo sapiens
cctgcacacgctccttcctct

SEQ ID NO: 5026442 - DNA, 17 bp, Homo sapiens
cctgcactccctcctgg

SEQ ID NO: 5026443 - DNA, 13 bp, Homo sapiens
cctgcagccagct

SEQ ID NO: 5026444 - DNA, 18 bp, Homo sapiens
cctgcaggcgtgacctga

SEQ ID NO: 5026445 - DNA, 17 bp, Homo sapiens
cctgccaagactcctca

SEQ ID NO: 5026446 - DNA, 18 bp, Homo sapiens
cctgccaagactcctcag

SEQ ID NO: 5026447 - DNA, 15 bp, Homo sapiens
atcccatttcccaaa

SEQ ID NO: 5026448 - DNA, 23 bp, Homo sapiens
atccgcaatgtggagcagcagcc

SEQ ID NO: 5026449 - DNA, 12 bp, Homo sapiens
atcctcccaggc

SEQ ID NO: 5026450 - DNA, 12 bp, Homo sapiens
atcctgggctgg

SEQ ID NO: 5026451 - DNA, 21 bp, Homo sapiens
atcctgggctgggtggcccct

SEQ ID NO: 5026452 - DNA, 11 bp, Homo sapiens
atcctgtgtgt

SEQ ID NO: 5026453 - DNA, 18 bp, Homo sapiens
atcgatgagcgccacctc

SEQ ID NO: 5026454 - DNA, 20 bp, Homo sapiens
atctattggctgatctatgc

SEQ ID NO: 5026455 - DNA, 18 bp, Homo sapiens
atctcaatgaagccagct

SEQ ID NO: 5026456 - DNA, 20 bp, Homo sapiens
atctccctgagatgggcttc

SEQ ID NO: 5026457 - DNA, 20 bp, Homo sapiens
atctctgcagtttttcccaa

SEQ ID NO: 5026458 - DNA, 17 bp, Homo sapiens
atctctttcacattgtt

SEQ ID NO: 5026459 - DNA, 19 bp, Homo sapiens
atctctttcacattgtttg

SEQ ID NO: 5026460 - DNA, 20 bp, Homo sapiens
atctgacatctctgcaatct

SEQ ID NO: 5026461 - DNA, 13 bp, Homo sapiens
atctgctgaggcc

SEQ ID NO: 5026462 - DNA, 21 bp, Homo sapiens
atctgctgaggcccagtgcat

SEQ ID NO: 5026463 - DNA, 21 bp, Homo sapiens
atctgcttaggagtttaggga

SEQ ID NO: 5026464 - DNA, 17 bp, Homo sapiens
atctgggccagaatttc

SEQ ID NO: 5026465 - DNA, 20 bp, Homo sapiens
atctgtaagagcttgctcca

SEQ ID NO: 5026466 - DNA, 16 bp, Homo sapiens
atctgtttgaggagag

SEQ ID NO: 5026467 - DNA, 18 bp, Homo sapiens
atcttcagttgtctctga

SEQ ID NO: 5026468 - DNA, 24 bp, Homo sapiens
atcttctcagaaggcaaatgactt

SEQ ID NO: 5026469 - DNA, 17 bp, Homo sapiens
atcttgccggtcatttt

SEQ ID NO: 5026470 - DNA, 21 bp, Homo sapiens
atcttggctatgtaattcttg

SEQ ID NO: 5026471 - DNA, 17 bp, Homo sapiens
atgaaaactaaggattt

SEQ ID NO: 5026472 - DNA, 20 bp, Homo sapiens
atgaaagtctagaaataaaa

SEQ ID NO: 5026473 - DNA, 13 bp, Homo sapiens
atgaagcaggagg

SEQ ID NO: 5026474 - DNA, 14 bp, Homo sapiens
atgaagctgtataa

SEQ ID NO: 5026475 - DNA, 18 bp, Homo sapiens
atgaccacactccagctg

SEQ ID NO: 5026476 - DNA, 22 bp, Homo sapiens
atgacggtaagtgttctcatga

SEQ ID NO: 5026477 - DNA, 14 bp, Homo sapiens
atgagcgccacctc

SEQ ID NO: 5026478 - DNA, 20 bp, Homo sapiens
atgagctttatgtaataatg

SEQ ID NO: 5026479 - DNA, 22 bp, Homo sapiens
atgagctttatgtaataatgtg

SEQ ID NO: 5026480 - DNA, 20 bp, Homo sapiens
atgataagttcctttccttt

SEQ ID NO: 5026481 - DNA, 16 bp, Homo sapiens
atgatgtgtgaaaact

SEQ ID NO: 5026482 - DNA, 21 bp, Homo sapiens
atgattcaaattgctgcttgg

SEQ ID NO: 5026483 - DNA, 12 bp, Homo sapiens
atgcaaactctt

SEQ ID NO: 5026484 - DNA, 20 bp, Homo sapiens
atgcaccctcatacacagaa

SEQ ID NO: 5026485 - DNA, 15 bp, Homo sapiens
atgcactttgcttta

SEQ ID NO: 5026486 - DNA, 16 bp, Homo sapiens
atgcactttgctttaa

SEQ ID NO: 5026487 - DNA, 18 bp, Homo sapiens
atgcactttgctttaata

SEQ ID NO: 5026488 - DNA, 20 bp, Homo sapiens
atgcactttgctttaatata

SEQ ID NO: 5026489 - DNA, 21 bp, Homo sapiens
atgcactttgctttaatataa

SEQ ID NO: 5026490 - DNA, 22 bp, Homo sapiens
atgcactttgctttaatataaa

SEQ ID NO: 5026491 - DNA, 21 bp, Homo sapiens
atgcagacctcatgcccagct

SEQ ID NO: 5026492 - DNA, 23 bp, Homo sapiens
atgcagacctcatgcccagctct

SEQ ID NO: 5026493 - DNA, 21 bp, Homo sapiens
atgcagcttatacgaaataat

SEQ ID NO: 5026494 - DNA, 19 bp, Homo sapiens
atgcaggaggctcaggtga

SEQ ID NO: 5026495 - DNA, 19 bp, Homo sapiens
atgccaaattaaaaaagat

SEQ ID NO: 5026496 - DNA, 18 bp, Homo sapiens
atgcccagctctctgacg

SEQ ID NO: 5026497 - DNA, 13 bp, Homo sapiens
atgccccaaagtt

SEQ ID NO: 5026498 - DNA, 17 bp, Homo sapiens
atgcccggcgccgggca

SEQ ID NO: 5026499 - DNA, 17 bp, Homo sapiens
atgctaatttaaagaga

SEQ ID NO: 5026500 - DNA, 15 bp, Homo sapiens
atgcttctaagtaaa

SEQ ID NO: 5026501 - DNA, 20 bp, Homo sapiens
atgcttctaagtaaatacaa

SEQ ID NO: 5026502 - DNA, 22 bp, Homo sapiens
atgcttctaagtaaatacaatt

SEQ ID NO: 5026503 - DNA, 13 bp, Homo sapiens
atgctttaaacat

SEQ ID NO: 5026504 - DNA, 18 bp, Homo sapiens
atgctttaggatgtacag

SEQ ID NO: 5026505 - DNA, 21 bp, Homo sapiens
atggaaagactgggacagccc

SEQ ID NO: 5026506 - DNA, 18 bp, Homo sapiens
atggaaggggcttctgga

SEQ ID NO: 5026507 - DNA, 21 bp, Homo sapiens
atggactccagcctgcctggc

SEQ ID NO: 5026508 - DNA, 14 bp, Homo sapiens
atggagccccacct

SEQ ID NO: 5026509 - DNA, 15 bp, Homo sapiens
atggagccccacctt

SEQ ID NO: 5026510 - DNA, 16 bp, Homo sapiens
atggagccccaccttg

SEQ ID NO: 5026511 - DNA, 21 bp, Homo sapiens
atggagccccaccttgtctgc

SEQ ID NO: 5026512 - DNA, 19 bp, Homo sapiens
atggagtgctgttttgtta

SEQ ID NO: 5026513 - DNA, 21 bp, Homo sapiens
atggagtgctgttttgttata

SEQ ID NO: 5026514 - DNA, 20 bp, Homo sapiens
atggatcaaagaaattcaga

SEQ ID NO: 5026515 - DNA, 20 bp, Homo sapiens
atggcatttggtctcaggca

SEQ ID NO: 5026516 - DNA, 23 bp, Homo sapiens
atggcatttggtctcaggcagca

SEQ ID NO: 5026517 - DNA, 20 bp, Homo sapiens
atggccatgcaggaggtgga

SEQ ID NO: 5026518 - DNA, 23 bp, Homo sapiens
atggcccctctgacctgcactgg

SEQ ID NO: 5026519 - DNA, 17 bp, Homo sapiens
atggcgtctgctctggt

SEQ ID NO: 5026520 - DNA, 15 bp, Homo sapiens
atggtagattctgtt

SEQ ID NO: 5026521 - DNA, 13 bp, Homo sapiens
atggtaggggagg

SEQ ID NO: 5026522 - DNA, 18 bp, Homo sapiens
atggtaggggagggcagg

SEQ ID NO: 5026523 - DNA, 14 bp, Homo sapiens
atggtagttttttc

SEQ ID NO: 5026524 - DNA, 18 bp, Homo sapiens
atggtagttttttcatct

SEQ ID NO: 5026525 - DNA, 16 bp, Homo sapiens
atggtggacccagcgg

SEQ ID NO: 5026526 - DNA, 14 bp, Homo sapiens
atgtaataatgtga

SEQ ID NO: 5026527 - DNA, 16 bp, Homo sapiens
atgtaataatgtgaat

SEQ ID NO: 5026528 - DNA, 18 bp, Homo sapiens
atgtaatggcagttatat

SEQ ID NO: 5026529 - DNA, 20 bp, Homo sapiens
atgtactagtgttctgtttg

SEQ ID NO: 5026530 - DNA, 18 bp, Homo sapiens
atgtagtcagttgcattc

SEQ ID NO: 5026531 - DNA, 17 bp, Homo sapiens
atgtattgtgcaatgtg

SEQ ID NO: 5026532 - DNA, 20 bp, Homo sapiens
atgtattgtgcaatgtgtat

SEQ ID NO: 5026533 - DNA, 14 bp, Homo sapiens
atgtatttgtttgc

SEQ ID NO: 5026534 - DNA, 16 bp, Homo sapiens
atgtattttatgttat

SEQ ID NO: 5026535 - DNA, 19 bp, Homo sapiens
atgtcacagtccaaccaga

SEQ ID NO: 5026536 - DNA, 17 bp, Homo sapiens
atgtcttttcccattta

SEQ ID NO: 5026537 - DNA, 18 bp, Homo sapiens
atgtgtacaatgtacaca

SEQ ID NO: 5026538 - DNA, 12 bp, Homo sapiens
atgtgtataaac

SEQ ID NO: 5026539 - DNA, 13 bp, Homo sapiens
atgtgtataaaca

SEQ ID NO: 5026540 - DNA, 14 bp, Homo sapiens
atgtgtataaacaa

SEQ ID NO: 5026541 - DNA, 20 bp, Homo sapiens
atgtgtcattggaagccatc

SEQ ID NO: 5026542 - DNA, 13 bp, Homo sapiens
atgtgtcctggtt

SEQ ID NO: 5026543 - DNA, 15 bp, Homo sapiens
atgttatatataaat

SEQ ID NO: 5026544 - DNA, 13 bp, Homo sapiens
atgttatgaacag

SEQ ID NO: 5026545 - DNA, 14 bp, Homo sapiens
atgttatgaacagc

SEQ ID NO: 5026546 - DNA, 20 bp, Homo sapiens
atgttatgaacagctgtgtc

SEQ ID NO: 5026547 - DNA, 18 bp, Homo sapiens
atgtttagactttaacat

SEQ ID NO: 5026548 - DNA, 17 bp, Homo sapiens
attttttgttgacatta

SEQ ID NO: 5026549 - DNA, 18 bp, Homo sapiens
attttttttctgttatat

SEQ ID NO: 5026550 - DNA, 20 bp, Homo sapiens
attttttttctgttatataa

SEQ ID NO: 5026551 - DNA, 14 bp, Homo sapiens
caaaaagacaaaca

SEQ ID NO: 5026552 - DNA, 12 bp, Homo sapiens
caaaacatttct

SEQ ID NO: 5026553 - DNA, 14 bp, Homo sapiens
caaaagcaaaacat

SEQ ID NO: 5026554 - DNA, 21 bp, Homo sapiens
caaaagcaaaacatctctgca

SEQ ID NO: 5026555 - DNA, 21 bp, Homo sapiens
caaacaccttccagctcctgt

SEQ ID NO: 5026556 - DNA, 12 bp, Homo sapiens
caaacattttga

SEQ ID NO: 5026557 - DNA, 15 bp, Homo sapiens
caaacattttgaaag

SEQ ID NO: 5026558 - DNA, 20 bp, Homo sapiens
caaacattttgaaagtctgt

SEQ ID NO: 5026559 - DNA, 20 bp, Homo sapiens
caaaccatttccaacagcaa

SEQ ID NO: 5026560 - DNA, 21 bp, Homo sapiens
caaaccatttttaaagtagaa

SEQ ID NO: 5026561 - DNA, 17 bp, Homo sapiens
caaactgaaattcagag

SEQ ID NO: 5026562 - DNA, 13 bp, Homo sapiens
caaagacatcagt

SEQ ID NO: 5026563 - DNA, 13 bp, Homo sapiens
aaacgaaaaacat

SEQ ID NO: 5026564 - DNA, 17 bp, Homo sapiens
aaactaaggatttttca

SEQ ID NO: 5026565 - DNA, 13 bp, Homo sapiens
aaactactctttg

SEQ ID NO: 5026566 - DNA, 17 bp, Homo sapiens
aaactactctttgattt

SEQ ID NO: 5026567 - DNA, 16 bp, Homo sapiens
aaactactttgctgct

SEQ ID NO: 5026568 - DNA, 15 bp, Homo sapiens
aaactgggttcctgc

SEQ ID NO: 5026569 - DNA, 12 bp, Homo sapiens
aaactgtacagt

SEQ ID NO: 5026570 - DNA, 19 bp, Homo sapiens
actacaaaggtttaaatga

SEQ ID NO: 5026571 - DNA, 16 bp, Homo sapiens
actaccgaatgtgtct

SEQ ID NO: 5026572 - DNA, 17 bp, Homo sapiens
actaccgaatgtgtctt

SEQ ID NO: 5026573 - DNA, 18 bp, Homo sapiens
actaccgaatgtgtcttt

SEQ ID NO: 5026574 - DNA, 19 bp, Homo sapiens
actaccgaatgtgtcttta

SEQ ID NO: 5026575 - DNA, 23 bp, Homo sapiens
actaccgaatgtgtctttagata

SEQ ID NO: 5026576 - DNA, 14 bp, Homo sapiens
actactctttgatt

SEQ ID NO: 5026577 - DNA, 16 bp, Homo sapiens
actatgaaaatgctgg

SEQ ID NO: 5026578 - DNA, 23 bp, Homo sapiens
actatttgcttatttaataaaga

SEQ ID NO: 5026579 - DNA, 16 bp, Homo sapiens
actcaagagttcagtg

SEQ ID NO: 5026580 - DNA, 12 bp, Homo sapiens
actcagacctga

SEQ ID NO: 5026581 - DNA, 20 bp, Homo sapiens
actcagttaaatctttgaag

SEQ ID NO: 5026582 - DNA, 23 bp, Homo sapiens
actcatacactcgtatgatactt

SEQ ID NO: 5026583 - DNA, 13 bp, Homo sapiens
actcattcattag

SEQ ID NO: 5026584 - DNA, 17 bp, Homo sapiens
actccaattaaggattt

SEQ ID NO: 5026585 - DNA, 21 bp, Homo sapiens
actccaattaaggattttatg

SEQ ID NO: 5026586 - DNA, 16 bp, Homo sapiens
actccctcctggagct

SEQ ID NO: 5026587 - DNA, 17 bp, Homo sapiens
actccgctcactgaact

SEQ ID NO: 5026588 - DNA, 23 bp, Homo sapiens
actctgacaacagacttctgaaa

SEQ ID NO: 5026589 - DNA, 21 bp, Homo sapiens
actctgcccccatttccccga

SEQ ID NO: 5026590 - DNA, 13 bp, Homo sapiens
actctgtaattgc

SEQ ID NO: 5026591 - DNA, 20 bp, Homo sapiens
actgaacatctgagtcctgg

SEQ ID NO: 5026592 - DNA, 23 bp, Homo sapiens
actgaacatctgagtcctggatg

SEQ ID NO: 5026593 - DNA, 12 bp, Homo sapiens
actgaagagtaa

SEQ ID NO: 5026594 - DNA, 13 bp, Homo sapiens
actgaataccact

SEQ ID NO: 5026595 - DNA, 17 bp, Homo sapiens
actgaataccactctgt

SEQ ID NO: 5026596 - DNA, 19 bp, Homo sapiens
actgaataccactctgtaa

SEQ ID NO: 5026597 - DNA, 22 bp, Homo sapiens
actgaataccactctgtaattg

SEQ ID NO: 5026598 - DNA, 15 bp, Homo sapiens
actgcacaggaggag

SEQ ID NO: 5026599 - DNA, 16 bp, Homo sapiens
actgccagtctcactg

SEQ ID NO: 5026600 - DNA, 16 bp, Homo sapiens
actgccatattaaatt

SEQ ID NO: 5026601 - DNA, 21 bp, Homo sapiens
actgccatattaaattttttg

SEQ ID NO: 5026602 - DNA, 18 bp, Homo sapiens
actgccccccgaggctgc

SEQ ID NO: 5026603 - DNA, 21 bp, Homo sapiens
actgccccccgaggctgctag

SEQ ID NO: 5026604 - DNA, 13 bp, Homo sapiens
actgcctgctccc

SEQ ID NO: 5026605 - DNA, 19 bp, Homo sapiens
actgcctgctcccatcctg

SEQ ID NO: 5026606 - DNA, 12 bp, Homo sapiens
actgctctgatg

SEQ ID NO: 5026607 - DNA, 16 bp, Homo sapiens
actgcttgtttcctag

SEQ ID NO: 5026608 - DNA, 18 bp, Homo sapiens
actggaaggggaagggac

SEQ ID NO: 5026609 - DNA, 17 bp, Homo sapiens
actggatgcagaaacag

SEQ ID NO: 5026610 - DNA, 14 bp, Homo sapiens
actgggctctggct

SEQ ID NO: 5026611 - DNA, 21 bp, Homo sapiens
actggggagcccgtctcagtg

SEQ ID NO: 5026612 - DNA, 19 bp, Homo sapiens
actgggtgcgtctccagtc

SEQ ID NO: 5026613 - DNA, 16 bp, Homo sapiens
actggtacttagagtt

SEQ ID NO: 5026614 - DNA, 20 bp, Homo sapiens
actggtacttagagtttctg

SEQ ID NO: 5026615 - DNA, 19 bp, Homo sapiens
actggtgtttgaaagtagg

SEQ ID NO: 5026616 - DNA, 15 bp, Homo sapiens
actgtacagtgtctt

SEQ ID NO: 5026617 - DNA, 16 bp, Homo sapiens
actgtacagtgtcttt

SEQ ID NO: 5026618 - DNA, 17 bp, Homo sapiens
actgtacagtgtctttt

SEQ ID NO: 5026619 - DNA, 13 bp, Homo sapiens
actgtatctgtgt

SEQ ID NO: 5026620 - DNA, 15 bp, Homo sapiens
actgtatctgtgtag

SEQ ID NO: 5026621 - DNA, 12 bp, Homo sapiens
actgtgctgtgc

SEQ ID NO: 5026622 - DNA, 16 bp, Homo sapiens
actgtgctgtgcagct

SEQ ID NO: 5026623 - DNA, 20 bp, Homo sapiens
actgtgggaaggccagctgc

SEQ ID NO: 5026624 - DNA, 17 bp, Homo sapiens
actgttctgtgtctttc

SEQ ID NO: 5026625 - DNA, 19 bp, Homo sapiens
actgttcttagctcaatga

SEQ ID NO: 5026626 - DNA, 21 bp, Homo sapiens
actgttcttagctcaatgagc

SEQ ID NO: 5026627 - DNA, 21 bp, Homo sapiens
acttagaaaaccagctcagca

SEQ ID NO: 5026628 - DNA, 19 bp, Homo sapiens
acttcatagatgcaggagg

SEQ ID NO: 5026629 - DNA, 17 bp, Homo sapiens
acttcctcctccccact

SEQ ID NO: 5026630 - DNA, 14 bp, Homo sapiens
acttctcttgcttt

SEQ ID NO: 5026631 - DNA, 16 bp, Homo sapiens
acttggagactcctgg

SEQ ID NO: 5026632 - DNA, 16 bp, Homo sapiens
acttggattctttcca

SEQ ID NO: 5026633 - DNA, 18 bp, Homo sapiens
acttggattctttccatt

SEQ ID NO: 5026634 - DNA, 13 bp, Homo sapiens
acttgggacattg

SEQ ID NO: 5026635 - DNA, 16 bp, Homo sapiens
acttgtaaatataaag

SEQ ID NO: 5026636 - DNA, 19 bp, Homo sapiens
acttgtcaggagtgtgtgt

SEQ ID NO: 5026637 - DNA, 17 bp, Homo sapiens
actttccattacaagta

SEQ ID NO: 5026638 - DNA, 21 bp, Homo sapiens
actttgaagggcaagaaatgg

SEQ ID NO: 5026639 - DNA, 19 bp, Homo sapiens
actttgctttaatataaat

SEQ ID NO: 5026640 - DNA, 22 bp, Homo sapiens
actttgctttaatataaatgca

SEQ ID NO: 5026641 - DNA, 20 bp, Homo sapiens
acttttggttaagtctgttt

SEQ ID NO: 5026642 - DNA, 12 bp, Homo sapiens
agaaaaaaacaa

SEQ ID NO: 5026643 - DNA, 22 bp, Homo sapiens
agaaaaaaatgtattttatgtt

SEQ ID NO: 5026644 - DNA, 17 bp, Homo sapiens
agaaaaaaattgaaatg

SEQ ID NO: 5026645 - DNA, 18 bp, Homo sapiens
agaaaaaaattgaaatgt

SEQ ID NO: 5026646 - DNA, 20 bp, Homo sapiens
agaaaaataaagaaaagatg

SEQ ID NO: 5026647 - DNA, 19 bp, Homo sapiens
agaaaaatatgaccacact

SEQ ID NO: 5026648 - DNA, 20 bp, Homo sapiens
agaaaaattcagcaaaccat

SEQ ID NO: 5026649 - DNA, 20 bp, Homo sapiens
agaaaattctaatgattggc

SEQ ID NO: 5026650 - DNA, 15 bp, Homo sapiens
agaaacacccctctg

SEQ ID NO: 5026651 - DNA, 16 bp, Homo sapiens
agaaatggcgtctgct

SEQ ID NO: 5026652 - DNA, 18 bp, Homo sapiens
agaaatggcgtctgctct

SEQ ID NO: 5026653 - DNA, 20 bp, Homo sapiens
agaaatggcgtctgctctgg

SEQ ID NO: 5026654 - DNA, 14 bp, Homo sapiens
acaggagacctggc

SEQ ID NO: 5026655 - DNA, 13 bp, Homo sapiens
acaggcagcagag

SEQ ID NO: 5026656 - DNA, 16 bp, Homo sapiens
acaggcttctgagcag

SEQ ID NO: 5026657 - DNA, 20 bp, Homo sapiens
acagggacatgccctgtgtg

SEQ ID NO: 5026658 - DNA, 18 bp, Homo sapiens
acagggcccggccacacc

SEQ ID NO: 5026659 - DNA, 17 bp, Homo sapiens
acaggggtagtttgttt

SEQ ID NO: 5026660 - DNA, 20 bp, Homo sapiens
acaggtgccgccagctgccg

SEQ ID NO: 5026661 - DNA, 19 bp, Homo sapiens
acagtatgggggttgtaaa

SEQ ID NO: 5026662 - DNA, 23 bp, Homo sapiens
acagtatgggggttgtaaattgg

SEQ ID NO: 5026663 - DNA, 16 bp, Homo sapiens
acagtattgctcaccc

SEQ ID NO: 5026664 - DNA, 20 bp, Homo sapiens
acagtctacattgagcattt

SEQ ID NO: 5026665 - DNA, 12 bp, Homo sapiens
acagtgccaccc

SEQ ID NO: 5026666 - DNA, 13 bp, Homo sapiens
acagtgctgtgtg

SEQ ID NO: 5026667 - DNA, 14 bp, Homo sapiens
acagtgtttatcct

SEQ ID NO: 5026668 - DNA, 20 bp, Homo sapiens
acagtgtttatcctttcata

SEQ ID NO: 5026669 - DNA, 21 bp, Homo sapiens
acagtgtttatcctttcatat

SEQ ID NO: 5026670 - DNA, 19 bp, Homo sapiens
acagttttggttgctttaa

SEQ ID NO: 5026671 - DNA, 17 bp, Homo sapiens
acataagctatttttct

SEQ ID NO: 5026672 - DNA, 18 bp, Homo sapiens
acataagctatttttcta

SEQ ID NO: 5026673 - DNA, 20 bp, Homo sapiens
acataattcaggaagcagct

SEQ ID NO: 5026674 - DNA, 18 bp, Homo sapiens
acatactggcctggactg

SEQ ID NO: 5026675 - DNA, 19 bp, Homo sapiens
atattttcctatattacgg

SEQ ID NO: 5026676 - DNA, 14 bp, Homo sapiens
atcaaacattttga

SEQ ID NO: 5026677 - DNA, 18 bp, Homo sapiens
atcaaagaaattcagaac

SEQ ID NO: 5026678 - DNA, 19 bp, Homo sapiens
atcaactgggctgaacact

SEQ ID NO: 5026679 - DNA, 22 bp, Homo sapiens
atcaagttctccccagggtaga

SEQ ID NO: 5026680 - DNA, 22 bp, Homo sapiens
atcacagttttggttgctttaa

SEQ ID NO: 5026681 - DNA, 17 bp, Homo sapiens
atcacattaatctcaaa

SEQ ID NO: 5026682 - DNA, 20 bp, Homo sapiens
atcacctagctgaatgtttt

SEQ ID NO: 5026683 - DNA, 21 bp, Homo sapiens
atcacctagctgaatgttttt

SEQ ID NO: 5026684 - DNA, 23 bp, Homo sapiens
atcacctagctgaatgtttttct

SEQ ID NO: 5026685 - DNA, 22 bp, Homo sapiens
atcaggagactgggctctggct

SEQ ID NO: 5026686 - DNA, 15 bp, Homo sapiens
atcagtattgaagca

SEQ ID NO: 5026687 - DNA, 22 bp, Homo sapiens
atcagtattgaagcattttata

SEQ ID NO: 5026688 - DNA, 17 bp, Homo sapiens
atcattatttatgtatt

SEQ ID NO: 5026689 - DNA, 19 bp, Homo sapiens
atccaaaatcttgatcagt

SEQ ID NO: 5026690 - DNA, 21 bp, Homo sapiens
atccagcgagagagtttcaaa

SEQ ID NO: 5026691 - DNA, 14 bp, Homo sapiens
atccataactgaac

SEQ ID NO: 5026692 - DNA, 12 bp, Homo sapiens
atcccacacagg

SEQ ID NO: 5026693 - DNA, 14 bp, Homo sapiens
atccccaccccacc

SEQ ID NO: 5026694 - DNA, 15 bp, Homo sapiens
atccccaccccaccc

SEQ ID NO: 5026695 - DNA, 16 bp, Homo sapiens
atcccgtgttctcctt

SEQ ID NO: 5026696 - DNA, 19 bp, Homo sapiens
atccctttttttacatttc

SEQ ID NO: 5026697 - DNA, 14 bp, Homo sapiens
atcctaggctgaca

SEQ ID NO: 5026698 - DNA, 19 bp, Homo sapiens
atcctgtgtgttaagctct

SEQ ID NO: 5026699 - DNA, 21 bp, Homo sapiens
atcctgtgtgttaagctctgc

SEQ ID NO: 5026700 - DNA, 17 bp, Homo sapiens
atcctttacgtgtttaa

SEQ ID NO: 5026701 - DNA, 13 bp, Homo sapiens
atcgtaaagtgct

SEQ ID NO: 5026702 - DNA, 18 bp, Homo sapiens
atcgttttcttaaagtgc

SEQ ID NO: 5026703 - DNA, 15 bp, Homo sapiens
atctactcaaagcat

SEQ ID NO: 5026704 - DNA, 22 bp, Homo sapiens
atctcagtatgaattattcaat

SEQ ID NO: 5026705 - DNA, 18 bp, Homo sapiens
atctctgtactttgcttg

SEQ ID NO: 5026706 - DNA, 15 bp, Homo sapiens
atctgacatctctgc

SEQ ID NO: 5026707 - DNA, 15 bp, Homo sapiens
atctgggccagaatt

SEQ ID NO: 5026708 - DNA, 22 bp, Homo sapiens
atcttggctatgtaattcttgt

SEQ ID NO: 5026709 - DNA, 23 bp, Homo sapiens
atctttctccctcaactgaaggg

SEQ ID NO: 5026710 - DNA, 15 bp, Homo sapiens
atctttctttccaaa

SEQ ID NO: 5026711 - DNA, 22 bp, Homo sapiens
atgaaatactgtttgaggtttt

SEQ ID NO: 5026712 - DNA, 18 bp, Homo sapiens
atgaacaagagaagcatt

SEQ ID NO: 5026713 - DNA, 12 bp, Homo sapiens
atgaacagctgt

SEQ ID NO: 5026714 - DNA, 13 bp, Homo sapiens
atgaacagctgtg

SEQ ID NO: 5026715 - DNA, 21 bp, Homo sapiens
atgaacagctgtgtctgccaa

SEQ ID NO: 5026716 - DNA, 11 bp, Homo sapiens
atgaagaggag

SEQ ID NO: 5026717 - DNA, 15 bp, Homo sapiens
atgaattattacagt

SEQ ID NO: 5026718 - DNA, 17 bp, Homo sapiens
atgaattattacagtgt

SEQ ID NO: 5026719 - DNA, 12 bp, Homo sapiens
atgactttggac

SEQ ID NO: 5026720 - DNA, 13 bp, Homo sapiens
atgaggtctgttt

SEQ ID NO: 5026721 - DNA, 16 bp, Homo sapiens
atgatacttcgacact

SEQ ID NO: 5026722 - DNA, 17 bp, Homo sapiens
atgatcggcaggacacc

SEQ ID NO: 5026723 - DNA, 23 bp, Homo sapiens
atgatctaccagcctccctattt

SEQ ID NO: 5026724 - DNA, 17 bp, Homo sapiens
atgatttttctttacaa

SEQ ID NO: 5026725 - DNA, 14 bp, Homo sapiens
atgcacatccctgg

SEQ ID NO: 5026726 - DNA, 19 bp, Homo sapiens
atgcactttgctttaatat

SEQ ID NO: 5026727 - DNA, 19 bp, Homo sapiens
atgcagacctcatgcccag

SEQ ID NO: 5026728 - DNA, 18 bp, Homo sapiens
atgcagaggcctggggga

SEQ ID NO: 5026729 - DNA, 16 bp, Homo sapiens
atgcaggaggtggaga

SEQ ID NO: 5026730 - DNA, 19 bp, Homo sapiens
atgcaggaggtggagaaaa

SEQ ID NO: 5026731 - DNA, 16 bp, Homo sapiens
atgccaagttgtttga

SEQ ID NO: 5026732 - DNA, 12 bp, Homo sapiens
atgccacattca

SEQ ID NO: 5026733 - DNA, 15 bp, Homo sapiens
atgccacattcaaaa

SEQ ID NO: 5026734 - DNA, 13 bp, Homo sapiens
atgcccagctctc

SEQ ID NO: 5026735 - DNA, 16 bp, Homo sapiens
atgcccagctctctga

SEQ ID NO: 5026736 - DNA, 17 bp, Homo sapiens
atgcccagctctctgac

SEQ ID NO: 5026737 - DNA, 14 bp, Homo sapiens
atttccacaccaag

SEQ ID NO: 5026738 - DNA, 18 bp, Homo sapiens
atttctgcagatggaaag

SEQ ID NO: 5026739 - DNA, 22 bp, Homo sapiens
atttctttctttgcaccaaaga

SEQ ID NO: 5026740 - DNA, 23 bp, Homo sapiens
atttctttctttgcaccaaagac

SEQ ID NO: 5026741 - DNA, 14 bp, Homo sapiens
atttgaaaaaaact

SEQ ID NO: 5026742 - DNA, 22 bp, Homo sapiens
atttgaaaaaaacttcattctc

SEQ ID NO: 5026743 - DNA, 20 bp, Homo sapiens
atttgaatgatttttcttta

SEQ ID NO: 5026744 - DNA, 12 bp, Homo sapiens
atttgagacagg

SEQ ID NO: 5026745 - DNA, 13 bp, Homo sapiens
atttgcatttgtt

SEQ ID NO: 5026746 - DNA, 21 bp, Homo sapiens
atttgcatttgtttatgtaat

SEQ ID NO: 5026747 - DNA, 22 bp, Homo sapiens
atttgcatttgtttatgtaatt

SEQ ID NO: 5026748 - DNA, 18 bp, Homo sapiens
atttgcttatttaataaa

SEQ ID NO: 5026749 - DNA, 18 bp, Homo sapiens
atttgtaaagctttacaa

SEQ ID NO: 5026750 - DNA, 14 bp, Homo sapiens
atttgtgccagaat

SEQ ID NO: 5026751 - DNA, 20 bp, Homo sapiens
atttgtgttttaatttaaac

SEQ ID NO: 5026752 - DNA, 16 bp, Homo sapiens
atttgttcattaaacg

SEQ ID NO: 5026753 - DNA, 20 bp, Homo sapiens
atttgtttcatttctgcaga

SEQ ID NO: 5026754 - DNA, 21 bp, Homo sapiens
atttgtttcatttctgcagat

SEQ ID NO: 5026755 - DNA, 20 bp, Homo sapiens
atttgtttttaaactgtaca

SEQ ID NO: 5026756 - DNA, 16 bp, Homo sapiens
attttaaaaacataga

SEQ ID NO: 5026757 - DNA, 18 bp, Homo sapiens
attttaaaatagcgttct

SEQ ID NO: 5026758 - DNA, 22 bp, Homo sapiens
attttaaaatagcgttcttgta

SEQ ID NO: 5026759 - DNA, 16 bp, Homo sapiens
attttaaggatatgat

SEQ ID NO: 5026760 - DNA, 21 bp, Homo sapiens
attttacacgcttttgtgatg

SEQ ID NO: 5026761 - DNA, 13 bp, Homo sapiens
attttaccaaagc

SEQ ID NO: 5026762 - DNA, 16 bp, Homo sapiens
attttaccaaagcatc

SEQ ID NO: 5026763 - DNA, 17 bp, Homo sapiens
attttaccaaagcatca

SEQ ID NO: 5026764 - DNA, 15 bp, Homo sapiens
attttataaatcgct

SEQ ID NO: 5026765 - DNA, 17 bp, Homo sapiens
attttataaatcgcttt

SEQ ID NO: 5026766 - DNA, 20 bp, Homo sapiens
attttataaatcgcttttga

SEQ ID NO: 5026767 - DNA, 23 bp, Homo sapiens
attttataaatcgcttttgataa

SEQ ID NO: 5026768 - DNA, 18 bp, Homo sapiens
attttatgctttaaacat

SEQ ID NO: 5026769 - DNA, 14 bp, Homo sapiens
attttatgttatat

SEQ ID NO: 5026770 - DNA, 16 bp, Homo sapiens
attttcaatagccact

SEQ ID NO: 5026771 - DNA, 17 bp, Homo sapiens
attttcgggctgagaag

SEQ ID NO: 5026772 - DNA, 15 bp, Homo sapiens
attttgaaagtctgt

SEQ ID NO: 5026773 - DNA, 19 bp, Homo sapiens
attttgacttaatgtgatt

SEQ ID NO: 5026774 - DNA, 23 bp, Homo sapiens
attttgtggttttcgagattatc

SEQ ID NO: 5026775 - DNA, 13 bp, Homo sapiens
atttttctttaca

SEQ ID NO: 5026776 - DNA, 16 bp, Homo sapiens
atttttgttagcaaag

SEQ ID NO: 5026777 - DNA, 16 bp, Homo sapiens
attttttgttgacatt

SEQ ID NO: 5026778 - DNA, 20 bp, Homo sapiens
attttttttattagtattgt

SEQ ID NO: 5026779 - DNA, 15 bp, Homo sapiens
attttttttctgtta

SEQ ID NO: 5026780 - DNA, 21 bp, Homo sapiens
caaaacatttctggacagtac

SEQ ID NO: 5026781 - DNA, 16 bp, Homo sapiens
caaaactcacagagct

SEQ ID NO: 5026782 - DNA, 23 bp, Homo sapiens
caaaagcgtgagcttaaaataca

SEQ ID NO: 5026783 - DNA, 18 bp, Homo sapiens
caaaatagggtatatttt

SEQ ID NO: 5026784 - DNA, 22 bp, Homo sapiens
caaaatcttgatcagttaagaa

SEQ ID NO: 5026785 - DNA, 21 bp, Homo sapiens
caaaatgagccctgtcctgcc

SEQ ID NO: 5026786 - DNA, 14 bp, Homo sapiens
caaacaccttccag

SEQ ID NO: 5026787 - DNA, 21 bp, Homo sapiens
caaacccagaggtggatgtta

SEQ ID NO: 5026788 - DNA, 19 bp, Homo sapiens
caaactctttggtcgtttt

SEQ ID NO: 5026789 - DNA, 14 bp, Homo sapiens
caaagagattcgaa

SEQ ID NO: 5026790 - DNA, 17 bp, Homo sapiens
caaagagcctttccaaa

SEQ ID NO: 5026791 - DNA, 15 bp, Homo sapiens
caaagattaaatgtg

SEQ ID NO: 5026792 - DNA, 16 bp, Homo sapiens
caaagattaaatgtgt

SEQ ID NO: 5026793 - DNA, 16 bp, Homo sapiens
caaaggtttaaatgaa

SEQ ID NO: 5026794 - DNA, 23 bp, Homo sapiens
caaaggtttaaatgaacaagaga

SEQ ID NO: 5026795 - DNA, 16 bp, Homo sapiens
agcttcattctccttg

SEQ ID NO: 5026796 - DNA, 19 bp, Homo sapiens
agcttgaaatagtgtctga

SEQ ID NO: 5026797 - DNA, 14 bp, Homo sapiens
agcttgctccagat

SEQ ID NO: 5026798 - DNA, 22 bp, Homo sapiens
agcttgctccagattctgatgc

SEQ ID NO: 5026799 - DNA, 18 bp, Homo sapiens
aggaactgggctgggcct

SEQ ID NO: 5026800 - DNA, 19 bp, Homo sapiens
aggaagagcccgcagggcc

SEQ ID NO: 5026801 - DNA, 18 bp, Homo sapiens
aggaagcagctttcccca

SEQ ID NO: 5026802 - DNA, 18 bp, Homo sapiens
aggacatttatgattgtc

SEQ ID NO: 5026803 - DNA, 13 bp, Homo sapiens
aggactgcagtgt

SEQ ID NO: 5026804 - DNA, 15 bp, Homo sapiens
aggactgcagtgtgg

SEQ ID NO: 5026805 - DNA, 21 bp, Homo sapiens
aggactgtgacaggcagcaga

SEQ ID NO: 5026806 - DNA, 22 bp, Homo sapiens
aggactgtgacaggcagcagag

SEQ ID NO: 5026807 - DNA, 23 bp, Homo sapiens
aggacttgggcgggacacaggct

SEQ ID NO: 5026808 - DNA, 22 bp, Homo sapiens
aggagatccagggcaaggccat

SEQ ID NO: 5026809 - DNA, 16 bp, Homo sapiens
aggagcacggctctgt

SEQ ID NO: 5026810 - DNA, 15 bp, Homo sapiens
aggaggaatactgaa

SEQ ID NO: 5026811 - DNA, 21 bp, Homo sapiens
aggaggcgtctcgggagagga

SEQ ID NO: 5026812 - DNA, 20 bp, Homo sapiens
aggaggtggagaaaattgga

SEQ ID NO: 5026813 - DNA, 12 bp, Homo sapiens
aggatctgctga

SEQ ID NO: 5026814 - DNA, 18 bp, Homo sapiens
aggatctgctgaggccca

SEQ ID NO: 5026815 - DNA, 19 bp, Homo sapiens
aggatctgctgaggcccag

SEQ ID NO: 5026816 - DNA, 22 bp, Homo sapiens
aggatctgctgaggcccagtgc

SEQ ID NO: 5026817 - DNA, 21 bp, Homo sapiens
aggattccaaaaacattttat

SEQ ID NO: 5026818 - DNA, 16 bp, Homo sapiens
aggattttaccaaagc

SEQ ID NO: 5026819 - DNA, 13 bp, Homo sapiens
aggattttatacc

SEQ ID NO: 5026820 - DNA, 16 bp, Homo sapiens
aggattttatgcttta

SEQ ID NO: 5026821 - DNA, 19 bp, Homo sapiens
aggcagcaccacactgggt

SEQ ID NO: 5026822 - DNA, 21 bp, Homo sapiens
aggcagcaccacactgggtgc

SEQ ID NO: 5026823 - DNA, 16 bp, Homo sapiens
aggcagcctgcaggga

SEQ ID NO: 5026824 - DNA, 21 bp, Homo sapiens
aggcatcatggaaagactggg

SEQ ID NO: 5026825 - DNA, 17 bp, Homo sapiens
aggcatgtcccacccac

SEQ ID NO: 5026826 - DNA, 18 bp, Homo sapiens
aggcatgtcccacccacc

SEQ ID NO: 5026827 - DNA, 20 bp, Homo sapiens
aggcccgctctacatcttct

SEQ ID NO: 5026828 - DNA, 20 bp, Homo sapiens
aggccgcagctccattttct

SEQ ID NO: 5026829 - DNA, 23 bp, Homo sapiens
aggcctgggggacccctggctct

SEQ ID NO: 5026830 - DNA, 20 bp, Homo sapiens
aggcgggaggaggtgtgagg

SEQ ID NO: 5026831 - DNA, 20 bp, Homo sapiens
aggctcccgaggggaagggg

SEQ ID NO: 5026832 - DNA, 21 bp, Homo sapiens
aggctgaacttgttttctggg

SEQ ID NO: 5026833 - DNA, 22 bp, Homo sapiens
aggctgggcagcacaaggcctt

SEQ ID NO: 5026834 - DNA, 15 bp, Homo sapiens
aggcttctgagcagc

SEQ ID NO: 5026835 - DNA, 19 bp, Homo sapiens
aggcttggggaaaatggcc

SEQ ID NO: 5026836 - DNA, 22 bp, Homo sapiens
aggcttggggaaaatggccatg

SEQ ID NO: 5026837 - DNA, 19 bp, Homo sapiens
agggacatgccctgtgtgg

SEQ ID NO: 5026838 - DNA, 20 bp, Homo sapiens
agggacatgccctgtgtggc

SEQ ID NO: 5026839 - DNA, 14 bp, Homo sapiens
agggacatgcttag

SEQ ID NO: 5026840 - DNA, 16 bp, Homo sapiens
agggaccaggggagag

SEQ ID NO: 5026841 - DNA, 17 bp, Homo sapiens
agggacgctttgtctgt

SEQ ID NO: 5026842 - DNA, 16 bp, Homo sapiens
agggagttttgtctgt

SEQ ID NO: 5026843 - DNA, 21 bp, Homo sapiens
agggagttttgtctgtctccc

SEQ ID NO: 5026844 - DNA, 13 bp, Homo sapiens
agggcaagaaatg

SEQ ID NO: 5026845 - DNA, 14 bp, Homo sapiens
agggcaagaaatgg

SEQ ID NO: 5026846 - DNA, 14 bp, Homo sapiens
agggcaggcttggg

SEQ ID NO: 5026847 - DNA, 22 bp, Homo sapiens
agggcaggcttggggaaaatgg

SEQ ID NO: 5026848 - DNA, 20 bp, Homo sapiens
agggcccggccacacccagc

SEQ ID NO: 5026849 - DNA, 22 bp, Homo sapiens
agggcgttctaggtaggaagag

SEQ ID NO: 5026850 - DNA, 17 bp, Homo sapiens
aggggaagcactcgtgt

SEQ ID NO: 5026851 - DNA, 18 bp, Homo sapiens
aggggtaggatgtacagg

SEQ ID NO: 5026852 - DNA, 17 bp, Homo sapiens
agggtatattttcctat

SEQ ID NO: 5026853 - DNA, 21 bp, Homo sapiens
agggtatattttcctatatta

SEQ ID NO: 5026854 - DNA, 14 bp, Homo sapiens
agggtcctgccggt

SEQ ID NO: 5026855 - DNA, 18 bp, Homo sapiens
agggtgcccttttccagc

SEQ ID NO: 5026856 - DNA, 24 bp, Homo sapiens
agggtgcccttttccagcctcagc

SEQ ID NO: 5026857 - DNA, 21 bp, Homo sapiens
aggtaggaagcaacagcttca

SEQ ID NO: 5026858 - DNA, 14 bp, Homo sapiens
aggtcaagcccaga

SEQ ID NO: 5026859 - DNA, 23 bp, Homo sapiens
aggtcactccaccatccccaccc

SEQ ID NO: 5026860 - DNA, 17 bp, Homo sapiens
aggtccagccctggctg

SEQ ID NO: 5026861 - DNA, 20 bp, Homo sapiens
aggtccagccctggctgaag

SEQ ID NO: 5026862 - DNA, 23 bp, Homo sapiens
aggtccagccctggctgaaggac

SEQ ID NO: 5026863 - DNA, 13 bp, Homo sapiens
aggtctgaaattt

SEQ ID NO: 5026864 - DNA, 20 bp, Homo sapiens
aggtctgtttaaagtggcaa

SEQ ID NO: 5026865 - DNA, 21 bp, Homo sapiens
aggtgactgtgctgtgcagct

SEQ ID NO: 5026866 - DNA, 19 bp, Homo sapiens
aggtgccgccagctgccgc

SEQ ID NO: 5026867 - DNA, 18 bp, Homo sapiens
aggtgcctgtcccacccc

SEQ ID NO: 5026868 - DNA, 16 bp, Homo sapiens
aggttccatcctttac

SEQ ID NO: 5026869 - DNA, 17 bp, Homo sapiens
aggttctgcctgctttg

SEQ ID NO: 5026870 - DNA, 16 bp, Homo sapiens
aggttgctgtttcaca

SEQ ID NO: 5026871 - DNA, 13 bp, Homo sapiens
aggtttaaatgaa

SEQ ID NO: 5026872 - DNA, 14 bp, Homo sapiens
aggtttaaatgaac

SEQ ID NO: 5026873 - DNA, 22 bp, Homo sapiens
aggtttaaatgaacaagagaag

SEQ ID NO: 5026874 - DNA, 14 bp, Homo sapiens
aggtttttaagcct

SEQ ID NO: 5026875 - DNA, 15 bp, Homo sapiens
agtaaatacaatttt

SEQ ID NO: 5026876 - DNA, 18 bp, Homo sapiens
agtaactggttgctgtgt

SEQ ID NO: 5026877 - DNA, 16 bp, Homo sapiens
agtaatcccatttccc

SEQ ID NO: 5026878 - DNA, 23 bp, Homo sapiens
agtaccccctcaaaccctgccct

SEQ ID NO: 5026879 - DNA, 18 bp, Homo sapiens
agtaccctctcagctcca

SEQ ID NO: 5026880 - DNA, 19 bp, Homo sapiens
agtacctgggcaagctggc

SEQ ID NO: 5026881 - DNA, 16 bp, Homo sapiens
agtagttttcaaaaca

SEQ ID NO: 5026882 - DNA, 21 bp, Homo sapiens
agtagtttttacagctgtgtt

SEQ ID NO: 5026883 - DNA, 17 bp, Homo sapiens
agtatgggactggcctc

SEQ ID NO: 5026884 - DNA, 20 bp, Homo sapiens
agtatgggactggcctctgc

SEQ ID NO: 5026885 - DNA, 19 bp, Homo sapiens
agtatgggggttgtaaatt

SEQ ID NO: 5026886 - DNA, 19 bp, Homo sapiens
agtatggtaggggagggca

SEQ ID NO: 5026887 - DNA, 23 bp, Homo sapiens
agtatggtaggggagggcaggct

SEQ ID NO: 5026888 - DNA, 18 bp, Homo sapiens
agtatgttctaaccttta

SEQ ID NO: 5026889 - DNA, 21 bp, Homo sapiens
agtatgttctaacctttacat

SEQ ID NO: 5026890 - DNA, 15 bp, Homo sapiens
agtattgaagcattt

SEQ ID NO: 5026891 - DNA, 20 bp, Homo sapiens
agtattgaagcattttataa

SEQ ID NO: 5026892 - DNA, 22 bp, Homo sapiens
agtattgctcacccagtgccct

SEQ ID NO: 5026893 - DNA, 18 bp, Homo sapiens
agtattggggtctgaccc

SEQ ID NO: 5026894 - DNA, 16 bp, Homo sapiens
agtattgttgtccttt

SEQ ID NO: 5026895 - DNA, 16 bp, Homo sapiens
agtattttaaaatagc

SEQ ID NO: 5026896 - DNA, 17 bp, Homo sapiens
agtcaaatctgggctca

SEQ ID NO: 5026897 - DNA, 14 bp, Homo sapiens
agtcacatctcttc

SEQ ID NO: 5026898 - DNA, 16 bp, Homo sapiens
agtcacatctcttcct

SEQ ID NO: 5026899 - DNA, 18 bp, Homo sapiens
agtcattgtatgttatta

SEQ ID NO: 5026900 - DNA, 16 bp, Homo sapiens
agtccaaccagaaaca

SEQ ID NO: 5026901 - DNA, 21 bp, Homo sapiens
agtccaaccagaaacacccct

SEQ ID NO: 5026902 - DNA, 20 bp, Homo sapiens
agtcccaagcggtgtctctc

SEQ ID NO: 5026903 - DNA, 22 bp, Homo sapiens
agtccccgaggagctgggcccc

SEQ ID NO: 5026904 - DNA, 16 bp, Homo sapiens
agtcccctcacctcct

SEQ ID NO: 5026905 - DNA, 17 bp, Homo sapiens
agtcctggatgttgtgt

SEQ ID NO: 5026906 - DNA, 18 bp, Homo sapiens
agtcctggatgttgtgtg

SEQ ID NO: 5026907 - DNA, 18 bp, Homo sapiens
agtctctgaagtgaaact

SEQ ID NO: 5026908 - DNA, 16 bp, Homo sapiens
agacgttttataagca

SEQ ID NO: 5026909 - DNA, 18 bp, Homo sapiens
agactctttttttgagtg

SEQ ID NO: 5026910 - DNA, 22 bp, Homo sapiens
agactctttttttgagtgacag

SEQ ID NO: 5026911 - DNA, 18 bp, Homo sapiens
agactgggctctggctct

SEQ ID NO: 5026912 - DNA, 21 bp, Homo sapiens
agacttggattctttccattt

SEQ ID NO: 5026913 - DNA, 21 bp, Homo sapiens
agactttaacataagctattt

SEQ ID NO: 5026914 - DNA, 23 bp, Homo sapiens
agagaagcattctcattggaaat

SEQ ID NO: 5026915 - DNA, 13 bp, Homo sapiens
agagacccccagg

SEQ ID NO: 5026916 - DNA, 19 bp, Homo sapiens
agagagaaaaaaaaaatag

SEQ ID NO: 5026917 - DNA, 12 bp, Homo sapiens
agagagagaaaa

SEQ ID NO: 5026918 - DNA, 15 bp, Homo sapiens
agagagagagagaaa

SEQ ID NO: 5026919 - DNA, 15 bp, Homo sapiens
agagagtttcaaaag

SEQ ID NO: 5026920 - DNA, 13 bp, Homo sapiens
agagatacagagg

SEQ ID NO: 5026921 - DNA, 13 bp, Homo sapiens
agagccagcagca

SEQ ID NO: 5026922 - DNA, 14 bp, Homo sapiens
agagcttgctccag

SEQ ID NO: 5026923 - DNA, 11 bp, Homo sapiens
agagctttccg

SEQ ID NO: 5026924 - DNA, 13 bp, Homo sapiens
agaggcagtacct

SEQ ID NO: 5026925 - DNA, 22 bp, Homo sapiens
agaggcctgggggacccctggc

SEQ ID NO: 5026926 - DNA, 14 bp, Homo sapiens
agaggtggatgtta

SEQ ID NO: 5026927 - DNA, 15 bp, Homo sapiens
agaggtttgcagtcc

SEQ ID NO: 5026928 - DNA, 15 bp, Homo sapiens
agagtggaggcgggc

SEQ ID NO: 5026929 - DNA, 20 bp, Homo sapiens
agagtgggacagttcctgag

SEQ ID NO: 5026930 - DNA, 16 bp, Homo sapiens
agataactgttattta

SEQ ID NO: 5026931 - DNA, 17 bp, Homo sapiens
agatacttcccaaagcc

SEQ ID NO: 5026932 - DNA, 20 bp, Homo sapiens
agatctttctttccaaaaca

SEQ ID NO: 5026933 - DNA, 20 bp, Homo sapiens
agatgactatgcagaggcct

SEQ ID NO: 5026934 - DNA, 16 bp, Homo sapiens
agattatcgttttctt

SEQ ID NO: 5026935 - DNA, 17 bp, Homo sapiens
agattatcgttttctta

SEQ ID NO: 5026936 - DNA, 18 bp, Homo sapiens
agatttattaaagaaaaa

SEQ ID NO: 5026937 - DNA, 19 bp, Homo sapiens
agatttattaaagaaaaaa

SEQ ID NO: 5026938 - DNA, 15 bp, Homo sapiens
agatttgtttttaaa

SEQ ID NO: 5026939 - DNA, 19 bp, Homo sapiens
agatttgtttttaaactgt

SEQ ID NO: 5026940 - DNA, 22 bp, Homo sapiens
agcaaaaactacattttgcaac

SEQ ID NO: 5026941 - DNA, 21 bp, Homo sapiens
agcaaaaatctcccagtgaca

SEQ ID NO: 5026942 - DNA, 19 bp, Homo sapiens
agcaaacccagaggtggat

SEQ ID NO: 5026943 - DNA, 17 bp, Homo sapiens
agcaacagcttcagaaa

SEQ ID NO: 5026944 - DNA, 13 bp, Homo sapiens
agcacaaattagt

SEQ ID NO: 5026945 - DNA, 22 bp, Homo sapiens
agcacaaggccttgcctggcct

SEQ ID NO: 5026946 - DNA, 13 bp, Homo sapiens
agcaccacactgg

SEQ ID NO: 5026947 - DNA, 16 bp, Homo sapiens
agcactgcctgctccc

SEQ ID NO: 5026948 - DNA, 18 bp, Homo sapiens
agcagcagccactgcaca

SEQ ID NO: 5026949 - DNA, 13 bp, Homo sapiens
agcagcgagcctg

SEQ ID NO: 5026950 - DNA, 23 bp, Homo sapiens
agcaggaggcccttgtcgtggga

SEQ ID NO: 5026951 - DNA, 15 bp, Homo sapiens
agcaggctgtgagtt

SEQ ID NO: 5026952 - DNA, 13 bp, Homo sapiens
agcaggtgactgt

SEQ ID NO: 5026953 - DNA, 18 bp, Homo sapiens
agcagtccccttccctcc

SEQ ID NO: 5026954 - DNA, 17 bp, Homo sapiens
agcatcacagttttggt

SEQ ID NO: 5026955 - DNA, 22 bp, Homo sapiens
agcatcattatttatgtattgt

SEQ ID NO: 5026956 - DNA, 24 bp, Homo sapiens
agcatgtttagactttaacataag

SEQ ID NO: 5026957 - DNA, 14 bp, Homo sapiens
agcattctcattgg

SEQ ID NO: 5026958 - DNA, 22 bp, Homo sapiens
agcattgtagtgctttgagaga

SEQ ID NO: 5026959 - DNA, 16 bp, Homo sapiens
agccaaacctctgtga

SEQ ID NO: 5026960 - DNA, 14 bp, Homo sapiens
agccacccaagcct

SEQ ID NO: 5026961 - DNA, 17 bp, Homo sapiens
agccacccaagcctgct

SEQ ID NO: 5026962 - DNA, 23 bp, Homo sapiens
agccacccaagcctgctggctgc

SEQ ID NO: 5026963 - DNA, 19 bp, Homo sapiens
agccacccgtggggtgctg

SEQ ID NO: 5026964 - DNA, 23 bp, Homo sapiens
agccacccgtggggtgctgccct

SEQ ID NO: 5026965 - DNA, 16 bp, Homo sapiens
agccactaaaacacaa

SEQ ID NO: 5026966 - DNA, 21 bp, Homo sapiens
agccagctcacagtgctgtgt

SEQ ID NO: 5026967 - DNA, 12 bp, Homo sapiens
agccagtctcag

SEQ ID NO: 5026968 - DNA, 24 bp, Homo sapiens
agcccagaaagtgataagtgcagg

SEQ ID NO: 5026969 - DNA, 14 bp, Homo sapiens
agcccgaacaccat

SEQ ID NO: 5026970 - DNA, 14 bp, Homo sapiens
agcccgaatacaaa

SEQ ID NO: 5026971 - DNA, 19 bp, Homo sapiens
agcccgcagggccatgcag

SEQ ID NO: 5026972 - DNA, 21 bp, Homo sapiens
agcccgcagggccatgcagac

SEQ ID NO: 5026973 - DNA, 12 bp, Homo sapiens
agccctggctga

SEQ ID NO: 5026974 - DNA, 15 bp, Homo sapiens
agccctggctgaagg

SEQ ID NO: 5026975 - DNA, 20 bp, Homo sapiens
agccctggctgaaggactgt

SEQ ID NO: 5026976 - DNA, 18 bp, Homo sapiens
agccgtattttacatgaa

SEQ ID NO: 5026977 - DNA, 19 bp, Homo sapiens
agccgtttgttccccaaga

SEQ ID NO: 5026978 - DNA, 22 bp, Homo sapiens
agcctctggcattagaattatt

SEQ ID NO: 5026979 - DNA, 23 bp, Homo sapiens
agcctctggcattagaattattt

SEQ ID NO: 5026980 - DNA, 14 bp, Homo sapiens
agcctgcctggcag

SEQ ID NO: 5026981 - DNA, 13 bp, Homo sapiens
agcctgctggctg

SEQ ID NO: 5026982 - DNA, 15 bp, Homo sapiens
agcctgctggctgcg

SEQ ID NO: 5026983 - DNA, 19 bp, Homo sapiens
agcctgggaaagcccctgc

SEQ ID NO: 5026984 - DNA, 15 bp, Homo sapiens
agcctttggaaacag

SEQ ID NO: 5026985 - DNA, 16 bp, Homo sapiens
agcgaccgccccctcc

SEQ ID NO: 5026986 - DNA, 17 bp, Homo sapiens
agcgaccgccccctcct

SEQ ID NO: 5026987 - DNA, 22 bp, Homo sapiens
agcgaccttcctcatccacccc

SEQ ID NO: 5026988 - DNA, 15 bp, Homo sapiens
agcgagagagtttca

SEQ ID NO: 5026989 - DNA, 22 bp, Homo sapiens
agcgagcccctcggctctggag

SEQ ID NO: 5026990 - DNA, 23 bp, Homo sapiens
agcgcagttttttttttcttgtc

SEQ ID NO: 5026991 - DNA, 16 bp, Homo sapiens
agcgctggccgggacc

SEQ ID NO: 5026992 - DNA, 17 bp, Homo sapiens
agcggaacaaggagtca

SEQ ID NO: 5026993 - DNA, 17 bp, Homo sapiens
agcggagtctgtcctgt

SEQ ID NO: 5026994 - DNA, 20 bp, Homo sapiens
agcggccccccgcacagcca

SEQ ID NO: 5026995 - DNA, 20 bp, Homo sapiens
agcgtgagcttaaaatacaa

SEQ ID NO: 5026996 - DNA, 14 bp, Homo sapiens
agcgtgtgggtccc

SEQ ID NO: 5026997 - DNA, 16 bp, Homo sapiens
agctaataaaaagctt

SEQ ID NO: 5026998 - DNA, 15 bp, Homo sapiens
agctacttcctcctc

SEQ ID NO: 5026999 - DNA, 16 bp, Homo sapiens
agctacttggtttgtg

SEQ ID NO: 5027000 - DNA, 19 bp, Homo sapiens
agctagtcttttgcttttg

SEQ ID NO: 5027001 - DNA, 14 bp, Homo sapiens
agctatttttctaa

SEQ ID NO: 5027002 - DNA, 15 bp, Homo sapiens
agctatttttctaac

SEQ ID NO: 5027003 - DNA, 15 bp, Homo sapiens
agctcaatgagcatg

SEQ ID NO: 5027004 - DNA, 17 bp, Homo sapiens
agctcagcactgcctgc

SEQ ID NO: 5027005 - DNA, 12 bp, Homo sapiens
agctcctcccac

SEQ ID NO: 5027006 - DNA, 11 bp, Homo sapiens
agctctctgac

SEQ ID NO: 5027007 - DNA, 21 bp, Homo sapiens
agctctctgacgcttgtgaca

SEQ ID NO: 5027008 - DNA, 23 bp, Homo sapiens
agctctctgacgcttgtgacagt

SEQ ID NO: 5027009 - DNA, 22 bp, Homo sapiens
agctgaatgtttttctaaagga

SEQ ID NO: 5027010 - DNA, 15 bp, Homo sapiens
agctgagcaggccac

SEQ ID NO: 5027011 - DNA, 12 bp, Homo sapiens
agctgctcccca

SEQ ID NO: 5027012 - DNA, 16 bp, Homo sapiens
agctgctccccaggcc

SEQ ID NO: 5027013 - DNA, 16 bp, Homo sapiens
agctggatagacttgg

SEQ ID NO: 5027014 - DNA, 18 bp, Homo sapiens
agctggccaaagagcctt

SEQ ID NO: 5027015 - DNA, 17 bp, Homo sapiens
agctgggcccctgcaca

SEQ ID NO: 5027016 - DNA, 21 bp, Homo sapiens
agctgtataattaattgtcat

SEQ ID NO: 5027017 - DNA, 13 bp, Homo sapiens
agctgtgtctgcc

SEQ ID NO: 5027018 - DNA, 23 bp, Homo sapiens
agctgttttgttgacattctgaa

SEQ ID NO: 5027019 - DNA, 14 bp, Homo sapiens
agcttaaaatacaa

SEQ ID NO: 5027020 - DNA, 17 bp, Homo sapiens
agcttaaaatacaagac

SEQ ID NO: 5027021 - DNA, 18 bp, Homo sapiens
agcttatacgaaataatt

SEQ ID NO: 5027022 - DNA, 20 bp, Homo sapiens
agcttatacgaaataattgt

SEQ ID NO: 5027023 - DNA, 18 bp, Homo sapiens
gttcattaaacgtcattc

SEQ ID NO: 5027024 - DNA, 16 bp, Homo sapiens
gttcattgcactttga

SEQ ID NO: 5027025 - DNA, 19 bp, Homo sapiens
gttcccgtttctccaccta

SEQ ID NO: 5027026 - DNA, 16 bp, Homo sapiens
gttctaacctttacat

SEQ ID NO: 5027027 - DNA, 18 bp, Homo sapiens
gttctccttttcctctct

SEQ ID NO: 5027028 - DNA, 18 bp, Homo sapiens
gttctggtgtgaactaaa

SEQ ID NO: 5027029 - DNA, 22 bp, Homo sapiens
gttctgtgtctttcacagctcc

SEQ ID NO: 5027030 - DNA, 14 bp, Homo sapiens
gttctgttaactga

SEQ ID NO: 5027031 - DNA, 16 bp, Homo sapiens
gttctgttaactgaat

SEQ ID NO: 5027032 - DNA, 18 bp, Homo sapiens
gttctgttaactgaatac

SEQ ID NO: 5027033 - DNA, 22 bp, Homo sapiens
gttctgtttgttattgttttgt

SEQ ID NO: 5027034 - DNA, 12 bp, Homo sapiens
gttctgttttgt

SEQ ID NO: 5027035 - DNA, 16 bp, Homo sapiens
gttcttagctcaatga

SEQ ID NO: 5027036 - DNA, 18 bp, Homo sapiens
gttcttgtattaagaatg

SEQ ID NO: 5027037 - DNA, 13 bp, Homo sapiens
gttgacattctga

SEQ ID NO: 5027038 - DNA, 17 bp, Homo sapiens
gttgagatagttttcat

SEQ ID NO: 5027039 - DNA, 15 bp, Homo sapiens
gttgagcccctggag

SEQ ID NO: 5027040 - DNA, 17 bp, Homo sapiens
gttggaaggatctgctg

SEQ ID NO: 5027041 - DNA, 19 bp, Homo sapiens
gttggaaggatctgctgag

SEQ ID NO: 5027042 - DNA, 17 bp, Homo sapiens
gttggtgcacagcacaa

SEQ ID NO: 5027043 - DNA, 14 bp, Homo sapiens
gttgtccttttcat

SEQ ID NO: 5027044 - DNA, 11 bp, Homo sapiens
gttgtctctga

SEQ ID NO: 5027045 - DNA, 14 bp, Homo sapiens
gttgtctctgatgc

SEQ ID NO: 5027046 - DNA, 15 bp, Homo sapiens
gttgtctctgatgca

SEQ ID NO: 5027047 - DNA, 18 bp, Homo sapiens
gttgttctgttaactgaa

SEQ ID NO: 5027048 - DNA, 14 bp, Homo sapiens
gttgttgcatgttt

SEQ ID NO: 5027049 - DNA, 14 bp, Homo sapiens
gtttaaatgaacaa

SEQ ID NO: 5027050 - DNA, 16 bp, Homo sapiens
gtttagggaacaattt

SEQ ID NO: 5027051 - DNA, 17 bp, Homo sapiens
gtttagggaacaatttg

SEQ ID NO: 5027052 - DNA, 21 bp, Homo sapiens
gtttatgagatgctggttttc

SEQ ID NO: 5027053 - DNA, 21 bp, Homo sapiens
gtttatgttccattaaacgat

SEQ ID NO: 5027054 - DNA, 16 bp, Homo sapiens
gtttcatttctgcaga

SEQ ID NO: 5027055 - DNA, 18 bp, Homo sapiens
gtttctgtttgattcttt

SEQ ID NO: 5027056 - DNA, 19 bp, Homo sapiens
gtttgaggtttttaagcct

SEQ ID NO: 5027057 - DNA, 20 bp, Homo sapiens
gtttgtcctttttcactttg

SEQ ID NO: 5027058 - DNA, 15 bp, Homo sapiens
gtttgtgtgtcttaa

SEQ ID NO: 5027059 - DNA, 15 bp, Homo sapiens
gtttgtgttctgttt

SEQ ID NO: 5027060 - DNA, 17 bp, Homo sapiens
gtttgtgttctgttttg

SEQ ID NO: 5027061 - DNA, 22 bp, Homo sapiens
gtttgttggttggttttcttct

SEQ ID NO: 5027062 - DNA, 20 bp, Homo sapiens
gtttgttttagaaccagccg

SEQ ID NO: 5027063 - DNA, 21 bp, Homo sapiens
gttttaatttaaacacctcct

SEQ ID NO: 5027064 - DNA, 16 bp, Homo sapiens
gttttaggtagaaaaa

SEQ ID NO: 5027065 - DNA, 20 bp, Homo sapiens
gttttataagcatcattatt

SEQ ID NO: 5027066 - DNA, 22 bp, Homo sapiens
gttttataagcatcattattta

SEQ ID NO: 5027067 - DNA, 23 bp, Homo sapiens
gttttataagcatcattatttat

SEQ ID NO: 5027068 - DNA, 19 bp, Homo sapiens
gttttctcctgcctgtgct

SEQ ID NO: 5027069 - DNA, 13 bp, Homo sapiens
gttttctgaaaca

SEQ ID NO: 5027070 - DNA, 14 bp, Homo sapiens
gttttgttgacatt

SEQ ID NO: 5027071 - DNA, 16 bp, Homo sapiens
gttttgttgacattct

SEQ ID NO: 5027072 - DNA, 18 bp, Homo sapiens
gttttgttgacattctga

SEQ ID NO: 5027073 - DNA, 17 bp, Homo sapiens
gtttttaaactgtacag

SEQ ID NO: 5027074 - DNA, 22 bp, Homo sapiens
gttttttcatcttcagttgtct

SEQ ID NO: 5027075 - DNA, 14 bp, Homo sapiens
taaaaatgctgctc

SEQ ID NO: 5027076 - DNA, 21 bp, Homo sapiens
taaaagaacaatgacaaacac

SEQ ID NO: 5027077 - DNA, 18 bp, Homo sapiens
taaaatacaagactgcca

SEQ ID NO: 5027078 - DNA, 20 bp, Homo sapiens
taaaatagcgttcttgtaat

SEQ ID NO: 5027079 - DNA, 18 bp, Homo sapiens
taaaatctgtttttctca

SEQ ID NO: 5027080 - DNA, 19 bp, Homo sapiens
taaacaagaaaaataaaga

SEQ ID NO: 5027081 - DNA, 19 bp, Homo sapiens
taaacattggttcttgtat

SEQ ID NO: 5027082 - DNA, 19 bp, Homo sapiens
taaacgatttttaaaatgt

SEQ ID NO: 5027083 - DNA, 21 bp, Homo sapiens
taaacgatttttaaaatgtac

SEQ ID NO: 5027084 - DNA, 12 bp, Homo sapiens
taaactgtacag

SEQ ID NO: 5027085 - DNA, 14 bp, Homo sapiens
taaactgtacagtg

SEQ ID NO: 5027086 - DNA, 18 bp, Homo sapiens
taaactgtacagtgtctt

SEQ ID NO: 5027087 - DNA, 19 bp, Homo sapiens
taaactgtacagtgtcttt

SEQ ID NO: 5027088 - DNA, 12 bp, Homo sapiens
taaactttcaca

SEQ ID NO: 5027089 - DNA, 19 bp, Homo sapiens
ggtagagacccccaggcct

SEQ ID NO: 5027090 - DNA, 17 bp, Homo sapiens
ggtaggggagggcaggc

SEQ ID NO: 5027091 - DNA, 16 bp, Homo sapiens
ggtagtgtagctgtgt

SEQ ID NO: 5027092 - DNA, 12 bp, Homo sapiens
ggtatattttcc

SEQ ID NO: 5027093 - DNA, 12 bp, Homo sapiens
ggtatgtttaat

SEQ ID NO: 5027094 - DNA, 18 bp, Homo sapiens
ggtatgtttaatctgtta

SEQ ID NO: 5027095 - DNA, 12 bp, Homo sapiens
ggtattttcaat

SEQ ID NO: 5027096 - DNA, 13 bp, Homo sapiens
ggtcaagcccaga

SEQ ID NO: 5027097 - DNA, 13 bp, Homo sapiens
ggtcactggaact

SEQ ID NO: 5027098 - DNA, 17 bp, Homo sapiens
ggtccagccctggctga

SEQ ID NO: 5027099 - DNA, 19 bp, Homo sapiens
ggtccagccctggctgaag

SEQ ID NO: 5027100 - DNA, 21 bp, Homo sapiens
ggtccagccctggctgaagga

SEQ ID NO: 5027101 - DNA, 23 bp, Homo sapiens
ggtccagccctggctgaaggact

SEQ ID NO: 5027102 - DNA, 14 bp, Homo sapiens
ggtcccagcagctg

SEQ ID NO: 5027103 - DNA, 14 bp, Homo sapiens
ggtcctctctctgt

SEQ ID NO: 5027104 - DNA, 17 bp, Homo sapiens
ggtcctggagcagacca

SEQ ID NO: 5027105 - DNA, 14 bp, Homo sapiens
ggtcgtgggccagt

SEQ ID NO: 5027106 - DNA, 12 bp, Homo sapiens
ggtgactctgtc

SEQ ID NO: 5027107 - DNA, 12 bp, Homo sapiens
ggtgactgtgct

SEQ ID NO: 5027108 - DNA, 12 bp, Homo sapiens
ggtgagaaaaaa

SEQ ID NO: 5027109 - DNA, 17 bp, Homo sapiens
ggtgaggggctggcact

SEQ ID NO: 5027110 - DNA, 16 bp, Homo sapiens
ggtgcacccacctgtt

SEQ ID NO: 5027111 - DNA, 22 bp, Homo sapiens
ggtgcacccacctgttttctga

SEQ ID NO: 5027112 - DNA, 15 bp, Homo sapiens
ggtgccaactggtgt

SEQ ID NO: 5027113 - DNA, 17 bp, Homo sapiens
ggtgcctgtcccacccc

SEQ ID NO: 5027114 - DNA, 14 bp, Homo sapiens
ggtgcgtctccagt

SEQ ID NO: 5027115 - DNA, 17 bp, Homo sapiens
ggtgcgtctccagtcat

SEQ ID NO: 5027116 - DNA, 21 bp, Homo sapiens
ggtgcgtgttcagcagaacct

SEQ ID NO: 5027117 - DNA, 22 bp, Homo sapiens
ggtgggaccctgtccggcccag

SEQ ID NO: 5027118 - DNA, 13 bp, Homo sapiens
ggtggtattttca

SEQ ID NO: 5027119 - DNA, 20 bp, Homo sapiens
ggtggtattttcaatagcca

SEQ ID NO: 5027120 - DNA, 17 bp, Homo sapiens
ggtggtgcccgtgcccg

SEQ ID NO: 5027121 - DNA, 12 bp, Homo sapiens
ggtgtggctcct

SEQ ID NO: 5027122 - DNA, 16 bp, Homo sapiens
ggttaagtctgtttta

SEQ ID NO: 5027123 - DNA, 23 bp, Homo sapiens
ggttaagtctgttttatgacttc

SEQ ID NO: 5027124 - DNA, 16 bp, Homo sapiens
ggttcctcccctcctc

SEQ ID NO: 5027125 - DNA, 21 bp, Homo sapiens
ggttctaggcatctctgtact

SEQ ID NO: 5027126 - DNA, 23 bp, Homo sapiens
ggttctaggcatctctgtacttt

SEQ ID NO: 5027127 - DNA, 18 bp, Homo sapiens
ggttctggtgtgaactaa

SEQ ID NO: 5027128 - DNA, 20 bp, Homo sapiens
ggttgttttttcctttgctc

SEQ ID NO: 5027129 - DNA, 17 bp, Homo sapiens
ggtttacctagagaaca

SEQ ID NO: 5027130 - DNA, 23 bp, Homo sapiens
ggtttgtcgggcaccagccagcg

SEQ ID NO: 5027131 - DNA, 17 bp, Homo sapiens
ggttttaggtagaaaaa

SEQ ID NO: 5027132 - DNA, 13 bp, Homo sapiens
ggttttcgagatt

SEQ ID NO: 5027133 - DNA, 17 bp, Homo sapiens
gtaaaatggagacacca

SEQ ID NO: 5027134 - DNA, 11 bp, Homo sapiens
gtaaatataaa

SEQ ID NO: 5027135 - DNA, 12 bp, Homo sapiens
gtaaatataaag

SEQ ID NO: 5027136 - DNA, 13 bp, Homo sapiens
gtaaatataaaga

SEQ ID NO: 5027137 - DNA, 19 bp, Homo sapiens
gtaaatataaagacgtttt

SEQ ID NO: 5027138 - DNA, 18 bp, Homo sapiens
gtaagagcttgctccaga

SEQ ID NO: 5027139 - DNA, 16 bp, Homo sapiens
gtaagtgttctcatga

SEQ ID NO: 5027140 - DNA, 16 bp, Homo sapiens
gtaataatgtgaatca

SEQ ID NO: 5027141 - DNA, 17 bp, Homo sapiens
gtaataatgtgaatcat

SEQ ID NO: 5027142 - DNA, 22 bp, Homo sapiens
gtaatcaatctactcaaagcat

SEQ ID NO: 5027143 - DNA, 16 bp, Homo sapiens
gtaatggcagttatat

SEQ ID NO: 5027144 - DNA, 16 bp, Homo sapiens
gtacaatgtacacact

SEQ ID NO: 5027145 - DNA, 24 bp, Homo sapiens
gtacagtatgggggttgtaaattg

SEQ ID NO: 5027146 - DNA, 14 bp, Homo sapiens
gtacagtgtctttt

SEQ ID NO: 5027147 - DNA, 21 bp, Homo sapiens
gtacagtgtctttttttgtat

SEQ ID NO: 5027148 - DNA, 19 bp, Homo sapiens
gtacataccctggccgccc

SEQ ID NO: 5027149 - DNA, 19 bp, Homo sapiens
gtacctgtgggttagcatc

SEQ ID NO: 5027150 - DNA, 13 bp, Homo sapiens
gtactagttttag

SEQ ID NO: 5027151 - DNA, 14 bp, Homo sapiens
gtactgttctgtgt

SEQ ID NO: 5027152 - DNA, 17 bp, Homo sapiens
gtactgttctgtgtctt

SEQ ID NO: 5027153 - DNA, 16 bp, Homo sapiens
gtacttgtttctctgt

SEQ ID NO: 5027154 - DNA, 12 bp, Homo sapiens
gtacttgtttgc

SEQ ID NO: 5027155 - DNA, 12 bp, Homo sapiens
gtagaaaaacat

SEQ ID NO: 5027156 - DNA, 17 bp, Homo sapiens
gtagcgtctttcttttt

SEQ ID NO: 5027157 - DNA, 22 bp, Homo sapiens
gtagtgaaataatagaatgagc

SEQ ID NO: 5027158 - DNA, 17 bp, Homo sapiens
gtagttttcaaaacaca

SEQ ID NO: 5027159 - DNA, 22 bp, Homo sapiens
gtagtttttacagctgtgttat

SEQ ID NO: 5027160 - DNA, 13 bp, Homo sapiens
gtagttttttcat

SEQ ID NO: 5027161 - DNA, 14 bp, Homo sapiens
gtagttttttcatc

SEQ ID NO: 5027162 - DNA, 15 bp, Homo sapiens
gtagttttttcatct

SEQ ID NO: 5027163 - DNA, 16 bp, Homo sapiens
gtataaacaagaaaaa

SEQ ID NO: 5027164 - DNA, 17 bp, Homo sapiens
gtataaacaagaaaaat

SEQ ID NO: 5027165 - DNA, 14 bp, Homo sapiens
gtatgaattattca

SEQ ID NO: 5027166 - DNA, 14 bp, Homo sapiens
gtgggatttgtaaa

SEQ ID NO: 5027167 - DNA, 20 bp, Homo sapiens
gtggggctaggggctggggc

SEQ ID NO: 5027168 - DNA, 12 bp, Homo sapiens
gtggggctgagc

SEQ ID NO: 5027169 - DNA, 18 bp, Homo sapiens
gtggggctgagctgggga

SEQ ID NO: 5027170 - DNA, 22 bp, Homo sapiens
gtgggtcacacacacgcactgc

SEQ ID NO: 5027171 - DNA, 14 bp, Homo sapiens
gtggtaccctctgg

SEQ ID NO: 5027172 - DNA, 20 bp, Homo sapiens
gtggttggggccctgccctg

SEQ ID NO: 5027173 - DNA, 16 bp, Homo sapiens
gtgtacaatgtacaca

SEQ ID NO: 5027174 - DNA, 20 bp, Homo sapiens
gtgtacaatgtacacactgg

SEQ ID NO: 5027175 - DNA, 12 bp, Homo sapiens
gtgtagctgtgt

SEQ ID NO: 5027176 - DNA, 15 bp, Homo sapiens
gtgtagctgtgtggc

SEQ ID NO: 5027177 - DNA, 17 bp, Homo sapiens
gtgtataaacaagaaaa

SEQ ID NO: 5027178 - DNA, 14 bp, Homo sapiens
gtgtcttaattatt

SEQ ID NO: 5027179 - DNA, 15 bp, Homo sapiens
gtgtcttaattatta

SEQ ID NO: 5027180 - DNA, 17 bp, Homo sapiens
gtgtctttagatagccc

SEQ ID NO: 5027181 - DNA, 17 bp, Homo sapiens
gtgtggagagagaggct

SEQ ID NO: 5027182 - DNA, 14 bp, Homo sapiens
gtgtggctccttcc

SEQ ID NO: 5027183 - DNA, 14 bp, Homo sapiens
gtgtgtcttaatta

SEQ ID NO: 5027184 - DNA, 17 bp, Homo sapiens
gtgtgttaagctctgct

SEQ ID NO: 5027185 - DNA, 14 bp, Homo sapiens
gtgttaagctctgc

SEQ ID NO: 5027186 - DNA, 16 bp, Homo sapiens
gtgttattctttgcgt

SEQ ID NO: 5027187 - DNA, 18 bp, Homo sapiens
gtgttctcatgaagcagg

SEQ ID NO: 5027188 - DNA, 16 bp, Homo sapiens
gtgttctccttttcct

SEQ ID NO: 5027189 - DNA, 12 bp, Homo sapiens
gtgtttaaaaaa

SEQ ID NO: 5027190 - DNA, 17 bp, Homo sapiens
gtgtttatcctttcata

SEQ ID NO: 5027191 - DNA, 15 bp, Homo sapiens
gtgttttaatttaaa

SEQ ID NO: 5027192 - DNA, 20 bp, Homo sapiens
gttaaaagaggtttttctta

SEQ ID NO: 5027193 - DNA, 18 bp, Homo sapiens
gttaactgagtgcctttt

SEQ ID NO: 5027194 - DNA, 15 bp, Homo sapiens
gttaagctctgctat

SEQ ID NO: 5027195 - DNA, 23 bp, Homo sapiens
gttactcttcagttaagcctttg

SEQ ID NO: 5027196 - DNA, 15 bp, Homo sapiens
gttatataatttaga

SEQ ID NO: 5027197 - DNA, 13 bp, Homo sapiens
gttatatataaat

SEQ ID NO: 5027198 - DNA, 16 bp, Homo sapiens
gttatatataaatata

SEQ ID NO: 5027199 - DNA, 19 bp, Homo sapiens
gttatatataaatatatta

SEQ ID NO: 5027200 - DNA, 22 bp, Homo sapiens
gttatatataaatatattatta

SEQ ID NO: 5027201 - DNA, 14 bp, Homo sapiens
gttatattttgcag

SEQ ID NO: 5027202 - DNA, 20 bp, Homo sapiens
gttatcacctagctgaatgt

SEQ ID NO: 5027203 - DNA, 13 bp, Homo sapiens
gttatctctgtgt

SEQ ID NO: 5027204 - DNA, 23 bp, Homo sapiens
gttatgaacagctgtgtctgcca

SEQ ID NO: 5027205 - DNA, 17 bp, Homo sapiens
gttatgtactagtgttc

SEQ ID NO: 5027206 - DNA, 22 bp, Homo sapiens
gttatgtactagtgttctgttt

SEQ ID NO: 5027207 - DNA, 14 bp, Homo sapiens
gttatttataatca

SEQ ID NO: 5027208 - DNA, 15 bp, Homo sapiens
gttcaacccacagct

SEQ ID NO: 5027209 - DNA, 21 bp, Homo sapiens
ggatctccctgagatgggctt

SEQ ID NO: 5027210 - DNA, 21 bp, Homo sapiens
ggatctgctgaggcccagtgc

SEQ ID NO: 5027211 - DNA, 20 bp, Homo sapiens
ggatgcattcgagatggcag

SEQ ID NO: 5027212 - DNA, 21 bp, Homo sapiens
ggatgctcctcccttctctac

SEQ ID NO: 5027213 - DNA, 19 bp, Homo sapiens
ggattattagaatcaaaca

SEQ ID NO: 5027214 - DNA, 13 bp, Homo sapiens
ggattttaccaaa

SEQ ID NO: 5027215 - DNA, 14 bp, Homo sapiens
ggattttaccaaag

SEQ ID NO: 5027216 - DNA, 15 bp, Homo sapiens
ggcaattttgtggtt

SEQ ID NO: 5027217 - DNA, 18 bp, Homo sapiens
ggcacaagtcctggatgt

SEQ ID NO: 5027218 - DNA, 15 bp, Homo sapiens
ggcagatggggagac

SEQ ID NO: 5027219 - DNA, 16 bp, Homo sapiens
ggcagccacccaagcc

SEQ ID NO: 5027220 - DNA, 16 bp, Homo sapiens
ggcagcctcttcaaaa

SEQ ID NO: 5027221 - DNA, 20 bp, Homo sapiens
ggcagggtggggagggagcc

SEQ ID NO: 5027222 - DNA, 17 bp, Homo sapiens
ggcagtacctgggcaag

SEQ ID NO: 5027223 - DNA, 12 bp, Homo sapiens
ggcagttatatt

SEQ ID NO: 5027224 - DNA, 14 bp, Homo sapiens
ggcagttggccaga

SEQ ID NO: 5027225 - DNA, 21 bp, Homo sapiens
ggcatagctccccgcttctgc

SEQ ID NO: 5027226 - DNA, 15 bp, Homo sapiens
ggcatggaaggggct

SEQ ID NO: 5027227 - DNA, 21 bp, Homo sapiens
ggcatgtatgacgtgactggc

SEQ ID NO: 5027228 - DNA, 13 bp, Homo sapiens
ggccaaataaagt

SEQ ID NO: 5027229 - DNA, 16 bp, Homo sapiens
ggccaagcagtgcctg

SEQ ID NO: 5027230 - DNA, 22 bp, Homo sapiens
ggccagagagcctggtgctgct

SEQ ID NO: 5027231 - DNA, 20 bp, Homo sapiens
ggccagatgcacatccctgg

SEQ ID NO: 5027232 - DNA, 11 bp, Homo sapiens
ggccaggctgg

SEQ ID NO: 5027233 - DNA, 18 bp, Homo sapiens
ggccagtacctttccatt

SEQ ID NO: 5027234 - DNA, 15 bp, Homo sapiens
ggccagtccccgagg

SEQ ID NO: 5027235 - DNA, 14 bp, Homo sapiens
ggccatctgctcct

SEQ ID NO: 5027236 - DNA, 17 bp, Homo sapiens
ggccatctgctcctgga

SEQ ID NO: 5027237 - DNA, 13 bp, Homo sapiens
ggccatgcagacc

SEQ ID NO: 5027238 - DNA, 11 bp, Homo sapiens
ggccatgcagg

SEQ ID NO: 5027239 - DNA, 16 bp, Homo sapiens
ggccatggcctctgca

SEQ ID NO: 5027240 - DNA, 20 bp, Homo sapiens
ggcccagagcgaggaaagga

SEQ ID NO: 5027241 - DNA, 17 bp, Homo sapiens
ggcccagtgccactgcc

SEQ ID NO: 5027242 - DNA, 18 bp, Homo sapiens
ggccccccgcacagccac

SEQ ID NO: 5027243 - DNA, 14 bp, Homo sapiens
ggcccctctgacct

SEQ ID NO: 5027244 - DNA, 13 bp, Homo sapiens
ggcccctggcccc

SEQ ID NO: 5027245 - DNA, 14 bp, Homo sapiens
ggcccggccacacc

SEQ ID NO: 5027246 - DNA, 15 bp, Homo sapiens
ggcccggccacaccc

SEQ ID NO: 5027247 - DNA, 17 bp, Homo sapiens
ggccctgcagccagctc

SEQ ID NO: 5027248 - DNA, 21 bp, Homo sapiens
ggccctgccagtggggaagga

SEQ ID NO: 5027249 - DNA, 15 bp, Homo sapiens
ggccctggtcctggc

SEQ ID NO: 5027250 - DNA, 15 bp, Homo sapiens
ggccctgtggcagga

SEQ ID NO: 5027251 - DNA, 19 bp, Homo sapiens
ggccctgttctcctcccca

SEQ ID NO: 5027252 - DNA, 12 bp, Homo sapiens
ggccgccccctg

SEQ ID NO: 5027253 - DNA, 18 bp, Homo sapiens
ggccgccccctgcccccc

SEQ ID NO: 5027254 - DNA, 22 bp, Homo sapiens
ggccggcttcatgccagctact

SEQ ID NO: 5027255 - DNA, 18 bp, Homo sapiens
ggcctcaaaggcccgctc

SEQ ID NO: 5027256 - DNA, 20 bp, Homo sapiens
ggcctcaaaggcccgctcta

SEQ ID NO: 5027257 - DNA, 18 bp, Homo sapiens
ggcctcaccgagtggggg

SEQ ID NO: 5027258 - DNA, 19 bp, Homo sapiens
ggcctcaccgagtgggggc

SEQ ID NO: 5027259 - DNA, 18 bp, Homo sapiens
ggcgaggcccttcctctt

SEQ ID NO: 5027260 - DNA, 18 bp, Homo sapiens
ggcgccgggcaccaactc

SEQ ID NO: 5027261 - DNA, 16 bp, Homo sapiens
ggcgcgggcagccacc

SEQ ID NO: 5027262 - DNA, 24 bp, Homo sapiens
ggcggctggggtcccagcagctgc

SEQ ID NO: 5027263 - DNA, 18 bp, Homo sapiens
ggcgggcccagaccggct

SEQ ID NO: 5027264 - DNA, 22 bp, Homo sapiens
ggcgttctaggtaggaagagcc

SEQ ID NO: 5027265 - DNA, 20 bp, Homo sapiens
ggctccgaaattccaaggcc

SEQ ID NO: 5027266 - DNA, 20 bp, Homo sapiens
ggctccttcccatcgctgtc

SEQ ID NO: 5027267 - DNA, 23 bp, Homo sapiens
ggctctgaggtgcctgtcccacc

SEQ ID NO: 5027268 - DNA, 12 bp, Homo sapiens
ggctctggctct

SEQ ID NO: 5027269 - DNA, 21 bp, Homo sapiens
ggctcttgatacccccctctg

SEQ ID NO: 5027270 - DNA, 14 bp, Homo sapiens
ggctgaaggactgt

SEQ ID NO: 5027271 - DNA, 18 bp, Homo sapiens
ggctgaaggactgtgaca

SEQ ID NO: 5027272 - DNA, 13 bp, Homo sapiens
ggctgagctgggg

SEQ ID NO: 5027273 - DNA, 16 bp, Homo sapiens
ggctgagggtgccctt

SEQ ID NO: 5027274 - DNA, 19 bp, Homo sapiens
ggctgcagagtctgcccca

SEQ ID NO: 5027275 - DNA, 20 bp, Homo sapiens
ggctgcagagtctgccccac

SEQ ID NO: 5027276 - DNA, 15 bp, Homo sapiens
ggctgccggggcagc

SEQ ID NO: 5027277 - DNA, 12 bp, Homo sapiens
ggctgcggcccc

SEQ ID NO: 5027278 - DNA, 23 bp, Homo sapiens
ggctgggagtagttgtctttcct

SEQ ID NO: 5027279 - DNA, 15 bp, Homo sapiens
ggctgggagtggcat

SEQ ID NO: 5027280 - DNA, 18 bp, Homo sapiens
ggctgtgtaaccttgggt

SEQ ID NO: 5027281 - DNA, 22 bp, Homo sapiens
ggctgtgtaagatttgttttta

SEQ ID NO: 5027282 - DNA, 15 bp, Homo sapiens
ggcttggatcctggg

SEQ ID NO: 5027283 - DNA, 19 bp, Homo sapiens
ggcttggatcctgggctgg

SEQ ID NO: 5027284 - DNA, 20 bp, Homo sapiens
gggaaaatggccatgcagga

SEQ ID NO: 5027285 - DNA, 21 bp, Homo sapiens
gggaacaatttggcaattttg

SEQ ID NO: 5027286 - DNA, 12 bp, Homo sapiens
gggaaggccagc

SEQ ID NO: 5027287 - DNA, 21 bp, Homo sapiens
gggaaggtggggtcctggagc

SEQ ID NO: 5027288 - DNA, 12 bp, Homo sapiens
gggaatgggaga

SEQ ID NO: 5027289 - DNA, 13 bp, Homo sapiens
gggaatgggagag

SEQ ID NO: 5027290 - DNA, 22 bp, Homo sapiens
gggaccactgggtgagagagga

SEQ ID NO: 5027291 - DNA, 18 bp, Homo sapiens
gggaccccgagcctggct

SEQ ID NO: 5027292 - DNA, 22 bp, Homo sapiens
gggaccctgtccggcccagtgc

SEQ ID NO: 5027293 - DNA, 14 bp, Homo sapiens
gggagacactggcc

SEQ ID NO: 5027294 - DNA, 19 bp, Homo sapiens
gggagacactggcccctca

SEQ ID NO: 5027295 - DNA, 16 bp, Homo sapiens
gggagaccctccccac

SEQ ID NO: 5027296 - DNA, 23 bp, Homo sapiens
gggagctgggagaccctccccac

SEQ ID NO: 5027297 - DNA, 12 bp, Homo sapiens
gggaggacaggc

SEQ ID NO: 5027298 - DNA, 23 bp, Homo sapiens
gggattattagaatcaaacattt

SEQ ID NO: 5027299 - DNA, 18 bp, Homo sapiens
gggattgaagggtcctgc

SEQ ID NO: 5027300 - DNA, 23 bp, Homo sapiens
gggcagccacccaagcctgctgg

SEQ ID NO: 5027301 - DNA, 12 bp, Homo sapiens
gggcaggcttgg

SEQ ID NO: 5027302 - DNA, 15 bp, Homo sapiens
gggcatttggtgaga

SEQ ID NO: 5027303 - DNA, 19 bp, Homo sapiens
gggcccacgtggttggggc

SEQ ID NO: 5027304 - DNA, 23 bp, Homo sapiens
gggcccggccacacccagcggcc

SEQ ID NO: 5027305 - DNA, 12 bp, Homo sapiens
gggcctggggct

SEQ ID NO: 5027306 - DNA, 14 bp, Homo sapiens
gggctaggggctgg

SEQ ID NO: 5027307 - DNA, 23 bp, Homo sapiens
gggctctgcaattcccctctgct

SEQ ID NO: 5027308 - DNA, 13 bp, Homo sapiens
gggctgagctggg

SEQ ID NO: 5027309 - DNA, 23 bp, Homo sapiens
gggctgagctggggacctggtac

SEQ ID NO: 5027310 - DNA, 20 bp, Homo sapiens
gggctgccggggcagccccc

SEQ ID NO: 5027311 - DNA, 16 bp, Homo sapiens
gggcttgccccactct

SEQ ID NO: 5027312 - DNA, 21 bp, Homo sapiens
ggggaaaatggccatgcagga

SEQ ID NO: 5027313 - DNA, 14 bp, Homo sapiens
ggggaaggggcggt

SEQ ID NO: 5027314 - DNA, 14 bp, Homo sapiens
ggggacaccagagc

SEQ ID NO: 5027315 - DNA, 19 bp, Homo sapiens
ggggtcctggagcagacca

SEQ ID NO: 5027316 - DNA, 21 bp, Homo sapiens
gggtcatcctgtgctcggagg

SEQ ID NO: 5027317 - DNA, 13 bp, Homo sapiens
gggtcccagcagc

SEQ ID NO: 5027318 - DNA, 17 bp, Homo sapiens
gggtgagggtcccatgt

SEQ ID NO: 5027319 - DNA, 23 bp, Homo sapiens
gggtggcccctgctgtctctctg

SEQ ID NO: 5027320 - DNA, 16 bp, Homo sapiens
ggtaaaaatgctgctc

SEQ ID NO: 5027321 - DNA, 16 bp, Homo sapiens
ggtaagtgttctcatg

SEQ ID NO: 5027322 - DNA, 17 bp, Homo sapiens
ggtacagtatgggggtt

SEQ ID NO: 5027323 - DNA, 18 bp, Homo sapiens
ggtagagacccccaggcc

SEQ ID NO: 5027324 - DNA, 14 bp, Homo sapiens
caaataaagtctct

SEQ ID NO: 5027325 - DNA, 21 bp, Homo sapiens
caaatgccaaattaaaaaaga

SEQ ID NO: 5027326 - DNA, 16 bp, Homo sapiens
caaattaaaaaagata

SEQ ID NO: 5027327 - DNA, 17 bp, Homo sapiens
caaattaaaaaagataa

SEQ ID NO: 5027328 - DNA, 19 bp, Homo sapiens
caaattaaaaaagataaac

SEQ ID NO: 5027329 - DNA, 12 bp, Homo sapiens
caaattgctgct

SEQ ID NO: 5027330 - DNA, 13 bp, Homo sapiens
caaattgctgctt

SEQ ID NO: 5027331 - DNA, 13 bp, Homo sapiens
caacatgtttctg

SEQ ID NO: 5027332 - DNA, 18 bp, Homo sapiens
caaccagaaacacccctc

SEQ ID NO: 5027333 - DNA, 19 bp, Homo sapiens
caaccagggccccggggcc

SEQ ID NO: 5027334 - DNA, 21 bp, Homo sapiens
caactcactccttttaaagaa

SEQ ID NO: 5027335 - DNA, 23 bp, Homo sapiens
caactcactccttttaaagaaaa

SEQ ID NO: 5027336 - DNA, 21 bp, Homo sapiens
caactgaaggggtgcacccac

SEQ ID NO: 5027337 - DNA, 20 bp, Homo sapiens
caagaaaaataaagaaaaga

SEQ ID NO: 5027338 - DNA, 21 bp, Homo sapiens
caagaaatgattcaaattgct

SEQ ID NO: 5027339 - DNA, 12 bp, Homo sapiens
caagaaatggcg

SEQ ID NO: 5027340 - DNA, 18 bp, Homo sapiens
caagaaatggcgtctgct

SEQ ID NO: 5027341 - DNA, 18 bp, Homo sapiens
caagactcctcaggcagc

SEQ ID NO: 5027342 - DNA, 13 bp, Homo sapiens
caagagaagcatt

SEQ ID NO: 5027343 - DNA, 14 bp, Homo sapiens
caagaggagatcca

SEQ ID NO: 5027344 - DNA, 21 bp, Homo sapiens
caagattggtgtttttttcta

SEQ ID NO: 5027345 - DNA, 15 bp, Homo sapiens
caagcggtgtctctc

SEQ ID NO: 5027346 - DNA, 17 bp, Homo sapiens
caaggaagaagaaatct

SEQ ID NO: 5027347 - DNA, 18 bp, Homo sapiens
caaggccttgcctggcct

SEQ ID NO: 5027348 - DNA, 15 bp, Homo sapiens
caaggtaccatccta

SEQ ID NO: 5027349 - DNA, 19 bp, Homo sapiens
caagtcctggatgttgtgt

SEQ ID NO: 5027350 - DNA, 14 bp, Homo sapiens
caagtgcacggggc

SEQ ID NO: 5027351 - DNA, 13 bp, Homo sapiens
caagttgtttgag

SEQ ID NO: 5027352 - DNA, 23 bp, Homo sapiens
caagttgtttgagaaattaagta

SEQ ID NO: 5027353 - DNA, 13 bp, Homo sapiens
caatgagcatgtt

SEQ ID NO: 5027354 - DNA, 20 bp, Homo sapiens
caatgagcatgtttagactt

SEQ ID NO: 5027355 - DNA, 22 bp, Homo sapiens
caatgtacaggaagtagttcta

SEQ ID NO: 5027356 - DNA, 17 bp, Homo sapiens
caatgtggagcagcagc

SEQ ID NO: 5027357 - DNA, 15 bp, Homo sapiens
caatgtgtataaaca

SEQ ID NO: 5027358 - DNA, 17 bp, Homo sapiens
caatgtgtataaacaag

SEQ ID NO: 5027359 - DNA, 21 bp, Homo sapiens
caatgtgtataaacaagaaaa

SEQ ID NO: 5027360 - DNA, 13 bp, Homo sapiens
caattaaggattt

SEQ ID NO: 5027361 - DNA, 23 bp, Homo sapiens
caattaaggattttatgctttaa

SEQ ID NO: 5027362 - DNA, 12 bp, Homo sapiens
caattcccctct

SEQ ID NO: 5027363 - DNA, 17 bp, Homo sapiens
caattcccctctgctgc

SEQ ID NO: 5027364 - DNA, 15 bp, Homo sapiens
caatttatttgaatg

SEQ ID NO: 5027365 - DNA, 23 bp, Homo sapiens
caatttatttgaatgatttttct

SEQ ID NO: 5027366 - DNA, 18 bp, Homo sapiens
caatttggcaattttgtg

SEQ ID NO: 5027367 - DNA, 13 bp, Homo sapiens
caatttggtaaaa

SEQ ID NO: 5027368 - DNA, 20 bp, Homo sapiens
caattttttttattagtatt

SEQ ID NO: 5027369 - DNA, 14 bp, Homo sapiens
cacaaattagttat

SEQ ID NO: 5027370 - DNA, 19 bp, Homo sapiens
cacaactcactccttttaa

SEQ ID NO: 5027371 - DNA, 23 bp, Homo sapiens
cacaagattggtgtttttttcta

SEQ ID NO: 5027372 - DNA, 21 bp, Homo sapiens
cacaagtcctggatgttgtgt

SEQ ID NO: 5027373 - DNA, 16 bp, Homo sapiens
cacacaagaagaaggg

SEQ ID NO: 5027374 - DNA, 13 bp, Homo sapiens
cacacacaaacct

SEQ ID NO: 5027375 - DNA, 12 bp, Homo sapiens
cacacacacaca

SEQ ID NO: 5027376 - DNA, 15 bp, Homo sapiens
ccgctgatggagccc

SEQ ID NO: 5027377 - DNA, 18 bp, Homo sapiens
ccgctgatggagccccac

SEQ ID NO: 5027378 - DNA, 19 bp, Homo sapiens
ccgctgatggagccccacc

SEQ ID NO: 5027379 - DNA, 23 bp, Homo sapiens
ccgctgcttccaggctgggcagc

SEQ ID NO: 5027380 - DNA, 15 bp, Homo sapiens
ccgcttctgcctgca

SEQ ID NO: 5027381 - DNA, 23 bp, Homo sapiens
ccggacttagaaaaccagctcag

SEQ ID NO: 5027382 - DNA, 14 bp, Homo sapiens
ccggccacacccag

SEQ ID NO: 5027383 - DNA, 18 bp, Homo sapiens
ccggcccagtgccactgc

SEQ ID NO: 5027384 - DNA, 17 bp, Homo sapiens
ccgggaccccgagcctg

SEQ ID NO: 5027385 - DNA, 14 bp, Homo sapiens
ccggggcagccccc

SEQ ID NO: 5027386 - DNA, 19 bp, Homo sapiens
ccggtcacctagcaagctg

SEQ ID NO: 5027387 - DNA, 18 bp, Homo sapiens
ccgtctctggttcctccc

SEQ ID NO: 5027388 - DNA, 20 bp, Homo sapiens
ccgtgcccccgcctgccacc

SEQ ID NO: 5027389 - DNA, 17 bp, Homo sapiens
ccgtgcccgcaggaact

SEQ ID NO: 5027390 - DNA, 23 bp, Homo sapiens
ccgtgcccgcaggaactgggctg

SEQ ID NO: 5027391 - DNA, 17 bp, Homo sapiens
cctaactcttctttcat

SEQ ID NO: 5027392 - DNA, 22 bp, Homo sapiens
cctacatgtatttgtttgcata

SEQ ID NO: 5027393 - DNA, 17 bp, Homo sapiens
cctagcacacacttttg

SEQ ID NO: 5027394 - DNA, 13 bp, Homo sapiens
cctagccctggga

SEQ ID NO: 5027395 - DNA, 19 bp, Homo sapiens
cctagctgaatgtttttct

SEQ ID NO: 5027396 - DNA, 20 bp, Homo sapiens
cctattttttttctgttata

SEQ ID NO: 5027397 - DNA, 16 bp, Homo sapiens
cctcaaaggcccgctc

SEQ ID NO: 5027398 - DNA, 16 bp, Homo sapiens
cctcatcaaggacacg

SEQ ID NO: 5027399 - DNA, 22 bp, Homo sapiens
cctcatccaccccatccctccc

SEQ ID NO: 5027400 - DNA, 18 bp, Homo sapiens
cctcatggcccctctgac

SEQ ID NO: 5027401 - DNA, 21 bp, Homo sapiens
cctcatgtacataccctggcc

SEQ ID NO: 5027402 - DNA, 23 bp, Homo sapiens
cctcccacaattaaaccgcatgt

SEQ ID NO: 5027403 - DNA, 16 bp, Homo sapiens
cctcccctctcagaac

SEQ ID NO: 5027404 - DNA, 23 bp, Homo sapiens
cctcctcatcccgtgttctcctt

SEQ ID NO: 5027405 - DNA, 19 bp, Homo sapiens
cctcctctaaggttgggca

SEQ ID NO: 5027406 - DNA, 15 bp, Homo sapiens
cctcggggacaccag

SEQ ID NO: 5027407 - DNA, 12 bp, Homo sapiens
cctcgggtgggg

SEQ ID NO: 5027408 - DNA, 14 bp, Homo sapiens
cctcgtttgtgttc

SEQ ID NO: 5027409 - DNA, 19 bp, Homo sapiens
cctctaaggttgggcaggg

SEQ ID NO: 5027410 - DNA, 22 bp, Homo sapiens
cctctagctgtgggggtgaggg

SEQ ID NO: 5027411 - DNA, 20 bp, Homo sapiens
cctctcagaacatactgatt

SEQ ID NO: 5027412 - DNA, 12 bp, Homo sapiens
cctctcccctca

SEQ ID NO: 5027413 - DNA, 22 bp, Homo sapiens
cctctccctgcactccctcctg

SEQ ID NO: 5027414 - DNA, 13 bp, Homo sapiens
cctctctctgtgg

SEQ ID NO: 5027415 - DNA, 17 bp, Homo sapiens
cctctgacctgcactgg

SEQ ID NO: 5027416 - DNA, 23 bp, Homo sapiens
cctctgccgctgcttccaggctg

SEQ ID NO: 5027417 - DNA, 15 bp, Homo sapiens
cctctgctgatcctc

SEQ ID NO: 5027418 - DNA, 10 bp, Homo sapiens
cctctgtcta

SEQ ID NO: 5027419 - DNA, 14 bp, Homo sapiens
cctctgtctaggac

SEQ ID NO: 5027420 - DNA, 20 bp, Homo sapiens
cctctttggctcccctgtac

SEQ ID NO: 5027421 - DNA, 21 bp, Homo sapiens
cctctttggtggcatggaagg

SEQ ID NO: 5027422 - DNA, 21 bp, Homo sapiens
cctgaaaaaaaacctgagatt

SEQ ID NO: 5027423 - DNA, 22 bp, Homo sapiens
cctgagatttattaaagaaaaa

SEQ ID NO: 5027424 - DNA, 23 bp, Homo sapiens
cctgagatttattaaagaaaaaa

SEQ ID NO: 5027425 - DNA, 22 bp, Homo sapiens
cctgattgtattttttttttaa

SEQ ID NO: 5027426 - DNA, 19 bp, Homo sapiens
cctgcaatgaagtctctga

SEQ ID NO: 5027427 - DNA, 20 bp, Homo sapiens
cctgcaatgaagtctctgaa

SEQ ID NO: 5027428 - DNA, 21 bp, Homo sapiens
cctgcaatgaagtctctgaag

SEQ ID NO: 5027429 - DNA, 17 bp, Homo sapiens
cctgcacacaggacagc

SEQ ID NO: 5027430 - DNA, 19 bp, Homo sapiens
cctgcacacaggacagcgg

SEQ ID NO: 5027431 - DNA, 20 bp, Homo sapiens
cctgcacacaggacagcggg

SEQ ID NO: 5027432 - DNA, 20 bp, Homo sapiens
cctgcacaggcacacagggc

SEQ ID NO: 5027433 - DNA, 22 bp, Homo sapiens
cctgcacaggcacacagggccc

SEQ ID NO: 5027434 - DNA, 14 bp, Homo sapiens
cctgcactggggag

SEQ ID NO: 5027435 - DNA, 21 bp, Homo sapiens
cctgcactggggagcccgtct

SEQ ID NO: 5027436 - DNA, 14 bp, Homo sapiens
cctgccagcccctg

SEQ ID NO: 5027437 - DNA, 16 bp, Homo sapiens
cctgccagcccctgcc

SEQ ID NO: 5027438 - DNA, 22 bp, Homo sapiens
cctgccattgtagcgtctttct

SEQ ID NO: 5027439 - DNA, 22 bp, Homo sapiens
cctgccggtgggaccctgtccg

SEQ ID NO: 5027440 - DNA, 14 bp, Homo sapiens
cctgcctctaccca

SEQ ID NO: 5027441 - DNA, 14 bp, Homo sapiens
cctgcctgccaccc

SEQ ID NO: 5027442 - DNA, 14 bp, Homo sapiens
cctgcctggcaggc

SEQ ID NO: 5027443 - DNA, 20 bp, Homo sapiens
cctgcgggcgcgggcagcca

SEQ ID NO: 5027444 - DNA, 23 bp, Homo sapiens
cctgcgggcgcgggcagccaccc

SEQ ID NO: 5027445 - DNA, 15 bp, Homo sapiens
cctgctcccatcctg

SEQ ID NO: 5027446 - DNA, 11 bp, Homo sapiens
cctgctggctg

SEQ ID NO: 5027447 - DNA, 12 bp, Homo sapiens
cctgctggctgc

SEQ ID NO: 5027448 - DNA, 13 bp, Homo sapiens
cctgctggctgcg

SEQ ID NO: 5027449 - DNA, 15 bp, Homo sapiens
cctgctgtctctctg

SEQ ID NO: 5027450 - DNA, 17 bp, Homo sapiens
cctgctgtctctctggg

SEQ ID NO: 5027451 - DNA, 18 bp, Homo sapiens
cctggagcagaccacccc

SEQ ID NO: 5027452 - DNA, 14 bp, Homo sapiens
cctggagctctgtg

SEQ ID NO: 5027453 - DNA, 17 bp, Homo sapiens
cctggatgttgtgtgta

SEQ ID NO: 5027454 - DNA, 21 bp, Homo sapiens
cctggcaggctgtctggccag

SEQ ID NO: 5027455 - DNA, 23 bp, Homo sapiens
cctggcagggtcatcctgtgctc

SEQ ID NO: 5027456 - DNA, 17 bp, Homo sapiens
cctggccccgcctgcct

SEQ ID NO: 5027457 - DNA, 18 bp, Homo sapiens
cctggccccgcctgcctg

SEQ ID NO: 5027458 - DNA, 18 bp, Homo sapiens
cctggccctgttctcctc

SEQ ID NO: 5027459 - DNA, 12 bp, Homo sapiens
cctggccgcccc

SEQ ID NO: 5027460 - DNA, 15 bp, Homo sapiens
cctggccgccccctg

SEQ ID NO: 5027461 - DNA, 14 bp, Homo sapiens
cctggcctttcata

SEQ ID NO: 5027462 - DNA, 14 bp, Homo sapiens
cctggctgaaggac

SEQ ID NO: 5027463 - DNA, 18 bp, Homo sapiens
cctgggaaagcccctgcc

SEQ ID NO: 5027464 - DNA, 17 bp, Homo sapiens
ctgcttcccagaggagc

SEQ ID NO: 5027465 - DNA, 17 bp, Homo sapiens
ctggaactcagtgtgac

SEQ ID NO: 5027466 - DNA, 14 bp, Homo sapiens
ctggaagaaaaaaa

SEQ ID NO: 5027467 - DNA, 15 bp, Homo sapiens
ctggacactcagacc

SEQ ID NO: 5027468 - DNA, 18 bp, Homo sapiens
ctggacactcagacctga

SEQ ID NO: 5027469 - DNA, 18 bp, Homo sapiens
ctggacagtacctgattg

SEQ ID NO: 5027470 - DNA, 19 bp, Homo sapiens
ctggaccccgtttcatttt

SEQ ID NO: 5027471 - DNA, 15 bp, Homo sapiens
ctggagcagaccacc

SEQ ID NO: 5027472 - DNA, 15 bp, Homo sapiens
ctggagctctgtggg

SEQ ID NO: 5027473 - DNA, 22 bp, Homo sapiens
ctggagcttgaaatagtgtctg

SEQ ID NO: 5027474 - DNA, 13 bp, Homo sapiens
ctggatagacttg

SEQ ID NO: 5027475 - DNA, 13 bp, Homo sapiens
ctggatctccctg

SEQ ID NO: 5027476 - DNA, 14 bp, Homo sapiens
ctggatgatactaa

SEQ ID NO: 5027477 - DNA, 23 bp, Homo sapiens
ctggattattcaaaatgatgtat

SEQ ID NO: 5027478 - DNA, 19 bp, Homo sapiens
ctggcattagaattattta

SEQ ID NO: 5027479 - DNA, 22 bp, Homo sapiens
ctggccgccccctgccccccag

SEQ ID NO: 5027480 - DNA, 22 bp, Homo sapiens
ctggccgggaccccgagcctgg

SEQ ID NO: 5027481 - DNA, 14 bp, Homo sapiens
ctggcctggactgt

SEQ ID NO: 5027482 - DNA, 20 bp, Homo sapiens
ctggcggctggggtcccagc

SEQ ID NO: 5027483 - DNA, 21 bp, Homo sapiens
ctggctctgttcggcctttgg

SEQ ID NO: 5027484 - DNA, 23 bp, Homo sapiens
ctggctctgttcggcctttgggt

SEQ ID NO: 5027485 - DNA, 21 bp, Homo sapiens
ctggctcttgatacccccctc

SEQ ID NO: 5027486 - DNA, 15 bp, Homo sapiens
ctggctgaaggactg

SEQ ID NO: 5027487 - DNA, 17 bp, Homo sapiens
ctggctgaaggactgtg

SEQ ID NO: 5027488 - DNA, 19 bp, Homo sapiens
ctggctgtgtaaccttggg

SEQ ID NO: 5027489 - DNA, 14 bp, Homo sapiens
ctgggaatgggaga

SEQ ID NO: 5027490 - DNA, 18 bp, Homo sapiens
ctgggaatgggagagggg

SEQ ID NO: 5027491 - DNA, 18 bp, Homo sapiens
ctgggagaccctccccac

SEQ ID NO: 5027492 - DNA, 19 bp, Homo sapiens
ctgggagaccctccccaca

SEQ ID NO: 5027493 - DNA, 22 bp, Homo sapiens
ctgggagggacatgcttagcag

SEQ ID NO: 5027494 - DNA, 17 bp, Homo sapiens
ctgggatgtcacagtcc

SEQ ID NO: 5027495 - DNA, 12 bp, Homo sapiens
ctgggcccctgc

SEQ ID NO: 5027496 - DNA, 15 bp, Homo sapiens
ctgggccgggcctgg

SEQ ID NO: 5027497 - DNA, 12 bp, Homo sapiens
ctggggagcccg

SEQ ID NO: 5027498 - DNA, 15 bp, Homo sapiens
ctggggagcccgtct

SEQ ID NO: 5027499 - DNA, 20 bp, Homo sapiens
ctggggagcccgtctcagtg

SEQ ID NO: 5027500 - DNA, 16 bp, Homo sapiens
ctggggccaaataaag

SEQ ID NO: 5027501 - DNA, 16 bp, Homo sapiens
ctggggccggggctga

SEQ ID NO: 5027502 - DNA, 13 bp, Homo sapiens
ctggggtcccagc

SEQ ID NO: 5027503 - DNA, 14 bp, Homo sapiens
ctggggtcccagca

SEQ ID NO: 5027504 - DNA, 18 bp, Homo sapiens
ctggggtcccagcagctg

SEQ ID NO: 5027505 - DNA, 22 bp, Homo sapiens
ctggggtcccagcagctgccag

SEQ ID NO: 5027506 - DNA, 18 bp, Homo sapiens
ctgggtgagagaggaata

SEQ ID NO: 5027507 - DNA, 19 bp, Homo sapiens
ctgggtgcgtctccagtca

SEQ ID NO: 5027508 - DNA, 19 bp, Homo sapiens
ctgggtggcccctgtctcg

SEQ ID NO: 5027509 - DNA, 16 bp, Homo sapiens
ctggtaccctcctggc

SEQ ID NO: 5027510 - DNA, 19 bp, Homo sapiens
ctggtacttagagtttctg

SEQ ID NO: 5027511 - DNA, 20 bp, Homo sapiens
ctggtacttagagtttctgt

SEQ ID NO: 5027512 - DNA, 17 bp, Homo sapiens
ctggtagagacccccag

SEQ ID NO: 5027513 - DNA, 20 bp, Homo sapiens
ctggtagagacccccaggcc

SEQ ID NO: 5027514 - DNA, 20 bp, Homo sapiens
ctggtagtgtagctgtgtgg

SEQ ID NO: 5027515 - DNA, 15 bp, Homo sapiens
ctggtcctggcctcc

SEQ ID NO: 5027516 - DNA, 11 bp, Homo sapiens
ctggtctgtga

SEQ ID NO: 5027517 - DNA, 20 bp, Homo sapiens
ctggtggcttaagtgagcag

SEQ ID NO: 5027518 - DNA, 23 bp, Homo sapiens
ctggtggcttaagtgagcagaac

SEQ ID NO: 5027519 - DNA, 16 bp, Homo sapiens
ctggtggtattttcaa

SEQ ID NO: 5027520 - DNA, 12 bp, Homo sapiens
ctggttcctccc

SEQ ID NO: 5027521 - DNA, 13 bp, Homo sapiens
ctggttcctcccc

SEQ ID NO: 5027522 - DNA, 17 bp, Homo sapiens
ctggttgatgcctgtga

SEQ ID NO: 5027523 - DNA, 19 bp, Homo sapiens
ctgtaacatactggcctgg

SEQ ID NO: 5027524 - DNA, 17 bp, Homo sapiens
ctgtaagagcttgctcc

SEQ ID NO: 5027525 - DNA, 17 bp, Homo sapiens
ctgtacacaactcactc

SEQ ID NO: 5027526 - DNA, 11 bp, Homo sapiens
ctgtacagtgt

SEQ ID NO: 5027527 - DNA, 15 bp, Homo sapiens
ctgtacagtgtcttt

SEQ ID NO: 5027528 - DNA, 20 bp, Homo sapiens
ctgtaccttttgaggagccc

SEQ ID NO: 5027529 - DNA, 20 bp, Homo sapiens
ctgtactgttctgtgtcttt

SEQ ID NO: 5027530 - DNA, 19 bp, Homo sapiens
ctgtaggcacagagctgca

SEQ ID NO: 5027531 - DNA, 18 bp, Homo sapiens
ctgtatctgtgtagacta

SEQ ID NO: 5027532 - DNA, 22 bp, Homo sapiens
ctgtcagtagtggacattgtaa

SEQ ID NO: 5027533 - DNA, 20 bp, Homo sapiens
ctgtcagtgtacacgtctgg

SEQ ID NO: 5027534 - DNA, 14 bp, Homo sapiens
ctgtcccaccccca

SEQ ID NO: 5027535 - DNA, 14 bp, Homo sapiens
ctgtccccagcctg

SEQ ID NO: 5027536 - DNA, 20 bp, Homo sapiens
ctgtccggcccagtgccact

SEQ ID NO: 5027537 - DNA, 22 bp, Homo sapiens
ctgtccggcccagtgccactgc

SEQ ID NO: 5027538 - DNA, 23 bp, Homo sapiens
ctgtcctggtggtattttcaata

SEQ ID NO: 5027539 - DNA, 21 bp, Homo sapiens
ctgtcgtgatggggcaagggc

SEQ ID NO: 5027540 - DNA, 20 bp, Homo sapiens
ctgtctaggactgcagtgtg

SEQ ID NO: 5027541 - DNA, 20 bp, Homo sapiens
ctgtctccctcccctctcag

SEQ ID NO: 5027542 - DNA, 22 bp, Homo sapiens
ctgtctccctcccctctcagaa

SEQ ID NO: 5027543 - DNA, 23 bp, Homo sapiens
ctgtctccctcccctctcagaac

SEQ ID NO: 5027544 - DNA, 12 bp, Homo sapiens
ctgtctctctgg

SEQ ID NO: 5027545 - DNA, 14 bp, Homo sapiens
ctgtctctctgggc

SEQ ID NO: 5027546 - DNA, 16 bp, Homo sapiens
ctgtctctctgggctg

SEQ ID NO: 5027547 - DNA, 15 bp, Homo sapiens
ctgtctggccaggcc

SEQ ID NO: 5027548 - DNA, 14 bp, Homo sapiens
ctgtgatgctgggc

SEQ ID NO: 5027549 - DNA, 21 bp, Homo sapiens
ctgtgctcggaggccatctcg

SEQ ID NO: 5027550 - DNA, 15 bp, Homo sapiens
ctgtggccgcacgcc

SEQ ID NO: 5027551 - DNA, 18 bp, Homo sapiens
ctgtggccgcacgcctct

SEQ ID NO: 5027552 - DNA, 20 bp, Homo sapiens
ctgtgggaaggccagctgcc

SEQ ID NO: 5027553 - DNA, 21 bp, Homo sapiens
ctgtggggctaggggctgggg

SEQ ID NO: 5027554 - DNA, 24 bp, Homo sapiens
ctgtgggggtgagggtcccatgtg

SEQ ID NO: 5027555 - DNA, 15 bp, Homo sapiens
ctgtgggtctctgga

SEQ ID NO: 5027556 - DNA, 18 bp, Homo sapiens
ctgtgtctgccaaacaca

SEQ ID NO: 5027557 - DNA, 21 bp, Homo sapiens
ctgtgtctgccaaacacattt

SEQ ID NO: 5027558 - DNA, 18 bp, Homo sapiens
ctgttaactgaataccac

SEQ ID NO: 5027559 - DNA, 22 bp, Homo sapiens
ctgttatataaatggttaaaag

SEQ ID NO: 5027560 - DNA, 16 bp, Homo sapiens
ctgttcttagctcaat

SEQ ID NO: 5027561 - DNA, 17 bp, Homo sapiens
ctgttcttagctcaatg

SEQ ID NO: 5027562 - DNA, 17 bp, Homo sapiens
ctgttgaatttcccaca

SEQ ID NO: 5027563 - DNA, 18 bp, Homo sapiens
ctgttggtcctctctctg

SEQ ID NO: 5027564 - DNA, 13 bp, Homo sapiens
ctgttttatgact

SEQ ID NO: 5027565 - DNA, 17 bp, Homo sapiens
ctgttttctgaaacaca

SEQ ID NO: 5027566 - DNA, 13 bp, Homo sapiens
ctgttttgttata

SEQ ID NO: 5027567 - DNA, 18 bp, Homo sapiens
ctgttttgttatataatt

SEQ ID NO: 5027568 - DNA, 20 bp, Homo sapiens
ctgttttgttatataattta

SEQ ID NO: 5027569 - DNA, 17 bp, Homo sapiens
ctgttttgttgacattc

SEQ ID NO: 5027570 - DNA, 20 bp, Homo sapiens
ctgttttgttgacattctga

SEQ ID NO: 5027571 - DNA, 16 bp, Homo sapiens
ctgttttgtttcgctc

SEQ ID NO: 5027572 - DNA, 13 bp, Homo sapiens
cttaaaatacaag

SEQ ID NO: 5027573 - DNA, 20 bp, Homo sapiens
ctaataaaaagcttttgtct

SEQ ID NO: 5027574 - DNA, 13 bp, Homo sapiens
ctaatattttcct

SEQ ID NO: 5027575 - DNA, 17 bp, Homo sapiens
ctaatattttcctcctg

SEQ ID NO: 5027576 - DNA, 15 bp, Homo sapiens
ctacaaaggtttaaa

SEQ ID NO: 5027577 - DNA, 20 bp, Homo sapiens
ctacaaaggtttaaatgaac

SEQ ID NO: 5027578 - DNA, 22 bp, Homo sapiens
ctacaaaggtttaaatgaacaa

SEQ ID NO: 5027579 - DNA, 14 bp, Homo sapiens
ctacattttgcaac

SEQ ID NO: 5027580 - DNA, 16 bp, Homo sapiens
ctacccaaccagggcc

SEQ ID NO: 5027581 - DNA, 17 bp, Homo sapiens
ctaccgaatgtgtcttt

SEQ ID NO: 5027582 - DNA, 14 bp, Homo sapiens
ctactatatatgtg

SEQ ID NO: 5027583 - DNA, 19 bp, Homo sapiens
ctacttcctcctccccact

SEQ ID NO: 5027584 - DNA, 14 bp, Homo sapiens
ctacttggtttgtg

SEQ ID NO: 5027585 - DNA, 13 bp, Homo sapiens
ctagccctgggac

SEQ ID NO: 5027586 - DNA, 21 bp, Homo sapiens
ctagcgcagttttttttttct

SEQ ID NO: 5027587 - DNA, 18 bp, Homo sapiens
ctaggagggagacactgg

SEQ ID NO: 5027588 - DNA, 21 bp, Homo sapiens
ctaggctgacacctaactctt

SEQ ID NO: 5027589 - DNA, 15 bp, Homo sapiens
ctaggggctggggcc

SEQ ID NO: 5027590 - DNA, 14 bp, Homo sapiens
ctaggtaggaagag

SEQ ID NO: 5027591 - DNA, 16 bp, Homo sapiens
ctagtcttttgctttt

SEQ ID NO: 5027592 - DNA, 14 bp, Homo sapiens
ctataaagcattta

SEQ ID NO: 5027593 - DNA, 15 bp, Homo sapiens
ctatagatgtctttt

SEQ ID NO: 5027594 - DNA, 19 bp, Homo sapiens
ctatattacggtttgcccc

SEQ ID NO: 5027595 - DNA, 15 bp, Homo sapiens
ctatcacgagccttt

SEQ ID NO: 5027596 - DNA, 18 bp, Homo sapiens
ctatgcagaggcctgggg

SEQ ID NO: 5027597 - DNA, 17 bp, Homo sapiens
ctatggaagcatattgt

SEQ ID NO: 5027598 - DNA, 22 bp, Homo sapiens
ctatggatcaaagaaattcaga

SEQ ID NO: 5027599 - DNA, 20 bp, Homo sapiens
ctatgggtgttatcacctag

SEQ ID NO: 5027600 - DNA, 12 bp, Homo sapiens
ctattatcacat

SEQ ID NO: 5027601 - DNA, 21 bp, Homo sapiens
ctattggctgatctatgcctt

SEQ ID NO: 5027602 - DNA, 20 bp, Homo sapiens
ctattttttttctgttatat

SEQ ID NO: 5027603 - DNA, 19 bp, Homo sapiens
ctcaagagttcagtgctca

SEQ ID NO: 5027604 - DNA, 22 bp, Homo sapiens
ctcaagcagcgaccgccccctc

SEQ ID NO: 5027605 - DNA, 14 bp, Homo sapiens
ctcaatggactgga

SEQ ID NO: 5027606 - DNA, 11 bp, Homo sapiens
ctcacaaaaga

SEQ ID NO: 5027607 - DNA, 13 bp, Homo sapiens
ctcacagagcttt

SEQ ID NO: 5027608 - DNA, 16 bp, Homo sapiens
ctcacgtccaggttca

SEQ ID NO: 5027609 - DNA, 13 bp, Homo sapiens
ctcactaggcttc

SEQ ID NO: 5027610 - DNA, 16 bp, Homo sapiens
ctcactaggcttctgg

SEQ ID NO: 5027611 - DNA, 15 bp, Homo sapiens
ctcactccttttaaa

SEQ ID NO: 5027612 - DNA, 19 bp, Homo sapiens
ctcactgaactccttcccc

SEQ ID NO: 5027613 - DNA, 14 bp, Homo sapiens
ctcacttcaccctg

SEQ ID NO: 5027614 - DNA, 14 bp, Homo sapiens
ctcagaacatactg

SEQ ID NO: 5027615 - DNA, 17 bp, Homo sapiens
ctcagaacatactgatt

SEQ ID NO: 5027616 - DNA, 21 bp, Homo sapiens
ctcagaacatactgattggga

SEQ ID NO: 5027617 - DNA, 20 bp, Homo sapiens
ctcagaaggcaaatgacttt

SEQ ID NO: 5027618 - DNA, 19 bp, Homo sapiens
ctcagcactgcctgctccc

SEQ ID NO: 5027619 - DNA, 14 bp, Homo sapiens
ctcagcctcccaca

SEQ ID NO: 5027620 - DNA, 19 bp, Homo sapiens
ctcagctccaggtggctct

SEQ ID NO: 5027621 - DNA, 22 bp, Homo sapiens
ctcaggaaacgagactttccat

SEQ ID NO: 5027622 - DNA, 17 bp, Homo sapiens
ctcaggcagcaccacac

SEQ ID NO: 5027623 - DNA, 21 bp, Homo sapiens
ctcaggcagcaccacactggg

SEQ ID NO: 5027624 - DNA, 21 bp, Homo sapiens
ctcaggtaggaagcaacagct

SEQ ID NO: 5027625 - DNA, 17 bp, Homo sapiens
ctcagtatgaattattc

SEQ ID NO: 5027626 - DNA, 16 bp, Homo sapiens
ctcagtggggcagagg

SEQ ID NO: 5027627 - DNA, 13 bp, Homo sapiens
ctcagtgtcctca

SEQ ID NO: 5027628 - DNA, 22 bp, Homo sapiens
ctcagttaaatctttgaagaat

SEQ ID NO: 5027629 - DNA, 17 bp, Homo sapiens
ctcatacactcgtatga

SEQ ID NO: 5027630 - DNA, 15 bp, Homo sapiens
ctcataccacactta

SEQ ID NO: 5027631 - DNA, 19 bp, Homo sapiens
ctcatcccgtgttctcctt

SEQ ID NO: 5027632 - DNA, 16 bp, Homo sapiens
ctcatgaagcaggagg

SEQ ID NO: 5027633 - DNA, 19 bp, Homo sapiens
ctcatgcccagctctctga

SEQ ID NO: 5027634 - DNA, 19 bp, Homo sapiens
ctcatggcccctctgacct

SEQ ID NO: 5027635 - DNA, 21 bp, Homo sapiens
ctcattttgacaaagtgcctc

SEQ ID NO: 5027636 - DNA, 21 bp, Homo sapiens
ctccaaaccctcgaggcggat

SEQ ID NO: 5027637 - DNA, 17 bp, Homo sapiens
ctccaattaaggatttt

SEQ ID NO: 5027638 - DNA, 16 bp, Homo sapiens
ctccaccatccccacc

SEQ ID NO: 5027639 - DNA, 16 bp, Homo sapiens
ctccagattctgatgc

SEQ ID NO: 5027640 - DNA, 17 bp, Homo sapiens
ctccagcctgcctggca

SEQ ID NO: 5027641 - DNA, 14 bp, Homo sapiens
ctccaggtggctct

SEQ ID NO: 5027642 - DNA, 13 bp, Homo sapiens
ctccattctattt

SEQ ID NO: 5027643 - DNA, 14 bp, Homo sapiens
ctccccacagtgcc

SEQ ID NO: 5027644 - DNA, 20 bp, Homo sapiens
ctccccatgtgtcctggttc

SEQ ID NO: 5027645 - DNA, 16 bp, Homo sapiens
ctcccctcagcctctc

SEQ ID NO: 5027646 - DNA, 13 bp, Homo sapiens
ctcccctctcaga

SEQ ID NO: 5027647 - DNA, 23 bp, Homo sapiens
ctcccctctcagaacatactgat

SEQ ID NO: 5027648 - DNA, 21 bp, Homo sapiens
ctccctattttttttctgtta

SEQ ID NO: 5027649 - DNA, 13 bp, Homo sapiens
ctccctcaactga

SEQ ID NO: 5027650 - DNA, 12 bp, Homo sapiens
ctccctgagatg

SEQ ID NO: 5027651 - DNA, 19 bp, Homo sapiens
ctcccttccctccatagcc

SEQ ID NO: 5027652 - DNA, 12 bp, Homo sapiens
ctcctcatcccg

SEQ ID NO: 5027653 - DNA, 11 bp, Homo sapiens
ctcctcatgta

SEQ ID NO: 5027654 - DNA, 14 bp, Homo sapiens
ctcctcctggactc

SEQ ID NO: 5027655 - DNA, 15 bp, Homo sapiens
ctcctcctggactcc

SEQ ID NO: 5027656 - DNA, 19 bp, Homo sapiens
ctcctcctggactcctgca

SEQ ID NO: 5027657 - DNA, 17 bp, Homo sapiens
ctcctctagctgtgggg

SEQ ID NO: 5027658 - DNA, 18 bp, Homo sapiens
ctcctgcctgtgctgtga

SEQ ID NO: 5027659 - DNA, 20 bp, Homo sapiens
ctcctgtaacatactggcct

SEQ ID NO: 5027660 - DNA, 15 bp, Homo sapiens
ctccttgaatatctt

SEQ ID NO: 5027661 - DNA, 14 bp, Homo sapiens
ctccttttaaagaa

SEQ ID NO: 5027662 - DNA, 23 bp, Homo sapiens
ctccttttaaagaaaaaaattga

SEQ ID NO: 5027663 - DNA, 18 bp, Homo sapiens
ctcgagggcagggaccac

SEQ ID NO: 5027664 - DNA, 19 bp, Homo sapiens
ctcggctccccatgtgtcc

SEQ ID NO: 5027665 - DNA, 18 bp, Homo sapiens
ctcggcttggatcctggg

SEQ ID NO: 5027666 - DNA, 13 bp, Homo sapiens
ctcgtttgtgttc

SEQ ID NO: 5027667 - DNA, 16 bp, Homo sapiens
ctctagctgtgggggt

SEQ ID NO: 5027668 - DNA, 16 bp, Homo sapiens
ctctcagcctcccaca

SEQ ID NO: 5027669 - DNA, 23 bp, Homo sapiens
ctctcccggaggttgggtgggcc

SEQ ID NO: 5027670 - DNA, 18 bp, Homo sapiens
ctctcggctccccatgtg

SEQ ID NO: 5027671 - DNA, 19 bp, Homo sapiens
ctctctgcggcagagtcct

SEQ ID NO: 5027672 - DNA, 13 bp, Homo sapiens
ctctctgtggggc

SEQ ID NO: 5027673 - DNA, 19 bp, Homo sapiens
ccttcagagccagccggct

SEQ ID NO: 5027674 - DNA, 20 bp, Homo sapiens
ccttcagtaccctctcagct

SEQ ID NO: 5027675 - DNA, 15 bp, Homo sapiens
ccttccagctcctgt

SEQ ID NO: 5027676 - DNA, 17 bp, Homo sapiens
ccttccagctcctgtaa

SEQ ID NO: 5027677 - DNA, 19 bp, Homo sapiens
ccttcctcatccaccccat

SEQ ID NO: 5027678 - DNA, 20 bp, Homo sapiens
ccttcctcatccaccccatc

SEQ ID NO: 5027679 - DNA, 18 bp, Homo sapiens
ccttgaagaacctctcac

SEQ ID NO: 5027680 - DNA, 19 bp, Homo sapiens
ccttgatttaaacacacag

SEQ ID NO: 5027681 - DNA, 15 bp, Homo sapiens
ccttgcctggtacag

SEQ ID NO: 5027682 - DNA, 17 bp, Homo sapiens
ccttgcctggtacagta

SEQ ID NO: 5027683 - DNA, 14 bp, Homo sapiens
ccttgtcctttccc

SEQ ID NO: 5027684 - DNA, 14 bp, Homo sapiens
cctttattctggca

SEQ ID NO: 5027685 - DNA, 22 bp, Homo sapiens
cctttcctggacactcagacct

SEQ ID NO: 5027686 - DNA, 16 bp, Homo sapiens
ccttttgaggagcccc

SEQ ID NO: 5027687 - DNA, 22 bp, Homo sapiens
cgaaataattgttgttctgtta

SEQ ID NO: 5027688 - DNA, 15 bp, Homo sapiens
cgaatgtgtctttag

SEQ ID NO: 5027689 - DNA, 19 bp, Homo sapiens
cgaatgtgtctttagatag

SEQ ID NO: 5027690 - DNA, 16 bp, Homo sapiens
cgacttggagactcct

SEQ ID NO: 5027691 - DNA, 19 bp, Homo sapiens
cgagaggccaaaggctggt

SEQ ID NO: 5027692 - DNA, 23 bp, Homo sapiens
cgagatggcagattcccactgcc

SEQ ID NO: 5027693 - DNA, 15 bp, Homo sapiens
cgagcaaacccagag

SEQ ID NO: 5027694 - DNA, 14 bp, Homo sapiens
cgagcccctcggct

SEQ ID NO: 5027695 - DNA, 18 bp, Homo sapiens
cgagcccctcggctctgg

SEQ ID NO: 5027696 - DNA, 21 bp, Homo sapiens
cgagcccctcggctctggagg

SEQ ID NO: 5027697 - DNA, 22 bp, Homo sapiens
cgagcccctcggctctggaggc

SEQ ID NO: 5027698 - DNA, 18 bp, Homo sapiens
cgaggaaaggattttacc

SEQ ID NO: 5027699 - DNA, 11 bp, Homo sapiens
cgaggagctgg

SEQ ID NO: 5027700 - DNA, 11 bp, Homo sapiens
cgaggccagta

SEQ ID NO: 5027701 - DNA, 11 bp, Homo sapiens
cgaggctgcta

SEQ ID NO: 5027702 - DNA, 19 bp, Homo sapiens
cgatgagcgccacctcttt

SEQ ID NO: 5027703 - DNA, 18 bp, Homo sapiens
cgatgggcccctggcccc

SEQ ID NO: 5027704 - DNA, 13 bp, Homo sapiens
cgatgtcccctgc

SEQ ID NO: 5027705 - DNA, 13 bp, Homo sapiens
cgcacgcctctcc

SEQ ID NO: 5027706 - DNA, 20 bp, Homo sapiens
cgcaggaactgggctgggcc

SEQ ID NO: 5027707 - DNA, 14 bp, Homo sapiens
cgcagggccatgca

SEQ ID NO: 5027708 - DNA, 13 bp, Homo sapiens
cgccacccgcagc

SEQ ID NO: 5027709 - DNA, 13 bp, Homo sapiens
cgccgggcaccaa

SEQ ID NO: 5027710 - DNA, 20 bp, Homo sapiens
cgcctgccctcatggcccct

SEQ ID NO: 5027711 - DNA, 14 bp, Homo sapiens
cgcgatcccacaca

SEQ ID NO: 5027712 - DNA, 15 bp, Homo sapiens
cgctgatggagcccc

SEQ ID NO: 5027713 - DNA, 18 bp, Homo sapiens
cgctgatggagccccacc

SEQ ID NO: 5027714 - DNA, 14 bp, Homo sapiens
cgctgggtggtacc

SEQ ID NO: 5027715 - DNA, 19 bp, Homo sapiens
cgctgggtggtaccctctg

SEQ ID NO: 5027716 - DNA, 21 bp, Homo sapiens
cgctgtttttgttgtgtgtgc

SEQ ID NO: 5027717 - DNA, 14 bp, Homo sapiens
cgcttgtgacagtg

SEQ ID NO: 5027718 - DNA, 19 bp, Homo sapiens
cgcttgtgacagtgcctct

SEQ ID NO: 5027719 - DNA, 21 bp, Homo sapiens
cggacttagaaaaccagctca

SEQ ID NO: 5027720 - DNA, 16 bp, Homo sapiens
cggatctttggacaga

SEQ ID NO: 5027721 - DNA, 19 bp, Homo sapiens
cggatctttggacagaagc

SEQ ID NO: 5027722 - DNA, 21 bp, Homo sapiens
cggcagagtccttagtggagg

SEQ ID NO: 5027723 - DNA, 16 bp, Homo sapiens
cggccacacccagcgg

SEQ ID NO: 5027724 - DNA, 18 bp, Homo sapiens
cggccacggccacagtca

SEQ ID NO: 5027725 - DNA, 13 bp, Homo sapiens
cggcccagtgcca

SEQ ID NO: 5027726 - DNA, 15 bp, Homo sapiens
cggcccagtgccact

SEQ ID NO: 5027727 - DNA, 16 bp, Homo sapiens
cggcccagtgccactg

SEQ ID NO: 5027728 - DNA, 19 bp, Homo sapiens
cggcccagtgccactgccc

SEQ ID NO: 5027729 - DNA, 20 bp, Homo sapiens
cggccccccgcacagccacc

SEQ ID NO: 5027730 - DNA, 20 bp, Homo sapiens
cggccccctccccccagact

SEQ ID NO: 5027731 - DNA, 22 bp, Homo sapiens
cggccccctccccccagactct

SEQ ID NO: 5027732 - DNA, 17 bp, Homo sapiens
cggccctgcagccagct

SEQ ID NO: 5027733 - DNA, 16 bp, Homo sapiens
cggcgcttcccagcac

SEQ ID NO: 5027734 - DNA, 20 bp, Homo sapiens
cggctccccatgtgtcctgg

SEQ ID NO: 5027735 - DNA, 13 bp, Homo sapiens
cggctctggaggc

SEQ ID NO: 5027736 - DNA, 17 bp, Homo sapiens
cggctctgtccccagcc

SEQ ID NO: 5027737 - DNA, 19 bp, Homo sapiens
cggctctgtccccagcctg

SEQ ID NO: 5027738 - DNA, 13 bp, Homo sapiens
cggctgtgtgtgc

SEQ ID NO: 5027739 - DNA, 15 bp, Homo sapiens
cggcttcatgccagc

SEQ ID NO: 5027740 - DNA, 16 bp, Homo sapiens
cggcttcatgccagct

SEQ ID NO: 5027741 - DNA, 21 bp, Homo sapiens
cggcttgttcttgcagcattc

SEQ ID NO: 5027742 - DNA, 14 bp, Homo sapiens
cgggcaccagccag

SEQ ID NO: 5027743 - DNA, 16 bp, Homo sapiens
cgggcaccagccagcg

SEQ ID NO: 5027744 - DNA, 13 bp, Homo sapiens
cgggcagccaccc

SEQ ID NO: 5027745 - DNA, 14 bp, Homo sapiens
cgggcagccaccca

SEQ ID NO: 5027746 - DNA, 23 bp, Homo sapiens
cgggcagccacccaagcctgctg

SEQ ID NO: 5027747 - DNA, 19 bp, Homo sapiens
cgggcccagaccggcttct

SEQ ID NO: 5027748 - DNA, 18 bp, Homo sapiens
cgggcgcgggcagccacc

SEQ ID NO: 5027749 - DNA, 16 bp, Homo sapiens
cggggacaccagagct

SEQ ID NO: 5027750 - DNA, 13 bp, Homo sapiens
cggggcagccccc

SEQ ID NO: 5027751 - DNA, 20 bp, Homo sapiens
cggtaagtgttctcatgaag

SEQ ID NO: 5027752 - DNA, 19 bp, Homo sapiens
cggtgggaccctgtccggc

SEQ ID NO: 5027753 - DNA, 20 bp, Homo sapiens
cggtggtgcccgtgcccgca

SEQ ID NO: 5027754 - DNA, 22 bp, Homo sapiens
cggtggtgcccgtgcccgcagg

SEQ ID NO: 5027755 - DNA, 11 bp, Homo sapiens
cggtgtctctc

SEQ ID NO: 5027756 - DNA, 23 bp, Homo sapiens
cggtgtttaagacatttttggaa

SEQ ID NO: 5027757 - DNA, 17 bp, Homo sapiens
cgtgagctgagcaggcc

SEQ ID NO: 5027758 - DNA, 20 bp, Homo sapiens
cgtgcccccgcctgccaccg

SEQ ID NO: 5027759 - DNA, 15 bp, Homo sapiens
cgtggggtgctgccc

SEQ ID NO: 5027760 - DNA, 22 bp, Homo sapiens
cgtgtagctatggaagttgcat

SEQ ID NO: 5027761 - DNA, 13 bp, Homo sapiens
cgtgtgcaggagc

SEQ ID NO: 5027762 - DNA, 17 bp, Homo sapiens
cgtgttacccactgcca

SEQ ID NO: 5027763 - DNA, 16 bp, Homo sapiens
cgtgttcagcagaacc

SEQ ID NO: 5027764 - DNA, 17 bp, Homo sapiens
cgtgttcagcagaacct

SEQ ID NO: 5027765 - DNA, 22 bp, Homo sapiens
cgttccttcaaagcaaatgtct

SEQ ID NO: 5027766 - DNA, 12 bp, Homo sapiens
cgttcttgtaat

SEQ ID NO: 5027767 - DNA, 14 bp, Homo sapiens
cgttcttgtaattt

SEQ ID NO: 5027768 - DNA, 13 bp, Homo sapiens
acctgttttctga

SEQ ID NO: 5027769 - DNA, 15 bp, Homo sapiens
acctgttttctgaaa

SEQ ID NO: 5027770 - DNA, 21 bp, Homo sapiens
acctgttttctgaaacacacg

SEQ ID NO: 5027771 - DNA, 11 bp, Homo sapiens
accttggaagg

SEQ ID NO: 5027772 - DNA, 12 bp, Homo sapiens
accttgtctgct

SEQ ID NO: 5027773 - DNA, 21 bp, Homo sapiens
accttgtctgctaaataaaca

SEQ ID NO: 5027774 - DNA, 22 bp, Homo sapiens
accttgtctgctaaataaacat

SEQ ID NO: 5027775 - DNA, 12 bp, Homo sapiens
acctttattctg

SEQ ID NO: 5027776 - DNA, 21 bp, Homo sapiens
acgaaataattgttgttctgt

SEQ ID NO: 5027777 - DNA, 14 bp, Homo sapiens
acgagactttccat

SEQ ID NO: 5027778 - DNA, 13 bp, Homo sapiens
acgatgtcttcat

SEQ ID NO: 5027779 - DNA, 16 bp, Homo sapiens
acgcttgtgacagtgc

SEQ ID NO: 5027780 - DNA, 17 bp, Homo sapiens
acgcttgtgacagtgcc

SEQ ID NO: 5027781 - DNA, 18 bp, Homo sapiens
acggccctgcagccagct

SEQ ID NO: 5027782 - DNA, 15 bp, Homo sapiens
acggtaagtgttctc

SEQ ID NO: 5027783 - DNA, 19 bp, Homo sapiens
acggtgactctgtccagct

SEQ ID NO: 5027784 - DNA, 21 bp, Homo sapiens
acggtggtcactggaactcag

SEQ ID NO: 5027785 - DNA, 21 bp, Homo sapiens
acgtccaggttcaacccacag

SEQ ID NO: 5027786 - DNA, 19 bp, Homo sapiens
acgtgctctttgttttgtg

SEQ ID NO: 5027787 - DNA, 16 bp, Homo sapiens
acgtgggcaaacaggc

SEQ ID NO: 5027788 - DNA, 19 bp, Homo sapiens
acgtgggcaaacaggcagt

SEQ ID NO: 5027789 - DNA, 16 bp, Homo sapiens
acgttgagcccctgga

SEQ ID NO: 5027790 - DNA, 15 bp, Homo sapiens
actaaactttcacac

SEQ ID NO: 5027791 - DNA, 16 bp, Homo sapiens
actaaactttcacacc

SEQ ID NO: 5027792 - DNA, 21 bp, Homo sapiens
actaaccttgcctggtacagt

SEQ ID NO: 5027793 - DNA, 14 bp, Homo sapiens
actaatagaaaagt

SEQ ID NO: 5027794 - DNA, 12 bp, Homo sapiens
ttcaccatggcc

SEQ ID NO: 5027795 - DNA, 16 bp, Homo sapiens
ttcaccccctttcctg

SEQ ID NO: 5027796 - DNA, 12 bp, Homo sapiens
ttcaccttggaa

SEQ ID NO: 5027797 - DNA, 10 bp, Homo sapiens
ttcactttga

SEQ ID NO: 5027798 - DNA, 12 bp, Homo sapiens
ttcactttgaaa

SEQ ID NO: 5027799 - DNA, 14 bp, Homo sapiens
ttcactttgaaaag

SEQ ID NO: 5027800 - DNA, 22 bp, Homo sapiens
ttcactttgaaaagttggaagg

SEQ ID NO: 5027801 - DNA, 18 bp, Homo sapiens
ttcagataactgttattt

SEQ ID NO: 5027802 - DNA, 15 bp, Homo sapiens
ttcaggaggaatact

SEQ ID NO: 5027803 - DNA, 22 bp, Homo sapiens
ttcagtaccctctcagctccag

SEQ ID NO: 5027804 - DNA, 19 bp, Homo sapiens
ttcatacctacatgtattt

SEQ ID NO: 5027805 - DNA, 13 bp, Homo sapiens
ttcataggtctga

SEQ ID NO: 5027806 - DNA, 22 bp, Homo sapiens
ttcataggtctgaaatttttct

SEQ ID NO: 5027807 - DNA, 19 bp, Homo sapiens
ttcatcttcagttgtctct

SEQ ID NO: 5027808 - DNA, 15 bp, Homo sapiens
ttcatgcaaactctt

SEQ ID NO: 5027809 - DNA, 21 bp, Homo sapiens
ttcatgccagctacttcctcc

SEQ ID NO: 5027810 - DNA, 18 bp, Homo sapiens
ttcattaataataaattc

SEQ ID NO: 5027811 - DNA, 15 bp, Homo sapiens
ttcattagtcatgtt

SEQ ID NO: 5027812 - DNA, 17 bp, Homo sapiens
ttcattctccttgttgt

SEQ ID NO: 5027813 - DNA, 19 bp, Homo sapiens
ttcattgcactttgattag

SEQ ID NO: 5027814 - DNA, 14 bp, Homo sapiens
ttcatttctgcaga

SEQ ID NO: 5027815 - DNA, 18 bp, Homo sapiens
ttccaaaaaggttgctgt

SEQ ID NO: 5027816 - DNA, 22 bp, Homo sapiens
ttccaaaacatttctggacagt

SEQ ID NO: 5027817 - DNA, 16 bp, Homo sapiens
ttccaaagctttatta

SEQ ID NO: 5027818 - DNA, 18 bp, Homo sapiens
ttccacaccaagcagcaa

SEQ ID NO: 5027819 - DNA, 16 bp, Homo sapiens
ttccagcagaagacaa

SEQ ID NO: 5027820 - DNA, 22 bp, Homo sapiens
ttccagcagaagacaaaaagac

SEQ ID NO: 5027821 - DNA, 23 bp, Homo sapiens
ttccagtgaacattcccagccca

SEQ ID NO: 5027822 - DNA, 14 bp, Homo sapiens
ttccatctctgact

SEQ ID NO: 5027823 - DNA, 23 bp, Homo sapiens
ttccattaaacgatttttaaaat

SEQ ID NO: 5027824 - DNA, 15 bp, Homo sapiens
ttccatttgcatttg

SEQ ID NO: 5027825 - DNA, 13 bp, Homo sapiens
ttcccagcccagc

SEQ ID NO: 5027826 - DNA, 15 bp, Homo sapiens
ttcccatttatctaa

SEQ ID NO: 5027827 - DNA, 22 bp, Homo sapiens
ttccccacttctgtgccacccc

SEQ ID NO: 5027828 - DNA, 14 bp, Homo sapiens
ttccctctttggct

SEQ ID NO: 5027829 - DNA, 14 bp, Homo sapiens
ttcccttcctgcca

SEQ ID NO: 5027830 - DNA, 21 bp, Homo sapiens
ttccgtgtgattgtctttgaa

SEQ ID NO: 5027831 - DNA, 19 bp, Homo sapiens
ttcctcatccaccccatcc

SEQ ID NO: 5027832 - DNA, 16 bp, Homo sapiens
ttcctcctccccactt

SEQ ID NO: 5027833 - DNA, 13 bp, Homo sapiens
ttcctgcaatgaa

SEQ ID NO: 5027834 - DNA, 15 bp, Homo sapiens
ttcctgccagcccct

SEQ ID NO: 5027835 - DNA, 13 bp, Homo sapiens
ttcctttaaaaaa

SEQ ID NO: 5027836 - DNA, 15 bp, Homo sapiens
ttcgacactgttctt

SEQ ID NO: 5027837 - DNA, 23 bp, Homo sapiens
ttcgagattatcgttttcttaaa

SEQ ID NO: 5027838 - DNA, 14 bp, Homo sapiens
ttcgctctttgaga

SEQ ID NO: 5027839 - DNA, 16 bp, Homo sapiens
ttcggcctttgggtgt

SEQ ID NO: 5027840 - DNA, 23 bp, Homo sapiens
ttctaaaggagtttatgttccat

SEQ ID NO: 5027841 - DNA, 14 bp, Homo sapiens
ttctaacctttaca

SEQ ID NO: 5027842 - DNA, 23 bp, Homo sapiens
ttctaactacaaaggtttaaatg

SEQ ID NO: 5027843 - DNA, 21 bp, Homo sapiens
ttctaagtaaatacaattttt

SEQ ID NO: 5027844 - DNA, 19 bp, Homo sapiens
ttctaggcatctctgtact

SEQ ID NO: 5027845 - DNA, 17 bp, Homo sapiens
ttctaggtaggaagagc

SEQ ID NO: 5027846 - DNA, 19 bp, Homo sapiens
ttctcagaaggcaaatgac

SEQ ID NO: 5027847 - DNA, 22 bp, Homo sapiens
ttctcagaaggcaaatgacttt

SEQ ID NO: 5027848 - DNA, 13 bp, Homo sapiens
ttctcatgaagca

SEQ ID NO: 5027849 - DNA, 18 bp, Homo sapiens
ttctcattggaaatttag

SEQ ID NO: 5027850 - DNA, 15 bp, Homo sapiens
ttctccagctgggct

SEQ ID NO: 5027851 - DNA, 15 bp, Homo sapiens
ttctcctgcctgtgc

SEQ ID NO: 5027852 - DNA, 21 bp, Homo sapiens
ttctccttgttgttggttgtt

SEQ ID NO: 5027853 - DNA, 13 bp, Homo sapiens
ttctccttttcct

SEQ ID NO: 5027854 - DNA, 14 bp, Homo sapiens
ttctcttgctttct

SEQ ID NO: 5027855 - DNA, 21 bp, Homo sapiens
ttctgacctgttgccagcaga

SEQ ID NO: 5027856 - DNA, 15 bp, Homo sapiens
ttctgcctttgatgt

SEQ ID NO: 5027857 - DNA, 19 bp, Homo sapiens
ttctggaatttgttcaagt

SEQ ID NO: 5027858 - DNA, 21 bp, Homo sapiens
ttctggaatttgttcaagttt

SEQ ID NO: 5027859 - DNA, 14 bp, Homo sapiens
ttctggtgtgaact

SEQ ID NO: 5027860 - DNA, 21 bp, Homo sapiens
ttctggtgtgaactaaacttt

SEQ ID NO: 5027861 - DNA, 22 bp, Homo sapiens
ttctggttgatgcctgtgaact

SEQ ID NO: 5027862 - DNA, 14 bp, Homo sapiens
ttctgtgtatctct

SEQ ID NO: 5027863 - DNA, 12 bp, Homo sapiens
ttctgtgtcttt

SEQ ID NO: 5027864 - DNA, 17 bp, Homo sapiens
ttctgttaactcttgaa

SEQ ID NO: 5027865 - DNA, 17 bp, Homo sapiens
ttctgttaactgaatac

SEQ ID NO: 5027866 - DNA, 15 bp, Homo sapiens
ttcttaaagtgccag

SEQ ID NO: 5027867 - DNA, 14 bp, Homo sapiens
ttcttcttctcgtc

SEQ ID NO: 5027868 - DNA, 12 bp, Homo sapiens
ttcttgtaattt

SEQ ID NO: 5027869 - DNA, 12 bp, Homo sapiens
ttcttgtattaa

SEQ ID NO: 5027870 - DNA, 19 bp, Homo sapiens
ttcttgtattaagaatgaa

SEQ ID NO: 5027871 - DNA, 11 bp, Homo sapiens
ttcttgtctat

SEQ ID NO: 5027872 - DNA, 13 bp, Homo sapiens
ttcttgtctataa

SEQ ID NO: 5027873 - DNA, 17 bp, Homo sapiens
ttcttgtctataaagca

SEQ ID NO: 5027874 - DNA, 18 bp, Homo sapiens
ttcttgtctataaagcat

SEQ ID NO: 5027875 - DNA, 17 bp, Homo sapiens
ttcttgttggtgcacag

SEQ ID NO: 5027876 - DNA, 22 bp, Homo sapiens
ttctttacaaaacaaactcatt

SEQ ID NO: 5027877 - DNA, 15 bp, Homo sapiens
ttgaaaaaaacttca

SEQ ID NO: 5027878 - DNA, 16 bp, Homo sapiens
ttgaaagtttacagga

SEQ ID NO: 5027879 - DNA, 14 bp, Homo sapiens
ttgaaatagtgtct

SEQ ID NO: 5027880 - DNA, 21 bp, Homo sapiens
ttgaaatgaggtctgtttaaa

SEQ ID NO: 5027881 - DNA, 23 bp, Homo sapiens
ttgaagcattttataaatcgctt

SEQ ID NO: 5027882 - DNA, 16 bp, Homo sapiens
ttgaagggcaagaaat

SEQ ID NO: 5027883 - DNA, 14 bp, Homo sapiens
ttgaagggtcctgc

SEQ ID NO: 5027884 - DNA, 18 bp, Homo sapiens
ttgacattctgaatgctt

SEQ ID NO: 5027885 - DNA, 20 bp, Homo sapiens
ttgacattctgaatgcttct

SEQ ID NO: 5027886 - DNA, 21 bp, Homo sapiens
ttgacttaatgtgattactgc

SEQ ID NO: 5027887 - DNA, 22 bp, Homo sapiens
ttgagatagttttcatccataa

SEQ ID NO: 5027888 - DNA, 20 bp, Homo sapiens
ttgagcgtgaatctgtatct

SEQ ID NO: 5027889 - DNA, 12 bp, Homo sapiens
ttgaggagcccc

SEQ ID NO: 5027890 - DNA, 18 bp, Homo sapiens
ttgaggcaagtgtgggcc

SEQ ID NO: 5027891 - DNA, 20 bp, Homo sapiens
ttgagggacgctttgtctgt

SEQ ID NO: 5027892 - DNA, 22 bp, Homo sapiens
ttgagggagctgggagaccctc

SEQ ID NO: 5027893 - DNA, 21 bp, Homo sapiens
ttgagtgacagctttctggga

SEQ ID NO: 5027894 - DNA, 19 bp, Homo sapiens
ttgataatcaactgggctg

SEQ ID NO: 5027895 - DNA, 9 bp, Homo sapiens
ttgcagctg

SEQ ID NO: 5027896 - DNA, 12 bp, Homo sapiens
ttgcagctgttt

SEQ ID NO: 5027897 - DNA, 18 bp, Homo sapiens
ttgcagctgttttgttga

SEQ ID NO: 5027898 - DNA, 21 bp, Homo sapiens
ttgcagctgttttgttgacat

SEQ ID NO: 5027899 - DNA, 14 bp, Homo sapiens
ttgcatatgtatga

SEQ ID NO: 5027900 - DNA, 18 bp, Homo sapiens
ttgccttttctagcccga

SEQ ID NO: 5027901 - DNA, 17 bp, Homo sapiens
ttgctccagattctgat

SEQ ID NO: 5027902 - DNA, 12 bp, Homo sapiens
ttgctgcttgga

SEQ ID NO: 5027903 - DNA, 12 bp, Homo sapiens
ttgcttttcatg

SEQ ID NO: 5027904 - DNA, 18 bp, Homo sapiens
ttgcttttcatgcaaact

SEQ ID NO: 5027905 - DNA, 18 bp, Homo sapiens
ttggaaatttagcattgt

SEQ ID NO: 5027906 - DNA, 13 bp, Homo sapiens
ttggaaggatctg

SEQ ID NO: 5027907 - DNA, 16 bp, Homo sapiens
ttggacagaagcagct

SEQ ID NO: 5027908 - DNA, 23 bp, Homo sapiens
ttggagtcccctcacctcctcta

SEQ ID NO: 5027909 - DNA, 22 bp, Homo sapiens
tgttcagcagaacctgcacaca

SEQ ID NO: 5027910 - DNA, 15 bp, Homo sapiens
tgttctcatgaagca

SEQ ID NO: 5027911 - DNA, 14 bp, Homo sapiens
tgttctgtttgtta

SEQ ID NO: 5027912 - DNA, 18 bp, Homo sapiens
tgttcttagctcaatgag

SEQ ID NO: 5027913 - DNA, 15 bp, Homo sapiens
tgttgaagcctttgt

SEQ ID NO: 5027914 - DNA, 14 bp, Homo sapiens
tgttgacattctga

SEQ ID NO: 5027915 - DNA, 23 bp, Homo sapiens
tgttgacattctgaatgcttcta

SEQ ID NO: 5027916 - DNA, 14 bp, Homo sapiens
tgttgcatgtttga

SEQ ID NO: 5027917 - DNA, 15 bp, Homo sapiens
tgttgcatgtttgaa

SEQ ID NO: 5027918 - DNA, 15 bp, Homo sapiens
tgttggttggttttc

SEQ ID NO: 5027919 - DNA, 22 bp, Homo sapiens
tgttgtacatttcaccatggcc

SEQ ID NO: 5027920 - DNA, 14 bp, Homo sapiens
tgttgtccttttca

SEQ ID NO: 5027921 - DNA, 17 bp, Homo sapiens
tgttgtccttttcatag

SEQ ID NO: 5027922 - DNA, 12 bp, Homo sapiens
tgttgtgtgtgc

SEQ ID NO: 5027923 - DNA, 13 bp, Homo sapiens
tgttgtgtgtgca

SEQ ID NO: 5027924 - DNA, 15 bp, Homo sapiens
tgttgtgtgtgcagg

SEQ ID NO: 5027925 - DNA, 13 bp, Homo sapiens
tgttgttctgtta

SEQ ID NO: 5027926 - DNA, 22 bp, Homo sapiens
tgttgttctgttaactgaatac

SEQ ID NO: 5027927 - DNA, 13 bp, Homo sapiens
tgttgttggttgt

SEQ ID NO: 5027928 - DNA, 16 bp, Homo sapiens
tgtttatcctttcata

SEQ ID NO: 5027929 - DNA, 18 bp, Homo sapiens
tgtttatcctttcatata

SEQ ID NO: 5027930 - DNA, 20 bp, Homo sapiens
tgtttccattttaaggatat

SEQ ID NO: 5027931 - DNA, 13 bp, Homo sapiens
tgtttgaaagtag

SEQ ID NO: 5027932 - DNA, 13 bp, Homo sapiens
taaggattttatg

SEQ ID NO: 5027933 - DNA, 20 bp, Homo sapiens
taaggattttatgctttaaa

SEQ ID NO: 5027934 - DNA, 22 bp, Homo sapiens
taaggctgtgtaagatttgttt

SEQ ID NO: 5027935 - DNA, 14 bp, Homo sapiens
taagtaaatacaat

SEQ ID NO: 5027936 - DNA, 16 bp, Homo sapiens
taagtctgttttatga

SEQ ID NO: 5027937 - DNA, 13 bp, Homo sapiens
taataaactaata

SEQ ID NO: 5027938 - DNA, 22 bp, Homo sapiens
taatataaatgcaaataacaaa

SEQ ID NO: 5027939 - DNA, 22 bp, Homo sapiens
taatattttcctcctgagtgct

SEQ ID NO: 5027940 - DNA, 21 bp, Homo sapiens
taatcaactgggctgaacact

SEQ ID NO: 5027941 - DNA, 17 bp, Homo sapiens
taatctaattctaagga

SEQ ID NO: 5027942 - DNA, 21 bp, Homo sapiens
taatggcagttatattttgca

SEQ ID NO: 5027943 - DNA, 18 bp, Homo sapiens
taattgggccagcttttc

SEQ ID NO: 5027944 - DNA, 18 bp, Homo sapiens
taattgttgttctgttaa

SEQ ID NO: 5027945 - DNA, 20 bp, Homo sapiens
taattgttgttctgttaact

SEQ ID NO: 5027946 - DNA, 11 bp, Homo sapiens
taatttaaaca

SEQ ID NO: 5027947 - DNA, 21 bp, Homo sapiens
taatttagacttggattcttt

SEQ ID NO: 5027948 - DNA, 15 bp, Homo sapiens
tacaaactgaagagt

SEQ ID NO: 5027949 - DNA, 16 bp, Homo sapiens
tacaaaggtttaaatg

SEQ ID NO: 5027950 - DNA, 17 bp, Homo sapiens
tacaaaggtttaaatga

SEQ ID NO: 5027951 - DNA, 17 bp, Homo sapiens
tacaatgtcatatactg

SEQ ID NO: 5027952 - DNA, 18 bp, Homo sapiens
tacacactggtacttaga

SEQ ID NO: 5027953 - DNA, 22 bp, Homo sapiens
tacaccaatttggtaaaaatgc

SEQ ID NO: 5027954 - DNA, 19 bp, Homo sapiens
tacactcgtatgatacttc

SEQ ID NO: 5027955 - DNA, 13 bp, Homo sapiens
tacagatttaata

SEQ ID NO: 5027956 - DNA, 17 bp, Homo sapiens
tacagctgtgttattct

SEQ ID NO: 5027957 - DNA, 21 bp, Homo sapiens
tacagtaatcccatttcccaa

SEQ ID NO: 5027958 - DNA, 14 bp, Homo sapiens
tacagtgtcttttt

SEQ ID NO: 5027959 - DNA, 23 bp, Homo sapiens
tacagtgtctttttttgtatagt

SEQ ID NO: 5027960 - DNA, 23 bp, Homo sapiens
tacagtttatttttaaagataga

SEQ ID NO: 5027961 - DNA, 17 bp, Homo sapiens
tacatcttctgccttag

SEQ ID NO: 5027962 - DNA, 13 bp, Homo sapiens
tacatgaggactc

SEQ ID NO: 5027963 - DNA, 14 bp, Homo sapiens
tacatgaggactct

SEQ ID NO: 5027964 - DNA, 21 bp, Homo sapiens
tacatgaggactctattcttt

SEQ ID NO: 5027965 - DNA, 13 bp, Homo sapiens
tacatgtatttgt

SEQ ID NO: 5027966 - DNA, 19 bp, Homo sapiens
tacattgagcatttgaaag

SEQ ID NO: 5027967 - DNA, 14 bp, Homo sapiens
taccactctgtaat

SEQ ID NO: 5027968 - DNA, 18 bp, Homo sapiens
taccatgtaatggcagtt

SEQ ID NO: 5027969 - DNA, 15 bp, Homo sapiens
tacccccctctgtct

SEQ ID NO: 5027970 - DNA, 12 bp, Homo sapiens
taccctcctggc

SEQ ID NO: 5027971 - DNA, 20 bp, Homo sapiens
taccctctcagctccaggtg

SEQ ID NO: 5027972 - DNA, 14 bp, Homo sapiens
taccctctggaggg

SEQ ID NO: 5027973 - DNA, 13 bp, Homo sapiens
taccctctgggtc

SEQ ID NO: 5027974 - DNA, 19 bp, Homo sapiens
taccctttttctccagctg

SEQ ID NO: 5027975 - DNA, 15 bp, Homo sapiens
taccggagagttatc

SEQ ID NO: 5027976 - DNA, 14 bp, Homo sapiens
tacctcaggcagct

SEQ ID NO: 5027977 - DNA, 18 bp, Homo sapiens
tacctcaggcagctcaag

SEQ ID NO: 5027978 - DNA, 21 bp, Homo sapiens
taccttttgaggagccccagc

SEQ ID NO: 5027979 - DNA, 13 bp, Homo sapiens
tacggaagagcag

SEQ ID NO: 5027980 - DNA, 16 bp, Homo sapiens
tactgattgggaggtg

SEQ ID NO: 5027981 - DNA, 17 bp, Homo sapiens
tactgttctgtgtcttt

SEQ ID NO: 5027982 - DNA, 16 bp, Homo sapiens
tacttagagtttctgt

SEQ ID NO: 5027983 - DNA, 17 bp, Homo sapiens
tacttcccaaagccctt

SEQ ID NO: 5027984 - DNA, 16 bp, Homo sapiens
tacttcctcctcccca

SEQ ID NO: 5027985 - DNA, 18 bp, Homo sapiens
tacttcgacactgttctt

SEQ ID NO: 5027986 - DNA, 13 bp, Homo sapiens
tacttggtttgtg

SEQ ID NO: 5027987 - DNA, 13 bp, Homo sapiens
tacttgtaaatat

SEQ ID NO: 5027988 - DNA, 16 bp, Homo sapiens
tacttgtaaatataaa

SEQ ID NO: 5027989 - DNA, 16 bp, Homo sapiens
tagaaaagtatgttct

SEQ ID NO: 5027990 - DNA, 18 bp, Homo sapiens
tagaaagagatacagagg

SEQ ID NO: 5027991 - DNA, 21 bp, Homo sapiens
tagaaccagccgtattttaca

SEQ ID NO: 5027992 - DNA, 16 bp, Homo sapiens
tagaattatttaaaca

SEQ ID NO: 5027993 - DNA, 15 bp, Homo sapiens
tttgttgtgtgtgca

SEQ ID NO: 5027994 - DNA, 15 bp, Homo sapiens
tttgttttagaacca

SEQ ID NO: 5027995 - DNA, 19 bp, Homo sapiens
tttgtttttaaactgtaca

SEQ ID NO: 5027996 - DNA, 20 bp, Homo sapiens
tttgtttttaaactgtacag

SEQ ID NO: 5027997 - DNA, 19 bp, Homo sapiens
ttttaaaaacatagaaaaa

SEQ ID NO: 5027998 - DNA, 16 bp, Homo sapiens
ttttaaaagttattaa

SEQ ID NO: 5027999 - DNA, 21 bp, Homo sapiens
ttttaaaatagcgttcttgta

SEQ ID NO: 5028000 - DNA, 14 bp, Homo sapiens
ttttaaaatgtaca

SEQ ID NO: 5028001 - DNA, 16 bp, Homo sapiens
ttttaaactgtacagt

SEQ ID NO: 5028002 - DNA, 19 bp, Homo sapiens
ttttaataaactactcttt

SEQ ID NO: 5028003 - DNA, 14 bp, Homo sapiens
agcaacagcttcag

SEQ ID NO: 5028004 - DNA, 20 bp, Homo sapiens
agcaatactgtttccatttt

SEQ ID NO: 5028005 - DNA, 19 bp, Homo sapiens
agcacaaattagttatata

SEQ ID NO: 5028006 - DNA, 16 bp, Homo sapiens
agcacaagtacttttg

SEQ ID NO: 5028007 - DNA, 15 bp, Homo sapiens
agcactgcctgctcc

SEQ ID NO: 5028008 - DNA, 18 bp, Homo sapiens
agcactttaacacagtgt

SEQ ID NO: 5028009 - DNA, 18 bp, Homo sapiens
agcagaaatccaagcacc

SEQ ID NO: 5028010 - DNA, 14 bp, Homo sapiens
agcagaacaggtag

SEQ ID NO: 5028011 - DNA, 15 bp, Homo sapiens
agcagaacctgcaca

SEQ ID NO: 5028012 - DNA, 20 bp, Homo sapiens
agcagaacctgcacacagga

SEQ ID NO: 5028013 - DNA, 23 bp, Homo sapiens
agcagaacctgcacacaggacag

SEQ ID NO: 5028014 - DNA, 24 bp, Homo sapiens
agcagaacctgcacacaggacagc

SEQ ID NO: 5028015 - DNA, 21 bp, Homo sapiens
agcagctgccaggagcacggc

SEQ ID NO: 5028016 - DNA, 23 bp, Homo sapiens
agcaggccacacttcaaactact

SEQ ID NO: 5028017 - DNA, 24 bp, Homo sapiens
agcaggccacacttcaaactactt

SEQ ID NO: 5028018 - DNA, 18 bp, Homo sapiens
agcagggtcgggaaaggc

SEQ ID NO: 5028019 - DNA, 15 bp, Homo sapiens
agcagtccccttccc

SEQ ID NO: 5028020 - DNA, 13 bp, Homo sapiens
agcagtgcctgcc

SEQ ID NO: 5028021 - DNA, 13 bp, Homo sapiens
agcataaaaacat

SEQ ID NO: 5028022 - DNA, 21 bp, Homo sapiens
agcataaaaacattttaaaaa

SEQ ID NO: 5028023 - DNA, 21 bp, Homo sapiens
agcatcattatttatgtattg

SEQ ID NO: 5028024 - DNA, 13 bp, Homo sapiens
agcatgtttagac

SEQ ID NO: 5028025 - DNA, 21 bp, Homo sapiens
agcatgtttagactttaacat

SEQ ID NO: 5028026 - DNA, 21 bp, Homo sapiens
agcatttaacccccctgtaca

SEQ ID NO: 5028027 - DNA, 22 bp, Homo sapiens
agcatttaacccccctgtacac

SEQ ID NO: 5028028 - DNA, 14 bp, Homo sapiens
agcattttataaat

SEQ ID NO: 5028029 - DNA, 15 bp, Homo sapiens
agcattttataaatc

SEQ ID NO: 5028030 - DNA, 20 bp, Homo sapiens
agcattttataaatcgcttt

SEQ ID NO: 5028031 - DNA, 18 bp, Homo sapiens
agccacccaagcctgctg

SEQ ID NO: 5028032 - DNA, 19 bp, Homo sapiens
agccactaaccttgcctgg

SEQ ID NO: 5028033 - DNA, 20 bp, Homo sapiens
agccactaaccttgcctggt

SEQ ID NO: 5028034 - DNA, 23 bp, Homo sapiens
agccagctcacagtgctgtgtgc

SEQ ID NO: 5028035 - DNA, 21 bp, Homo sapiens
agccatccctttttttacatt

SEQ ID NO: 5028036 - DNA, 18 bp, Homo sapiens
agcccctcggctctggag

SEQ ID NO: 5028037 - DNA, 16 bp, Homo sapiens
agcccctgcccctcct

SEQ ID NO: 5028038 - DNA, 13 bp, Homo sapiens
agccctggctgaa

SEQ ID NO: 5028039 - DNA, 21 bp, Homo sapiens
agccctggctgaaggactgtg

SEQ ID NO: 5028040 - DNA, 16 bp, Homo sapiens
agccctgtcctggtgg

SEQ ID NO: 5028041 - DNA, 17 bp, Homo sapiens
agccctgtcctggtggt

SEQ ID NO: 5028042 - DNA, 13 bp, Homo sapiens
agccggtggtgcc

SEQ ID NO: 5028043 - DNA, 15 bp, Homo sapiens
agccggtggtgcccg

SEQ ID NO: 5028044 - DNA, 13 bp, Homo sapiens
agcctagccctgg

SEQ ID NO: 5028045 - DNA, 16 bp, Homo sapiens
agcctagccctgggac

SEQ ID NO: 5028046 - DNA, 14 bp, Homo sapiens
agcctcgggtgggg

SEQ ID NO: 5028047 - DNA, 19 bp, Homo sapiens
agcctctcccctgcctgcc

SEQ ID NO: 5028048 - DNA, 12 bp, Homo sapiens
agcctgagagag

SEQ ID NO: 5028049 - DNA, 18 bp, Homo sapiens
agcctgctggctgcggcc

SEQ ID NO: 5028050 - DNA, 19 bp, Homo sapiens
agcctgctggctgcggccc

SEQ ID NO: 5028051 - DNA, 13 bp, Homo sapiens
agcctggctccaa

SEQ ID NO: 5028052 - DNA, 20 bp, Homo sapiens
agcctggctccaaaccctcg

SEQ ID NO: 5028053 - DNA, 22 bp, Homo sapiens
agcctggctccaaaccctcgag

SEQ ID NO: 5028054 - DNA, 17 bp, Homo sapiens
agcctgggaaagcccct

SEQ ID NO: 5028055 - DNA, 16 bp, Homo sapiens
agccttggatgtatat

SEQ ID NO: 5028056 - DNA, 18 bp, Homo sapiens
agccttttccctctttgg

SEQ ID NO: 5028057 - DNA, 23 bp, Homo sapiens
agccttttccctctttggctccc

SEQ ID NO: 5028058 - DNA, 13 bp, Homo sapiens
agcgaggaaagga

SEQ ID NO: 5028059 - DNA, 14 bp, Homo sapiens
agcgcagttttttt

SEQ ID NO: 5028060 - DNA, 22 bp, Homo sapiens
agcggaacaaggagtcagacat

SEQ ID NO: 5028061 - DNA, 20 bp, Homo sapiens
agcggtgggggaggagggtt

SEQ ID NO: 5028062 - DNA, 15 bp, Homo sapiens
agcgtgagctgagca

SEQ ID NO: 5028063 - DNA, 12 bp, Homo sapiens
agcgttcttgta

SEQ ID NO: 5028064 - DNA, 19 bp, Homo sapiens
agctaataaaaagcttttg

SEQ ID NO: 5028065 - DNA, 23 bp, Homo sapiens
agctaataaaaagcttttgtcta

SEQ ID NO: 5028066 - DNA, 16 bp, Homo sapiens
agctaataattcttca

SEQ ID NO: 5028067 - DNA, 16 bp, Homo sapiens
agctacttcctcctcc

SEQ ID NO: 5028068 - DNA, 21 bp, Homo sapiens
agctacttcctcctccccact

SEQ ID NO: 5028069 - DNA, 14 bp, Homo sapiens
agctacttggtttg

SEQ ID NO: 5028070 - DNA, 20 bp, Homo sapiens
agctatttttctaactacaa

SEQ ID NO: 5028071 - DNA, 14 bp, Homo sapiens
agctcaatgagcat

SEQ ID NO: 5028072 - DNA, 23 bp, Homo sapiens
agctcaatgagcatgtttagact

SEQ ID NO: 5028073 - DNA, 14 bp, Homo sapiens
agctcaatggactg

SEQ ID NO: 5028074 - DNA, 18 bp, Homo sapiens
agctcacagtgctgtgtg

SEQ ID NO: 5028075 - DNA, 13 bp, Homo sapiens
agctcagcactgc

SEQ ID NO: 5028076 - DNA, 21 bp, Homo sapiens
agctcagcactgcctgctccc

SEQ ID NO: 5028077 - DNA, 16 bp, Homo sapiens
agctcagcatttccac

SEQ ID NO: 5028078 - DNA, 16 bp, Homo sapiens
agctccagtttgcatt

SEQ ID NO: 5028079 - DNA, 13 bp, Homo sapiens
agctccattttct

SEQ ID NO: 5028080 - DNA, 21 bp, Homo sapiens
agctccccgcttctgcctgca

SEQ ID NO: 5028081 - DNA, 23 bp, Homo sapiens
agctctgctattaggccagcaag

SEQ ID NO: 5028082 - DNA, 20 bp, Homo sapiens
agctctgtgggtctctggaa

SEQ ID NO: 5028083 - DNA, 16 bp, Homo sapiens
agctgaatgtttttct

SEQ ID NO: 5028084 - DNA, 18 bp, Homo sapiens
agctgaatgtttttctaa

SEQ ID NO: 5028085 - DNA, 23 bp, Homo sapiens
agctgccaggagcacggctctgt

SEQ ID NO: 5028086 - DNA, 15 bp, Homo sapiens
agctgccccagccag

SEQ ID NO: 5028087 - DNA, 16 bp, Homo sapiens
agctgccccagccaga

SEQ ID NO: 5028088 - DNA, 17 bp, Homo sapiens
agctgccgacttggaga

SEQ ID NO: 5028089 - DNA, 13 bp, Homo sapiens
agctgctccccag

SEQ ID NO: 5028090 - DNA, 20 bp, Homo sapiens
agctgctccccaggccaccc

SEQ ID NO: 5028091 - DNA, 18 bp, Homo sapiens
agctggatagacttggga

SEQ ID NO: 5028092 - DNA, 21 bp, Homo sapiens
agctggatagacttgggatgg

SEQ ID NO: 5028093 - DNA, 19 bp, Homo sapiens
agctggccaaagagccttt

SEQ ID NO: 5028094 - DNA, 22 bp, Homo sapiens
agctggcggctggggtcccagc

SEQ ID NO: 5028095 - DNA, 23 bp, Homo sapiens
agctggcggctggggtcccagca

SEQ ID NO: 5028096 - DNA, 14 bp, Homo sapiens
agctgtgtctgcca

SEQ ID NO: 5028097 - DNA, 22 bp, Homo sapiens
agctgtgtctgccaaacacatt

SEQ ID NO: 5028098 - DNA, 21 bp, Homo sapiens
agcttatacgaaataattgtt

SEQ ID NO: 5028099 - DNA, 16 bp, Homo sapiens
agcttatgaaaagaat

SEQ ID NO: 5028100 - DNA, 21 bp, Homo sapiens
agcttctggaatttgttcaag

SEQ ID NO: 5028101 - DNA, 23 bp, Homo sapiens
agcttgctccagattctgatgca

SEQ ID NO: 5028102 - DNA, 16 bp, Homo sapiens
agctttatgtaataat

SEQ ID NO: 5028103 - DNA, 13 bp, Homo sapiens
agcttttgtctac

SEQ ID NO: 5028104 - DNA, 15 bp, Homo sapiens
aggaaacgagacttt

SEQ ID NO: 5028105 - DNA, 12 bp, Homo sapiens
aggaaaggattt

SEQ ID NO: 5028106 - DNA, 15 bp, Homo sapiens
aggaaaggattttac

SEQ ID NO: 5028107 - DNA, 19 bp, Homo sapiens
aggaaaggattttaccaaa

SEQ ID NO: 5028108 - DNA, 22 bp, Homo sapiens
aggaaaggattttaccaaagca

SEQ ID NO: 5028109 - DNA, 23 bp, Homo sapiens
aggaaaggattttaccaaagcat

SEQ ID NO: 5028110 - DNA, 20 bp, Homo sapiens
aggaagaagaaatctttctc

SEQ ID NO: 5028111 - DNA, 20 bp, Homo sapiens
aggaagaggggaagcagaaa

SEQ ID NO: 5028112 - DNA, 12 bp, Homo sapiens
aggaagcaacag

SEQ ID NO: 5028113 - DNA, 17 bp, Homo sapiens
caggcagttggccagag

SEQ ID NO: 5028114 - DNA, 23 bp, Homo sapiens
caggcatgggtgcaaggaaaatt

SEQ ID NO: 5028115 - DNA, 15 bp, Homo sapiens
caggcatttgccaag

SEQ ID NO: 5028116 - DNA, 12 bp, Homo sapiens
caggcctcttgg

SEQ ID NO: 5028117 - DNA, 16 bp, Homo sapiens
caggcctgtccaccct

SEQ ID NO: 5028118 - DNA, 18 bp, Homo sapiens
caggcctgtccaccctgc

SEQ ID NO: 5028119 - DNA, 15 bp, Homo sapiens
caggctccaaactgg

SEQ ID NO: 5028120 - DNA, 14 bp, Homo sapiens
caggctgtgagttt

SEQ ID NO: 5028121 - DNA, 20 bp, Homo sapiens
cagggacatgccctgtgtgg

SEQ ID NO: 5028122 - DNA, 22 bp, Homo sapiens
cagggacatgccctgtgtggct

SEQ ID NO: 5028123 - DNA, 23 bp, Homo sapiens
cagggacatgccctgtgtggctg

SEQ ID NO: 5028124 - DNA, 18 bp, Homo sapiens
cagggaccactgggtgag

SEQ ID NO: 5028125 - DNA, 15 bp, Homo sapiens
cagggcaaggccatt

SEQ ID NO: 5028126 - DNA, 22 bp, Homo sapiens
cagggccatgcagacctcatgc

SEQ ID NO: 5028127 - DNA, 15 bp, Homo sapiens
cagggcccggccaca

SEQ ID NO: 5028128 - DNA, 17 bp, Homo sapiens
cagggcccggccacacc

SEQ ID NO: 5028129 - DNA, 18 bp, Homo sapiens
cagggcccggccacaccc

SEQ ID NO: 5028130 - DNA, 20 bp, Homo sapiens
cagggcccggccacacccag

SEQ ID NO: 5028131 - DNA, 22 bp, Homo sapiens
cagggcctggctgggagtggca

SEQ ID NO: 5028132 - DNA, 19 bp, Homo sapiens
cagggggaaggtggggtcc

SEQ ID NO: 5028133 - DNA, 22 bp, Homo sapiens
caggtagtattacaccaccggc

SEQ ID NO: 5028134 - DNA, 18 bp, Homo sapiens
caggtgactgtgctgtgc

SEQ ID NO: 5028135 - DNA, 17 bp, Homo sapiens
caggtgccgccagctgc

SEQ ID NO: 5028136 - DNA, 19 bp, Homo sapiens
caggtgctcaataaatgat

SEQ ID NO: 5028137 - DNA, 23 bp, Homo sapiens
caggtgctcccctgacagtccct

SEQ ID NO: 5028138 - DNA, 17 bp, Homo sapiens
caggttcaacccacagc

SEQ ID NO: 5028139 - DNA, 15 bp, Homo sapiens
caggttctgcctgct

SEQ ID NO: 5028140 - DNA, 20 bp, Homo sapiens
cagtaatcccatttcccaaa

SEQ ID NO: 5028141 - DNA, 16 bp, Homo sapiens
cagtaccctctcagct

SEQ ID NO: 5028142 - DNA, 23 bp, Homo sapiens
cagtagaggctatggacagggca

SEQ ID NO: 5028143 - DNA, 18 bp, Homo sapiens
cagtatgggggttgtaaa

SEQ ID NO: 5028144 - DNA, 14 bp, Homo sapiens
cagtattgaagcat

SEQ ID NO: 5028145 - DNA, 17 bp, Homo sapiens
cagtattgaagcatttt

SEQ ID NO: 5028146 - DNA, 20 bp, Homo sapiens
cagtattgaagcattttata

SEQ ID NO: 5028147 - DNA, 21 bp, Homo sapiens
cagtattgctcacccagtgcc

SEQ ID NO: 5028148 - DNA, 19 bp, Homo sapiens
cagtccaaccagaaacacc

SEQ ID NO: 5028149 - DNA, 12 bp, Homo sapiens
cagtccccgagg

SEQ ID NO: 5028150 - DNA, 22 bp, Homo sapiens
cagtccccgaggagctgggccc

SEQ ID NO: 5028151 - DNA, 23 bp, Homo sapiens
cagtgaacattcccagcccagcc

SEQ ID NO: 5028152 - DNA, 13 bp, Homo sapiens
cagtgacaacatc

SEQ ID NO: 5028153 - DNA, 14 bp, Homo sapiens
cagtgccactgccc

SEQ ID NO: 5028154 - DNA, 13 bp, Homo sapiens
cagtgccctctcc

SEQ ID NO: 5028155 - DNA, 15 bp, Homo sapiens
cagtgcctcttccag

SEQ ID NO: 5028156 - DNA, 22 bp, Homo sapiens
cagtgcctcttccagtgaacat

SEQ ID NO: 5028157 - DNA, 23 bp, Homo sapiens
cagtgctgaccagacagcctccc

SEQ ID NO: 5028158 - DNA, 12 bp, Homo sapiens
cagtgctgtgtg

SEQ ID NO: 5028159 - DNA, 21 bp, Homo sapiens
cagtggggcagaggcagtacc

SEQ ID NO: 5028160 - DNA, 22 bp, Homo sapiens
cagtgtacacgtctggaccccg

SEQ ID NO: 5028161 - DNA, 13 bp, Homo sapiens
cagtgtggagttc

SEQ ID NO: 5028162 - DNA, 15 bp, Homo sapiens
cagttaagcctttgg

SEQ ID NO: 5028163 - DNA, 18 bp, Homo sapiens
cagttcattgcactttga

SEQ ID NO: 5028164 - DNA, 13 bp, Homo sapiens
cagttgtctctga

SEQ ID NO: 5028165 - DNA, 15 bp, Homo sapiens
cagttgtctctgatg

SEQ ID NO: 5028166 - DNA, 16 bp, Homo sapiens
cagtttgagacaggag

SEQ ID NO: 5028167 - DNA, 18 bp, Homo sapiens
cagtttgagacaggagac

SEQ ID NO: 5028168 - DNA, 22 bp, Homo sapiens
cagtttggagagtcagatcttt

SEQ ID NO: 5028169 - DNA, 16 bp, Homo sapiens
cagtttgtgtgtctta

SEQ ID NO: 5028170 - DNA, 17 bp, Homo sapiens
cagttttggttgcttta

SEQ ID NO: 5028171 - DNA, 18 bp, Homo sapiens
cagttttggttgctttaa

SEQ ID NO: 5028172 - DNA, 23 bp, Homo sapiens
cagttttttttttcttgtctata

SEQ ID NO: 5028173 - DNA, 19 bp, Homo sapiens
cataaaaacattttaaaaa

SEQ ID NO: 5028174 - DNA, 16 bp, Homo sapiens
cataagctatttttct

SEQ ID NO: 5028175 - DNA, 22 bp, Homo sapiens
catacaacagaaaccagaaaag

SEQ ID NO: 5028176 - DNA, 18 bp, Homo sapiens
catactggcctggactgt

SEQ ID NO: 5028177 - DNA, 18 bp, Homo sapiens
catagcagctttgtctct

SEQ ID NO: 5028178 - DNA, 16 bp, Homo sapiens
cataggtgatctcatt

SEQ ID NO: 5028179 - DNA, 13 bp, Homo sapiens
catagtagttttt

SEQ ID NO: 5028180 - DNA, 20 bp, Homo sapiens
catagtagtttttacagctg

SEQ ID NO: 5028181 - DNA, 20 bp, Homo sapiens
catatttattgcattgctgg

SEQ ID NO: 5028182 - DNA, 13 bp, Homo sapiens
catattttagcta

SEQ ID NO: 5028183 - DNA, 18 bp, Homo sapiens
catcaaaaactttggagt

SEQ ID NO: 5028184 - DNA, 17 bp, Homo sapiens
catcaatacaaccagcc

SEQ ID NO: 5028185 - DNA, 22 bp, Homo sapiens
catcacagttttggttgcttta

SEQ ID NO: 5028186 - DNA, 21 bp, Homo sapiens
catcaggagactgggctctgg

SEQ ID NO: 5028187 - DNA, 22 bp, Homo sapiens
catcagtattgaagcattttat

SEQ ID NO: 5028188 - DNA, 17 bp, Homo sapiens
catcagtctccaacatg

SEQ ID NO: 5028189 - DNA, 14 bp, Homo sapiens
catccaccccatcc

SEQ ID NO: 5028190 - DNA, 20 bp, Homo sapiens
catccagcgagagagtttca

SEQ ID NO: 5028191 - DNA, 16 bp, Homo sapiens
catcccgtgttctcct

SEQ ID NO: 5028192 - DNA, 16 bp, Homo sapiens
catccctttttttaca

SEQ ID NO: 5028193 - DNA, 23 bp, Homo sapiens
catcctgtgtgttaagctctgct

SEQ ID NO: 5028194 - DNA, 15 bp, Homo sapiens
catctgagtcctgga

SEQ ID NO: 5028195 - DNA, 22 bp, Homo sapiens
catctgtaaaatggagacacca

SEQ ID NO: 5028196 - DNA, 14 bp, Homo sapiens
catctgtaagagct

SEQ ID NO: 5028197 - DNA, 22 bp, Homo sapiens
catctgtaagagcttgctccag

SEQ ID NO: 5028198 - DNA, 14 bp, Homo sapiens
catcttcagttgtc

SEQ ID NO: 5028199 - DNA, 20 bp, Homo sapiens
catcttcagttgtctctgat

SEQ ID NO: 5028200 - DNA, 23 bp, Homo sapiens
catcttcagttgtctctgatgca

SEQ ID NO: 5028201 - DNA, 14 bp, Homo sapiens
catgaagcaggagg

SEQ ID NO: 5028202 - DNA, 15 bp, Homo sapiens
catgaagcaggaggc

SEQ ID NO: 5028203 - DNA, 23 bp, Homo sapiens
catgaagcaggaggcccttgtcg

SEQ ID NO: 5028204 - DNA, 14 bp, Homo sapiens
ccaggactggctgt

SEQ ID NO: 5028205 - DNA, 16 bp, Homo sapiens
ccaggagaagggctgg

SEQ ID NO: 5028206 - DNA, 19 bp, Homo sapiens
ccaggagaagggctggggc

SEQ ID NO: 5028207 - DNA, 19 bp, Homo sapiens
ccaggagcacggctctgtc

SEQ ID NO: 5028208 - DNA, 21 bp, Homo sapiens
ccaggagtgtggccacgtggg

SEQ ID NO: 5028209 - DNA, 23 bp, Homo sapiens
ccaggccctgccagtggggaagg

SEQ ID NO: 5028210 - DNA, 16 bp, Homo sapiens
ccaggcctcttggcag

SEQ ID NO: 5028211 - DNA, 15 bp, Homo sapiens
ccagggcctggctgg

SEQ ID NO: 5028212 - DNA, 20 bp, Homo sapiens
ccaggttcaacccacagcta

SEQ ID NO: 5028213 - DNA, 22 bp, Homo sapiens
ccagtcaaatctgggctcactc

SEQ ID NO: 5028214 - DNA, 16 bp, Homo sapiens
ccagtcatctgtaaga

SEQ ID NO: 5028215 - DNA, 14 bp, Homo sapiens
ccagtccccgagga

SEQ ID NO: 5028216 - DNA, 17 bp, Homo sapiens
ccagtccccgaggagct

SEQ ID NO: 5028217 - DNA, 20 bp, Homo sapiens
ccagtgaaatcagttactct

SEQ ID NO: 5028218 - DNA, 15 bp, Homo sapiens
ccagtgaacattccc

SEQ ID NO: 5028219 - DNA, 21 bp, Homo sapiens
ccagtgaacattcccagccca

SEQ ID NO: 5028220 - DNA, 22 bp, Homo sapiens
ccagtgaacattcccagcccag

SEQ ID NO: 5028221 - DNA, 23 bp, Homo sapiens
ccagtgccctctcccctcagcct

SEQ ID NO: 5028222 - DNA, 14 bp, Homo sapiens
ccatccattctgga

SEQ ID NO: 5028223 - DNA, 16 bp, Homo sapiens
ccatcctaggctgaca

SEQ ID NO: 5028224 - DNA, 22 bp, Homo sapiens
ccatcctgtgtgttaagctctg

SEQ ID NO: 5028225 - DNA, 15 bp, Homo sapiens
ccatctgctcctgga

SEQ ID NO: 5028226 - DNA, 19 bp, Homo sapiens
ccatctgtaaaggggcagc

SEQ ID NO: 5028227 - DNA, 20 bp, Homo sapiens
ccatgagtggcatggccacc

SEQ ID NO: 5028228 - DNA, 21 bp, Homo sapiens
ccatgagtggcatggccacca

SEQ ID NO: 5028229 - DNA, 12 bp, Homo sapiens
ccatgcagacct

SEQ ID NO: 5028230 - DNA, 14 bp, Homo sapiens
ccatgcagctgctc

SEQ ID NO: 5028231 - DNA, 15 bp, Homo sapiens
ccatgcagctgctcc

SEQ ID NO: 5028232 - DNA, 12 bp, Homo sapiens
ccatgcaggagg

SEQ ID NO: 5028233 - DNA, 16 bp, Homo sapiens
ccatgcaggaggtgga

SEQ ID NO: 5028234 - DNA, 20 bp, Homo sapiens
ccatgtaatggcagttatat

SEQ ID NO: 5028235 - DNA, 18 bp, Homo sapiens
ccatgtggtggcacaggc

SEQ ID NO: 5028236 - DNA, 23 bp, Homo sapiens
ccatgtttggtgtttgtctgtgt

SEQ ID NO: 5028237 - DNA, 14 bp, Homo sapiens
ccattccaaagctt

SEQ ID NO: 5028238 - DNA, 20 bp, Homo sapiens
ccattgtagcgtctttcttt

SEQ ID NO: 5028239 - DNA, 21 bp, Homo sapiens
ccatttcatttgtgccagaat

SEQ ID NO: 5028240 - DNA, 16 bp, Homo sapiens
cccaaacaccttccag

SEQ ID NO: 5028241 - DNA, 16 bp, Homo sapiens
cccaacggccctgcag

SEQ ID NO: 5028242 - DNA, 22 bp, Homo sapiens
cccaacggccctgcagccagct

SEQ ID NO: 5028243 - DNA, 20 bp, Homo sapiens
cccaacttctcttgctttct

SEQ ID NO: 5028244 - DNA, 23 bp, Homo sapiens
cccaagcctacttttgccattga

SEQ ID NO: 5028245 - DNA, 15 bp, Homo sapiens
cccaagcctgctggc

SEQ ID NO: 5028246 - DNA, 22 bp, Homo sapiens
cccaagcctgctggctgcggcc

SEQ ID NO: 5028247 - DNA, 23 bp, Homo sapiens
cccacaggaagcctgcagtcctg

SEQ ID NO: 5028248 - DNA, 15 bp, Homo sapiens
cccacagtgccaccc

SEQ ID NO: 5028249 - DNA, 19 bp, Homo sapiens
cccacatgtggccatggcc

SEQ ID NO: 5028250 - DNA, 16 bp, Homo sapiens
cccacctgttttctga

SEQ ID NO: 5028251 - DNA, 14 bp, Homo sapiens
cccactctgcctgc

SEQ ID NO: 5028252 - DNA, 14 bp, Homo sapiens
cccacttacattta

SEQ ID NO: 5028253 - DNA, 22 bp, Homo sapiens
cccagaaagtgataagtgcagg

SEQ ID NO: 5028254 - DNA, 13 bp, Homo sapiens
cccagaccggctt

SEQ ID NO: 5028255 - DNA, 19 bp, Homo sapiens
cccagactctttttttgag

SEQ ID NO: 5028256 - DNA, 20 bp, Homo sapiens
cccagagaccaggctgtgtc

SEQ ID NO: 5028257 - DNA, 15 bp, Homo sapiens
cccagagtcatctga

SEQ ID NO: 5028258 - DNA, 17 bp, Homo sapiens
cccagcggccccccgca

SEQ ID NO: 5028259 - DNA, 14 bp, Homo sapiens
cccagctctctgac

SEQ ID NO: 5028260 - DNA, 18 bp, Homo sapiens
cccagtgaggatgctgca

SEQ ID NO: 5028261 - DNA, 14 bp, Homo sapiens
cccagtgccctctc

SEQ ID NO: 5028262 - DNA, 18 bp, Homo sapiens
cccagtgccctctcccct

SEQ ID NO: 5028263 - DNA, 21 bp, Homo sapiens
cccatgtgtcctggttcccgt

SEQ ID NO: 5028264 - DNA, 19 bp, Homo sapiens
cccattctacacagagcag

SEQ ID NO: 5028265 - DNA, 19 bp, Homo sapiens
cccattgttgtcaaggaag

SEQ ID NO: 5028266 - DNA, 20 bp, Homo sapiens
cccattgttgtcaaggaaga

SEQ ID NO: 5028267 - DNA, 15 bp, Homo sapiens
ccccacagtgccacc

SEQ ID NO: 5028268 - DNA, 15 bp, Homo sapiens
ccccaccttgtctgc

SEQ ID NO: 5028269 - DNA, 14 bp, Homo sapiens
ccccactctgcctg

SEQ ID NO: 5028270 - DNA, 13 bp, Homo sapiens
ccccacttctgtg

SEQ ID NO: 5028271 - DNA, 23 bp, Homo sapiens
ccccagccagatggactccagcc

SEQ ID NO: 5028272 - DNA, 11 bp, Homo sapiens
ccccagctacc

SEQ ID NO: 5028273 - DNA, 22 bp, Homo sapiens
ccccagctaccctttttctcca

SEQ ID NO: 5028274 - DNA, 18 bp, Homo sapiens
ccccagggtagccatggc

SEQ ID NO: 5028275 - DNA, 17 bp, Homo sapiens
cccccacccccagctca

SEQ ID NO: 5028276 - DNA, 14 bp, Homo sapiens
cccccgcctgccac

SEQ ID NO: 5028277 - DNA, 16 bp, Homo sapiens
ccccctctgtcttgtg

SEQ ID NO: 5028278 - DNA, 22 bp, Homo sapiens
ccccctgccccccagcctctgg

SEQ ID NO: 5028279 - DNA, 18 bp, Homo sapiens
ccccctgtacacaactca

SEQ ID NO: 5028280 - DNA, 12 bp, Homo sapiens
ccccctttcctg

SEQ ID NO: 5028281 - DNA, 20 bp, Homo sapiens
ccccctttcctggacactca

SEQ ID NO: 5028282 - DNA, 19 bp, Homo sapiens
ccccgcacagccacccgtg

SEQ ID NO: 5028283 - DNA, 15 bp, Homo sapiens
ccccgcctgccaccg

SEQ ID NO: 5028284 - DNA, 12 bp, Homo sapiens
ccccgcctgcct

SEQ ID NO: 5028285 - DNA, 17 bp, Homo sapiens
ccccgctgatggagccc

SEQ ID NO: 5028286 - DNA, 20 bp, Homo sapiens
ccccggtcacctagcaagct

SEQ ID NO: 5028287 - DNA, 21 bp, Homo sapiens
ccccgtctctggttcctcccc

SEQ ID NO: 5028288 - DNA, 12 bp, Homo sapiens
cccctcacctcc

SEQ ID NO: 5028289 - DNA, 13 bp, Homo sapiens
cccctcacctcct

SEQ ID NO: 5028290 - DNA, 18 bp, Homo sapiens
cccctcctcctggactcc

SEQ ID NO: 5028291 - DNA, 22 bp, Homo sapiens
cccctcctcctggactcctgca

SEQ ID NO: 5028292 - DNA, 16 bp, Homo sapiens
cccctcggctctggag

SEQ ID NO: 5028293 - DNA, 13 bp, Homo sapiens
cccctctcagaac

SEQ ID NO: 5028294 - DNA, 15 bp, Homo sapiens
cccctgcctgccctg

SEQ ID NO: 5028295 - DNA, 19 bp, Homo sapiens
cccctgcctgccctggtga

SEQ ID NO: 5028296 - DNA, 14 bp, Homo sapiens
cccctgctgtctct

SEQ ID NO: 5028297 - DNA, 16 bp, Homo sapiens
cccctggccccgcctg

SEQ ID NO: 5028298 - DNA, 11 bp, Homo sapiens
cccctgtacac

SEQ ID NO: 5028299 - DNA, 21 bp, Homo sapiens
ccccttgatttaaacacacag

SEQ ID NO: 5028300 - DNA, 21 bp, Homo sapiens
cccgaggagctgggcccctgc

SEQ ID NO: 5028301 - DNA, 19 bp, Homo sapiens
cccgaggccgcgtgcgtga

SEQ ID NO: 5028302 - DNA, 16 bp, Homo sapiens
cccgatgtcccctgcg

SEQ ID NO: 5028303 - DNA, 16 bp, Homo sapiens
cccgcacagccacccg

SEQ ID NO: 5028304 - DNA, 12 bp, Homo sapiens
cccgcactctgc

SEQ ID NO: 5028305 - DNA, 16 bp, Homo sapiens
cccgcagggccatgca

SEQ ID NO: 5028306 - DNA, 20 bp, Homo sapiens
cccgccccgttgtgagctgg

SEQ ID NO: 5028307 - DNA, 13 bp, Homo sapiens
cccgcctgcctgc

SEQ ID NO: 5028308 - DNA, 22 bp, Homo sapiens
cccgctgatggagccccacctt

SEQ ID NO: 5028309 - DNA, 23 bp, Homo sapiens
cccgctgatggagccccaccttg

SEQ ID NO: 5028310 - DNA, 18 bp, Homo sapiens
cccggaggttgggtgggc

SEQ ID NO: 5028311 - DNA, 18 bp, Homo sapiens
cccggccacacccagcgg

SEQ ID NO: 5028312 - DNA, 22 bp, Homo sapiens
cccggtctatgtcgagagctgg

SEQ ID NO: 5028313 - DNA, 22 bp, Homo sapiens
cccgtactttgtcccgtggcat

SEQ ID NO: 5028314 - DNA, 16 bp, Homo sapiens
ccctaggcagcctgca

SEQ ID NO: 5028315 - DNA, 19 bp, Homo sapiens
ccctagttctacctcaggc

SEQ ID NO: 5028316 - DNA, 15 bp, Homo sapiens
ccctcaactgaaggg

SEQ ID NO: 5028317 - DNA, 15 bp, Homo sapiens
caccacactgggtgc

SEQ ID NO: 5028318 - DNA, 14 bp, Homo sapiens
caccaccacccttg

SEQ ID NO: 5028319 - DNA, 17 bp, Homo sapiens
caccaccggccccctcc

SEQ ID NO: 5028320 - DNA, 17 bp, Homo sapiens
caccagggcctggctgg

SEQ ID NO: 5028321 - DNA, 18 bp, Homo sapiens
caccataggtcaccttta

SEQ ID NO: 5028322 - DNA, 14 bp, Homo sapiens
cacccaagcctgct

SEQ ID NO: 5028323 - DNA, 18 bp, Homo sapiens
cacccacctgttttctga

SEQ ID NO: 5028324 - DNA, 19 bp, Homo sapiens
cacccacctgttttctgaa

SEQ ID NO: 5028325 - DNA, 22 bp, Homo sapiens
cacccacctgttttctgaaaca

SEQ ID NO: 5028326 - DNA, 15 bp, Homo sapiens
cacccagcggccccc

SEQ ID NO: 5028327 - DNA, 11 bp, Homo sapiens
cacccccaccc

SEQ ID NO: 5028328 - DNA, 13 bp, Homo sapiens
cacccccagctca

SEQ ID NO: 5028329 - DNA, 16 bp, Homo sapiens
caccccgcctgccctc

SEQ ID NO: 5028330 - DNA, 21 bp, Homo sapiens
cacccgccgcctcccacggca

SEQ ID NO: 5028331 - DNA, 19 bp, Homo sapiens
cacccgtggggtgctgccc

SEQ ID NO: 5028332 - DNA, 20 bp, Homo sapiens
cacccgtggggtgctgccct

SEQ ID NO: 5028333 - DNA, 18 bp, Homo sapiens
caccctgcctctacccaa

SEQ ID NO: 5028334 - DNA, 16 bp, Homo sapiens
caccctgtactgttct

SEQ ID NO: 5028335 - DNA, 21 bp, Homo sapiens
caccctgtactgttctgtgtc

SEQ ID NO: 5028336 - DNA, 17 bp, Homo sapiens
caccggaggtcactcca

SEQ ID NO: 5028337 - DNA, 20 bp, Homo sapiens
caccggggacaggccgcagc

SEQ ID NO: 5028338 - DNA, 20 bp, Homo sapiens
cacctctttaaaaactcact

SEQ ID NO: 5028339 - DNA, 14 bp, Homo sapiens
cacctgttttctga

SEQ ID NO: 5028340 - DNA, 21 bp, Homo sapiens
cacctgttttctgaaacacac

SEQ ID NO: 5028341 - DNA, 18 bp, Homo sapiens
caccttccagctcctgta

SEQ ID NO: 5028342 - DNA, 22 bp, Homo sapiens
caccttgaagaacctctcactt

SEQ ID NO: 5028343 - DNA, 12 bp, Homo sapiens
caccttggaagg

SEQ ID NO: 5028344 - DNA, 13 bp, Homo sapiens
caccttggaaggg

SEQ ID NO: 5028345 - DNA, 21 bp, Homo sapiens
cacggctctgtccccagcctg

SEQ ID NO: 5028346 - DNA, 17 bp, Homo sapiens
cacgggcctgtccacag

SEQ ID NO: 5028347 - DNA, 23 bp, Homo sapiens
cactaccgaatgtgtctttagat

SEQ ID NO: 5028348 - DNA, 12 bp, Homo sapiens
cactcagacctg

SEQ ID NO: 5028349 - DNA, 13 bp, Homo sapiens
cactccaattaag

SEQ ID NO: 5028350 - DNA, 22 bp, Homo sapiens
cactccaattaaggattttatg

SEQ ID NO: 5028351 - DNA, 12 bp, Homo sapiens
cactccagctgg

SEQ ID NO: 5028352 - DNA, 15 bp, Homo sapiens
cactccagctgggat

SEQ ID NO: 5028353 - DNA, 21 bp, Homo sapiens
cactgccccccgaggctgcta

SEQ ID NO: 5028354 - DNA, 12 bp, Homo sapiens
cactgccgctgc

SEQ ID NO: 5028355 - DNA, 20 bp, Homo sapiens
cactgctctgatgaagagga

SEQ ID NO: 5028356 - DNA, 15 bp, Homo sapiens
cactggatgcagaaa

SEQ ID NO: 5028357 - DNA, 22 bp, Homo sapiens
cactggggagcccgtctcagtg

SEQ ID NO: 5028358 - DNA, 13 bp, Homo sapiens
cactgggtgagag

SEQ ID NO: 5028359 - DNA, 14 bp, Homo sapiens
cactgtgggaaggc

SEQ ID NO: 5028360 - DNA, 16 bp, Homo sapiens
cacttcaaactacttt

SEQ ID NO: 5028361 - DNA, 14 bp, Homo sapiens
cacttcaccctgga

SEQ ID NO: 5028362 - DNA, 16 bp, Homo sapiens
cacttgtcaggagtgt

SEQ ID NO: 5028363 - DNA, 22 bp, Homo sapiens
cacttgtcaggagtgtgtgtga

SEQ ID NO: 5028364 - DNA, 12 bp, Homo sapiens
cactttgaaaag

SEQ ID NO: 5028365 - DNA, 12 bp, Homo sapiens
cactttgcttta

SEQ ID NO: 5028366 - DNA, 22 bp, Homo sapiens
cacttttggttaagtctgtttt

SEQ ID NO: 5028367 - DNA, 18 bp, Homo sapiens
cagaaaccagaaaagcaa

SEQ ID NO: 5028368 - DNA, 12 bp, Homo sapiens
cagaaagagctc

SEQ ID NO: 5028369 - DNA, 18 bp, Homo sapiens
cagaaagtgataagtgca

SEQ ID NO: 5028370 - DNA, 13 bp, Homo sapiens
cagaacaggtagt

SEQ ID NO: 5028371 - DNA, 15 bp, Homo sapiens
cagaaccaattattt

SEQ ID NO: 5028372 - DNA, 22 bp, Homo sapiens
cagaacctgcacacaggacagc

SEQ ID NO: 5028373 - DNA, 18 bp, Homo sapiens
cagaagacaaaaagacaa

SEQ ID NO: 5028374 - DNA, 13 bp, Homo sapiens
cagaccaccccgc

SEQ ID NO: 5028375 - DNA, 14 bp, Homo sapiens
cagaccctctgccg

SEQ ID NO: 5028376 - DNA, 13 bp, Homo sapiens
cagacctcatgcc

SEQ ID NO: 5028377 - DNA, 20 bp, Homo sapiens
cagactctttttttgagtga

SEQ ID NO: 5028378 - DNA, 15 bp, Homo sapiens
cagagaccaggctgt

SEQ ID NO: 5028379 - DNA, 18 bp, Homo sapiens
cagagaccaggctgtgtc

SEQ ID NO: 5028380 - DNA, 20 bp, Homo sapiens
cagagacttgggacattgcc

SEQ ID NO: 5028381 - DNA, 20 bp, Homo sapiens
cagagaggtttgcagtccca

SEQ ID NO: 5028382 - DNA, 14 bp, Homo sapiens
cagagcaggactgc

SEQ ID NO: 5028383 - DNA, 20 bp, Homo sapiens
cagagcgaggaaaggatttt

SEQ ID NO: 5028384 - DNA, 19 bp, Homo sapiens
cagagcgtgagctgagcag

SEQ ID NO: 5028385 - DNA, 15 bp, Homo sapiens
cagaggcctggggga

SEQ ID NO: 5028386 - DNA, 22 bp, Homo sapiens
cagaggtggatgttatgaacag

SEQ ID NO: 5028387 - DNA, 23 bp, Homo sapiens
cagagtccttagtggaggggttt

SEQ ID NO: 5028388 - DNA, 23 bp, Homo sapiens
cagatgactatgcagaggcctgg

SEQ ID NO: 5028389 - DNA, 12 bp, Homo sapiens
cagatggcactt

SEQ ID NO: 5028390 - DNA, 18 bp, Homo sapiens
cagatgtggggctgagct

SEQ ID NO: 5028391 - DNA, 21 bp, Homo sapiens
cagatgtggggctgagctggg

SEQ ID NO: 5028392 - DNA, 23 bp, Homo sapiens
cagatgtggggctgagctgggga

SEQ ID NO: 5028393 - DNA, 15 bp, Homo sapiens
cagattctgatgcat

SEQ ID NO: 5028394 - DNA, 13 bp, Homo sapiens
cagatttaataca

SEQ ID NO: 5028395 - DNA, 11 bp, Homo sapiens
cagcaaaccat

SEQ ID NO: 5028396 - DNA, 22 bp, Homo sapiens
cagcaaagggaccaggggagag

SEQ ID NO: 5028397 - DNA, 15 bp, Homo sapiens
cagcaccacactggg

SEQ ID NO: 5028398 - DNA, 16 bp, Homo sapiens
cagcagaacctgcaca

SEQ ID NO: 5028399 - DNA, 21 bp, Homo sapiens
cagcatttccacaccaagcag

SEQ ID NO: 5028400 - DNA, 20 bp, Homo sapiens
cagccacccaagcctgctgg

SEQ ID NO: 5028401 - DNA, 21 bp, Homo sapiens
cagccacccaagcctgctggc

SEQ ID NO: 5028402 - DNA, 21 bp, Homo sapiens
cagccacccgtggggtgctgc

SEQ ID NO: 5028403 - DNA, 22 bp, Homo sapiens
cagccagatggactccagcctg

SEQ ID NO: 5028404 - DNA, 15 bp, Homo sapiens
cagccaggccctgcc

SEQ ID NO: 5028405 - DNA, 17 bp, Homo sapiens
cagccaggccctgccag

SEQ ID NO: 5028406 - DNA, 17 bp, Homo sapiens
cagccagtctcagatgc

SEQ ID NO: 5028407 - DNA, 12 bp, Homo sapiens
cagccccctcac

SEQ ID NO: 5028408 - DNA, 14 bp, Homo sapiens
cagccccctcacag

SEQ ID NO: 5028409 - DNA, 13 bp, Homo sapiens
cagcccgaacacc

SEQ ID NO: 5028410 - DNA, 13 bp, Homo sapiens
cagccctggctga

SEQ ID NO: 5028411 - DNA, 20 bp, Homo sapiens
cagccctggctgaaggactg

SEQ ID NO: 5028412 - DNA, 14 bp, Homo sapiens
cagccgtattttac

SEQ ID NO: 5028413 - DNA, 15 bp, Homo sapiens
cagccgtattttaca

SEQ ID NO: 5028414 - DNA, 15 bp, Homo sapiens
cagcctgcctggcag

SEQ ID NO: 5028415 - DNA, 19 bp, Homo sapiens
cagcctgcctggcaggctg

SEQ ID NO: 5028416 - DNA, 19 bp, Homo sapiens
cagcctgtgcctgcctttg

SEQ ID NO: 5028417 - DNA, 18 bp, Homo sapiens
cagcgaccgccccctcct

SEQ ID NO: 5028418 - DNA, 18 bp, Homo sapiens
cagcgaccttcctcatcc

SEQ ID NO: 5028419 - DNA, 12 bp, Homo sapiens
cagcgagcctgc

SEQ ID NO: 5028420 - DNA, 19 bp, Homo sapiens
cagcgatgtatataagcca

SEQ ID NO: 5028421 - DNA, 20 bp, Homo sapiens
cagcgctggccgggaccccg

SEQ ID NO: 5028422 - DNA, 12 bp, Homo sapiens
cagcggcccccc

SEQ ID NO: 5028423 - DNA, 14 bp, Homo sapiens
cagcggccccccgc

SEQ ID NO: 5028424 - DNA, 14 bp, Homo sapiens
cagcgtcctgtcca

SEQ ID NO: 5028425 - DNA, 15 bp, Homo sapiens
cagctacttcctcct

SEQ ID NO: 5028426 - DNA, 17 bp, Homo sapiens
cagctacttggtttgtg

SEQ ID NO: 5028427 - DNA, 16 bp, Homo sapiens
cagctcaatggactgg

SEQ ID NO: 5028428 - DNA, 13 bp, Homo sapiens
cagctcacagtgc

SEQ ID NO: 5028429 - DNA, 20 bp, Homo sapiens
cagctcagcactgcctgctc

SEQ ID NO: 5028430 - DNA, 12 bp, Homo sapiens
cagctctctgac

SEQ ID NO: 5028431 - DNA, 20 bp, Homo sapiens
gaacacataattcaggaagc

SEQ ID NO: 5028432 - DNA, 18 bp, Homo sapiens
gaacactccaattaagga

SEQ ID NO: 5028433 - DNA, 18 bp, Homo sapiens
gaacagataatccctgta

SEQ ID NO: 5028434 - DNA, 15 bp, Homo sapiens
gaacagcctgcctgt

SEQ ID NO: 5028435 - DNA, 16 bp, Homo sapiens
gaacagcctgcctgtc

SEQ ID NO: 5028436 - DNA, 11 bp, Homo sapiens
gaacagctgtg

SEQ ID NO: 5028437 - DNA, 14 bp, Homo sapiens
gaacagctgtgtct

SEQ ID NO: 5028438 - DNA, 21 bp, Homo sapiens
gaacatctgagtcctggatga

SEQ ID NO: 5028439 - DNA, 10 bp, Homo sapiens
gaacattgta

SEQ ID NO: 5028440 - DNA, 21 bp, Homo sapiens
gaaccacgcgggggccttgag

SEQ ID NO: 5028441 - DNA, 17 bp, Homo sapiens
gaaccaggagaagggct

SEQ ID NO: 5028442 - DNA, 20 bp, Homo sapiens
gaacctgcacacaggacagc

SEQ ID NO: 5028443 - DNA, 21 bp, Homo sapiens
gaacctgcacacaggacagcg

SEQ ID NO: 5028444 - DNA, 12 bp, Homo sapiens
gaactaaacttt

SEQ ID NO: 5028445 - DNA, 17 bp, Homo sapiens
gaactaaactttcacac

SEQ ID NO: 5028446 - DNA, 18 bp, Homo sapiens
gaactaaactttcacacc

SEQ ID NO: 5028447 - DNA, 17 bp, Homo sapiens
gaactccttccccactt

SEQ ID NO: 5028448 - DNA, 15 bp, Homo sapiens
gaactgggctgggcc

SEQ ID NO: 5028449 - DNA, 15 bp, Homo sapiens
gaacttgttttctgg

SEQ ID NO: 5028450 - DNA, 23 bp, Homo sapiens
gaagaaatctttctccctcaact

SEQ ID NO: 5028451 - DNA, 17 bp, Homo sapiens
gaagaagaaatctttct

SEQ ID NO: 5028452 - DNA, 16 bp, Homo sapiens
gaagaagggcacccta

SEQ ID NO: 5028453 - DNA, 21 bp, Homo sapiens
gaagagcaggtgactgtgctg

SEQ ID NO: 5028454 - DNA, 12 bp, Homo sapiens
gaagcagctctt

SEQ ID NO: 5028455 - DNA, 18 bp, Homo sapiens
gaagcattctcattggaa

SEQ ID NO: 5028456 - DNA, 13 bp, Homo sapiens
gaagcattttata

SEQ ID NO: 5028457 - DNA, 18 bp, Homo sapiens
gaagccaaacctctgtga

SEQ ID NO: 5028458 - DNA, 10 bp, Homo sapiens
gaagccagct

SEQ ID NO: 5028459 - DNA, 14 bp, Homo sapiens
gaagctagtctttt

SEQ ID NO: 5028460 - DNA, 18 bp, Homo sapiens
gaaggactgtgacaggca

SEQ ID NO: 5028461 - DNA, 14 bp, Homo sapiens
gaaggcaaatgact

SEQ ID NO: 5028462 - DNA, 22 bp, Homo sapiens
gaaggcagggggaaggtggggt

SEQ ID NO: 5028463 - DNA, 22 bp, Homo sapiens
gaaggccagctgccccagccag

SEQ ID NO: 5028464 - DNA, 13 bp, Homo sapiens
gaagggaggtggc

SEQ ID NO: 5028465 - DNA, 13 bp, Homo sapiens
gaagggtcctgcc

SEQ ID NO: 5028466 - DNA, 16 bp, Homo sapiens
gaaggttctggtgtga

SEQ ID NO: 5028467 - DNA, 20 bp, Homo sapiens
gaataaattcccaacttctc

SEQ ID NO: 5028468 - DNA, 17 bp, Homo sapiens
gaataccactctgtaat

SEQ ID NO: 5028469 - DNA, 22 bp, Homo sapiens
gaatactgaacatctgagtcct

SEQ ID NO: 5028470 - DNA, 19 bp, Homo sapiens
gaatatccatgtacttgtt

SEQ ID NO: 5028471 - DNA, 23 bp, Homo sapiens
gaatattttgttttgtgcagaga

SEQ ID NO: 5028472 - DNA, 15 bp, Homo sapiens
gaatcgcagctgtgg

SEQ ID NO: 5028473 - DNA, 19 bp, Homo sapiens
gaatgaaatactgtttgag

SEQ ID NO: 5028474 - DNA, 20 bp, Homo sapiens
gaatgacggtaagtgttctc

SEQ ID NO: 5028475 - DNA, 16 bp, Homo sapiens
gaatgatttttcttta

SEQ ID NO: 5028476 - DNA, 18 bp, Homo sapiens
gaatgatttttctttaca

SEQ ID NO: 5028477 - DNA, 13 bp, Homo sapiens
gaatgctttagga

SEQ ID NO: 5028478 - DNA, 11 bp, Homo sapiens
gacaaagtgcc

SEQ ID NO: 5028479 - DNA, 23 bp, Homo sapiens
gacaacatcgcaatagtttttta

SEQ ID NO: 5028480 - DNA, 21 bp, Homo sapiens
gacacgggcctgtccacaggc

SEQ ID NO: 5028481 - DNA, 14 bp, Homo sapiens
gacactggcccctc

SEQ ID NO: 5028482 - DNA, 18 bp, Homo sapiens
gacagcctccccctgtcc

SEQ ID NO: 5028483 - DNA, 15 bp, Homo sapiens
gacagctttctggga

SEQ ID NO: 5028484 - DNA, 18 bp, Homo sapiens
gacagctttctgggatgt

SEQ ID NO: 5028485 - DNA, 20 bp, Homo sapiens
gacagctttctgggatgtca

SEQ ID NO: 5028486 - DNA, 17 bp, Homo sapiens
gacagtacctgattgta

SEQ ID NO: 5028487 - DNA, 13 bp, Homo sapiens
gacagtgcctctt

SEQ ID NO: 5028488 - DNA, 17 bp, Homo sapiens
gacagttcctgagacca

SEQ ID NO: 5028489 - DNA, 23 bp, Homo sapiens
gacataatatattctatttttat

SEQ ID NO: 5028490 - DNA, 19 bp, Homo sapiens
gacatagaagagccaagag

SEQ ID NO: 5028491 - DNA, 21 bp, Homo sapiens
gacatgtggaggggcagcctg

SEQ ID NO: 5028492 - DNA, 24 bp, Homo sapiens
gacatgtggaggggcagcctgtgc

SEQ ID NO: 5028493 - DNA, 20 bp, Homo sapiens
gacattctgaatgcttctaa

SEQ ID NO: 5028494 - DNA, 22 bp, Homo sapiens
gacattctgaatgcttctaagt

SEQ ID NO: 5028495 - DNA, 22 bp, Homo sapiens
gaccaccaccccaacaaaccat

SEQ ID NO: 5028496 - DNA, 17 bp, Homo sapiens
gaccactgggtgagaga

SEQ ID NO: 5028497 - DNA, 17 bp, Homo sapiens
gaccagccaacctgggg

SEQ ID NO: 5028498 - DNA, 15 bp, Homo sapiens
gaccaggctgtgtcc

SEQ ID NO: 5028499 - DNA, 20 bp, Homo sapiens
gacccattctacacagagca

SEQ ID NO: 5028500 - DNA, 11 bp, Homo sapiens
gacccccaggc

SEQ ID NO: 5028501 - DNA, 14 bp, Homo sapiens
gacccccaggcctg

SEQ ID NO: 5028502 - DNA, 22 bp, Homo sapiens
gacccccaggcctgtccaccct

SEQ ID NO: 5028503 - DNA, 24 bp, Homo sapiens
gacccccaggcctgtccaccctgc

SEQ ID NO: 5028504 - DNA, 13 bp, Homo sapiens
gacccctggctct

SEQ ID NO: 5028505 - DNA, 14 bp, Homo sapiens
gaccgccccctcct

SEQ ID NO: 5028506 - DNA, 14 bp, Homo sapiens
gacctcatgcccag

SEQ ID NO: 5028507 - DNA, 16 bp, Homo sapiens
gacctgcactggggag

SEQ ID NO: 5028508 - DNA, 15 bp, Homo sapiens
gacctgctgtttcct

SEQ ID NO: 5028509 - DNA, 23 bp, Homo sapiens
gacctggtaccctcctggctctt

SEQ ID NO: 5028510 - DNA, 17 bp, Homo sapiens
gacctgtttatgagatg

SEQ ID NO: 5028511 - DNA, 21 bp, Homo sapiens
gacctttcatcgtaaagtgct

SEQ ID NO: 5028512 - DNA, 21 bp, Homo sapiens
gacggtaagtgttctcatgaa

SEQ ID NO: 5028513 - DNA, 22 bp, Homo sapiens
gactaatagaaaagtatgttct

SEQ ID NO: 5028514 - DNA, 18 bp, Homo sapiens
gactacttgggagcaccg

SEQ ID NO: 5028515 - DNA, 20 bp, Homo sapiens
gactacttgggagcaccgcc

SEQ ID NO: 5028516 - DNA, 18 bp, Homo sapiens
gactatgcagaggcctgg

SEQ ID NO: 5028517 - DNA, 18 bp, Homo sapiens
gactctattctttaactc

SEQ ID NO: 5028518 - DNA, 21 bp, Homo sapiens
gactgcacagcgtcctgtcca

SEQ ID NO: 5028519 - DNA, 23 bp, Homo sapiens
gactggctgtgtaaccttgggtg

SEQ ID NO: 5028520 - DNA, 16 bp, Homo sapiens
gactgtatctgtgtag

SEQ ID NO: 5028521 - DNA, 17 bp, Homo sapiens
gactgtgacaggcagca

SEQ ID NO: 5028522 - DNA, 18 bp, Homo sapiens
gactgtgacaggcagcag

SEQ ID NO: 5028523 - DNA, 20 bp, Homo sapiens
gactgtgacaggcagcagag

SEQ ID NO: 5028524 - DNA, 14 bp, Homo sapiens
gacttaatgtgatt

SEQ ID NO: 5028525 - DNA, 23 bp, Homo sapiens
gacttaatgtgattactgctcta

SEQ ID NO: 5028526 - DNA, 21 bp, Homo sapiens
gacttagaaaaccagctcagc

SEQ ID NO: 5028527 - DNA, 15 bp, Homo sapiens
gacttcattaataat

SEQ ID NO: 5028528 - DNA, 21 bp, Homo sapiens
gacttggagactcctggtctg

SEQ ID NO: 5028529 - DNA, 18 bp, Homo sapiens
gactttaacataagctat

SEQ ID NO: 5028530 - DNA, 19 bp, Homo sapiens
gactttaacataagctatt

SEQ ID NO: 5028531 - DNA, 16 bp, Homo sapiens
gagaaaaaaaaaatag

SEQ ID NO: 5028532 - DNA, 22 bp, Homo sapiens
gagaaaattggaactctactca

SEQ ID NO: 5028533 - DNA, 18 bp, Homo sapiens
gagaagcattctcattgg

SEQ ID NO: 5028534 - DNA, 17 bp, Homo sapiens
gagaaggggaagcactc

SEQ ID NO: 5028535 - DNA, 14 bp, Homo sapiens
gagacaccaccacc

SEQ ID NO: 5028536 - DNA, 15 bp, Homo sapiens
gagacactggcccct

SEQ ID NO: 5028537 - DNA, 15 bp, Homo sapiens
gagaccagccaacct

SEQ ID NO: 5028538 - DNA, 14 bp, Homo sapiens
gagaccctccccac

SEQ ID NO: 5028539 - DNA, 23 bp, Homo sapiens
gagaccctccccacagtgccacc

SEQ ID NO: 5028540 - DNA, 19 bp, Homo sapiens
gagacctggcactggatgc

SEQ ID NO: 5028541 - DNA, 21 bp, Homo sapiens
gagacggcgattttcgggctg

SEQ ID NO: 5028542 - DNA, 14 bp, Homo sapiens
gagactcctggtct

SEQ ID NO: 5028543 - DNA, 14 bp, Homo sapiens
gagactgggctctg

SEQ ID NO: 5028544 - DNA, 17 bp, Homo sapiens
gagactgggctctggct

SEQ ID NO: 5028545 - DNA, 22 bp, Homo sapiens
gagagaggaggtttgcctgtga

SEQ ID NO: 5028546 - DNA, 13 bp, Homo sapiens
gagagcctggtgc

SEQ ID NO: 5028547 - DNA, 17 bp, Homo sapiens
gagaggccaaaggctgg

SEQ ID NO: 5028548 - DNA, 16 bp, Homo sapiens
gagagtcaaagctgac

SEQ ID NO: 5028549 - DNA, 13 bp, Homo sapiens
gagagtttcaaaa

SEQ ID NO: 5028550 - DNA, 15 bp, Homo sapiens
gagatacttcccaaa

SEQ ID NO: 5028551 - DNA, 18 bp, Homo sapiens
gagatccagggcaaggcc

SEQ ID NO: 5028552 - DNA, 17 bp, Homo sapiens
gagatctttctttccaa

SEQ ID NO: 5028553 - DNA, 21 bp, Homo sapiens
gagatctttctttccaaaaca

SEQ ID NO: 5028554 - DNA, 16 bp, Homo sapiens
gagcacccattccaaa

SEQ ID NO: 5028555 - DNA, 19 bp, Homo sapiens
gagcacccattccaaagct

SEQ ID NO: 5028556 - DNA, 21 bp, Homo sapiens
gagcacctgcaggcgtgacct

SEQ ID NO: 5028557 - DNA, 13 bp, Homo sapiens
gagcacggctctg

SEQ ID NO: 5028558 - DNA, 22 bp, Homo sapiens
gagcacggctctgtccccagcc

SEQ ID NO: 5028559 - DNA, 22 bp, Homo sapiens
gagcagaccaccccgcctgccc

SEQ ID NO: 5028560 - DNA, 15 bp, Homo sapiens
gagcagcgagcctgc

SEQ ID NO: 5028561 - DNA, 17 bp, Homo sapiens
gagcagcgagcctgcta

SEQ ID NO: 5028562 - DNA, 20 bp, Homo sapiens
gagcccctcggctctggagg

SEQ ID NO: 5028563 - DNA, 19 bp, Homo sapiens
gagcccgcagggccatgca

SEQ ID NO: 5028564 - DNA, 20 bp, Homo sapiens
gagcccgcagggccatgcag

SEQ ID NO: 5028565 - DNA, 22 bp, Homo sapiens
gagccctgtcctgcctaaggct

SEQ ID NO: 5028566 - DNA, 17 bp, Homo sapiens
gagcctggtgctgctgc

SEQ ID NO: 5028567 - DNA, 21 bp, Homo sapiens
gagctctcaaatccctctcca

SEQ ID NO: 5028568 - DNA, 20 bp, Homo sapiens
gagctggccaaagagccttt

SEQ ID NO: 5028569 - DNA, 22 bp, Homo sapiens
gagctgggcccctgcacaggca

SEQ ID NO: 5028570 - DNA, 16 bp, Homo sapiens
gagcttaaaatacaag

SEQ ID NO: 5028571 - DNA, 18 bp, Homo sapiens
gagcttgaaatagtgtct

SEQ ID NO: 5028572 - DNA, 20 bp, Homo sapiens
gagcttgaaatagtgtctga

SEQ ID NO: 5028573 - DNA, 22 bp, Homo sapiens
gagctttatgtaataatgtgaa

SEQ ID NO: 5028574 - DNA, 19 bp, Homo sapiens
gaggacgtgttacccactg

SEQ ID NO: 5028575 - DNA, 14 bp, Homo sapiens
gaggatcagttttt

SEQ ID NO: 5028576 - DNA, 15 bp, Homo sapiens
gaggatgcattcgag

SEQ ID NO: 5028577 - DNA, 23 bp, Homo sapiens
gaggcagtacctgggcaagctgg

SEQ ID NO: 5028578 - DNA, 22 bp, Homo sapiens
gaggcatcatggaaagactggg

SEQ ID NO: 5028579 - DNA, 17 bp, Homo sapiens
gaggccaaaggctggtg

SEQ ID NO: 5028580 - DNA, 21 bp, Homo sapiens
gaggccaagcagtgcctgcct

SEQ ID NO: 5028581 - DNA, 12 bp, Homo sapiens
gaggcccttcct

SEQ ID NO: 5028582 - DNA, 12 bp, Homo sapiens
gaggcccttgtc

SEQ ID NO: 5028583 - DNA, 21 bp, Homo sapiens
gaggcccttgtcgtgggatgg

SEQ ID NO: 5028584 - DNA, 19 bp, Homo sapiens
gaggcggatctttggacag

SEQ ID NO: 5028585 - DNA, 11 bp, Homo sapiens
gaggctgctag

SEQ ID NO: 5028586 - DNA, 19 bp, Homo sapiens
gagggacccttcgagatca

SEQ ID NO: 5028587 - DNA, 21 bp, Homo sapiens
gagggagacactggcccctca

SEQ ID NO: 5028588 - DNA, 14 bp, Homo sapiens
gagggcaggcttgg

SEQ ID NO: 5028589 - DNA, 19 bp, Homo sapiens
gagggcaggcttggggaaa

SEQ ID NO: 5028590 - DNA, 16 bp, Homo sapiens
gaggggcagcctgtgc

SEQ ID NO: 5028591 - DNA, 13 bp, Homo sapiens
gagggttgtgcta

SEQ ID NO: 5028592 - DNA, 19 bp, Homo sapiens
gaggtccagccctggctga

SEQ ID NO: 5028593 - DNA, 20 bp, Homo sapiens
gaggtgacaaaccatttcca

SEQ ID NO: 5028594 - DNA, 21 bp, Homo sapiens
gaggtgacaaaccatttccaa

SEQ ID NO: 5028595 - DNA, 17 bp, Homo sapiens
gaggtgaggattccaaa

SEQ ID NO: 5028596 - DNA, 22 bp, Homo sapiens
gaggtggatgttatgaacagct

SEQ ID NO: 5028597 - DNA, 16 bp, Homo sapiens
gaggtttgcagtccca

SEQ ID NO: 5028598 - DNA, 22 bp, Homo sapiens
gaggtttgcagtcccaagcggt

SEQ ID NO: 5028599 - DNA, 15 bp, Homo sapiens
gaggtttgcctgtga

SEQ ID NO: 5028600 - DNA, 22 bp, Homo sapiens
gagtcagacattttaagatggt

SEQ ID NO: 5028601 - DNA, 15 bp, Homo sapiens
gagtcatttaaatgt

SEQ ID NO: 5028602 - DNA, 16 bp, Homo sapiens
gagtcccctcacctcc

SEQ ID NO: 5028603 - DNA, 18 bp, Homo sapiens
gagtcccctcacctcctc

SEQ ID NO: 5028604 - DNA, 23 bp, Homo sapiens
gagtctgccccacatgtggccat

SEQ ID NO: 5028605 - DNA, 17 bp, Homo sapiens
gagtgacagctttctgg

SEQ ID NO: 5028606 - DNA, 21 bp, Homo sapiens
gagtgacagctttctgggatg

SEQ ID NO: 5028607 - DNA, 23 bp, Homo sapiens
gagtgacagctttctgggatgtc

SEQ ID NO: 5028608 - DNA, 18 bp, Homo sapiens
gagtgcttgcttttcatg

SEQ ID NO: 5028609 - DNA, 20 bp, Homo sapiens
gagtggcatggccaccacca

SEQ ID NO: 5028610 - DNA, 18 bp, Homo sapiens
gagtgtgcggctgtgtgt

SEQ ID NO: 5028611 - DNA, 19 bp, Homo sapiens
gagttcaccttggaagggc

SEQ ID NO: 5028612 - DNA, 20 bp, Homo sapiens
gagtttagggaacaatttgg

SEQ ID NO: 5028613 - DNA, 12 bp, Homo sapiens
gagtttctgttt

SEQ ID NO: 5028614 - DNA, 14 bp, Homo sapiens
gagtttctgtttga

SEQ ID NO: 5028615 - DNA, 15 bp, Homo sapiens
gagttttgtctgtct

SEQ ID NO: 5028616 - DNA, 18 bp, Homo sapiens
gataaacaacaaggtggt

SEQ ID NO: 5028617 - DNA, 22 bp, Homo sapiens
gataaacacaagattggtgttt

SEQ ID NO: 5028618 - DNA, 15 bp, Homo sapiens
gataaagcacagctg

SEQ ID NO: 5028619 - DNA, 17 bp, Homo sapiens
gataactgttatttata

SEQ ID NO: 5028620 - DNA, 17 bp, Homo sapiens
gataatcaactgggctg

SEQ ID NO: 5028621 - DNA, 22 bp, Homo sapiens
gatactaataaactaataattg

SEQ ID NO: 5028622 - DNA, 20 bp, Homo sapiens
gatacttcgacactgttctt

SEQ ID NO: 5028623 - DNA, 13 bp, Homo sapiens
gatagacttggga

SEQ ID NO: 5028624 - DNA, 17 bp, Homo sapiens
gatagccctgtcctggt

SEQ ID NO: 5028625 - DNA, 21 bp, Homo sapiens
gatagccctgtcctggtggta

SEQ ID NO: 5028626 - DNA, 19 bp, Homo sapiens
gatcacagtggccacggcc

SEQ ID NO: 5028627 - DNA, 17 bp, Homo sapiens
gatcctgggctgggtgg

SEQ ID NO: 5028628 - DNA, 15 bp, Homo sapiens
gatctatgcctttca

SEQ ID NO: 5028629 - DNA, 16 bp, Homo sapiens
gatctatgcctttcaa

SEQ ID NO: 5028630 - DNA, 19 bp, Homo sapiens
gatctgatccccaagacat

SEQ ID NO: 5028631 - DNA, 21 bp, Homo sapiens
gatctgctgaggcccagtgca

SEQ ID NO: 5028632 - DNA, 18 bp, Homo sapiens
gatctttctttccaaaac

SEQ ID NO: 5028633 - DNA, 18 bp, Homo sapiens
gatgatagaggattttat

SEQ ID NO: 5028634 - DNA, 17 bp, Homo sapiens
gatgatgatgatgatga

SEQ ID NO: 5028635 - DNA, 16 bp, Homo sapiens
gatgcacatccctgga

SEQ ID NO: 5028636 - DNA, 18 bp, Homo sapiens
gatgccttttttgtagtt

SEQ ID NO: 5028637 - DNA, 15 bp, Homo sapiens
gatggagccccacct

SEQ ID NO: 5028638 - DNA, 21 bp, Homo sapiens
gatgtatgttgaagcctttgt

SEQ ID NO: 5028639 - DNA, 20 bp, Homo sapiens
gatgtcacagtccaaccaga

SEQ ID NO: 5028640 - DNA, 15 bp, Homo sapiens
gatgtcccctgcggg

SEQ ID NO: 5028641 - DNA, 16 bp, Homo sapiens
gatgtcccctgcgggc

SEQ ID NO: 5028642 - DNA, 17 bp, Homo sapiens
gatgttatgaacagctg

SEQ ID NO: 5028643 - DNA, 20 bp, Homo sapiens
gattaaatgtgtcattggaa

SEQ ID NO: 5028644 - DNA, 17 bp, Homo sapiens
gattcaaattgctgctt

SEQ ID NO: 5028645 - DNA, 12 bp, Homo sapiens
gatttattaaag

SEQ ID NO: 5028646 - DNA, 13 bp, Homo sapiens
gatttattaaaga

SEQ ID NO: 5028647 - DNA, 15 bp, Homo sapiens
gatttattaaagaaa

SEQ ID NO: 5028648 - DNA, 16 bp, Homo sapiens
gatttgtttttaaact

SEQ ID NO: 5028649 - DNA, 18 bp, Homo sapiens
gatttgtttttaaactgt

SEQ ID NO: 5028650 - DNA, 22 bp, Homo sapiens
gatttgtttttaaactgtacag

SEQ ID NO: 5028651 - DNA, 23 bp, Homo sapiens
gatttgtttttaaactgtacagt

SEQ ID NO: 5028652 - DNA, 15 bp, Homo sapiens
gattttaccaaagca

SEQ ID NO: 5028653 - DNA, 15 bp, Homo sapiens
gatttttctttacaa

SEQ ID NO: 5028654 - DNA, 20 bp, Homo sapiens
gcaaaaactacattttgcaa

SEQ ID NO: 5028655 - DNA, 16 bp, Homo sapiens
gcaaaacatctctgca

SEQ ID NO: 5028656 - DNA, 17 bp, Homo sapiens
gcaaacccagaggtgga

SEQ ID NO: 5028657 - DNA, 20 bp, Homo sapiens
gcaaactctttggtcgtttt

SEQ ID NO: 5028658 - DNA, 21 bp, Homo sapiens
gcaaattgctagtcagggtga

SEQ ID NO: 5028659 - DNA, 19 bp, Homo sapiens
gcaacagacaagtgactgt

SEQ ID NO: 5028660 - DNA, 22 bp, Homo sapiens
gcaagctgccgaaccaaaagaa

SEQ ID NO: 5028661 - DNA, 21 bp, Homo sapiens
gcaatagttttttacttctct

SEQ ID NO: 5028662 - DNA, 19 bp, Homo sapiens
gcaatgaagtctctgaagt

SEQ ID NO: 5028663 - DNA, 19 bp, Homo sapiens
gcaatgtggagcagcagcc

SEQ ID NO: 5028664 - DNA, 16 bp, Homo sapiens
gcaatgtgtataaaca

SEQ ID NO: 5028665 - DNA, 23 bp, Homo sapiens
gcaatgtgtataaacaagaaaaa

SEQ ID NO: 5028666 - DNA, 19 bp, Homo sapiens
gcacaaattagttatatat

SEQ ID NO: 5028667 - DNA, 16 bp, Homo sapiens
gcacagctgtagtggg

SEQ ID NO: 5028668 - DNA, 14 bp, Homo sapiens
gcacaggccccctt

SEQ ID NO: 5028669 - DNA, 10 bp, Homo sapiens
gcaccaaaga

SEQ ID NO: 5028670 - DNA, 13 bp, Homo sapiens
gcaccagccagcg

SEQ ID NO: 5028671 - DNA, 19 bp, Homo sapiens
gcaccagcccgaacaccat

SEQ ID NO: 5028672 - DNA, 18 bp, Homo sapiens
gcacccacctgttttctg

SEQ ID NO: 5028673 - DNA, 21 bp, Homo sapiens
gcacccacctgttttctgaaa

SEQ ID NO: 5028674 - DNA, 17 bp, Homo sapiens
gcaccctaggcagcctg

SEQ ID NO: 5028675 - DNA, 18 bp, Homo sapiens
gcaccctaggcagcctgc

SEQ ID NO: 5028676 - DNA, 22 bp, Homo sapiens
gcaccgcggcgcttcccagcac

SEQ ID NO: 5028677 - DNA, 21 bp, Homo sapiens
gcacctcggggacaccagagc

SEQ ID NO: 5028678 - DNA, 23 bp, Homo sapiens
gcacctcggggacaccagagctg

SEQ ID NO: 5028679 - DNA, 18 bp, Homo sapiens
gcacctgcaggcgtgacc

SEQ ID NO: 5028680 - DNA, 13 bp, Homo sapiens
gcactgcgcctgt

SEQ ID NO: 5028681 - DNA, 19 bp, Homo sapiens
gcactttaacacagtgtct

SEQ ID NO: 5028682 - DNA, 16 bp, Homo sapiens
gcagaaatccaagcac

SEQ ID NO: 5028683 - DNA, 18 bp, Homo sapiens
gcagaggcagtacctggg

SEQ ID NO: 5028684 - DNA, 13 bp, Homo sapiens
gcagaggcctggg

SEQ ID NO: 5028685 - DNA, 13 bp, Homo sapiens
gcagcaccacact

SEQ ID NO: 5028686 - DNA, 14 bp, Homo sapiens
gcagcaccacactg

SEQ ID NO: 5028687 - DNA, 16 bp, Homo sapiens
gcagcaccacactggg

SEQ ID NO: 5028688 - DNA, 18 bp, Homo sapiens
gcagcaggatagagtggg

SEQ ID NO: 5028689 - DNA, 22 bp, Homo sapiens
gcagccactgcacaggaggagg

SEQ ID NO: 5028690 - DNA, 17 bp, Homo sapiens
gcagcgaccgccccctc

SEQ ID NO: 5028691 - DNA, 18 bp, Homo sapiens
gcagcgaccgccccctcc

SEQ ID NO: 5028692 - DNA, 14 bp, Homo sapiens
gcagcgagggcgga

SEQ ID NO: 5028693 - DNA, 21 bp, Homo sapiens
gcagcgagggcggagccggcc

SEQ ID NO: 5028694 - DNA, 20 bp, Homo sapiens
gcagcgtgtgggtcccgcac

SEQ ID NO: 5028695 - DNA, 17 bp, Homo sapiens
gcagctgccaggagcac

SEQ ID NO: 5028696 - DNA, 13 bp, Homo sapiens
gcagctgctcccc

SEQ ID NO: 5028697 - DNA, 20 bp, Homo sapiens
gcagctgttttgttgacatt

SEQ ID NO: 5028698 - DNA, 20 bp, Homo sapiens
gcaggaactgggctgggcct

SEQ ID NO: 5028699 - DNA, 19 bp, Homo sapiens
gcaggactgcacagcgtcc

SEQ ID NO: 5028700 - DNA, 23 bp, Homo sapiens
gcaggccacacttcaaactactt

SEQ ID NO: 5028701 - DNA, 13 bp, Homo sapiens
gcaggcttgggga

SEQ ID NO: 5028702 - DNA, 18 bp, Homo sapiens
gcagggagggcagttttc

SEQ ID NO: 5028703 - DNA, 21 bp, Homo sapiens
gcagggccatgcagacctcat

SEQ ID NO: 5028704 - DNA, 13 bp, Homo sapiens
gcaggttcttgtt

SEQ ID NO: 5028705 - DNA, 17 bp, Homo sapiens
gcaggttcttgttggtg

SEQ ID NO: 5028706 - DNA, 17 bp, Homo sapiens
gcagtcacatctcttcc

SEQ ID NO: 5028707 - DNA, 16 bp, Homo sapiens
gcagtcccaagcggtg

SEQ ID NO: 5028708 - DNA, 21 bp, Homo sapiens
gcagtccccttccctccaaga

SEQ ID NO: 5028709 - DNA, 23 bp, Homo sapiens
gcagtggaggtggggtgtttggg

SEQ ID NO: 5028710 - DNA, 19 bp, Homo sapiens
gcagttcccacattaaaga

SEQ ID NO: 5028711 - DNA, 15 bp, Homo sapiens
gcatattgttattat

SEQ ID NO: 5028712 - DNA, 19 bp, Homo sapiens
gcatattgttattatataa

SEQ ID NO: 5028713 - DNA, 23 bp, Homo sapiens
gcatatttattgcattgctggta

SEQ ID NO: 5028714 - DNA, 19 bp, Homo sapiens
gcatcaatacaaccagccc

SEQ ID NO: 5028715 - DNA, 21 bp, Homo sapiens
gcatcatggaaagactgggac

SEQ ID NO: 5028716 - DNA, 19 bp, Homo sapiens
gcatcattatttatgtatt

SEQ ID NO: 5028717 - DNA, 17 bp, Homo sapiens
gcatctctgtactttgc

SEQ ID NO: 5028718 - DNA, 11 bp, Homo sapiens
gcatggaaatt

SEQ ID NO: 5028719 - DNA, 22 bp, Homo sapiens
gcatgtttagactttaacataa

SEQ ID NO: 5028720 - DNA, 14 bp, Homo sapiens
gcatgtttgaaatg

SEQ ID NO: 5028721 - DNA, 18 bp, Homo sapiens
gcatgtttgaaatgaggt

SEQ ID NO: 5028722 - DNA, 13 bp, Homo sapiens
gcattaacacaaa

SEQ ID NO: 5028723 - DNA, 20 bp, Homo sapiens
gcattctcattggaaattta

SEQ ID NO: 5028724 - DNA, 21 bp, Homo sapiens
gcatttaacccccctgtacac

SEQ ID NO: 5028725 - DNA, 22 bp, Homo sapiens
gcatttaacccccctgtacaca

SEQ ID NO: 5028726 - DNA, 12 bp, Homo sapiens
gcatttggtctc

SEQ ID NO: 5028727 - DNA, 16 bp, Homo sapiens
gcatttggtctcaggc

SEQ ID NO: 5028728 - DNA, 22 bp, Homo sapiens
gcatttggtgagagtcaaagct

SEQ ID NO: 5028729 - DNA, 19 bp, Homo sapiens
gccaaagagcctttccaaa

SEQ ID NO: 5028730 - DNA, 22 bp, Homo sapiens
gccaaagagcctttccaaagag

SEQ ID NO: 5028731 - DNA, 12 bp, Homo sapiens
gccaaataaagt

SEQ ID NO: 5028732 - DNA, 14 bp, Homo sapiens
gccaaataaagtct

SEQ ID NO: 5028733 - DNA, 14 bp, Homo sapiens
gccaaattaaaaaa

SEQ ID NO: 5028734 - DNA, 18 bp, Homo sapiens
gccaaattaaaaaagata

SEQ ID NO: 5028735 - DNA, 23 bp, Homo sapiens
gccaaattaaaaaagataaacac

SEQ ID NO: 5028736 - DNA, 17 bp, Homo sapiens
gccaagactcctcaggc

SEQ ID NO: 5028737 - DNA, 19 bp, Homo sapiens
gccacacttcaaactactt

SEQ ID NO: 5028738 - DNA, 14 bp, Homo sapiens
gccacagtcatggt

SEQ ID NO: 5028739 - DNA, 22 bp, Homo sapiens
gccaccccgctgatggagcccc

SEQ ID NO: 5028740 - DNA, 14 bp, Homo sapiens
gccaccctgcccct

SEQ ID NO: 5028741 - DNA, 21 bp, Homo sapiens
gccacgtgggcaaacaggcag

SEQ ID NO: 5028742 - DNA, 23 bp, Homo sapiens
gccactaaccttgcctggtacag

SEQ ID NO: 5028743 - DNA, 15 bp, Homo sapiens
gccagaatttcaaac

SEQ ID NO: 5028744 - DNA, 14 bp, Homo sapiens
gccagcccctgcca

SEQ ID NO: 5028745 - DNA, 18 bp, Homo sapiens
gccagctgccgcaccagc

SEQ ID NO: 5028746 - DNA, 21 bp, Homo sapiens
gccaggcctcttggcagtcac

SEQ ID NO: 5028747 - DNA, 19 bp, Homo sapiens
gccaggggcgaggcccttc

SEQ ID NO: 5028748 - DNA, 12 bp, Homo sapiens
gccagtatttta

SEQ ID NO: 5028749 - DNA, 17 bp, Homo sapiens
gccagtattttaaaata

SEQ ID NO: 5028750 - DNA, 17 bp, Homo sapiens
gccagtcaagaagaaaa

SEQ ID NO: 5028751 - DNA, 15 bp, Homo sapiens
gccagtccccgagga

SEQ ID NO: 5028752 - DNA, 22 bp, Homo sapiens
gccagtccccgaggagctgggc

SEQ ID NO: 5028753 - DNA, 23 bp, Homo sapiens
gccagtccccgaggagctgggcc

SEQ ID NO: 5028754 - DNA, 14 bp, Homo sapiens
gccatattaaattt

SEQ ID NO: 5028755 - DNA, 23 bp, Homo sapiens
gccatccctttttttacatttca

SEQ ID NO: 5028756 - DNA, 16 bp, Homo sapiens
gccatctgctcctgga

SEQ ID NO: 5028757 - DNA, 22 bp, Homo sapiens
gccatgcaccaggactggctgt

SEQ ID NO: 5028758 - DNA, 20 bp, Homo sapiens
gccatgcagacctcatgccc

SEQ ID NO: 5028759 - DNA, 14 bp, Homo sapiens
gccatgcaggaggt

SEQ ID NO: 5028760 - DNA, 17 bp, Homo sapiens
gccatgcaggaggtgga

SEQ ID NO: 5028761 - DNA, 14 bp, Homo sapiens
gccatgctggccag

SEQ ID NO: 5028762 - DNA, 17 bp, Homo sapiens
gccatgtactagtttta

SEQ ID NO: 5028763 - DNA, 19 bp, Homo sapiens
gcccaaccatcggtccaca

SEQ ID NO: 5028764 - DNA, 12 bp, Homo sapiens
gcccaagggtgg

SEQ ID NO: 5028765 - DNA, 17 bp, Homo sapiens
gcccagaccggcttctc

SEQ ID NO: 5028766 - DNA, 20 bp, Homo sapiens
gcccagaccggcttctcggc

SEQ ID NO: 5028767 - DNA, 21 bp, Homo sapiens
gcccagacttgcggggggtgg

SEQ ID NO: 5028768 - DNA, 17 bp, Homo sapiens
gcccagtgccactgccc

SEQ ID NO: 5028769 - DNA, 16 bp, Homo sapiens
gccccactttgaaggg

SEQ ID NO: 5028770 - DNA, 17 bp, Homo sapiens
gccccccgcacagccac

SEQ ID NO: 5028771 - DNA, 18 bp, Homo sapiens
gccccccgcacagccacc

SEQ ID NO: 5028772 - DNA, 15 bp, Homo sapiens
gcccccgcctgccac

SEQ ID NO: 5028773 - DNA, 15 bp, Homo sapiens
ctctcagctccaggt

SEQ ID NO: 5028774 - DNA, 14 bp, Homo sapiens
ctctcccctgcctg

SEQ ID NO: 5028775 - DNA, 15 bp, Homo sapiens
ctctcctgccccttg

SEQ ID NO: 5028776 - DNA, 14 bp, Homo sapiens
ctctcggccaggca

SEQ ID NO: 5028777 - DNA, 14 bp, Homo sapiens
ctctcggctcccca

SEQ ID NO: 5028778 - DNA, 15 bp, Homo sapiens
ctctctgtggggctg

SEQ ID NO: 5028779 - DNA, 23 bp, Homo sapiens
ctctgaagtgaaactgcttgttt

SEQ ID NO: 5028780 - DNA, 22 bp, Homo sapiens
ctctgacaacagacttctgaaa

SEQ ID NO: 5028781 - DNA, 12 bp, Homo sapiens
ctctgacctgca

SEQ ID NO: 5028782 - DNA, 15 bp, Homo sapiens
ctctgacgcttgtga

SEQ ID NO: 5028783 - DNA, 17 bp, Homo sapiens
ctctgacgcttgtgaca

SEQ ID NO: 5028784 - DNA, 19 bp, Homo sapiens
ctctgaggtgcctgtccca

SEQ ID NO: 5028785 - DNA, 15 bp, Homo sapiens
ctctgcaattcccct

SEQ ID NO: 5028786 - DNA, 12 bp, Homo sapiens
ctctgcctgcct

SEQ ID NO: 5028787 - DNA, 20 bp, Homo sapiens
ctctggaggggtgtggctcc

SEQ ID NO: 5028788 - DNA, 21 bp, Homo sapiens
ctctggaggggtgtggctcct

SEQ ID NO: 5028789 - DNA, 19 bp, Homo sapiens
ctctggcattagaattatt

SEQ ID NO: 5028790 - DNA, 23 bp, Homo sapiens
ctctggcattagaattatttaaa

SEQ ID NO: 5028791 - DNA, 23 bp, Homo sapiens
ctctggtggcttaagtgagcaga

SEQ ID NO: 5028792 - DNA, 16 bp, Homo sapiens
ctctgtaattgcaaaa

SEQ ID NO: 5028793 - DNA, 18 bp, Homo sapiens
ctctgtaggcacagagct

SEQ ID NO: 5028794 - DNA, 12 bp, Homo sapiens
ctctgtccccag

SEQ ID NO: 5028795 - DNA, 18 bp, Homo sapiens
ctctgtgagcatcacagt

SEQ ID NO: 5028796 - DNA, 20 bp, Homo sapiens
ctctgtgcacttatttatga

SEQ ID NO: 5028797 - DNA, 17 bp, Homo sapiens
ctctgtgggtctctgga

SEQ ID NO: 5028798 - DNA, 14 bp, Homo sapiens
ctcttacaaaagct

SEQ ID NO: 5028799 - DNA, 23 bp, Homo sapiens
ctcttcagttaagcctttggaaa

SEQ ID NO: 5028800 - DNA, 18 bp, Homo sapiens
ctctttaaaaactcactt

SEQ ID NO: 5028801 - DNA, 18 bp, Homo sapiens
ctctttgttttgtgtctc

SEQ ID NO: 5028802 - DNA, 20 bp, Homo sapiens
ctctttgttttgtgtctctt

SEQ ID NO: 5028803 - DNA, 22 bp, Homo sapiens
ctctttttttgagtgacagctt

SEQ ID NO: 5028804 - DNA, 15 bp, Homo sapiens
ctgaaaaaaaacctg

SEQ ID NO: 5028805 - DNA, 13 bp, Homo sapiens
ctgaaacacacga

SEQ ID NO: 5028806 - DNA, 20 bp, Homo sapiens
ctgaacatctgagtcctgga

SEQ ID NO: 5028807 - DNA, 23 bp, Homo sapiens
ctgaagacaccgttcattcaggc

SEQ ID NO: 5028808 - DNA, 12 bp, Homo sapiens
ctgaaggactgt

SEQ ID NO: 5028809 - DNA, 15 bp, Homo sapiens
ctgaaggactgtgac

SEQ ID NO: 5028810 - DNA, 21 bp, Homo sapiens
ctgaaggactgtgacaggcag

SEQ ID NO: 5028811 - DNA, 21 bp, Homo sapiens
ctgaaggggtgcacccacctg

SEQ ID NO: 5028812 - DNA, 22 bp, Homo sapiens
ctgaaggggtgcacccacctgt

SEQ ID NO: 5028813 - DNA, 13 bp, Homo sapiens
ctgaagtgaaact

SEQ ID NO: 5028814 - DNA, 16 bp, Homo sapiens
ctgaagtgcttagtgt

SEQ ID NO: 5028815 - DNA, 19 bp, Homo sapiens
ctgaataccactctgtaat

SEQ ID NO: 5028816 - DNA, 21 bp, Homo sapiens
ctgaataccactctgtaattg

SEQ ID NO: 5028817 - DNA, 20 bp, Homo sapiens
ctgaatcagccagtctcaga

SEQ ID NO: 5028818 - DNA, 15 bp, Homo sapiens
ctgaatgcttctaag

SEQ ID NO: 5028819 - DNA, 18 bp, Homo sapiens
ctgaatgcttctaagtaa

SEQ ID NO: 5028820 - DNA, 20 bp, Homo sapiens
ctgaatgcttctaagtaaat

SEQ ID NO: 5028821 - DNA, 15 bp, Homo sapiens
ctgaatgtttttcta

SEQ ID NO: 5028822 - DNA, 23 bp, Homo sapiens
ctgaatgtttttctaaaggagtt

SEQ ID NO: 5028823 - DNA, 19 bp, Homo sapiens
ctgacacctaactcttctt

SEQ ID NO: 5028824 - DNA, 19 bp, Homo sapiens
ctgacagggacatgccctg

SEQ ID NO: 5028825 - DNA, 16 bp, Homo sapiens
ctgacatctctgcaat

SEQ ID NO: 5028826 - DNA, 20 bp, Homo sapiens
ctgaccccaaacaccttcca

SEQ ID NO: 5028827 - DNA, 21 bp, Homo sapiens
ctgaccccaaacaccttccag

SEQ ID NO: 5028828 - DNA, 13 bp, Homo sapiens
ctgacgcttgtga

SEQ ID NO: 5028829 - DNA, 18 bp, Homo sapiens
ctgacgcttgtgacagtg

SEQ ID NO: 5028830 - DNA, 21 bp, Homo sapiens
ctgacgcttgtgacagtgcct

SEQ ID NO: 5028831 - DNA, 19 bp, Homo sapiens
ctgacttaagcaaaagaaa

SEQ ID NO: 5028832 - DNA, 24 bp, Homo sapiens
ctgacttaagcaaaagaaaaagat

SEQ ID NO: 5028833 - DNA, 15 bp, Homo sapiens
ctgagatacttccca

SEQ ID NO: 5028834 - DNA, 18 bp, Homo sapiens
ctgagatacttcccaaag

SEQ ID NO: 5028835 - DNA, 18 bp, Homo sapiens
ctgagatttattaaagaa

SEQ ID NO: 5028836 - DNA, 18 bp, Homo sapiens
ctgagcagcgagcctgct

SEQ ID NO: 5028837 - DNA, 13 bp, Homo sapiens
ctgagcaggccac

SEQ ID NO: 5028838 - DNA, 23 bp, Homo sapiens
ctgagcaggccacacttcaaact

SEQ ID NO: 5028839 - DNA, 22 bp, Homo sapiens
ctgagcggtgggggaggagggt

SEQ ID NO: 5028840 - DNA, 15 bp, Homo sapiens
ctgaggcccagtgca

SEQ ID NO: 5028841 - DNA, 16 bp, Homo sapiens
ctgaggcccagtgcat

SEQ ID NO: 5028842 - DNA, 16 bp, Homo sapiens
ctgagggtctgggcgg

SEQ ID NO: 5028843 - DNA, 14 bp, Homo sapiens
ctgagtgccttttg

SEQ ID NO: 5028844 - DNA, 18 bp, Homo sapiens
ctgataaagcacagctgt

SEQ ID NO: 5028845 - DNA, 15 bp, Homo sapiens
ctgatggagccccac

SEQ ID NO: 5028846 - DNA, 16 bp, Homo sapiens
ctgatggagccccacc

SEQ ID NO: 5028847 - DNA, 17 bp, Homo sapiens
ctgcaattcccctctgc

SEQ ID NO: 5028848 - DNA, 14 bp, Homo sapiens
ctgcacacaggaca

SEQ ID NO: 5028849 - DNA, 15 bp, Homo sapiens
ctgcacacaggacag

SEQ ID NO: 5028850 - DNA, 18 bp, Homo sapiens
ctgcactccctcctggag

SEQ ID NO: 5028851 - DNA, 21 bp, Homo sapiens
ctgcactccctcctggagctc

SEQ ID NO: 5028852 - DNA, 22 bp, Homo sapiens
ctgcactggggagcccgtctca

SEQ ID NO: 5028853 - DNA, 18 bp, Homo sapiens
ctgcagagtctgccccac

SEQ ID NO: 5028854 - DNA, 16 bp, Homo sapiens
ctgcagtgaggctgta

SEQ ID NO: 5028855 - DNA, 21 bp, Homo sapiens
ctgcagtttgagacaggagac

SEQ ID NO: 5028856 - DNA, 16 bp, Homo sapiens
ctgcagtttttcccaa

SEQ ID NO: 5028857 - DNA, 22 bp, Homo sapiens
ctgccaccctgccccttgccat

SEQ ID NO: 5028858 - DNA, 19 bp, Homo sapiens
ctgcccacagtctttccgt

SEQ ID NO: 5028859 - DNA, 13 bp, Homo sapiens
ctgccccagccag

SEQ ID NO: 5028860 - DNA, 19 bp, Homo sapiens
ctgccccccagcctctggc

SEQ ID NO: 5028861 - DNA, 17 bp, Homo sapiens
ctgccgacttggagact

SEQ ID NO: 5028862 - DNA, 13 bp, Homo sapiens
ctgccggggcagc

SEQ ID NO: 5028863 - DNA, 21 bp, Homo sapiens
ctgccggtgggaccctgtccg

SEQ ID NO: 5028864 - DNA, 15 bp, Homo sapiens
ctgcctgcacccctg

SEQ ID NO: 5028865 - DNA, 18 bp, Homo sapiens
ctgcctgctcccatcctg

SEQ ID NO: 5028866 - DNA, 21 bp, Homo sapiens
ctgcctgtccccccgcacttt

SEQ ID NO: 5028867 - DNA, 14 bp, Homo sapiens
ctgcctgtgctgtg

SEQ ID NO: 5028868 - DNA, 18 bp, Homo sapiens
ctgcctttgatgttacag

SEQ ID NO: 5028869 - DNA, 22 bp, Homo sapiens
ctgcgggcgcgggcagccaccc

SEQ ID NO: 5028870 - DNA, 16 bp, Homo sapiens
ctgctaatattttcct

SEQ ID NO: 5028871 - DNA, 24 bp, Homo sapiens
ctgctaatattttcctcctgagtg

SEQ ID NO: 5028872 - DNA, 15 bp, Homo sapiens
ctgctcagctctggt

SEQ ID NO: 5028873 - DNA, 16 bp, Homo sapiens
ctgctccccaggccac

SEQ ID NO: 5028874 - DNA, 18 bp, Homo sapiens
ctgctccccaggccaccc

SEQ ID NO: 5028875 - DNA, 20 bp, Homo sapiens
ctgctctgatgaagaggagt

SEQ ID NO: 5028876 - DNA, 14 bp, Homo sapiens
ctgctgaggcccag

SEQ ID NO: 5028877 - DNA, 19 bp, Homo sapiens
ctgctggattcaagtgatc

SEQ ID NO: 5028878 - DNA, 15 bp, Homo sapiens
ctgctggctgcggcc

SEQ ID NO: 5028879 - DNA, 19 bp, Homo sapiens
ctgctggctgcggccccct

SEQ ID NO: 5028880 - DNA, 16 bp, Homo sapiens
ctgctgtctctctggg

SEQ ID NO: 5028881 - DNA, 19 bp, Homo sapiens
ctgctgtctctctgggctg

SEQ ID NO: 5028882 - DNA, 21 bp, Homo sapiens
ctgctgttggtcctctctctg

SEQ ID NO: 5028883 - DNA, 23 bp, Homo sapiens
ctgctgttggtcctctctctgtg

SEQ ID NO: 5028884 - DNA, 19 bp, Homo sapiens
ctgcttagcttgcaccttg

SEQ ID NO: 5028885 - DNA, 17 bp, Homo sapiens
ctgcttccaggctgggc

SEQ ID NO: 5028886 - DNA, 12 bp, Homo sapiens
ctggaagaaaaa

SEQ ID NO: 5028887 - DNA, 19 bp, Homo sapiens
ctggaaggggaagggacac

SEQ ID NO: 5028888 - DNA, 16 bp, Homo sapiens
ctggacactcagacct

SEQ ID NO: 5028889 - DNA, 20 bp, Homo sapiens
ctggaccccgtttcattttt

SEQ ID NO: 5028890 - DNA, 22 bp, Homo sapiens
ctggagcagaccaccccgcctg

SEQ ID NO: 5028891 - DNA, 16 bp, Homo sapiens
ctggagctctgtgggt

SEQ ID NO: 5028892 - DNA, 23 bp, Homo sapiens
ctggagctctgtgggtctctgga

SEQ ID NO: 5028893 - DNA, 16 bp, Homo sapiens
ctggatagacttggga

SEQ ID NO: 5028894 - DNA, 20 bp, Homo sapiens
ctggcactgactgggcatag

SEQ ID NO: 5028895 - DNA, 21 bp, Homo sapiens
ctggcactggatgcagaaaca

SEQ ID NO: 5028896 - DNA, 15 bp, Homo sapiens
ctggcacttgggaca

SEQ ID NO: 5028897 - DNA, 19 bp, Homo sapiens
ctggccaaagagcctttcc

SEQ ID NO: 5028898 - DNA, 17 bp, Homo sapiens
ctggccccgcctgcctg

SEQ ID NO: 5028899 - DNA, 21 bp, Homo sapiens
ctggccccgcctgcctgccac

SEQ ID NO: 5028900 - DNA, 15 bp, Homo sapiens
ctggccctgttctcc

SEQ ID NO: 5028901 - DNA, 22 bp, Homo sapiens
ctggcctggactgttttctctc

SEQ ID NO: 5028902 - DNA, 23 bp, Homo sapiens
ctggctatagatgtcttttccca

SEQ ID NO: 5028903 - DNA, 18 bp, Homo sapiens
ctggctctgttcggcctt

SEQ ID NO: 5028904 - DNA, 13 bp, Homo sapiens
ctggctgaaggac

SEQ ID NO: 5028905 - DNA, 14 bp, Homo sapiens
ctggctgaaggact

SEQ ID NO: 5028906 - DNA, 16 bp, Homo sapiens
ctgggaaagcccctgc

SEQ ID NO: 5028907 - DNA, 16 bp, Homo sapiens
ctgggaatgggagagg

SEQ ID NO: 5028908 - DNA, 15 bp, Homo sapiens
ctgggacagcccagg

SEQ ID NO: 5028909 - DNA, 21 bp, Homo sapiens
ctgggcagcacaaggccttgc

SEQ ID NO: 5028910 - DNA, 14 bp, Homo sapiens
ctgggccagaattt

SEQ ID NO: 5028911 - DNA, 14 bp, Homo sapiens
ctgggcccctgcac

SEQ ID NO: 5028912 - DNA, 20 bp, Homo sapiens
ctgggcccctgcacaggcac

SEQ ID NO: 5028913 - DNA, 20 bp, Homo sapiens
ctgggccgggcctggggctc

SEQ ID NO: 5028914 - DNA, 20 bp, Homo sapiens
ctgggcctcgtgcgcccgtg

SEQ ID NO: 5028915 - DNA, 15 bp, Homo sapiens
ctgggctctggctct

SEQ ID NO: 5028916 - DNA, 18 bp, Homo sapiens
ctgggctgaacactccaa

SEQ ID NO: 5028917 - DNA, 20 bp, Homo sapiens
ctggggacctggtaccctcc

SEQ ID NO: 5028918 - DNA, 19 bp, Homo sapiens
ctggggccaaataaagtct

SEQ ID NO: 5028919 - DNA, 19 bp, Homo sapiens
ctgggggacccctggctct

SEQ ID NO: 5028920 - DNA, 13 bp, Homo sapiens
ctgggttcctgca

SEQ ID NO: 5028921 - DNA, 19 bp, Homo sapiens
ctggtagagacccccaggc

SEQ ID NO: 5028922 - DNA, 22 bp, Homo sapiens
ctggtagagacccccaggcctg

SEQ ID NO: 5028923 - DNA, 13 bp, Homo sapiens
ctggtcctggcct

SEQ ID NO: 5028924 - DNA, 19 bp, Homo sapiens
ctggtctcgaactgctgga

SEQ ID NO: 5028925 - DNA, 20 bp, Homo sapiens
ctggtgacatcaggtttttc

SEQ ID NO: 5028926 - DNA, 14 bp, Homo sapiens
ctggtgctgctgct

SEQ ID NO: 5028927 - DNA, 17 bp, Homo sapiens
ctggtggcttaagtgag

SEQ ID NO: 5028928 - DNA, 23 bp, Homo sapiens
ctggttaatatttataggtcact

SEQ ID NO: 5028929 - DNA, 18 bp, Homo sapiens
ctggttcccgtttctcca

SEQ ID NO: 5028930 - DNA, 16 bp, Homo sapiens
ctgtaaaatggagaca

SEQ ID NO: 5028931 - DNA, 22 bp, Homo sapiens
ctgtaaaatggagacaccacca

SEQ ID NO: 5028932 - DNA, 20 bp, Homo sapiens
ctgtaaacctctcgagggca

SEQ ID NO: 5028933 - DNA, 15 bp, Homo sapiens
ctgtaactgtcagtg

SEQ ID NO: 5028934 - DNA, 14 bp, Homo sapiens
ctgtacagtgtctt

SEQ ID NO: 5028935 - DNA, 16 bp, Homo sapiens
ctgtacagtgtctttt

SEQ ID NO: 5028936 - DNA, 22 bp, Homo sapiens
ctgtaccttttgaggagcccca

SEQ ID NO: 5028937 - DNA, 13 bp, Homo sapiens
ctgtatctgtgta

SEQ ID NO: 5028938 - DNA, 14 bp, Homo sapiens
ctgtatctgtgtag

SEQ ID NO: 5028939 - DNA, 14 bp, Homo sapiens
ctgtccaccctgcc

SEQ ID NO: 5028940 - DNA, 15 bp, Homo sapiens
ctgtccggcccagtg

SEQ ID NO: 5028941 - DNA, 23 bp, Homo sapiens
ctgtccggcccagtgccactgcc

SEQ ID NO: 5028942 - DNA, 17 bp, Homo sapiens
ctgtcctggtggtattt

SEQ ID NO: 5028943 - DNA, 20 bp, Homo sapiens
ctgtcctggtggtattttca

SEQ ID NO: 5028944 - DNA, 12 bp, Homo sapiens
ctgtcctgtgac

SEQ ID NO: 5028945 - DNA, 18 bp, Homo sapiens
ctgtctaggactgcagtg

SEQ ID NO: 5028946 - DNA, 21 bp, Homo sapiens
ctgtctaggactgcagtgtgg

SEQ ID NO: 5028947 - DNA, 21 bp, Homo sapiens
ctgtctccctcccctctcaga

SEQ ID NO: 5028948 - DNA, 16 bp, Homo sapiens
ctgtctttaaaagaga

SEQ ID NO: 5028949 - DNA, 15 bp, Homo sapiens
ctgtgaactgaactc

SEQ ID NO: 5028950 - DNA, 18 bp, Homo sapiens
ctgtgacaggcagcagag

SEQ ID NO: 5028951 - DNA, 19 bp, Homo sapiens
ctgtgagcatcacagtttt

SEQ ID NO: 5028952 - DNA, 18 bp, Homo sapiens
ctgtgcctgcctttgtgt

SEQ ID NO: 5028953 - DNA, 22 bp, Homo sapiens
ctgtgcttggatttgcatattt

SEQ ID NO: 5028954 - DNA, 22 bp, Homo sapiens
ctgtggggctaggggctggggc

SEQ ID NO: 5028955 - DNA, 23 bp, Homo sapiens
ctgtgggggtgagggtcccatgt

SEQ ID NO: 5028956 - DNA, 15 bp, Homo sapiens
ctgtgtaaccttggg

SEQ ID NO: 5028957 - DNA, 20 bp, Homo sapiens
ctgtgtctttcacagctcct

SEQ ID NO: 5028958 - DNA, 12 bp, Homo sapiens
ctgttaactgaa

SEQ ID NO: 5028959 - DNA, 13 bp, Homo sapiens
ctgttaactgaat

SEQ ID NO: 5028960 - DNA, 14 bp, Homo sapiens
ctgttaactgaata

SEQ ID NO: 5028961 - DNA, 22 bp, Homo sapiens
ctgttaactgaataccactctg

SEQ ID NO: 5028962 - DNA, 13 bp, Homo sapiens
ctgttctgtgtct

SEQ ID NO: 5028963 - DNA, 14 bp, Homo sapiens
ctgttctgtgtctt

SEQ ID NO: 5028964 - DNA, 21 bp, Homo sapiens
ctgttcttagctcaatgagca

SEQ ID NO: 5028965 - DNA, 18 bp, Homo sapiens
ctgttgggaacagcatgg

SEQ ID NO: 5028966 - DNA, 11 bp, Homo sapiens
ctgtttcacaa

SEQ ID NO: 5028967 - DNA, 13 bp, Homo sapiens
ctgtttgattctt

SEQ ID NO: 5028968 - DNA, 12 bp, Homo sapiens
ctgttttatgac

SEQ ID NO: 5028969 - DNA, 15 bp, Homo sapiens
ctgttttctgaaaca

SEQ ID NO: 5028970 - DNA, 19 bp, Homo sapiens
ctgttttgttatataattt

SEQ ID NO: 5028971 - DNA, 14 bp, Homo sapiens
ctgttttgttgaca

SEQ ID NO: 5028972 - DNA, 16 bp, Homo sapiens
ctgttttgttgacatt

SEQ ID NO: 5028973 - DNA, 19 bp, Homo sapiens
ctgttttgttgacattctg

SEQ ID NO: 5028974 - DNA, 19 bp, Homo sapiens
cttaaaatacaagactgcc

SEQ ID NO: 5028975 - DNA, 22 bp, Homo sapiens
cttaaagtgccagtattttaaa

SEQ ID NO: 5028976 - DNA, 14 bp, Homo sapiens
cttaagcaaaagaa

SEQ ID NO: 5028977 - DNA, 15 bp, Homo sapiens
cttaagcaaaagaaa

SEQ ID NO: 5028978 - DNA, 20 bp, Homo sapiens
cttaatgtgattactgctct

SEQ ID NO: 5028979 - DNA, 15 bp, Homo sapiens
cttaattctctgcaa

SEQ ID NO: 5028980 - DNA, 20 bp, Homo sapiens
cttagaaaaccagctcagca

SEQ ID NO: 5028981 - DNA, 19 bp, Homo sapiens
cttagctcaatgagcatgt

SEQ ID NO: 5028982 - DNA, 20 bp, Homo sapiens
cttagctcaatgagcatgtt

SEQ ID NO: 5028983 - DNA, 19 bp, Homo sapiens
cttagtctcagtttgtgtg

SEQ ID NO: 5028984 - DNA, 23 bp, Homo sapiens
cttagtctcagtttgtgtgtctt

SEQ ID NO: 5028985 - DNA, 17 bp, Homo sapiens
cttatacgaaataattg

SEQ ID NO: 5028986 - DNA, 21 bp, Homo sapiens
cttatgaaaagaattgttggg

SEQ ID NO: 5028987 - DNA, 17 bp, Homo sapiens
cttatggatgtccccag

SEQ ID NO: 5028988 - DNA, 19 bp, Homo sapiens
cttatgttaatagtaattc

SEQ ID NO: 5028989 - DNA, 15 bp, Homo sapiens
cttattcccttcctg

SEQ ID NO: 5028990 - DNA, 17 bp, Homo sapiens
cttcaatcggcttgtgg

SEQ ID NO: 5028991 - DNA, 19 bp, Homo sapiens
cttcacctaagtctctgtg

SEQ ID NO: 5028992 - DNA, 22 bp, Homo sapiens
cttcagtaccctctcagctcca

SEQ ID NO: 5028993 - DNA, 13 bp, Homo sapiens
cttcagttgtctc

SEQ ID NO: 5028994 - DNA, 20 bp, Homo sapiens
cttcatattctaaaaccatt

SEQ ID NO: 5028995 - DNA, 15 bp, Homo sapiens
cttcatgccagctac

SEQ ID NO: 5028996 - DNA, 16 bp, Homo sapiens
cttcattaataataaa

SEQ ID NO: 5028997 - DNA, 14 bp, Homo sapiens
cttcattctcgtga

SEQ ID NO: 5028998 - DNA, 13 bp, Homo sapiens
cttccagctcctg

SEQ ID NO: 5028999 - DNA, 14 bp, Homo sapiens
cttccagctcctgt

SEQ ID NO: 5029000 - DNA, 15 bp, Homo sapiens
cttccagctcctgta

SEQ ID NO: 5029001 - DNA, 14 bp, Homo sapiens
cttccagtgaacat

SEQ ID NO: 5029002 - DNA, 21 bp, Homo sapiens
cttccagtgaacattcccagc

SEQ ID NO: 5029003 - DNA, 20 bp, Homo sapiens
cttcccagaggagcagctct

SEQ ID NO: 5029004 - DNA, 23 bp, Homo sapiens
cttcctcatccaccccatccctc

SEQ ID NO: 5029005 - DNA, 17 bp, Homo sapiens
cttcctgccagcccctg

SEQ ID NO: 5029006 - DNA, 12 bp, Homo sapiens
cttccttgcccc

SEQ ID NO: 5029007 - DNA, 21 bp, Homo sapiens
cttctaagtaaatacaatttt

SEQ ID NO: 5029008 - DNA, 16 bp, Homo sapiens
cttctcttgctttcta

SEQ ID NO: 5029009 - DNA, 17 bp, Homo sapiens
cttctcttgctttctat

SEQ ID NO: 5029010 - DNA, 18 bp, Homo sapiens
cttctgagcagcgagcct

SEQ ID NO: 5029011 - DNA, 20 bp, Homo sapiens
cttctgagcagcgagcctgc

SEQ ID NO: 5029012 - DNA, 18 bp, Homo sapiens
cttctgccttagtctcag

SEQ ID NO: 5029013 - DNA, 19 bp, Homo sapiens
cttctgccttagtctcagt

SEQ ID NO: 5029014 - DNA, 18 bp, Homo sapiens
cttctggaatttgttcaa

SEQ ID NO: 5029015 - DNA, 16 bp, Homo sapiens
cttcttctcggggaca

SEQ ID NO: 5029016 - DNA, 17 bp, Homo sapiens
cttctttcatttcttct

SEQ ID NO: 5029017 - DNA, 19 bp, Homo sapiens
cttgaggggaagctagtct

SEQ ID NO: 5029018 - DNA, 18 bp, Homo sapiens
cttgatcagttaagaaat

SEQ ID NO: 5029019 - DNA, 18 bp, Homo sapiens
cttgccatccattctgga

SEQ ID NO: 5029020 - DNA, 19 bp, Homo sapiens
cttgctccagattctgatg

SEQ ID NO: 5029021 - DNA, 21 bp, Homo sapiens
cttgctttctatgctgtttgt

SEQ ID NO: 5029022 - DNA, 22 bp, Homo sapiens
cttggaagggcgttctaggtag

SEQ ID NO: 5029023 - DNA, 13 bp, Homo sapiens
cttggatcctggg

SEQ ID NO: 5029024 - DNA, 18 bp, Homo sapiens
cttggattctttccattt

SEQ ID NO: 5029025 - DNA, 21 bp, Homo sapiens
cttggggaaaatggccatgca

SEQ ID NO: 5029026 - DNA, 19 bp, Homo sapiens
cttgtaaatataaagacgt

SEQ ID NO: 5029027 - DNA, 16 bp, Homo sapiens
cttgtaatttttattt

SEQ ID NO: 5029028 - DNA, 14 bp, Homo sapiens
cttgtattaagaat

SEQ ID NO: 5029029 - DNA, 14 bp, Homo sapiens
cttgtcctttccct

SEQ ID NO: 5029030 - DNA, 15 bp, Homo sapiens
cttgtcctttccctt

SEQ ID NO: 5029031 - DNA, 16 bp, Homo sapiens
cttgtctataaagcat

SEQ ID NO: 5029032 - DNA, 17 bp, Homo sapiens
cttgtctataaagcatt

SEQ ID NO: 5029033 - DNA, 15 bp, Homo sapiens
cttgtgacagtgcct

SEQ ID NO: 5029034 - DNA, 22 bp, Homo sapiens
cttgtgacagtgcctcttccag

SEQ ID NO: 5029035 - DNA, 14 bp, Homo sapiens
cttgttttctggga

SEQ ID NO: 5029036 - DNA, 22 bp, Homo sapiens
ctttaaaaaattaatctgggcc

SEQ ID NO: 5029037 - DNA, 21 bp, Homo sapiens
ctttaaaaagctccaaatgca

SEQ ID NO: 5029038 - DNA, 13 bp, Homo sapiens
ctttaaaagagag

SEQ ID NO: 5029039 - DNA, 16 bp, Homo sapiens
ctttaaaagagagaga

SEQ ID NO: 5029040 - DNA, 21 bp, Homo sapiens
ctttaaaagagagagagagaa

SEQ ID NO: 5029041 - DNA, 12 bp, Homo sapiens
ctttaatataaa

SEQ ID NO: 5029042 - DNA, 23 bp, Homo sapiens
ctttaattgttaagatatgatgt

SEQ ID NO: 5029043 - DNA, 18 bp, Homo sapiens
ctttacaaaacaaactca

SEQ ID NO: 5029044 - DNA, 17 bp, Homo sapiens
ctttacatgaggactct

SEQ ID NO: 5029045 - DNA, 21 bp, Homo sapiens
ctttacgtgtttaaaaaaaag

SEQ ID NO: 5029046 - DNA, 22 bp, Homo sapiens
ctttacgtgtttaaaaaaaagc

SEQ ID NO: 5029047 - DNA, 21 bp, Homo sapiens
ctttagatagccctgtcctgg

SEQ ID NO: 5029048 - DNA, 20 bp, Homo sapiens
ctttataagtcattgtatgt

SEQ ID NO: 5029049 - DNA, 13 bp, Homo sapiens
ctttattaccagt

SEQ ID NO: 5029050 - DNA, 18 bp, Homo sapiens
ctttcacagctcctccca

SEQ ID NO: 5029051 - DNA, 24 bp, Homo sapiens
ctttcacattgtttgctgctattg

SEQ ID NO: 5029052 - DNA, 20 bp, Homo sapiens
ctttcagataactgttattt

SEQ ID NO: 5029053 - DNA, 18 bp, Homo sapiens
ctttcatcgtaaagtgct

SEQ ID NO: 5029054 - DNA, 11 bp, Homo sapiens
ctttccaaaga

SEQ ID NO: 5029055 - DNA, 22 bp, Homo sapiens
ctttccgtttttttctttcctg

SEQ ID NO: 5029056 - DNA, 23 bp, Homo sapiens
ctttccgtttttttctttcctgt

SEQ ID NO: 5029057 - DNA, 15 bp, Homo sapiens
ctttccttttcttta

SEQ ID NO: 5029058 - DNA, 20 bp, Homo sapiens
ctttctcttttcctctacca

SEQ ID NO: 5029059 - DNA, 15 bp, Homo sapiens
ctttctgtgcttgga

SEQ ID NO: 5029060 - DNA, 12 bp, Homo sapiens
ctttgaagggca

SEQ ID NO: 5029061 - DNA, 13 bp, Homo sapiens
ctttgcaccaaag

SEQ ID NO: 5029062 - DNA, 15 bp, Homo sapiens
ctttgcaccaaagac

SEQ ID NO: 5029063 - DNA, 17 bp, Homo sapiens
ctttgcaccaaagacat

SEQ ID NO: 5029064 - DNA, 18 bp, Homo sapiens
ctttgcaccaaagacatc

SEQ ID NO: 5029065 - DNA, 22 bp, Homo sapiens
ctttgcatctcagtatgaatta

SEQ ID NO: 5029066 - DNA, 17 bp, Homo sapiens
ctttgctttaatataaa

SEQ ID NO: 5029067 - DNA, 20 bp, Homo sapiens
ctttggacagaagcagctct

SEQ ID NO: 5029068 - DNA, 15 bp, Homo sapiens
ctttgtaaattgtca

SEQ ID NO: 5029069 - DNA, 20 bp, Homo sapiens
ctttgtgtcagaaaaaggaa

SEQ ID NO: 5029070 - DNA, 23 bp, Homo sapiens
cttttaaagaaaaaaattgaaat

SEQ ID NO: 5029071 - DNA, 14 bp, Homo sapiens
cttttaacaccttt

SEQ ID NO: 5029072 - DNA, 21 bp, Homo sapiens
cttttataggtgagaaaaaaa

SEQ ID NO: 5029073 - DNA, 22 bp, Homo sapiens
cttttataggtgagaaaaaaac

SEQ ID NO: 5029074 - DNA, 15 bp, Homo sapiens
cttttcacattttta

SEQ ID NO: 5029075 - DNA, 15 bp, Homo sapiens
cttttcatgcaaact

SEQ ID NO: 5029076 - DNA, 20 bp, Homo sapiens
cttttcatgcaaactctttg

SEQ ID NO: 5029077 - DNA, 22 bp, Homo sapiens
cttttccctctttggctcccct

SEQ ID NO: 5029078 - DNA, 19 bp, Homo sapiens
cttttcctgataaagcaca

SEQ ID NO: 5029079 - DNA, 22 bp, Homo sapiens
cttttcctgataaagcacagct

SEQ ID NO: 5029080 - DNA, 20 bp, Homo sapiens
cttttgtgatggagtgctgt

SEQ ID NO: 5029081 - DNA, 21 bp, Homo sapiens
cttttgtgatggagtgctgtt

SEQ ID NO: 5029082 - DNA, 16 bp, Homo sapiens
cttttttaataaacta

SEQ ID NO: 5029083 - DNA, 12 bp, Homo sapiens
ctttttttgtat

SEQ ID NO: 5029084 - DNA, 15 bp, Homo sapiens
gaaaaaaatgtattt

SEQ ID NO: 5029085 - DNA, 15 bp, Homo sapiens
gaaaaaaattgaaat

SEQ ID NO: 5029086 - DNA, 18 bp, Homo sapiens
gaaaaaaattgaaatgta

SEQ ID NO: 5029087 - DNA, 19 bp, Homo sapiens
gaaaaaaattgaaatgtaa

SEQ ID NO: 5029088 - DNA, 17 bp, Homo sapiens
gaaaaataaagaaaaga

SEQ ID NO: 5029089 - DNA, 18 bp, Homo sapiens
gaaaactaaggatttttc

SEQ ID NO: 5029090 - DNA, 21 bp, Homo sapiens
gaaacacccctctgtctagga

SEQ ID NO: 5029091 - DNA, 21 bp, Homo sapiens
gaaacgagactttccattaca

SEQ ID NO: 5029092 - DNA, 23 bp, Homo sapiens
gaaacgagactttccattacaag

SEQ ID NO: 5029093 - DNA, 14 bp, Homo sapiens
gaaagcccctgccc

SEQ ID NO: 5029094 - DNA, 14 bp, Homo sapiens
gaaaggattttacc

SEQ ID NO: 5029095 - DNA, 17 bp, Homo sapiens
gaaaggattttaccaaa

SEQ ID NO: 5029096 - DNA, 20 bp, Homo sapiens
gaaaggattttaccaaagca

SEQ ID NO: 5029097 - DNA, 21 bp, Homo sapiens
gaaaggattttaccaaagcat

SEQ ID NO: 5029098 - DNA, 13 bp, Homo sapiens
gaaagtctgtcct

SEQ ID NO: 5029099 - DNA, 19 bp, Homo sapiens
gaaataattgttgttctgt

SEQ ID NO: 5029100 - DNA, 22 bp, Homo sapiens
gaaataattgttgttctgttaa

SEQ ID NO: 5029101 - DNA, 14 bp, Homo sapiens
gaaatactatttaa

SEQ ID NO: 5029102 - DNA, 18 bp, Homo sapiens
gaaatagcttatgaaaag

SEQ ID NO: 5029103 - DNA, 16 bp, Homo sapiens
gaaatgaggtctgttt

SEQ ID NO: 5029104 - DNA, 22 bp, Homo sapiens
gaaatgaggtctgtttaaagtg

SEQ ID NO: 5029105 - DNA, 23 bp, Homo sapiens
gaaatgaggtctgtttaaagtgg

SEQ ID NO: 5029106 - DNA, 21 bp, Homo sapiens
gaaatgtaaggctgtgtaaga

SEQ ID NO: 5029107 - DNA, 19 bp, Homo sapiens
gaaattcagaacagcctgc

SEQ ID NO: 5029108 - DNA, 13 bp, Homo sapiens
gaaatttaaagca

SEQ ID NO: 5029109 - DNA, 23 bp, Homo sapiens
gaaatttaaagcaggttcttgtt

SEQ ID NO: 5029110 - DNA, 16 bp, Homo sapiens
gaaatttagcattgta

SEQ ID NO: 5029111 - DNA, 16 bp, Homo sapiens
gaacaagagaagcatt

SEQ ID NO: 5029112 - DNA, 19 bp, Homo sapiens
gaacaatttggcaattttg

SEQ ID NO: 5029113 - DNA, 20 bp, Homo sapiens
gaacaatttggcaattttgt

SEQ ID NO: 5029114 - DNA, 12 bp, Homo sapiens
aaaaaaagcata

SEQ ID NO: 5029115 - DNA, 13 bp, Homo sapiens
aaaaaaatgtatt

SEQ ID NO: 5029116 - DNA, 14 bp, Homo sapiens
aaaaacatattctt

SEQ ID NO: 5029117 - DNA, 22 bp, Homo sapiens
aaaaacctgagatttattaaag

SEQ ID NO: 5029118 - DNA, 17 bp, Homo sapiens
aaaaagcataaaaacat

SEQ ID NO: 5029119 - DNA, 20 bp, Homo sapiens
aaaaagctccaaatgcagct

SEQ ID NO: 5029120 - DNA, 21 bp, Homo sapiens
aaaaatatgaccacactccag

SEQ ID NO: 5029121 - DNA, 12 bp, Homo sapiens
aaaaatgtattt

SEQ ID NO: 5029122 - DNA, 22 bp, Homo sapiens
aaaaattcagcaaaccattttt

SEQ ID NO: 5029123 - DNA, 13 bp, Homo sapiens
aaaaattgaaatg

SEQ ID NO: 5029124 - DNA, 15 bp, Homo sapiens
aaaaccacacaaaga

SEQ ID NO: 5029125 - DNA, 11 bp, Homo sapiens
aaaactttgga

SEQ ID NO: 5029126 - DNA, 19 bp, Homo sapiens
aaaagcacaagtacttttg

SEQ ID NO: 5029127 - DNA, 13 bp, Homo sapiens
aaaagcttttgtc

SEQ ID NO: 5029128 - DNA, 12 bp, Homo sapiens
aaaagttattaa

SEQ ID NO: 5029129 - DNA, 17 bp, Homo sapiens
aaaatagcgttcttgta

SEQ ID NO: 5029130 - DNA, 18 bp, Homo sapiens
aaaatagcgttcttgtaa

SEQ ID NO: 5029131 - DNA, 13 bp, Homo sapiens
aaaatgtatttta

SEQ ID NO: 5029132 - DNA, 18 bp, Homo sapiens
aaaatgtattttatgtta

SEQ ID NO: 5029133 - DNA, 21 bp, Homo sapiens
aaaattcagcaaaccattttt

SEQ ID NO: 5029134 - DNA, 18 bp, Homo sapiens
aaaattttagaacagtcc

SEQ ID NO: 5029135 - DNA, 13 bp, Homo sapiens
aaacaagaaaaat

SEQ ID NO: 5029136 - DNA, 18 bp, Homo sapiens
aaacaagaaaaataaaga

SEQ ID NO: 5029137 - DNA, 18 bp, Homo sapiens
aaacaatctggaagaaaa

SEQ ID NO: 5029138 - DNA, 21 bp, Homo sapiens
aaacacacagatacacacaca

SEQ ID NO: 5029139 - DNA, 14 bp, Homo sapiens
aaacacacgagcaa

SEQ ID NO: 5029140 - DNA, 16 bp, Homo sapiens
aaacacccctctgtct

SEQ ID NO: 5029141 - DNA, 22 bp, Homo sapiens
aaacaccttccagctcctgtaa

SEQ ID NO: 5029142 - DNA, 14 bp, Homo sapiens
aaacattttaaaaa

SEQ ID NO: 5029143 - DNA, 16 bp, Homo sapiens
aaaccagaaaagcaat

SEQ ID NO: 5029144 - DNA, 23 bp, Homo sapiens
aaaccatccagtgacaaaccatc

SEQ ID NO: 5029145 - DNA, 17 bp, Homo sapiens
aaaccatttttaaagta

SEQ ID NO: 5029146 - DNA, 13 bp, Homo sapiens
aaaccctcgaggc

SEQ ID NO: 5029147 - DNA, 24 bp, Homo sapiens
aaaccctcgaggcggatctttgga

SEQ ID NO: 5029148 - DNA, 17 bp, Homo sapiens
aaacgagactttccatt

SEQ ID NO: 5029149 - DNA, 12 bp, Homo sapiens
aaactactcttt

SEQ ID NO: 5029150 - DNA, 14 bp, Homo sapiens
aaactactctttga

SEQ ID NO: 5029151 - DNA, 21 bp, Homo sapiens
aaactcattcattagtcatgt

SEQ ID NO: 5029152 - DNA, 20 bp, Homo sapiens
aaactctttggtcgtttttt

SEQ ID NO: 5029153 - DNA, 16 bp, Homo sapiens
aaactgggttcctgca

SEQ ID NO: 5029154 - DNA, 20 bp, Homo sapiens
aaactgtctttaaaagagag

SEQ ID NO: 5029155 - DNA, 10 bp, Homo sapiens
aaagaaaaaa

SEQ ID NO: 5029156 - DNA, 18 bp, Homo sapiens
aaagaaaaaaatgtattt

SEQ ID NO: 5029157 - DNA, 22 bp, Homo sapiens
aaagaaaaaaatgtattttatg

SEQ ID NO: 5029158 - DNA, 13 bp, Homo sapiens
aaagaaaaaaatt

SEQ ID NO: 5029159 - DNA, 15 bp, Homo sapiens
aaagaaaaaaattga

SEQ ID NO: 5029160 - DNA, 14 bp, Homo sapiens
aaagaaaagatgca

SEQ ID NO: 5029161 - DNA, 23 bp, Homo sapiens
aaagaaattcagaacagcctgcc

SEQ ID NO: 5029162 - DNA, 22 bp, Homo sapiens
aaagaagacctgagaatgtatc

SEQ ID NO: 5029163 - DNA, 20 bp, Homo sapiens
aaagaattgttgggggtttt

SEQ ID NO: 5029164 - DNA, 14 bp, Homo sapiens
aaagagatacagag

SEQ ID NO: 5029165 - DNA, 16 bp, Homo sapiens
aaagaggtttttctta

SEQ ID NO: 5029166 - DNA, 19 bp, Homo sapiens
aaagaggtttttcttaaat

SEQ ID NO: 5029167 - DNA, 18 bp, Homo sapiens
aaagataaacacaagatt

SEQ ID NO: 5029168 - DNA, 12 bp, Homo sapiens
aaagatgcactt

SEQ ID NO: 5029169 - DNA, 17 bp, Homo sapiens
aaagatgcactttgctt

SEQ ID NO: 5029170 - DNA, 21 bp, Homo sapiens
aaagatgcactttgctttaat

SEQ ID NO: 5029171 - DNA, 14 bp, Homo sapiens
aaagcaggttcttg

SEQ ID NO: 5029172 - DNA, 19 bp, Homo sapiens
aaagcaggttcttgttggt

SEQ ID NO: 5029173 - DNA, 23 bp, Homo sapiens
aaagcatttaacccccctgtaca

SEQ ID NO: 5029174 - DNA, 18 bp, Homo sapiens
aaagctttattaccagtg

SEQ ID NO: 5029175 - DNA, 16 bp, Homo sapiens
aaagcttttgtctaca

SEQ ID NO: 5029176 - DNA, 20 bp, Homo sapiens
aaaggaaggttctggtgtga

SEQ ID NO: 5029177 - DNA, 21 bp, Homo sapiens
aaaggactcctgaaaaaaaac

SEQ ID NO: 5029178 - DNA, 21 bp, Homo sapiens
aaaggagtttatgttccatta

SEQ ID NO: 5029179 - DNA, 14 bp, Homo sapiens
aaaggattttacca

SEQ ID NO: 5029180 - DNA, 13 bp, Homo sapiens
aaaggtttaaatg

SEQ ID NO: 5029181 - DNA, 16 bp, Homo sapiens
aaaggtttaaatgaac

SEQ ID NO: 5029182 - DNA, 18 bp, Homo sapiens
aaaggtttaaatgaacaa

SEQ ID NO: 5029183 - DNA, 20 bp, Homo sapiens
aaaggtttaaatgaacaaga

SEQ ID NO: 5029184 - DNA, 21 bp, Homo sapiens
aaaggtttaaatgaacaagag

SEQ ID NO: 5029185 - DNA, 19 bp, Homo sapiens
aaagtatgttctaaccttt

SEQ ID NO: 5029186 - DNA, 14 bp, Homo sapiens
aaagtctgtccttg

SEQ ID NO: 5029187 - DNA, 19 bp, Homo sapiens
aaagtgccagtattttaaa

SEQ ID NO: 5029188 - DNA, 13 bp, Homo sapiens
aaagttaagttga

SEQ ID NO: 5029189 - DNA, 17 bp, Homo sapiens
aaagttgcagctgtttt

SEQ ID NO: 5029190 - DNA, 18 bp, Homo sapiens
aaagttgcagctgttttg

SEQ ID NO: 5029191 - DNA, 14 bp, Homo sapiens
aaataaaagcacaa

SEQ ID NO: 5029192 - DNA, 16 bp, Homo sapiens
aaataaaagcacaagt

SEQ ID NO: 5029193 - DNA, 15 bp, Homo sapiens
aaataaagaaaagat

SEQ ID NO: 5029194 - DNA, 11 bp, Homo sapiens
aaataaagtct

SEQ ID NO: 5029195 - DNA, 17 bp, Homo sapiens
aaatagcgttcttgtaa

SEQ ID NO: 5029196 - DNA, 20 bp, Homo sapiens
aaatagcgttcttgtaattt

SEQ ID NO: 5029197 - DNA, 15 bp, Homo sapiens
aaatagcttatgaaa

SEQ ID NO: 5029198 - DNA, 10 bp, Homo sapiens
aaatataaag

SEQ ID NO: 5029199 - DNA, 12 bp, Homo sapiens
aaatataaagac

SEQ ID NO: 5029200 - DNA, 12 bp, Homo sapiens
aaatatattatt

SEQ ID NO: 5029201 - DNA, 13 bp, Homo sapiens
aaatatattatta

SEQ ID NO: 5029202 - DNA, 16 bp, Homo sapiens
aaatatattattactt

SEQ ID NO: 5029203 - DNA, 19 bp, Homo sapiens
aaatatattattacttgta

SEQ ID NO: 5029204 - DNA, 23 bp, Homo sapiens
aaatatattattacttgtaaata

SEQ ID NO: 5029205 - DNA, 21 bp, Homo sapiens
aaatcgatgagcgccacctct

SEQ ID NO: 5029206 - DNA, 14 bp, Homo sapiens
aaatcttgatcagt

SEQ ID NO: 5029207 - DNA, 21 bp, Homo sapiens
aaatgaacaagagaagcattc

SEQ ID NO: 5029208 - DNA, 15 bp, Homo sapiens
aaatgaggtctgttt

SEQ ID NO: 5029209 - DNA, 16 bp, Homo sapiens
aaatgaggtctgttta

SEQ ID NO: 5029210 - DNA, 22 bp, Homo sapiens
aaatgccaaattaaaaaagata

SEQ ID NO: 5029211 - DNA, 12 bp, Homo sapiens
aaatgctgctct

SEQ ID NO: 5029212 - DNA, 15 bp, Homo sapiens
aaatgggaattctca

SEQ ID NO: 5029213 - DNA, 18 bp, Homo sapiens
aaatgggaattctcaggt

SEQ ID NO: 5029214 - DNA, 19 bp, Homo sapiens
aaatggttaaaagaggttt

SEQ ID NO: 5029215 - DNA, 15 bp, Homo sapiens
aaatgtattttatgt

SEQ ID NO: 5029216 - DNA, 16 bp, Homo sapiens
aaatgtattttatgtt

SEQ ID NO: 5029217 - DNA, 18 bp, Homo sapiens
aaatgtattttatgttat

SEQ ID NO: 5029218 - DNA, 13 bp, Homo sapiens
aaattggaactct

SEQ ID NO: 5029219 - DNA, 23 bp, Homo sapiens
aaattggcatggaaatttaaagc

SEQ ID NO: 5029220 - DNA, 18 bp, Homo sapiens
aaatttaaagcaggttct

SEQ ID NO: 5029221 - DNA, 21 bp, Homo sapiens
aaatttaaagcaggttcttgt

SEQ ID NO: 5029222 - DNA, 13 bp, Homo sapiens
aaatttagcattg

SEQ ID NO: 5029223 - DNA, 21 bp, Homo sapiens
aaatttagcattgtagtgctt

SEQ ID NO: 5029224 - DNA, 17 bp, Homo sapiens
aaatttttcttcttgag

SEQ ID NO: 5029225 - DNA, 15 bp, Homo sapiens
aaattttttgttgac

SEQ ID NO: 5029226 - DNA, 18 bp, Homo sapiens
aaattttttgttgacatt

SEQ ID NO: 5029227 - DNA, 11 bp, Homo sapiens
aacaaaccatc

SEQ ID NO: 5029228 - DNA, 21 bp, Homo sapiens
aacaaagatgccacattcaaa

SEQ ID NO: 5029229 - DNA, 11 bp, Homo sapiens
aacaagaaaaa

SEQ ID NO: 5029230 - DNA, 12 bp, Homo sapiens
aacaagaaaaat

SEQ ID NO: 5029231 - DNA, 16 bp, Homo sapiens
aacaagagaagcattc

SEQ ID NO: 5029232 - DNA, 17 bp, Homo sapiens
aacaatctggaagaaaa

SEQ ID NO: 5029233 - DNA, 19 bp, Homo sapiens
aacaatttggcaattttgt

SEQ ID NO: 5029234 - DNA, 19 bp, Homo sapiens
aacacaagattggtgtttt

SEQ ID NO: 5029235 - DNA, 20 bp, Homo sapiens
aacacaagattggtgttttt

SEQ ID NO: 5029236 - DNA, 12 bp, Homo sapiens
aacacagtgtct

SEQ ID NO: 5029237 - DNA, 14 bp, Homo sapiens
aacagctgtgtctg

SEQ ID NO: 5029238 - DNA, 23 bp, Homo sapiens
aacaggtagtattacaccaccgg

SEQ ID NO: 5029239 - DNA, 15 bp, Homo sapiens
aacataagctatttt

SEQ ID NO: 5029240 - DNA, 15 bp, Homo sapiens
aacatccaaaatctt

SEQ ID NO: 5029241 - DNA, 18 bp, Homo sapiens
aacatgtttctgttttgt

SEQ ID NO: 5029242 - DNA, 14 bp, Homo sapiens
aacattcccagccc

SEQ ID NO: 5029243 - DNA, 19 bp, Homo sapiens
aacattggttcttgtatta

SEQ ID NO: 5029244 - DNA, 17 bp, Homo sapiens
aaccaattcctcatttg

SEQ ID NO: 5029245 - DNA, 20 bp, Homo sapiens
aaccagccgtattttacatg

SEQ ID NO: 5029246 - DNA, 14 bp, Homo sapiens
aaccagctcagcac

SEQ ID NO: 5029247 - DNA, 18 bp, Homo sapiens
aaccagggccccggggcc

SEQ ID NO: 5029248 - DNA, 15 bp, Homo sapiens
aaccatcggtccaca

SEQ ID NO: 5029249 - DNA, 17 bp, Homo sapiens
aaccattccatttccaa

SEQ ID NO: 5029250 - DNA, 14 bp, Homo sapiens
aacctctcacagtt

SEQ ID NO: 5029251 - DNA, 19 bp, Homo sapiens
aacctgcacacaggacagc

SEQ ID NO: 5029252 - DNA, 16 bp, Homo sapiens
aaccttgcctggtaca

SEQ ID NO: 5029253 - DNA, 18 bp, Homo sapiens
aaccttgcctggtacagt

SEQ ID NO: 5029254 - DNA, 13 bp, Homo sapiens
aactaaactttca

SEQ ID NO: 5029255 - DNA, 14 bp, Homo sapiens
aactaataattgca

SEQ ID NO: 5029256 - DNA, 18 bp, Homo sapiens
aactacaaaggtttaaat

SEQ ID NO: 5029257 - DNA, 14 bp, Homo sapiens
aactactctttgat

SEQ ID NO: 5029258 - DNA, 15 bp, Homo sapiens
aactactctttgatt

SEQ ID NO: 5029259 - DNA, 16 bp, Homo sapiens
aactactttgctgcta

SEQ ID NO: 5029260 - DNA, 22 bp, Homo sapiens
aactctgacaacagacttctga

SEQ ID NO: 5029261 - DNA, 14 bp, Homo sapiens
aactgaaattcaga

SEQ ID NO: 5029262 - DNA, 16 bp, Homo sapiens
aactgaactctgacaa

SEQ ID NO: 5029263 - DNA, 19 bp, Homo sapiens
aactgaactctgacaacag

SEQ ID NO: 5029264 - DNA, 20 bp, Homo sapiens
aactgaactctgacaacaga

SEQ ID NO: 5029265 - DNA, 23 bp, Homo sapiens
aactgaactctgacaacagactt

SEQ ID NO: 5029266 - DNA, 18 bp, Homo sapiens
aactgaagagtaatcaat

SEQ ID NO: 5029267 - DNA, 21 bp, Homo sapiens
aactgaaggggtgcacccacc

SEQ ID NO: 5029268 - DNA, 13 bp, Homo sapiens
aactgaataccac

SEQ ID NO: 5029269 - DNA, 16 bp, Homo sapiens
aactgagtgccttttg

SEQ ID NO: 5029270 - DNA, 10 bp, Homo sapiens
aactgcattt

SEQ ID NO: 5029271 - DNA, 17 bp, Homo sapiens
aactgcttgtttcctag

SEQ ID NO: 5029272 - DNA, 14 bp, Homo sapiens
aactgggctgaaca

SEQ ID NO: 5029273 - DNA, 15 bp, Homo sapiens
aactgggctgggcct

SEQ ID NO: 5029274 - DNA, 15 bp, Homo sapiens
aactgttatttataa

SEQ ID NO: 5029275 - DNA, 20 bp, Homo sapiens
aactgttatttataatcact

SEQ ID NO: 5029276 - DNA, 22 bp, Homo sapiens
aacttgagcgtgaatctgtatc

SEQ ID NO: 5029277 - DNA, 18 bp, Homo sapiens
aactttggagtcccctca

SEQ ID NO: 5029278 - DNA, 21 bp, Homo sapiens
aagaaaaaaatgtattttatg

SEQ ID NO: 5029279 - DNA, 22 bp, Homo sapiens
aagaaaaaaatgtattttatgt

SEQ ID NO: 5029280 - DNA, 23 bp, Homo sapiens
aagaaaaaaatgtattttatgtt

SEQ ID NO: 5029281 - DNA, 17 bp, Homo sapiens
aagaaaaaaattgaaat

SEQ ID NO: 5029282 - DNA, 18 bp, Homo sapiens
aagaaaaaaattgaaatg

SEQ ID NO: 5029283 - DNA, 20 bp, Homo sapiens
aagaaaaaaattgaaatgta

SEQ ID NO: 5029284 - DNA, 21 bp, Homo sapiens
aagaaaaaaattgaaatgtaa

SEQ ID NO: 5029285 - DNA, 16 bp, Homo sapiens
aagaaaaataaagaaa

SEQ ID NO: 5029286 - DNA, 23 bp, Homo sapiens
aagaaaagatgcactttgcttta

SEQ ID NO: 5029287 - DNA, 13 bp, Homo sapiens
aagaaacatttcc

SEQ ID NO: 5029288 - DNA, 21 bp, Homo sapiens
aagaaatgattcaaattgctg

SEQ ID NO: 5029289 - DNA, 22 bp, Homo sapiens
aagaaatgattcaaattgctgc

SEQ ID NO: 5029290 - DNA, 20 bp, Homo sapiens
aagaaatggcgtctgctctg

SEQ ID NO: 5029291 - DNA, 22 bp, Homo sapiens
aagaaatggcgtctgctctggt

SEQ ID NO: 5029292 - DNA, 14 bp, Homo sapiens
aagaaattcagaac

SEQ ID NO: 5029293 - DNA, 15 bp, Homo sapiens
aagaaatttcacata

SEQ ID NO: 5029294 - DNA, 12 bp, Homo sapiens
aagaagaaaaag

SEQ ID NO: 5029295 - DNA, 15 bp, Homo sapiens
aagaagacaaacttt

SEQ ID NO: 5029296 - DNA, 21 bp, Homo sapiens
aagaattgttgggggtttttt

SEQ ID NO: 5029297 - DNA, 15 bp, Homo sapiens
aagacaaactttgca

SEQ ID NO: 5029298 - DNA, 18 bp, Homo sapiens
aagacaccgttcattcag

SEQ ID NO: 5029299 - DNA, 17 bp, Homo sapiens
aagacgttttataagca

SEQ ID NO: 5029300 - DNA, 15 bp, Homo sapiens
aagactatgaaaatg

SEQ ID NO: 5029301 - DNA, 16 bp, Homo sapiens
aagagaagacgaaata

SEQ ID NO: 5029302 - DNA, 21 bp, Homo sapiens
aagagatatgtagaaggcaca

SEQ ID NO: 5029303 - DNA, 15 bp, Homo sapiens
aagagccggtggtgc

SEQ ID NO: 5029304 - DNA, 14 bp, Homo sapiens
aagagcttgctcca

SEQ ID NO: 5029305 - DNA, 17 bp, Homo sapiens
aagagcttgctccagat

SEQ ID NO: 5029306 - DNA, 23 bp, Homo sapiens
aagagcttgctccagattctgat

SEQ ID NO: 5029307 - DNA, 22 bp, Homo sapiens
aagagggttttaggtagaaaaa

SEQ ID NO: 5029308 - DNA, 23 bp, Homo sapiens
aagagggttttaggtagaaaaac

SEQ ID NO: 5029309 - DNA, 16 bp, Homo sapiens
aagaggtttttcttaa

SEQ ID NO: 5029310 - DNA, 13 bp, Homo sapiens
aagagtaatcaat

SEQ ID NO: 5029311 - DNA, 23 bp, Homo sapiens
aagatgcactttgctttaatata

SEQ ID NO: 5029312 - DNA, 20 bp, Homo sapiens
aagattggtgtttttttcta

SEQ ID NO: 5029313 - DNA, 20 bp, Homo sapiens
aagcaaaacatctctgcagt

SEQ ID NO: 5029314 - DNA, 11 bp, Homo sapiens
aagcacagctg

SEQ ID NO: 5029315 - DNA, 12 bp, Homo sapiens
aagcactcgtgt

SEQ ID NO: 5029316 - DNA, 17 bp, Homo sapiens
aagcactttaacacagt

SEQ ID NO: 5029317 - DNA, 21 bp, Homo sapiens
aagcactttaacacagtgtct

SEQ ID NO: 5029318 - DNA, 15 bp, Homo sapiens
aagcagaaatccaag

SEQ ID NO: 5029319 - DNA, 19 bp, Homo sapiens
aagcagcgaccgccccctc

SEQ ID NO: 5029320 - DNA, 11 bp, Homo sapiens
aagcagctctt

SEQ ID NO: 5029321 - DNA, 23 bp, Homo sapiens
aagcaggactttgaggcaagtgt

SEQ ID NO: 5029322 - DNA, 17 bp, Homo sapiens
aagcaggaggcccttgt

SEQ ID NO: 5029323 - DNA, 21 bp, Homo sapiens
aagcatttaacccccctgtac

SEQ ID NO: 5029324 - DNA, 17 bp, Homo sapiens
aagcattttataaatcg

SEQ ID NO: 5029325 - DNA, 17 bp, Homo sapiens
aagccaaacctctgtga

SEQ ID NO: 5029326 - DNA, 12 bp, Homo sapiens
aagcctgctggc

SEQ ID NO: 5029327 - DNA, 14 bp, Homo sapiens
aagcctgctggctg

SEQ ID NO: 5029328 - DNA, 15 bp, Homo sapiens
aagcctgctggctgc

SEQ ID NO: 5029329 - DNA, 21 bp, Homo sapiens
aagcggtgtctctcctgcccc

SEQ ID NO: 5029330 - DNA, 16 bp, Homo sapiens
aagctagtcttttgct

SEQ ID NO: 5029331 - DNA, 22 bp, Homo sapiens
aagctgtataattaattgtcat

SEQ ID NO: 5029332 - DNA, 13 bp, Homo sapiens
aaggacagcccct

SEQ ID NO: 5029333 - DNA, 19 bp, Homo sapiens
aaggacagcccctcctcca

SEQ ID NO: 5029334 - DNA, 15 bp, Homo sapiens
aaggactaatagaaa

SEQ ID NO: 5029335 - DNA, 15 bp, Homo sapiens
aaggactcctgaaaa

SEQ ID NO: 5029336 - DNA, 21 bp, Homo sapiens
aaggactgtgacaggcagcag

SEQ ID NO: 5029337 - DNA, 13 bp, Homo sapiens
aaggagtttatgt

SEQ ID NO: 5029338 - DNA, 13 bp, Homo sapiens
aaggatctgctga

SEQ ID NO: 5029339 - DNA, 15 bp, Homo sapiens
aaggatctgctgagg

SEQ ID NO: 5029340 - DNA, 12 bp, Homo sapiens
aaggattttatg

SEQ ID NO: 5029341 - DNA, 16 bp, Homo sapiens
aaggattttatgcttt

SEQ ID NO: 5029342 - DNA, 15 bp, Homo sapiens
aaggcaaatgacttt

SEQ ID NO: 5029343 - DNA, 16 bp, Homo sapiens
aaggcaaatgactttg

SEQ ID NO: 5029344 - DNA, 19 bp, Homo sapiens
aaggcagtagttttcaaaa

SEQ ID NO: 5029345 - DNA, 23 bp, Homo sapiens
aaggctgatgccaagttgtttga

SEQ ID NO: 5029346 - DNA, 23 bp, Homo sapiens
aaggggcctcaccgagtgggggc

SEQ ID NO: 5029347 - DNA, 16 bp, Homo sapiens
aaggggtgcacccacc

SEQ ID NO: 5029348 - DNA, 17 bp, Homo sapiens
acacactggtacttaga

SEQ ID NO: 5029349 - DNA, 14 bp, Homo sapiens
acacagaaaccaat

SEQ ID NO: 5029350 - DNA, 17 bp, Homo sapiens
acacagatacacacaca

SEQ ID NO: 5029351 - DNA, 18 bp, Homo sapiens
acacaggctccaaactgg

SEQ ID NO: 5029352 - DNA, 12 bp, Homo sapiens
acacaggctggc

SEQ ID NO: 5029353 - DNA, 16 bp, Homo sapiens
acacagtgtctggcac

SEQ ID NO: 5029354 - DNA, 17 bp, Homo sapiens
acaccaccggccccctc

SEQ ID NO: 5029355 - DNA, 14 bp, Homo sapiens
acacccctctgtct

SEQ ID NO: 5029356 - DNA, 13 bp, Homo sapiens
acaccctgtactg

SEQ ID NO: 5029357 - DNA, 14 bp, Homo sapiens
acaccttccagctc

SEQ ID NO: 5029358 - DNA, 17 bp, Homo sapiens
acacgagcaaacccaga

SEQ ID NO: 5029359 - DNA, 12 bp, Homo sapiens
acacgcttttgt

SEQ ID NO: 5029360 - DNA, 14 bp, Homo sapiens
acacgcttttgtga

SEQ ID NO: 5029361 - DNA, 13 bp, Homo sapiens
acacgggcctgtc

SEQ ID NO: 5029362 - DNA, 14 bp, Homo sapiens
acactcagacctga

SEQ ID NO: 5029363 - DNA, 19 bp, Homo sapiens
acactcagacctgaattct

SEQ ID NO: 5029364 - DNA, 16 bp, Homo sapiens
acactccaattaagga

SEQ ID NO: 5029365 - DNA, 17 bp, Homo sapiens
acactccaattaaggat

SEQ ID NO: 5029366 - DNA, 17 bp, Homo sapiens
acactcgtatgatactt

SEQ ID NO: 5029367 - DNA, 16 bp, Homo sapiens
acactgggtgcgtctc

SEQ ID NO: 5029368 - DNA, 18 bp, Homo sapiens
acactgttcttagctcaa

SEQ ID NO: 5029369 - DNA, 21 bp, Homo sapiens
acactgttcttagctcaatga

SEQ ID NO: 5029370 - DNA, 22 bp, Homo sapiens
acactgttcttagctcaatgag

SEQ ID NO: 5029371 - DNA, 13 bp, Homo sapiens
acacttttggtta

SEQ ID NO: 5029372 - DNA, 12 bp, Homo sapiens
acagaagcagct

SEQ ID NO: 5029373 - DNA, 13 bp, Homo sapiens
acagacttctgaa

SEQ ID NO: 5029374 - DNA, 22 bp, Homo sapiens
acagagcgtgagctgagcaggc

SEQ ID NO: 5029375 - DNA, 15 bp, Homo sapiens
acagatacacacaca

SEQ ID NO: 5029376 - DNA, 19 bp, Homo sapiens
acagatgccttttttgtag

SEQ ID NO: 5029377 - DNA, 20 bp, Homo sapiens
acagatttaatacagtttat

SEQ ID NO: 5029378 - DNA, 15 bp, Homo sapiens
acagcaattcctcag

SEQ ID NO: 5029379 - DNA, 16 bp, Homo sapiens
acagcccctcctccat

SEQ ID NO: 5029380 - DNA, 13 bp, Homo sapiens
acagctgtgtctg

SEQ ID NO: 5029381 - DNA, 14 bp, Homo sapiens
acagctgtgtctgc

SEQ ID NO: 5029382 - DNA, 22 bp, Homo sapiens
acagctgtgtctgccaaacaca

SEQ ID NO: 5029383 - DNA, 12 bp, Homo sapiens
acagctgtgtta

SEQ ID NO: 5029384 - DNA, 22 bp, Homo sapiens
acagctgtgttattctttgcgt

SEQ ID NO: 5029385 - DNA, 13 bp, Homo sapiens
acagctttctggg

SEQ ID NO: 5029386 - DNA, 14 bp, Homo sapiens
acagctttctggga

SEQ ID NO: 5029387 - DNA, 17 bp, Homo sapiens
acagctttctgggatgt

SEQ ID NO: 5029388 - DNA, 19 bp, Homo sapiens
acagctttctgggatgtca

SEQ ID NO: 5029389 - DNA, 12 bp, Homo sapiens
acaggcagcaga

SEQ ID NO: 5029390 - DNA, 14 bp, Homo sapiens
acaggcagcagaga

SEQ ID NO: 5029391 - DNA, 18 bp, Homo sapiens
acagtacctgattgtatt

SEQ ID NO: 5029392 - DNA, 21 bp, Homo sapiens
acagtacctgattgtattttt

SEQ ID NO: 5029393 - DNA, 21 bp, Homo sapiens
acagtcatggtggccacggcc

SEQ ID NO: 5029394 - DNA, 17 bp, Homo sapiens
acagtccaaccagaaac

SEQ ID NO: 5029395 - DNA, 13 bp, Homo sapiens
acagtgcctcttc

SEQ ID NO: 5029396 - DNA, 15 bp, Homo sapiens
acagtgcctcttcca

SEQ ID NO: 5029397 - DNA, 17 bp, Homo sapiens
acagtgcctcttccagt

SEQ ID NO: 5029398 - DNA, 19 bp, Homo sapiens
acagtgcctcttccagtga

SEQ ID NO: 5029399 - DNA, 20 bp, Homo sapiens
acagtgctgaccagacagcc

SEQ ID NO: 5029400 - DNA, 21 bp, Homo sapiens
acagtggccaagatcacagtg

SEQ ID NO: 5029401 - DNA, 14 bp, Homo sapiens
acagtgtctttttt

SEQ ID NO: 5029402 - DNA, 21 bp, Homo sapiens
acagtgtctttttttgtatag

SEQ ID NO: 5029403 - DNA, 18 bp, Homo sapiens
acagttttggttgcttta

SEQ ID NO: 5029404 - DNA, 13 bp, Homo sapiens
acataagctattt

SEQ ID NO: 5029405 - DNA, 21 bp, Homo sapiens
acataccctggccgccccctg

SEQ ID NO: 5029406 - DNA, 19 bp, Homo sapiens
acatactggcctggactgt

SEQ ID NO: 5029407 - DNA, 21 bp, Homo sapiens
acatagcccacttacatttac

SEQ ID NO: 5029408 - DNA, 15 bp, Homo sapiens
acatcaggagactgg

SEQ ID NO: 5029409 - DNA, 18 bp, Homo sapiens
acatcaggagactgggct

SEQ ID NO: 5029410 - DNA, 17 bp, Homo sapiens
acatgaattattacagt

SEQ ID NO: 5029411 - DNA, 19 bp, Homo sapiens
acatgcttagcagtcccct

SEQ ID NO: 5029412 - DNA, 23 bp, Homo sapiens
acatgcttagcagtccccttccc

SEQ ID NO: 5029413 - DNA, 19 bp, Homo sapiens
acatggatgaaattcccgt

SEQ ID NO: 5029414 - DNA, 19 bp, Homo sapiens
acatgtatttgtttgcata

SEQ ID NO: 5029415 - DNA, 19 bp, Homo sapiens
acatgtggccatggcctct

SEQ ID NO: 5029416 - DNA, 17 bp, Homo sapiens
acatgtgttggcagcct

SEQ ID NO: 5029417 - DNA, 14 bp, Homo sapiens
acatgttgtacatt

SEQ ID NO: 5029418 - DNA, 24 bp, Homo sapiens
acattcaaaatagggtatattttc

SEQ ID NO: 5029419 - DNA, 11 bp, Homo sapiens
acattctgaat

SEQ ID NO: 5029420 - DNA, 22 bp, Homo sapiens
acattgccttttctagcccgaa

SEQ ID NO: 5029421 - DNA, 18 bp, Homo sapiens
acattggttcttgtatta

SEQ ID NO: 5029422 - DNA, 21 bp, Homo sapiens
acattggttcttgtattaaga

SEQ ID NO: 5029423 - DNA, 23 bp, Homo sapiens
acattggttcttgtattaagaat

SEQ ID NO: 5029424 - DNA, 21 bp, Homo sapiens
acatttacaaactgaagagta

SEQ ID NO: 5029425 - DNA, 22 bp, Homo sapiens
acatttaccctttggccccact

SEQ ID NO: 5029426 - DNA, 16 bp, Homo sapiens
acatttcatacaacag

SEQ ID NO: 5029427 - DNA, 15 bp, Homo sapiens
acatttcctttgaac

SEQ ID NO: 5029428 - DNA, 14 bp, Homo sapiens
acatttctggacag

SEQ ID NO: 5029429 - DNA, 23 bp, Homo sapiens
acattttaaaaacatagaaaaat

SEQ ID NO: 5029430 - DNA, 21 bp, Homo sapiens
acattttgaaagtctgtcctt

SEQ ID NO: 5029431 - DNA, 17 bp, Homo sapiens
accaaaagaatttgcac

SEQ ID NO: 5029432 - DNA, 14 bp, Homo sapiens
accaattattttca

SEQ ID NO: 5029433 - DNA, 17 bp, Homo sapiens
accaattcctcatttgt

SEQ ID NO: 5029434 - DNA, 11 bp, Homo sapiens
accacacaaag

SEQ ID NO: 5029435 - DNA, 14 bp, Homo sapiens
accacacaaagaca

SEQ ID NO: 5029436 - DNA, 17 bp, Homo sapiens
accacaccctgtactgt

SEQ ID NO: 5029437 - DNA, 14 bp, Homo sapiens
accacactccagct

SEQ ID NO: 5029438 - DNA, 18 bp, Homo sapiens
accaccccgcctgccctc

SEQ ID NO: 5029439 - DNA, 14 bp, Homo sapiens
accaccggccccct

SEQ ID NO: 5029440 - DNA, 23 bp, Homo sapiens
accaccggccccctccccccaga

SEQ ID NO: 5029441 - DNA, 17 bp, Homo sapiens
accaccgtctgtctcag

SEQ ID NO: 5029442 - DNA, 12 bp, Homo sapiens
accactctgtaa

SEQ ID NO: 5029443 - DNA, 14 bp, Homo sapiens
accactctgtaatt

SEQ ID NO: 5029444 - DNA, 21 bp, Homo sapiens
accaggagaagggctggggcc

SEQ ID NO: 5029445 - DNA, 13 bp, Homo sapiens
accaggctgtgtc

SEQ ID NO: 5029446 - DNA, 17 bp, Homo sapiens
accagggccccggggcc

SEQ ID NO: 5029447 - DNA, 22 bp, Homo sapiens
accagtggcgttgttgcatgtt

SEQ ID NO: 5029448 - DNA, 18 bp, Homo sapiens
accatcctaggctgacac

SEQ ID NO: 5029449 - DNA, 18 bp, Homo sapiens
acccaaaaactgtcttta

SEQ ID NO: 5029450 - DNA, 18 bp, Homo sapiens
acccaaggtaccatccta

SEQ ID NO: 5029451 - DNA, 18 bp, Homo sapiens
acccacctgttttctgaa

SEQ ID NO: 5029452 - DNA, 19 bp, Homo sapiens
acccacctgttttctgaaa

SEQ ID NO: 5029453 - DNA, 14 bp, Homo sapiens
acccagtgccctct

SEQ ID NO: 5029454 - DNA, 22 bp, Homo sapiens
acccagtgccctctcccctcag

SEQ ID NO: 5029455 - DNA, 15 bp, Homo sapiens
acccatagcagcttt

SEQ ID NO: 5029456 - DNA, 16 bp, Homo sapiens
acccatgcagctgctc

SEQ ID NO: 5029457 - DNA, 18 bp, Homo sapiens
acccattgttgtcaagga

SEQ ID NO: 5029458 - DNA, 20 bp, Homo sapiens
accccaaacaccttccagct

SEQ ID NO: 5029459 - DNA, 23 bp, Homo sapiens
accccaaacaccttccagctcct

SEQ ID NO: 5029460 - DNA, 15 bp, Homo sapiens
accccaacaaaccat

SEQ ID NO: 5029461 - DNA, 16 bp, Homo sapiens
actgttctgtgtcttt

SEQ ID NO: 5029462 - DNA, 13 bp, Homo sapiens
actgttcttagct

SEQ ID NO: 5029463 - DNA, 23 bp, Homo sapiens
actgttcttagctcaatgagcat

SEQ ID NO: 5029464 - DNA, 20 bp, Homo sapiens
acttagagtttctgtttgat

SEQ ID NO: 5029465 - DNA, 21 bp, Homo sapiens
acttagagtttctgtttgatt

SEQ ID NO: 5029466 - DNA, 22 bp, Homo sapiens
acttagagtttctgtttgattc

SEQ ID NO: 5029467 - DNA, 14 bp, Homo sapiens
acttatttttcaag

SEQ ID NO: 5029468 - DNA, 21 bp, Homo sapiens
acttcaaactactttgctgct

SEQ ID NO: 5029469 - DNA, 15 bp, Homo sapiens
acttcctcctcccca

SEQ ID NO: 5029470 - DNA, 23 bp, Homo sapiens
acttcgacactgttcttagctca

SEQ ID NO: 5029471 - DNA, 16 bp, Homo sapiens
acttctcttgctttct

SEQ ID NO: 5029472 - DNA, 12 bp, Homo sapiens
acttggtttgtg

SEQ ID NO: 5029473 - DNA, 13 bp, Homo sapiens
acttgtaaatata

SEQ ID NO: 5029474 - DNA, 18 bp, Homo sapiens
acttgtaaatataaagac

SEQ ID NO: 5029475 - DNA, 19 bp, Homo sapiens
acttgtaaatataaagacg

SEQ ID NO: 5029476 - DNA, 18 bp, Homo sapiens
actttaacacagtgtctg

SEQ ID NO: 5029477 - DNA, 23 bp, Homo sapiens
actttaacataagctatttttct

SEQ ID NO: 5029478 - DNA, 22 bp, Homo sapiens
actttataagtcattgtatgtt

SEQ ID NO: 5029479 - DNA, 15 bp, Homo sapiens
actttccattacaag

SEQ ID NO: 5029480 - DNA, 21 bp, Homo sapiens
actttccattacaagtatttt

SEQ ID NO: 5029481 - DNA, 16 bp, Homo sapiens
actttgcatctcagta

SEQ ID NO: 5029482 - DNA, 18 bp, Homo sapiens
actttggagtcccctcac

SEQ ID NO: 5029483 - DNA, 22 bp, Homo sapiens
actttggagtcccctcacctcc

SEQ ID NO: 5029484 - DNA, 16 bp, Homo sapiens
acttttggttaagtct

SEQ ID NO: 5029485 - DNA, 18 bp, Homo sapiens
agaaaaaaaccacacaaa

SEQ ID NO: 5029486 - DNA, 14 bp, Homo sapiens
agaaaaaaatgtat

SEQ ID NO: 5029487 - DNA, 23 bp, Homo sapiens
agaaaaaaatgtattttatgtta

SEQ ID NO: 5029488 - DNA, 13 bp, Homo sapiens
agaaaaataaaga

SEQ ID NO: 5029489 - DNA, 21 bp, Homo sapiens
agaaaaccagctcagcactgc

SEQ ID NO: 5029490 - DNA, 15 bp, Homo sapiens
agaaaagatgcactt

SEQ ID NO: 5029491 - DNA, 19 bp, Homo sapiens
agaaaagatgcactttgct

SEQ ID NO: 5029492 - DNA, 18 bp, Homo sapiens
agaaaagcaatactgttt

SEQ ID NO: 5029493 - DNA, 21 bp, Homo sapiens
agaaaagtatgttctaacctt

SEQ ID NO: 5029494 - DNA, 18 bp, Homo sapiens
agaaacacccctctgtct

SEQ ID NO: 5029495 - DNA, 22 bp, Homo sapiens
agaaacacccctctgtctagga

SEQ ID NO: 5029496 - DNA, 15 bp, Homo sapiens
agaaaccagaaaagc

SEQ ID NO: 5029497 - DNA, 22 bp, Homo sapiens
agaaagaagacaaactttgcat

SEQ ID NO: 5029498 - DNA, 18 bp, Homo sapiens
agaaagagctcaaaataa

SEQ ID NO: 5029499 - DNA, 23 bp, Homo sapiens
agaaatggcgtctgctctggtgg

SEQ ID NO: 5029500 - DNA, 18 bp, Homo sapiens
agaaccagccgtatttta

SEQ ID NO: 5029501 - DNA, 17 bp, Homo sapiens
agaacctgcacacagga

SEQ ID NO: 5029502 - DNA, 21 bp, Homo sapiens
agaacctgcacacaggacagc

SEQ ID NO: 5029503 - DNA, 18 bp, Homo sapiens
agaataggcattaacaca

SEQ ID NO: 5029504 - DNA, 19 bp, Homo sapiens
agaatgaaatactgtttga

SEQ ID NO: 5029505 - DNA, 20 bp, Homo sapiens
agaatgaaatactgtttgag

SEQ ID NO: 5029506 - DNA, 16 bp, Homo sapiens
agacaacgtgctcttt

SEQ ID NO: 5029507 - DNA, 14 bp, Homo sapiens
agacagaccctctg

SEQ ID NO: 5029508 - DNA, 14 bp, Homo sapiens
agaccctccccaca

SEQ ID NO: 5029509 - DNA, 13 bp, Homo sapiens
agacctcatgccc

SEQ ID NO: 5029510 - DNA, 19 bp, Homo sapiens
agacgatgtcttcatacct

SEQ ID NO: 5029511 - DNA, 15 bp, Homo sapiens
agactatgaaaatgc

SEQ ID NO: 5029512 - DNA, 20 bp, Homo sapiens
agactgccatattaaatttt

SEQ ID NO: 5029513 - DNA, 15 bp, Homo sapiens
agacttgggacattg

SEQ ID NO: 5029514 - DNA, 17 bp, Homo sapiens
agactttaacataagct

SEQ ID NO: 5029515 - DNA, 15 bp, Homo sapiens
agactttccattaca

SEQ ID NO: 5029516 - DNA, 16 bp, Homo sapiens
agagaaaaaaaaaata

SEQ ID NO: 5029517 - DNA, 18 bp, Homo sapiens
agagaaaaaaaaaatagt

SEQ ID NO: 5029518 - DNA, 13 bp, Homo sapiens
agagagaaaaaaa

SEQ ID NO: 5029519 - DNA, 15 bp, Homo sapiens
agagagaaaggactc

SEQ ID NO: 5029520 - DNA, 20 bp, Homo sapiens
agagatatgtagaaggcaca

SEQ ID NO: 5029521 - DNA, 19 bp, Homo sapiens
agagatctttctttccaaa

SEQ ID NO: 5029522 - DNA, 14 bp, Homo sapiens
agagcccgcagggc

SEQ ID NO: 5029523 - DNA, 15 bp, Homo sapiens
agagccggtggtgcc

SEQ ID NO: 5029524 - DNA, 16 bp, Homo sapiens
agagcctggtgctgct

SEQ ID NO: 5029525 - DNA, 16 bp, Homo sapiens
agagcgaggaaaggat

SEQ ID NO: 5029526 - DNA, 21 bp, Homo sapiens
agagcgaggaaaggattttac

SEQ ID NO: 5029527 - DNA, 13 bp, Homo sapiens
agagcttgctcca

SEQ ID NO: 5029528 - DNA, 15 bp, Homo sapiens
agagcttgctccaga

SEQ ID NO: 5029529 - DNA, 16 bp, Homo sapiens
agagcttgctccagat

SEQ ID NO: 5029530 - DNA, 21 bp, Homo sapiens
agaggaataaggcccagagcg

SEQ ID NO: 5029531 - DNA, 22 bp, Homo sapiens
agaggacgtgttacccactgcc

SEQ ID NO: 5029532 - DNA, 19 bp, Homo sapiens
agaggaggtttgcctgtga

SEQ ID NO: 5029533 - DNA, 21 bp, Homo sapiens
agaggtggatgttatgaacag

SEQ ID NO: 5029534 - DNA, 23 bp, Homo sapiens
agaggtggatgttatgaacagct

SEQ ID NO: 5029535 - DNA, 17 bp, Homo sapiens
agaggtttgcagtccca

SEQ ID NO: 5029536 - DNA, 14 bp, Homo sapiens
agagtcagatcttt

SEQ ID NO: 5029537 - DNA, 16 bp, Homo sapiens
agagtccgtggttgcc

SEQ ID NO: 5029538 - DNA, 15 bp, Homo sapiens
agagtgtggaggctg

SEQ ID NO: 5029539 - DNA, 13 bp, Homo sapiens
agagtttcaaaag

SEQ ID NO: 5029540 - DNA, 14 bp, Homo sapiens
agataaacacaaga

SEQ ID NO: 5029541 - DNA, 19 bp, Homo sapiens
agataactgttatttataa

SEQ ID NO: 5029542 - DNA, 14 bp, Homo sapiens
agatacttcccaaa

SEQ ID NO: 5029543 - DNA, 15 bp, Homo sapiens
agatagccctgtcct

SEQ ID NO: 5029544 - DNA, 18 bp, Homo sapiens
agatagccctgtcctggt

SEQ ID NO: 5029545 - DNA, 13 bp, Homo sapiens
agatagttttcat

SEQ ID NO: 5029546 - DNA, 17 bp, Homo sapiens
agatagttttcatccat

SEQ ID NO: 5029547 - DNA, 15 bp, Homo sapiens
agatcacagtggcca

SEQ ID NO: 5029548 - DNA, 21 bp, Homo sapiens
agatctttctttccaaaacat

SEQ ID NO: 5029549 - DNA, 12 bp, Homo sapiens
agatgacaacct

SEQ ID NO: 5029550 - DNA, 17 bp, Homo sapiens
agatgacaacctccatt

SEQ ID NO: 5029551 - DNA, 22 bp, Homo sapiens
agatgcactttgctttaatata

SEQ ID NO: 5029552 - DNA, 16 bp, Homo sapiens
agatgcaggaggctca

SEQ ID NO: 5029553 - DNA, 15 bp, Homo sapiens
agatgcagtttggag

SEQ ID NO: 5029554 - DNA, 14 bp, Homo sapiens
agatgccccaaagt

SEQ ID NO: 5029555 - DNA, 14 bp, Homo sapiens
agatggcactttga

SEQ ID NO: 5029556 - DNA, 12 bp, Homo sapiens
agatgtctattc

SEQ ID NO: 5029557 - DNA, 18 bp, Homo sapiens
agattaaatgtgtcattg

SEQ ID NO: 5029558 - DNA, 22 bp, Homo sapiens
agattacccaaaaactgtcttt

SEQ ID NO: 5029559 - DNA, 15 bp, Homo sapiens
agattatcgttttct

SEQ ID NO: 5029560 - DNA, 16 bp, Homo sapiens
agattcaatcccagga

SEQ ID NO: 5029561 - DNA, 14 bp, Homo sapiens
agattggtgttttt

SEQ ID NO: 5029562 - DNA, 20 bp, Homo sapiens
agattggtgtttttttctat

SEQ ID NO: 5029563 - DNA, 14 bp, Homo sapiens
agatttattaaaga

SEQ ID NO: 5029564 - DNA, 17 bp, Homo sapiens
agatttgtttttaaact

SEQ ID NO: 5029565 - DNA, 20 bp, Homo sapiens
agatttgtttttaaactgta

SEQ ID NO: 5029566 - DNA, 23 bp, Homo sapiens
agatttgtttttaaactgtacag

SEQ ID NO: 5029567 - DNA, 16 bp, Homo sapiens
agcaaaaactacattt

SEQ ID NO: 5029568 - DNA, 13 bp, Homo sapiens
agcaaaaatctcc

SEQ ID NO: 5029569 - DNA, 12 bp, Homo sapiens
agcaaaagaaaa

SEQ ID NO: 5029570 - DNA, 18 bp, Homo sapiens
agcaaacccagaggtgga

SEQ ID NO: 5029571 - DNA, 23 bp, Homo sapiens
agcaaagattaaatgtgtcattg

SEQ ID NO: 5029572 - DNA, 17 bp, Homo sapiens
agcaaatgtcttcctgg

SEQ ID NO: 5029573 - DNA, 19 bp, Homo sapiens
agcaaattgctagtcaggg

SEQ ID NO: 5029574 - DNA, 22 bp, Homo sapiens
aagtgctggggaccttaagtga

SEQ ID NO: 5029575 - DNA, 19 bp, Homo sapiens
aagtgttctcatgaagcag

SEQ ID NO: 5029576 - DNA, 21 bp, Homo sapiens
aagtgttctcatgaagcagga

SEQ ID NO: 5029577 - DNA, 23 bp, Homo sapiens
aagttgagatagttttcatccat

SEQ ID NO: 5029578 - DNA, 19 bp, Homo sapiens
aagttgcagctgttttgtt

SEQ ID NO: 5029579 - DNA, 21 bp, Homo sapiens
aagttgtttgagaaattaagt

SEQ ID NO: 5029580 - DNA, 18 bp, Homo sapiens
aataaaaagcttttgtct

SEQ ID NO: 5029581 - DNA, 13 bp, Homo sapiens
aataaaagcacaa

SEQ ID NO: 5029582 - DNA, 18 bp, Homo sapiens
aataaactaataattgca

SEQ ID NO: 5029583 - DNA, 19 bp, Homo sapiens
aataaactactctttgatt

SEQ ID NO: 5029584 - DNA, 16 bp, Homo sapiens
aataaagaaaagatgc

SEQ ID NO: 5029585 - DNA, 14 bp, Homo sapiens
aataaagatcatgt

SEQ ID NO: 5029586 - DNA, 20 bp, Homo sapiens
aataaagatcatgtaaaagt

SEQ ID NO: 5029587 - DNA, 12 bp, Homo sapiens
aataattgttgt

SEQ ID NO: 5029588 - DNA, 19 bp, Homo sapiens
aataccactctgtaattgc

SEQ ID NO: 5029589 - DNA, 20 bp, Homo sapiens
aataccactctgtaattgca

SEQ ID NO: 5029590 - DNA, 21 bp, Homo sapiens
aataccactctgtaattgcaa

SEQ ID NO: 5029591 - DNA, 15 bp, Homo sapiens
aatacctcatgcttc

SEQ ID NO: 5029592 - DNA, 15 bp, Homo sapiens
aatacggaagagcag

SEQ ID NO: 5029593 - DNA, 22 bp, Homo sapiens
aatagcgctgtttttgttgtgt

SEQ ID NO: 5029594 - DNA, 22 bp, Homo sapiens
aataggcattaacacaaaggag

SEQ ID NO: 5029595 - DNA, 15 bp, Homo sapiens
aatagtaattcccgt

SEQ ID NO: 5029596 - DNA, 14 bp, Homo sapiens
aatagttttttact

SEQ ID NO: 5029597 - DNA, 14 bp, Homo sapiens
aatataaatgcaaa

SEQ ID NO: 5029598 - DNA, 15 bp, Homo sapiens
aatataaatgcaaat

SEQ ID NO: 5029599 - DNA, 20 bp, Homo sapiens
aatataaatgcaaataacaa

SEQ ID NO: 5029600 - DNA, 17 bp, Homo sapiens
aatataataatgatgat

SEQ ID NO: 5029601 - DNA, 15 bp, Homo sapiens
aatatattattactt

SEQ ID NO: 5029602 - DNA, 18 bp, Homo sapiens
aatatattattacttgta

SEQ ID NO: 5029603 - DNA, 20 bp, Homo sapiens
aatatattattacttgtaaa

SEQ ID NO: 5029604 - DNA, 22 bp, Homo sapiens
aatatattattacttgtaaata

SEQ ID NO: 5029605 - DNA, 15 bp, Homo sapiens
aatatggactgctca

SEQ ID NO: 5029606 - DNA, 21 bp, Homo sapiens
aatattagtgacctcagcttt

SEQ ID NO: 5029607 - DNA, 15 bp, Homo sapiens
aatcaaacattttga

SEQ ID NO: 5029608 - DNA, 23 bp, Homo sapiens
aatcaaacattttgaaagtctgt

SEQ ID NO: 5029609 - DNA, 15 bp, Homo sapiens
aatcagccagtctca

SEQ ID NO: 5029610 - DNA, 23 bp, Homo sapiens
aatccaagtagataggaagaaag

SEQ ID NO: 5029611 - DNA, 15 bp, Homo sapiens
aatcccatttcccaa

SEQ ID NO: 5029612 - DNA, 21 bp, Homo sapiens
aatcctctcaaccacctttca

SEQ ID NO: 5029613 - DNA, 19 bp, Homo sapiens
aatctcaatgaagccagct

SEQ ID NO: 5029614 - DNA, 17 bp, Homo sapiens
aatctgggccagaattt

SEQ ID NO: 5029615 - DNA, 18 bp, Homo sapiens
aatctgggccagaatttc

SEQ ID NO: 5029616 - DNA, 20 bp, Homo sapiens
aatctgttatgtactagtgt

SEQ ID NO: 5029617 - DNA, 23 bp, Homo sapiens
aatctgttatgtactagtgttct

SEQ ID NO: 5029618 - DNA, 12 bp, Homo sapiens
aatgaacaagag

SEQ ID NO: 5029619 - DNA, 14 bp, Homo sapiens
aatgaacaagagaa

SEQ ID NO: 5029620 - DNA, 16 bp, Homo sapiens
aatgaacaagagaagc

SEQ ID NO: 5029621 - DNA, 17 bp, Homo sapiens
aatgaacaagagaagca

SEQ ID NO: 5029622 - DNA, 13 bp, Homo sapiens
aatgaagccagct

SEQ ID NO: 5029623 - DNA, 22 bp, Homo sapiens
aatgacggtaagtgttctcatg

SEQ ID NO: 5029624 - DNA, 15 bp, Homo sapiens
aatgaggtctgttta

SEQ ID NO: 5029625 - DNA, 20 bp, Homo sapiens
aatgatgtatgttgaagcct

SEQ ID NO: 5029626 - DNA, 15 bp, Homo sapiens
aatgatttttcttta

SEQ ID NO: 5029627 - DNA, 18 bp, Homo sapiens
aatgatttttctttacaa

SEQ ID NO: 5029628 - DNA, 22 bp, Homo sapiens
aatgccaaattaaaaaagataa

SEQ ID NO: 5029629 - DNA, 22 bp, Homo sapiens
aatgctggctatagatgtcttt

SEQ ID NO: 5029630 - DNA, 14 bp, Homo sapiens
aatgcttctaagta

SEQ ID NO: 5029631 - DNA, 20 bp, Homo sapiens
aatgcttctaagtaaataca

SEQ ID NO: 5029632 - DNA, 22 bp, Homo sapiens
aatgcttctaagtaaatacaat

SEQ ID NO: 5029633 - DNA, 17 bp, Homo sapiens
aatggactggaagggga

SEQ ID NO: 5029634 - DNA, 17 bp, Homo sapiens
aatggcagttatatttt

SEQ ID NO: 5029635 - DNA, 17 bp, Homo sapiens
aatggcgtctgctctgg

SEQ ID NO: 5029636 - DNA, 13 bp, Homo sapiens
aatgtaaggctgt

SEQ ID NO: 5029637 - DNA, 19 bp, Homo sapiens
aatgtattttatgttatat

SEQ ID NO: 5029638 - DNA, 19 bp, Homo sapiens
aatgtgaatcgcagctgtg

SEQ ID NO: 5029639 - DNA, 17 bp, Homo sapiens
aatgtggagcagcagcc

SEQ ID NO: 5029640 - DNA, 14 bp, Homo sapiens
aatgtgtcattgga

SEQ ID NO: 5029641 - DNA, 11 bp, Homo sapiens
aatgtgtcttt

SEQ ID NO: 5029642 - DNA, 12 bp, Homo sapiens
aatgtgtcttta

SEQ ID NO: 5029643 - DNA, 15 bp, Homo sapiens
aatgtgtctttagat

SEQ ID NO: 5029644 - DNA, 14 bp, Homo sapiens
aatgtttttctaaa

SEQ ID NO: 5029645 - DNA, 15 bp, Homo sapiens
aatgtttttctaaag

SEQ ID NO: 5029646 - DNA, 16 bp, Homo sapiens
aattaaaaaagataaa

SEQ ID NO: 5029647 - DNA, 20 bp, Homo sapiens
aattaaggattttatgcttt

SEQ ID NO: 5029648 - DNA, 18 bp, Homo sapiens
aattattacagtgtttat

SEQ ID NO: 5029649 - DNA, 14 bp, Homo sapiens
aattattcaattta

SEQ ID NO: 5029650 - DNA, 19 bp, Homo sapiens
aattccctggcctttcata

SEQ ID NO: 5029651 - DNA, 20 bp, Homo sapiens
aattccctggcctttcatat

SEQ ID NO: 5029652 - DNA, 20 bp, Homo sapiens
aattcctcatttgttcatta

SEQ ID NO: 5029653 - DNA, 12 bp, Homo sapiens
aattgaaatgta

SEQ ID NO: 5029654 - DNA, 19 bp, Homo sapiens
aattgctagtcagggtgaa

SEQ ID NO: 5029655 - DNA, 20 bp, Homo sapiens
aattgggccagcttttcaaa

SEQ ID NO: 5029656 - DNA, 13 bp, Homo sapiens
aattgttgttctg

SEQ ID NO: 5029657 - DNA, 16 bp, Homo sapiens
aattgttgttctgtta

SEQ ID NO: 5029658 - DNA, 22 bp, Homo sapiens
aattgttgttctgttaactgaa

SEQ ID NO: 5029659 - DNA, 15 bp, Homo sapiens
aatttaaacacctcc

SEQ ID NO: 5029660 - DNA, 20 bp, Homo sapiens
aatttaaagcaggttcttgt

SEQ ID NO: 5029661 - DNA, 22 bp, Homo sapiens
aatttaaagcaggttcttgttg

SEQ ID NO: 5029662 - DNA, 14 bp, Homo sapiens
aatttagcattgta

SEQ ID NO: 5029663 - DNA, 16 bp, Homo sapiens
aatttagcattgtagt

SEQ ID NO: 5029664 - DNA, 23 bp, Homo sapiens
aatttatttgaatgatttttctt

SEQ ID NO: 5029665 - DNA, 19 bp, Homo sapiens
aatttcttcccccaaagcc

SEQ ID NO: 5029666 - DNA, 13 bp, Homo sapiens
aatttggcaattt

SEQ ID NO: 5029667 - DNA, 21 bp, Homo sapiens
aatttggtaaaaatgctgctc

SEQ ID NO: 5029668 - DNA, 16 bp, Homo sapiens
aatttttcttcttgag

SEQ ID NO: 5029669 - DNA, 22 bp, Homo sapiens
aattttttgttgacattagtct

SEQ ID NO: 5029670 - DNA, 19 bp, Homo sapiens
acaaactttgcatctcagt

SEQ ID NO: 5029671 - DNA, 14 bp, Homo sapiens
acaaaggtttaaat

SEQ ID NO: 5029672 - DNA, 15 bp, Homo sapiens
acaaaggtttaaatg

SEQ ID NO: 5029673 - DNA, 23 bp, Homo sapiens
acaaaggtttaaatgaacaagag

SEQ ID NO: 5029674 - DNA, 11 bp, Homo sapiens
acaaagtgcct

SEQ ID NO: 5029675 - DNA, 22 bp, Homo sapiens
acaaatgccaaattaaaaaaga

SEQ ID NO: 5029676 - DNA, 15 bp, Homo sapiens
acaaattagttatat

SEQ ID NO: 5029677 - DNA, 21 bp, Homo sapiens
acaacatcgcaatagtttttt

SEQ ID NO: 5029678 - DNA, 18 bp, Homo sapiens
acaacgtgctctttgttt

SEQ ID NO: 5029679 - DNA, 22 bp, Homo sapiens
acaacgtgctctttgttttgtg

SEQ ID NO: 5029680 - DNA, 17 bp, Homo sapiens
acaactcactcctttta

SEQ ID NO: 5029681 - DNA, 19 bp, Homo sapiens
acaactcactccttttaaa

SEQ ID NO: 5029682 - DNA, 21 bp, Homo sapiens
acaactcactccttttaaaga

SEQ ID NO: 5029683 - DNA, 16 bp, Homo sapiens
acaagaaaaataaaga

SEQ ID NO: 5029684 - DNA, 14 bp, Homo sapiens
acaagaagaagggc

SEQ ID NO: 5029685 - DNA, 22 bp, Homo sapiens
acaaggacagcccctcctccat

SEQ ID NO: 5029686 - DNA, 14 bp, Homo sapiens
acttaagcaaaaga

SEQ ID NO: 5029687 - DNA, 20 bp, Homo sapiens
acttaagcaaaagaaaaaga

SEQ ID NO: 5029688 - DNA, 14 bp, Homo sapiens
acttacatttacaa

SEQ ID NO: 5029689 - DNA, 15 bp, Homo sapiens
acttacatttacaaa

SEQ ID NO: 5029690 - DNA, 17 bp, Homo sapiens
acttagagtttctgttt

SEQ ID NO: 5029691 - DNA, 18 bp, Homo sapiens
acttagagtttctgtttg

SEQ ID NO: 5029692 - DNA, 18 bp, Homo sapiens
acttagtgacaaaataga

SEQ ID NO: 5029693 - DNA, 18 bp, Homo sapiens
acttcctcctccccactt

SEQ ID NO: 5029694 - DNA, 14 bp, Homo sapiens
acttcgacactgtt

SEQ ID NO: 5029695 - DNA, 16 bp, Homo sapiens
acttcgacactgttct

SEQ ID NO: 5029696 - DNA, 21 bp, Homo sapiens
acttcgacactgttcttagct

SEQ ID NO: 5029697 - DNA, 18 bp, Homo sapiens
acttctctgttgtcaaac

SEQ ID NO: 5029698 - DNA, 19 bp, Homo sapiens
acttggagactcctggtct

SEQ ID NO: 5029699 - DNA, 21 bp, Homo sapiens
acttggagactcctggtctgt

SEQ ID NO: 5029700 - DNA, 17 bp, Homo sapiens
acttggattctttccat

SEQ ID NO: 5029701 - DNA, 22 bp, Homo sapiens
acttggattctttccatttgca

SEQ ID NO: 5029702 - DNA, 18 bp, Homo sapiens
acttgtattaaagacaga

SEQ ID NO: 5029703 - DNA, 16 bp, Homo sapiens
acttgttggtgtggat

SEQ ID NO: 5029704 - DNA, 16 bp, Homo sapiens
acttgttttctgggaa

SEQ ID NO: 5029705 - DNA, 14 bp, Homo sapiens
actttaacataagc

SEQ ID NO: 5029706 - DNA, 16 bp, Homo sapiens
actttaacataagcta

SEQ ID NO: 5029707 - DNA, 18 bp, Homo sapiens
actttaacataagctatt

SEQ ID NO: 5029708 - DNA, 13 bp, Homo sapiens
actttccattaca

SEQ ID NO: 5029709 - DNA, 14 bp, Homo sapiens
actttccattacaa

SEQ ID NO: 5029710 - DNA, 19 bp, Homo sapiens
actttgaaaagttggaagg

SEQ ID NO: 5029711 - DNA, 14 bp, Homo sapiens
actttgaagggcaa

SEQ ID NO: 5029712 - DNA, 15 bp, Homo sapiens
actttgctttaatat

SEQ ID NO: 5029713 - DNA, 18 bp, Homo sapiens
actttgctttaatataaa

SEQ ID NO: 5029714 - DNA, 23 bp, Homo sapiens
actttggagtcccctcacctcct

SEQ ID NO: 5029715 - DNA, 23 bp, Homo sapiens
acttttatttccagtgaaatcag

SEQ ID NO: 5029716 - DNA, 11 bp, Homo sapiens
actttttacat

SEQ ID NO: 5029717 - DNA, 13 bp, Homo sapiens
acttttttccaca

SEQ ID NO: 5029718 - DNA, 18 bp, Homo sapiens
agaaaaaaatgtatttta

SEQ ID NO: 5029719 - DNA, 20 bp, Homo sapiens
agaaaaccagctcagcactg

SEQ ID NO: 5029720 - DNA, 12 bp, Homo sapiens
agaaaagatgca

SEQ ID NO: 5029721 - DNA, 13 bp, Homo sapiens
agaaaagatgcac

SEQ ID NO: 5029722 - DNA, 19 bp, Homo sapiens
agaaacacccctctgtcta

SEQ ID NO: 5029723 - DNA, 19 bp, Homo sapiens
agaaaggactcctgaaaaa

SEQ ID NO: 5029724 - DNA, 17 bp, Homo sapiens
agaaagtgataagtgca

SEQ ID NO: 5029725 - DNA, 16 bp, Homo sapiens
agaaatctttctccct

SEQ ID NO: 5029726 - DNA, 22 bp, Homo sapiens
agaaatgattcaaattgctgct

SEQ ID NO: 5029727 - DNA, 22 bp, Homo sapiens
agaaatggcgtctgctctggtg

SEQ ID NO: 5029728 - DNA, 20 bp, Homo sapiens
agaacacagcaattcctcag

SEQ ID NO: 5029729 - DNA, 14 bp, Homo sapiens
agaacatactgatt

SEQ ID NO: 5029730 - DNA, 19 bp, Homo sapiens
agaaccagccgtattttac

SEQ ID NO: 5029731 - DNA, 15 bp, Homo sapiens
agaagacaaaaagac

SEQ ID NO: 5029732 - DNA, 20 bp, Homo sapiens
agaaggcaaatgactttgga

SEQ ID NO: 5029733 - DNA, 16 bp, Homo sapiens
agaatacggaagagca

SEQ ID NO: 5029734 - DNA, 21 bp, Homo sapiens
agaatacggaagagcaggtga

SEQ ID NO: 5029735 - DNA, 19 bp, Homo sapiens
agaataggcattaacacaa

SEQ ID NO: 5029736 - DNA, 14 bp, Homo sapiens
agaatcaaacattt

SEQ ID NO: 5029737 - DNA, 16 bp, Homo sapiens
agaatcagtgcaaaga

SEQ ID NO: 5029738 - DNA, 16 bp, Homo sapiens
agaatgagcacccatt

SEQ ID NO: 5029739 - DNA, 15 bp, Homo sapiens
agacaaaaagacaaa

SEQ ID NO: 5029740 - DNA, 21 bp, Homo sapiens
agacaaactttgcatctcagt

SEQ ID NO: 5029741 - DNA, 21 bp, Homo sapiens
agacaacgtgctctttgtttt

SEQ ID NO: 5029742 - DNA, 13 bp, Homo sapiens
agacaatttgcac

SEQ ID NO: 5029743 - DNA, 15 bp, Homo sapiens
agacaccaccaccct

SEQ ID NO: 5029744 - DNA, 17 bp, Homo sapiens
agacaccgttcattcag

SEQ ID NO: 5029745 - DNA, 13 bp, Homo sapiens
agacactggcccc

SEQ ID NO: 5029746 - DNA, 15 bp, Homo sapiens
agacactggcccctc

SEQ ID NO: 5029747 - DNA, 16 bp, Homo sapiens
agaccaccccgcctgc

SEQ ID NO: 5029748 - DNA, 21 bp, Homo sapiens
agaccctccccacagtgccac

SEQ ID NO: 5029749 - DNA, 22 bp, Homo sapiens
agacctcatgcccagctctctg

SEQ ID NO: 5029750 - DNA, 18 bp, Homo sapiens
agacctctgtgcacttat

SEQ ID NO: 5029751 - DNA, 22 bp, Homo sapiens
agacgttttataagcatcatta

SEQ ID NO: 5029752 - DNA, 14 bp, Homo sapiens
agactatttgctta

SEQ ID NO: 5029753 - DNA, 15 bp, Homo sapiens
agacttggattcttt

SEQ ID NO: 5029754 - DNA, 12 bp, Homo sapiens
agactttaacat

SEQ ID NO: 5029755 - DNA, 22 bp, Homo sapiens
agactttccattacaagtattt

SEQ ID NO: 5029756 - DNA, 22 bp, Homo sapiens
agagaagcattctcattggaaa

SEQ ID NO: 5029757 - DNA, 22 bp, Homo sapiens
agagaaggggaagcactcgtgt

SEQ ID NO: 5029758 - DNA, 12 bp, Homo sapiens
agagacccccag

SEQ ID NO: 5029759 - DNA, 15 bp, Homo sapiens
agagacccccaggcc

SEQ ID NO: 5029760 - DNA, 22 bp, Homo sapiens
agagaggtttgcagtcccaagc

SEQ ID NO: 5029761 - DNA, 20 bp, Homo sapiens
agagcaggtgactgtgctgt

SEQ ID NO: 5029762 - DNA, 18 bp, Homo sapiens
agagccggtggtgcccgt

SEQ ID NO: 5029763 - DNA, 19 bp, Homo sapiens
agagccggtggtgcccgtg

SEQ ID NO: 5029764 - DNA, 18 bp, Homo sapiens
agagcctggtgctgctgc

SEQ ID NO: 5029765 - DNA, 14 bp, Homo sapiens
agagccttaataaa

SEQ ID NO: 5029766 - DNA, 23 bp, Homo sapiens
agagcttgctccagattctgatg

SEQ ID NO: 5029767 - DNA, 23 bp, Homo sapiens
agaggagggagcatcagtgccct

SEQ ID NO: 5029768 - DNA, 16 bp, Homo sapiens
agaggaggtttgcctg

SEQ ID NO: 5029769 - DNA, 20 bp, Homo sapiens
agaggaggtttgcctgtgat

SEQ ID NO: 5029770 - DNA, 10 bp, Homo sapiens
agaggcattg

SEQ ID NO: 5029771 - DNA, 18 bp, Homo sapiens
agaggccaaaggctggtg

SEQ ID NO: 5029772 - DNA, 22 bp, Homo sapiens
agaggtggatgttatgaacagc

SEQ ID NO: 5029773 - DNA, 20 bp, Homo sapiens
agaggtttgcagtcccaagc

SEQ ID NO: 5029774 - DNA, 12 bp, Homo sapiens
agaggtttttct

SEQ ID NO: 5029775 - DNA, 22 bp, Homo sapiens
agaggtttttcttaaataataa

SEQ ID NO: 5029776 - DNA, 13 bp, Homo sapiens
agagtcaaagctg

SEQ ID NO: 5029777 - DNA, 22 bp, Homo sapiens
agagtcccaggaccttgagtgt

SEQ ID NO: 5029778 - DNA, 15 bp, Homo sapiens
agagtttcaaaagca

SEQ ID NO: 5029779 - DNA, 20 bp, Homo sapiens
agataactgttatttataat

SEQ ID NO: 5029780 - DNA, 13 bp, Homo sapiens
agataatccctgt

SEQ ID NO: 5029781 - DNA, 13 bp, Homo sapiens
agatagcatggga

SEQ ID NO: 5029782 - DNA, 17 bp, Homo sapiens
agatagccctgtcctgg

SEQ ID NO: 5029783 - DNA, 20 bp, Homo sapiens
agatagccctgtcctggtgg

SEQ ID NO: 5029784 - DNA, 14 bp, Homo sapiens
agatagttttcatc

SEQ ID NO: 5029785 - DNA, 15 bp, Homo sapiens
agatgcactttgctt

SEQ ID NO: 5029786 - DNA, 19 bp, Homo sapiens
agatgcactttgctttaat

SEQ ID NO: 5029787 - DNA, 22 bp, Homo sapiens
agatgccttttttgtagttttt

SEQ ID NO: 5029788 - DNA, 15 bp, Homo sapiens
agatgctggttttct

SEQ ID NO: 5029789 - DNA, 17 bp, Homo sapiens
agatgggcttcccaagg

SEQ ID NO: 5029790 - DNA, 14 bp, Homo sapiens
agatggtggcagta

SEQ ID NO: 5029791 - DNA, 18 bp, Homo sapiens
agatgtcttttcccattt

SEQ ID NO: 5029792 - DNA, 22 bp, Homo sapiens
agatgtggggctgagctgggga

SEQ ID NO: 5029793 - DNA, 19 bp, Homo sapiens
agattggtgtttttttcta

SEQ ID NO: 5029794 - DNA, 16 bp, Homo sapiens
agatttattaaagaaa

SEQ ID NO: 5029795 - DNA, 17 bp, Homo sapiens
agcaaaacatctctgca

SEQ ID NO: 5029796 - DNA, 13 bp, Homo sapiens
agcaaaagaaaaa

SEQ ID NO: 5029797 - DNA, 14 bp, Homo sapiens
agcaaaagaaaaag

SEQ ID NO: 5029798 - DNA, 20 bp, Homo sapiens
agcaagttcctgagtgcgtg

SEQ ID NO: 5029799 - DNA, 23 bp, Homo sapiens
agtgttctcatgaagcaggaggc

SEQ ID NO: 5029800 - DNA, 22 bp, Homo sapiens
agtgttctgtttgttattgttt

SEQ ID NO: 5029801 - DNA, 12 bp, Homo sapiens
agtgttgaaggg

SEQ ID NO: 5029802 - DNA, 19 bp, Homo sapiens
agtgttgaagggaggtggc

SEQ ID NO: 5029803 - DNA, 13 bp, Homo sapiens
agttaacacacta

SEQ ID NO: 5029804 - DNA, 18 bp, Homo sapiens
agttagctaataaaaagc

SEQ ID NO: 5029805 - DNA, 15 bp, Homo sapiens
agttagtgatcctgt

SEQ ID NO: 5029806 - DNA, 16 bp, Homo sapiens
agttatattttgcagt

SEQ ID NO: 5029807 - DNA, 15 bp, Homo sapiens
agttcaccttggaag

SEQ ID NO: 5029808 - DNA, 18 bp, Homo sapiens
agttgagatagttttcat

SEQ ID NO: 5029809 - DNA, 15 bp, Homo sapiens
agttgcagctgtttt

SEQ ID NO: 5029810 - DNA, 21 bp, Homo sapiens
agttgcagctgttttgttgac

SEQ ID NO: 5029811 - DNA, 13 bp, Homo sapiens
agttgtctctgat

SEQ ID NO: 5029812 - DNA, 19 bp, Homo sapiens
agtttctgtttgattcttt

SEQ ID NO: 5029813 - DNA, 16 bp, Homo sapiens
agtttgtgtgtcttaa

SEQ ID NO: 5029814 - DNA, 12 bp, Homo sapiens
agtttgttttag

SEQ ID NO: 5029815 - DNA, 20 bp, Homo sapiens
agttttcatccataactgaa

SEQ ID NO: 5029816 - DNA, 21 bp, Homo sapiens
agttttcatccataactgaac

SEQ ID NO: 5029817 - DNA, 12 bp, Homo sapiens
agttttctctta

SEQ ID NO: 5029818 - DNA, 15 bp, Homo sapiens
agttttggttgcttt

SEQ ID NO: 5029819 - DNA, 13 bp, Homo sapiens
agttttttcatct

SEQ ID NO: 5029820 - DNA, 23 bp, Homo sapiens
agttttttcatcttcagttgtct

SEQ ID NO: 5029821 - DNA, 16 bp, Homo sapiens
agttttttgttttaca

SEQ ID NO: 5029822 - DNA, 13 bp, Homo sapiens
ataaacaagaaaa

SEQ ID NO: 5029823 - DNA, 19 bp, Homo sapiens
ataaacaagaaaaataaag

SEQ ID NO: 5029824 - DNA, 20 bp, Homo sapiens
ataaacaagaaaaataaaga

SEQ ID NO: 5029825 - DNA, 17 bp, Homo sapiens
ataaacatgtgccctca

SEQ ID NO: 5029826 - DNA, 14 bp, Homo sapiens
ataaactaataatt

SEQ ID NO: 5029827 - DNA, 21 bp, Homo sapiens
ataaagacgttttataagcat

SEQ ID NO: 5029828 - DNA, 22 bp, Homo sapiens
ataaagacgttttataagcatc

SEQ ID NO: 5029829 - DNA, 19 bp, Homo sapiens
ataaagatcatgtaaaagt

SEQ ID NO: 5029830 - DNA, 14 bp, Homo sapiens
ataaagcatttaac

SEQ ID NO: 5029831 - DNA, 18 bp, Homo sapiens
ataaatatattattactt

SEQ ID NO: 5029832 - DNA, 22 bp, Homo sapiens
ataaatatattattacttgtaa

SEQ ID NO: 5029833 - DNA, 23 bp, Homo sapiens
ataaatatattattacttgtaaa

SEQ ID NO: 5029834 - DNA, 18 bp, Homo sapiens
ataaatgattcttagtga

SEQ ID NO: 5029835 - DNA, 12 bp, Homo sapiens
ataaatgcaaat

SEQ ID NO: 5029836 - DNA, 17 bp, Homo sapiens
ataacaaatgccaaatt

SEQ ID NO: 5029837 - DNA, 14 bp, Homo sapiens
ataagcatcattat

SEQ ID NO: 5029838 - DNA, 17 bp, Homo sapiens
ataagcatcattattta

SEQ ID NO: 5029839 - DNA, 16 bp, Homo sapiens
ataagctatttttcta

SEQ ID NO: 5029840 - DNA, 21 bp, Homo sapiens
ataagtccttgcaagaatcag

SEQ ID NO: 5029841 - DNA, 17 bp, Homo sapiens
ataagtgcagggaggaa

SEQ ID NO: 5029842 - DNA, 19 bp, Homo sapiens
ataatcacttttttccaca

SEQ ID NO: 5029843 - DNA, 17 bp, Homo sapiens
ataatgctaatttaaag

SEQ ID NO: 5029844 - DNA, 14 bp, Homo sapiens
ataattaattgtca

SEQ ID NO: 5029845 - DNA, 15 bp, Homo sapiens
ataattgttgttctg

SEQ ID NO: 5029846 - DNA, 17 bp, Homo sapiens
ataattgttgttctgtt

SEQ ID NO: 5029847 - DNA, 19 bp, Homo sapiens
ataattgttgttctgttaa

SEQ ID NO: 5029848 - DNA, 23 bp, Homo sapiens
ataattgttgttctgttaactga

SEQ ID NO: 5029849 - DNA, 12 bp, Homo sapiens
atacaagactgc

SEQ ID NO: 5029850 - DNA, 20 bp, Homo sapiens
atacaattttttttattagt

SEQ ID NO: 5029851 - DNA, 15 bp, Homo sapiens
ataccactctgtaat

SEQ ID NO: 5029852 - DNA, 13 bp, Homo sapiens
atacccccctctg

SEQ ID NO: 5029853 - DNA, 17 bp, Homo sapiens
atacctacatgtatttg

SEQ ID NO: 5029854 - DNA, 21 bp, Homo sapiens
atacctacatgtatttgtttg

SEQ ID NO: 5029855 - DNA, 18 bp, Homo sapiens
atactaataaactaataa

SEQ ID NO: 5029856 - DNA, 18 bp, Homo sapiens
atactcttatagacaaca

SEQ ID NO: 5029857 - DNA, 15 bp, Homo sapiens
atactgaacatctga

SEQ ID NO: 5029858 - DNA, 17 bp, Homo sapiens
atactgattgggaggtg

SEQ ID NO: 5029859 - DNA, 18 bp, Homo sapiens
atactgattgggaggtgc

SEQ ID NO: 5029860 - DNA, 14 bp, Homo sapiens
atactggcctggac

SEQ ID NO: 5029861 - DNA, 12 bp, Homo sapiens
atactgtttgag

SEQ ID NO: 5029862 - DNA, 16 bp, Homo sapiens
atactgtttgaggttt

SEQ ID NO: 5029863 - DNA, 15 bp, Homo sapiens
atagccactaacctt

SEQ ID NO: 5029864 - DNA, 21 bp, Homo sapiens
atagccactaaccttgcctgg

SEQ ID NO: 5029865 - DNA, 22 bp, Homo sapiens
atagccactaaccttgcctggt

SEQ ID NO: 5029866 - DNA, 15 bp, Homo sapiens
ataggtctgaaattt

SEQ ID NO: 5029867 - DNA, 18 bp, Homo sapiens
ataggtgagaaaaaaaca

SEQ ID NO: 5029868 - DNA, 19 bp, Homo sapiens
atagttttttacttctctt

SEQ ID NO: 5029869 - DNA, 15 bp, Homo sapiens
atataaatgcaaata

SEQ ID NO: 5029870 - DNA, 18 bp, Homo sapiens
atataaatgcaaataaca

SEQ ID NO: 5029871 - DNA, 16 bp, Homo sapiens
atataataatgatgat

SEQ ID NO: 5029872 - DNA, 17 bp, Homo sapiens
atatagttagctaataa

SEQ ID NO: 5029873 - DNA, 10 bp, Homo sapiens
atatataaat

SEQ ID NO: 5029874 - DNA, 13 bp, Homo sapiens
atatataaatata

SEQ ID NO: 5029875 - DNA, 19 bp, Homo sapiens
atatataaatatattatta

SEQ ID NO: 5029876 - DNA, 21 bp, Homo sapiens
atatatggggatggtagtttt

SEQ ID NO: 5029877 - DNA, 21 bp, Homo sapiens
atatcataatgggggtaaagt

SEQ ID NO: 5029878 - DNA, 10 bp, Homo sapiens
atatcctgtg

SEQ ID NO: 5029879 - DNA, 20 bp, Homo sapiens
atatggggatggtagttttt

SEQ ID NO: 5029880 - DNA, 16 bp, Homo sapiens
atattaaattttttgt

SEQ ID NO: 5029881 - DNA, 12 bp, Homo sapiens
atattaatgtac

SEQ ID NO: 5029882 - DNA, 18 bp, Homo sapiens
atattaatgtacttgttt

SEQ ID NO: 5029883 - DNA, 14 bp, Homo sapiens
atattattaatata

SEQ ID NO: 5029884 - DNA, 12 bp, Homo sapiens
atattattactt

SEQ ID NO: 5029885 - DNA, 19 bp, Homo sapiens
atattattacttgtaaata

SEQ ID NO: 5029886 - DNA, 15 bp, Homo sapiens
atattcttgtgcttt

SEQ ID NO: 5029887 - DNA, 13 bp, Homo sapiens
atattttcctata

SEQ ID NO: 5029888 - DNA, 12 bp, Homo sapiens
atattttgcagt

SEQ ID NO: 5029889 - DNA, 15 bp, Homo sapiens
atcaaacattttgaa

SEQ ID NO: 5029890 - DNA, 21 bp, Homo sapiens
atcacagttttggttgcttta

SEQ ID NO: 5029891 - DNA, 20 bp, Homo sapiens
atcacatgaattattacagt

SEQ ID NO: 5029892 - DNA, 16 bp, Homo sapiens
atcacctagctgaatg

SEQ ID NO: 5029893 - DNA, 17 bp, Homo sapiens
atcagagctccagtttg

SEQ ID NO: 5029894 - DNA, 17 bp, Homo sapiens
atcagcaatttcagaac

SEQ ID NO: 5029895 - DNA, 14 bp, Homo sapiens
atcaggtttttccc

SEQ ID NO: 5029896 - DNA, 13 bp, Homo sapiens
atcagtgccctcc

SEQ ID NO: 5029897 - DNA, 17 bp, Homo sapiens
atcagtgccctccagga

SEQ ID NO: 5029898 - DNA, 15 bp, Homo sapiens
atcatcagtattgaa

SEQ ID NO: 5029899 - DNA, 19 bp, Homo sapiens
atcatcagtattgaagcat

SEQ ID NO: 5029900 - DNA, 13 bp, Homo sapiens
atccccaccccac

SEQ ID NO: 5029901 - DNA, 13 bp, Homo sapiens
atcccgtgttctc

SEQ ID NO: 5029902 - DNA, 15 bp, Homo sapiens
atccctccccagttc

SEQ ID NO: 5029903 - DNA, 20 bp, Homo sapiens
atccctttttttacatttca

SEQ ID NO: 5029904 - DNA, 16 bp, Homo sapiens
atccgcaatgtggagc

SEQ ID NO: 5029905 - DNA, 13 bp, Homo sapiens
atcctgctaagtt

SEQ ID NO: 5029906 - DNA, 12 bp, Homo sapiens
atcctgtgtaac

SEQ ID NO: 5029907 - DNA, 12 bp, Homo sapiens
atcctgtgtgtt

SEQ ID NO: 5029908 - DNA, 14 bp, Homo sapiens
atccttgtcttatt

SEQ ID NO: 5029909 - DNA, 17 bp, Homo sapiens
atcctttcatatagtta

SEQ ID NO: 5029910 - DNA, 20 bp, Homo sapiens
atcctttcatatagttagct

SEQ ID NO: 5029911 - DNA, 14 bp, Homo sapiens
atcgttttcttaaa

SEQ ID NO: 5029912 - DNA, 17 bp, Homo sapiens
atcgttttcttaaagtg

SEQ ID NO: 5029913 - DNA, 13 bp, Homo sapiens
cacttctgtgcca

SEQ ID NO: 5029914 - DNA, 20 bp, Homo sapiens
cacttgtcaggagtgtgtgt

SEQ ID NO: 5029915 - DNA, 18 bp, Homo sapiens
cactttataagtcattgt

SEQ ID NO: 5029916 - DNA, 14 bp, Homo sapiens
cactttgaaaagtt

SEQ ID NO: 5029917 - DNA, 17 bp, Homo sapiens
cactttgaaaagttgga

SEQ ID NO: 5029918 - DNA, 14 bp, Homo sapiens
cactttgaagggca

SEQ ID NO: 5029919 - DNA, 17 bp, Homo sapiens
cactttgctttaatata

SEQ ID NO: 5029920 - DNA, 20 bp, Homo sapiens
cactttgctttaatataaat

SEQ ID NO: 5029921 - DNA, 16 bp, Homo sapiens
cagaaacacccctctg

SEQ ID NO: 5029922 - DNA, 19 bp, Homo sapiens
cagaaacacccctctgtct

SEQ ID NO: 5029923 - DNA, 19 bp, Homo sapiens
cagaaagtgataagtgcag

SEQ ID NO: 5029924 - DNA, 22 bp, Homo sapiens
cagaaagtgataagtgcaggga

SEQ ID NO: 5029925 - DNA, 19 bp, Homo sapiens
cagaaccaaaagggaggct

SEQ ID NO: 5029926 - DNA, 13 bp, Homo sapiens
cagaacctgcaca

SEQ ID NO: 5029927 - DNA, 17 bp, Homo sapiens
cagaacctgcacacagg

SEQ ID NO: 5029928 - DNA, 19 bp, Homo sapiens
cagaaggcaaatgactttg

SEQ ID NO: 5029929 - DNA, 16 bp, Homo sapiens
cagaatacggaagagc

SEQ ID NO: 5029930 - DNA, 15 bp, Homo sapiens
cagaccaccccgcct

SEQ ID NO: 5029931 - DNA, 19 bp, Homo sapiens
cagaccaccccgcctgccc

SEQ ID NO: 5029932 - DNA, 22 bp, Homo sapiens
cagaccaccccgcctgccctca

SEQ ID NO: 5029933 - DNA, 23 bp, Homo sapiens
cagactctttttttgagtgacag

SEQ ID NO: 5029934 - DNA, 16 bp, Homo sapiens
cagagaccaggctgtg

SEQ ID NO: 5029935 - DNA, 15 bp, Homo sapiens
cagagacttgggaca

SEQ ID NO: 5029936 - DNA, 19 bp, Homo sapiens
cagagagcctggtgctgct

SEQ ID NO: 5029937 - DNA, 18 bp, Homo sapiens
cagagaggtttgcagtcc

SEQ ID NO: 5029938 - DNA, 23 bp, Homo sapiens
cagagaggtttgcagtcccaagc

SEQ ID NO: 5029939 - DNA, 16 bp, Homo sapiens
cagaggagcagctctc

SEQ ID NO: 5029940 - DNA, 23 bp, Homo sapiens
cagaggcctgggggacccctggc

SEQ ID NO: 5029941 - DNA, 13 bp, Homo sapiens
cagaggtggatgt

SEQ ID NO: 5029942 - DNA, 16 bp, Homo sapiens
cagataactgttattt

SEQ ID NO: 5029943 - DNA, 19 bp, Homo sapiens
cagataactgttatttata

SEQ ID NO: 5029944 - DNA, 20 bp, Homo sapiens
cagataactgttatttataa

SEQ ID NO: 5029945 - DNA, 21 bp, Homo sapiens
cagataactgttatttataat

SEQ ID NO: 5029946 - DNA, 15 bp, Homo sapiens
cagataatccctgta

SEQ ID NO: 5029947 - DNA, 15 bp, Homo sapiens
cagatgctgtgcaaa

SEQ ID NO: 5029948 - DNA, 15 bp, Homo sapiens
cagatgtggggctga

SEQ ID NO: 5029949 - DNA, 14 bp, Homo sapiens
cagattcccactgc

SEQ ID NO: 5029950 - DNA, 14 bp, Homo sapiens
cagattctgatgca

SEQ ID NO: 5029951 - DNA, 18 bp, Homo sapiens
cagcacaaggccttgcct

SEQ ID NO: 5029952 - DNA, 17 bp, Homo sapiens
cagcaccacactgggtg

SEQ ID NO: 5029953 - DNA, 14 bp, Homo sapiens
cagcactgcctgct

SEQ ID NO: 5029954 - DNA, 17 bp, Homo sapiens
cagcactgcctgctccc

SEQ ID NO: 5029955 - DNA, 15 bp, Homo sapiens
cagcagaagacaaaa

SEQ ID NO: 5029956 - DNA, 13 bp, Homo sapiens
cagcagagacggg

SEQ ID NO: 5029957 - DNA, 18 bp, Homo sapiens
cagcagagacttgggaca

SEQ ID NO: 5029958 - DNA, 21 bp, Homo sapiens
cagcagagacttgggacattg

SEQ ID NO: 5029959 - DNA, 16 bp, Homo sapiens
cagcagccactgcaca

SEQ ID NO: 5029960 - DNA, 17 bp, Homo sapiens
cagcaggatagagtggg

SEQ ID NO: 5029961 - DNA, 11 bp, Homo sapiens
cagccacccaa

SEQ ID NO: 5029962 - DNA, 14 bp, Homo sapiens
cagccacccaagcc

SEQ ID NO: 5029963 - DNA, 22 bp, Homo sapiens
cagccacccaagcctgctggct

SEQ ID NO: 5029964 - DNA, 15 bp, Homo sapiens
cagccactgcacagg

SEQ ID NO: 5029965 - DNA, 12 bp, Homo sapiens
cagccagtctca

SEQ ID NO: 5029966 - DNA, 17 bp, Homo sapiens
cagccccgccccgttgt

SEQ ID NO: 5029967 - DNA, 16 bp, Homo sapiens
cagccctggctgaagg

SEQ ID NO: 5029968 - DNA, 17 bp, Homo sapiens
cagccctggctgaagga

SEQ ID NO: 5029969 - DNA, 13 bp, Homo sapiens
cagccgtatttta

SEQ ID NO: 5029970 - DNA, 21 bp, Homo sapiens
cagcctagggctgagctgggg

SEQ ID NO: 5029971 - DNA, 13 bp, Homo sapiens
cagcctcccacaa

SEQ ID NO: 5029972 - DNA, 21 bp, Homo sapiens
cagcctccctattttttttct

SEQ ID NO: 5029973 - DNA, 18 bp, Homo sapiens
cagcctctcccctgcctg

SEQ ID NO: 5029974 - DNA, 20 bp, Homo sapiens
cagcctgggaaagcccctgc

SEQ ID NO: 5029975 - DNA, 17 bp, Homo sapiens
cagcgaccgccccctcc

SEQ ID NO: 5029976 - DNA, 20 bp, Homo sapiens
cagcgggcaggttctgcctg

SEQ ID NO: 5029977 - DNA, 15 bp, Homo sapiens
cagcgtcctgtccac

SEQ ID NO: 5029978 - DNA, 21 bp, Homo sapiens
cagctaccctttttctccagc

SEQ ID NO: 5029979 - DNA, 19 bp, Homo sapiens
cagctacttggtttgtgtt

SEQ ID NO: 5029980 - DNA, 14 bp, Homo sapiens
cagctcagcactgc

SEQ ID NO: 5029981 - DNA, 21 bp, Homo sapiens
cagctcagcactgcctgctcc

SEQ ID NO: 5029982 - DNA, 17 bp, Homo sapiens
cagctccaggtggctct

SEQ ID NO: 5029983 - DNA, 15 bp, Homo sapiens
cagctcccgctgtgg

SEQ ID NO: 5029984 - DNA, 20 bp, Homo sapiens
cagctcccgctgtggccgca

SEQ ID NO: 5029985 - DNA, 15 bp, Homo sapiens
cagctcctgtaacat

SEQ ID NO: 5029986 - DNA, 13 bp, Homo sapiens
cagctctctgacg

SEQ ID NO: 5029987 - DNA, 18 bp, Homo sapiens
cagctctctgacgcttgt

SEQ ID NO: 5029988 - DNA, 14 bp, Homo sapiens
cagctgctccccag

SEQ ID NO: 5029989 - DNA, 20 bp, Homo sapiens
cagctgctccccaggccacc

SEQ ID NO: 5029990 - DNA, 16 bp, Homo sapiens
cagctgggctctgcaa

SEQ ID NO: 5029991 - DNA, 19 bp, Homo sapiens
cagctgttttgttgacatt

SEQ ID NO: 5029992 - DNA, 23 bp, Homo sapiens
cagctgttttgttgacattctga

SEQ ID NO: 5029993 - DNA, 13 bp, Homo sapiens
cagcttatacgaa

SEQ ID NO: 5029994 - DNA, 23 bp, Homo sapiens
cagcttcagaaagagctcaaaat

SEQ ID NO: 5029995 - DNA, 23 bp, Homo sapiens
cagctttccccatgtctcgactc

SEQ ID NO: 5029996 - DNA, 15 bp, Homo sapiens
cagctttctgggatg

SEQ ID NO: 5029997 - DNA, 21 bp, Homo sapiens
cagctttctgggatgtcacag

SEQ ID NO: 5029998 - DNA, 14 bp, Homo sapiens
cagctttgatattt

SEQ ID NO: 5029999 - DNA, 11 bp, Homo sapiens
cagcttttcaa

SEQ ID NO: 5030000 - DNA, 15 bp, Homo sapiens
caggaactgggctgg

SEQ ID NO: 5030001 - DNA, 21 bp, Homo sapiens
caggaagcctgcagtcctgga

SEQ ID NO: 5030002 - DNA, 19 bp, Homo sapiens
caggagactgggctctggc

SEQ ID NO: 5030003 - DNA, 15 bp, Homo sapiens
caggaggaatactga

SEQ ID NO: 5030004 - DNA, 22 bp, Homo sapiens
caggaggccctggtcctggcct

SEQ ID NO: 5030005 - DNA, 15 bp, Homo sapiens
caggaggtggagaaa

SEQ ID NO: 5030006 - DNA, 17 bp, Homo sapiens
caggatagagtgggaca

SEQ ID NO: 5030007 - DNA, 13 bp, Homo sapiens
caggcagcaccac

SEQ ID NO: 5030008 - DNA, 20 bp, Homo sapiens
caggcagcaccacactgggt

SEQ ID NO: 5030009 - DNA, 18 bp, Homo sapiens
caggcattggctcagccc

SEQ ID NO: 5030010 - DNA, 18 bp, Homo sapiens
caggccaccccgctgatg

SEQ ID NO: 5030011 - DNA, 18 bp, Homo sapiens
caggccattccccgtctc

SEQ ID NO: 5030012 - DNA, 19 bp, Homo sapiens
caggcctcttggcagtcac

SEQ ID NO: 5030013 - DNA, 12 bp, Homo sapiens
caggcctgtcca

SEQ ID NO: 5030014 - DNA, 18 bp, Homo sapiens
caggcgggcccagaccgg

SEQ ID NO: 5030015 - DNA, 16 bp, Homo sapiens
caggcgtgagccacca

SEQ ID NO: 5030016 - DNA, 16 bp, Homo sapiens
caggctgtctggccag

SEQ ID NO: 5030017 - DNA, 17 bp, Homo sapiens
caggctgtctggccagg

SEQ ID NO: 5030018 - DNA, 16 bp, Homo sapiens
caggcttctgagcagc

SEQ ID NO: 5030019 - DNA, 21 bp, Homo sapiens
caggcttctgagcagcgagcc

SEQ ID NO: 5030020 - DNA, 11 bp, Homo sapiens
caggcttgggg

SEQ ID NO: 5030021 - DNA, 20 bp, Homo sapiens
caggcttggggaaaatggcc

SEQ ID NO: 5030022 - DNA, 19 bp, Homo sapiens
cagggacatgccctgtgtg

SEQ ID NO: 5030023 - DNA, 22 bp, Homo sapiens
cagggaccacaccctgtactgt

SEQ ID NO: 5030024 - DNA, 20 bp, Homo sapiens
cagggaccactgggtgagag

SEQ ID NO: 5030025 - DNA, 17 bp, Homo sapiens
cagggaggaaaagtgca

SEQ ID NO: 5030026 - DNA, 17 bp, Homo sapiens
ccagtgaacattcccag

SEQ ID NO: 5030027 - DNA, 18 bp, Homo sapiens
ccagtgaacattcccagc

SEQ ID NO: 5030028 - DNA, 15 bp, Homo sapiens
ccagtgcatatgcaa

SEQ ID NO: 5030029 - DNA, 21 bp, Homo sapiens
ccatagtatgggactggcctc

SEQ ID NO: 5030030 - DNA, 18 bp, Homo sapiens
ccatccagtgacaaacca

SEQ ID NO: 5030031 - DNA, 17 bp, Homo sapiens
ccatccctttttttaca

SEQ ID NO: 5030032 - DNA, 13 bp, Homo sapiens
ccatcctgtgtgt

SEQ ID NO: 5030033 - DNA, 14 bp, Homo sapiens
ccatcctgtgtgtt

SEQ ID NO: 5030034 - DNA, 20 bp, Homo sapiens
ccatctcgggcacaggccca

SEQ ID NO: 5030035 - DNA, 12 bp, Homo sapiens
ccatctgctcct

SEQ ID NO: 5030036 - DNA, 18 bp, Homo sapiens
ccatgacttgagaaacaa

SEQ ID NO: 5030037 - DNA, 18 bp, Homo sapiens
ccatgcagacctcatgcc

SEQ ID NO: 5030038 - DNA, 21 bp, Homo sapiens
ccatgcagacctcatgcccag

SEQ ID NO: 5030039 - DNA, 17 bp, Homo sapiens
ccatgcagctgctcccc

SEQ ID NO: 5030040 - DNA, 17 bp, Homo sapiens
ccatgtactagttttag

SEQ ID NO: 5030041 - DNA, 17 bp, Homo sapiens
ccatgtgtcctggttcc

SEQ ID NO: 5030042 - DNA, 16 bp, Homo sapiens
ccattaccatgtaatg

SEQ ID NO: 5030043 - DNA, 16 bp, Homo sapiens
ccattccaaagcttta

SEQ ID NO: 5030044 - DNA, 22 bp, Homo sapiens
ccattccaaagctttattacca

SEQ ID NO: 5030045 - DNA, 22 bp, Homo sapiens
ccattccagtcaaatctgggct

SEQ ID NO: 5030046 - DNA, 18 bp, Homo sapiens
ccattgttgtcaaggaag

SEQ ID NO: 5030047 - DNA, 21 bp, Homo sapiens
ccattgttgtcaaggaagaag

SEQ ID NO: 5030048 - DNA, 12 bp, Homo sapiens
ccatttgcattt

SEQ ID NO: 5030049 - DNA, 21 bp, Homo sapiens
cccaaacaccttccagctcct

SEQ ID NO: 5030050 - DNA, 20 bp, Homo sapiens
cccaacggccctgcagccag

SEQ ID NO: 5030051 - DNA, 21 bp, Homo sapiens
cccaagagaaggggaagcact

SEQ ID NO: 5030052 - DNA, 14 bp, Homo sapiens
cccacattaaagaa

SEQ ID NO: 5030053 - DNA, 14 bp, Homo sapiens
cccacccacccgcc

SEQ ID NO: 5030054 - DNA, 17 bp, Homo sapiens
cccaccccaccccaccc

SEQ ID NO: 5030055 - DNA, 23 bp, Homo sapiens
cccacccgccgcctcccacggca

SEQ ID NO: 5030056 - DNA, 17 bp, Homo sapiens
cccacctgttttctgaa

SEQ ID NO: 5030057 - DNA, 16 bp, Homo sapiens
cccactctgcctgcct

SEQ ID NO: 5030058 - DNA, 22 bp, Homo sapiens
cccactgccaggggttcttgag

SEQ ID NO: 5030059 - DNA, 17 bp, Homo sapiens
cccagacgatgtcttca

SEQ ID NO: 5030060 - DNA, 13 bp, Homo sapiens
cccagactctttt

SEQ ID NO: 5030061 - DNA, 20 bp, Homo sapiens
cccagagcgaggaaaggatt

SEQ ID NO: 5030062 - DNA, 15 bp, Homo sapiens
cccagcctctggcat

SEQ ID NO: 5030063 - DNA, 23 bp, Homo sapiens
cccagcggccccccgcacagcca

SEQ ID NO: 5030064 - DNA, 22 bp, Homo sapiens
cccagcgggcaggttctgcctg

SEQ ID NO: 5030065 - DNA, 16 bp, Homo sapiens
cccagctctctgacgc

SEQ ID NO: 5030066 - DNA, 16 bp, Homo sapiens
cccaggcctgtccacc

SEQ ID NO: 5030067 - DNA, 21 bp, Homo sapiens
cccaggcctgtccaccctgcc

SEQ ID NO: 5030068 - DNA, 19 bp, Homo sapiens
cccagggtgggaagggcta

SEQ ID NO: 5030069 - DNA, 15 bp, Homo sapiens
cccagtgccactgcc

SEQ ID NO: 5030070 - DNA, 18 bp, Homo sapiens
cccagtgccactgccccc

SEQ ID NO: 5030071 - DNA, 15 bp, Homo sapiens
cccatccctccccag

SEQ ID NO: 5030072 - DNA, 16 bp, Homo sapiens
cccatccctccccagt

SEQ ID NO: 5030073 - DNA, 22 bp, Homo sapiens
cccatcctgtgtgttaagctct

SEQ ID NO: 5030074 - DNA, 17 bp, Homo sapiens
cccatgtctcgactcat

SEQ ID NO: 5030075 - DNA, 18 bp, Homo sapiens
cccattccaaagctttat

SEQ ID NO: 5030076 - DNA, 18 bp, Homo sapiens
cccattctacacagagca

SEQ ID NO: 5030077 - DNA, 17 bp, Homo sapiens
cccattgttgtcaagga

SEQ ID NO: 5030078 - DNA, 19 bp, Homo sapiens
ccccaaaagcgtgagctta

SEQ ID NO: 5030079 - DNA, 22 bp, Homo sapiens
ccccaacaaaccatccagtgac

SEQ ID NO: 5030080 - DNA, 17 bp, Homo sapiens
ccccaccccaccccacc

SEQ ID NO: 5030081 - DNA, 17 bp, Homo sapiens
ccccacccccagctcaa

SEQ ID NO: 5030082 - DNA, 18 bp, Homo sapiens
ccccacccccgccatgca

SEQ ID NO: 5030083 - DNA, 13 bp, Homo sapiens
ccccaggccaccc

SEQ ID NO: 5030084 - DNA, 23 bp, Homo sapiens
ccccatgtgtcctggttcccgtt

SEQ ID NO: 5030085 - DNA, 22 bp, Homo sapiens
ccccccagactctttttttgag

SEQ ID NO: 5030086 - DNA, 12 bp, Homo sapiens
ccccccagcctc

SEQ ID NO: 5030087 - DNA, 13 bp, Homo sapiens
cccccctgtacac

SEQ ID NO: 5030088 - DNA, 15 bp, Homo sapiens
cccccgaggctgcta

SEQ ID NO: 5030089 - DNA, 14 bp, Homo sapiens
cccccgcacagcca

SEQ ID NO: 5030090 - DNA, 18 bp, Homo sapiens
cccccgcacagccacccg

SEQ ID NO: 5030091 - DNA, 21 bp, Homo sapiens
cccccgcacagccacccgtgg

SEQ ID NO: 5030092 - DNA, 15 bp, Homo sapiens
cccccgcctgccacc

SEQ ID NO: 5030093 - DNA, 12 bp, Homo sapiens
ccccctgtacac

SEQ ID NO: 5030094 - DNA, 20 bp, Homo sapiens
ccccctgtacacaactcact

SEQ ID NO: 5030095 - DNA, 14 bp, Homo sapiens
cccccttgagtggg

SEQ ID NO: 5030096 - DNA, 17 bp, Homo sapiens
ccccgaggagctgggcc

SEQ ID NO: 5030097 - DNA, 13 bp, Homo sapiens
ccccgaggctgct

SEQ ID NO: 5030098 - DNA, 14 bp, Homo sapiens
ccccgatgtcccct

SEQ ID NO: 5030099 - DNA, 19 bp, Homo sapiens
ccccgatgtcccctgcggg

SEQ ID NO: 5030100 - DNA, 13 bp, Homo sapiens
ccccgcacagcca

SEQ ID NO: 5030101 - DNA, 15 bp, Homo sapiens
ccccgcacagccacc

SEQ ID NO: 5030102 - DNA, 18 bp, Homo sapiens
ccccgcctgccctcatgg

SEQ ID NO: 5030103 - DNA, 14 bp, Homo sapiens
ccccgcttctgcct

SEQ ID NO: 5030104 - DNA, 18 bp, Homo sapiens
cccctcaaatcgtccagc

SEQ ID NO: 5030105 - DNA, 18 bp, Homo sapiens
cccctccccccagactct

SEQ ID NO: 5030106 - DNA, 17 bp, Homo sapiens
cccctcctctagctgtg

SEQ ID NO: 5030107 - DNA, 15 bp, Homo sapiens
cccctctgacctgca

SEQ ID NO: 5030108 - DNA, 17 bp, Homo sapiens
cccctgccccccagcct

SEQ ID NO: 5030109 - DNA, 18 bp, Homo sapiens
cccctgctgtctctctgg

SEQ ID NO: 5030110 - DNA, 19 bp, Homo sapiens
cccctggccccgcctgcct

SEQ ID NO: 5030111 - DNA, 14 bp, Homo sapiens
cccctggctctggg

SEQ ID NO: 5030112 - DNA, 15 bp, Homo sapiens
cccctggctctgggc

SEQ ID NO: 5030113 - DNA, 16 bp, Homo sapiens
cccctgtacacaactc

SEQ ID NO: 5030114 - DNA, 18 bp, Homo sapiens
ccccttgtcctttccctt

SEQ ID NO: 5030115 - DNA, 22 bp, Homo sapiens
cccctttcctggacactcagac

SEQ ID NO: 5030116 - DNA, 23 bp, Homo sapiens
cccctttcctggacactcagacc

SEQ ID NO: 5030117 - DNA, 14 bp, Homo sapiens
cccgaatacaaaca

SEQ ID NO: 5030118 - DNA, 20 bp, Homo sapiens
cccgaatacaaacacctgga

SEQ ID NO: 5030119 - DNA, 15 bp, Homo sapiens
cccgcacagccaccc

SEQ ID NO: 5030120 - DNA, 21 bp, Homo sapiens
cccgcaggaactgggctgggc

SEQ ID NO: 5030121 - DNA, 21 bp, Homo sapiens
cccgcagggccatgcagacct

SEQ ID NO: 5030122 - DNA, 17 bp, Homo sapiens
cccgctcagcccagctg

SEQ ID NO: 5030123 - DNA, 16 bp, Homo sapiens
cccgctgatggagccc

SEQ ID NO: 5030124 - DNA, 20 bp, Homo sapiens
cccgctgatggagccccacc

SEQ ID NO: 5030125 - DNA, 15 bp, Homo sapiens
cccgctgtggccgca

SEQ ID NO: 5030126 - DNA, 23 bp, Homo sapiens
cccggaagccaaacctctgtgag

SEQ ID NO: 5030127 - DNA, 15 bp, Homo sapiens
cccggccacacccag

SEQ ID NO: 5030128 - DNA, 16 bp, Homo sapiens
cccggccacacccagc

SEQ ID NO: 5030129 - DNA, 13 bp, Homo sapiens
cccggggcctgtt

SEQ ID NO: 5030130 - DNA, 18 bp, Homo sapiens
cccgggggcagggtgggg

SEQ ID NO: 5030131 - DNA, 13 bp, Homo sapiens
cccgtctcagtgt

SEQ ID NO: 5030132 - DNA, 22 bp, Homo sapiens
cccgtctctggttcctcccctc

SEQ ID NO: 5030133 - DNA, 21 bp, Homo sapiens
cccgtgcccccgcctgccacc

SEQ ID NO: 5030134 - DNA, 16 bp, Homo sapiens
cccgtttctccaccta

SEQ ID NO: 5030135 - DNA, 17 bp, Homo sapiens
ccctcatggcccctctg

SEQ ID NO: 5030136 - DNA, 14 bp, Homo sapiens
ccctcccacagcgc

SEQ ID NO: 5030137 - DNA, 14 bp, Homo sapiens
ccctccccacagtg

SEQ ID NO: 5030138 - DNA, 23 bp, Homo sapiens
ccctccccacagtgccacccatg

SEQ ID NO: 5030139 - DNA, 12 bp, Homo sapiens
ctccctcctgga

SEQ ID NO: 5030140 - DNA, 15 bp, Homo sapiens
ctccctcctggagct

SEQ ID NO: 5030141 - DNA, 20 bp, Homo sapiens
ctccctcctggagctctgtg

SEQ ID NO: 5030142 - DNA, 21 bp, Homo sapiens
ctccctcctggagctctgtgg

SEQ ID NO: 5030143 - DNA, 22 bp, Homo sapiens
ctccctgcactccctcctggag

SEQ ID NO: 5030144 - DNA, 11 bp, Homo sapiens
ctccctgggcc

SEQ ID NO: 5030145 - DNA, 19 bp, Homo sapiens
ctccgaaattccaaggccc

SEQ ID NO: 5030146 - DNA, 13 bp, Homo sapiens
ctccgaggccagt

SEQ ID NO: 5030147 - DNA, 18 bp, Homo sapiens
ctcctcagggttgaggtc

SEQ ID NO: 5030148 - DNA, 15 bp, Homo sapiens
ctcctcatcccgtgt

SEQ ID NO: 5030149 - DNA, 20 bp, Homo sapiens
ctcctcatgtacataccctg

SEQ ID NO: 5030150 - DNA, 19 bp, Homo sapiens
ctcctctagctgtgggggt

SEQ ID NO: 5030151 - DNA, 23 bp, Homo sapiens
ctcctgaaaaaaaacctgagatt

SEQ ID NO: 5030152 - DNA, 11 bp, Homo sapiens
ctcctggactc

SEQ ID NO: 5030153 - DNA, 22 bp, Homo sapiens
ctcctggctcttgatacccccc

SEQ ID NO: 5030154 - DNA, 16 bp, Homo sapiens
ctcctggtctgtgaag

SEQ ID NO: 5030155 - DNA, 22 bp, Homo sapiens
ctcctgtaacatactggcctgg

SEQ ID NO: 5030156 - DNA, 13 bp, Homo sapiens
ctcggccaggcat

SEQ ID NO: 5030157 - DNA, 16 bp, Homo sapiens
ctcggccaggcattgg

SEQ ID NO: 5030158 - DNA, 22 bp, Homo sapiens
ctcggctccccatgtgtcctgg

SEQ ID NO: 5030159 - DNA, 17 bp, Homo sapiens
ctcggcttggatcctgg

SEQ ID NO: 5030160 - DNA, 20 bp, Homo sapiens
ctcggcttggatcctgggct

SEQ ID NO: 5030161 - DNA, 11 bp, Homo sapiens
ctcgggtgggg

SEQ ID NO: 5030162 - DNA, 19 bp, Homo sapiens
ctcgtcctcgtttgtgttc

SEQ ID NO: 5030163 - DNA, 14 bp, Homo sapiens
ctctaaggttgggc

SEQ ID NO: 5030164 - DNA, 18 bp, Homo sapiens
ctctacatcttctgcctt

SEQ ID NO: 5030165 - DNA, 18 bp, Homo sapiens
ctctcaaatccctctcca

SEQ ID NO: 5030166 - DNA, 20 bp, Homo sapiens
ctctcaaccacctttcagat

SEQ ID NO: 5030167 - DNA, 13 bp, Homo sapiens
ctctcagaacata

SEQ ID NO: 5030168 - DNA, 13 bp, Homo sapiens
ctctcagctccag

SEQ ID NO: 5030169 - DNA, 16 bp, Homo sapiens
ctctcccctgcctgcc

SEQ ID NO: 5030170 - DNA, 13 bp, Homo sapiens
ctctccctgcact

SEQ ID NO: 5030171 - DNA, 15 bp, Homo sapiens
ctctcggccaggcat

SEQ ID NO: 5030172 - DNA, 15 bp, Homo sapiens
ctctcggctccccat

SEQ ID NO: 5030173 - DNA, 16 bp, Homo sapiens
ctctcggctccccatg

SEQ ID NO: 5030174 - DNA, 14 bp, Homo sapiens
ctctctctgtgggg

SEQ ID NO: 5030175 - DNA, 21 bp, Homo sapiens
ctctctgacgcttgtgacagt

SEQ ID NO: 5030176 - DNA, 12 bp, Homo sapiens
ctctctgggctg

SEQ ID NO: 5030177 - DNA, 17 bp, Homo sapiens
ctctctgtggggctgaa

SEQ ID NO: 5030178 - DNA, 20 bp, Homo sapiens
ctctgacttaagcaaaagaa

SEQ ID NO: 5030179 - DNA, 22 bp, Homo sapiens
ctctgaggtgcctgtcccaccc

SEQ ID NO: 5030180 - DNA, 13 bp, Homo sapiens
ctctgatgcagct

SEQ ID NO: 5030181 - DNA, 14 bp, Homo sapiens
ctctgatgcagctt

SEQ ID NO: 5030182 - DNA, 14 bp, Homo sapiens
ctctgcaactgctc

SEQ ID NO: 5030183 - DNA, 17 bp, Homo sapiens
ctctgcaatcttctcag

SEQ ID NO: 5030184 - DNA, 18 bp, Homo sapiens
ctctgcaatcttctcaga

SEQ ID NO: 5030185 - DNA, 18 bp, Homo sapiens
ctctgcaattcccctctg

SEQ ID NO: 5030186 - DNA, 19 bp, Homo sapiens
ctctgcagtttttcccaag

SEQ ID NO: 5030187 - DNA, 21 bp, Homo sapiens
ctctgcccccatttccccgat

SEQ ID NO: 5030188 - DNA, 22 bp, Homo sapiens
ctctgctgctgtccctccccct

SEQ ID NO: 5030189 - DNA, 20 bp, Homo sapiens
ctctggcattagaattattt

SEQ ID NO: 5030190 - DNA, 14 bp, Homo sapiens
ctctggctctgttc

SEQ ID NO: 5030191 - DNA, 18 bp, Homo sapiens
ctctgggtctcagtgtcc

SEQ ID NO: 5030192 - DNA, 18 bp, Homo sapiens
ctctggtggcttaagtga

SEQ ID NO: 5030193 - DNA, 15 bp, Homo sapiens
ctctgtaattgcaaa

SEQ ID NO: 5030194 - DNA, 21 bp, Homo sapiens
ctctgtaggcacagagctgca

SEQ ID NO: 5030195 - DNA, 19 bp, Homo sapiens
ctctgtccagctcccgctg

SEQ ID NO: 5030196 - DNA, 13 bp, Homo sapiens
ctctgtccccagc

SEQ ID NO: 5030197 - DNA, 16 bp, Homo sapiens
ctctgtccccagcctg

SEQ ID NO: 5030198 - DNA, 17 bp, Homo sapiens
ctctgtccccagcctgg

SEQ ID NO: 5030199 - DNA, 20 bp, Homo sapiens
ctctgtctaggactgcagtg

SEQ ID NO: 5030200 - DNA, 21 bp, Homo sapiens
ctctgtctaggactgcagtgt

SEQ ID NO: 5030201 - DNA, 22 bp, Homo sapiens
ctctgtctaggactgcagtgtg

SEQ ID NO: 5030202 - DNA, 21 bp, Homo sapiens
ctctgtgagcatcacagtttt

SEQ ID NO: 5030203 - DNA, 13 bp, Homo sapiens
ctctgtggggctg

SEQ ID NO: 5030204 - DNA, 18 bp, Homo sapiens
ctctgtgggtctctggaa

SEQ ID NO: 5030205 - DNA, 22 bp, Homo sapiens
ctctgttgtcaaactgaaattc

SEQ ID NO: 5030206 - DNA, 15 bp, Homo sapiens
ctcttagaacattgt

SEQ ID NO: 5030207 - DNA, 16 bp, Homo sapiens
ctcttcctatttttgt

SEQ ID NO: 5030208 - DNA, 19 bp, Homo sapiens
ctcttgatacccccctctg

SEQ ID NO: 5030209 - DNA, 23 bp, Homo sapiens
ctcttgatacccccctctgtctt

SEQ ID NO: 5030210 - DNA, 17 bp, Homo sapiens
ctctttaaaaactcact

SEQ ID NO: 5030211 - DNA, 16 bp, Homo sapiens
ctctttcacattgttt

SEQ ID NO: 5030212 - DNA, 14 bp, Homo sapiens
ctctttgagaaata

SEQ ID NO: 5030213 - DNA, 20 bp, Homo sapiens
ctgaaatttttcttcttgag

SEQ ID NO: 5030214 - DNA, 23 bp, Homo sapiens
ctgaacactccaattaaggattt

SEQ ID NO: 5030215 - DNA, 19 bp, Homo sapiens
ctgaacatctgagtcctgg

SEQ ID NO: 5030216 - DNA, 14 bp, Homo sapiens
ctgaaggactgtga

SEQ ID NO: 5030217 - DNA, 18 bp, Homo sapiens
ctgaagtgagcacagcct

SEQ ID NO: 5030218 - DNA, 23 bp, Homo sapiens
ctgaataccactctgtaattgca

SEQ ID NO: 5030219 - DNA, 13 bp, Homo sapiens
ctgaatgcttcta

SEQ ID NO: 5030220 - DNA, 17 bp, Homo sapiens
ctgaatgtttttctaaa

SEQ ID NO: 5030221 - DNA, 20 bp, Homo sapiens
ctgaatgtttttctaaagga

SEQ ID NO: 5030222 - DNA, 18 bp, Homo sapiens
ctgacaacagacttctga

SEQ ID NO: 5030223 - DNA, 19 bp, Homo sapiens
ctgacaacagacttctgaa

SEQ ID NO: 5030224 - DNA, 14 bp, Homo sapiens
ctgacatctctgca

SEQ ID NO: 5030225 - DNA, 17 bp, Homo sapiens
ctgacccggaggaaagg

SEQ ID NO: 5030226 - DNA, 14 bp, Homo sapiens
ctgacctgcactgg

SEQ ID NO: 5030227 - DNA, 18 bp, Homo sapiens
ctgacctgttgccagcag

SEQ ID NO: 5030228 - DNA, 15 bp, Homo sapiens
ctgacgcttgtgaca

SEQ ID NO: 5030229 - DNA, 23 bp, Homo sapiens
ctgacgcttgtgacagtgcctct

SEQ ID NO: 5030230 - DNA, 19 bp, Homo sapiens
ctgagattattttaatcta

SEQ ID NO: 5030231 - DNA, 12 bp, Homo sapiens
ctgagcaggcca

SEQ ID NO: 5030232 - DNA, 15 bp, Homo sapiens
ctgagcaggccacac

SEQ ID NO: 5030233 - DNA, 13 bp, Homo sapiens
ctgaggcccagtg

SEQ ID NO: 5030234 - DNA, 15 bp, Homo sapiens
ctgagtgccttttgg

SEQ ID NO: 5030235 - DNA, 17 bp, Homo sapiens
ctgagtgcttgcttttc

SEQ ID NO: 5030236 - DNA, 23 bp, Homo sapiens
ctgatccccaagacatgtggagg

SEQ ID NO: 5030237 - DNA, 19 bp, Homo sapiens
ctgatccgtccgaggctgc

SEQ ID NO: 5030238 - DNA, 20 bp, Homo sapiens
ctgatccgtccgaggctgct

SEQ ID NO: 5030239 - DNA, 16 bp, Homo sapiens
ctgatgcagcttatac

SEQ ID NO: 5030240 - DNA, 17 bp, Homo sapiens
ctgatggagccccacct

SEQ ID NO: 5030241 - DNA, 18 bp, Homo sapiens
ctgatggagccccacctt

SEQ ID NO: 5030242 - DNA, 20 bp, Homo sapiens
ctgcaattcccctctgctgc

SEQ ID NO: 5030243 - DNA, 12 bp, Homo sapiens
ctgcacacagga

SEQ ID NO: 5030244 - DNA, 18 bp, Homo sapiens
ctgcacacaggacagcgg

SEQ ID NO: 5030245 - DNA, 20 bp, Homo sapiens
ctgcacacgctccttcctct

SEQ ID NO: 5030246 - DNA, 20 bp, Homo sapiens
ctgcacaggcacacagggcc

SEQ ID NO: 5030247 - DNA, 21 bp, Homo sapiens
ctgcacaggcacacagggccc

SEQ ID NO: 5030248 - DNA, 16 bp, Homo sapiens
ctgcactggggagccc

SEQ ID NO: 5030249 - DNA, 17 bp, Homo sapiens
ctgcagagtctgcccca

SEQ ID NO: 5030250 - DNA, 14 bp, Homo sapiens
ctgcagccagctca

SEQ ID NO: 5030251 - DNA, 15 bp, Homo sapiens
ctgcagtttttccca

SEQ ID NO: 5030252 - DNA, 15 bp, Homo sapiens
ctttcacagctcctc

SEQ ID NO: 5030253 - DNA, 13 bp, Homo sapiens
ctttcatatagtt

SEQ ID NO: 5030254 - DNA, 23 bp, Homo sapiens
ctttcatatagttagctaataaa

SEQ ID NO: 5030255 - DNA, 12 bp, Homo sapiens
ctttccattaca

SEQ ID NO: 5030256 - DNA, 15 bp, Homo sapiens
ctttccccatgtctc

SEQ ID NO: 5030257 - DNA, 20 bp, Homo sapiens
ctttccccatgtctcgactc

SEQ ID NO: 5030258 - DNA, 13 bp, Homo sapiens
ctttctccctcaa

SEQ ID NO: 5030259 - DNA, 22 bp, Homo sapiens
ctttctccctcaactgaagggg

SEQ ID NO: 5030260 - DNA, 15 bp, Homo sapiens
ctttctccttgaata

SEQ ID NO: 5030261 - DNA, 21 bp, Homo sapiens
ctttctgggatgtcacagtcc

SEQ ID NO: 5030262 - DNA, 21 bp, Homo sapiens
ctttctttccaaaacatttct

SEQ ID NO: 5030263 - DNA, 18 bp, Homo sapiens
ctttcttttttggccatc

SEQ ID NO: 5030264 - DNA, 19 bp, Homo sapiens
ctttcttttttggccatct

SEQ ID NO: 5030265 - DNA, 20 bp, Homo sapiens
ctttgaaaagttggaaggat

SEQ ID NO: 5030266 - DNA, 14 bp, Homo sapiens
ctttgaagggcaag

SEQ ID NO: 5030267 - DNA, 18 bp, Homo sapiens
ctttgaaggggcctcacc

SEQ ID NO: 5030268 - DNA, 18 bp, Homo sapiens
ctttgagagagaaaggac

SEQ ID NO: 5030269 - DNA, 16 bp, Homo sapiens
ctttgcatctcagtat

SEQ ID NO: 5030270 - DNA, 18 bp, Homo sapiens
ctttgctttaatataaat

SEQ ID NO: 5030271 - DNA, 18 bp, Homo sapiens
ctttggacagaagcagct

SEQ ID NO: 5030272 - DNA, 21 bp, Homo sapiens
ctttggacagaagcagctctt

SEQ ID NO: 5030273 - DNA, 16 bp, Homo sapiens
ctttggagtcccctca

SEQ ID NO: 5030274 - DNA, 18 bp, Homo sapiens
ctttggagtcccctcacc

SEQ ID NO: 5030275 - DNA, 13 bp, Homo sapiens
ctttggctcccct

SEQ ID NO: 5030276 - DNA, 15 bp, Homo sapiens
ctttggctcccctgt

SEQ ID NO: 5030277 - DNA, 23 bp, Homo sapiens
ctttggtgccaactggtgtttga

SEQ ID NO: 5030278 - DNA, 14 bp, Homo sapiens
ctttgttttgtgtc

SEQ ID NO: 5030279 - DNA, 20 bp, Homo sapiens
cttttataggtgagaaaaaa

SEQ ID NO: 5030280 - DNA, 12 bp, Homo sapiens
cttttcacattt

SEQ ID NO: 5030281 - DNA, 21 bp, Homo sapiens
cttttcccatttatctaaata

SEQ ID NO: 5030282 - DNA, 17 bp, Homo sapiens
cttttctttaaagaagt

SEQ ID NO: 5030283 - DNA, 18 bp, Homo sapiens
cttttctttaaagaagtt

SEQ ID NO: 5030284 - DNA, 22 bp, Homo sapiens
cttttgataatcaactgggctg

SEQ ID NO: 5030285 - DNA, 23 bp, Homo sapiens
cttttgataatcaactgggctga

SEQ ID NO: 5030286 - DNA, 13 bp, Homo sapiens
cttttgccattga

SEQ ID NO: 5030287 - DNA, 17 bp, Homo sapiens
cttttgcccattttgaa

SEQ ID NO: 5030288 - DNA, 13 bp, Homo sapiens
cttttggttaagt

SEQ ID NO: 5030289 - DNA, 16 bp, Homo sapiens
cttttggttaagtctg

SEQ ID NO: 5030290 - DNA, 11 bp, Homo sapiens
cttttgtctac

SEQ ID NO: 5030291 - DNA, 15 bp, Homo sapiens
ctttttcactttgaa

SEQ ID NO: 5030292 - DNA, 13 bp, Homo sapiens
ctttttttgtata

SEQ ID NO: 5030293 - DNA, 18 bp, Homo sapiens
gaaaaaaaacctgagatt

SEQ ID NO: 5030294 - DNA, 13 bp, Homo sapiens
gaaaaaaatgtat

SEQ ID NO: 5030295 - DNA, 19 bp, Homo sapiens
gaaaaaaatgtattttatg

SEQ ID NO: 5030296 - DNA, 20 bp, Homo sapiens
gaaaaaaatgtattttatgt

SEQ ID NO: 5030297 - DNA, 12 bp, Homo sapiens
gaaaaaaattga

SEQ ID NO: 5030298 - DNA, 14 bp, Homo sapiens
gaaaaaaattgaaa

SEQ ID NO: 5030299 - DNA, 16 bp, Homo sapiens
gaaaaaaattgaaatg

SEQ ID NO: 5030300 - DNA, 13 bp, Homo sapiens
gaaaaataaagaa

SEQ ID NO: 5030301 - DNA, 15 bp, Homo sapiens
gaaaaccagctcagc

SEQ ID NO: 5030302 - DNA, 22 bp, Homo sapiens
gaaaagatgcactttgctttaa

SEQ ID NO: 5030303 - DNA, 16 bp, Homo sapiens
gaaaagttggaaggat

SEQ ID NO: 5030304 - DNA, 22 bp, Homo sapiens
gaaaatgttttacattccattt

SEQ ID NO: 5030305 - DNA, 11 bp, Homo sapiens
gaaacacacga

SEQ ID NO: 5030306 - DNA, 16 bp, Homo sapiens
gaaacacccctctgtc

SEQ ID NO: 5030307 - DNA, 22 bp, Homo sapiens
gaaacacccctctgtctaggac

SEQ ID NO: 5030308 - DNA, 15 bp, Homo sapiens
gaaacagctcgactt

SEQ ID NO: 5030309 - DNA, 20 bp, Homo sapiens
gaaacagctcgactttaaaa

SEQ ID NO: 5030310 - DNA, 12 bp, Homo sapiens
gaaacatttcct

SEQ ID NO: 5030311 - DNA, 13 bp, Homo sapiens
gaaaccagaaaag

SEQ ID NO: 5030312 - DNA, 21 bp, Homo sapiens
gaaactgcttgtttcctagca

SEQ ID NO: 5030313 - DNA, 23 bp, Homo sapiens
gaaagcccctgcccctcctctcc

SEQ ID NO: 5030314 - DNA, 12 bp, Homo sapiens
gaaaggatttta

SEQ ID NO: 5030315 - DNA, 15 bp, Homo sapiens
gaaagtctgtccttg

SEQ ID NO: 5030316 - DNA, 16 bp, Homo sapiens
gaaagtctgtccttga

SEQ ID NO: 5030317 - DNA, 23 bp, Homo sapiens
gaaagtctgtccttgaaggacta

SEQ ID NO: 5030318 - DNA, 20 bp, Homo sapiens
gaaagttgacatgggtgggg

SEQ ID NO: 5030319 - DNA, 16 bp, Homo sapiens
gaaagtttacaggaaa

SEQ ID NO: 5030320 - DNA, 13 bp, Homo sapiens
gaaataattgttg

SEQ ID NO: 5030321 - DNA, 15 bp, Homo sapiens
gaaatactatttaaa

SEQ ID NO: 5030322 - DNA, 21 bp, Homo sapiens
gaaatgaggtctgtttaaagt

SEQ ID NO: 5030323 - DNA, 17 bp, Homo sapiens
gaaatggcgtctgctct

SEQ ID NO: 5030324 - DNA, 14 bp, Homo sapiens
gaaatgtaaggctg

SEQ ID NO: 5030325 - DNA, 16 bp, Homo sapiens
gaaattggaagagcac

SEQ ID NO: 5030326 - DNA, 22 bp, Homo sapiens
gaaatttaaagcaggttcttgt

SEQ ID NO: 5030327 - DNA, 18 bp, Homo sapiens
gaaatttagcattgtagt

SEQ ID NO: 5030328 - DNA, 15 bp, Homo sapiens
gaaatttttcttctt

SEQ ID NO: 5030329 - DNA, 17 bp, Homo sapiens
gaacaagagaagcattc

SEQ ID NO: 5030330 - DNA, 13 bp, Homo sapiens
gaacagctgtgtc

SEQ ID NO: 5030331 - DNA, 15 bp, Homo sapiens
gaacagctgtgtctg

SEQ ID NO: 5030332 - DNA, 17 bp, Homo sapiens
gaacatactgattggga

SEQ ID NO: 5030333 - DNA, 19 bp, Homo sapiens
gaacatccaaaatcttgat

SEQ ID NO: 5030334 - DNA, 17 bp, Homo sapiens
gaacatctgagtcctgg

SEQ ID NO: 5030335 - DNA, 18 bp, Homo sapiens
gaacattcccagcccagc

SEQ ID NO: 5030336 - DNA, 22 bp, Homo sapiens
gaaccaggagaagggctggggc

SEQ ID NO: 5030337 - DNA, 15 bp, Homo sapiens
gaacctgcacacagg

SEQ ID NO: 5030338 - DNA, 22 bp, Homo sapiens
gaacctgcacacaggacagcgg

SEQ ID NO: 5030339 - DNA, 16 bp, Homo sapiens
gaactccttccccact

SEQ ID NO: 5030340 - DNA, 17 bp, Homo sapiens
gaactctactcaaccca

SEQ ID NO: 5030341 - DNA, 20 bp, Homo sapiens
gaagaaatctttctccctca

SEQ ID NO: 5030342 - DNA, 23 bp, Homo sapiens
gaagagcccgcagggccatgcag

SEQ ID NO: 5030343 - DNA, 15 bp, Homo sapiens
gaagcaacagcttca

SEQ ID NO: 5030344 - DNA, 16 bp, Homo sapiens
gaagcattctcattgg

SEQ ID NO: 5030345 - DNA, 15 bp, Homo sapiens
gaagcattttataaa

SEQ ID NO: 5030346 - DNA, 11 bp, Homo sapiens
gaagcctttgt

SEQ ID NO: 5030347 - DNA, 16 bp, Homo sapiens
gaagctagtcttttgc

SEQ ID NO: 5030348 - DNA, 23 bp, Homo sapiens
gaaggactgtgacaggcagcaga

SEQ ID NO: 5030349 - DNA, 15 bp, Homo sapiens
gaaggcaaatgactt

SEQ ID NO: 5030350 - DNA, 21 bp, Homo sapiens
gaaggcagggggaaggtgggg

SEQ ID NO: 5030351 - DNA, 21 bp, Homo sapiens
gaaggcagtagttttcaaaac

SEQ ID NO: 5030352 - DNA, 23 bp, Homo sapiens
gaagggctggggccggggctgag

SEQ ID NO: 5030353 - DNA, 16 bp, Homo sapiens
gaagggtcctgccggt

SEQ ID NO: 5030354 - DNA, 16 bp, Homo sapiens
gaagtctctgaagtga

SEQ ID NO: 5030355 - DNA, 14 bp, Homo sapiens
gaagtgaaactgct

SEQ ID NO: 5030356 - DNA, 21 bp, Homo sapiens
gaagtgcttagtgtacttgga

SEQ ID NO: 5030357 - DNA, 17 bp, Homo sapiens
gaagttgaagtttagga

SEQ ID NO: 5030358 - DNA, 15 bp, Homo sapiens
gaataccactctgta

SEQ ID NO: 5030359 - DNA, 16 bp, Homo sapiens
gaataccactctgtaa

SEQ ID NO: 5030360 - DNA, 16 bp, Homo sapiens
gaatatccatgtactt

SEQ ID NO: 5030361 - DNA, 14 bp, Homo sapiens
gaatcaaacatttt

SEQ ID NO: 5030362 - DNA, 15 bp, Homo sapiens
gaatgaaatactgtt

SEQ ID NO: 5030363 - DNA, 14 bp, Homo sapiens
gaatgatttttctt

SEQ ID NO: 5030364 - DNA, 14 bp, Homo sapiens
gaatgcttctaagt

SEQ ID NO: 5030365 - DNA, 12 bp, Homo sapiens
gaatgtgtcttt

SEQ ID NO: 5030366 - DNA, 20 bp, Homo sapiens
gccttttccctctttggctc

SEQ ID NO: 5030367 - DNA, 14 bp, Homo sapiens
gccttttctagccc

SEQ ID NO: 5030368 - DNA, 13 bp, Homo sapiens
gcgaccgccccct

SEQ ID NO: 5030369 - DNA, 14 bp, Homo sapiens
gcgaccgccccctc

SEQ ID NO: 5030370 - DNA, 23 bp, Homo sapiens
gcgaccttcctcatccaccccat

SEQ ID NO: 5030371 - DNA, 12 bp, Homo sapiens
gcgagcctgcta

SEQ ID NO: 5030372 - DNA, 22 bp, Homo sapiens
gcgctgtttttgttgtgtgtgc

SEQ ID NO: 5030373 - DNA, 21 bp, Homo sapiens
gcggaaagtgagagccagcag

SEQ ID NO: 5030374 - DNA, 17 bp, Homo sapiens
gcggaggggacagagcg

SEQ ID NO: 5030375 - DNA, 14 bp, Homo sapiens
gcggcgggcggctg

SEQ ID NO: 5030376 - DNA, 16 bp, Homo sapiens
gcggctggggtcccag

SEQ ID NO: 5030377 - DNA, 22 bp, Homo sapiens
gcggctggggtcccagcagctg

SEQ ID NO: 5030378 - DNA, 13 bp, Homo sapiens
gcgtcctgtccac

SEQ ID NO: 5030379 - DNA, 19 bp, Homo sapiens
gcgtcctgtccacacccag

SEQ ID NO: 5030380 - DNA, 24 bp, Homo sapiens
gcgtcctgtccacacccagctcag

SEQ ID NO: 5030381 - DNA, 15 bp, Homo sapiens
gcgtgtgcaggagcg

SEQ ID NO: 5030382 - DNA, 16 bp, Homo sapiens
gcgttcttgtaatttt

SEQ ID NO: 5030383 - DNA, 13 bp, Homo sapiens
gctaaataaacat

SEQ ID NO: 5030384 - DNA, 16 bp, Homo sapiens
gctaatttaaagagac

SEQ ID NO: 5030385 - DNA, 19 bp, Homo sapiens
gctaccctttttctccagc

SEQ ID NO: 5030386 - DNA, 22 bp, Homo sapiens
gctaccctttttctccagctgg

SEQ ID NO: 5030387 - DNA, 19 bp, Homo sapiens
gctacttcctcctccccac

SEQ ID NO: 5030388 - DNA, 15 bp, Homo sapiens
gctacttggtttgtg

SEQ ID NO: 5030389 - DNA, 16 bp, Homo sapiens
gctaggggctggggcc

SEQ ID NO: 5030390 - DNA, 17 bp, Homo sapiens
gctagtcttttgctttt

SEQ ID NO: 5030391 - DNA, 20 bp, Homo sapiens
gctatagatgtcttttccca

SEQ ID NO: 5030392 - DNA, 13 bp, Homo sapiens
gctatttttctaa

SEQ ID NO: 5030393 - DNA, 15 bp, Homo sapiens
gctcaagcagcgacc

SEQ ID NO: 5030394 - DNA, 21 bp, Homo sapiens
gctcaagcagcgaccgccccc

SEQ ID NO: 5030395 - DNA, 23 bp, Homo sapiens
gctcaagcagcgaccgccccctc

SEQ ID NO: 5030396 - DNA, 22 bp, Homo sapiens
gctcagcactgcctgctcccat

SEQ ID NO: 5030397 - DNA, 20 bp, Homo sapiens
gctcagctctggtccaggcc

SEQ ID NO: 5030398 - DNA, 17 bp, Homo sapiens
gctcagtggggcagagg

SEQ ID NO: 5030399 - DNA, 23 bp, Homo sapiens
gctcattttgacaaagtgcctca

SEQ ID NO: 5030400 - DNA, 14 bp, Homo sapiens
gctccagattctga

SEQ ID NO: 5030401 - DNA, 16 bp, Homo sapiens
gctccaggtggctctg

SEQ ID NO: 5030402 - DNA, 22 bp, Homo sapiens
gctccattttcttattgcgctg

SEQ ID NO: 5030403 - DNA, 13 bp, Homo sapiens
gctcccacagaac

SEQ ID NO: 5030404 - DNA, 17 bp, Homo sapiens
gctcccatcctgtgtgt

SEQ ID NO: 5030405 - DNA, 16 bp, Homo sapiens
gctccccaggccaccc

SEQ ID NO: 5030406 - DNA, 14 bp, Homo sapiens
gctcccgctgtggc

SEQ ID NO: 5030407 - DNA, 16 bp, Homo sapiens
gctcccttccctccat

SEQ ID NO: 5030408 - DNA, 11 bp, Homo sapiens
gctcctcccac

SEQ ID NO: 5030409 - DNA, 13 bp, Homo sapiens
gctccttcccatc

SEQ ID NO: 5030410 - DNA, 18 bp, Homo sapiens
gctccttcctctgaggct

SEQ ID NO: 5030411 - DNA, 20 bp, Homo sapiens
gctccttcctctgaggctga

SEQ ID NO: 5030412 - DNA, 16 bp, Homo sapiens
gctctacatcttctgc

SEQ ID NO: 5030413 - DNA, 17 bp, Homo sapiens
gctctacatcttctgcc

SEQ ID NO: 5030414 - DNA, 19 bp, Homo sapiens
gctctacatcttctgcctt

SEQ ID NO: 5030415 - DNA, 20 bp, Homo sapiens
gctctacatcttctgcctta

SEQ ID NO: 5030416 - DNA, 16 bp, Homo sapiens
gctctcagcctcccac

SEQ ID NO: 5030417 - DNA, 18 bp, Homo sapiens
gctctcagcctcccacaa

SEQ ID NO: 5030418 - DNA, 17 bp, Homo sapiens
gctctctgacgcttgtg

SEQ ID NO: 5030419 - DNA, 18 bp, Homo sapiens
gctctctgacgcttgtga

SEQ ID NO: 5030420 - DNA, 19 bp, Homo sapiens
gctctctgacgcttgtgac

SEQ ID NO: 5030421 - DNA, 17 bp, Homo sapiens
gctctgcaattcccctc

SEQ ID NO: 5030422 - DNA, 22 bp, Homo sapiens
gctctgctattaggccagcaag

SEQ ID NO: 5030423 - DNA, 21 bp, Homo sapiens
gctctgggccgggcctggggc

SEQ ID NO: 5030424 - DNA, 23 bp, Homo sapiens
gctctggtggcttaagtgagcag

SEQ ID NO: 5030425 - DNA, 14 bp, Homo sapiens
gctctgtccccagc

SEQ ID NO: 5030426 - DNA, 17 bp, Homo sapiens
gctctgtccccagcctg

SEQ ID NO: 5030427 - DNA, 20 bp, Homo sapiens
gctcttgatacccccctctg

SEQ ID NO: 5030428 - DNA, 22 bp, Homo sapiens
gctcttgatacccccctctgtc

SEQ ID NO: 5030429 - DNA, 20 bp, Homo sapiens
gctgaacactccaattaagg

SEQ ID NO: 5030430 - DNA, 12 bp, Homo sapiens
gctgaaggactg

SEQ ID NO: 5030431 - DNA, 14 bp, Homo sapiens
gctgaaggactgtg

SEQ ID NO: 5030432 - DNA, 17 bp, Homo sapiens
gctgaatgtttttctaa

SEQ ID NO: 5030433 - DNA, 19 bp, Homo sapiens
gctgacagtttgtggcatc

SEQ ID NO: 5030434 - DNA, 14 bp, Homo sapiens
gctgagaaggcagt

SEQ ID NO: 5030435 - DNA, 13 bp, Homo sapiens
gctgagctgggga

SEQ ID NO: 5030436 - DNA, 17 bp, Homo sapiens
gctgaggcccagtgcat

SEQ ID NO: 5030437 - DNA, 19 bp, Homo sapiens
gctgaggcccagtgcatat

SEQ ID NO: 5030438 - DNA, 21 bp, Homo sapiens
gctgagggtgcccttttccag

SEQ ID NO: 5030439 - DNA, 22 bp, Homo sapiens
gctgagtggggggtcgtgggcc

SEQ ID NO: 5030440 - DNA, 12 bp, Homo sapiens
gctgccccagcc

SEQ ID NO: 5030441 - DNA, 22 bp, Homo sapiens
gctgccgacttggagactcctg

SEQ ID NO: 5030442 - DNA, 15 bp, Homo sapiens
gctgccgcaccagcc

SEQ ID NO: 5030443 - DNA, 23 bp, Homo sapiens
gctgctaatattttcctcctgag

SEQ ID NO: 5030444 - DNA, 16 bp, Homo sapiens
gctgcttccaggctgg

SEQ ID NO: 5030445 - DNA, 17 bp, Homo sapiens
gctgcttccaggctggg

SEQ ID NO: 5030446 - DNA, 14 bp, Homo sapiens
gctggatagacttg

SEQ ID NO: 5030447 - DNA, 20 bp, Homo sapiens
gctggatagacttgggatgg

SEQ ID NO: 5030448 - DNA, 16 bp, Homo sapiens
gctggccaaagagcct

SEQ ID NO: 5030449 - DNA, 21 bp, Homo sapiens
gctgggcagcacaaggccttg

SEQ ID NO: 5030450 - DNA, 19 bp, Homo sapiens
gctggggccaaataaagtc

SEQ ID NO: 5030451 - DNA, 18 bp, Homo sapiens
gctggggccggggctgag

SEQ ID NO: 5030452 - DNA, 14 bp, Homo sapiens
gctggggtcccagc

SEQ ID NO: 5030453 - DNA, 15 bp, Homo sapiens
gctgtccctccccct

SEQ ID NO: 5030454 - DNA, 12 bp, Homo sapiens
gctgtctctctg

SEQ ID NO: 5030455 - DNA, 13 bp, Homo sapiens
gctgtctctctgg

SEQ ID NO: 5030456 - DNA, 15 bp, Homo sapiens
gctgtctctctgggc

SEQ ID NO: 5030457 - DNA, 19 bp, Homo sapiens
gctgtctctctgggctgca

SEQ ID NO: 5030458 - DNA, 19 bp, Homo sapiens
gctgttggtcctctctctg

SEQ ID NO: 5030459 - DNA, 18 bp, Homo sapiens
gctgtttgtagtgaaata

SEQ ID NO: 5030460 - DNA, 13 bp, Homo sapiens
gcttaaaatacaa

SEQ ID NO: 5030461 - DNA, 18 bp, Homo sapiens
gcttaagtgagcagaaca

SEQ ID NO: 5030462 - DNA, 19 bp, Homo sapiens
gcttagcagtccccttccc

SEQ ID NO: 5030463 - DNA, 17 bp, Homo sapiens
gcttatacgaaataatt

SEQ ID NO: 5030464 - DNA, 15 bp, Homo sapiens
gcttatgaaaagaat

SEQ ID NO: 5030465 - DNA, 22 bp, Homo sapiens
gcttcaatcggcttgtgggtga

SEQ ID NO: 5030466 - DNA, 16 bp, Homo sapiens
gcttcccagaggagca

SEQ ID NO: 5030467 - DNA, 16 bp, Homo sapiens
gcttctaagtaaatac

SEQ ID NO: 5030468 - DNA, 20 bp, Homo sapiens
gcttctaagtaaatacaatt

SEQ ID NO: 5030469 - DNA, 22 bp, Homo sapiens
gcttctgagcagcgagcctgct

SEQ ID NO: 5030470 - DNA, 20 bp, Homo sapiens
gcttctggaatttgttcaag

SEQ ID NO: 5030471 - DNA, 21 bp, Homo sapiens
gcttgccccactctgcctgcc

SEQ ID NO: 5030472 - DNA, 21 bp, Homo sapiens
gcttgctccagattctgatgc

SEQ ID NO: 5030473 - DNA, 22 bp, Homo sapiens
gcttgctccagattctgatgca

SEQ ID NO: 5030474 - DNA, 14 bp, Homo sapiens
gcttgcttttcatg

SEQ ID NO: 5030475 - DNA, 22 bp, Homo sapiens
gcttgtgacagtgcctcttcca

SEQ ID NO: 5030476 - DNA, 12 bp, Homo sapiens
gctttaatataa

SEQ ID NO: 5030477 - DNA, 15 bp, Homo sapiens
gctttatgtaataat

SEQ ID NO: 5030478 - DNA, 22 bp, Homo sapiens
gctttccccatgtctcgactca

SEQ ID NO: 5030479 - DNA, 19 bp, Homo sapiens
gtaaacagatggcactttg

SEQ ID NO: 5030480 - DNA, 20 bp, Homo sapiens
gtaaacagatggcactttga

SEQ ID NO: 5030481 - DNA, 19 bp, Homo sapiens
gtaaatacaatttttttta

SEQ ID NO: 5030482 - DNA, 23 bp, Homo sapiens
gtaaatataaagacgttttataa

SEQ ID NO: 5030483 - DNA, 22 bp, Homo sapiens
gtaaattacagtaatcccattt

SEQ ID NO: 5030484 - DNA, 19 bp, Homo sapiens
gtaaattggcatggaaatt

SEQ ID NO: 5030485 - DNA, 21 bp, Homo sapiens
gtaagatttgtttttaaactg

SEQ ID NO: 5030486 - DNA, 17 bp, Homo sapiens
gtaagtgttctcatgaa

SEQ ID NO: 5030487 - DNA, 22 bp, Homo sapiens
gtacagtatgggggttgtaaat

SEQ ID NO: 5030488 - DNA, 15 bp, Homo sapiens
gtacagtgtcttttt

SEQ ID NO: 5030489 - DNA, 18 bp, Homo sapiens
gtacatttcaccatggcc

SEQ ID NO: 5030490 - DNA, 22 bp, Homo sapiens
gtaccccctcaaaccctgccct

SEQ ID NO: 5030491 - DNA, 17 bp, Homo sapiens
gtaccctctcagctcca

SEQ ID NO: 5030492 - DNA, 15 bp, Homo sapiens
gtacctgattgtatt

SEQ ID NO: 5030493 - DNA, 16 bp, Homo sapiens
gtacctgggcaagctg

SEQ ID NO: 5030494 - DNA, 21 bp, Homo sapiens
gtaccttttgaggagccccag

SEQ ID NO: 5030495 - DNA, 23 bp, Homo sapiens
gtaccttttgaggagccccagct

SEQ ID NO: 5030496 - DNA, 15 bp, Homo sapiens
gtactagtgttctgt

SEQ ID NO: 5030497 - DNA, 15 bp, Homo sapiens
gtactgttctgtgtc

SEQ ID NO: 5030498 - DNA, 19 bp, Homo sapiens
gtacttagagtttctgttt

SEQ ID NO: 5030499 - DNA, 20 bp, Homo sapiens
gtacttagagtttctgtttg

SEQ ID NO: 5030500 - DNA, 21 bp, Homo sapiens
gtacttggagtattggggtct

SEQ ID NO: 5030501 - DNA, 20 bp, Homo sapiens
gtactttgtcccgtggcatt

SEQ ID NO: 5030502 - DNA, 18 bp, Homo sapiens
gtagcgtctttctttttt

SEQ ID NO: 5030503 - DNA, 15 bp, Homo sapiens
gtaggcacagagctg

SEQ ID NO: 5030504 - DNA, 15 bp, Homo sapiens
gtaggcagaggctgc

SEQ ID NO: 5030505 - DNA, 18 bp, Homo sapiens
gtaggggagggcaggctt

SEQ ID NO: 5030506 - DNA, 20 bp, Homo sapiens
gtaggggagggcaggcttgg

SEQ ID NO: 5030507 - DNA, 17 bp, Homo sapiens
gtagttttttcatcttc

SEQ ID NO: 5030508 - DNA, 23 bp, Homo sapiens
gtagttttttttttttttatgtg

SEQ ID NO: 5030509 - DNA, 23 bp, Homo sapiens
gtataaacaagaaaaataaagaa

SEQ ID NO: 5030510 - DNA, 18 bp, Homo sapiens
gtataattaattgtcatt

SEQ ID NO: 5030511 - DNA, 15 bp, Homo sapiens
gtatattttcctata

SEQ ID NO: 5030512 - DNA, 19 bp, Homo sapiens
gtatgatcggcaggacacc

SEQ ID NO: 5030513 - DNA, 16 bp, Homo sapiens
gtatgggactggcctc

SEQ ID NO: 5030514 - DNA, 22 bp, Homo sapiens
gtatggtaggggagggcaggct

SEQ ID NO: 5030515 - DNA, 23 bp, Homo sapiens
gtattttaaaatagcgttcttgt

SEQ ID NO: 5030516 - DNA, 17 bp, Homo sapiens
gtattttatgttatata

SEQ ID NO: 5030517 - DNA, 13 bp, Homo sapiens
gtattttcaatag

SEQ ID NO: 5030518 - DNA, 22 bp, Homo sapiens
gtattttttttttaaataaaag

SEQ ID NO: 5030519 - DNA, 21 bp, Homo sapiens
gtcacagtccaaccagaaaca

SEQ ID NO: 5030520 - DNA, 19 bp, Homo sapiens
gtcacctagcaagctgccg

SEQ ID NO: 5030521 - DNA, 21 bp, Homo sapiens
gtcagtgtacacgtctggacc

SEQ ID NO: 5030522 - DNA, 21 bp, Homo sapiens
gtcatctgtaagagcttgctc

SEQ ID NO: 5030523 - DNA, 20 bp, Homo sapiens
gtcatggtggccacggccac

SEQ ID NO: 5030524 - DNA, 17 bp, Homo sapiens
gtcattatttttgttag

SEQ ID NO: 5030525 - DNA, 14 bp, Homo sapiens
gtcatttaaatgtg

SEQ ID NO: 5030526 - DNA, 15 bp, Homo sapiens
gtccagagtagtttc

SEQ ID NO: 5030527 - DNA, 14 bp, Homo sapiens
gtccagccctggct

SEQ ID NO: 5030528 - DNA, 23 bp, Homo sapiens
gtccagccctggctgaaggactg

SEQ ID NO: 5030529 - DNA, 23 bp, Homo sapiens
gtccagctcccgctgtggccgca

SEQ ID NO: 5030530 - DNA, 17 bp, Homo sapiens
gtccaggccctgtggca

SEQ ID NO: 5030531 - DNA, 12 bp, Homo sapiens
gtcccacccacc

SEQ ID NO: 5030532 - DNA, 13 bp, Homo sapiens
gtcccacccaccc

SEQ ID NO: 5030533 - DNA, 22 bp, Homo sapiens
gtcccacccccacccccagctc

SEQ ID NO: 5030534 - DNA, 23 bp, Homo sapiens
gtcccacccccacccccagctca

SEQ ID NO: 5030535 - DNA, 12 bp, Homo sapiens
gtcccagcagct

SEQ ID NO: 5030536 - DNA, 15 bp, Homo sapiens
gtcccagcagctgcc

SEQ ID NO: 5030537 - DNA, 12 bp, Homo sapiens
gtccccagcaga

SEQ ID NO: 5030538 - DNA, 14 bp, Homo sapiens
gtccccagcagaga

SEQ ID NO: 5030539 - DNA, 16 bp, Homo sapiens
gtccccgaggagctgg

SEQ ID NO: 5030540 - DNA, 17 bp, Homo sapiens
gtccccgaggagctggg

SEQ ID NO: 5030541 - DNA, 19 bp, Homo sapiens
gtccccgaggagctgggcc

SEQ ID NO: 5030542 - DNA, 23 bp, Homo sapiens
gtccccgaggagctgggcccctg

SEQ ID NO: 5030543 - DNA, 16 bp, Homo sapiens
gtcccgcactctgccc

SEQ ID NO: 5030544 - DNA, 17 bp, Homo sapiens
gtcccgcactctgcccc

SEQ ID NO: 5030545 - DNA, 16 bp, Homo sapiens
gtccctcccccttgtc

SEQ ID NO: 5030546 - DNA, 17 bp, Homo sapiens
gtccgtggttgccctag

SEQ ID NO: 5030547 - DNA, 13 bp, Homo sapiens
gtcctctctctgt

SEQ ID NO: 5030548 - DNA, 14 bp, Homo sapiens
gtcctctctctgtg

SEQ ID NO: 5030549 - DNA, 19 bp, Homo sapiens
gtcctgccggtgggaccct

SEQ ID NO: 5030550 - DNA, 15 bp, Homo sapiens
gtccttagtggaggg

SEQ ID NO: 5030551 - DNA, 19 bp, Homo sapiens
gtcctttttcactttgaaa

SEQ ID NO: 5030552 - DNA, 21 bp, Homo sapiens
gtcctttttcactttgaaaag

SEQ ID NO: 5030553 - DNA, 13 bp, Homo sapiens
gtcgagagctggc

SEQ ID NO: 5030554 - DNA, 15 bp, Homo sapiens
gtctaggactgcagt

SEQ ID NO: 5030555 - DNA, 13 bp, Homo sapiens
gtctataaagcat

SEQ ID NO: 5030556 - DNA, 15 bp, Homo sapiens
gtctataaagcattt

SEQ ID NO: 5030557 - DNA, 14 bp, Homo sapiens
gtctattatcacat

SEQ ID NO: 5030558 - DNA, 17 bp, Homo sapiens
gtctattatcacattaa

SEQ ID NO: 5030559 - DNA, 22 bp, Homo sapiens
gtctcactgtgggaaggccagc

SEQ ID NO: 5030560 - DNA, 13 bp, Homo sapiens
gtctcaggcagca

SEQ ID NO: 5030561 - DNA, 15 bp, Homo sapiens
gtctcccaaagtgct

SEQ ID NO: 5030562 - DNA, 19 bp, Homo sapiens
gtctccctcccctctcaga

SEQ ID NO: 5030563 - DNA, 23 bp, Homo sapiens
gtctccctcccctctcagaacat

SEQ ID NO: 5030564 - DNA, 16 bp, Homo sapiens
gtctctggttcctccc

SEQ ID NO: 5030565 - DNA, 17 bp, Homo sapiens
gtctctggttcctcccc

SEQ ID NO: 5030566 - DNA, 23 bp, Homo sapiens
gtctcttatggatgtccccagca

SEQ ID NO: 5030567 - DNA, 17 bp, Homo sapiens
gtctgccccacatgtgg

SEQ ID NO: 5030568 - DNA, 16 bp, Homo sapiens
gtctgctaaataaaca

SEQ ID NO: 5030569 - DNA, 14 bp, Homo sapiens
gtctgctctggtgg

SEQ ID NO: 5030570 - DNA, 13 bp, Homo sapiens
gtctggaccccgt

SEQ ID NO: 5030571 - DNA, 21 bp, Homo sapiens
gtctgtctcagagtcccagga

SEQ ID NO: 5030572 - DNA, 14 bp, Homo sapiens
gtctgtgaagagcc

SEQ ID NO: 5030573 - DNA, 14 bp, Homo sapiens
gtctgtttaaagtg

SEQ ID NO: 5030574 - DNA, 21 bp, Homo sapiens
gtcttaattattatttgtgtt

SEQ ID NO: 5030575 - DNA, 22 bp, Homo sapiens
gtctttagatagccctgtcctg

SEQ ID NO: 5030576 - DNA, 22 bp, Homo sapiens
gtcttttgcttttgcccatttt

SEQ ID NO: 5030577 - DNA, 15 bp, Homo sapiens
gtctttttttgtata

SEQ ID NO: 5030578 - DNA, 17 bp, Homo sapiens
gtctttttttgtatagt

SEQ ID NO: 5030579 - DNA, 16 bp, Homo sapiens
gtgacaaaccatccag

SEQ ID NO: 5030580 - DNA, 15 bp, Homo sapiens
gtgacaggcagcaga

SEQ ID NO: 5030581 - DNA, 18 bp, Homo sapiens
gtgacagtgcctcttcca

SEQ ID NO: 5030582 - DNA, 17 bp, Homo sapiens
gtgacatgcccaaggcc

SEQ ID NO: 5030583 - DNA, 13 bp, Homo sapiens
gtgactgtgctgt

SEQ ID NO: 5030584 - DNA, 11 bp, Homo sapiens
gtgagagagga

SEQ ID NO: 5030585 - DNA, 16 bp, Homo sapiens
gtgagagccagcagca

SEQ ID NO: 5030586 - DNA, 16 bp, Homo sapiens
gtgagagtcaaagctg

SEQ ID NO: 5030587 - DNA, 14 bp, Homo sapiens
gtgagcacagccta

SEQ ID NO: 5030588 - DNA, 15 bp, Homo sapiens
gtgagcaggctgtga

SEQ ID NO: 5030589 - DNA, 14 bp, Homo sapiens
gtgaggattccaaa

SEQ ID NO: 5030590 - DNA, 17 bp, Homo sapiens
gtgagtcatttaaatgt

SEQ ID NO: 5030591 - DNA, 14 bp, Homo sapiens
gtgatctcatttaa

SEQ ID NO: 5030592 - DNA, 20 bp, Homo sapiens
tattataacaagtgtgtctt

SEQ ID NO: 5030593 - DNA, 13 bp, Homo sapiens
tattatcacatta

SEQ ID NO: 5030594 - DNA, 17 bp, Homo sapiens
tattattacttgtaaat

SEQ ID NO: 5030595 - DNA, 18 bp, Homo sapiens
tattattacttgtaaata

SEQ ID NO: 5030596 - DNA, 21 bp, Homo sapiens
tattcacatcgcttctgtgta

SEQ ID NO: 5030597 - DNA, 12 bp, Homo sapiens
tattgaagcatt

SEQ ID NO: 5030598 - DNA, 23 bp, Homo sapiens
tattgtgcaatgtgtataaacaa

SEQ ID NO: 5030599 - DNA, 13 bp, Homo sapiens
tattgttgtcctt

SEQ ID NO: 5030600 - DNA, 15 bp, Homo sapiens
tatttaggaagtgtt

SEQ ID NO: 5030601 - DNA, 20 bp, Homo sapiens
tatttatgtattgtgcaatg

SEQ ID NO: 5030602 - DNA, 23 bp, Homo sapiens
tatttgaaaaaaacttcattctc

SEQ ID NO: 5030603 - DNA, 12 bp, Homo sapiens
tatttgtgtttt

SEQ ID NO: 5030604 - DNA, 15 bp, Homo sapiens
tatttgtttgcatag

SEQ ID NO: 5030605 - DNA, 23 bp, Homo sapiens
tattttaaaatagcgttcttgta

SEQ ID NO: 5030606 - DNA, 22 bp, Homo sapiens
tattttacatgaagctgtataa

SEQ ID NO: 5030607 - DNA, 12 bp, Homo sapiens
tattttatgtta

SEQ ID NO: 5030608 - DNA, 21 bp, Homo sapiens
tattttatgttatatataaat

SEQ ID NO: 5030609 - DNA, 15 bp, Homo sapiens
tatttttaaagatag

SEQ ID NO: 5030610 - DNA, 21 bp, Homo sapiens
tatttttatactcttcctatt

SEQ ID NO: 5030611 - DNA, 16 bp, Homo sapiens
tatttttctaactaca

SEQ ID NO: 5030612 - DNA, 17 bp, Homo sapiens
tcaaaaactttggagtc

SEQ ID NO: 5030613 - DNA, 18 bp, Homo sapiens
tcaaactgtcttggctgt

SEQ ID NO: 5030614 - DNA, 15 bp, Homo sapiens
tcaaagcaaatgtct

SEQ ID NO: 5030615 - DNA, 18 bp, Homo sapiens
tcaaatgggctgctgctt

SEQ ID NO: 5030616 - DNA, 17 bp, Homo sapiens
tcaaattgctgcttgga

SEQ ID NO: 5030617 - DNA, 12 bp, Homo sapiens
tcaactgaaggg

SEQ ID NO: 5030618 - DNA, 14 bp, Homo sapiens
tcaagaagaaaaag

SEQ ID NO: 5030619 - DNA, 16 bp, Homo sapiens
tcaaggttttaaaaca

SEQ ID NO: 5030620 - DNA, 18 bp, Homo sapiens
tcaaggttttaaaacagt

SEQ ID NO: 5030621 - DNA, 12 bp, Homo sapiens
tcaatagccact

SEQ ID NO: 5030622 - DNA, 22 bp, Homo sapiens
tcaatagccactaaccttgcct

SEQ ID NO: 5030623 - DNA, 21 bp, Homo sapiens
tcaatgaagccagctcacagt

SEQ ID NO: 5030624 - DNA, 12 bp, Homo sapiens
tcaatgagcatg

SEQ ID NO: 5030625 - DNA, 19 bp, Homo sapiens
tcaatgagcatgtttagac

SEQ ID NO: 5030626 - DNA, 20 bp, Homo sapiens
tcaatttatttgaatgattt

SEQ ID NO: 5030627 - DNA, 11 bp, Homo sapiens
tcacagctcct

SEQ ID NO: 5030628 - DNA, 16 bp, Homo sapiens
tcacagtccaaccaga

SEQ ID NO: 5030629 - DNA, 23 bp, Homo sapiens
tcacagttttggttgctttaata

SEQ ID NO: 5030630 - DNA, 17 bp, Homo sapiens
tcacatagagtgatctt

SEQ ID NO: 5030631 - DNA, 19 bp, Homo sapiens
tcacatagcccacttacat

SEQ ID NO: 5030632 - DNA, 20 bp, Homo sapiens
tcacatagcccacttacatt

SEQ ID NO: 5030633 - DNA, 16 bp, Homo sapiens
tcacatcagcaatttc

SEQ ID NO: 5030634 - DNA, 15 bp, Homo sapiens
tcacatgaattatta

SEQ ID NO: 5030635 - DNA, 18 bp, Homo sapiens
tcacattaatctcaaaga

SEQ ID NO: 5030636 - DNA, 20 bp, Homo sapiens
tcacatttttaaaagaacaa

SEQ ID NO: 5030637 - DNA, 11 bp, Homo sapiens
tcaccatggcc

SEQ ID NO: 5030638 - DNA, 23 bp, Homo sapiens
tcacctagctgaatgtttttcta

SEQ ID NO: 5030639 - DNA, 19 bp, Homo sapiens
tcacctcctctgtgatttc

SEQ ID NO: 5030640 - DNA, 13 bp, Homo sapiens
tcaccttggaagg

SEQ ID NO: 5030641 - DNA, 14 bp, Homo sapiens
tcactccaccatcc

SEQ ID NO: 5030642 - DNA, 15 bp, Homo sapiens
tcactccaccatccc

SEQ ID NO: 5030643 - DNA, 19 bp, Homo sapiens
tcactccaccatccccacc

SEQ ID NO: 5030644 - DNA, 14 bp, Homo sapiens
tcactccttttaaa

SEQ ID NO: 5030645 - DNA, 15 bp, Homo sapiens
tcactccttttaaag

SEQ ID NO: 5030646 - DNA, 18 bp, Homo sapiens
tcactccttttaaagaaa

SEQ ID NO: 5030647 - DNA, 21 bp, Homo sapiens
tcacttgtcaggagtgtgtgt

SEQ ID NO: 5030648 - DNA, 22 bp, Homo sapiens
tcacttgtcaggagtgtgtgtg

SEQ ID NO: 5030649 - DNA, 21 bp, Homo sapiens
tcactttgaaaagttggaagg

SEQ ID NO: 5030650 - DNA, 10 bp, Homo sapiens
tcagaacata

SEQ ID NO: 5030651 - DNA, 16 bp, Homo sapiens
tcagaacatactgatt

SEQ ID NO: 5030652 - DNA, 22 bp, Homo sapiens
tcagaaggcaaatgactttgga

SEQ ID NO: 5030653 - DNA, 23 bp, Homo sapiens
tcagaggtttacctagagaacag

SEQ ID NO: 5030654 - DNA, 13 bp, Homo sapiens
tcagataactgtt

SEQ ID NO: 5030655 - DNA, 15 bp, Homo sapiens
tcagataactgttat

SEQ ID NO: 5030656 - DNA, 23 bp, Homo sapiens
tcagatgactatgcagaggcctg

SEQ ID NO: 5030657 - DNA, 21 bp, Homo sapiens
tcagatgctgtgcaaatgtta

SEQ ID NO: 5030658 - DNA, 22 bp, Homo sapiens
tcagcaaaccatttttaaagta

SEQ ID NO: 5030659 - DNA, 21 bp, Homo sapiens
tcagcagaacctgcacacagg

SEQ ID NO: 5030660 - DNA, 21 bp, Homo sapiens
tcagcctactccgctcactga

SEQ ID NO: 5030661 - DNA, 20 bp, Homo sapiens
tcagcgatgtatataagcca

SEQ ID NO: 5030662 - DNA, 14 bp, Homo sapiens
tcagctccaggtgg

SEQ ID NO: 5030663 - DNA, 22 bp, Homo sapiens
tcaggaaacgagactttccatt

SEQ ID NO: 5030664 - DNA, 19 bp, Homo sapiens
tcaggagactgggctctgg

SEQ ID NO: 5030665 - DNA, 16 bp, Homo sapiens
tcaggagtgtgtgtga

SEQ ID NO: 5030666 - DNA, 13 bp, Homo sapiens
tcaggcagctcaa

SEQ ID NO: 5030667 - DNA, 16 bp, Homo sapiens
tcagtattgaagcatt

SEQ ID NO: 5030668 - DNA, 13 bp, Homo sapiens
tcagttaagaaat

SEQ ID NO: 5030669 - DNA, 20 bp, Homo sapiens
tcagttttttgttttacaat

SEQ ID NO: 5030670 - DNA, 13 bp, Homo sapiens
tcatacacagaaa

SEQ ID NO: 5030671 - DNA, 15 bp, Homo sapiens
tcatacctacatgta

SEQ ID NO: 5030672 - DNA, 16 bp, Homo sapiens
tcatacctacatgtat

SEQ ID NO: 5030673 - DNA, 22 bp, Homo sapiens
tcatagcaataacattcccact

SEQ ID NO: 5030674 - DNA, 16 bp, Homo sapiens
tcataggtctgaaatt

SEQ ID NO: 5030675 - DNA, 16 bp, Homo sapiens
tcatagtagtttttac

SEQ ID NO: 5030676 - DNA, 18 bp, Homo sapiens
tcatagtagtttttacag

SEQ ID NO: 5030677 - DNA, 14 bp, Homo sapiens
tcatcagtattgaa

SEQ ID NO: 5030678 - DNA, 20 bp, Homo sapiens
tcatcagtattgaagcattt

SEQ ID NO: 5030679 - DNA, 13 bp, Homo sapiens
tcatcctcaggaa

SEQ ID NO: 5030680 - DNA, 16 bp, Homo sapiens
tcatgaagcaggaggc

SEQ ID NO: 5030681 - DNA, 23 bp, Homo sapiens
tcatgccagctacttcctcctcc

SEQ ID NO: 5030682 - DNA, 18 bp, Homo sapiens
tcatgcccagctctctga

SEQ ID NO: 5030683 - DNA, 21 bp, Homo sapiens
tcatggaaagactgggacagc

SEQ ID NO: 5030684 - DNA, 23 bp, Homo sapiens
tcatggtggccacggccacagcc

SEQ ID NO: 5030685 - DNA, 22 bp, Homo sapiens
tcattagtcatgtttatctgct

SEQ ID NO: 5030686 - DNA, 14 bp, Homo sapiens
tcattatttatgta

SEQ ID NO: 5030687 - DNA, 20 bp, Homo sapiens
tcattatttttgttagcaaa

SEQ ID NO: 5030688 - DNA, 15 bp, Homo sapiens
tcattcgggatgatt

SEQ ID NO: 5030689 - DNA, 22 bp, Homo sapiens
tccaaaacatttctggacagta

SEQ ID NO: 5030690 - DNA, 15 bp, Homo sapiens
tccaaatgcagcttt

SEQ ID NO: 5030691 - DNA, 19 bp, Homo sapiens
tccaaatgcagctttaaaa

SEQ ID NO: 5030692 - DNA, 16 bp, Homo sapiens
tccaattaaggatttt

SEQ ID NO: 5030693 - DNA, 19 bp, Homo sapiens
tccaattccttgcacatag

SEQ ID NO: 5030694 - DNA, 14 bp, Homo sapiens
tccacagagtataa

SEQ ID NO: 5030695 - DNA, 22 bp, Homo sapiens
tccacataaggaaactgggttc

SEQ ID NO: 5030696 - DNA, 14 bp, Homo sapiens
tccaccctgccaag

SEQ ID NO: 5030697 - DNA, 23 bp, Homo sapiens
tccaccctgccaagactcctcag

SEQ ID NO: 5030698 - DNA, 20 bp, Homo sapiens
tccagaacacggctcacgct

SEQ ID NO: 5030699 - DNA, 14 bp, Homo sapiens
tccagattctgatg

SEQ ID NO: 5030700 - DNA, 15 bp, Homo sapiens
tccagattctgatgc

SEQ ID NO: 5030701 - DNA, 16 bp, Homo sapiens
tccagattctgatgca

SEQ ID NO: 5030702 - DNA, 19 bp, Homo sapiens
tccagccctggctgaagga

SEQ ID NO: 5030703 - DNA, 16 bp, Homo sapiens
tccagcctgcctggca

SEQ ID NO: 5030704 - DNA, 21 bp, Homo sapiens
tccagcgagagagtttcaaaa

SEQ ID NO: 5030705 - DNA, 20 bp, Homo sapiens
tgccattgtagcgtctttct

SEQ ID NO: 5030706 - DNA, 16 bp, Homo sapiens
tgcccagctctctgac

SEQ ID NO: 5030707 - DNA, 15 bp, Homo sapiens
tgccccactctgcct

SEQ ID NO: 5030708 - DNA, 17 bp, Homo sapiens
tgcccccatttcaccca

SEQ ID NO: 5030709 - DNA, 13 bp, Homo sapiens
tgcccccgcctgc

SEQ ID NO: 5030710 - DNA, 13 bp, Homo sapiens
tgccccttgccat

SEQ ID NO: 5030711 - DNA, 19 bp, Homo sapiens
tgcccctttataaatccaa

SEQ ID NO: 5030712 - DNA, 17 bp, Homo sapiens
tgcccggcgccgggcac

SEQ ID NO: 5030713 - DNA, 19 bp, Homo sapiens
tgccctcatggcccctctg

SEQ ID NO: 5030714 - DNA, 21 bp, Homo sapiens
tgccctcatggcccctctgac

SEQ ID NO: 5030715 - DNA, 14 bp, Homo sapiens
tgccctgtgtggct

SEQ ID NO: 5030716 - DNA, 15 bp, Homo sapiens
tgccctgtgtggctg

SEQ ID NO: 5030717 - DNA, 16 bp, Homo sapiens
tgccctgtgtggctgg

SEQ ID NO: 5030718 - DNA, 23 bp, Homo sapiens
tgcctcatgcaaccgggccctct

SEQ ID NO: 5030719 - DNA, 20 bp, Homo sapiens
tgcctgctgttggtcctctc

SEQ ID NO: 5030720 - DNA, 14 bp, Homo sapiens
tgcctggtacagta

SEQ ID NO: 5030721 - DNA, 16 bp, Homo sapiens
tgcctgtcccaccccc

SEQ ID NO: 5030722 - DNA, 17 bp, Homo sapiens
tgcctgtgaactgaact

SEQ ID NO: 5030723 - DNA, 21 bp, Homo sapiens
tgcctgtgaactgaactctga

SEQ ID NO: 5030724 - DNA, 15 bp, Homo sapiens
tgccttttctagccc

SEQ ID NO: 5030725 - DNA, 19 bp, Homo sapiens
tgccttttttgtagttttt

SEQ ID NO: 5030726 - DNA, 19 bp, Homo sapiens
tgcgcctgtgatgctgggc

SEQ ID NO: 5030727 - DNA, 23 bp, Homo sapiens
tgcggccccctctcggccaggca

SEQ ID NO: 5030728 - DNA, 23 bp, Homo sapiens
tgcgggcgcgggcagccacccaa

SEQ ID NO: 5030729 - DNA, 15 bp, Homo sapiens
tgcgtctccagtcat

SEQ ID NO: 5030730 - DNA, 20 bp, Homo sapiens
tgcgtctccagtcatctgta

SEQ ID NO: 5030731 - DNA, 14 bp, Homo sapiens
tgcgtgttcagcag

SEQ ID NO: 5030732 - DNA, 18 bp, Homo sapiens
tgcgtgttcagcagaacc

SEQ ID NO: 5030733 - DNA, 20 bp, Homo sapiens
tgctattggaggatcagttt

SEQ ID NO: 5030734 - DNA, 13 bp, Homo sapiens
tgctccagattct

SEQ ID NO: 5030735 - DNA, 15 bp, Homo sapiens
tgctccagattctga

SEQ ID NO: 5030736 - DNA, 16 bp, Homo sapiens
tgctccagattctgat

SEQ ID NO: 5030737 - DNA, 18 bp, Homo sapiens
tgctccagattctgatgc

SEQ ID NO: 5030738 - DNA, 15 bp, Homo sapiens
tgctctcagcctccc

SEQ ID NO: 5030739 - DNA, 18 bp, Homo sapiens
tgctctgatgaagaggag

SEQ ID NO: 5030740 - DNA, 20 bp, Homo sapiens
tgctctttgttttgtgtctc

SEQ ID NO: 5030741 - DNA, 18 bp, Homo sapiens
tgctgaatatacagcagg

SEQ ID NO: 5030742 - DNA, 18 bp, Homo sapiens
tgctgaggcccagtgcat

SEQ ID NO: 5030743 - DNA, 19 bp, Homo sapiens
tgctgctaatattttcctc

SEQ ID NO: 5030744 - DNA, 12 bp, Homo sapiens
tgctgctctcag

SEQ ID NO: 5030745 - DNA, 12 bp, Homo sapiens
tgctgctgctgc

SEQ ID NO: 5030746 - DNA, 18 bp, Homo sapiens
tgctggtagagaccccca

SEQ ID NO: 5030747 - DNA, 17 bp, Homo sapiens
tgctgtaaaaactgtgg

SEQ ID NO: 5030748 - DNA, 12 bp, Homo sapiens
tgctgtccctcc

SEQ ID NO: 5030749 - DNA, 16 bp, Homo sapiens
tgctgtccctccccct

SEQ ID NO: 5030750 - DNA, 17 bp, Homo sapiens
tgctgtccctccccctt

SEQ ID NO: 5030751 - DNA, 14 bp, Homo sapiens
tgctgtctctctgg

SEQ ID NO: 5030752 - DNA, 16 bp, Homo sapiens
tgctgtctctctgggc

SEQ ID NO: 5030753 - DNA, 11 bp, Homo sapiens
tgctgtgtgcc

SEQ ID NO: 5030754 - DNA, 17 bp, Homo sapiens
tgctgttggtcctctct

SEQ ID NO: 5030755 - DNA, 21 bp, Homo sapiens
tgctgttggtcctctctctgt

SEQ ID NO: 5030756 - DNA, 18 bp, Homo sapiens
tgctgtttcacaatacct

SEQ ID NO: 5030757 - DNA, 16 bp, Homo sapiens
tgctgtttgtagtgaa

SEQ ID NO: 5030758 - DNA, 21 bp, Homo sapiens
tgctgtttgtagtgaaataat

SEQ ID NO: 5030759 - DNA, 13 bp, Homo sapiens
tgctgttttgtta

SEQ ID NO: 5030760 - DNA, 18 bp, Homo sapiens
tgctgttttgttatataa

SEQ ID NO: 5030761 - DNA, 20 bp, Homo sapiens
tgcttagtccaattccttgc

SEQ ID NO: 5030762 - DNA, 16 bp, Homo sapiens
tgcttctaagtaaata

SEQ ID NO: 5030763 - DNA, 14 bp, Homo sapiens
tgcttgttaactga

SEQ ID NO: 5030764 - DNA, 22 bp, Homo sapiens
tgctttaatataaatgcaaata

SEQ ID NO: 5030765 - DNA, 21 bp, Homo sapiens
tgctttctatgctgtttgtag

SEQ ID NO: 5030766 - DNA, 12 bp, Homo sapiens
tgcttttgccca

SEQ ID NO: 5030767 - DNA, 13 bp, Homo sapiens
tggaaatttaaag

SEQ ID NO: 5030768 - DNA, 21 bp, Homo sapiens
tggaaatttaaagcaggttct

SEQ ID NO: 5030769 - DNA, 22 bp, Homo sapiens
tggaaatttaaagcaggttctt

SEQ ID NO: 5030770 - DNA, 14 bp, Homo sapiens
tggaacatccttgg

SEQ ID NO: 5030771 - DNA, 19 bp, Homo sapiens
tggaagcatattgttatta

SEQ ID NO: 5030772 - DNA, 20 bp, Homo sapiens
tggaaggatctgctgaggcc

SEQ ID NO: 5030773 - DNA, 22 bp, Homo sapiens
tggacacgctcagtggggcaga

SEQ ID NO: 5030774 - DNA, 16 bp, Homo sapiens
tggacactcagacctg

SEQ ID NO: 5030775 - DNA, 15 bp, Homo sapiens
tggacagaagcagct

SEQ ID NO: 5030776 - DNA, 16 bp, Homo sapiens
tggacagaagcagctc

SEQ ID NO: 5030777 - DNA, 18 bp, Homo sapiens
tggacagaagcagctctt

SEQ ID NO: 5030778 - DNA, 22 bp, Homo sapiens
tggacagtacctgattgtattt

SEQ ID NO: 5030779 - DNA, 20 bp, Homo sapiens
tggactccagcctgcctggc

SEQ ID NO: 5030780 - DNA, 22 bp, Homo sapiens
tggactccagcctgcctggcag

SEQ ID NO: 5030781 - DNA, 17 bp, Homo sapiens
tggactgttttctctcg

SEQ ID NO: 5030782 - DNA, 22 bp, Homo sapiens
tggactgttttctctcggctcc

SEQ ID NO: 5030783 - DNA, 18 bp, Homo sapiens
tggagaaaattggaactc

SEQ ID NO: 5030784 - DNA, 19 bp, Homo sapiens
tggagaaaattggaactct

SEQ ID NO: 5030785 - DNA, 18 bp, Homo sapiens
tggagacaccaccaccct

SEQ ID NO: 5030786 - DNA, 20 bp, Homo sapiens
tggagactcctggtctgtga

SEQ ID NO: 5030787 - DNA, 17 bp, Homo sapiens
tggagcagaccaccccg

SEQ ID NO: 5030788 - DNA, 21 bp, Homo sapiens
tggagccccaccttgtctgct

SEQ ID NO: 5030789 - DNA, 22 bp, Homo sapiens
tggagccccaccttgtctgcta

SEQ ID NO: 5030790 - DNA, 19 bp, Homo sapiens
tggaggctgacgtgtgagg

SEQ ID NO: 5030791 - DNA, 13 bp, Homo sapiens
tggaggggtgtgg

SEQ ID NO: 5030792 - DNA, 14 bp, Homo sapiens
tggagttcaccttg

SEQ ID NO: 5030793 - DNA, 13 bp, Homo sapiens
tggcactggatgc

SEQ ID NO: 5030794 - DNA, 15 bp, Homo sapiens
tggcactggatgcag

SEQ ID NO: 5030795 - DNA, 11 bp, Homo sapiens
tggcactttga

SEQ ID NO: 5030796 - DNA, 16 bp, Homo sapiens
tggcactttgaagggg

SEQ ID NO: 5030797 - DNA, 21 bp, Homo sapiens
tggcaggacacacatggtgag

SEQ ID NO: 5030798 - DNA, 13 bp, Homo sapiens
tggcatcttgcca

SEQ ID NO: 5030799 - DNA, 18 bp, Homo sapiens
tggcatggaaggggcttc

SEQ ID NO: 5030800 - DNA, 19 bp, Homo sapiens
tggcatggaaggggcttct

SEQ ID NO: 5030801 - DNA, 17 bp, Homo sapiens
tggcattagaattattt

SEQ ID NO: 5030802 - DNA, 23 bp, Homo sapiens
tggcatttcaattcctggccctg

SEQ ID NO: 5030803 - DNA, 20 bp, Homo sapiens
tggcatttggtctcaggcag

SEQ ID NO: 5030804 - DNA, 15 bp, Homo sapiens
tggccaaagagcctt

SEQ ID NO: 5030805 - DNA, 20 bp, Homo sapiens
tggccaagatcacagtggcc

SEQ ID NO: 5030806 - DNA, 20 bp, Homo sapiens
tggccaggctggtctcgaac

SEQ ID NO: 5030807 - DNA, 18 bp, Homo sapiens
tggccatgcaggaggtgg

SEQ ID NO: 5030808 - DNA, 16 bp, Homo sapiens
tggccccgcctgcctg

SEQ ID NO: 5030809 - DNA, 10 bp, Homo sapiens
tggcccctct

SEQ ID NO: 5030810 - DNA, 18 bp, Homo sapiens
tggcccctgtctcggggc

SEQ ID NO: 5030811 - DNA, 19 bp, Homo sapiens
tggccgcacgcctctccct

SEQ ID NO: 5030812 - DNA, 21 bp, Homo sapiens
tggccgcacgcctctccctgc

SEQ ID NO: 5030813 - DNA, 17 bp, Homo sapiens
tggccgccccctgcccc

SEQ ID NO: 5030814 - DNA, 19 bp, Homo sapiens
tggccgggtaaagcaaggg

SEQ ID NO: 5030815 - DNA, 19 bp, Homo sapiens
tggcctctgcaactgctca

SEQ ID NO: 5030816 - DNA, 20 bp, Homo sapiens
tggcctttcatattttagct

SEQ ID NO: 5030817 - DNA, 15 bp, Homo sapiens
tggcgtctgctctgg

SEQ ID NO: 5030818 - DNA, 15 bp, Homo sapiens
ttctgttaactgaat

SEQ ID NO: 5030819 - DNA, 16 bp, Homo sapiens
ttctgttaactgaata

SEQ ID NO: 5030820 - DNA, 21 bp, Homo sapiens
ttctgttaactgaataccact

SEQ ID NO: 5030821 - DNA, 12 bp, Homo sapiens
ttctgtttgtta

SEQ ID NO: 5030822 - DNA, 20 bp, Homo sapiens
ttcttaaagtgccagtattt

SEQ ID NO: 5030823 - DNA, 15 bp, Homo sapiens
ttcttaaataataaa

SEQ ID NO: 5030824 - DNA, 15 bp, Homo sapiens
ttcttagctcaatga

SEQ ID NO: 5030825 - DNA, 15 bp, Homo sapiens
ttcttagtagatttt

SEQ ID NO: 5030826 - DNA, 19 bp, Homo sapiens
ttcttattgcgctgctacc

SEQ ID NO: 5030827 - DNA, 15 bp, Homo sapiens
ttcttcatattctaa

SEQ ID NO: 5030828 - DNA, 22 bp, Homo sapiens
ttcttctacaactcatacactc

SEQ ID NO: 5030829 - DNA, 16 bp, Homo sapiens
ttcttcttgaggggaa

SEQ ID NO: 5030830 - DNA, 13 bp, Homo sapiens
ttcttgtattaag

SEQ ID NO: 5030831 - DNA, 18 bp, Homo sapiens
ttcttgtattaagaatga

SEQ ID NO: 5030832 - DNA, 14 bp, Homo sapiens
ttcttgtctataaa

SEQ ID NO: 5030833 - DNA, 21 bp, Homo sapiens
ttcttgtctataaagcattta

SEQ ID NO: 5030834 - DNA, 14 bp, Homo sapiens
ttctttaaagaagt

SEQ ID NO: 5030835 - DNA, 19 bp, Homo sapiens
ttgaaatgaggtctgttta

SEQ ID NO: 5030836 - DNA, 20 bp, Homo sapiens
ttgaaatgaggtctgtttaa

SEQ ID NO: 5030837 - DNA, 11 bp, Homo sapiens
ttgaaatgtaa

SEQ ID NO: 5030838 - DNA, 20 bp, Homo sapiens
ttgaaatgtaaggctgtgta

SEQ ID NO: 5030839 - DNA, 16 bp, Homo sapiens
ttgaacttgattgcct

SEQ ID NO: 5030840 - DNA, 13 bp, Homo sapiens
ttgaagcctttgt

SEQ ID NO: 5030841 - DNA, 14 bp, Homo sapiens
ttgaaggactaata

SEQ ID NO: 5030842 - DNA, 13 bp, Homo sapiens
ttgaagggtcctg

SEQ ID NO: 5030843 - DNA, 21 bp, Homo sapiens
ttgaatgatttttctttacaa

SEQ ID NO: 5030844 - DNA, 16 bp, Homo sapiens
ttgacaaagtgcctca

SEQ ID NO: 5030845 - DNA, 13 bp, Homo sapiens
ttgacattctgaa

SEQ ID NO: 5030846 - DNA, 10 bp, Homo sapiens
ttgagacagg

SEQ ID NO: 5030847 - DNA, 13 bp, Homo sapiens
ttgaggcaagtgt

SEQ ID NO: 5030848 - DNA, 21 bp, Homo sapiens
ttgagggacgctttgtctgtc

SEQ ID NO: 5030849 - DNA, 18 bp, Homo sapiens
ttgagggagctgggagac

SEQ ID NO: 5030850 - DNA, 23 bp, Homo sapiens
ttgagtggggttatctctgtgtt

SEQ ID NO: 5030851 - DNA, 15 bp, Homo sapiens
ttgatacccccctct

SEQ ID NO: 5030852 - DNA, 14 bp, Homo sapiens
ttgattcagcaaaa

SEQ ID NO: 5030853 - DNA, 17 bp, Homo sapiens
ttgattcagcaaaaatc

SEQ ID NO: 5030854 - DNA, 14 bp, Homo sapiens
ttgattcagcctgt

SEQ ID NO: 5030855 - DNA, 17 bp, Homo sapiens
ttgatttaaacacacag

SEQ ID NO: 5030856 - DNA, 18 bp, Homo sapiens
ttgatttaaacacacaga

SEQ ID NO: 5030857 - DNA, 12 bp, Homo sapiens
ttgcaccaaaga

SEQ ID NO: 5030858 - DNA, 23 bp, Homo sapiens
ttgcagtcccaagcggtgtctct

SEQ ID NO: 5030859 - DNA, 21 bp, Homo sapiens
ttgcagttcccacattaaaga

SEQ ID NO: 5030860 - DNA, 14 bp, Homo sapiens
ttgcatttgtttat

SEQ ID NO: 5030861 - DNA, 17 bp, Homo sapiens
ttgccatccattctgga

SEQ ID NO: 5030862 - DNA, 11 bp, Homo sapiens
ttgccccactc

SEQ ID NO: 5030863 - DNA, 12 bp, Homo sapiens
ttgctcacccag

SEQ ID NO: 5030864 - DNA, 13 bp, Homo sapiens
ttgcttatttaat

SEQ ID NO: 5030865 - DNA, 18 bp, Homo sapiens
ttgctttaatataaatgc

SEQ ID NO: 5030866 - DNA, 21 bp, Homo sapiens
ttgctttaatataaatgcaaa

SEQ ID NO: 5030867 - DNA, 16 bp, Homo sapiens
ttgctttaattgttaa

SEQ ID NO: 5030868 - DNA, 15 bp, Homo sapiens
ttggaaatttagcat

SEQ ID NO: 5030869 - DNA, 17 bp, Homo sapiens
ttggaaatttagcattg

SEQ ID NO: 5030870 - DNA, 14 bp, Homo sapiens
ttggaactctactc

SEQ ID NO: 5030871 - DNA, 16 bp, Homo sapiens
ttggcatggaaattta

SEQ ID NO: 5030872 - DNA, 20 bp, Homo sapiens
ttggcatggaaatttaaagc

SEQ ID NO: 5030873 - DNA, 22 bp, Homo sapiens
ttggcatggaaatttaaagcag

SEQ ID NO: 5030874 - DNA, 12 bp, Homo sapiens
ttggccatctgc

SEQ ID NO: 5030875 - DNA, 16 bp, Homo sapiens
ttggccccactttgaa

SEQ ID NO: 5030876 - DNA, 11 bp, Homo sapiens
ttgggaggtgc

SEQ ID NO: 5030877 - DNA, 23 bp, Homo sapiens
ttgggtagaaagagatacagagg

SEQ ID NO: 5030878 - DNA, 18 bp, Homo sapiens
ttggtaaaaatgctgctc

SEQ ID NO: 5030879 - DNA, 17 bp, Homo sapiens
ttggtctcaggcagcac

SEQ ID NO: 5030880 - DNA, 16 bp, Homo sapiens
ttggttgctttaatat

SEQ ID NO: 5030881 - DNA, 11 bp, Homo sapiens
ttgtaaatata

SEQ ID NO: 5030882 - DNA, 12 bp, Homo sapiens
ttgtaaatataa

SEQ ID NO: 5030883 - DNA, 17 bp, Homo sapiens
ttgtaaatataaagacg

SEQ ID NO: 5030884 - DNA, 13 bp, Homo sapiens
ttgtaaattgtca

SEQ ID NO: 5030885 - DNA, 13 bp, Homo sapiens
ttgtaattttaca

SEQ ID NO: 5030886 - DNA, 23 bp, Homo sapiens
ttgtagtgctttgagagagaaag

SEQ ID NO: 5030887 - DNA, 16 bp, Homo sapiens
ttgtatagttaacaca

SEQ ID NO: 5030888 - DNA, 19 bp, Homo sapiens
ttgtatagttaacacacta

SEQ ID NO: 5030889 - DNA, 13 bp, Homo sapiens
ttgtattaagaat

SEQ ID NO: 5030890 - DNA, 18 bp, Homo sapiens
ttgtattaagaatgaaat

SEQ ID NO: 5030891 - DNA, 14 bp, Homo sapiens
ttgtattacagatg

SEQ ID NO: 5030892 - DNA, 17 bp, Homo sapiens
ttgtcaggagtgtgtgt

SEQ ID NO: 5030893 - DNA, 16 bp, Homo sapiens
ttgtccgctgggtggt

SEQ ID NO: 5030894 - DNA, 21 bp, Homo sapiens
ttgtcctttttcactttgaaa

SEQ ID NO: 5030895 - DNA, 16 bp, Homo sapiens
ttgtctataaagcatt

SEQ ID NO: 5030896 - DNA, 13 bp, Homo sapiens
ttgtctctgatgc

SEQ ID NO: 5030897 - DNA, 17 bp, Homo sapiens
ttgtctgtctccctccc

SEQ ID NO: 5030898 - DNA, 13 bp, Homo sapiens
ttgtgaaggcagg

SEQ ID NO: 5030899 - DNA, 12 bp, Homo sapiens
ttgtgacagtgc

SEQ ID NO: 5030900 - DNA, 19 bp, Homo sapiens
ttgtgacagtgcctcttcc

SEQ ID NO: 5030901 - DNA, 21 bp, Homo sapiens
ttgtgacagtgcctcttccag

SEQ ID NO: 5030902 - DNA, 16 bp, Homo sapiens
ttgtgatggagtgctg

SEQ ID NO: 5030903 - DNA, 17 bp, Homo sapiens
ttgtgatggagtgctgt

SEQ ID NO: 5030904 - DNA, 16 bp, Homo sapiens
ttgtgccagaatgctt

SEQ ID NO: 5030905 - DNA, 15 bp, Homo sapiens
ttgtgttctgttttg

SEQ ID NO: 5030906 - DNA, 14 bp, Homo sapiens
ttgttattatataa

SEQ ID NO: 5030907 - DNA, 15 bp, Homo sapiens
ttgttctgttaactg

SEQ ID NO: 5030908 - DNA, 18 bp, Homo sapiens
ttgttctgttaactgaat

SEQ ID NO: 5030909 - DNA, 15 bp, Homo sapiens
ttgttgacattctga

SEQ ID NO: 5030910 - DNA, 15 bp, Homo sapiens
ttgttggtgcacagc

SEQ ID NO: 5030911 - DNA, 17 bp, Homo sapiens
ttgtttctctgttgtaa

SEQ ID NO: 5030912 - DNA, 12 bp, Homo sapiens
ttgttttacaat

SEQ ID NO: 5030913 - DNA, 15 bp, Homo sapiens
ttgttttactgtctt

SEQ ID NO: 5030914 - DNA, 14 bp, Homo sapiens
ttgtttttaaactg

SEQ ID NO: 5030915 - DNA, 15 bp, Homo sapiens
tttaaaagttattaa

SEQ ID NO: 5030916 - DNA, 20 bp, Homo sapiens
tttaaaatagcgttcttgta

SEQ ID NO: 5030917 - DNA, 11 bp, Homo sapiens
tttaaaatgta

SEQ ID NO: 5030918 - DNA, 12 bp, Homo sapiens
tttaaaatgtac

SEQ ID NO: 5030919 - DNA, 13 bp, Homo sapiens
tttaaacacacag

SEQ ID NO: 5030920 - DNA, 18 bp, Homo sapiens
tttaaactgtacagtgtc

SEQ ID NO: 5030921 - DNA, 19 bp, Homo sapiens
tttaaagaaaaaaattgaa

SEQ ID NO: 5030922 - DNA, 16 bp, Homo sapiens
tttaaagcaggttctt

SEQ ID NO: 5030923 - DNA, 19 bp, Homo sapiens
tttaaagcaggttcttgtt

SEQ ID NO: 5030924 - DNA, 15 bp, Homo sapiens
tttaaataaaagcac

SEQ ID NO: 5030925 - DNA, 17 bp, Homo sapiens
tttaaataaaagcacaa

SEQ ID NO: 5030926 - DNA, 14 bp, Homo sapiens
tttaaatgtgtaca

SEQ ID NO: 5030927 - DNA, 17 bp, Homo sapiens
tttaaatgtgtacaatg

SEQ ID NO: 5030928 - DNA, 18 bp, Homo sapiens
tttaaatgtgtacaatgt

SEQ ID NO: 5030929 - DNA, 23 bp, Homo sapiens
tttaaatgtgtacaatgtacaca

SEQ ID NO: 5030930 - DNA, 21 bp, Homo sapiens
tttaacaccttttttgtgggg

SEQ ID NO: 5030931 - DNA, 18 bp, Homo sapiens
tttaacataagctatttt

SEQ ID NO: 5030932 - DNA, 17 bp, Homo sapiens
tttaacccccctgtaca

SEQ ID NO: 5030933 - DNA, 19 bp, Homo sapiens
gccccctccccccagactc

SEQ ID NO: 5030934 - DNA, 12 bp, Homo sapiens
gccccctctcgg

SEQ ID NO: 5030935 - DNA, 13 bp, Homo sapiens
gccccctgccccc

SEQ ID NO: 5030936 - DNA, 18 bp, Homo sapiens
gccccggtcacctagcaa

SEQ ID NO: 5030937 - DNA, 13 bp, Homo sapiens
gcccctcggctct

SEQ ID NO: 5030938 - DNA, 17 bp, Homo sapiens
gcccctgcacaggcaca

SEQ ID NO: 5030939 - DNA, 17 bp, Homo sapiens
gcccctgctgtctctct

SEQ ID NO: 5030940 - DNA, 11 bp, Homo sapiens
gcccctggccc

SEQ ID NO: 5030941 - DNA, 13 bp, Homo sapiens
gccccttgccatc

SEQ ID NO: 5030942 - DNA, 13 bp, Homo sapiens
gcccgaatacaaa

SEQ ID NO: 5030943 - DNA, 12 bp, Homo sapiens
gcccgcagggcc

SEQ ID NO: 5030944 - DNA, 22 bp, Homo sapiens
gcccggccacacccagcggccc

SEQ ID NO: 5030945 - DNA, 20 bp, Homo sapiens
gcccggcgccgggcaccaac

SEQ ID NO: 5030946 - DNA, 14 bp, Homo sapiens
gcccgtctcagtgt

SEQ ID NO: 5030947 - DNA, 21 bp, Homo sapiens
gcccgtgcccccgcctgccac

SEQ ID NO: 5030948 - DNA, 19 bp, Homo sapiens
gccctagcctgacccggag

SEQ ID NO: 5030949 - DNA, 18 bp, Homo sapiens
gccctcatggcccctctg

SEQ ID NO: 5030950 - DNA, 17 bp, Homo sapiens
gccctctcccctcagcc

SEQ ID NO: 5030951 - DNA, 14 bp, Homo sapiens
gccctgcagccagc

SEQ ID NO: 5030952 - DNA, 15 bp, Homo sapiens
gccctggctgaagga

SEQ ID NO: 5030953 - DNA, 17 bp, Homo sapiens
gccctggctgaaggact

SEQ ID NO: 5030954 - DNA, 20 bp, Homo sapiens
gccctggctgaaggactgtg

SEQ ID NO: 5030955 - DNA, 21 bp, Homo sapiens
gccctggctgaaggactgtga

SEQ ID NO: 5030956 - DNA, 18 bp, Homo sapiens
gccctggtcctggcctcc

SEQ ID NO: 5030957 - DNA, 22 bp, Homo sapiens
gccctgtcctgcctaaggctga

SEQ ID NO: 5030958 - DNA, 17 bp, Homo sapiens
gccctgtcctggtggta

SEQ ID NO: 5030959 - DNA, 16 bp, Homo sapiens
gcccttttccagcctc

SEQ ID NO: 5030960 - DNA, 15 bp, Homo sapiens
gccgacttggagact

SEQ ID NO: 5030961 - DNA, 18 bp, Homo sapiens
gccgacttggagactcct

SEQ ID NO: 5030962 - DNA, 19 bp, Homo sapiens
gccgagacagaccctctgc

SEQ ID NO: 5030963 - DNA, 13 bp, Homo sapiens
gccgcaccagccc

SEQ ID NO: 5030964 - DNA, 14 bp, Homo sapiens
gccgcacgcctctc

SEQ ID NO: 5030965 - DNA, 14 bp, Homo sapiens
gccgctgcccgctc

SEQ ID NO: 5030966 - DNA, 12 bp, Homo sapiens
gccggtcatttt

SEQ ID NO: 5030967 - DNA, 18 bp, Homo sapiens
gccggtgggaccctgtcc

SEQ ID NO: 5030968 - DNA, 14 bp, Homo sapiens
gcctcagcctactc

SEQ ID NO: 5030969 - DNA, 13 bp, Homo sapiens
gcctcccacggca

SEQ ID NO: 5030970 - DNA, 16 bp, Homo sapiens
gcctctcccctgcctg

SEQ ID NO: 5030971 - DNA, 18 bp, Homo sapiens
gcctctcccctgcctgcc

SEQ ID NO: 5030972 - DNA, 17 bp, Homo sapiens
gcctgcagtcctggaag

SEQ ID NO: 5030973 - DNA, 21 bp, Homo sapiens
gcctgccctcatggcccctct

SEQ ID NO: 5030974 - DNA, 15 bp, Homo sapiens
gcctgcctggcaggc

SEQ ID NO: 5030975 - DNA, 17 bp, Homo sapiens
gcctgcctggcaggctg

SEQ ID NO: 5030976 - DNA, 21 bp, Homo sapiens
gcctgctgttggtcctctctc

SEQ ID NO: 5030977 - DNA, 14 bp, Homo sapiens
gcctggcaggctgt

SEQ ID NO: 5030978 - DNA, 23 bp, Homo sapiens
gcctgggggacccctggctctgg

SEQ ID NO: 5030979 - DNA, 15 bp, Homo sapiens
gcctgtccacaggct

SEQ ID NO: 5030980 - DNA, 18 bp, Homo sapiens
gcctgtccacaggcttct

SEQ ID NO: 5030981 - DNA, 23 bp, Homo sapiens
gcctgtccacaggcttctgagca

SEQ ID NO: 5030982 - DNA, 13 bp, Homo sapiens
gcctgtgctgtga

SEQ ID NO: 5030983 - DNA, 17 bp, Homo sapiens
gcctttgatgttacaga

SEQ ID NO: 5030984 - DNA, 22 bp, Homo sapiens
gcctttggaaacagctcgactt

SEQ ID NO: 5030985 - DNA, 15 bp, Homo sapiens
gcgaccttcctcatc

SEQ ID NO: 5030986 - DNA, 22 bp, Homo sapiens
gcgaccttcctcatccacccca

SEQ ID NO: 5030987 - DNA, 13 bp, Homo sapiens
gcgagcctgctag

SEQ ID NO: 5030988 - DNA, 11 bp, Homo sapiens
gcgccaccacg

SEQ ID NO: 5030989 - DNA, 20 bp, Homo sapiens
gcgcgagggcctcaaaggcc

SEQ ID NO: 5030990 - DNA, 21 bp, Homo sapiens
gcgcgatcccacacaggctgg

SEQ ID NO: 5030991 - DNA, 13 bp, Homo sapiens
gcgcgccaccacg

SEQ ID NO: 5030992 - DNA, 16 bp, Homo sapiens
gcgcgggcagccaccc

SEQ ID NO: 5030993 - DNA, 17 bp, Homo sapiens
gcgcgggcagccaccca

SEQ ID NO: 5030994 - DNA, 18 bp, Homo sapiens
gcgcgggcagccacccaa

SEQ ID NO: 5030995 - DNA, 19 bp, Homo sapiens
gcgctggccgggaccccga

SEQ ID NO: 5030996 - DNA, 14 bp, Homo sapiens
gcgcttcccagcac

SEQ ID NO: 5030997 - DNA, 20 bp, Homo sapiens
gcgcttggtctttctgtgct

SEQ ID NO: 5030998 - DNA, 20 bp, Homo sapiens
gcggaacaaggagtcagaca

SEQ ID NO: 5030999 - DNA, 16 bp, Homo sapiens
gcggcagatggggaga

SEQ ID NO: 5031000 - DNA, 19 bp, Homo sapiens
gcggctggggtcccagcag

SEQ ID NO: 5031001 - DNA, 12 bp, Homo sapiens
gcggctgtgtgt

SEQ ID NO: 5031002 - DNA, 16 bp, Homo sapiens
gcgtctgctctggtgg

SEQ ID NO: 5031003 - DNA, 12 bp, Homo sapiens
gcgtgaatctgt

SEQ ID NO: 5031004 - DNA, 17 bp, Homo sapiens
gcgtgttcagcagaacc

SEQ ID NO: 5031005 - DNA, 15 bp, Homo sapiens
gcgttcttgtaattt

SEQ ID NO: 5031006 - DNA, 23 bp, Homo sapiens
gcgttgttgcatgtttgaaatga

SEQ ID NO: 5031007 - DNA, 22 bp, Homo sapiens
gctaaataaacatgtgccctca

SEQ ID NO: 5031008 - DNA, 23 bp, Homo sapiens
gctaatattttcctcctgagtgc

SEQ ID NO: 5031009 - DNA, 15 bp, Homo sapiens
gctactataaagaga

SEQ ID NO: 5031010 - DNA, 18 bp, Homo sapiens
gctacttcctcctcccca

SEQ ID NO: 5031011 - DNA, 15 bp, Homo sapiens
gctaggggctggggc

SEQ ID NO: 5031012 - DNA, 15 bp, Homo sapiens
gctagtcttttgctt

SEQ ID NO: 5031013 - DNA, 19 bp, Homo sapiens
gctattggaggatcagttt

SEQ ID NO: 5031014 - DNA, 21 bp, Homo sapiens
gctatttttctaactacaaag

SEQ ID NO: 5031015 - DNA, 13 bp, Homo sapiens
gctcaatgagcat

SEQ ID NO: 5031016 - DNA, 19 bp, Homo sapiens
gctcacccagtgccctctc

SEQ ID NO: 5031017 - DNA, 17 bp, Homo sapiens
gctcagcactgcctgct

SEQ ID NO: 5031018 - DNA, 13 bp, Homo sapiens
gctccaaaccctc

SEQ ID NO: 5031019 - DNA, 16 bp, Homo sapiens
gctccaaaccctcgag

SEQ ID NO: 5031020 - DNA, 17 bp, Homo sapiens
gctccaaaccctcgagg

SEQ ID NO: 5031021 - DNA, 16 bp, Homo sapiens
gctccaaatgcagctt

SEQ ID NO: 5031022 - DNA, 13 bp, Homo sapiens
gctccagattctg

SEQ ID NO: 5031023 - DNA, 15 bp, Homo sapiens
gctccagattctgat

SEQ ID NO: 5031024 - DNA, 18 bp, Homo sapiens
gctccagattctgatgca

SEQ ID NO: 5031025 - DNA, 14 bp, Homo sapiens
gctccagtttgcat

SEQ ID NO: 5031026 - DNA, 19 bp, Homo sapiens
gctcccacagaacacagca

SEQ ID NO: 5031027 - DNA, 18 bp, Homo sapiens
gctccttcccatcgctgt

SEQ ID NO: 5031028 - DNA, 16 bp, Homo sapiens
gctctcaaatccctct

SEQ ID NO: 5031029 - DNA, 17 bp, Homo sapiens
gctctcagcctcccaca

SEQ ID NO: 5031030 - DNA, 23 bp, Homo sapiens
gctctgcaattcccctctgctgc

SEQ ID NO: 5031031 - DNA, 11 bp, Homo sapiens
gctctggctct

SEQ ID NO: 5031032 - DNA, 23 bp, Homo sapiens
gctctggtccaggccctgtggca

SEQ ID NO: 5031033 - DNA, 13 bp, Homo sapiens
gctctgtccccag

SEQ ID NO: 5031034 - DNA, 17 bp, Homo sapiens
gctctgtgggtctctgg

SEQ ID NO: 5031035 - DNA, 18 bp, Homo sapiens
gctctgtgggtctctgga

SEQ ID NO: 5031036 - DNA, 17 bp, Homo sapiens
gctcttgatacccccct

SEQ ID NO: 5031037 - DNA, 15 bp, Homo sapiens
gctcttggtacctgt

SEQ ID NO: 5031038 - DNA, 13 bp, Homo sapiens
gctctttgagaaa

SEQ ID NO: 5031039 - DNA, 20 bp, Homo sapiens
gctgaacttgttttctggga

SEQ ID NO: 5031040 - DNA, 21 bp, Homo sapiens
gctgaaggactgtgacaggca

SEQ ID NO: 5031041 - DNA, 23 bp, Homo sapiens
gctgaaggactgtgacaggcagc

SEQ ID NO: 5031042 - DNA, 15 bp, Homo sapiens
gctgaatgtttttct

SEQ ID NO: 5031043 - DNA, 16 bp, Homo sapiens
gctgacacctaactct

SEQ ID NO: 5031044 - DNA, 17 bp, Homo sapiens
gctgacacctaactctt

SEQ ID NO: 5031045 - DNA, 12 bp, Homo sapiens
gctgaccagaca

SEQ ID NO: 5031046 - DNA, 13 bp, Homo sapiens
gctgagaaggcag

SEQ ID NO: 5031047 - DNA, 14 bp, Homo sapiens
gctgagctggggaa

SEQ ID NO: 5031048 - DNA, 13 bp, Homo sapiens
gctgatggagccc

SEQ ID NO: 5031049 - DNA, 15 bp, Homo sapiens
gctgatggagcccca

SEQ ID NO: 5031050 - DNA, 17 bp, Homo sapiens
gctgatggagccccacc

SEQ ID NO: 5031051 - DNA, 18 bp, Homo sapiens
gctgatggagccccacct

SEQ ID NO: 5031052 - DNA, 19 bp, Homo sapiens
gctgatggagccccacctt

SEQ ID NO: 5031053 - DNA, 21 bp, Homo sapiens
gctgcccttatgcccggcgcc

SEQ ID NO: 5031054 - DNA, 18 bp, Homo sapiens
gctgccgacttggagact

SEQ ID NO: 5031055 - DNA, 21 bp, Homo sapiens
gctgccgagacagaccctctg

SEQ ID NO: 5031056 - DNA, 22 bp, Homo sapiens
gctgctaatattttcctcctga

SEQ ID NO: 5031057 - DNA, 13 bp, Homo sapiens
gctgctccccagg

SEQ ID NO: 5031058 - DNA, 13 bp, Homo sapiens
gctgctctcagcc

SEQ ID NO: 5031059 - DNA, 22 bp, Homo sapiens
gctgctgtccctcccccttgtc

SEQ ID NO: 5031060 - DNA, 19 bp, Homo sapiens
gctggatagacttgggatg

SEQ ID NO: 5031061 - DNA, 20 bp, Homo sapiens
gctggccaaagagcctttcc

SEQ ID NO: 5031062 - DNA, 12 bp, Homo sapiens
gctggccaggct

SEQ ID NO: 5031063 - DNA, 14 bp, Homo sapiens
gctggccaggctgg

SEQ ID NO: 5031064 - DNA, 13 bp, Homo sapiens
gctgggagaccct

SEQ ID NO: 5031065 - DNA, 15 bp, Homo sapiens
gctgggcccctgcac

SEQ ID NO: 5031066 - DNA, 16 bp, Homo sapiens
gctggggccaaataaa

SEQ ID NO: 5031067 - DNA, 17 bp, Homo sapiens
gctggggtcccagcagc

SEQ ID NO: 5031068 - DNA, 19 bp, Homo sapiens
gctggggtcccagcagctg

SEQ ID NO: 5031069 - DNA, 21 bp, Homo sapiens
gctggtagagacccccaggcc

SEQ ID NO: 5031070 - DNA, 20 bp, Homo sapiens
gctggtctcgaactgctgga

SEQ ID NO: 5031071 - DNA, 14 bp, Homo sapiens
gctgtctctctggg

SEQ ID NO: 5031072 - DNA, 16 bp, Homo sapiens
gctgtgtaagatttgt

SEQ ID NO: 5031073 - DNA, 23 bp, Homo sapiens
gctgtgtaagatttgtttttaaa

SEQ ID NO: 5031074 - DNA, 20 bp, Homo sapiens
gctgtgtctgccaaacacat

SEQ ID NO: 5031075 - DNA, 21 bp, Homo sapiens
gctgttggtcctctctctgtg

SEQ ID NO: 5031076 - DNA, 13 bp, Homo sapiens
gctgttttgttat

SEQ ID NO: 5031077 - DNA, 14 bp, Homo sapiens
gctgttttgttgac

SEQ ID NO: 5031078 - DNA, 23 bp, Homo sapiens
gctgttttgttgacattctgaat

SEQ ID NO: 5031079 - DNA, 14 bp, Homo sapiens
gctgtttttgttgt

SEQ ID NO: 5031080 - DNA, 14 bp, Homo sapiens
gcttaaaatacaag

SEQ ID NO: 5031081 - DNA, 16 bp, Homo sapiens
gcttatacccagtgag

SEQ ID NO: 5031082 - DNA, 19 bp, Homo sapiens
gcttatacgaaataattgt

SEQ ID NO: 5031083 - DNA, 20 bp, Homo sapiens
gcttatgttaatagtaattc

SEQ ID NO: 5031084 - DNA, 16 bp, Homo sapiens
gcttatttaataaaga

SEQ ID NO: 5031085 - DNA, 18 bp, Homo sapiens
gcttctaagtaaatacaa

SEQ ID NO: 5031086 - DNA, 22 bp, Homo sapiens
gcttctaagtaaatacaatttt

SEQ ID NO: 5031087 - DNA, 22 bp, Homo sapiens
gcttctcggcttggatcctggg

SEQ ID NO: 5031088 - DNA, 18 bp, Homo sapiens
gcttctgagcagcgagcc

SEQ ID NO: 5031089 - DNA, 23 bp, Homo sapiens
gcttctgagcagcgagcctgcta

SEQ ID NO: 5031090 - DNA, 13 bp, Homo sapiens
gcttctgcctgca

SEQ ID NO: 5031091 - DNA, 17 bp, Homo sapiens
gcttctggaatttgttc

SEQ ID NO: 5031092 - DNA, 23 bp, Homo sapiens
gcttctggaatttgttcaagttt

SEQ ID NO: 5031093 - DNA, 17 bp, Homo sapiens
gcttgaaatagtgtctg

SEQ ID NO: 5031094 - DNA, 20 bp, Homo sapiens
gcttgctccagattctgatg

SEQ ID NO: 5031095 - DNA, 21 bp, Homo sapiens
gcttgcttttcatgcaaactc

SEQ ID NO: 5031096 - DNA, 23 bp, Homo sapiens
gcttgcttttcatgcaaactctt

SEQ ID NO: 5031097 - DNA, 19 bp, Homo sapiens
gcttggatcctgggctggg

SEQ ID NO: 5031098 - DNA, 14 bp, Homo sapiens
gcttgtgacagtgc

SEQ ID NO: 5031099 - DNA, 22 bp, Homo sapiens
gctttaaacattggttcttgta

SEQ ID NO: 5031100 - DNA, 23 bp, Homo sapiens
gctttaatatcatcagtattgaa

SEQ ID NO: 5031101 - DNA, 21 bp, Homo sapiens
gctttccccatgtctcgactc

SEQ ID NO: 5031102 - DNA, 14 bp, Homo sapiens
gctttctgggatgt

SEQ ID NO: 5031103 - DNA, 20 bp, Homo sapiens
gctttctgggatgtcacagt

SEQ ID NO: 5031104 - DNA, 21 bp, Homo sapiens
gctttctgggatgtcacagtc

SEQ ID NO: 5031105 - DNA, 22 bp, Homo sapiens
gctttgagagagaaaggactcc

SEQ ID NO: 5031106 - DNA, 14 bp, Homo sapiens
gctttgtctgtcgt

SEQ ID NO: 5031107 - DNA, 20 bp, Homo sapiens
gcttttgcccattttgaatc

SEQ ID NO: 5031108 - DNA, 19 bp, Homo sapiens
gcttttgtgatggagtgct

SEQ ID NO: 5031109 - DNA, 21 bp, Homo sapiens
ggaaaatggccatgcaggagg

SEQ ID NO: 5031110 - DNA, 15 bp, Homo sapiens
ggaaacgagactttc

SEQ ID NO: 5031111 - DNA, 17 bp, Homo sapiens
ggaacaccataggtcac

SEQ ID NO: 5031112 - DNA, 12 bp, Homo sapiens
ggaagaagaaat

SEQ ID NO: 5031113 - DNA, 17 bp, Homo sapiens
ggaagagcccgcagggc

SEQ ID NO: 5031114 - DNA, 20 bp, Homo sapiens
ggaagcgcgagggcctcaaa

SEQ ID NO: 5031115 - DNA, 19 bp, Homo sapiens
ggaagctagtcttttgctt

SEQ ID NO: 5031116 - DNA, 14 bp, Homo sapiens
ggaaggatctgctg

SEQ ID NO: 5031117 - DNA, 15 bp, Homo sapiens
ggaaggatctgctga

SEQ ID NO: 5031118 - DNA, 18 bp, Homo sapiens
ggaataaggcccagagcg

SEQ ID NO: 5031119 - DNA, 13 bp, Homo sapiens
ggaatatgagctt

SEQ ID NO: 5031120 - DNA, 16 bp, Homo sapiens
ggaatgggagaggggt

SEQ ID NO: 5031121 - DNA, 13 bp, Homo sapiens
ggacaccagagct

SEQ ID NO: 5031122 - DNA, 21 bp, Homo sapiens
ggacacgggcctgtccacagg

SEQ ID NO: 5031123 - DNA, 23 bp, Homo sapiens
ggacacgggcctgtccacaggct

SEQ ID NO: 5031124 - DNA, 14 bp, Homo sapiens
ggacactcagacct

SEQ ID NO: 5031125 - DNA, 15 bp, Homo sapiens
ggacagaagcagctc

SEQ ID NO: 5031126 - DNA, 17 bp, Homo sapiens
ggacagaagcagctctt

SEQ ID NO: 5031127 - DNA, 13 bp, Homo sapiens
ggacatgcttagc

SEQ ID NO: 5031128 - DNA, 18 bp, Homo sapiens
ggaccccgagcctggctc

SEQ ID NO: 5031129 - DNA, 23 bp, Homo sapiens
ggaccctgtccggcccagtgcca

SEQ ID NO: 5031130 - DNA, 15 bp, Homo sapiens
ggacgctttgtctgt

SEQ ID NO: 5031131 - DNA, 16 bp, Homo sapiens
ggactcctgaaaaaaa

SEQ ID NO: 5031132 - DNA, 23 bp, Homo sapiens
ggactgcacagcgtcctgtccac

SEQ ID NO: 5031133 - DNA, 19 bp, Homo sapiens
ggacttagaaaaccagctc

SEQ ID NO: 5031134 - DNA, 18 bp, Homo sapiens
ggacttttatttccagtg

SEQ ID NO: 5031135 - DNA, 23 bp, Homo sapiens
ggagaggcattgccttctctgcc

SEQ ID NO: 5031136 - DNA, 12 bp, Homo sapiens
ggagcagcagcc

SEQ ID NO: 5031137 - DNA, 16 bp, Homo sapiens
ggagcatcagtgccct

SEQ ID NO: 5031138 - DNA, 15 bp, Homo sapiens
ggaggagggttgtgc

SEQ ID NO: 5031139 - DNA, 17 bp, Homo sapiens
ggaggctgcgtgccagt

SEQ ID NO: 5031140 - DNA, 17 bp, Homo sapiens
ggaggggcagcctgtgc

SEQ ID NO: 5031141 - DNA, 19 bp, Homo sapiens
ggaggggcagcctgtgcct

SEQ ID NO: 5031142 - DNA, 15 bp, Homo sapiens
ggaggggtgtggctc

SEQ ID NO: 5031143 - DNA, 15 bp, Homo sapiens
ggaggtttgcctgtg

SEQ ID NO: 5031144 - DNA, 15 bp, Homo sapiens
ggatctgctgaggcc

SEQ ID NO: 5031145 - DNA, 22 bp, Homo sapiens
ggatctttggacagaagcagct

SEQ ID NO: 5031146 - DNA, 20 bp, Homo sapiens
ggatggcatttggtctcagg

SEQ ID NO: 5031147 - DNA, 21 bp, Homo sapiens
ggatgtacaaggacagcccct

SEQ ID NO: 5031148 - DNA, 15 bp, Homo sapiens
ggatgtccccagcag

SEQ ID NO: 5031149 - DNA, 18 bp, Homo sapiens
ggatgttatgaacagctg

SEQ ID NO: 5031150 - DNA, 16 bp, Homo sapiens
ggatttgcatatttat

SEQ ID NO: 5031151 - DNA, 15 bp, Homo sapiens
ggattttaccaaagc

SEQ ID NO: 5031152 - DNA, 16 bp, Homo sapiens
ggattttaccaaagca

SEQ ID NO: 5031153 - DNA, 13 bp, Homo sapiens
ggcaaacaggcag

SEQ ID NO: 5031154 - DNA, 11 bp, Homo sapiens
ggcaattttgt

SEQ ID NO: 5031155 - DNA, 23 bp, Homo sapiens
ggcacaagtcctggatgttgtgt

SEQ ID NO: 5031156 - DNA, 22 bp, Homo sapiens
ggcacagcggagtctgtcctgt

SEQ ID NO: 5031157 - DNA, 14 bp, Homo sapiens
ggcacaggccccct

SEQ ID NO: 5031158 - DNA, 15 bp, Homo sapiens
ggcacaggccccctt

SEQ ID NO: 5031159 - DNA, 14 bp, Homo sapiens
ggcaccagccagcg

SEQ ID NO: 5031160 - DNA, 22 bp, Homo sapiens
ggcacctcggggacaccagagc

SEQ ID NO: 5031161 - DNA, 23 bp, Homo sapiens
ggcactaacgttgagcccctgga

SEQ ID NO: 5031162 - DNA, 22 bp, Homo sapiens
ggcacttgggacaaaaacaaac

SEQ ID NO: 5031163 - DNA, 22 bp, Homo sapiens
ggcactttgaaggggcctcacc

SEQ ID NO: 5031164 - DNA, 15 bp, Homo sapiens
ggcagattcccactg

SEQ ID NO: 5031165 - DNA, 15 bp, Homo sapiens
ggcagcaccacactg

SEQ ID NO: 5031166 - DNA, 17 bp, Homo sapiens
ggcagcaccacactggg

SEQ ID NO: 5031167 - DNA, 12 bp, Homo sapiens
ggcaggcttggg

SEQ ID NO: 5031168 - DNA, 23 bp, Homo sapiens
ggcaggtatgatcggcaggacac

SEQ ID NO: 5031169 - DNA, 23 bp, Homo sapiens
ggcagtacctgggcaagctggcg

SEQ ID NO: 5031170 - DNA, 12 bp, Homo sapiens
ggcagtggaggt

SEQ ID NO: 5031171 - DNA, 14 bp, Homo sapiens
ggcagttatatttt

SEQ ID NO: 5031172 - DNA, 19 bp, Homo sapiens
ggcatggaaggggcttctg

SEQ ID NO: 5031173 - DNA, 16 bp, Homo sapiens
ggcattaacacaaagg

SEQ ID NO: 5031174 - DNA, 19 bp, Homo sapiens
ggcattagaattatttaaa

SEQ ID NO: 5031175 - DNA, 20 bp, Homo sapiens
ggcattagaattatttaaac

SEQ ID NO: 5031176 - DNA, 21 bp, Homo sapiens
ggcatttcaattcctggccct

SEQ ID NO: 5031177 - DNA, 14 bp, Homo sapiens
ggcatttggtgaga

SEQ ID NO: 5031178 - DNA, 21 bp, Homo sapiens
ggcatttggtgagagtcaaag

SEQ ID NO: 5031179 - DNA, 22 bp, Homo sapiens
ggcatttggtgagagtcaaagc

SEQ ID NO: 5031180 - DNA, 15 bp, Homo sapiens
ggcatttttatttta

SEQ ID NO: 5031181 - DNA, 16 bp, Homo sapiens
ggccaaaggctggtgg

SEQ ID NO: 5031182 - DNA, 19 bp, Homo sapiens
ggccaagcagtgcctgcct

SEQ ID NO: 5031183 - DNA, 20 bp, Homo sapiens
ggccacacttcaaactactt

SEQ ID NO: 5031184 - DNA, 21 bp, Homo sapiens
ggccacagccactaatcagga

SEQ ID NO: 5031185 - DNA, 23 bp, Homo sapiens
ggccagagagcctggtgctgctg

SEQ ID NO: 5031186 - DNA, 23 bp, Homo sapiens
ggccagatgcacatccctggaag

SEQ ID NO: 5031187 - DNA, 20 bp, Homo sapiens
ggccagctgccccagccaga

SEQ ID NO: 5031188 - DNA, 18 bp, Homo sapiens
ggcccagagcgaggaaag

SEQ ID NO: 5031189 - DNA, 11 bp, Homo sapiens
ggccccacttt

SEQ ID NO: 5031190 - DNA, 17 bp, Homo sapiens
ggccccactttgaaggg

SEQ ID NO: 5031191 - DNA, 21 bp, Homo sapiens
ggccccctccccccagactct

SEQ ID NO: 5031192 - DNA, 20 bp, Homo sapiens
ggccccctctcggccaggca

SEQ ID NO: 5031193 - DNA, 12 bp, Homo sapiens
ggcccctggccc

SEQ ID NO: 5031194 - DNA, 18 bp, Homo sapiens
ggcccggccacacccagc

SEQ ID NO: 5031195 - DNA, 17 bp, Homo sapiens
ggccctgccctggcagg

SEQ ID NO: 5031196 - DNA, 17 bp, Homo sapiens
ggccgcacgcctctccc

SEQ ID NO: 5031197 - DNA, 16 bp, Homo sapiens
ggccgccccctgcccc

SEQ ID NO: 5031198 - DNA, 19 bp, Homo sapiens
ggccgccccctgcccccca

SEQ ID NO: 5031199 - DNA, 22 bp, Homo sapiens
ggccgccccctgccccccagcc

SEQ ID NO: 5031200 - DNA, 22 bp, Homo sapiens
ggcctgggggacccctggctct

SEQ ID NO: 5031201 - DNA, 22 bp, Homo sapiens
ggcctgtccacaggcttctgag

SEQ ID NO: 5031202 - DNA, 16 bp, Homo sapiens
ggcctgtccaccctgc

SEQ ID NO: 5031203 - DNA, 15 bp, Homo sapiens
ggcgcgggcagccac

SEQ ID NO: 5031204 - DNA, 13 bp, Homo sapiens
ggcggagccggcc

SEQ ID NO: 5031205 - DNA, 20 bp, Homo sapiens
ggcggctggggtcccagcag

SEQ ID NO: 5031206 - DNA, 17 bp, Homo sapiens
ggcggtgcccacaccgg

SEQ ID NO: 5031207 - DNA, 23 bp, Homo sapiens
ggcggtgcccacaccggggacag

SEQ ID NO: 5031208 - DNA, 22 bp, Homo sapiens
ggctacaccttagcctgccctc

SEQ ID NO: 5031209 - DNA, 14 bp, Homo sapiens
ggctaggggctggg

SEQ ID NO: 5031210 - DNA, 18 bp, Homo sapiens
ggctatagatgtcttttc

SEQ ID NO: 5031211 - DNA, 14 bp, Homo sapiens
ggctcagcccgctg

SEQ ID NO: 5031212 - DNA, 21 bp, Homo sapiens
ggctccccatgtgtcctggtt

SEQ ID NO: 5031213 - DNA, 22 bp, Homo sapiens
ggctccccatgtgtcctggttc

SEQ ID NO: 5031214 - DNA, 17 bp, Homo sapiens
ggctctctgtaggcaca

SEQ ID NO: 5031215 - DNA, 15 bp, Homo sapiens
ggctctgggaatggg

SEQ ID NO: 5031216 - DNA, 19 bp, Homo sapiens
ggctctgggccgggcctgg

SEQ ID NO: 5031217 - DNA, 16 bp, Homo sapiens
ggctctgtccccagcc

SEQ ID NO: 5031218 - DNA, 23 bp, Homo sapiens
ggctctgtccccagcctgggaaa

SEQ ID NO: 5031219 - DNA, 19 bp, Homo sapiens
ggctcttgatacccccctc

SEQ ID NO: 5031220 - DNA, 13 bp, Homo sapiens
ggctgaaagacag

SEQ ID NO: 5031221 - DNA, 21 bp, Homo sapiens
ggctgaacactccaattaagg

SEQ ID NO: 5031222 - DNA, 23 bp, Homo sapiens
ggctgacgtgtgagggaggacag

SEQ ID NO: 5031223 - DNA, 21 bp, Homo sapiens
ggctgatgccaagttgtttga

SEQ ID NO: 5031224 - DNA, 22 bp, Homo sapiens
ggctgatgccaagttgtttgag

SEQ ID NO: 5031225 - DNA, 17 bp, Homo sapiens
ggctgcggcgtctgtct

SEQ ID NO: 5031226 - DNA, 21 bp, Homo sapiens
ggctgggcagcacaaggcctt

SEQ ID NO: 5031227 - DNA, 18 bp, Homo sapiens
ggctggggtcccagcagc

SEQ ID NO: 5031228 - DNA, 21 bp, Homo sapiens
ggctggggtcccagcagctgc

SEQ ID NO: 5031229 - DNA, 14 bp, Homo sapiens
ggctgggtggcccc

SEQ ID NO: 5031230 - DNA, 20 bp, Homo sapiens
ggctgtgtaagatttgtttt

SEQ ID NO: 5031231 - DNA, 21 bp, Homo sapiens
ggcttaagtgagcagaacagg

SEQ ID NO: 5031232 - DNA, 16 bp, Homo sapiens
ggcttcatgccagcta

SEQ ID NO: 5031233 - DNA, 13 bp, Homo sapiens
ggcttctgagcag

SEQ ID NO: 5031234 - DNA, 23 bp, Homo sapiens
ggcttgccccactctgcctgcct

SEQ ID NO: 5031235 - DNA, 17 bp, Homo sapiens
ggcttggatcctgggct

SEQ ID NO: 5031236 - DNA, 14 bp, Homo sapiens
gggaagggacacac

SEQ ID NO: 5031237 - DNA, 17 bp, Homo sapiens
gggacatgccctgtgtg

SEQ ID NO: 5031238 - DNA, 18 bp, Homo sapiens
gggacctggtaccctcct

SEQ ID NO: 5031239 - DNA, 20 bp, Homo sapiens
gggagacagttgagagcggg

SEQ ID NO: 5031240 - DNA, 12 bp, Homo sapiens
gggagtggcgcg

SEQ ID NO: 5031241 - DNA, 12 bp, Homo sapiens
gggatggggagg

SEQ ID NO: 5031242 - DNA, 14 bp, Homo sapiens
gggatgtgacatgc

SEQ ID NO: 5031243 - DNA, 20 bp, Homo sapiens
gggcactttaaatgaagcta

SEQ ID NO: 5031244 - DNA, 21 bp, Homo sapiens
gggcagaggcagtacctgggc

SEQ ID NO: 5031245 - DNA, 15 bp, Homo sapiens
gggcagccacccaag

SEQ ID NO: 5031246 - DNA, 15 bp, Homo sapiens
gggcagcctgtgcct

SEQ ID NO: 5031247 - DNA, 14 bp, Homo sapiens
gggcaggcttgggg

SEQ ID NO: 5031248 - DNA, 13 bp, Homo sapiens
gggcagggtgggg

SEQ ID NO: 5031249 - DNA, 21 bp, Homo sapiens
gggcaggttctgcctgctttg

SEQ ID NO: 5031250 - DNA, 19 bp, Homo sapiens
gggcatttggtgagagtca

SEQ ID NO: 5031251 - DNA, 20 bp, Homo sapiens
gggccactgtggtggcagtg

SEQ ID NO: 5031252 - DNA, 14 bp, Homo sapiens
gggccccagaggct

SEQ ID NO: 5031253 - DNA, 19 bp, Homo sapiens
gggccctgccctggcaggg

SEQ ID NO: 5031254 - DNA, 14 bp, Homo sapiens
gggccgggcctggg

SEQ ID NO: 5031255 - DNA, 23 bp, Homo sapiens
gggctacaccttagcctgccctc

SEQ ID NO: 5031256 - DNA, 18 bp, Homo sapiens
gggctaggggctggggcc

SEQ ID NO: 5031257 - DNA, 16 bp, Homo sapiens
gggctgagggtgccct

SEQ ID NO: 5031258 - DNA, 22 bp, Homo sapiens
gggctggggccaaataaagtct

SEQ ID NO: 5031259 - DNA, 17 bp, Homo sapiens
ggggcagaggcagtacc

SEQ ID NO: 5031260 - DNA, 23 bp, Homo sapiens
ggggcagaggcagtacctgggca

SEQ ID NO: 5031261 - DNA, 18 bp, Homo sapiens
ggggccaaataaagtctc

SEQ ID NO: 5031262 - DNA, 19 bp, Homo sapiens
ggggtgtggctccttccca

SEQ ID NO: 5031263 - DNA, 15 bp, Homo sapiens
gggtgcacccacctg

SEQ ID NO: 5031264 - DNA, 14 bp, Homo sapiens
gggtgcccttttcc

SEQ ID NO: 5031265 - DNA, 19 bp, Homo sapiens
gggtgcgtctccagtcatc

SEQ ID NO: 5031266 - DNA, 16 bp, Homo sapiens
gggttcttgagccagc

SEQ ID NO: 5031267 - DNA, 20 bp, Homo sapiens
ggtaaagttaagttgagata

SEQ ID NO: 5031268 - DNA, 18 bp, Homo sapiens
ggtaagtgttctcatgaa

SEQ ID NO: 5031269 - DNA, 16 bp, Homo sapiens
ggtacccaattcaatt

SEQ ID NO: 5031270 - DNA, 14 bp, Homo sapiens
ggtaccctcctggc

SEQ ID NO: 5031271 - DNA, 13 bp, Homo sapiens
ggtaccctctgga

SEQ ID NO: 5031272 - DNA, 21 bp, Homo sapiens
ggtacttagagtttctgtttg

SEQ ID NO: 5031273 - DNA, 13 bp, Homo sapiens
ggtagaaaaacat

SEQ ID NO: 5031274 - DNA, 20 bp, Homo sapiens
ggtagaaagagatacagagg

SEQ ID NO: 5031275 - DNA, 12 bp, Homo sapiens
ggtagagacccc

SEQ ID NO: 5031276 - DNA, 14 bp, Homo sapiens
ggtagagaccccca

SEQ ID NO: 5031277 - DNA, 15 bp, Homo sapiens
ggtagagacccccag

SEQ ID NO: 5031278 - DNA, 20 bp, Homo sapiens
ggtagttttttcatcttcag

SEQ ID NO: 5031279 - DNA, 14 bp, Homo sapiens
ggtcaagcccagaa

SEQ ID NO: 5031280 - DNA, 17 bp, Homo sapiens
ggtccacacctgggcat

SEQ ID NO: 5031281 - DNA, 20 bp, Homo sapiens
ggtccagccctggctgaagg

SEQ ID NO: 5031282 - DNA, 22 bp, Homo sapiens
ggtccagccctggctgaaggac

SEQ ID NO: 5031283 - DNA, 15 bp, Homo sapiens
ggtcccagcagctgc

SEQ ID NO: 5031284 - DNA, 13 bp, Homo sapiens
ggtcctggcctcc

SEQ ID NO: 5031285 - DNA, 10 bp, Homo sapiens
ggtccttcaa

SEQ ID NO: 5031286 - DNA, 23 bp, Homo sapiens
ggtgacaaaccatttccaacagc

SEQ ID NO: 5031287 - DNA, 21 bp, Homo sapiens
ggtgagcctagccctgggaca

SEQ ID NO: 5031288 - DNA, 13 bp, Homo sapiens
ggtgcaaggaaaa

SEQ ID NO: 5031289 - DNA, 14 bp, Homo sapiens
ggtgcacccacctg

SEQ ID NO: 5031290 - DNA, 17 bp, Homo sapiens
ggtgcacccacctgttt

SEQ ID NO: 5031291 - DNA, 15 bp, Homo sapiens
ggtgctccctctgtc

SEQ ID NO: 5031292 - DNA, 15 bp, Homo sapiens
ggtggaacaagcaca

SEQ ID NO: 5031293 - DNA, 23 bp, Homo sapiens
ggtggattctccctgggcctcag

SEQ ID NO: 5031294 - DNA, 18 bp, Homo sapiens
ggtggcttaagtgagcag

SEQ ID NO: 5031295 - DNA, 17 bp, Homo sapiens
ggtgggatttgtaaagc

SEQ ID NO: 5031296 - DNA, 12 bp, Homo sapiens
ggtgggggagga

SEQ ID NO: 5031297 - DNA, 23 bp, Homo sapiens
ggtggggtcctggagcagaccac

SEQ ID NO: 5031298 - DNA, 19 bp, Homo sapiens
ggtgtgctagaacaaggtc

SEQ ID NO: 5031299 - DNA, 17 bp, Homo sapiens
ggttcccgtttctccac

SEQ ID NO: 5031300 - DNA, 16 bp, Homo sapiens
ggttctgcctgctttg

SEQ ID NO: 5031301 - DNA, 22 bp, Homo sapiens
ggttcttgtattaagaatgaaa

SEQ ID NO: 5031302 - DNA, 23 bp, Homo sapiens
ggttgaggtccagccctggctga

SEQ ID NO: 5031303 - DNA, 12 bp, Homo sapiens
ggtttaaatgaa

SEQ ID NO: 5031304 - DNA, 18 bp, Homo sapiens
ggttttaggtagaaaaac

SEQ ID NO: 5031305 - DNA, 14 bp, Homo sapiens
gtaaaaatgctgct

SEQ ID NO: 5031306 - DNA, 15 bp, Homo sapiens
gtaaaaatgctgctc

SEQ ID NO: 5031307 - DNA, 13 bp, Homo sapiens
gtaaatacaattt

SEQ ID NO: 5031308 - DNA, 21 bp, Homo sapiens
gtaaatacaattttttttatt

SEQ ID NO: 5031309 - DNA, 22 bp, Homo sapiens
gtaaattggcatggaaatttaa

SEQ ID NO: 5031310 - DNA, 17 bp, Homo sapiens
gtaagagcttgctccag

SEQ ID NO: 5031311 - DNA, 16 bp, Homo sapiens
gtaagatttgttttta

SEQ ID NO: 5031312 - DNA, 17 bp, Homo sapiens
gtaagatttgtttttaa

SEQ ID NO: 5031313 - DNA, 19 bp, Homo sapiens
gtaaggctgtgtaagattt

SEQ ID NO: 5031314 - DNA, 20 bp, Homo sapiens
gtaattttacacgcttttgt

SEQ ID NO: 5031315 - DNA, 22 bp, Homo sapiens
gtaattttacacgcttttgtga

SEQ ID NO: 5031316 - DNA, 23 bp, Homo sapiens
gtacagtatgggggttgtaaatt

SEQ ID NO: 5031317 - DNA, 14 bp, Homo sapiens
gtactagtgttctg

SEQ ID NO: 5031318 - DNA, 18 bp, Homo sapiens
gtactgttctgtgtcttt

SEQ ID NO: 5031319 - DNA, 17 bp, Homo sapiens
gtacttagagtttctgt

SEQ ID NO: 5031320 - DNA, 15 bp, Homo sapiens
gtagagacccccagg

SEQ ID NO: 5031321 - DNA, 19 bp, Homo sapiens
gtagcagggtcgggaaagg

SEQ ID NO: 5031322 - DNA, 13 bp, Homo sapiens
gtaggaagcaaca

SEQ ID NO: 5031323 - DNA, 22 bp, Homo sapiens
gtaggggagggcaggcttgggg

SEQ ID NO: 5031324 - DNA, 16 bp, Homo sapiens
gtagttttcaaaacac

SEQ ID NO: 5031325 - DNA, 15 bp, Homo sapiens
gtataaacaagaaaa

SEQ ID NO: 5031326 - DNA, 23 bp, Homo sapiens
gtataagtccttgcaagaatcag

SEQ ID NO: 5031327 - DNA, 21 bp, Homo sapiens
gtatagtgtctattatcacat

SEQ ID NO: 5031328 - DNA, 14 bp, Homo sapiens
gtatagttaacaca

SEQ ID NO: 5031329 - DNA, 14 bp, Homo sapiens
gtatattttcctat

SEQ ID NO: 5031330 - DNA, 18 bp, Homo sapiens
gtatgaattattcaattt

SEQ ID NO: 5031331 - DNA, 16 bp, Homo sapiens
gtatgatacttcgaca

SEQ ID NO: 5031332 - DNA, 19 bp, Homo sapiens
gtatgttctaacctttaca

SEQ ID NO: 5031333 - DNA, 17 bp, Homo sapiens
gtatgttgaagcctttg

SEQ ID NO: 5031334 - DNA, 19 bp, Homo sapiens
gtatgtttaatctgttatg

SEQ ID NO: 5031335 - DNA, 16 bp, Homo sapiens
gtattaagaatgaaat

SEQ ID NO: 5031336 - DNA, 10 bp, Homo sapiens
gtattgaagc

SEQ ID NO: 5031337 - DNA, 18 bp, Homo sapiens
gtattgaagcattttata

SEQ ID NO: 5031338 - DNA, 15 bp, Homo sapiens
gtattgttgtccttt

SEQ ID NO: 5031339 - DNA, 19 bp, Homo sapiens
gtattgttgtccttttcat

SEQ ID NO: 5031340 - DNA, 18 bp, Homo sapiens
gtattttaaaatagcgtt

SEQ ID NO: 5031341 - DNA, 23 bp, Homo sapiens
gtattttttttttaaataaaagc

SEQ ID NO: 5031342 - DNA, 12 bp, Homo sapiens
gtcaagaagaaa

SEQ ID NO: 5031343 - DNA, 15 bp, Homo sapiens
gtcacctagcaagct

SEQ ID NO: 5031344 - DNA, 15 bp, Homo sapiens
gtcactccaccatcc

SEQ ID NO: 5031345 - DNA, 22 bp, Homo sapiens
gtcagatgctgtgcaaatgtta

SEQ ID NO: 5031346 - DNA, 20 bp, Homo sapiens
gtcaggagtgtgtgtgagtg

SEQ ID NO: 5031347 - DNA, 14 bp, Homo sapiens
gtcatctgtaagag

SEQ ID NO: 5031348 - DNA, 17 bp, Homo sapiens
gtcatctgtaagagctt

SEQ ID NO: 5031349 - DNA, 19 bp, Homo sapiens
gtcatctgtaagagcttgc

SEQ ID NO: 5031350 - DNA, 13 bp, Homo sapiens
gtcatgtttatct

SEQ ID NO: 5031351 - DNA, 23 bp, Homo sapiens
gtcattatttttgttagcaaaga

SEQ ID NO: 5031352 - DNA, 22 bp, Homo sapiens
gtccacaggcttctgagcagcg

SEQ ID NO: 5031353 - DNA, 22 bp, Homo sapiens
gtccagagtagtttctttctgt

SEQ ID NO: 5031354 - DNA, 18 bp, Homo sapiens
gtccagccctggctgaag

SEQ ID NO: 5031355 - DNA, 19 bp, Homo sapiens
gtccagccctggctgaagg

SEQ ID NO: 5031356 - DNA, 14 bp, Homo sapiens
gtcccacccccacc

SEQ ID NO: 5031357 - DNA, 19 bp, Homo sapiens
gtcccacccccacccccag

SEQ ID NO: 5031358 - DNA, 14 bp, Homo sapiens
gtcccagcagctgc

SEQ ID NO: 5031359 - DNA, 13 bp, Homo sapiens
gtccccagcctgg

SEQ ID NO: 5031360 - DNA, 20 bp, Homo sapiens
gtccccatccagcgagagag

SEQ ID NO: 5031361 - DNA, 14 bp, Homo sapiens
gtccccgaggagct

SEQ ID NO: 5031362 - DNA, 20 bp, Homo sapiens
gtccccgaggagctgggccc

SEQ ID NO: 5031363 - DNA, 13 bp, Homo sapiens
gtccggcccagtg

SEQ ID NO: 5031364 - DNA, 16 bp, Homo sapiens
gtccggcccagtgcca

SEQ ID NO: 5031365 - DNA, 12 bp, Homo sapiens
gtcctctctctg

SEQ ID NO: 5031366 - DNA, 21 bp, Homo sapiens
gtcctctctctgtggggctga

SEQ ID NO: 5031367 - DNA, 17 bp, Homo sapiens
gtcctggatgatactaa

SEQ ID NO: 5031368 - DNA, 19 bp, Homo sapiens
gtcctggatgatactaata

SEQ ID NO: 5031369 - DNA, 17 bp, Homo sapiens
gtcctggatgttgtgtg

SEQ ID NO: 5031370 - DNA, 23 bp, Homo sapiens
gtcctggtggtattttcaatagc

SEQ ID NO: 5031371 - DNA, 18 bp, Homo sapiens
gtcctgtccacacccagc

SEQ ID NO: 5031372 - DNA, 22 bp, Homo sapiens
gtcctgtccacacccagctcag

SEQ ID NO: 5031373 - DNA, 14 bp, Homo sapiens
gtcgagagctggcc

SEQ ID NO: 5031374 - DNA, 18 bp, Homo sapiens
gtcgggcaccagccagcg

SEQ ID NO: 5031375 - DNA, 19 bp, Homo sapiens
gtcgtgggccagtccccga

SEQ ID NO: 5031376 - DNA, 17 bp, Homo sapiens
gtctacacaccctgcat

SEQ ID NO: 5031377 - DNA, 16 bp, Homo sapiens
gtctaggactgcagtg

SEQ ID NO: 5031378 - DNA, 23 bp, Homo sapiens
gtctcactgtgggaaggccagct

SEQ ID NO: 5031379 - DNA, 16 bp, Homo sapiens
gtctcaggcagcacca

SEQ ID NO: 5031380 - DNA, 16 bp, Homo sapiens
gtctcagtgaagacta

SEQ ID NO: 5031381 - DNA, 12 bp, Homo sapiens
gtctcagtgtcc

SEQ ID NO: 5031382 - DNA, 21 bp, Homo sapiens
gtctcagtttgtgtgtcttaa

SEQ ID NO: 5031383 - DNA, 13 bp, Homo sapiens
gtctccgagagag

SEQ ID NO: 5031384 - DNA, 22 bp, Homo sapiens
gtctcggggcttgccccactct

SEQ ID NO: 5031385 - DNA, 21 bp, Homo sapiens
gtctctgaagtgaaactgctt

SEQ ID NO: 5031386 - DNA, 19 bp, Homo sapiens
gtctctgatgcagcttata

SEQ ID NO: 5031387 - DNA, 12 bp, Homo sapiens
gtctgctctggt

SEQ ID NO: 5031388 - DNA, 16 bp, Homo sapiens
gtctgtcgtgatgggg

SEQ ID NO: 5031389 - DNA, 13 bp, Homo sapiens
gtctgtttaaagt

SEQ ID NO: 5031390 - DNA, 16 bp, Homo sapiens
gtcttattcccttcct

SEQ ID NO: 5031391 - DNA, 15 bp, Homo sapiens
gtctttaaaagagag

SEQ ID NO: 5031392 - DNA, 16 bp, Homo sapiens
gtctttagatagccct

SEQ ID NO: 5031393 - DNA, 16 bp, Homo sapiens
gtcttttcccatttat

SEQ ID NO: 5031394 - DNA, 21 bp, Homo sapiens
gtgaaactgcttgtttcctag

SEQ ID NO: 5031395 - DNA, 20 bp, Homo sapiens
gtgaacattcccagcccagc

SEQ ID NO: 5031396 - DNA, 23 bp, Homo sapiens
gtgacaaaccatccagtggaggt

SEQ ID NO: 5031397 - DNA, 19 bp, Homo sapiens
gtgacagctttctgggatg

SEQ ID NO: 5031398 - DNA, 22 bp, Homo sapiens
gtgacatgtgttggcagcctct

SEQ ID NO: 5031399 - DNA, 13 bp, Homo sapiens
gtgacctgtttat

SEQ ID NO: 5031400 - DNA, 19 bp, Homo sapiens
gtgactgtatctgtgtaga

SEQ ID NO: 5031401 - DNA, 13 bp, Homo sapiens
gtgagcagaacag

SEQ ID NO: 5031402 - DNA, 14 bp, Homo sapiens
gtgagctgagcagg

SEQ ID NO: 5031403 - DNA, 16 bp, Homo sapiens
gtgagctgagcaggcc

SEQ ID NO: 5031404 - DNA, 19 bp, Homo sapiens
gtgatctgtttgaggagag

SEQ ID NO: 5031405 - DNA, 15 bp, Homo sapiens
gtgcaatgtgtataa

SEQ ID NO: 5031406 - DNA, 17 bp, Homo sapiens
gtgcaatgtgtataaac

SEQ ID NO: 5031407 - DNA, 15 bp, Homo sapiens
gtgcacccacctgtt

SEQ ID NO: 5031408 - DNA, 14 bp, Homo sapiens
gtgcatgtcctttg

SEQ ID NO: 5031409 - DNA, 23 bp, Homo sapiens
gtgccacccatgcagctgctccc

SEQ ID NO: 5031410 - DNA, 17 bp, Homo sapiens
gtgccactgccccccga

SEQ ID NO: 5031411 - DNA, 17 bp, Homo sapiens
gtgcccccgcctgccac

SEQ ID NO: 5031412 - DNA, 13 bp, Homo sapiens
gtgctccctctgt

SEQ ID NO: 5031413 - DNA, 14 bp, Homo sapiens
gtgctccctctgtc

SEQ ID NO: 5031414 - DNA, 16 bp, Homo sapiens
gtgctctttgttttgt

SEQ ID NO: 5031415 - DNA, 22 bp, Homo sapiens
gtgctctttgttttgtgtctct

SEQ ID NO: 5031416 - DNA, 23 bp, Homo sapiens
gtgctctttgttttgtgtctctt

SEQ ID NO: 5031417 - DNA, 15 bp, Homo sapiens
gtgctgctgctgctg

SEQ ID NO: 5031418 - DNA, 21 bp, Homo sapiens
gtgctgggaattacaggcgtg

SEQ ID NO: 5031419 - DNA, 11 bp, Homo sapiens
gtgcttggatt

SEQ ID NO: 5031420 - DNA, 17 bp, Homo sapiens
gtggagaaaattggaac

SEQ ID NO: 5031421 - DNA, 12 bp, Homo sapiens
gtggagttcacc

SEQ ID NO: 5031422 - DNA, 17 bp, Homo sapiens
gtggatgttatgaacag

SEQ ID NO: 5031423 - DNA, 16 bp, Homo sapiens
gtggattctccctggg

SEQ ID NO: 5031424 - DNA, 17 bp, Homo sapiens
gtggcaagagtgtggag

SEQ ID NO: 5031425 - DNA, 12 bp, Homo sapiens
gtggcacaggcc

SEQ ID NO: 5031426 - DNA, 21 bp, Homo sapiens
gtggctctgaggtgcctgtcc

SEQ ID NO: 5031427 - DNA, 20 bp, Homo sapiens
gtggcttaagtgagcagaac

SEQ ID NO: 5031428 - DNA, 17 bp, Homo sapiens
gtgggaagggctacacc

SEQ ID NO: 5031429 - DNA, 19 bp, Homo sapiens
gtgggaccctgtccggccc

SEQ ID NO: 5031430 - DNA, 15 bp, Homo sapiens
gtggggctgagctgg

SEQ ID NO: 5031431 - DNA, 17 bp, Homo sapiens
gtggggctgagctgggg

SEQ ID NO: 5031432 - DNA, 17 bp, Homo sapiens
gtgggtatgcgagacca

SEQ ID NO: 5031433 - DNA, 14 bp, Homo sapiens
gtggtattttcaat

SEQ ID NO: 5031434 - DNA, 16 bp, Homo sapiens
gtggtggcacaggccc

SEQ ID NO: 5031435 - DNA, 17 bp, Homo sapiens
gtggtggcagtggaggt

SEQ ID NO: 5031436 - DNA, 14 bp, Homo sapiens
gtgtacaatgtaca

SEQ ID NO: 5031437 - DNA, 19 bp, Homo sapiens
gtgtacacgtctggacccc

SEQ ID NO: 5031438 - DNA, 19 bp, Homo sapiens
gtgtcttaattattatttg

SEQ ID NO: 5031439 - DNA, 19 bp, Homo sapiens
gtgtctttagatagccctg

SEQ ID NO: 5031440 - DNA, 16 bp, Homo sapiens
gtgtctttttttgtat

SEQ ID NO: 5031441 - DNA, 16 bp, Homo sapiens
gtgtgcaacagacaag

SEQ ID NO: 5031442 - DNA, 16 bp, Homo sapiens
gtgtgcggctgtgtgt

SEQ ID NO: 5031443 - DNA, 22 bp, Homo sapiens
gtgtggagttcaccttggaagg

SEQ ID NO: 5031444 - DNA, 14 bp, Homo sapiens
gtgttacccactgc

SEQ ID NO: 5031445 - DNA, 20 bp, Homo sapiens
gtgttctcatgaagcaggag

SEQ ID NO: 5031446 - DNA, 19 bp, Homo sapiens
gtgttgagccttttccctc

SEQ ID NO: 5031447 - DNA, 14 bp, Homo sapiens
gtgtttaagacatt

SEQ ID NO: 5031448 - DNA, 15 bp, Homo sapiens
gtgtttatcctttca

SEQ ID NO: 5031449 - DNA, 14 bp, Homo sapiens
gttaaaagaggttt

SEQ ID NO: 5031450 - DNA, 21 bp, Homo sapiens
gttaacacactaccgaatgtg

SEQ ID NO: 5031451 - DNA, 22 bp, Homo sapiens
gttaactgaataccactctgta

SEQ ID NO: 5031452 - DNA, 23 bp, Homo sapiens
gttaactgaataccactctgtaa

SEQ ID NO: 5031453 - DNA, 15 bp, Homo sapiens
gttaagaaatttcac

SEQ ID NO: 5031454 - DNA, 15 bp, Homo sapiens
gttaagtctgtttta

SEQ ID NO: 5031455 - DNA, 23 bp, Homo sapiens
gttaagttgagatagttttcatc

SEQ ID NO: 5031456 - DNA, 14 bp, Homo sapiens
gttatataatttag

SEQ ID NO: 5031457 - DNA, 12 bp, Homo sapiens
gttatctctgtg

SEQ ID NO: 5031458 - DNA, 13 bp, Homo sapiens
gttatgaacagct

SEQ ID NO: 5031459 - DNA, 16 bp, Homo sapiens
gttcaacccacagcta

SEQ ID NO: 5031460 - DNA, 12 bp, Homo sapiens
gttcaagttttg

SEQ ID NO: 5031461 - DNA, 22 bp, Homo sapiens
gttcaccttgaagaacctctca

SEQ ID NO: 5031462 - DNA, 14 bp, Homo sapiens
gttcaccttggaag

SEQ ID NO: 5031463 - DNA, 15 bp, Homo sapiens
gttcaccttggaagg

SEQ ID NO: 5031464 - DNA, 12 bp, Homo sapiens
gttcagcagaac

SEQ ID NO: 5031465 - DNA, 22 bp, Homo sapiens
gttcagcagaacctgcacacag

SEQ ID NO: 5031466 - DNA, 10 bp, Homo sapiens
gttcattaaa

SEQ ID NO: 5031467 - DNA, 20 bp, Homo sapiens
gttcattaaacgtcattcag

SEQ ID NO: 5031468 - DNA, 17 bp, Homo sapiens
gttccattaaacgattt

SEQ ID NO: 5031469 - DNA, 18 bp, Homo sapiens
gttcccacattaaagaag

SEQ ID NO: 5031470 - DNA, 14 bp, Homo sapiens
gttctcatgaagca

SEQ ID NO: 5031471 - DNA, 13 bp, Homo sapiens
gttctccccaggg

SEQ ID NO: 5031472 - DNA, 23 bp, Homo sapiens
gttctgtgtctttcacagctcct

SEQ ID NO: 5031473 - DNA, 17 bp, Homo sapiens
gttctgttaactgaata

SEQ ID NO: 5031474 - DNA, 19 bp, Homo sapiens
gttcttagctcaatgagca

SEQ ID NO: 5031475 - DNA, 13 bp, Homo sapiens
gttcttgtaattt

SEQ ID NO: 5031476 - DNA, 13 bp, Homo sapiens
gttcttgttggtg

SEQ ID NO: 5031477 - DNA, 22 bp, Homo sapiens
gttgaagggaggtggcaagagt

SEQ ID NO: 5031478 - DNA, 17 bp, Homo sapiens
gttgacattctgaatgc

SEQ ID NO: 5031479 - DNA, 18 bp, Homo sapiens
gttgacattctgaatgct

SEQ ID NO: 5031480 - DNA, 22 bp, Homo sapiens
gttgacttccaggcacggtttg

SEQ ID NO: 5031481 - DNA, 18 bp, Homo sapiens
gttgagatagttttcatc

SEQ ID NO: 5031482 - DNA, 21 bp, Homo sapiens
gttgatgcctgtgaactgaac

SEQ ID NO: 5031483 - DNA, 20 bp, Homo sapiens
gttgcagctgttttgttgac

SEQ ID NO: 5031484 - DNA, 23 bp, Homo sapiens
gttgcagctgttttgttgacatt

SEQ ID NO: 5031485 - DNA, 14 bp, Homo sapiens
gttggtcctctctc

SEQ ID NO: 5031486 - DNA, 15 bp, Homo sapiens
gttggttttcttctt

SEQ ID NO: 5031487 - DNA, 14 bp, Homo sapiens
gttgtaaattggca

SEQ ID NO: 5031488 - DNA, 16 bp, Homo sapiens
gttgtaaattggcatg

SEQ ID NO: 5031489 - DNA, 15 bp, Homo sapiens
gttgtccttttcata

SEQ ID NO: 5031490 - DNA, 20 bp, Homo sapiens
gttgtctctgatgcagctta

SEQ ID NO: 5031491 - DNA, 12 bp, Homo sapiens
gttgttctgtta

SEQ ID NO: 5031492 - DNA, 17 bp, Homo sapiens
gttgttgcatgtttgaa

SEQ ID NO: 5031493 - DNA, 20 bp, Homo sapiens
gttgttttttcctttgctct

SEQ ID NO: 5031494 - DNA, 18 bp, Homo sapiens
gtttatgagatgctggtt

SEQ ID NO: 5031495 - DNA, 15 bp, Homo sapiens
gtttatgtaatttca

SEQ ID NO: 5031496 - DNA, 22 bp, Homo sapiens
gtttatgttccattaaacgatt

SEQ ID NO: 5031497 - DNA, 19 bp, Homo sapiens
gtttctttctgtctgcttt

SEQ ID NO: 5031498 - DNA, 20 bp, Homo sapiens
gtttgaaatgaggtctgttt

SEQ ID NO: 5031499 - DNA, 21 bp, Homo sapiens
gtttgcatttggatgtgtaaa

SEQ ID NO: 5031500 - DNA, 12 bp, Homo sapiens
gtttgcctgtga

SEQ ID NO: 5031501 - DNA, 20 bp, Homo sapiens
gtttgggccccagaggctgg

SEQ ID NO: 5031502 - DNA, 13 bp, Homo sapiens
gtttgtgtgtctt

SEQ ID NO: 5031503 - DNA, 16 bp, Homo sapiens
gttttcaaaacacata

SEQ ID NO: 5031504 - DNA, 18 bp, Homo sapiens
gttttcatccataactga

SEQ ID NO: 5031505 - DNA, 17 bp, Homo sapiens
gttttctctcggctccc

SEQ ID NO: 5031506 - DNA, 16 bp, Homo sapiens
gttttctgaaacacac

SEQ ID NO: 5031507 - DNA, 18 bp, Homo sapiens
tccagtgaacattcccag

SEQ ID NO: 5031508 - DNA, 20 bp, Homo sapiens
tccagtgacaaaccatccag

SEQ ID NO: 5031509 - DNA, 16 bp, Homo sapiens
tccagtttgcatttgg

SEQ ID NO: 5031510 - DNA, 14 bp, Homo sapiens
tccatctctgactt

SEQ ID NO: 5031511 - DNA, 18 bp, Homo sapiens
tccatgtacttgtttgca

SEQ ID NO: 5031512 - DNA, 17 bp, Homo sapiens
tcccaagcggtgtctct

SEQ ID NO: 5031513 - DNA, 15 bp, Homo sapiens
tcccaagggctgccg

SEQ ID NO: 5031514 - DNA, 11 bp, Homo sapiens
tcccacacagg

SEQ ID NO: 5031515 - DNA, 22 bp, Homo sapiens
tcccacccacccgccgcctccc

SEQ ID NO: 5031516 - DNA, 20 bp, Homo sapiens
tcccacccccacccccagct

SEQ ID NO: 5031517 - DNA, 23 bp, Homo sapiens
tcccacccccacccccagctcaa

SEQ ID NO: 5031518 - DNA, 14 bp, Homo sapiens
tcccagaggagcag

SEQ ID NO: 5031519 - DNA, 15 bp, Homo sapiens
tcccatcctgtgtgt

SEQ ID NO: 5031520 - DNA, 18 bp, Homo sapiens
tccccacttctgtgccac

SEQ ID NO: 5031521 - DNA, 19 bp, Homo sapiens
tccccacttgtccgctggg

SEQ ID NO: 5031522 - DNA, 21 bp, Homo sapiens
tccccaggcatttgccaaggg

SEQ ID NO: 5031523 - DNA, 12 bp, Homo sapiens
tccccccagact

SEQ ID NO: 5031524 - DNA, 18 bp, Homo sapiens
tccccgaggagctgggcc

SEQ ID NO: 5031525 - DNA, 19 bp, Homo sapiens
tccccgaggagctgggccc

SEQ ID NO: 5031526 - DNA, 15 bp, Homo sapiens
tcccctcacctcctc

SEQ ID NO: 5031527 - DNA, 23 bp, Homo sapiens
tccccttgatttaaacacacaga

SEQ ID NO: 5031528 - DNA, 18 bp, Homo sapiens
tccctcaactgaaggggt

SEQ ID NO: 5031529 - DNA, 12 bp, Homo sapiens
tccctccccctt

SEQ ID NO: 5031530 - DNA, 16 bp, Homo sapiens
tccctcccctctcaga

SEQ ID NO: 5031531 - DNA, 21 bp, Homo sapiens
tccctcccctctcagaacata

SEQ ID NO: 5031532 - DNA, 23 bp, Homo sapiens
tccctgagatgggcttcccaagg

SEQ ID NO: 5031533 - DNA, 19 bp, Homo sapiens
tccctgcactccctcctgg

SEQ ID NO: 5031534 - DNA, 16 bp, Homo sapiens
tccctgcgcctgtgat

SEQ ID NO: 5031535 - DNA, 15 bp, Homo sapiens
tccctggcctttcat

SEQ ID NO: 5031536 - DNA, 21 bp, Homo sapiens
tccctggtagtgtagctgtgt

SEQ ID NO: 5031537 - DNA, 21 bp, Homo sapiens
tcccttcagtaccctctcagc

SEQ ID NO: 5031538 - DNA, 23 bp, Homo sapiens
tcccttcagtaccctctcagctc

SEQ ID NO: 5031539 - DNA, 19 bp, Homo sapiens
tcccttcctgccagcccct

SEQ ID NO: 5031540 - DNA, 16 bp, Homo sapiens
tccggcccagtgccac

SEQ ID NO: 5031541 - DNA, 22 bp, Homo sapiens
tccggcccagtgccactgcccc

SEQ ID NO: 5031542 - DNA, 22 bp, Homo sapiens
tccgtgtgattgtctttgaatc

SEQ ID NO: 5031543 - DNA, 17 bp, Homo sapiens
tcctaagagtgctgggc

SEQ ID NO: 5031544 - DNA, 15 bp, Homo sapiens
tcctagcgcagccat

SEQ ID NO: 5031545 - DNA, 23 bp, Homo sapiens
tcctagcgcagccatgtgattac

SEQ ID NO: 5031546 - DNA, 22 bp, Homo sapiens
tcctcatcccgtgttctccttt

SEQ ID NO: 5031547 - DNA, 12 bp, Homo sapiens
tcctcatttgtt

SEQ ID NO: 5031548 - DNA, 18 bp, Homo sapiens
tcctcatttgttcattaa

SEQ ID NO: 5031549 - DNA, 15 bp, Homo sapiens
gttttgggtatgttt

SEQ ID NO: 5031550 - DNA, 16 bp, Homo sapiens
gttttggttgctttaa

SEQ ID NO: 5031551 - DNA, 17 bp, Homo sapiens
gttttgtctgtctccct

SEQ ID NO: 5031552 - DNA, 20 bp, Homo sapiens
gttttgtttcgctctttgag

SEQ ID NO: 5031553 - DNA, 13 bp, Homo sapiens
gtttttaaactgt

SEQ ID NO: 5031554 - DNA, 20 bp, Homo sapiens
gtttttaaactgtacagtgt

SEQ ID NO: 5031555 - DNA, 17 bp, Homo sapiens
gtttttacagctgtgtt

SEQ ID NO: 5031556 - DNA, 17 bp, Homo sapiens
gtttttatattaatgta

SEQ ID NO: 5031557 - DNA, 13 bp, Homo sapiens
gtttttctaaagg

SEQ ID NO: 5031558 - DNA, 16 bp, Homo sapiens
gttttttcctttgctc

SEQ ID NO: 5031559 - DNA, 12 bp, Homo sapiens
gtttttttctat

SEQ ID NO: 5031560 - DNA, 18 bp, Homo sapiens
gttttttttttcttgtct

SEQ ID NO: 5031561 - DNA, 20 bp, Homo sapiens
gttttttttttttttatgtg

SEQ ID NO: 5031562 - DNA, 21 bp, Homo sapiens
taaaatagcgttcttgtaatt

SEQ ID NO: 5031563 - DNA, 14 bp, Homo sapiens
taaacaagaaaaat

SEQ ID NO: 5031564 - DNA, 18 bp, Homo sapiens
taaacaagaaaaataaag

SEQ ID NO: 5031565 - DNA, 20 bp, Homo sapiens
taaacaagaaaaataaagaa

SEQ ID NO: 5031566 - DNA, 20 bp, Homo sapiens
taaacacaagattggtgttt

SEQ ID NO: 5031567 - DNA, 14 bp, Homo sapiens
taaacacacagata

SEQ ID NO: 5031568 - DNA, 18 bp, Homo sapiens
taaacacacagatacaca

SEQ ID NO: 5031569 - DNA, 22 bp, Homo sapiens
taaacacacagatacacacaca

SEQ ID NO: 5031570 - DNA, 21 bp, Homo sapiens
taaacattggttcttgtatta

SEQ ID NO: 5031571 - DNA, 16 bp, Homo sapiens
taaacgatttttaaaa

SEQ ID NO: 5031572 - DNA, 17 bp, Homo sapiens
taaacgatttttaaaat

SEQ ID NO: 5031573 - DNA, 16 bp, Homo sapiens
taaactaataattgca

SEQ ID NO: 5031574 - DNA, 16 bp, Homo sapiens
taaactactctttgat

SEQ ID NO: 5031575 - DNA, 18 bp, Homo sapiens
taaactactctttgattt

SEQ ID NO: 5031576 - DNA, 20 bp, Homo sapiens
taaactgtacagtgtctttt

SEQ ID NO: 5031577 - DNA, 11 bp, Homo sapiens
taaagaaaaaa

SEQ ID NO: 5031578 - DNA, 18 bp, Homo sapiens
taaagaaaaaaattgaaa

SEQ ID NO: 5031579 - DNA, 17 bp, Homo sapiens
taaagaagttgaagttt

SEQ ID NO: 5031580 - DNA, 15 bp, Homo sapiens
taaagacagaggcag

SEQ ID NO: 5031581 - DNA, 16 bp, Homo sapiens
taaagcaggttcttgt

SEQ ID NO: 5031582 - DNA, 11 bp, Homo sapiens
taaagcattta

SEQ ID NO: 5031583 - DNA, 17 bp, Homo sapiens
taaaggagtttatgttc

SEQ ID NO: 5031584 - DNA, 19 bp, Homo sapiens
taaaggagtttatgttcca

SEQ ID NO: 5031585 - DNA, 13 bp, Homo sapiens
taaagtagaagag

SEQ ID NO: 5031586 - DNA, 18 bp, Homo sapiens
taaagtgccagtatttta

SEQ ID NO: 5031587 - DNA, 22 bp, Homo sapiens
taaagtgccagtattttaaaat

SEQ ID NO: 5031588 - DNA, 23 bp, Homo sapiens
taaagtgccagtattttaaaata

SEQ ID NO: 5031589 - DNA, 15 bp, Homo sapiens
taaatatattattac

SEQ ID NO: 5031590 - DNA, 20 bp, Homo sapiens
taaatatattattacttgta

SEQ ID NO: 5031591 - DNA, 19 bp, Homo sapiens
taaatcgcttttgataatc

SEQ ID NO: 5031592 - DNA, 13 bp, Homo sapiens
taaatgaacaaga

SEQ ID NO: 5031593 - DNA, 17 bp, Homo sapiens
taaatgcaaataacaaa

SEQ ID NO: 5031594 - DNA, 20 bp, Homo sapiens
taaattggcatggaaattta

SEQ ID NO: 5031595 - DNA, 20 bp, Homo sapiens
taacaaatgccaaattaaaa

SEQ ID NO: 5031596 - DNA, 14 bp, Homo sapiens
taacataagctatt

SEQ ID NO: 5031597 - DNA, 17 bp, Homo sapiens
taacccccctgtacaca

SEQ ID NO: 5031598 - DNA, 19 bp, Homo sapiens
taaccttgcctggtacagt

SEQ ID NO: 5031599 - DNA, 18 bp, Homo sapiens
tgttaggcatgtcccacc

SEQ ID NO: 5031600 - DNA, 20 bp, Homo sapiens
tgttaggcatgtcccaccca

SEQ ID NO: 5031601 - DNA, 12 bp, Homo sapiens
tgttatataatt

SEQ ID NO: 5031602 - DNA, 15 bp, Homo sapiens
tgttatataatttag

SEQ ID NO: 5031603 - DNA, 15 bp, Homo sapiens
tgttatatataaata

SEQ ID NO: 5031604 - DNA, 17 bp, Homo sapiens
tgttatatataaatata

SEQ ID NO: 5031605 - DNA, 14 bp, Homo sapiens
tgttatgaacagct

SEQ ID NO: 5031606 - DNA, 15 bp, Homo sapiens
tgttatgaacagctg

SEQ ID NO: 5031607 - DNA, 16 bp, Homo sapiens
tgttatgaacagctgt

SEQ ID NO: 5031608 - DNA, 24 bp, Homo sapiens
tgttatgaacagctgtgtctgcca

SEQ ID NO: 5031609 - DNA, 20 bp, Homo sapiens
tgttatgtactagtgttctg

SEQ ID NO: 5031610 - DNA, 22 bp, Homo sapiens
tgttattgttttgttaattaca

SEQ ID NO: 5031611 - DNA, 14 bp, Homo sapiens
tgttcagcagaacc

SEQ ID NO: 5031612 - DNA, 21 bp, Homo sapiens
tgttcattaaacgtcattcag

SEQ ID NO: 5031613 - DNA, 15 bp, Homo sapiens
tgttccattaaacga

SEQ ID NO: 5031614 - DNA, 14 bp, Homo sapiens
tgttctcctcccca

SEQ ID NO: 5031615 - DNA, 13 bp, Homo sapiens
tgttctgtgtctt

SEQ ID NO: 5031616 - DNA, 18 bp, Homo sapiens
tgttctgttaactgaata

SEQ ID NO: 5031617 - DNA, 13 bp, Homo sapiens
tgttctgttttgt

SEQ ID NO: 5031618 - DNA, 16 bp, Homo sapiens
tgttctgttttgtttc

SEQ ID NO: 5031619 - DNA, 20 bp, Homo sapiens
tgttcttagctcaatgagca

SEQ ID NO: 5031620 - DNA, 14 bp, Homo sapiens
tgttgacattagtc

SEQ ID NO: 5031621 - DNA, 16 bp, Homo sapiens
tgttgacattctgaat

SEQ ID NO: 5031622 - DNA, 17 bp, Homo sapiens
tgttgacattctgaatg

SEQ ID NO: 5031623 - DNA, 18 bp, Homo sapiens
tgttgacattctgaatgc

SEQ ID NO: 5031624 - DNA, 14 bp, Homo sapiens
tgttggcagcctct

SEQ ID NO: 5031625 - DNA, 18 bp, Homo sapiens
tgttggtgcacagcacaa

SEQ ID NO: 5031626 - DNA, 16 bp, Homo sapiens
tgttggttgttttttc

SEQ ID NO: 5031627 - DNA, 13 bp, Homo sapiens
tgtttaaagtggc

SEQ ID NO: 5031628 - DNA, 14 bp, Homo sapiens
ttcaatagccacta

SEQ ID NO: 5031629 - DNA, 16 bp, Homo sapiens
ttcaatcccaggatgt

SEQ ID NO: 5031630 - DNA, 15 bp, Homo sapiens
ttcaattcctggccc

SEQ ID NO: 5031631 - DNA, 16 bp, Homo sapiens
ttcaattcctggccct

SEQ ID NO: 5031632 - DNA, 17 bp, Homo sapiens
ttcacagctcctcccac

SEQ ID NO: 5031633 - DNA, 17 bp, Homo sapiens
ttcacctaagtctctgt

SEQ ID NO: 5031634 - DNA, 14 bp, Homo sapiens
ttcaccttgaagaa

SEQ ID NO: 5031635 - DNA, 14 bp, Homo sapiens
ttcaccttggaagg

SEQ ID NO: 5031636 - DNA, 15 bp, Homo sapiens
ttcacttacagcacc

SEQ ID NO: 5031637 - DNA, 16 bp, Homo sapiens
ttcagagcaagttcct

SEQ ID NO: 5031638 - DNA, 23 bp, Homo sapiens
ttcagataactgttatttataat

SEQ ID NO: 5031639 - DNA, 16 bp, Homo sapiens
ttcagcagaacctgca

SEQ ID NO: 5031640 - DNA, 18 bp, Homo sapiens
ttcaggaggaatactgaa

SEQ ID NO: 5031641 - DNA, 20 bp, Homo sapiens
ttcaggaggaatactgaaca

SEQ ID NO: 5031642 - DNA, 17 bp, Homo sapiens
ttcagtccaataggtgt

SEQ ID NO: 5031643 - DNA, 16 bp, Homo sapiens
ttcatgcaaactcttt

SEQ ID NO: 5031644 - DNA, 15 bp, Homo sapiens
ttcattaataataaa

SEQ ID NO: 5031645 - DNA, 15 bp, Homo sapiens
ttcattctccttgtt

SEQ ID NO: 5031646 - DNA, 18 bp, Homo sapiens
ttcatttgagaagtaaac

SEQ ID NO: 5031647 - DNA, 22 bp, Homo sapiens
ttccaaagctttattaccagtg

SEQ ID NO: 5031648 - DNA, 17 bp, Homo sapiens
ttccagtgaacattccc

SEQ ID NO: 5031649 - DNA, 18 bp, Homo sapiens
ttccatcctttacgtgtt

SEQ ID NO: 5031650 - DNA, 13 bp, Homo sapiens
ttccattaaacga

SEQ ID NO: 5031651 - DNA, 13 bp, Homo sapiens
ttccattacaagt

SEQ ID NO: 5031652 - DNA, 18 bp, Homo sapiens
ttccatttgcatttgttt

SEQ ID NO: 5031653 - DNA, 20 bp, Homo sapiens
ttcccaacttctcttgcttt

SEQ ID NO: 5031654 - DNA, 13 bp, Homo sapiens
ttcccaagggctg

SEQ ID NO: 5031655 - DNA, 10 bp, Homo sapiens
ttcccactgc

SEQ ID NO: 5031656 - DNA, 19 bp, Homo sapiens
ttcccagagtcatctgatt

SEQ ID NO: 5031657 - DNA, 14 bp, Homo sapiens
ttccccaagacatt

SEQ ID NO: 5031658 - DNA, 19 bp, Homo sapiens
ttccccatgtctcgactca

SEQ ID NO: 5031659 - DNA, 14 bp, Homo sapiens
ttcccctctgctgc

SEQ ID NO: 5031660 - DNA, 15 bp, Homo sapiens
ttcccctctgctgct

SEQ ID NO: 5031661 - DNA, 15 bp, Homo sapiens
ttcccgtttctccac

SEQ ID NO: 5031662 - DNA, 16 bp, Homo sapiens
ttccctctttggctcc

SEQ ID NO: 5031663 - DNA, 16 bp, Homo sapiens
ttccctggcctttcat

SEQ ID NO: 5031664 - DNA, 17 bp, Homo sapiens
ttccctggcctttcata

SEQ ID NO: 5031665 - DNA, 23 bp, Homo sapiens
ttcccttcagtaccctctcagct

SEQ ID NO: 5031666 - DNA, 14 bp, Homo sapiens
ttcctcctccccac

SEQ ID NO: 5031667 - DNA, 19 bp, Homo sapiens
ttcctggacactcagacct

SEQ ID NO: 5031668 - DNA, 15 bp, Homo sapiens
ttcctttgctctttc

SEQ ID NO: 5031669 - DNA, 13 bp, Homo sapiens
ttccttttcttta

SEQ ID NO: 5031670 - DNA, 23 bp, Homo sapiens
ttcgaatgacggtaagtgttctc

SEQ ID NO: 5031671 - DNA, 19 bp, Homo sapiens
ttctaaaggagtttatgtt

SEQ ID NO: 5031672 - DNA, 15 bp, Homo sapiens
ttctaacctttacat

SEQ ID NO: 5031673 - DNA, 16 bp, Homo sapiens
ttctaacctttacatg

SEQ ID NO: 5031674 - DNA, 22 bp, Homo sapiens
ttctaactacaaaggtttaaat

SEQ ID NO: 5031675 - DNA, 18 bp, Homo sapiens
ttctaaggaatatgagct

SEQ ID NO: 5031676 - DNA, 16 bp, Homo sapiens
ttctaagtaaatacaa

SEQ ID NO: 5031677 - DNA, 17 bp, Homo sapiens
ttctaagtaaatacaat

SEQ ID NO: 5031678 - DNA, 18 bp, Homo sapiens
ttctaagtaaatacaatt

SEQ ID NO: 5031679 - DNA, 20 bp, Homo sapiens
ttctaagtaaatacaatttt

SEQ ID NO: 5031680 - DNA, 16 bp, Homo sapiens
ttctaatggaatggtt

SEQ ID NO: 5031681 - DNA, 15 bp, Homo sapiens
ttctacacagagcag

SEQ ID NO: 5031682 - DNA, 21 bp, Homo sapiens
ttctagcccgaatacaaacac

SEQ ID NO: 5031683 - DNA, 16 bp, Homo sapiens
ttctaggcatctctgt

SEQ ID NO: 5031684 - DNA, 15 bp, Homo sapiens
ttctatgggtgttat

SEQ ID NO: 5031685 - DNA, 18 bp, Homo sapiens
ttctatgggtgttatcac

SEQ ID NO: 5031686 - DNA, 23 bp, Homo sapiens
ttctcaggtaggaagcaacagct

SEQ ID NO: 5031687 - DNA, 21 bp, Homo sapiens
ttctcattggaaatttagcat

SEQ ID NO: 5031688 - DNA, 12 bp, Homo sapiens
ttctccagctgg

SEQ ID NO: 5031689 - DNA, 22 bp, Homo sapiens
ttctcccgggggcagggtgggg

SEQ ID NO: 5031690 - DNA, 17 bp, Homo sapiens
ttctctcggctccccat

SEQ ID NO: 5031691 - DNA, 14 bp, Homo sapiens
ttctctgcaacact

SEQ ID NO: 5031692 - DNA, 16 bp, Homo sapiens
ttctctgttgtcaaac

SEQ ID NO: 5031693 - DNA, 15 bp, Homo sapiens
ttctcttttcctttg

SEQ ID NO: 5031694 - DNA, 18 bp, Homo sapiens
ttctgaaacacacgagca

SEQ ID NO: 5031695 - DNA, 15 bp, Homo sapiens
ttctgaatgcttcta

SEQ ID NO: 5031696 - DNA, 20 bp, Homo sapiens
ttctgagcagcgagcctgct

SEQ ID NO: 5031697 - DNA, 14 bp, Homo sapiens
ttctggaatttgtt

SEQ ID NO: 5031698 - DNA, 22 bp, Homo sapiens
ttctggaatttgttcaagtttt

SEQ ID NO: 5031699 - DNA, 20 bp, Homo sapiens
ttctggatagagtcctggga

SEQ ID NO: 5031700 - DNA, 16 bp, Homo sapiens
ttctgggatgtcacag

SEQ ID NO: 5031701 - DNA, 19 bp, Homo sapiens
ttctgggatgtcacagtcc

SEQ ID NO: 5031702 - DNA, 22 bp, Homo sapiens
ttctgtgtctttcacagctcct

SEQ ID NO: 5031703 - DNA, 13 bp, Homo sapiens
ttctgttaactga

SEQ ID NO: 5031704 - DNA, 19 bp, Homo sapiens
ttcttaaataataaagatc

SEQ ID NO: 5031705 - DNA, 12 bp, Homo sapiens
ttcttagctcaa

SEQ ID NO: 5031706 - DNA, 16 bp, Homo sapiens
ttcttagctcaatgag

SEQ ID NO: 5031707 - DNA, 23 bp, Homo sapiens
ttcttagctcaatgagcatgttt

SEQ ID NO: 5031708 - DNA, 21 bp, Homo sapiens
ttcttcacctaagtctctgtg

SEQ ID NO: 5031709 - DNA, 20 bp, Homo sapiens
ttcttcatattctaaaacca

SEQ ID NO: 5031710 - DNA, 23 bp, Homo sapiens
ttcttgaggggaagctagtcttt

SEQ ID NO: 5031711 - DNA, 16 bp, Homo sapiens
ttcttgtctataaagc

SEQ ID NO: 5031712 - DNA, 14 bp, Homo sapiens
ttcttgtgcttttc

SEQ ID NO: 5031713 - DNA, 13 bp, Homo sapiens
ttctttcatttct

SEQ ID NO: 5031714 - DNA, 15 bp, Homo sapiens
ttctttccatttgca

SEQ ID NO: 5031715 - DNA, 14 bp, Homo sapiens
ttctttgcaccaaa

SEQ ID NO: 5031716 - DNA, 16 bp, Homo sapiens
ttctttgcaccaaaga

SEQ ID NO: 5031717 - DNA, 16 bp, Homo sapiens
ttgaaaagttggaagg

SEQ ID NO: 5031718 - DNA, 17 bp, Homo sapiens
ttgaaatagtgtctgat

SEQ ID NO: 5031719 - DNA, 18 bp, Homo sapiens
ttgaaatgaggtctgttt

SEQ ID NO: 5031720 - DNA, 21 bp, Homo sapiens
ttgaaatgtaaggctgtgtaa

SEQ ID NO: 5031721 - DNA, 13 bp, Homo sapiens
ttgaagcatttta

SEQ ID NO: 5031722 - DNA, 15 bp, Homo sapiens
ttgaagcattttata

SEQ ID NO: 5031723 - DNA, 17 bp, Homo sapiens
ttgaagcattttataaa

SEQ ID NO: 5031724 - DNA, 22 bp, Homo sapiens
ttgaagcattttataaatcgct

SEQ ID NO: 5031725 - DNA, 17 bp, Homo sapiens
ttgagatagttttcatc

SEQ ID NO: 5031726 - DNA, 16 bp, Homo sapiens
ttgaggagccccagct

SEQ ID NO: 5031727 - DNA, 14 bp, Homo sapiens
ttgatgttacagat

SEQ ID NO: 5031728 - DNA, 13 bp, Homo sapiens
ttgcagctgtttt

SEQ ID NO: 5031729 - DNA, 13 bp, Homo sapiens
ttgcagtcccaag

SEQ ID NO: 5031730 - DNA, 21 bp, Homo sapiens
ttgcagtcccaagcggtgtct

SEQ ID NO: 5031731 - DNA, 15 bp, Homo sapiens
ttgccagagccttaa

SEQ ID NO: 5031732 - DNA, 15 bp, Homo sapiens
ttgccccactctgcc

SEQ ID NO: 5031733 - DNA, 20 bp, Homo sapiens
ttgccccactctgcctgcct

SEQ ID NO: 5031734 - DNA, 20 bp, Homo sapiens
ttgcctatggatcaaagaaa

SEQ ID NO: 5031735 - DNA, 13 bp, Homo sapiens
ttgcctggtacag

SEQ ID NO: 5031736 - DNA, 14 bp, Homo sapiens
ttgcctggtacagt

SEQ ID NO: 5031737 - DNA, 19 bp, Homo sapiens
ttgccttctctgcccacag

SEQ ID NO: 5031738 - DNA, 19 bp, Homo sapiens
ttgctcacccagtgccctc

SEQ ID NO: 5031739 - DNA, 16 bp, Homo sapiens
ttgctgctaatatttt

SEQ ID NO: 5031740 - DNA, 20 bp, Homo sapiens
ttgctgctaatattttcctc

SEQ ID NO: 5031741 - DNA, 14 bp, Homo sapiens
ttgctttaatataa

SEQ ID NO: 5031742 - DNA, 16 bp, Homo sapiens
ttgctttaatataaat

SEQ ID NO: 5031743 - DNA, 17 bp, Homo sapiens
ttgctttaatataaatg

SEQ ID NO: 5031744 - DNA, 19 bp, Homo sapiens
ttgctttaatataaatgca

SEQ ID NO: 5031745 - DNA, 22 bp, Homo sapiens
ttgctttaatataaatgcaaat

SEQ ID NO: 5031746 - DNA, 13 bp, Homo sapiens
ttgcttttcatgc

SEQ ID NO: 5031747 - DNA, 16 bp, Homo sapiens
ttgcttttcatgcaaa

SEQ ID NO: 5031748 - DNA, 17 bp, Homo sapiens
ttgcttttcatgcaaac

SEQ ID NO: 5031749 - DNA, 22 bp, Homo sapiens
ttgcttttcatgcaaactcttt

SEQ ID NO: 5031750 - DNA, 18 bp, Homo sapiens
ttggaagaaggggcaggt

SEQ ID NO: 5031751 - DNA, 14 bp, Homo sapiens
ttggacacgctcag

SEQ ID NO: 5031752 - DNA, 19 bp, Homo sapiens
ttggacagaagcagctctt

SEQ ID NO: 5031753 - DNA, 16 bp, Homo sapiens
ttggcaagtcacgttg

SEQ ID NO: 5031754 - DNA, 13 bp, Homo sapiens
ttggcaattttgt

SEQ ID NO: 5031755 - DNA, 20 bp, Homo sapiens
ttggccccactttgaagggc

SEQ ID NO: 5031756 - DNA, 19 bp, Homo sapiens
ttgggaggtgcgtgttcag

SEQ ID NO: 5031757 - DNA, 13 bp, Homo sapiens
ttgggtgaagagc

SEQ ID NO: 5031758 - DNA, 15 bp, Homo sapiens
ttgggtgaagagctt

SEQ ID NO: 5031759 - DNA, 15 bp, Homo sapiens
ttggtcctctctctg

SEQ ID NO: 5031760 - DNA, 22 bp, Homo sapiens
ttggtgcacagcacaaattagt

SEQ ID NO: 5031761 - DNA, 18 bp, Homo sapiens
ttggttaagtctgtttta

SEQ ID NO: 5031762 - DNA, 20 bp, Homo sapiens
ttggttctagcgcagttttt

SEQ ID NO: 5031763 - DNA, 18 bp, Homo sapiens
ttggttgttttttccttt

SEQ ID NO: 5031764 - DNA, 14 bp, Homo sapiens
ttggttttcttctt

SEQ ID NO: 5031765 - DNA, 18 bp, Homo sapiens
ttgtaaattggcatggaa

SEQ ID NO: 5031766 - DNA, 21 bp, Homo sapiens
ttgtacctgtaggactctcat

SEQ ID NO: 5031767 - DNA, 21 bp, Homo sapiens
ttgtagcgtctttcttttttg

SEQ ID NO: 5031768 - DNA, 17 bp, Homo sapiens
ttgtagtgctttgagag

SEQ ID NO: 5031769 - DNA, 14 bp, Homo sapiens
ttgtattaaagaca

SEQ ID NO: 5031770 - DNA, 16 bp, Homo sapiens
ttgtattaaagacaga

SEQ ID NO: 5031771 - DNA, 12 bp, Homo sapiens
ttgtattaagaa

SEQ ID NO: 5031772 - DNA, 21 bp, Homo sapiens
ttgtcaaggaagaagaaatct

SEQ ID NO: 5031773 - DNA, 18 bp, Homo sapiens
ttgtctataaagcattta

SEQ ID NO: 5031774 - DNA, 14 bp, Homo sapiens
ttgtctctgatgca

SEQ ID NO: 5031775 - DNA, 17 bp, Homo sapiens
ttgtctctgatgcagct

SEQ ID NO: 5031776 - DNA, 21 bp, Homo sapiens
ttgtctgtctccctcccctct

SEQ ID NO: 5031777 - DNA, 13 bp, Homo sapiens
ttgtgagctggat

SEQ ID NO: 5031778 - DNA, 19 bp, Homo sapiens
ttgtgcaatgtgtataaac

SEQ ID NO: 5031779 - DNA, 20 bp, Homo sapiens
ttgtgcaatgtgtataaaca

SEQ ID NO: 5031780 - DNA, 14 bp, Homo sapiens
ttgtgcttttcctg

SEQ ID NO: 5031781 - DNA, 15 bp, Homo sapiens
ttgtgcttttcctga

SEQ ID NO: 5031782 - DNA, 13 bp, Homo sapiens
ttgtgtgtcttaa

SEQ ID NO: 5031783 - DNA, 19 bp, Homo sapiens
ttgtgtgtcttaattatta

SEQ ID NO: 5031784 - DNA, 17 bp, Homo sapiens
ttgttaagatatgatgt

SEQ ID NO: 5031785 - DNA, 17 bp, Homo sapiens
ttgttctgttaactgaa

SEQ ID NO: 5031786 - DNA, 12 bp, Homo sapiens
ttgttgacatta

SEQ ID NO: 5031787 - DNA, 17 bp, Homo sapiens
ttgttgacattctgaat

SEQ ID NO: 5031788 - DNA, 20 bp, Homo sapiens
ttgttgacattctgaatgct

SEQ ID NO: 5031789 - DNA, 17 bp, Homo sapiens
ttgttgcatgtttgaaa

SEQ ID NO: 5031790 - DNA, 20 bp, Homo sapiens
ttgttggttggttttcttct

SEQ ID NO: 5031791 - DNA, 15 bp, Homo sapiens
ttgttgtgtgtgcag

SEQ ID NO: 5031792 - DNA, 13 bp, Homo sapiens
ttgttgttctgtt

SEQ ID NO: 5031793 - DNA, 14 bp, Homo sapiens
ttgttgttctgtta

SEQ ID NO: 5031794 - DNA, 15 bp, Homo sapiens
ttgttgttctgttaa

SEQ ID NO: 5031795 - DNA, 15 bp, Homo sapiens
ttgtttgagaaatta

SEQ ID NO: 5031796 - DNA, 17 bp, Homo sapiens
ttgtttgattcagcaaa

SEQ ID NO: 5031797 - DNA, 16 bp, Homo sapiens
ttgttttagaaccagc

SEQ ID NO: 5031798 - DNA, 16 bp, Homo sapiens
ttgttttgtgcagaga

SEQ ID NO: 5031799 - DNA, 16 bp, Homo sapiens
ttgtttttaaactgta

SEQ ID NO: 5031800 - DNA, 19 bp, Homo sapiens
ttgtttttaaactgtacag

SEQ ID NO: 5031801 - DNA, 21 bp, Homo sapiens
tttaaaaaattaatctgggcc

SEQ ID NO: 5031802 - DNA, 19 bp, Homo sapiens
tttaaaaacatagaaaaat

SEQ ID NO: 5031803 - DNA, 21 bp, Homo sapiens
tttaaaagagagagagagaaa

SEQ ID NO: 5031804 - DNA, 17 bp, Homo sapiens
tttaaaatagcgttctt

SEQ ID NO: 5031805 - DNA, 23 bp, Homo sapiens
tttaaacacacagatacacacac

SEQ ID NO: 5031806 - DNA, 13 bp, Homo sapiens
tttaaactgtaca

SEQ ID NO: 5031807 - DNA, 15 bp, Homo sapiens
tttaaactgtacagt

SEQ ID NO: 5031808 - DNA, 15 bp, Homo sapiens
tttaaagcaggttct

SEQ ID NO: 5031809 - DNA, 18 bp, Homo sapiens
tttaaagtggcaatctca

SEQ ID NO: 5031810 - DNA, 16 bp, Homo sapiens
tttaacataagctatt

SEQ ID NO: 5031811 - DNA, 19 bp, Homo sapiens
tttaataaactactctttg

SEQ ID NO: 5031812 - DNA, 20 bp, Homo sapiens
tttaataaactactctttga

SEQ ID NO: 5031813 - DNA, 17 bp, Homo sapiens
tttaatacagtttattt

SEQ ID NO: 5031814 - DNA, 13 bp, Homo sapiens
tttaatataaatg

SEQ ID NO: 5031815 - DNA, 18 bp, Homo sapiens
tttaatataaatgcaaat

SEQ ID NO: 5031816 - DNA, 14 bp, Homo sapiens
tttaattaattggg

SEQ ID NO: 5031817 - DNA, 13 bp, Homo sapiens
tttacaaactgaa

SEQ ID NO: 5031818 - DNA, 16 bp, Homo sapiens
tttacacgcttttgtg

SEQ ID NO: 5031819 - DNA, 15 bp, Homo sapiens
tttacagctgtgtta

SEQ ID NO: 5031820 - DNA, 22 bp, Homo sapiens
tttaccctttggccccactttg

SEQ ID NO: 5031821 - DNA, 23 bp, Homo sapiens
tttagaataaattcccaacttct

SEQ ID NO: 5031822 - DNA, 22 bp, Homo sapiens
tttagacttggattctttccat

SEQ ID NO: 5031823 - DNA, 20 bp, Homo sapiens
tttagatagccctgtcctgg

SEQ ID NO: 5031824 - DNA, 18 bp, Homo sapiens
tttaggaatcctttggtg

SEQ ID NO: 5031825 - DNA, 16 bp, Homo sapiens
tttagggaacaatttg

SEQ ID NO: 5031826 - DNA, 13 bp, Homo sapiens
tttagttttctct

SEQ ID NO: 5031827 - DNA, 15 bp, Homo sapiens
tttataaatcgcttt

SEQ ID NO: 5031828 - DNA, 18 bp, Homo sapiens
tttataaatcgcttttga

SEQ ID NO: 5031829 - DNA, 22 bp, Homo sapiens
tttataaatcgcttttgataat

SEQ ID NO: 5031830 - DNA, 18 bp, Homo sapiens
tttataagcatcattatt

SEQ ID NO: 5031831 - DNA, 21 bp, Homo sapiens
tttataagcatcattatttat

SEQ ID NO: 5031832 - DNA, 23 bp, Homo sapiens
tttataagcatcattatttatgt

SEQ ID NO: 5031833 - DNA, 14 bp, Homo sapiens
tttatattaatgta

SEQ ID NO: 5031834 - DNA, 16 bp, Homo sapiens
tttatattaatgtact

SEQ ID NO: 5031835 - DNA, 20 bp, Homo sapiens
tttatgttatatataaatat

SEQ ID NO: 5031836 - DNA, 21 bp, Homo sapiens
tttatgttatatataaatata

SEQ ID NO: 5031837 - DNA, 19 bp, Homo sapiens
tttatgttccattaaacga

SEQ ID NO: 5031838 - DNA, 11 bp, Homo sapiens
tttattaaaga

SEQ ID NO: 5031839 - DNA, 13 bp, Homo sapiens
tttattaaagaaa

SEQ ID NO: 5031840 - DNA, 12 bp, Homo sapiens
tttattaccagt

SEQ ID NO: 5031841 - DNA, 20 bp, Homo sapiens
tttattagtattgttgtcct

SEQ ID NO: 5031842 - DNA, 12 bp, Homo sapiens
tttattgcattg

SEQ ID NO: 5031843 - DNA, 22 bp, Homo sapiens
tttcacatagcccacttacatt

SEQ ID NO: 5031844 - DNA, 14 bp, Homo sapiens
tttcacatttttaa

SEQ ID NO: 5031845 - DNA, 22 bp, Homo sapiens
tttcaggaggaatactgaacat

SEQ ID NO: 5031846 - DNA, 15 bp, Homo sapiens
tttcatcttcagttg

SEQ ID NO: 5031847 - DNA, 17 bp, Homo sapiens
tttcatcttcagttgtc

SEQ ID NO: 5031848 - DNA, 22 bp, Homo sapiens
tttcatcttcagttgtctctga

SEQ ID NO: 5031849 - DNA, 11 bp, Homo sapiens
tttccaacagc

SEQ ID NO: 5031850 - DNA, 12 bp, Homo sapiens
tttccaacagca

SEQ ID NO: 5031851 - DNA, 23 bp, Homo sapiens
tttccagcagaagacaaaaagac

SEQ ID NO: 5031852 - DNA, 14 bp, Homo sapiens
tttccatttgcatt

SEQ ID NO: 5031853 - DNA, 19 bp, Homo sapiens
tttcccggacttagaaaac

SEQ ID NO: 5031854 - DNA, 22 bp, Homo sapiens
tgacagggacatgccctgtgtg

SEQ ID NO: 5031855 - DNA, 14 bp, Homo sapiens
tgacagtgcctctt

SEQ ID NO: 5031856 - DNA, 17 bp, Homo sapiens
tgacagtgcctcttcca

SEQ ID NO: 5031857 - DNA, 18 bp, Homo sapiens
tgacagtgcctcttccag

SEQ ID NO: 5031858 - DNA, 21 bp, Homo sapiens
tgacagtgcctcttccagtga

SEQ ID NO: 5031859 - DNA, 18 bp, Homo sapiens
tgacatcaggtttttccc

SEQ ID NO: 5031860 - DNA, 15 bp, Homo sapiens
tgacattctgaatgc

SEQ ID NO: 5031861 - DNA, 22 bp, Homo sapiens
tgacctcagctttgatatttca

SEQ ID NO: 5031862 - DNA, 20 bp, Homo sapiens
tgaccttcagagccagccgg

SEQ ID NO: 5031863 - DNA, 15 bp, Homo sapiens
tgacgcttgtgacag

SEQ ID NO: 5031864 - DNA, 16 bp, Homo sapiens
tgacgcttgtgacagt

SEQ ID NO: 5031865 - DNA, 18 bp, Homo sapiens
tgacgcttgtgacagtgc

SEQ ID NO: 5031866 - DNA, 20 bp, Homo sapiens
tgacgcttgtgacagtgcct

SEQ ID NO: 5031867 - DNA, 21 bp, Homo sapiens
tgacgcttgtgacagtgcctc

SEQ ID NO: 5031868 - DNA, 24 bp, Homo sapiens
tgactatgcagaggcctgggggac

SEQ ID NO: 5031869 - DNA, 12 bp, Homo sapiens
tgactgtgctgt

SEQ ID NO: 5031870 - DNA, 22 bp, Homo sapiens
tgagaaatagcttatgaaaaga

SEQ ID NO: 5031871 - DNA, 13 bp, Homo sapiens
tgagagccagcag

SEQ ID NO: 5031872 - DNA, 16 bp, Homo sapiens
tgagatttattaaaga

SEQ ID NO: 5031873 - DNA, 18 bp, Homo sapiens
tgagatttattaaagaaa

SEQ ID NO: 5031874 - DNA, 20 bp, Homo sapiens
tgagcatttgaaaggtgtgc

SEQ ID NO: 5031875 - DNA, 18 bp, Homo sapiens
tgagccctgtcctgccta

SEQ ID NO: 5031876 - DNA, 22 bp, Homo sapiens
tgagctttatgtaataatgtga

SEQ ID NO: 5031877 - DNA, 23 bp, Homo sapiens
tgaggacttgggcgggacacagg

SEQ ID NO: 5031878 - DNA, 14 bp, Homo sapiens
tgaggagccccagc

SEQ ID NO: 5031879 - DNA, 15 bp, Homo sapiens
tgaggcccagtgcat

SEQ ID NO: 5031880 - DNA, 18 bp, Homo sapiens
tgaggggaagctagtctt

SEQ ID NO: 5031881 - DNA, 19 bp, Homo sapiens
tgagggtgcccttttccag

SEQ ID NO: 5031882 - DNA, 16 bp, Homo sapiens
tgaggtccagccctgg

SEQ ID NO: 5031883 - DNA, 20 bp, Homo sapiens
tgaggtccagccctggctga

SEQ ID NO: 5031884 - DNA, 17 bp, Homo sapiens
tgagtcctggatgatac

SEQ ID NO: 5031885 - DNA, 15 bp, Homo sapiens
tgagtgacagctttc

SEQ ID NO: 5031886 - DNA, 19 bp, Homo sapiens
tgagtgtgcggctgtgtgt

SEQ ID NO: 5031887 - DNA, 14 bp, Homo sapiens
tgataatcaactgg

SEQ ID NO: 5031888 - DNA, 24 bp, Homo sapiens
tgataatcaactgggctgaacact

SEQ ID NO: 5031889 - DNA, 21 bp, Homo sapiens
tgataccagaagggaaagctt

SEQ ID NO: 5031890 - DNA, 19 bp, Homo sapiens
tgatacccccctctgtctt

SEQ ID NO: 5031891 - DNA, 13 bp, Homo sapiens
tgatactaataaa

SEQ ID NO: 5031892 - DNA, 21 bp, Homo sapiens
tggaagggcgttctaggtagg

SEQ ID NO: 5031893 - DNA, 13 bp, Homo sapiens
tggaatttgttca

SEQ ID NO: 5031894 - DNA, 15 bp, Homo sapiens
tggacactcagacct

SEQ ID NO: 5031895 - DNA, 18 bp, Homo sapiens
tggacagtacctgattgt

SEQ ID NO: 5031896 - DNA, 21 bp, Homo sapiens
tggactccagcctgcctggca

SEQ ID NO: 5031897 - DNA, 23 bp, Homo sapiens
tggactccagcctgcctggcagg

SEQ ID NO: 5031898 - DNA, 15 bp, Homo sapiens
tggactcctgcacac

SEQ ID NO: 5031899 - DNA, 16 bp, Homo sapiens
tggagacaccaccacc

SEQ ID NO: 5031900 - DNA, 14 bp, Homo sapiens
tggagccccacctt

SEQ ID NO: 5031901 - DNA, 16 bp, Homo sapiens
tggagcttgaaatagt

SEQ ID NO: 5031902 - DNA, 17 bp, Homo sapiens
tggaggcgggcttggaa

SEQ ID NO: 5031903 - DNA, 17 bp, Homo sapiens
tggaggggcagcctgtg

SEQ ID NO: 5031904 - DNA, 18 bp, Homo sapiens
tggaggggcagcctgtgc

SEQ ID NO: 5031905 - DNA, 20 bp, Homo sapiens
tggaggggcagcctgtgcct

SEQ ID NO: 5031906 - DNA, 14 bp, Homo sapiens
tggaggggtgtggc

SEQ ID NO: 5031907 - DNA, 23 bp, Homo sapiens
tggaggggtgtggctccttccca

SEQ ID NO: 5031908 - DNA, 17 bp, Homo sapiens
tggagtgctgttttgtt

SEQ ID NO: 5031909 - DNA, 19 bp, Homo sapiens
tggagttcaccttggaagg

SEQ ID NO: 5031910 - DNA, 15 bp, Homo sapiens
tggatagacttggga

SEQ ID NO: 5031911 - DNA, 19 bp, Homo sapiens
tggatcctgggctgggtgg

SEQ ID NO: 5031912 - DNA, 22 bp, Homo sapiens
tggatctccctgagatgggctt

SEQ ID NO: 5031913 - DNA, 15 bp, Homo sapiens
tggatgtccccagca

SEQ ID NO: 5031914 - DNA, 17 bp, Homo sapiens
tggatgttatgaacagc

SEQ ID NO: 5031915 - DNA, 18 bp, Homo sapiens
tggatgttatgaacagct

SEQ ID NO: 5031916 - DNA, 21 bp, Homo sapiens
tggatgttatgaacagctgtg

SEQ ID NO: 5031917 - DNA, 19 bp, Homo sapiens
tggattctccctgggcctc

SEQ ID NO: 5031918 - DNA, 14 bp, Homo sapiens
tggattctttccat

SEQ ID NO: 5031919 - DNA, 22 bp, Homo sapiens
tggcactaacgttgagcccctg

SEQ ID NO: 5031920 - DNA, 12 bp, Homo sapiens
tggcagaggagg

SEQ ID NO: 5031921 - DNA, 18 bp, Homo sapiens
tggcagattcccactgcc

SEQ ID NO: 5031922 - DNA, 20 bp, Homo sapiens
tggcagattcccactgccgc

SEQ ID NO: 5031923 - DNA, 12 bp, Homo sapiens
tggcagtggagg

SEQ ID NO: 5031924 - DNA, 13 bp, Homo sapiens
tggcagttatatt

SEQ ID NO: 5031925 - DNA, 20 bp, Homo sapiens
tggcatggaaatttaaagca

SEQ ID NO: 5031926 - DNA, 23 bp, Homo sapiens
tggcatggaaatttaaagcaggt

SEQ ID NO: 5031927 - DNA, 19 bp, Homo sapiens
tggcatttcaattcctggc

SEQ ID NO: 5031928 - DNA, 21 bp, Homo sapiens
tggcatttcaattcctggccc

SEQ ID NO: 5031929 - DNA, 18 bp, Homo sapiens
tggcatttggtctcaggc

SEQ ID NO: 5031930 - DNA, 14 bp, Homo sapiens
tggccacggccaca

SEQ ID NO: 5031931 - DNA, 15 bp, Homo sapiens
tggccatctgctcct

SEQ ID NO: 5031932 - DNA, 16 bp, Homo sapiens
tggccatgcaggaggt

SEQ ID NO: 5031933 - DNA, 21 bp, Homo sapiens
tggccatgcaggaggtggaga

SEQ ID NO: 5031934 - DNA, 14 bp, Homo sapiens
tggccatggcctct

SEQ ID NO: 5031935 - DNA, 16 bp, Homo sapiens
tggccatggcctctgc

SEQ ID NO: 5031936 - DNA, 19 bp, Homo sapiens
tggccccgcctgcctgcca

SEQ ID NO: 5031937 - DNA, 21 bp, Homo sapiens
tggcccctcaaatcgtccagc

SEQ ID NO: 5031938 - DNA, 16 bp, Homo sapiens
tggcccctctgacctg

SEQ ID NO: 5031939 - DNA, 18 bp, Homo sapiens
tggcccctctgacctgca

SEQ ID NO: 5031940 - DNA, 20 bp, Homo sapiens
tggcccctgctgtctctctg

SEQ ID NO: 5031941 - DNA, 22 bp, Homo sapiens
tggcccctgctgtctctctggg

SEQ ID NO: 5031942 - DNA, 19 bp, Homo sapiens
tggccctgttctcctcccc

SEQ ID NO: 5031943 - DNA, 21 bp, Homo sapiens
tggccgccccctgccccccag

SEQ ID NO: 5031944 - DNA, 13 bp, Homo sapiens
tggcctggactgt

SEQ ID NO: 5031945 - DNA, 19 bp, Homo sapiens
tggcgtctgctctggtggc

SEQ ID NO: 5031946 - DNA, 14 bp, Homo sapiens
tggcgttgttgcat

SEQ ID NO: 5031947 - DNA, 17 bp, Homo sapiens
tggctatagatgtcttt

SEQ ID NO: 5031948 - DNA, 22 bp, Homo sapiens
tggctatagatgtcttttccca

SEQ ID NO: 5031949 - DNA, 11 bp, Homo sapiens
tggctctgggc

SEQ ID NO: 5031950 - DNA, 19 bp, Homo sapiens
tggctcttgatacccccct

SEQ ID NO: 5031951 - DNA, 20 bp, Homo sapiens
tggctcttgatacccccctc

SEQ ID NO: 5031952 - DNA, 11 bp, Homo sapiens
tggctgaagga

SEQ ID NO: 5031953 - DNA, 16 bp, Homo sapiens
tggcttaagtgagcag

SEQ ID NO: 5031954 - DNA, 21 bp, Homo sapiens
tggcttaagtgagcagaacag

SEQ ID NO: 5031955 - DNA, 22 bp, Homo sapiens
tggcttaagtgagcagaacagg

SEQ ID NO: 5031956 - DNA, 12 bp, Homo sapiens
tgggaatgggag

SEQ ID NO: 5031957 - DNA, 15 bp, Homo sapiens
tgggaatgggagagg

SEQ ID NO: 5031958 - DNA, 23 bp, Homo sapiens
tgggacatcaggagactgggctc

SEQ ID NO: 5031959 - DNA, 23 bp, Homo sapiens
tgggatggcatttggtctcaggc

SEQ ID NO: 5031960 - DNA, 14 bp, Homo sapiens
tgggatgtcacagt

SEQ ID NO: 5031961 - DNA, 22 bp, Homo sapiens
tgggatgtcacagtccaaccag

SEQ ID NO: 5031962 - DNA, 15 bp, Homo sapiens
tgggcaaacaggcag

SEQ ID NO: 5031963 - DNA, 17 bp, Homo sapiens
tgggcagcacaaggcct

SEQ ID NO: 5031964 - DNA, 16 bp, Homo sapiens
tgggcatttggtgaga

SEQ ID NO: 5031965 - DNA, 18 bp, Homo sapiens
tgggccagcttttcaaac

SEQ ID NO: 5031966 - DNA, 23 bp, Homo sapiens
tgggcccctggccccgcctgcct

SEQ ID NO: 5031967 - DNA, 22 bp, Homo sapiens
tgggctctgcaattcccctctg

SEQ ID NO: 5031968 - DNA, 16 bp, Homo sapiens
tgggctgcagagtctg

SEQ ID NO: 5031969 - DNA, 18 bp, Homo sapiens
tgggctgggtggcccctg

SEQ ID NO: 5031970 - DNA, 13 bp, Homo sapiens
tgggcttcccaag

SEQ ID NO: 5031971 - DNA, 14 bp, Homo sapiens
tgggcttcccaagg

SEQ ID NO: 5031972 - DNA, 14 bp, Homo sapiens
tggggaaaatggcc

SEQ ID NO: 5031973 - DNA, 21 bp, Homo sapiens
tggggaaaatggccatgcagg

SEQ ID NO: 5031974 - DNA, 18 bp, Homo sapiens
tggggctaggggctgggg

SEQ ID NO: 5031975 - DNA, 21 bp, Homo sapiens
tggggtcccagcagctgccag

SEQ ID NO: 5031976 - DNA, 12 bp, Homo sapiens
tgggtctctgga

SEQ ID NO: 5031977 - DNA, 12 bp, Homo sapiens
tgggtgagagag

SEQ ID NO: 5031978 - DNA, 15 bp, Homo sapiens
tgggtgagagaggaa

SEQ ID NO: 5031979 - DNA, 21 bp, Homo sapiens
tgggtggcccctgctgtctct

SEQ ID NO: 5031980 - DNA, 13 bp, Homo sapiens
tgggtggtaccct

SEQ ID NO: 5031981 - DNA, 14 bp, Homo sapiens
tgggtggtaccctc

SEQ ID NO: 5031982 - DNA, 22 bp, Homo sapiens
tgggtggtaccctctggagggg

SEQ ID NO: 5031983 - DNA, 16 bp, Homo sapiens
tggtaaaaatgctgct

SEQ ID NO: 5031984 - DNA, 21 bp, Homo sapiens
tggtaccctcctggctcttga

SEQ ID NO: 5031985 - DNA, 14 bp, Homo sapiens
tggtaccctctgga

SEQ ID NO: 5031986 - DNA, 19 bp, Homo sapiens
tggtagagacccccaggcc

SEQ ID NO: 5031987 - DNA, 15 bp, Homo sapiens
tggtagttttttcat

SEQ ID NO: 5031988 - DNA, 18 bp, Homo sapiens
tggtagttttttcatctt

SEQ ID NO: 5031989 - DNA, 13 bp, Homo sapiens
tggtattttcaat

SEQ ID NO: 5031990 - DNA, 22 bp, Homo sapiens
tggtattttcaatagccactaa

SEQ ID NO: 5031991 - DNA, 15 bp, Homo sapiens
tggtcctctctctgt

SEQ ID NO: 5031992 - DNA, 22 bp, Homo sapiens
tggtcctctctctgtggggctg

SEQ ID NO: 5031993 - DNA, 12 bp, Homo sapiens
tggtcctggcct

SEQ ID NO: 5031994 - DNA, 20 bp, Homo sapiens
tggtctcaggcagcaccaca

SEQ ID NO: 5031995 - DNA, 15 bp, Homo sapiens
tggtctgtgaagagc

SEQ ID NO: 5031996 - DNA, 20 bp, Homo sapiens
tggtgagcctagccctggga

SEQ ID NO: 5031997 - DNA, 19 bp, Homo sapiens
tggtgctgctgctgctgtg

SEQ ID NO: 5031998 - DNA, 15 bp, Homo sapiens
tggtggcacaggccc

SEQ ID NO: 5031999 - DNA, 17 bp, Homo sapiens
tggtggcagtggaggtg

SEQ ID NO: 5032000 - DNA, 19 bp, Homo sapiens
tggtggcagtggaggtggg

SEQ ID NO: 5032001 - DNA, 14 bp, Homo sapiens
tggtgtgaactaaa

SEQ ID NO: 5032002 - DNA, 23 bp, Homo sapiens
tggtgtgaactaaactttcacac

SEQ ID NO: 5032003 - DNA, 16 bp, Homo sapiens
tggtgtttgtctgtgt

SEQ ID NO: 5032004 - DNA, 17 bp, Homo sapiens
tggttggttttcttctt

SEQ ID NO: 5032005 - DNA, 23 bp, Homo sapiens
acatctcttcctccgaggccagt

SEQ ID NO: 5032006 - DNA, 13 bp, Homo sapiens
acatgaggactct

SEQ ID NO: 5032007 - DNA, 18 bp, Homo sapiens
acatgaggactctattct

SEQ ID NO: 5032008 - DNA, 16 bp, Homo sapiens
acatgccctgtgtggc

SEQ ID NO: 5032009 - DNA, 16 bp, Homo sapiens
acatgtatttgtttgc

SEQ ID NO: 5032010 - DNA, 18 bp, Homo sapiens
acatgtatttgtttgcat

SEQ ID NO: 5032011 - DNA, 14 bp, Homo sapiens
acatgtgccctcag

SEQ ID NO: 5032012 - DNA, 17 bp, Homo sapiens
acatgtttctgttttgt

SEQ ID NO: 5032013 - DNA, 14 bp, Homo sapiens
acattctgaatgct

SEQ ID NO: 5032014 - DNA, 18 bp, Homo sapiens
acattctgaatgcttcta

SEQ ID NO: 5032015 - DNA, 20 bp, Homo sapiens
acattctgaatgcttctaag

SEQ ID NO: 5032016 - DNA, 15 bp, Homo sapiens
acattgagcatttga

SEQ ID NO: 5032017 - DNA, 16 bp, Homo sapiens
acattgattcagcctg

SEQ ID NO: 5032018 - DNA, 14 bp, Homo sapiens
acattggttcttgt

SEQ ID NO: 5032019 - DNA, 22 bp, Homo sapiens
acattggttcttgtattaagaa

SEQ ID NO: 5032020 - DNA, 16 bp, Homo sapiens
acatttacaaactgaa

SEQ ID NO: 5032021 - DNA, 16 bp, Homo sapiens
acatttcaccatggcc

SEQ ID NO: 5032022 - DNA, 18 bp, Homo sapiens
acatttcatacaacagaa

SEQ ID NO: 5032023 - DNA, 13 bp, Homo sapiens
acattttgaaagt

SEQ ID NO: 5032024 - DNA, 13 bp, Homo sapiens
accaaaagggagg

SEQ ID NO: 5032025 - DNA, 13 bp, Homo sapiens
accaaagcatcaa

SEQ ID NO: 5032026 - DNA, 23 bp, Homo sapiens
accaagttggaacatccttggaa

SEQ ID NO: 5032027 - DNA, 16 bp, Homo sapiens
accaattattttcatc

SEQ ID NO: 5032028 - DNA, 21 bp, Homo sapiens
accaatttggtaaaaatgctg

SEQ ID NO: 5032029 - DNA, 13 bp, Homo sapiens
accacaccctgta

SEQ ID NO: 5032030 - DNA, 17 bp, Homo sapiens
accactgctctgatgaa

SEQ ID NO: 5032031 - DNA, 14 bp, Homo sapiens
accagaaaagcaat

SEQ ID NO: 5032032 - DNA, 22 bp, Homo sapiens
accagaaacacccctctgtcta

SEQ ID NO: 5032033 - DNA, 15 bp, Homo sapiens
acccaacggccctgc

SEQ ID NO: 5032034 - DNA, 23 bp, Homo sapiens
acccaacggccctgcagccagct

SEQ ID NO: 5032035 - DNA, 19 bp, Homo sapiens
acccaagcctgctggctgc

SEQ ID NO: 5032036 - DNA, 14 bp, Homo sapiens
acccaagtcttctc

SEQ ID NO: 5032037 - DNA, 17 bp, Homo sapiens
acccacctgttttctga

SEQ ID NO: 5032038 - DNA, 17 bp, Homo sapiens
acccacttatttttcaa

SEQ ID NO: 5032039 - DNA, 13 bp, Homo sapiens
acccagaggtgga

SEQ ID NO: 5032040 - DNA, 23 bp, Homo sapiens
acccagcgggcaggttctgcctg

SEQ ID NO: 5032041 - DNA, 17 bp, Homo sapiens
acccaggagtgtggcca

SEQ ID NO: 5032042 - DNA, 15 bp, Homo sapiens
acccagtgccctctc

SEQ ID NO: 5032043 - DNA, 19 bp, Homo sapiens
acccattctacacagagca

SEQ ID NO: 5032044 - DNA, 17 bp, Homo sapiens
acccattgttgtcaagg

SEQ ID NO: 5032045 - DNA, 22 bp, Homo sapiens
acccattgttgtcaaggaagaa

SEQ ID NO: 5032046 - DNA, 23 bp, Homo sapiens
acccattgttgtcaaggaagaag

SEQ ID NO: 5032047 - DNA, 16 bp, Homo sapiens
accccaaacaccttcc

SEQ ID NO: 5032048 - DNA, 14 bp, Homo sapiens
accccaccccaccc

SEQ ID NO: 5032049 - DNA, 18 bp, Homo sapiens
accccacccccgccatgc

SEQ ID NO: 5032050 - DNA, 17 bp, Homo sapiens
accccatccctccccag

SEQ ID NO: 5032051 - DNA, 19 bp, Homo sapiens
acccccacccccagctcaa

SEQ ID NO: 5032052 - DNA, 13 bp, Homo sapiens
acccccagctcaa

SEQ ID NO: 5032053 - DNA, 21 bp, Homo sapiens
acccccagctcaatggactgg

SEQ ID NO: 5032054 - DNA, 11 bp, Homo sapiens
acccccctctg

SEQ ID NO: 5032055 - DNA, 14 bp, Homo sapiens
accccgcctgccct

SEQ ID NO: 5032056 - DNA, 12 bp, Homo sapiens
acccctggctct

SEQ ID NO: 5032057 - DNA, 19 bp, Homo sapiens
acccgccgcctcccacggc

SEQ ID NO: 5032058 - DNA, 21 bp, Homo sapiens
acccgccgcctcccacggcac

SEQ ID NO: 5032059 - DNA, 18 bp, Homo sapiens
acccggtgctccctctgt

SEQ ID NO: 5032060 - DNA, 18 bp, Homo sapiens
acccgtggggtgctgccc

SEQ ID NO: 5032061 - DNA, 21 bp, Homo sapiens
accctagttctacctcaggca

SEQ ID NO: 5032062 - DNA, 22 bp, Homo sapiens
accctccccacagtgccaccca

SEQ ID NO: 5032063 - DNA, 14 bp, Homo sapiens
accctcgaggcgga

SEQ ID NO: 5032064 - DNA, 23 bp, Homo sapiens
accctctggaggggtgtggctcc

SEQ ID NO: 5032065 - DNA, 22 bp, Homo sapiens
accctctgggtctcagtgtcct

SEQ ID NO: 5032066 - DNA, 20 bp, Homo sapiens
accctgagatacttcccaaa

SEQ ID NO: 5032067 - DNA, 21 bp, Homo sapiens
accctgagatacttcccaaag

SEQ ID NO: 5032068 - DNA, 19 bp, Homo sapiens
accctgataggaagagggg

SEQ ID NO: 5032069 - DNA, 20 bp, Homo sapiens
accctgccaagactcctcag

SEQ ID NO: 5032070 - DNA, 22 bp, Homo sapiens
accctgccaagactcctcaggc

SEQ ID NO: 5032071 - DNA, 18 bp, Homo sapiens
accctggcacccagggtg

SEQ ID NO: 5032072 - DNA, 22 bp, Homo sapiens
accctggccgccccctgccccc

SEQ ID NO: 5032073 - DNA, 23 bp, Homo sapiens
accctgtccggcccagtgccact

SEQ ID NO: 5032074 - DNA, 15 bp, Homo sapiens
accgaatgtgtcttt

SEQ ID NO: 5032075 - DNA, 19 bp, Homo sapiens
accggagagttatcctgat

SEQ ID NO: 5032076 - DNA, 22 bp, Homo sapiens
acctagagaacaggtggttttt

SEQ ID NO: 5032077 - DNA, 23 bp, Homo sapiens
acctagctgaatgtttttctaaa

SEQ ID NO: 5032078 - DNA, 15 bp, Homo sapiens
acctcaggcagctca

SEQ ID NO: 5032079 - DNA, 17 bp, Homo sapiens
acctcaggcagctcaag

SEQ ID NO: 5032080 - DNA, 16 bp, Homo sapiens
acctcatgcccagctc

SEQ ID NO: 5032081 - DNA, 20 bp, Homo sapiens
acctcatgcccagctctctg

SEQ ID NO: 5032082 - DNA, 21 bp, Homo sapiens
acctcatgcccagctctctga

SEQ ID NO: 5032083 - DNA, 23 bp, Homo sapiens
acctcggggacaccagagctgcc

SEQ ID NO: 5032084 - DNA, 15 bp, Homo sapiens
acctgagatttatta

SEQ ID NO: 5032085 - DNA, 20 bp, Homo sapiens
acctgagatttattaaagaa

SEQ ID NO: 5032086 - DNA, 16 bp, Homo sapiens
acctgcacacaggaca

SEQ ID NO: 5032087 - DNA, 18 bp, Homo sapiens
acctgcacacaggacagc

SEQ ID NO: 5032088 - DNA, 20 bp, Homo sapiens
acctgcacacaggacagcgg

SEQ ID NO: 5032089 - DNA, 17 bp, Homo sapiens
acctgggcaagctggcg

SEQ ID NO: 5032090 - DNA, 19 bp, Homo sapiens
acctgggcatttggtgaga

SEQ ID NO: 5032091 - DNA, 16 bp, Homo sapiens
acctggtaccctcctg

SEQ ID NO: 5032092 - DNA, 19 bp, Homo sapiens
acctggtaccctcctggct

SEQ ID NO: 5032093 - DNA, 13 bp, Homo sapiens
agaaattaagtat

SEQ ID NO: 5032094 - DNA, 17 bp, Homo sapiens
agaaattaagtatctga

SEQ ID NO: 5032095 - DNA, 14 bp, Homo sapiens
agaaatttcacata

SEQ ID NO: 5032096 - DNA, 18 bp, Homo sapiens
agaacacggctcacgctt

SEQ ID NO: 5032097 - DNA, 11 bp, Homo sapiens
agaacattgta

SEQ ID NO: 5032098 - DNA, 21 bp, Homo sapiens
agaaccagccgtattttacat

SEQ ID NO: 5032099 - DNA, 22 bp, Homo sapiens
agaaccagccgtattttacatg

SEQ ID NO: 5032100 - DNA, 13 bp, Homo sapiens
agaagacaaaaag

SEQ ID NO: 5032101 - DNA, 22 bp, Homo sapiens
agaagcattctcattggaaatt

SEQ ID NO: 5032102 - DNA, 14 bp, Homo sapiens
agaaggcaaatgac

SEQ ID NO: 5032103 - DNA, 20 bp, Homo sapiens
agaaggcagtagttttcaaa

SEQ ID NO: 5032104 - DNA, 16 bp, Homo sapiens
agaaggggaagcactc

SEQ ID NO: 5032105 - DNA, 16 bp, Homo sapiens
agaatgaaatactgtt

SEQ ID NO: 5032106 - DNA, 14 bp, Homo sapiens
agaatgtatcccca

SEQ ID NO: 5032107 - DNA, 11 bp, Homo sapiens
agaattattta

SEQ ID NO: 5032108 - DNA, 21 bp, Homo sapiens
agaattgttgggggttttttt

SEQ ID NO: 5032109 - DNA, 14 bp, Homo sapiens
agacaaaaagacaa

SEQ ID NO: 5032110 - DNA, 20 bp, Homo sapiens
agacaacgtgctctttgttt

SEQ ID NO: 5032111 - DNA, 23 bp, Homo sapiens
agacaacgtgctctttgttttgt

SEQ ID NO: 5032112 - DNA, 20 bp, Homo sapiens
agacaagtgactgtatctgt

SEQ ID NO: 5032113 - DNA, 15 bp, Homo sapiens
agacagaccctctgc

SEQ ID NO: 5032114 - DNA, 23 bp, Homo sapiens
agacatcagtctccaacatgttt

SEQ ID NO: 5032115 - DNA, 20 bp, Homo sapiens
agacatgtggaggggcagcc

SEQ ID NO: 5032116 - DNA, 15 bp, Homo sapiens
agacccatagcagct

SEQ ID NO: 5032117 - DNA, 12 bp, Homo sapiens
agacccccaggc

SEQ ID NO: 5032118 - DNA, 13 bp, Homo sapiens
agacccccaggcc

SEQ ID NO: 5032119 - DNA, 15 bp, Homo sapiens
agaccctccccacag

SEQ ID NO: 5032120 - DNA, 19 bp, Homo sapiens
agacctcatgcccagctct

SEQ ID NO: 5032121 - DNA, 23 bp, Homo sapiens
agacctcatgcccagctctctga

SEQ ID NO: 5032122 - DNA, 15 bp, Homo sapiens
agacctgaattcttt

SEQ ID NO: 5032123 - DNA, 17 bp, Homo sapiens
agacgatgtcttcatac

SEQ ID NO: 5032124 - DNA, 19 bp, Homo sapiens
aatgctaatttaaagagac

SEQ ID NO: 5032125 - DNA, 19 bp, Homo sapiens
aatgcttctaagtaaatac

SEQ ID NO: 5032126 - DNA, 16 bp, Homo sapiens
aatggaaacagactca

SEQ ID NO: 5032127 - DNA, 12 bp, Homo sapiens
aatggccatgca

SEQ ID NO: 5032128 - DNA, 15 bp, Homo sapiens
aatggccatgcagga

SEQ ID NO: 5032129 - DNA, 17 bp, Homo sapiens
aatggccatgcaggagg

SEQ ID NO: 5032130 - DNA, 14 bp, Homo sapiens
aatggcgtctgctc

SEQ ID NO: 5032131 - DNA, 16 bp, Homo sapiens
aatggcgtctgctctg

SEQ ID NO: 5032132 - DNA, 19 bp, Homo sapiens
aatggcgtctgctctggtg

SEQ ID NO: 5032133 - DNA, 18 bp, Homo sapiens
aatgtattttatgttata

SEQ ID NO: 5032134 - DNA, 20 bp, Homo sapiens
aatgtattttatgttatata

SEQ ID NO: 5032135 - DNA, 17 bp, Homo sapiens
aatgtgattactgctct

SEQ ID NO: 5032136 - DNA, 19 bp, Homo sapiens
aatgtgtacaatgtacaca

SEQ ID NO: 5032137 - DNA, 12 bp, Homo sapiens
aatgtgtcattg

SEQ ID NO: 5032138 - DNA, 13 bp, Homo sapiens
aatgtgtctttag

SEQ ID NO: 5032139 - DNA, 17 bp, Homo sapiens
aatgttttacattccat

SEQ ID NO: 5032140 - DNA, 17 bp, Homo sapiens
aattaaaaaagataaac

SEQ ID NO: 5032141 - DNA, 16 bp, Homo sapiens
aattaaaccgcatgtg

SEQ ID NO: 5032142 - DNA, 16 bp, Homo sapiens
aattaaggattttatg

SEQ ID NO: 5032143 - DNA, 13 bp, Homo sapiens
aattaagtatctg

SEQ ID NO: 5032144 - DNA, 22 bp, Homo sapiens
aattaatctgggccagaatttc

SEQ ID NO: 5032145 - DNA, 14 bp, Homo sapiens
aattagttatatat

SEQ ID NO: 5032146 - DNA, 12 bp, Homo sapiens
aattattatttg

SEQ ID NO: 5032147 - DNA, 16 bp, Homo sapiens
aattattatttgtgtt

SEQ ID NO: 5032148 - DNA, 23 bp, Homo sapiens
aattcctcatttgttcattaaac

SEQ ID NO: 5032149 - DNA, 13 bp, Homo sapiens
aattgaaatgtaa

SEQ ID NO: 5032150 - DNA, 15 bp, Homo sapiens
aattgaaatgtaagg

SEQ ID NO: 5032151 - DNA, 24 bp, Homo sapiens
aattgaaatgtaaggctgtgtaag

SEQ ID NO: 5032152 - DNA, 23 bp, Homo sapiens
aattggcatggaaatttaaagca

SEQ ID NO: 5032153 - DNA, 19 bp, Homo sapiens
aattgggccagcttttcaa

SEQ ID NO: 5032154 - DNA, 17 bp, Homo sapiens
aattgggtgaagagctt

SEQ ID NO: 5032155 - DNA, 19 bp, Homo sapiens
aattgtcattatttttgtt

SEQ ID NO: 5032156 - DNA, 20 bp, Homo sapiens
aattgtcattatttttgtta

SEQ ID NO: 5032157 - DNA, 15 bp, Homo sapiens
aattgttgttctgtt

SEQ ID NO: 5032158 - DNA, 23 bp, Homo sapiens
aattgttgttctgttaactgaat

SEQ ID NO: 5032159 - DNA, 10 bp, Homo sapiens
aatttaaaca

SEQ ID NO: 5032160 - DNA, 12 bp, Homo sapiens
aatttaaagcag

SEQ ID NO: 5032161 - DNA, 19 bp, Homo sapiens
aatttaaagcaggttcttg

SEQ ID NO: 5032162 - DNA, 13 bp, Homo sapiens
aatttagcattgt

SEQ ID NO: 5032163 - DNA, 21 bp, Homo sapiens
aatttcaggaggaatactgaa

SEQ ID NO: 5032164 - DNA, 18 bp, Homo sapiens
aatttggcaattttgtgg

SEQ ID NO: 5032165 - DNA, 14 bp, Homo sapiens
aatttttcttcttg

SEQ ID NO: 5032166 - DNA, 23 bp, Homo sapiens
aattttttttattagtattgttg

SEQ ID NO: 5032167 - DNA, 14 bp, Homo sapiens
acaaaccatttcca

SEQ ID NO: 5032168 - DNA, 11 bp, Homo sapiens
acaaactgaag

SEQ ID NO: 5032169 - DNA, 13 bp, Homo sapiens
acaaactttgcat

SEQ ID NO: 5032170 - DNA, 18 bp, Homo sapiens
acaaaggtttaaatgaac

SEQ ID NO: 5032171 - DNA, 19 bp, Homo sapiens
acaaaggtttaaatgaaca

SEQ ID NO: 5032172 - DNA, 20 bp, Homo sapiens
acaaaggtttaaatgaacaa

SEQ ID NO: 5032173 - DNA, 18 bp, Homo sapiens
acaaatgccaaattaaaa

SEQ ID NO: 5032174 - DNA, 14 bp, Homo sapiens
acaactcatacact

SEQ ID NO: 5032175 - DNA, 14 bp, Homo sapiens
acaagagaagcatt

SEQ ID NO: 5032176 - DNA, 17 bp, Homo sapiens
acaagagaagcattctc

SEQ ID NO: 5032177 - DNA, 19 bp, Homo sapiens
acaagagaagcattctcat

SEQ ID NO: 5032178 - DNA, 17 bp, Homo sapiens
acaagattggtgttttt

SEQ ID NO: 5032179 - DNA, 22 bp, Homo sapiens
acaagattggtgtttttttcta

SEQ ID NO: 5032180 - DNA, 23 bp, Homo sapiens
acaagattggtgtttttttctat

SEQ ID NO: 5032181 - DNA, 13 bp, Homo sapiens
acaagtacttttg

SEQ ID NO: 5032182 - DNA, 22 bp, Homo sapiens
acaatttggcaattttgtggtt

SEQ ID NO: 5032183 - DNA, 15 bp, Homo sapiens
acacacacacacaaa

SEQ ID NO: 5032184 - DNA, 19 bp, Homo sapiens
acacacagatacacacaca

SEQ ID NO: 5032185 - DNA, 19 bp, Homo sapiens
acacagccactaaaacaca

SEQ ID NO: 5032186 - DNA, 12 bp, Homo sapiens
acaccagagctg

SEQ ID NO: 5032187 - DNA, 13 bp, Homo sapiens
acaccagagctgc

SEQ ID NO: 5032188 - DNA, 17 bp, Homo sapiens
acaccagagctgccgac

SEQ ID NO: 5032189 - DNA, 18 bp, Homo sapiens
acacccagcggccccccg

SEQ ID NO: 5032190 - DNA, 13 bp, Homo sapiens
acacccctctgtc

SEQ ID NO: 5032191 - DNA, 13 bp, Homo sapiens
acacgagcaaacc

SEQ ID NO: 5032192 - DNA, 18 bp, Homo sapiens
acacgagcaaacccagag

SEQ ID NO: 5032193 - DNA, 21 bp, Homo sapiens
acacgcgggcgcgatcccaca

SEQ ID NO: 5032194 - DNA, 23 bp, Homo sapiens
acacgcgggcgcgatcccacaca

SEQ ID NO: 5032195 - DNA, 14 bp, Homo sapiens
acacgctccttcct

SEQ ID NO: 5032196 - DNA, 19 bp, Homo sapiens
acacgctccttcctctgag

SEQ ID NO: 5032197 - DNA, 17 bp, Homo sapiens
acacgcttttgtgatgg

SEQ ID NO: 5032198 - DNA, 16 bp, Homo sapiens
acactaccgaatgtgt

SEQ ID NO: 5032199 - DNA, 19 bp, Homo sapiens
acactaccgaatgtgtctt

SEQ ID NO: 5032200 - DNA, 15 bp, Homo sapiens
acactccaattaagg

SEQ ID NO: 5032201 - DNA, 21 bp, Homo sapiens
acactccaattaaggatttta

SEQ ID NO: 5032202 - DNA, 12 bp, Homo sapiens
acactgttctta

SEQ ID NO: 5032203 - DNA, 15 bp, Homo sapiens
acactgttcttagct

SEQ ID NO: 5032204 - DNA, 23 bp, Homo sapiens
acactgttcttagctcaatgagc

SEQ ID NO: 5032205 - DNA, 22 bp, Homo sapiens
acacttttggttaagtctgttt

SEQ ID NO: 5032206 - DNA, 17 bp, Homo sapiens
acagaaaccagaaaagc

SEQ ID NO: 5032207 - DNA, 13 bp, Homo sapiens
acagaagcagctc

SEQ ID NO: 5032208 - DNA, 14 bp, Homo sapiens
acagaagcagctct

SEQ ID NO: 5032209 - DNA, 14 bp, Homo sapiens
acagagcaggactg

SEQ ID NO: 5032210 - DNA, 22 bp, Homo sapiens
acagatggcactttgaaggggc

SEQ ID NO: 5032211 - DNA, 21 bp, Homo sapiens
acagccacccgtggggtgctg

SEQ ID NO: 5032212 - DNA, 18 bp, Homo sapiens
acagcggagtctgtcctg

SEQ ID NO: 5032213 - DNA, 21 bp, Homo sapiens
acagctacttggtttgtgttc

SEQ ID NO: 5032214 - DNA, 14 bp, Homo sapiens
acagctcctcccac

SEQ ID NO: 5032215 - DNA, 12 bp, Homo sapiens
acagctttctgg

SEQ ID NO: 5032216 - DNA, 16 bp, Homo sapiens
acagctttctgggatg

SEQ ID NO: 5032217 - DNA, 14 bp, Homo sapiens
acaggacagcggga

SEQ ID NO: 5032218 - DNA, 13 bp, Homo sapiens
aaactgtacagtg

SEQ ID NO: 5032219 - DNA, 16 bp, Homo sapiens
aaactgtacagtgtct

SEQ ID NO: 5032220 - DNA, 18 bp, Homo sapiens
aaactgtacagtgtcttt

SEQ ID NO: 5032221 - DNA, 18 bp, Homo sapiens
aaactgtctttaaaagag

SEQ ID NO: 5032222 - DNA, 18 bp, Homo sapiens
aaagaaaaaaattgaaat

SEQ ID NO: 5032223 - DNA, 21 bp, Homo sapiens
aaagaaaaaaattgaaatgta

SEQ ID NO: 5032224 - DNA, 13 bp, Homo sapiens
aaagaaaagatgc

SEQ ID NO: 5032225 - DNA, 15 bp, Homo sapiens
aaagaaaagatgcac

SEQ ID NO: 5032226 - DNA, 15 bp, Homo sapiens
aaagaaacatttcct

SEQ ID NO: 5032227 - DNA, 20 bp, Homo sapiens
aaagaagacctgagaatgta

SEQ ID NO: 5032228 - DNA, 15 bp, Homo sapiens
aaagacgttttataa

SEQ ID NO: 5032229 - DNA, 20 bp, Homo sapiens
aaagacgttttataagcatc

SEQ ID NO: 5032230 - DNA, 16 bp, Homo sapiens
aaagataaacacaaga

SEQ ID NO: 5032231 - DNA, 17 bp, Homo sapiens
aaagataaacacaagat

SEQ ID NO: 5032232 - DNA, 19 bp, Homo sapiens
aaagcaaaacatctctgca

SEQ ID NO: 5032233 - DNA, 17 bp, Homo sapiens
aaagcaggttcttgttg

SEQ ID NO: 5032234 - DNA, 18 bp, Homo sapiens
aaagcataaaaacatttt

SEQ ID NO: 5032235 - DNA, 21 bp, Homo sapiens
aaagcgtgagcttaaaataca

SEQ ID NO: 5032236 - DNA, 23 bp, Homo sapiens
aaagcgtgagcttaaaatacaag

SEQ ID NO: 5032237 - DNA, 23 bp, Homo sapiens
aaaggaaggttctggtgtgaact

SEQ ID NO: 5032238 - DNA, 20 bp, Homo sapiens
aaagtagaagagggttttag

SEQ ID NO: 5032239 - DNA, 12 bp, Homo sapiens
aaagtatgttct

SEQ ID NO: 5032240 - DNA, 19 bp, Homo sapiens
aaagtgagagccagcagca

SEQ ID NO: 5032241 - DNA, 23 bp, Homo sapiens
aaagttgcagctgttttgttgac

SEQ ID NO: 5032242 - DNA, 19 bp, Homo sapiens
aaagttggaaggatctgct

SEQ ID NO: 5032243 - DNA, 13 bp, Homo sapiens
aaataaagtctct

SEQ ID NO: 5032244 - DNA, 13 bp, Homo sapiens
aaatacaagactg

SEQ ID NO: 5032245 - DNA, 13 bp, Homo sapiens
aaatacaattttt

SEQ ID NO: 5032246 - DNA, 20 bp, Homo sapiens
aaatactatttaaagcctcc

SEQ ID NO: 5032247 - DNA, 15 bp, Homo sapiens
aaatagggtatattt

SEQ ID NO: 5032248 - DNA, 15 bp, Homo sapiens
aaatagtatttgcat

SEQ ID NO: 5032249 - DNA, 19 bp, Homo sapiens
aaatagtgacataatatat

SEQ ID NO: 5032250 - DNA, 22 bp, Homo sapiens
aaatagtgacataatatattct

SEQ ID NO: 5032251 - DNA, 13 bp, Homo sapiens
aaatataaagacg

SEQ ID NO: 5032252 - DNA, 13 bp, Homo sapiens
aaatcgcttttga

SEQ ID NO: 5032253 - DNA, 15 bp, Homo sapiens
aaatcgcttttgata

SEQ ID NO: 5032254 - DNA, 13 bp, Homo sapiens
aaatgaacaagag

SEQ ID NO: 5032255 - DNA, 18 bp, Homo sapiens
aaatgattcaaattgctg

SEQ ID NO: 5032256 - DNA, 23 bp, Homo sapiens
aaatgctggctatagatgtcttt

SEQ ID NO: 5032257 - DNA, 18 bp, Homo sapiens
aaatggccatgcaggagg

SEQ ID NO: 5032258 - DNA, 20 bp, Homo sapiens
aaatggcgtctgctctggtg

SEQ ID NO: 5032259 - DNA, 18 bp, Homo sapiens
aaatgtaaggctgtgtaa

SEQ ID NO: 5032260 - DNA, 19 bp, Homo sapiens
aaatgtattttatgttata

SEQ ID NO: 5032261 - DNA, 21 bp, Homo sapiens
aaatgtattttatgttatata

SEQ ID NO: 5032262 - DNA, 17 bp, Homo sapiens
aaatgtgaatcgcagct

SEQ ID NO: 5032263 - DNA, 12 bp, Homo sapiens
aaattaaaaaag

SEQ ID NO: 5032264 - DNA, 19 bp, Homo sapiens
aaattcagagcaagttcct

SEQ ID NO: 5032265 - DNA, 15 bp, Homo sapiens
aaattgctgcttgga

SEQ ID NO: 5032266 - DNA, 13 bp, Homo sapiens
aaatttaaagcag

SEQ ID NO: 5032267 - DNA, 16 bp, Homo sapiens
aaatttagcattgtag

SEQ ID NO: 5032268 - DNA, 23 bp, Homo sapiens
aacaaatgccaaattaaaaaaga

SEQ ID NO: 5032269 - DNA, 17 bp, Homo sapiens
aacaagaaaaataaaga

SEQ ID NO: 5032270 - DNA, 18 bp, Homo sapiens
aacaagaaaaataaagaa

SEQ ID NO: 5032271 - DNA, 14 bp, Homo sapiens
aacaatttggcaat

SEQ ID NO: 5032272 - DNA, 18 bp, Homo sapiens
aacacaagattggtgttt

SEQ ID NO: 5032273 - DNA, 20 bp, Homo sapiens
aacacacagatacacacaca

SEQ ID NO: 5032274 - DNA, 13 bp, Homo sapiens
aacacccctctgt

SEQ ID NO: 5032275 - DNA, 15 bp, Homo sapiens
aacagcctgcctgtc

SEQ ID NO: 5032276 - DNA, 16 bp, Homo sapiens
aacagctgtgtctgcc

SEQ ID NO: 5032277 - DNA, 23 bp, Homo sapiens
aacagctgtgtctgccaaacaca

SEQ ID NO: 5032278 - DNA, 18 bp, Homo sapiens
aacataagctatttttct

SEQ ID NO: 5032279 - DNA, 23 bp, Homo sapiens
aacatctctgcagtttttcccaa

SEQ ID NO: 5032280 - DNA, 16 bp, Homo sapiens
aacatctgagtcctgg

SEQ ID NO: 5032281 - DNA, 22 bp, Homo sapiens
aacattggttcttgtattaaga

SEQ ID NO: 5032282 - DNA, 23 bp, Homo sapiens
aacattggttcttgtattaagaa

SEQ ID NO: 5032283 - DNA, 22 bp, Homo sapiens
aacattttaaaaacatagaaaa

SEQ ID NO: 5032284 - DNA, 22 bp, Homo sapiens
aaccaaaagggaggctctctgt

SEQ ID NO: 5032285 - DNA, 13 bp, Homo sapiens
aaccaattatttt

SEQ ID NO: 5032286 - DNA, 22 bp, Homo sapiens
aaccagctcagcactgcctgct

SEQ ID NO: 5032287 - DNA, 19 bp, Homo sapiens
aacccaaggtaccatccta

SEQ ID NO: 5032288 - DNA, 22 bp, Homo sapiens
aacctccattctattttagaat

SEQ ID NO: 5032289 - DNA, 14 bp, Homo sapiens
aacctgagatttat

SEQ ID NO: 5032290 - DNA, 13 bp, Homo sapiens
aacctgcacacag

SEQ ID NO: 5032291 - DNA, 15 bp, Homo sapiens
aacctgcacacagga

SEQ ID NO: 5032292 - DNA, 19 bp, Homo sapiens
aacctttacatgaggactc

SEQ ID NO: 5032293 - DNA, 14 bp, Homo sapiens
aacgatttttaaaa

SEQ ID NO: 5032294 - DNA, 18 bp, Homo sapiens
aacgatttttaaaatgta

SEQ ID NO: 5032295 - DNA, 14 bp, Homo sapiens
aacggcaacagcat

SEQ ID NO: 5032296 - DNA, 18 bp, Homo sapiens
aacgtcattcagtactta

SEQ ID NO: 5032297 - DNA, 17 bp, Homo sapiens
aacgtccacagagtata

SEQ ID NO: 5032298 - DNA, 20 bp, Homo sapiens
aacgtgctctttgttttgtg

SEQ ID NO: 5032299 - DNA, 17 bp, Homo sapiens
aactaaactttcacacc

SEQ ID NO: 5032300 - DNA, 20 bp, Homo sapiens
aactacaaaggtttaaatga

SEQ ID NO: 5032301 - DNA, 15 bp, Homo sapiens
aactacattttgcaa

SEQ ID NO: 5032302 - DNA, 16 bp, Homo sapiens
aactactctttgattt

SEQ ID NO: 5032303 - DNA, 13 bp, Homo sapiens
aactcacagagct

SEQ ID NO: 5032304 - DNA, 15 bp, Homo sapiens
aactcacagagcttt

SEQ ID NO: 5032305 - DNA, 16 bp, Homo sapiens
aactcactccttttaa

SEQ ID NO: 5032306 - DNA, 20 bp, Homo sapiens
aactcactccttttaaagaa

SEQ ID NO: 5032307 - DNA, 15 bp, Homo sapiens
aactcccattaccat

SEQ ID NO: 5032308 - DNA, 20 bp, Homo sapiens
aactctgacaacagacttct

SEQ ID NO: 5032309 - DNA, 17 bp, Homo sapiens
aactgaaggggtgcacc

SEQ ID NO: 5032310 - DNA, 17 bp, Homo sapiens
aactgaataccactctg

SEQ ID NO: 5032311 - DNA, 18 bp, Homo sapiens
aactgaataccactctgt

SEQ ID NO: 5032312 - DNA, 22 bp, Homo sapiens
aactgcattttaccagatgttt

SEQ ID NO: 5032313 - DNA, 16 bp, Homo sapiens
aactgctcagctctgg

SEQ ID NO: 5032314 - DNA, 17 bp, Homo sapiens
aactgctcagctctggt

SEQ ID NO: 5032315 - DNA, 22 bp, Homo sapiens
aactgtcagtgtacacgtctgg

SEQ ID NO: 5032316 - DNA, 19 bp, Homo sapiens
aactgtctttaaaagagag

SEQ ID NO: 5032317 - DNA, 16 bp, Homo sapiens
aactgttatttataat

SEQ ID NO: 5032318 - DNA, 20 bp, Homo sapiens
aacttagtgacaaaatagac

SEQ ID NO: 5032319 - DNA, 12 bp, Homo sapiens
aacttcattctc

SEQ ID NO: 5032320 - DNA, 13 bp, Homo sapiens
aacttgttttctg

SEQ ID NO: 5032321 - DNA, 21 bp, Homo sapiens
tgtttgaccttcagagccagc

SEQ ID NO: 5032322 - DNA, 22 bp, Homo sapiens
tgtttgaggtttttaagcctta

SEQ ID NO: 5032323 - DNA, 16 bp, Homo sapiens
tgtttgtagtgaaata

SEQ ID NO: 5032324 - DNA, 17 bp, Homo sapiens
tgttttacattccattt

SEQ ID NO: 5032325 - DNA, 13 bp, Homo sapiens
tgttttgttgaca

SEQ ID NO: 5032326 - DNA, 14 bp, Homo sapiens
tgttttgttgacat

SEQ ID NO: 5032327 - DNA, 16 bp, Homo sapiens
tgttttgttgtttgat

SEQ ID NO: 5032328 - DNA, 14 bp, Homo sapiens
tgtttttaaactgt

SEQ ID NO: 5032329 - DNA, 13 bp, Homo sapiens
tgtttttctaaag

SEQ ID NO: 5032330 - DNA, 13 bp, Homo sapiens
tgttttttccttt

SEQ ID NO: 5032331 - DNA, 19 bp, Homo sapiens
tgtttttttaactgcattt

SEQ ID NO: 5032332 - DNA, 15 bp, Homo sapiens
ttaaaaaagataaac

SEQ ID NO: 5032333 - DNA, 18 bp, Homo sapiens
ttaaaaaagataaacaca

SEQ ID NO: 5032334 - DNA, 21 bp, Homo sapiens
ttaaaaaagataaacacaaga

SEQ ID NO: 5032335 - DNA, 15 bp, Homo sapiens
ttaaaatacaagact

SEQ ID NO: 5032336 - DNA, 22 bp, Homo sapiens
ttaaaatagcgttcttgtaatt

SEQ ID NO: 5032337 - DNA, 23 bp, Homo sapiens
ttaaaatagcgttcttgtaattt

SEQ ID NO: 5032338 - DNA, 18 bp, Homo sapiens
ttaaagaaaaaaatgtat

SEQ ID NO: 5032339 - DNA, 19 bp, Homo sapiens
ttaaagaaaaaaatgtatt

SEQ ID NO: 5032340 - DNA, 13 bp, Homo sapiens
ttaaagcctcctc

SEQ ID NO: 5032341 - DNA, 22 bp, Homo sapiens
ttaaaggaaggttctggtgtga

SEQ ID NO: 5032342 - DNA, 14 bp, Homo sapiens
ttaaatgaacaaga

SEQ ID NO: 5032343 - DNA, 16 bp, Homo sapiens
ttaaattttttgttga

SEQ ID NO: 5032344 - DNA, 14 bp, Homo sapiens
ttaacacagtgtct

SEQ ID NO: 5032345 - DNA, 21 bp, Homo sapiens
ttaacataagctatttttcta

SEQ ID NO: 5032346 - DNA, 23 bp, Homo sapiens
ttaactcccattaccatgtaatg

SEQ ID NO: 5032347 - DNA, 16 bp, Homo sapiens
ttaactgaataccact

SEQ ID NO: 5032348 - DNA, 20 bp, Homo sapiens
ttaactgaataccactctgt

SEQ ID NO: 5032349 - DNA, 23 bp, Homo sapiens
ttaagacatttttggaaggggac

SEQ ID NO: 5032350 - DNA, 14 bp, Homo sapiens
ttaagatatgatgt

SEQ ID NO: 5032351 - DNA, 16 bp, Homo sapiens
ttaaggctaaaaagta

SEQ ID NO: 5032352 - DNA, 21 bp, Homo sapiens
ttaagttgagatagttttcat

SEQ ID NO: 5032353 - DNA, 19 bp, Homo sapiens
ttaataaactactctttga

SEQ ID NO: 5032354 - DNA, 17 bp, Homo sapiens
ttaatataaatgcaaat

SEQ ID NO: 5032355 - DNA, 14 bp, Homo sapiens
ttaattattatttg

SEQ ID NO: 5032356 - DNA, 21 bp, Homo sapiens
ttaattgggccagcttttcaa

SEQ ID NO: 5032357 - DNA, 18 bp, Homo sapiens
ttaatttaaacacctcct

SEQ ID NO: 5032358 - DNA, 17 bp, Homo sapiens
ttacacgcttttgtgat

SEQ ID NO: 5032359 - DNA, 22 bp, Homo sapiens
ttacagtaatcccatttcccaa

SEQ ID NO: 5032360 - DNA, 18 bp, Homo sapiens
ttacatttacaaactgaa

SEQ ID NO: 5032361 - DNA, 20 bp, Homo sapiens
ttaccaaagcatcaatacaa

SEQ ID NO: 5032362 - DNA, 23 bp, Homo sapiens
ttaccagtggcgttgttgcatgt

SEQ ID NO: 5032363 - DNA, 23 bp, Homo sapiens
ttaccctctgggtctcagtgtcc

SEQ ID NO: 5032364 - DNA, 23 bp, Homo sapiens
ttactcttcagttaagcctttgg

SEQ ID NO: 5032365 - DNA, 17 bp, Homo sapiens
ttacttgtaaatataaa

SEQ ID NO: 5032366 - DNA, 19 bp, Homo sapiens
ttacttgtaaatataaaga

SEQ ID NO: 5032367 - DNA, 20 bp, Homo sapiens
ttagaaccagccgtatttta

SEQ ID NO: 5032368 - DNA, 20 bp, Homo sapiens
ttagaatcaaacattttgaa

SEQ ID NO: 5032369 - DNA, 23 bp, Homo sapiens
ttagaatcaaacattttgaaagt

SEQ ID NO: 5032370 - DNA, 15 bp, Homo sapiens
ttagagtttctgttt

SEQ ID NO: 5032371 - DNA, 16 bp, Homo sapiens
ttagagtttctgtttg

SEQ ID NO: 5032372 - DNA, 18 bp, Homo sapiens
ttagatagccctgtcctg

SEQ ID NO: 5032373 - DNA, 13 bp, Homo sapiens
ttagcatcaagtt

SEQ ID NO: 5032374 - DNA, 15 bp, Homo sapiens
ttagctaataaaaag

SEQ ID NO: 5032375 - DNA, 14 bp, Homo sapiens
ttagctcaatgagc

SEQ ID NO: 5032376 - DNA, 18 bp, Homo sapiens
ttagctcaatgagcatgt

SEQ ID NO: 5032377 - DNA, 16 bp, Homo sapiens
ttagggaacaatttgg

SEQ ID NO: 5032378 - DNA, 12 bp, Homo sapiens
ttagtattgttg

SEQ ID NO: 5032379 - DNA, 12 bp, Homo sapiens
ttagtctcagtt

SEQ ID NO: 5032380 - DNA, 15 bp, Homo sapiens
ttagtgacaaaatag

SEQ ID NO: 5032381 - DNA, 13 bp, Homo sapiens
ttataagcatcat

SEQ ID NO: 5032382 - DNA, 19 bp, Homo sapiens
ttataagcatcattattta

SEQ ID NO: 5032383 - DNA, 22 bp, Homo sapiens
ttataagcatcattatttatgt

SEQ ID NO: 5032384 - DNA, 13 bp, Homo sapiens
ttataatcacttt

SEQ ID NO: 5032385 - DNA, 16 bp, Homo sapiens
ttatacgaaataattg

SEQ ID NO: 5032386 - DNA, 23 bp, Homo sapiens
ttatatataaatatattattact

SEQ ID NO: 5032387 - DNA, 19 bp, Homo sapiens
ttatcacctagctgaatgt

SEQ ID NO: 5032388 - DNA, 17 bp, Homo sapiens
ttatgaacagctgtgtc

SEQ ID NO: 5032389 - DNA, 18 bp, Homo sapiens
ttatgaacagctgtgtct

SEQ ID NO: 5032390 - DNA, 13 bp, Homo sapiens
ttatgctttaaac

SEQ ID NO: 5032391 - DNA, 17 bp, Homo sapiens
ttatgttatatataaat

SEQ ID NO: 5032392 - DNA, 18 bp, Homo sapiens
ttatgttatatataaata

SEQ ID NO: 5032393 - DNA, 19 bp, Homo sapiens
ttattacagtgtttatcct

SEQ ID NO: 5032394 - DNA, 16 bp, Homo sapiens
ttattacttgtaaata

SEQ ID NO: 5032395 - DNA, 18 bp, Homo sapiens
ttattacttgtaaatata

SEQ ID NO: 5032396 - DNA, 18 bp, Homo sapiens
ttattagaatcaaacatt

SEQ ID NO: 5032397 - DNA, 16 bp, Homo sapiens
ttattagtattgttgt

SEQ ID NO: 5032398 - DNA, 19 bp, Homo sapiens
ttattagtattgttgtcct

SEQ ID NO: 5032399 - DNA, 22 bp, Homo sapiens
ttattatttgtgttttaattta

SEQ ID NO: 5032400 - DNA, 20 bp, Homo sapiens
ttattcaatttatttgaatg

SEQ ID NO: 5032401 - DNA, 12 bp, Homo sapiens
ttatttatgtat

SEQ ID NO: 5032402 - DNA, 15 bp, Homo sapiens
ttatttatgtattgt

SEQ ID NO: 5032403 - DNA, 22 bp, Homo sapiens
ttatttgtgttttaatttaaac

SEQ ID NO: 5032404 - DNA, 23 bp, Homo sapiens
ttcaaaagcaaaacatctctgca

SEQ ID NO: 5032405 - DNA, 19 bp, Homo sapiens
ttcaaaatagggtatattt

SEQ ID NO: 5032406 - DNA, 20 bp, Homo sapiens
ttcaaaatagggtatatttt

SEQ ID NO: 5032407 - DNA, 22 bp, Homo sapiens
ttcaaactactttgctgctaat

SEQ ID NO: 5032408 - DNA, 15 bp, Homo sapiens
ttcaaattgctgctt

SEQ ID NO: 5032409 - DNA, 22 bp, Homo sapiens
ttcaagttttgggtatgtttaa

SEQ ID NO: 5032410 - DNA, 17 bp, Homo sapiens
ttcaatagccactaacc

SEQ ID NO: 5032411 - DNA, 23 bp, Homo sapiens
ttcaatagccactaaccttgcct

SEQ ID NO: 5032412 - DNA, 23 bp, Homo sapiens
tggtgcacagcacaaattagtta

SEQ ID NO: 5032413 - DNA, 10 bp, Homo sapiens
tggtggcatg

SEQ ID NO: 5032414 - DNA, 15 bp, Homo sapiens
tggtgtttgtctgtg

SEQ ID NO: 5032415 - DNA, 22 bp, Homo sapiens
tggtgtttttttctatgggtgt

SEQ ID NO: 5032416 - DNA, 18 bp, Homo sapiens
tggttaagtctgttttat

SEQ ID NO: 5032417 - DNA, 18 bp, Homo sapiens
tggttcccgtttctccac

SEQ ID NO: 5032418 - DNA, 12 bp, Homo sapiens
tggttcctcccc

SEQ ID NO: 5032419 - DNA, 18 bp, Homo sapiens
tggttcctcccctcctcc

SEQ ID NO: 5032420 - DNA, 23 bp, Homo sapiens
tggttcctcccctcctcctggac

SEQ ID NO: 5032421 - DNA, 18 bp, Homo sapiens
tggttcttgtattaagaa

SEQ ID NO: 5032422 - DNA, 16 bp, Homo sapiens
tggttggttttcttct

SEQ ID NO: 5032423 - DNA, 20 bp, Homo sapiens
tggtttgggaatatccatgt

SEQ ID NO: 5032424 - DNA, 21 bp, Homo sapiens
tggttttcttcttctcgtcct

SEQ ID NO: 5032425 - DNA, 14 bp, Homo sapiens
tgtaaatataaaga

SEQ ID NO: 5032426 - DNA, 16 bp, Homo sapiens
tgtaaatataaagacg

SEQ ID NO: 5032427 - DNA, 15 bp, Homo sapiens
tgtaagagcttgctc

SEQ ID NO: 5032428 - DNA, 20 bp, Homo sapiens
tgtaaggctgtgtaagattt

SEQ ID NO: 5032429 - DNA, 21 bp, Homo sapiens
tgtaaggctgtgtaagatttg

SEQ ID NO: 5032430 - DNA, 23 bp, Homo sapiens
tgtaatggcagttatattttgca

SEQ ID NO: 5032431 - DNA, 20 bp, Homo sapiens
tgtacaaggacagcccctcc

SEQ ID NO: 5032432 - DNA, 22 bp, Homo sapiens
tgtacagtgtctttttttgtat

SEQ ID NO: 5032433 - DNA, 16 bp, Homo sapiens
tgtactgttctgtgtc

SEQ ID NO: 5032434 - DNA, 15 bp, Homo sapiens
tgtactttgcttgct

SEQ ID NO: 5032435 - DNA, 18 bp, Homo sapiens
tgtactttgcttgctcat

SEQ ID NO: 5032436 - DNA, 15 bp, Homo sapiens
tgtagcgtctttctt

SEQ ID NO: 5032437 - DNA, 16 bp, Homo sapiens
tgtagcgtctttcttt

SEQ ID NO: 5032438 - DNA, 16 bp, Homo sapiens
tgtaggcagaggctgc

SEQ ID NO: 5032439 - DNA, 16 bp, Homo sapiens
tgtatctctttcacat

SEQ ID NO: 5032440 - DNA, 14 bp, Homo sapiens
tgtcaaggaagaag

SEQ ID NO: 5032441 - DNA, 19 bp, Homo sapiens
tgtcacagtccaaccagaa

SEQ ID NO: 5032442 - DNA, 21 bp, Homo sapiens
tgtcacatcagcaatttcaga

SEQ ID NO: 5032443 - DNA, 16 bp, Homo sapiens
tgtcaggagtgtgtgt

SEQ ID NO: 5032444 - DNA, 16 bp, Homo sapiens
tgtccacaggcttctg

SEQ ID NO: 5032445 - DNA, 17 bp, Homo sapiens
tgtcccacccccacccc

SEQ ID NO: 5032446 - DNA, 14 bp, Homo sapiens
tgtccctccccctt

SEQ ID NO: 5032447 - DNA, 20 bp, Homo sapiens
tgtccgctgggtggtaccct

SEQ ID NO: 5032448 - DNA, 22 bp, Homo sapiens
tgtccgctgggtggtaccctct

SEQ ID NO: 5032449 - DNA, 18 bp, Homo sapiens
tgtccggcccagtgccac

SEQ ID NO: 5032450 - DNA, 17 bp, Homo sapiens
tgtcctggtggtatttt

SEQ ID NO: 5032451 - DNA, 13 bp, Homo sapiens
tgtccttttcata

SEQ ID NO: 5032452 - DNA, 20 bp, Homo sapiens
tgtcctttttcactttgaaa

SEQ ID NO: 5032453 - DNA, 23 bp, Homo sapiens
tgtcctttttcactttgaaaagt

SEQ ID NO: 5032454 - DNA, 21 bp, Homo sapiens
tgtcgagagctggccaaagag

SEQ ID NO: 5032455 - DNA, 18 bp, Homo sapiens
tgtctaggactgcagtgt

SEQ ID NO: 5032456 - DNA, 12 bp, Homo sapiens
tgtctataaagc

SEQ ID NO: 5032457 - DNA, 18 bp, Homo sapiens
tgtctccctcccctctca

SEQ ID NO: 5032458 - DNA, 21 bp, Homo sapiens
tgtctccctcccctctcagaa

SEQ ID NO: 5032459 - DNA, 13 bp, Homo sapiens
tgtctctcctgcc

SEQ ID NO: 5032460 - DNA, 13 bp, Homo sapiens
tgtctctctgggc

SEQ ID NO: 5032461 - DNA, 15 bp, Homo sapiens
tgtctgccaaacaca

SEQ ID NO: 5032462 - DNA, 16 bp, Homo sapiens
tgtctgccaaacacat

SEQ ID NO: 5032463 - DNA, 18 bp, Homo sapiens
tgtctgctaaataaacat

SEQ ID NO: 5032464 - DNA, 21 bp, Homo sapiens
tgtctgtctccctcccctctc

SEQ ID NO: 5032465 - DNA, 17 bp, Homo sapiens
tgtcttaatactgtcct

SEQ ID NO: 5032466 - DNA, 14 bp, Homo sapiens
tgtcttaattatta

SEQ ID NO: 5032467 - DNA, 15 bp, Homo sapiens
tgtcttaattattat

SEQ ID NO: 5032468 - DNA, 19 bp, Homo sapiens
tgtcttttcccatttatct

SEQ ID NO: 5032469 - DNA, 16 bp, Homo sapiens
tgtctttttttgtata

SEQ ID NO: 5032470 - DNA, 23 bp, Homo sapiens
tgtgaactgaactctgacaacag

SEQ ID NO: 5032471 - DNA, 12 bp, Homo sapiens
tgtgacatgccc

SEQ ID NO: 5032472 - DNA, 13 bp, Homo sapiens
tgtgaccaccacc

SEQ ID NO: 5032473 - DNA, 18 bp, Homo sapiens
tgtgagcatcacagtttt

SEQ ID NO: 5032474 - DNA, 21 bp, Homo sapiens
tgtgatcttaatatatttgaa

SEQ ID NO: 5032475 - DNA, 15 bp, Homo sapiens
tgtgatggagtgctg

SEQ ID NO: 5032476 - DNA, 20 bp, Homo sapiens
tgtgcaatgtgtataaacaa

SEQ ID NO: 5032477 - DNA, 17 bp, Homo sapiens
tgtgcaggagcggcaga

SEQ ID NO: 5032478 - DNA, 18 bp, Homo sapiens
tgtgcaggagcggcagat

SEQ ID NO: 5032479 - DNA, 15 bp, Homo sapiens
tgtgcggctgtgtgt

SEQ ID NO: 5032480 - DNA, 17 bp, Homo sapiens
tgtgcggctgtgtgtgc

SEQ ID NO: 5032481 - DNA, 14 bp, Homo sapiens
tgtgctacagatga

SEQ ID NO: 5032482 - DNA, 14 bp, Homo sapiens
tgtgcttttcctga

SEQ ID NO: 5032483 - DNA, 15 bp, Homo sapiens
tgtggagcagcagcc

SEQ ID NO: 5032484 - DNA, 14 bp, Homo sapiens
tgtggctccttccc

SEQ ID NO: 5032485 - DNA, 15 bp, Homo sapiens
tgtggctccttccca

SEQ ID NO: 5032486 - DNA, 12 bp, Homo sapiens
tgtgggtcccgc

SEQ ID NO: 5032487 - DNA, 22 bp, Homo sapiens
tgtgtataaacaagaaaaataa

SEQ ID NO: 5032488 - DNA, 15 bp, Homo sapiens
tgtgtctgccaaaca

SEQ ID NO: 5032489 - DNA, 23 bp, Homo sapiens
tgtgtttgtttttcaagaaatga

SEQ ID NO: 5032490 - DNA, 22 bp, Homo sapiens
tgttaactgaataccactctgt

SEQ ID NO: 5032491 - DNA, 13 bp, Homo sapiens
tgttatataaatg

SEQ ID NO: 5032492 - DNA, 13 bp, Homo sapiens
tgttatatataaa

SEQ ID NO: 5032493 - DNA, 16 bp, Homo sapiens
tgttatatataaatat

SEQ ID NO: 5032494 - DNA, 18 bp, Homo sapiens
tgttatatataaatatat

SEQ ID NO: 5032495 - DNA, 22 bp, Homo sapiens
tgttatgtcaaactgtcttggc

SEQ ID NO: 5032496 - DNA, 12 bp, Homo sapiens
tgttattatata

SEQ ID NO: 5032497 - DNA, 21 bp, Homo sapiens
tgttatttataatcacttttt

SEQ ID NO: 5032498 - DNA, 18 bp, Homo sapiens
tgttcagcagaacctgca

SEQ ID NO: 5032499 - DNA, 16 bp, Homo sapiens
tgctgtagatgacaac

SEQ ID NO: 5032500 - DNA, 13 bp, Homo sapiens
tgctgtttcacaa

SEQ ID NO: 5032501 - DNA, 19 bp, Homo sapiens
tgcttctaagtaaatacaa

SEQ ID NO: 5032502 - DNA, 20 bp, Homo sapiens
tgcttctaagtaaatacaat

SEQ ID NO: 5032503 - DNA, 18 bp, Homo sapiens
tgcttgttaactgagtgc

SEQ ID NO: 5032504 - DNA, 14 bp, Homo sapiens
tgctttaatataaa

SEQ ID NO: 5032505 - DNA, 19 bp, Homo sapiens
tgctttctatgctgtttgt

SEQ ID NO: 5032506 - DNA, 16 bp, Homo sapiens
tgcttttcatgcaaac

SEQ ID NO: 5032507 - DNA, 18 bp, Homo sapiens
tgcttttgcccattttga

SEQ ID NO: 5032508 - DNA, 22 bp, Homo sapiens
tggaaacagctcgactttaaaa

SEQ ID NO: 5032509 - DNA, 13 bp, Homo sapiens
tggaaagactggg

SEQ ID NO: 5032510 - DNA, 19 bp, Homo sapiens
tggaaatgtgaatcgcagc

SEQ ID NO: 5032511 - DNA, 16 bp, Homo sapiens
tggaaattggaagagc

SEQ ID NO: 5032512 - DNA, 12 bp, Homo sapiens
tggaaatttaaa

SEQ ID NO: 5032513 - DNA, 14 bp, Homo sapiens
tggaaatttaaagc

SEQ ID NO: 5032514 - DNA, 16 bp, Homo sapiens
tggaaatttaaagcag

SEQ ID NO: 5032515 - DNA, 15 bp, Homo sapiens
tggaaatttagcatt

SEQ ID NO: 5032516 - DNA, 17 bp, Homo sapiens
tggaaatttagcattgt

SEQ ID NO: 5032517 - DNA, 15 bp, Homo sapiens
tggaaggatctgctg

SEQ ID NO: 5032518 - DNA, 19 bp, Homo sapiens
tggaaggatctgctgaggc

SEQ ID NO: 5032519 - DNA, 21 bp, Homo sapiens
tggaaggatctgctgaggccc

SEQ ID NO: 5032520 - DNA, 23 bp, Homo sapiens
tggaaggatctgctgaggcccag

SEQ ID NO: 5032521 - DNA, 18 bp, Homo sapiens
tggaagggcgttctaggt

SEQ ID NO: 5032522 - DNA, 16 bp, Homo sapiens
tggaatggtttgggaa

SEQ ID NO: 5032523 - DNA, 15 bp, Homo sapiens
tggaatttgttcaag

SEQ ID NO: 5032524 - DNA, 17 bp, Homo sapiens
tggacagaagcagctct

SEQ ID NO: 5032525 - DNA, 19 bp, Homo sapiens
tggacagtacctgattgta

SEQ ID NO: 5032526 - DNA, 20 bp, Homo sapiens
tggactgttttctctcggct

SEQ ID NO: 5032527 - DNA, 16 bp, Homo sapiens
tggagactcctggtct

SEQ ID NO: 5032528 - DNA, 19 bp, Homo sapiens
tggagactcctggtctgtg

SEQ ID NO: 5032529 - DNA, 13 bp, Homo sapiens
tggagcagcagcc

SEQ ID NO: 5032530 - DNA, 22 bp, Homo sapiens
tggagctctgtgggtctctgga

SEQ ID NO: 5032531 - DNA, 21 bp, Homo sapiens
tggaggcagatgtggggctga

SEQ ID NO: 5032532 - DNA, 22 bp, Homo sapiens
tggaggggcagcctgtgcctgc

SEQ ID NO: 5032533 - DNA, 19 bp, Homo sapiens
tggagtcccctcacctcct

SEQ ID NO: 5032534 - DNA, 20 bp, Homo sapiens
tggagtcccctcacctcctc

SEQ ID NO: 5032535 - DNA, 18 bp, Homo sapiens
tggatcctgggctgggtg

SEQ ID NO: 5032536 - DNA, 19 bp, Homo sapiens
tggatgttatgaacagctg

SEQ ID NO: 5032537 - DNA, 17 bp, Homo sapiens
tggattctccctgggcc

SEQ ID NO: 5032538 - DNA, 15 bp, Homo sapiens
tggatttgcatattt

SEQ ID NO: 5032539 - DNA, 17 bp, Homo sapiens
tggcaagagtgtggagg

SEQ ID NO: 5032540 - DNA, 19 bp, Homo sapiens
tggcaatctcagatgcagt

SEQ ID NO: 5032541 - DNA, 14 bp, Homo sapiens
tggcaattttgtgg

SEQ ID NO: 5032542 - DNA, 18 bp, Homo sapiens
tggcactggatgcagaaa

SEQ ID NO: 5032543 - DNA, 15 bp, Homo sapiens
tggcagcctcttcaa

SEQ ID NO: 5032544 - DNA, 16 bp, Homo sapiens
tggcagcctcttcaaa

SEQ ID NO: 5032545 - DNA, 21 bp, Homo sapiens
tggcatggaaatttaaagcag

SEQ ID NO: 5032546 - DNA, 16 bp, Homo sapiens
tggcatggaaggggct

SEQ ID NO: 5032547 - DNA, 14 bp, Homo sapiens
tggcatggccacca

SEQ ID NO: 5032548 - DNA, 17 bp, Homo sapiens
tggcatttggtctcagg

SEQ ID NO: 5032549 - DNA, 21 bp, Homo sapiens
tggcatttggtctcaggcagc

SEQ ID NO: 5032550 - DNA, 22 bp, Homo sapiens
tggcatttggtctcaggcagca

SEQ ID NO: 5032551 - DNA, 20 bp, Homo sapiens
tggccacggccacggccaca

SEQ ID NO: 5032552 - DNA, 18 bp, Homo sapiens
tggccatctgctcctgga

SEQ ID NO: 5032553 - DNA, 15 bp, Homo sapiens
tggccatgcaggagg

SEQ ID NO: 5032554 - DNA, 18 bp, Homo sapiens
tggccatggcctctgcaa

SEQ ID NO: 5032555 - DNA, 19 bp, Homo sapiens
tggccccactttgaagggc

SEQ ID NO: 5032556 - DNA, 15 bp, Homo sapiens
tggccccgcctgcct

SEQ ID NO: 5032557 - DNA, 12 bp, Homo sapiens
tggcccctctga

SEQ ID NO: 5032558 - DNA, 14 bp, Homo sapiens
tggcccctctgacc

SEQ ID NO: 5032559 - DNA, 13 bp, Homo sapiens
tggccgccccctg

SEQ ID NO: 5032560 - DNA, 23 bp, Homo sapiens
tggccgggaccccgagcctggct

SEQ ID NO: 5032561 - DNA, 18 bp, Homo sapiens
tggcctgatgatggtggg

SEQ ID NO: 5032562 - DNA, 18 bp, Homo sapiens
tggctccaaaccctcgag

SEQ ID NO: 5032563 - DNA, 19 bp, Homo sapiens
tggctccttcccatcgctg

SEQ ID NO: 5032564 - DNA, 22 bp, Homo sapiens
tggctctgaggtgcctgtccca

SEQ ID NO: 5032565 - DNA, 21 bp, Homo sapiens
tggctcttgatacccccctct

SEQ ID NO: 5032566 - DNA, 12 bp, Homo sapiens
tggctgaaggac

SEQ ID NO: 5032567 - DNA, 13 bp, Homo sapiens
tggctgaaggact

SEQ ID NO: 5032568 - DNA, 14 bp, Homo sapiens
tggctgaaggactg

SEQ ID NO: 5032569 - DNA, 15 bp, Homo sapiens
tggctgaaggactgt

SEQ ID NO: 5032570 - DNA, 16 bp, Homo sapiens
tggctgatctatgcct

SEQ ID NO: 5032571 - DNA, 23 bp, Homo sapiens
tggctgtggggctaggggctggg

SEQ ID NO: 5032572 - DNA, 20 bp, Homo sapiens
tggctgtgtaaccttgggtg

SEQ ID NO: 5032573 - DNA, 17 bp, Homo sapiens
tggcttaagtgagcaga

SEQ ID NO: 5032574 - DNA, 20 bp, Homo sapiens
tgggaaagcccctgcccctc

SEQ ID NO: 5032575 - DNA, 20 bp, Homo sapiens
tgggaacaccataggtcacc

SEQ ID NO: 5032576 - DNA, 16 bp, Homo sapiens
tgggaaggccagctgc

SEQ ID NO: 5032577 - DNA, 13 bp, Homo sapiens
tgggaatgggaga

SEQ ID NO: 5032578 - DNA, 14 bp, Homo sapiens
tgggaatgggagag

SEQ ID NO: 5032579 - DNA, 23 bp, Homo sapiens
tgggaccctgtccggcccagtgc

SEQ ID NO: 5032580 - DNA, 13 bp, Homo sapiens
tgggactggcctc

SEQ ID NO: 5032581 - DNA, 14 bp, Homo sapiens
tgagcatgtttaga

SEQ ID NO: 5032582 - DNA, 22 bp, Homo sapiens
tgagccagccaggccctgccag

SEQ ID NO: 5032583 - DNA, 17 bp, Homo sapiens
tgagcctagccctggga

SEQ ID NO: 5032584 - DNA, 16 bp, Homo sapiens
tgagccttttccctct

SEQ ID NO: 5032585 - DNA, 14 bp, Homo sapiens
tgagcgccacctct

SEQ ID NO: 5032586 - DNA, 14 bp, Homo sapiens
tgagctgagcaggc

SEQ ID NO: 5032587 - DNA, 20 bp, Homo sapiens
tgagctggatagacttggga

SEQ ID NO: 5032588 - DNA, 17 bp, Homo sapiens
tgagcttaaaatacaag

SEQ ID NO: 5032589 - DNA, 20 bp, Homo sapiens
tgagcttaaaatacaagact

SEQ ID NO: 5032590 - DNA, 16 bp, Homo sapiens
tgaggagccccagcta

SEQ ID NO: 5032591 - DNA, 13 bp, Homo sapiens
tgaggaggaggct

SEQ ID NO: 5032592 - DNA, 16 bp, Homo sapiens
tgaggcaagtgtgggc

SEQ ID NO: 5032593 - DNA, 20 bp, Homo sapiens
tgagggtgcccttttccagc

SEQ ID NO: 5032594 - DNA, 21 bp, Homo sapiens
tgaggtccagccctggctgaa

SEQ ID NO: 5032595 - DNA, 16 bp, Homo sapiens
tgaggtgcctgtccca

SEQ ID NO: 5032596 - DNA, 14 bp, Homo sapiens
tgagtgacagcttt

SEQ ID NO: 5032597 - DNA, 19 bp, Homo sapiens
tgagtgcttgcttttcatg

SEQ ID NO: 5032598 - DNA, 19 bp, Homo sapiens
tgataagttcctttccttt

SEQ ID NO: 5032599 - DNA, 18 bp, Homo sapiens
tgataatcaactgggctg

SEQ ID NO: 5032600 - DNA, 17 bp, Homo sapiens
tgataccagaagggaaa

SEQ ID NO: 5032601 - DNA, 15 bp, Homo sapiens
tgatacccccctctg

SEQ ID NO: 5032602 - DNA, 18 bp, Homo sapiens
tgatacccccctctgtct

SEQ ID NO: 5032603 - DNA, 20 bp, Homo sapiens
tgatacttcgacactgttct

SEQ ID NO: 5032604 - DNA, 20 bp, Homo sapiens
tgatcagttaagaaatttca

SEQ ID NO: 5032605 - DNA, 19 bp, Homo sapiens
tgatccgtccgaggctgct

SEQ ID NO: 5032606 - DNA, 18 bp, Homo sapiens
tgatcttaatatatttga

SEQ ID NO: 5032607 - DNA, 13 bp, Homo sapiens
tgatgaagaggag

SEQ ID NO: 5032608 - DNA, 16 bp, Homo sapiens
tgatgatgatgaaaac

SEQ ID NO: 5032609 - DNA, 21 bp, Homo sapiens
tgatgcagcttatacgaaata

SEQ ID NO: 5032610 - DNA, 21 bp, Homo sapiens
tgatgccaagttgtttgagaa

SEQ ID NO: 5032611 - DNA, 20 bp, Homo sapiens
tgatgcctgtgaactgaact

SEQ ID NO: 5032612 - DNA, 11 bp, Homo sapiens
tgatggagccc

SEQ ID NO: 5032613 - DNA, 16 bp, Homo sapiens
tgatggagtgctgttt

SEQ ID NO: 5032614 - DNA, 16 bp, Homo sapiens
tgatgtccctatggaa

SEQ ID NO: 5032615 - DNA, 19 bp, Homo sapiens
tgattggaatagcttctgg

SEQ ID NO: 5032616 - DNA, 12 bp, Homo sapiens
tgcaaagatttg

SEQ ID NO: 5032617 - DNA, 17 bp, Homo sapiens
tgcaatgtatagtgtct

SEQ ID NO: 5032618 - DNA, 13 bp, Homo sapiens
tgcaatgtgtata

SEQ ID NO: 5032619 - DNA, 13 bp, Homo sapiens
tgcaattcccctc

SEQ ID NO: 5032620 - DNA, 12 bp, Homo sapiens
tgcacacaggac

SEQ ID NO: 5032621 - DNA, 19 bp, Homo sapiens
tgcacaggcacacagggcc

SEQ ID NO: 5032622 - DNA, 22 bp, Homo sapiens
tgcacaggtgccgccagctgcc

SEQ ID NO: 5032623 - DNA, 11 bp, Homo sapiens
tgcaccaaaga

SEQ ID NO: 5032624 - DNA, 12 bp, Homo sapiens
tgcaccaaagac

SEQ ID NO: 5032625 - DNA, 13 bp, Homo sapiens
tgcaccaaagaca

SEQ ID NO: 5032626 - DNA, 17 bp, Homo sapiens
tgcacccacccaggagt

SEQ ID NO: 5032627 - DNA, 18 bp, Homo sapiens
tgcacccacccaggagtg

SEQ ID NO: 5032628 - DNA, 21 bp, Homo sapiens
tgcacccacctgttttctgaa

SEQ ID NO: 5032629 - DNA, 22 bp, Homo sapiens
tgcacttatttatgaacctgcc

SEQ ID NO: 5032630 - DNA, 12 bp, Homo sapiens
tgcactttgctt

SEQ ID NO: 5032631 - DNA, 15 bp, Homo sapiens
tgcagacctcatgcc

SEQ ID NO: 5032632 - DNA, 16 bp, Homo sapiens
tgcagctgctccccag

SEQ ID NO: 5032633 - DNA, 18 bp, Homo sapiens
tgcagctgctccccaggc

SEQ ID NO: 5032634 - DNA, 15 bp, Homo sapiens
tgcagctgttttgtt

SEQ ID NO: 5032635 - DNA, 13 bp, Homo sapiens
tgcagctttaaaa

SEQ ID NO: 5032636 - DNA, 22 bp, Homo sapiens
tgcagctttaaaaaattaatct

SEQ ID NO: 5032637 - DNA, 13 bp, Homo sapiens
tgcaggaggctca

SEQ ID NO: 5032638 - DNA, 14 bp, Homo sapiens
tgcaggaggtggag

SEQ ID NO: 5032639 - DNA, 20 bp, Homo sapiens
tgcaggcagcaggatagagt

SEQ ID NO: 5032640 - DNA, 11 bp, Homo sapiens
tgcagtcccaa

SEQ ID NO: 5032641 - DNA, 22 bp, Homo sapiens
tgcagtcccaagcggtgtctct

SEQ ID NO: 5032642 - DNA, 23 bp, Homo sapiens
tgcagtcccaagcggtgtctctc

SEQ ID NO: 5032643 - DNA, 20 bp, Homo sapiens
tgcagtgtggagttcacctt

SEQ ID NO: 5032644 - DNA, 21 bp, Homo sapiens
tgcagttcccacattaaagaa

SEQ ID NO: 5032645 - DNA, 15 bp, Homo sapiens
tgcattgctggtaga

SEQ ID NO: 5032646 - DNA, 13 bp, Homo sapiens
tgccaaattaaaa

SEQ ID NO: 5032647 - DNA, 22 bp, Homo sapiens
tgccaaattaaaaaagataaac

SEQ ID NO: 5032648 - DNA, 19 bp, Homo sapiens
tgccaagttgtttgagaaa

SEQ ID NO: 5032649 - DNA, 14 bp, Homo sapiens
tgccactgcccccc

SEQ ID NO: 5032650 - DNA, 20 bp, Homo sapiens
tgccaggagcacggctctgt

SEQ ID NO: 5032651 - DNA, 23 bp, Homo sapiens
tgccagtctcactgtgggaaggc

SEQ ID NO: 5032652 - DNA, 13 bp, Homo sapiens
tgccatgctggcc

SEQ ID NO: 5032653 - DNA, 13 bp, Homo sapiens
tgcccagctctct

SEQ ID NO: 5032654 - DNA, 18 bp, Homo sapiens
tgcccagctctctgacgc

SEQ ID NO: 5032655 - DNA, 14 bp, Homo sapiens
tgcccattttgaat

SEQ ID NO: 5032656 - DNA, 18 bp, Homo sapiens
tgccccacatgtggccat

SEQ ID NO: 5032657 - DNA, 19 bp, Homo sapiens
tgccccccgaggctgctag

SEQ ID NO: 5032658 - DNA, 15 bp, Homo sapiens
tatattaatgtactt

SEQ ID NO: 5032659 - DNA, 19 bp, Homo sapiens
tatattattacttgtaaat

SEQ ID NO: 5032660 - DNA, 20 bp, Homo sapiens
tatattattacttgtaaata

SEQ ID NO: 5032661 - DNA, 22 bp, Homo sapiens
tatcatcagtattgaagcattt

SEQ ID NO: 5032662 - DNA, 12 bp, Homo sapiens
tatctctgtgtt

SEQ ID NO: 5032663 - DNA, 18 bp, Homo sapiens
tatctgacatctctgcaa

SEQ ID NO: 5032664 - DNA, 13 bp, Homo sapiens
tatgaacagctgt

SEQ ID NO: 5032665 - DNA, 14 bp, Homo sapiens
tatgaacagctgtg

SEQ ID NO: 5032666 - DNA, 23 bp, Homo sapiens
tatgatacttcgacactgttctt

SEQ ID NO: 5032667 - DNA, 22 bp, Homo sapiens
tatggaagcatattgttattat

SEQ ID NO: 5032668 - DNA, 16 bp, Homo sapiens
tatggatgtccccagc

SEQ ID NO: 5032669 - DNA, 14 bp, Homo sapiens
tatgtactagtgtt

SEQ ID NO: 5032670 - DNA, 20 bp, Homo sapiens
tatgtattgtgcaatgtgta

SEQ ID NO: 5032671 - DNA, 21 bp, Homo sapiens
tatgtattgtgcaatgtgtat

SEQ ID NO: 5032672 - DNA, 15 bp, Homo sapiens
tatgttatatataaa

SEQ ID NO: 5032673 - DNA, 20 bp, Homo sapiens
tatgttccattaaacgattt

SEQ ID NO: 5032674 - DNA, 19 bp, Homo sapiens
tatgtttaatctgttatgt

SEQ ID NO: 5032675 - DNA, 13 bp, Homo sapiens
tattaaagaaaaa

SEQ ID NO: 5032676 - DNA, 19 bp, Homo sapiens
tattaaattttttgttgac

SEQ ID NO: 5032677 - DNA, 16 bp, Homo sapiens
tattaagaatgaaata

SEQ ID NO: 5032678 - DNA, 21 bp, Homo sapiens
tattaatataataatgatgat

SEQ ID NO: 5032679 - DNA, 16 bp, Homo sapiens
tattacggtttgcccc

SEQ ID NO: 5032680 - DNA, 22 bp, Homo sapiens
tattacttgtaaatataaagac

SEQ ID NO: 5032681 - DNA, 17 bp, Homo sapiens
tattagaatcaaacatt

SEQ ID NO: 5032682 - DNA, 16 bp, Homo sapiens
tattagtattgttgtc

SEQ ID NO: 5032683 - DNA, 14 bp, Homo sapiens
tattattacttgta

SEQ ID NO: 5032684 - DNA, 14 bp, Homo sapiens
tattatttgtgttt

SEQ ID NO: 5032685 - DNA, 17 bp, Homo sapiens
tattctacttctctgtt

SEQ ID NO: 5032686 - DNA, 13 bp, Homo sapiens
tattgaagcattt

SEQ ID NO: 5032687 - DNA, 14 bp, Homo sapiens
tattgcgctgctac

SEQ ID NO: 5032688 - DNA, 16 bp, Homo sapiens
tattggggtctgaccc

SEQ ID NO: 5032689 - DNA, 17 bp, Homo sapiens
tattggggtctgacccc

SEQ ID NO: 5032690 - DNA, 18 bp, Homo sapiens
tattgtgcaatgtgtata

SEQ ID NO: 5032691 - DNA, 14 bp, Homo sapiens
tattgttgtccttt

SEQ ID NO: 5032692 - DNA, 18 bp, Homo sapiens
tattgttgtccttttcat

SEQ ID NO: 5032693 - DNA, 13 bp, Homo sapiens
tatttattgcatt

SEQ ID NO: 5032694 - DNA, 16 bp, Homo sapiens
tatttgaaaaaaactt

SEQ ID NO: 5032695 - DNA, 21 bp, Homo sapiens
tatttgaatgatttttcttta

SEQ ID NO: 5032696 - DNA, 15 bp, Homo sapiens
tatttgcatatgtat

SEQ ID NO: 5032697 - DNA, 13 bp, Homo sapiens
tatttttctaact

SEQ ID NO: 5032698 - DNA, 23 bp, Homo sapiens
tatttttgtagtgacctgtttat

SEQ ID NO: 5032699 - DNA, 21 bp, Homo sapiens
tcaaactactttgctgctaat

SEQ ID NO: 5032700 - DNA, 15 bp, Homo sapiens
tcaaagaaattcaga

SEQ ID NO: 5032701 - DNA, 18 bp, Homo sapiens
tcaaagaaattcagaaca

SEQ ID NO: 5032702 - DNA, 23 bp, Homo sapiens
tcaaagcaaatgtcttcctggat

SEQ ID NO: 5032703 - DNA, 16 bp, Homo sapiens
tcaaatccctctccaa

SEQ ID NO: 5032704 - DNA, 14 bp, Homo sapiens
tcaaattgctgctt

SEQ ID NO: 5032705 - DNA, 17 bp, Homo sapiens
tcaaccacctttcagat

SEQ ID NO: 5032706 - DNA, 21 bp, Homo sapiens
tcaactgaaggggtgcaccca

SEQ ID NO: 5032707 - DNA, 21 bp, Homo sapiens
tcaagcagacatagaagagcc

SEQ ID NO: 5032708 - DNA, 22 bp, Homo sapiens
tcaagcagcgaccgccccctcc

SEQ ID NO: 5032709 - DNA, 13 bp, Homo sapiens
tcaatagccacta

SEQ ID NO: 5032710 - DNA, 23 bp, Homo sapiens
tcaatagccactaaccttgcctg

SEQ ID NO: 5032711 - DNA, 15 bp, Homo sapiens
tcaatgaagccagct

SEQ ID NO: 5032712 - DNA, 14 bp, Homo sapiens
tcaatgagcatgtt

SEQ ID NO: 5032713 - DNA, 14 bp, Homo sapiens
tctgtctaggactg

SEQ ID NO: 5032714 - DNA, 20 bp, Homo sapiens
tctgtgagcatcacagtttt

SEQ ID NO: 5032715 - DNA, 12 bp, Homo sapiens
tctgtgcttgga

SEQ ID NO: 5032716 - DNA, 16 bp, Homo sapiens
tctgtgggtctctgga

SEQ ID NO: 5032717 - DNA, 11 bp, Homo sapiens
tctgtgtcttt

SEQ ID NO: 5032718 - DNA, 21 bp, Homo sapiens
tctgtgtctttcacagctcct

SEQ ID NO: 5032719 - DNA, 17 bp, Homo sapiens
tctgttaactgaatacc

SEQ ID NO: 5032720 - DNA, 15 bp, Homo sapiens
tctgttgtaagaata

SEQ ID NO: 5032721 - DNA, 13 bp, Homo sapiens
tctgtttgttatt

SEQ ID NO: 5032722 - DNA, 13 bp, Homo sapiens
tctgttttatgac

SEQ ID NO: 5032723 - DNA, 16 bp, Homo sapiens
tctgttttatgacttc

SEQ ID NO: 5032724 - DNA, 19 bp, Homo sapiens
tctgttttgtttcgctctt

SEQ ID NO: 5032725 - DNA, 14 bp, Homo sapiens
tctgtttttctcat

SEQ ID NO: 5032726 - DNA, 15 bp, Homo sapiens
tcttaaataataaag

SEQ ID NO: 5032727 - DNA, 12 bp, Homo sapiens
tcttaattatta

SEQ ID NO: 5032728 - DNA, 15 bp, Homo sapiens
tcttagctcaatgag

SEQ ID NO: 5032729 - DNA, 12 bp, Homo sapiens
tcttatggatgt

SEQ ID NO: 5032730 - DNA, 17 bp, Homo sapiens
tcttcaaaatgagccct

SEQ ID NO: 5032731 - DNA, 23 bp, Homo sapiens
tcttcacctaagtctctgtgaat

SEQ ID NO: 5032732 - DNA, 19 bp, Homo sapiens
tcttcagttaagcctttgg

SEQ ID NO: 5032733 - DNA, 15 bp, Homo sapiens
tcttcagttgtctct

SEQ ID NO: 5032734 - DNA, 21 bp, Homo sapiens
tcttcagttgtctctgatgca

SEQ ID NO: 5032735 - DNA, 21 bp, Homo sapiens
tcttcatattctaaaaccatt

SEQ ID NO: 5032736 - DNA, 17 bp, Homo sapiens
tcttcctccgaggccag

SEQ ID NO: 5032737 - DNA, 18 bp, Homo sapiens
tcttctacaactcataca

SEQ ID NO: 5032738 - DNA, 23 bp, Homo sapiens
tcttctcagaaggcaaatgactt

SEQ ID NO: 5032739 - DNA, 23 bp, Homo sapiens
tcttctcgtcctcgtttgtgttc

SEQ ID NO: 5032740 - DNA, 21 bp, Homo sapiens
tcttgagccagccaggccctg

SEQ ID NO: 5032741 - DNA, 22 bp, Homo sapiens
tcttgaggggaagctagtcttt

SEQ ID NO: 5032742 - DNA, 21 bp, Homo sapiens
tcttgatacccccctctgtct

SEQ ID NO: 5032743 - DNA, 22 bp, Homo sapiens
tcttgatacccccctctgtctt

SEQ ID NO: 5032744 - DNA, 23 bp, Homo sapiens
tcttgatcagttaagaaatttca

SEQ ID NO: 5032745 - DNA, 15 bp, Homo sapiens
tcttgtattaagaat

SEQ ID NO: 5032746 - DNA, 22 bp, Homo sapiens
tcttgtattaagaatgaaatac

SEQ ID NO: 5032747 - DNA, 18 bp, Homo sapiens
tcttgtgcttttcctgat

SEQ ID NO: 5032748 - DNA, 18 bp, Homo sapiens
tctttaaaaactcactta

SEQ ID NO: 5032749 - DNA, 23 bp, Homo sapiens
tctttaaaagagagagagagaaa

SEQ ID NO: 5032750 - DNA, 23 bp, Homo sapiens
tctttaactcccattaccatgta

SEQ ID NO: 5032751 - DNA, 16 bp, Homo sapiens
tctttccatttgcatt

SEQ ID NO: 5032752 - DNA, 17 bp, Homo sapiens
tctttccatttgcattt

SEQ ID NO: 5032753 - DNA, 20 bp, Homo sapiens
tctttctgtgcttggatttg

SEQ ID NO: 5032754 - DNA, 16 bp, Homo sapiens
tctttgcaccaaagac

SEQ ID NO: 5032755 - DNA, 18 bp, Homo sapiens
tctttgcaccaaagacat

SEQ ID NO: 5032756 - DNA, 19 bp, Homo sapiens
tctttgcaccaaagacatc

SEQ ID NO: 5032757 - DNA, 19 bp, Homo sapiens
tcttttcccatttatctaa

SEQ ID NO: 5032758 - DNA, 17 bp, Homo sapiens
tcttttttaataaacta

SEQ ID NO: 5032759 - DNA, 22 bp, Homo sapiens
tgaaaaaaaacctgagatttat

SEQ ID NO: 5032760 - DNA, 13 bp, Homo sapiens
tgaaaagttggaa

SEQ ID NO: 5032761 - DNA, 21 bp, Homo sapiens
tgaaaagttggaaggatctgc

SEQ ID NO: 5032762 - DNA, 22 bp, Homo sapiens
tgaaaagttggaaggatctgct

SEQ ID NO: 5032763 - DNA, 13 bp, Homo sapiens
tgaaaatgctggc

SEQ ID NO: 5032764 - DNA, 17 bp, Homo sapiens
tgaaacacacgagcaaa

SEQ ID NO: 5032765 - DNA, 16 bp, Homo sapiens
tgaaagtctgtccttg

SEQ ID NO: 5032766 - DNA, 17 bp, Homo sapiens
tgaaagtctgtccttga

SEQ ID NO: 5032767 - DNA, 21 bp, Homo sapiens
tgaaataccaacctgaagaca

SEQ ID NO: 5032768 - DNA, 13 bp, Homo sapiens
tgaaatagtgtct

SEQ ID NO: 5032769 - DNA, 17 bp, Homo sapiens
tgaaatcagttactctt

SEQ ID NO: 5032770 - DNA, 19 bp, Homo sapiens
tgaaatgaggtctgtttaa

SEQ ID NO: 5032771 - DNA, 12 bp, Homo sapiens
tgaaatgtaagg

SEQ ID NO: 5032772 - DNA, 14 bp, Homo sapiens
tgaacaagagaagc

SEQ ID NO: 5032773 - DNA, 19 bp, Homo sapiens
tgaacactccaattaagga

SEQ ID NO: 5032774 - DNA, 22 bp, Homo sapiens
tgaacactccaattaaggattt

SEQ ID NO: 5032775 - DNA, 13 bp, Homo sapiens
tgaacagctgtgt

SEQ ID NO: 5032776 - DNA, 23 bp, Homo sapiens
tgaagagtaatcaatctactcaa

SEQ ID NO: 5032777 - DNA, 13 bp, Homo sapiens
tgaagcaggaggc

SEQ ID NO: 5032778 - DNA, 20 bp, Homo sapiens
tgaaggactaatagaaaagt

SEQ ID NO: 5032779 - DNA, 14 bp, Homo sapiens
tgaagggtcctgcc

SEQ ID NO: 5032780 - DNA, 13 bp, Homo sapiens
tgaagtgaaactg

SEQ ID NO: 5032781 - DNA, 18 bp, Homo sapiens
tgaataccactctgtaat

SEQ ID NO: 5032782 - DNA, 20 bp, Homo sapiens
tgaataccactctgtaattg

SEQ ID NO: 5032783 - DNA, 13 bp, Homo sapiens
tgaatactgtgaa

SEQ ID NO: 5032784 - DNA, 19 bp, Homo sapiens
tgaatgatttttctttaca

SEQ ID NO: 5032785 - DNA, 14 bp, Homo sapiens
ttggcaattttgtg

SEQ ID NO: 5032786 - DNA, 17 bp, Homo sapiens
ttggccccactttgaag

SEQ ID NO: 5032787 - DNA, 22 bp, Homo sapiens
ttgggaacagcatggaggcaga

SEQ ID NO: 5032788 - DNA, 13 bp, Homo sapiens
ttggggccctgcc

SEQ ID NO: 5032789 - DNA, 14 bp, Homo sapiens
ttggggtctgaccc

SEQ ID NO: 5032790 - DNA, 15 bp, Homo sapiens
ttggggtctgacccc

SEQ ID NO: 5032791 - DNA, 20 bp, Homo sapiens
ttggtaaaaatgctgctctc

SEQ ID NO: 5032792 - DNA, 16 bp, Homo sapiens
ttggtgcacagcacaa

SEQ ID NO: 5032793 - DNA, 17 bp, Homo sapiens
ttggtgtttgtctgtgt

SEQ ID NO: 5032794 - DNA, 16 bp, Homo sapiens
ttgtaaatataaagac

SEQ ID NO: 5032795 - DNA, 12 bp, Homo sapiens
ttgtaaattggc

SEQ ID NO: 5032796 - DNA, 13 bp, Homo sapiens
ttgtaaattggca

SEQ ID NO: 5032797 - DNA, 14 bp, Homo sapiens
ttgtaaattggcat

SEQ ID NO: 5032798 - DNA, 15 bp, Homo sapiens
ttgtaattttacacg

SEQ ID NO: 5032799 - DNA, 21 bp, Homo sapiens
ttttacatgaagctgtataat

SEQ ID NO: 5032800 - DNA, 16 bp, Homo sapiens
ttttacatttcataca

SEQ ID NO: 5032801 - DNA, 12 bp, Homo sapiens
ttttaccaaagc

SEQ ID NO: 5032802 - DNA, 13 bp, Homo sapiens
ttttaccaaagca

SEQ ID NO: 5032803 - DNA, 16 bp, Homo sapiens
ttttaccaaagcatca

SEQ ID NO: 5032804 - DNA, 20 bp, Homo sapiens
ttttataaatcgcttttgat

SEQ ID NO: 5032805 - DNA, 20 bp, Homo sapiens
ttttatgacttcattaataa

SEQ ID NO: 5032806 - DNA, 18 bp, Homo sapiens
ttttatgctttaaacatt

SEQ ID NO: 5032807 - DNA, 15 bp, Homo sapiens
ttttattagtattgt

SEQ ID NO: 5032808 - DNA, 20 bp, Homo sapiens
ttttcaaacaaagatgccac

SEQ ID NO: 5032809 - DNA, 14 bp, Homo sapiens
ttttcaagaaatga

SEQ ID NO: 5032810 - DNA, 20 bp, Homo sapiens
ttttcatccataactgaaca

SEQ ID NO: 5032811 - DNA, 16 bp, Homo sapiens
ttttcatcttcagttg

SEQ ID NO: 5032812 - DNA, 22 bp, Homo sapiens
ttttcccatttatctaaatatg

SEQ ID NO: 5032813 - DNA, 16 bp, Homo sapiens
ttttcctcctgagtgc

SEQ ID NO: 5032814 - DNA, 13 bp, Homo sapiens
ttttccttttcac

SEQ ID NO: 5032815 - DNA, 21 bp, Homo sapiens
ttttctagcccgaatacaaac

SEQ ID NO: 5032816 - DNA, 16 bp, Homo sapiens
ttttcttaaagtgcca

SEQ ID NO: 5032817 - DNA, 18 bp, Homo sapiens
ttttcttaaagtgccagt

SEQ ID NO: 5032818 - DNA, 17 bp, Homo sapiens
ttttgaaagtctgtcct

SEQ ID NO: 5032819 - DNA, 18 bp, Homo sapiens
ttttgacttaatgtgatt

SEQ ID NO: 5032820 - DNA, 15 bp, Homo sapiens
ttttgaggagcccca

SEQ ID NO: 5032821 - DNA, 17 bp, Homo sapiens
ttttgcccattttgaat

SEQ ID NO: 5032822 - DNA, 21 bp, Homo sapiens
ttttgtgtctcttatggatgt

SEQ ID NO: 5032823 - DNA, 16 bp, Homo sapiens
ttttgttagcaaagat

SEQ ID NO: 5032824 - DNA, 18 bp, Homo sapiens
ttttgttgacattctgaa

SEQ ID NO: 5032825 - DNA, 13 bp, Homo sapiens
ttttgttgtgtgt

SEQ ID NO: 5032826 - DNA, 13 bp, Homo sapiens
ttttgttttacaa

SEQ ID NO: 5032827 - DNA, 16 bp, Homo sapiens
ttttgttttacaatgt

SEQ ID NO: 5032828 - DNA, 13 bp, Homo sapiens
tttttaaactgta

SEQ ID NO: 5032829 - DNA, 19 bp, Homo sapiens
tttttaaactgtacagtgt

SEQ ID NO: 5032830 - DNA, 18 bp, Homo sapiens
tttttaagccttaaagga

SEQ ID NO: 5032831 - DNA, 19 bp, Homo sapiens
tttttacagctgtgttatt

SEQ ID NO: 5032832 - DNA, 16 bp, Homo sapiens
tttttatgtgatcaat

SEQ ID NO: 5032833 - DNA, 17 bp, Homo sapiens
tttttattagtattgtt

SEQ ID NO: 5032834 - DNA, 16 bp, Homo sapiens
tttttcatcttcagtt

SEQ ID NO: 5032835 - DNA, 21 bp, Homo sapiens
tttttccacataaggaaactg

SEQ ID NO: 5032836 - DNA, 13 bp, Homo sapiens
tttttctaaagga

SEQ ID NO: 5032837 - DNA, 12 bp, Homo sapiens
tttttctttaca

SEQ ID NO: 5032838 - DNA, 21 bp, Homo sapiens
ttttttggccatctgctcctg

SEQ ID NO: 5032839 - DNA, 12 bp, Homo sapiens
ttttttgtatag

SEQ ID NO: 5032840 - DNA, 13 bp, Homo sapiens
tttttttgtttgt

SEQ ID NO: 5032841 - DNA, 16 bp, Homo sapiens
tagacttggattcttt

SEQ ID NO: 5032842 - DNA, 13 bp, Homo sapiens
tagagtttctgtt

SEQ ID NO: 5032843 - DNA, 15 bp, Homo sapiens
tagatagccctgtcc

SEQ ID NO: 5032844 - DNA, 17 bp, Homo sapiens
tagatagccctgtcctg

SEQ ID NO: 5032845 - DNA, 20 bp, Homo sapiens
tagataggaagaaagaagac

SEQ ID NO: 5032846 - DNA, 21 bp, Homo sapiens
tagcaaagattaaatgtgtca

SEQ ID NO: 5032847 - DNA, 18 bp, Homo sapiens
tagcacacacttttggtt

SEQ ID NO: 5032848 - DNA, 22 bp, Homo sapiens
tagcagcggaacaaggagtcag

SEQ ID NO: 5032849 - DNA, 20 bp, Homo sapiens
tagcagctttgtctctgtca

SEQ ID NO: 5032850 - DNA, 21 bp, Homo sapiens
tagcattgtagtgctttgaga

SEQ ID NO: 5032851 - DNA, 15 bp, Homo sapiens
tagcccgaatacaaa

SEQ ID NO: 5032852 - DNA, 16 bp, Homo sapiens
tagcccgaatacaaac

SEQ ID NO: 5032853 - DNA, 14 bp, Homo sapiens
tagccctgtcctgg

SEQ ID NO: 5032854 - DNA, 13 bp, Homo sapiens
tagcgttcttgta

SEQ ID NO: 5032855 - DNA, 16 bp, Homo sapiens
tagcgttcttgtaatt

SEQ ID NO: 5032856 - DNA, 13 bp, Homo sapiens
tagctcaatgagc

SEQ ID NO: 5032857 - DNA, 15 bp, Homo sapiens
tagctcaatgagcat

SEQ ID NO: 5032858 - DNA, 21 bp, Homo sapiens
tagctcaatgagcatgtttag

SEQ ID NO: 5032859 - DNA, 15 bp, Homo sapiens
tagctgaatgttttt

SEQ ID NO: 5032860 - DNA, 19 bp, Homo sapiens
tagctgaatgtttttctaa

SEQ ID NO: 5032861 - DNA, 21 bp, Homo sapiens
taggaagagcccgcagggcca

SEQ ID NO: 5032862 - DNA, 21 bp, Homo sapiens
taggcatgtcccacccacccg

SEQ ID NO: 5032863 - DNA, 16 bp, Homo sapiens
taggcattaacacaaa

SEQ ID NO: 5032864 - DNA, 17 bp, Homo sapiens
taggccgttccttcaaa

SEQ ID NO: 5032865 - DNA, 19 bp, Homo sapiens
taggctgacacctaactct

SEQ ID NO: 5032866 - DNA, 13 bp, Homo sapiens
tagggaacaattt

SEQ ID NO: 5032867 - DNA, 18 bp, Homo sapiens
tagggacctcagaggttt

SEQ ID NO: 5032868 - DNA, 21 bp, Homo sapiens
taggggctggggccaaataaa

SEQ ID NO: 5032869 - DNA, 19 bp, Homo sapiens
taggtctgaaatttttctt

SEQ ID NO: 5032870 - DNA, 22 bp, Homo sapiens
taggtctgaaatttttcttctt

SEQ ID NO: 5032871 - DNA, 20 bp, Homo sapiens
taggtggctctgggaatggg

SEQ ID NO: 5032872 - DNA, 22 bp, Homo sapiens
taggtgttaggcatgtcccacc

SEQ ID NO: 5032873 - DNA, 14 bp, Homo sapiens
tagtagtttttaca

SEQ ID NO: 5032874 - DNA, 16 bp, Homo sapiens
tagtattgttgtcctt

SEQ ID NO: 5032875 - DNA, 15 bp, Homo sapiens
tagtcatgtttatct

SEQ ID NO: 5032876 - DNA, 15 bp, Homo sapiens
tagtctcagtgaaga

SEQ ID NO: 5032877 - DNA, 22 bp, Homo sapiens
tagtctcagtttgtgtgtctta

SEQ ID NO: 5032878 - DNA, 22 bp, Homo sapiens
tagttagctaataaaaagcttt

SEQ ID NO: 5032879 - DNA, 17 bp, Homo sapiens
tagttgtctttcctggc

SEQ ID NO: 5032880 - DNA, 22 bp, Homo sapiens
tagttttcatccataactgaac

SEQ ID NO: 5032881 - DNA, 14 bp, Homo sapiens
tagttttttcatct

SEQ ID NO: 5032882 - DNA, 21 bp, Homo sapiens
tagttttttcatcttcagttg

SEQ ID NO: 5032883 - DNA, 17 bp, Homo sapiens
tataaagacgttttata

SEQ ID NO: 5032884 - DNA, 17 bp, Homo sapiens
tataaagagaagacgaa

SEQ ID NO: 5032885 - DNA, 16 bp, Homo sapiens
tataagcatcattatt

SEQ ID NO: 5032886 - DNA, 17 bp, Homo sapiens
tataagcatcattattt

SEQ ID NO: 5032887 - DNA, 21 bp, Homo sapiens
tataagcatcattatttatgt

SEQ ID NO: 5032888 - DNA, 18 bp, Homo sapiens
tataattacatatttgca

SEQ ID NO: 5032889 - DNA, 15 bp, Homo sapiens
tatacccagtgagga

SEQ ID NO: 5032890 - DNA, 17 bp, Homo sapiens
tatacgaaataattgtt

SEQ ID NO: 5032891 - DNA, 18 bp, Homo sapiens
tatagatgtcttttccca

SEQ ID NO: 5032892 - DNA, 16 bp, Homo sapiens
tatagttaacacacta

SEQ ID NO: 5032893 - DNA, 18 bp, Homo sapiens
tatagttaacacactacc

SEQ ID NO: 5032894 - DNA, 18 bp, Homo sapiens
tatataaatggttaaaag

SEQ ID NO: 5032895 - DNA, 16 bp, Homo sapiens
gtcgttttttttttgt

SEQ ID NO: 5032896 - DNA, 21 bp, Homo sapiens
gtcgttttttttttgtttgtt

SEQ ID NO: 5032897 - DNA, 20 bp, Homo sapiens
gtctaggactgcagtgtgga

SEQ ID NO: 5032898 - DNA, 20 bp, Homo sapiens
gtctataaagcatttaaccc

SEQ ID NO: 5032899 - DNA, 18 bp, Homo sapiens
gtctatgtcgagagctgg

SEQ ID NO: 5032900 - DNA, 22 bp, Homo sapiens
gtctatgtcgagagctggccaa

SEQ ID NO: 5032901 - DNA, 19 bp, Homo sapiens
gtctcaggcagcaccacac

SEQ ID NO: 5032902 - DNA, 22 bp, Homo sapiens
gtctcagtgtcctcatctgtaa

SEQ ID NO: 5032903 - DNA, 16 bp, Homo sapiens
gtctccctcccctctc

SEQ ID NO: 5032904 - DNA, 18 bp, Homo sapiens
gtctccctcccctctcag

SEQ ID NO: 5032905 - DNA, 20 bp, Homo sapiens
gtctccctcccctctcagaa

SEQ ID NO: 5032906 - DNA, 22 bp, Homo sapiens
gtctccctcccctctcagaaca

SEQ ID NO: 5032907 - DNA, 15 bp, Homo sapiens
gtctctctgggctgc

SEQ ID NO: 5032908 - DNA, 15 bp, Homo sapiens
gtctctgaagtgaaa

SEQ ID NO: 5032909 - DNA, 15 bp, Homo sapiens
gtctctgatgcagct

SEQ ID NO: 5032910 - DNA, 15 bp, Homo sapiens
gtctcttatggatgt

SEQ ID NO: 5032911 - DNA, 14 bp, Homo sapiens
gtctgccaaacaca

SEQ ID NO: 5032912 - DNA, 16 bp, Homo sapiens
gtctgctctggtggct

SEQ ID NO: 5032913 - DNA, 12 bp, Homo sapiens
gtctggaccccg

SEQ ID NO: 5032914 - DNA, 23 bp, Homo sapiens
gtctgtctccctcccctctcaga

SEQ ID NO: 5032915 - DNA, 24 bp, Homo sapiens
gtctgtctccctcccctctcagaa

SEQ ID NO: 5032916 - DNA, 13 bp, Homo sapiens
gtctgtgaagagc

SEQ ID NO: 5032917 - DNA, 17 bp, Homo sapiens
gtctgtttaaagtggca

SEQ ID NO: 5032918 - DNA, 13 bp, Homo sapiens
gtcttaattatta

SEQ ID NO: 5032919 - DNA, 19 bp, Homo sapiens
gtcttaattattatttgtg

SEQ ID NO: 5032920 - DNA, 15 bp, Homo sapiens
gtctttcacagctcc

SEQ ID NO: 5032921 - DNA, 16 bp, Homo sapiens
gtctttcacagctcct

SEQ ID NO: 5032922 - DNA, 14 bp, Homo sapiens
gtcttttgcttttg

SEQ ID NO: 5032923 - DNA, 16 bp, Homo sapiens
gtctttttttgtatag

SEQ ID NO: 5032924 - DNA, 22 bp, Homo sapiens
gtctttttttgtatagttaaca

SEQ ID NO: 5032925 - DNA, 20 bp, Homo sapiens
gtgaaactgcttgtttccta

SEQ ID NO: 5032926 - DNA, 23 bp, Homo sapiens
gtgaaactgcttgtttcctagca

SEQ ID NO: 5032927 - DNA, 14 bp, Homo sapiens
gtgaacattcccag

SEQ ID NO: 5032928 - DNA, 15 bp, Homo sapiens
gtgaacattcccagc

SEQ ID NO: 5032929 - DNA, 17 bp, Homo sapiens
gtgaatcgcagctgtgg

SEQ ID NO: 5032930 - DNA, 12 bp, Homo sapiens
gtgacaaaccat

SEQ ID NO: 5032931 - DNA, 13 bp, Homo sapiens
gtgacagctttct

SEQ ID NO: 5032932 - DNA, 14 bp, Homo sapiens
gtgacaggcagcag

SEQ ID NO: 5032933 - DNA, 16 bp, Homo sapiens
gtgacctcagctttga

SEQ ID NO: 5032934 - DNA, 20 bp, Homo sapiens
gtgactcgagtcacactcaa

SEQ ID NO: 5032935 - DNA, 14 bp, Homo sapiens
gtgactgtgctgtg

SEQ ID NO: 5032936 - DNA, 12 bp, Homo sapiens
gtgagcagaaca

SEQ ID NO: 5032937 - DNA, 14 bp, Homo sapiens
gtgagcagaacagg

SEQ ID NO: 5032938 - DNA, 20 bp, Homo sapiens
gtgaggattccaaaaacatt

SEQ ID NO: 5032939 - DNA, 16 bp, Homo sapiens
gtgatggagtgctgtt

SEQ ID NO: 5032940 - DNA, 18 bp, Homo sapiens
gtgatggagtgctgtttt

SEQ ID NO: 5032941 - DNA, 14 bp, Homo sapiens
gtgcaacagacaag

SEQ ID NO: 5032942 - DNA, 23 bp, Homo sapiens
gtgcaatgtgtataaacaagaaa

SEQ ID NO: 5032943 - DNA, 13 bp, Homo sapiens
gtgcacccacctg

SEQ ID NO: 5032944 - DNA, 20 bp, Homo sapiens
gtgcagggagggcagttttc

SEQ ID NO: 5032945 - DNA, 16 bp, Homo sapiens
gtgccagtattttaaa

SEQ ID NO: 5032946 - DNA, 18 bp, Homo sapiens
gtgcccccgcctgccacc

SEQ ID NO: 5032947 - DNA, 16 bp, Homo sapiens
gtgcccgcaggaactg

SEQ ID NO: 5032948 - DNA, 19 bp, Homo sapiens
gtgcccttttccagcctca

SEQ ID NO: 5032949 - DNA, 15 bp, Homo sapiens
gtgcctcttccagtg

SEQ ID NO: 5032950 - DNA, 20 bp, Homo sapiens
gtgcctgtcccacccccacc

SEQ ID NO: 5032951 - DNA, 12 bp, Homo sapiens
gtgcgcccgtgg

SEQ ID NO: 5032952 - DNA, 16 bp, Homo sapiens
gtgcgtctccagtcat

SEQ ID NO: 5032953 - DNA, 19 bp, Homo sapiens
gtgcgtgttcagcagaacc

SEQ ID NO: 5032954 - DNA, 15 bp, Homo sapiens
gtgctctttgttttg

SEQ ID NO: 5032955 - DNA, 19 bp, Homo sapiens
gtggagcagcagccactgc

SEQ ID NO: 5032956 - DNA, 20 bp, Homo sapiens
gtggagttcaccttggaagg

SEQ ID NO: 5032957 - DNA, 13 bp, Homo sapiens
gtggcatggccac

SEQ ID NO: 5032958 - DNA, 21 bp, Homo sapiens
gtggcatttcaattcctggcc

SEQ ID NO: 5032959 - DNA, 19 bp, Homo sapiens
gtggccatggcctctgcaa

SEQ ID NO: 5032960 - DNA, 18 bp, Homo sapiens
gtggccgaaccagaacca

SEQ ID NO: 5032961 - DNA, 18 bp, Homo sapiens
gtggccgcacgcctctcc

SEQ ID NO: 5032962 - DNA, 13 bp, Homo sapiens
gtggctccttccc

SEQ ID NO: 5032963 - DNA, 23 bp, Homo sapiens
gtggctctgggaatgggagaggg

SEQ ID NO: 5032964 - DNA, 22 bp, Homo sapiens
gtggcttaagtgagcagaacag

SEQ ID NO: 5032965 - DNA, 13 bp, Homo sapiens
gtgggaaggccag

SEQ ID NO: 5032966 - DNA, 22 bp, Homo sapiens
gtgggacagttcctgagaccag

SEQ ID NO: 5032967 - DNA, 13 bp, Homo sapiens
taaactttcacac

SEQ ID NO: 5032968 - DNA, 9 bp, Homo sapiens
taaagaaaa

SEQ ID NO: 5032969 - DNA, 12 bp, Homo sapiens
taaagaaaaaaa

SEQ ID NO: 5032970 - DNA, 23 bp, Homo sapiens
taaagaaaaaaatgtattttatg

SEQ ID NO: 5032971 - DNA, 17 bp, Homo sapiens
taaagaaaaaaattgaa

SEQ ID NO: 5032972 - DNA, 21 bp, Homo sapiens
taaagaaaaaaattgaaatgt

SEQ ID NO: 5032973 - DNA, 22 bp, Homo sapiens
taaagaaaaaaattgaaatgta

SEQ ID NO: 5032974 - DNA, 14 bp, Homo sapiens
taaagaaaagatgc

SEQ ID NO: 5032975 - DNA, 11 bp, Homo sapiens
taaagaagacc

SEQ ID NO: 5032976 - DNA, 20 bp, Homo sapiens
taaagaagacctgagaatgt

SEQ ID NO: 5032977 - DNA, 17 bp, Homo sapiens
taaagacgatttgtcag

SEQ ID NO: 5032978 - DNA, 17 bp, Homo sapiens
taaagcaggttcttgtt

SEQ ID NO: 5032979 - DNA, 16 bp, Homo sapiens
taaaggagtttatgtt

SEQ ID NO: 5032980 - DNA, 14 bp, Homo sapiens
taaatataaagacg

SEQ ID NO: 5032981 - DNA, 23 bp, Homo sapiens
taaatataaagacgttttataag

SEQ ID NO: 5032982 - DNA, 14 bp, Homo sapiens
taaatatattatta

SEQ ID NO: 5032983 - DNA, 17 bp, Homo sapiens
taaatatattattactt

SEQ ID NO: 5032984 - DNA, 18 bp, Homo sapiens
taaatatattattacttg

SEQ ID NO: 5032985 - DNA, 21 bp, Homo sapiens
taaatatattattacttgtaa

SEQ ID NO: 5032986 - DNA, 23 bp, Homo sapiens
taaatatattattacttgtaaat

SEQ ID NO: 5032987 - DNA, 17 bp, Homo sapiens
taaatatggactgctca

SEQ ID NO: 5032988 - DNA, 19 bp, Homo sapiens
taaatatggactgctcagg

SEQ ID NO: 5032989 - DNA, 14 bp, Homo sapiens
taaatgtgtacaat

SEQ ID NO: 5032990 - DNA, 21 bp, Homo sapiens
taaattacagtaatcccattt

SEQ ID NO: 5032991 - DNA, 17 bp, Homo sapiens
taaattggcatggaaat

SEQ ID NO: 5032992 - DNA, 21 bp, Homo sapiens
taaattggcatggaaatttaa

SEQ ID NO: 5032993 - DNA, 18 bp, Homo sapiens
taaattttttgttgacat

SEQ ID NO: 5032994 - DNA, 21 bp, Homo sapiens
taacacactaccgaatgtgtc

SEQ ID NO: 5032995 - DNA, 23 bp, Homo sapiens
taacacactaccgaatgtgtctt

SEQ ID NO: 5032996 - DNA, 14 bp, Homo sapiens
taacacagtgtctg

SEQ ID NO: 5032997 - DNA, 15 bp, Homo sapiens
taacataagctattt

SEQ ID NO: 5032998 - DNA, 17 bp, Homo sapiens
taaccaattcctcattt

SEQ ID NO: 5032999 - DNA, 16 bp, Homo sapiens
taacccccctgtacac

SEQ ID NO: 5033000 - DNA, 14 bp, Homo sapiens
taacctttacatga

SEQ ID NO: 5033001 - DNA, 22 bp, Homo sapiens
taactcttctttcatttcttct

SEQ ID NO: 5033002 - DNA, 14 bp, Homo sapiens
taactgaataccac

SEQ ID NO: 5033003 - DNA, 15 bp, Homo sapiens
taactgaataccact

SEQ ID NO: 5033004 - DNA, 18 bp, Homo sapiens
taactgaataccactctg

SEQ ID NO: 5033005 - DNA, 14 bp, Homo sapiens
taactgcattttac

SEQ ID NO: 5033006 - DNA, 16 bp, Homo sapiens
taactgttatttataa

SEQ ID NO: 5033007 - DNA, 14 bp, Homo sapiens
taagaaatttcaca

SEQ ID NO: 5033008 - DNA, 15 bp, Homo sapiens
taagaatgaaatact

SEQ ID NO: 5033009 - DNA, 21 bp, Homo sapiens
taagaatgaaatactgtttga

SEQ ID NO: 5033010 - DNA, 17 bp, Homo sapiens
taagagcttgctccaga

SEQ ID NO: 5033011 - DNA, 18 bp, Homo sapiens
taagcactttaacacagt

SEQ ID NO: 5033012 - DNA, 14 bp, Homo sapiens
taagcatcattatt

SEQ ID NO: 5033013 - DNA, 14 bp, Homo sapiens
taagcctttggaaa

SEQ ID NO: 5033014 - DNA, 21 bp, Homo sapiens
taagcctttggaaacagctcg

SEQ ID NO: 5033015 - DNA, 17 bp, Homo sapiens
taagctatttttctaac

SEQ ID NO: 5033016 - DNA, 17 bp, Homo sapiens
gtattgaagcattttat

SEQ ID NO: 5033017 - DNA, 14 bp, Homo sapiens
gtattgtgcaatgt

SEQ ID NO: 5033018 - DNA, 19 bp, Homo sapiens
gtattgtgcaatgtgtata

SEQ ID NO: 5033019 - DNA, 23 bp, Homo sapiens
gtattgtgcaatgtgtataaaca

SEQ ID NO: 5033020 - DNA, 20 bp, Homo sapiens
gtattgttgtccttttcata

SEQ ID NO: 5033021 - DNA, 21 bp, Homo sapiens
gtattgttgtccttttcatag

SEQ ID NO: 5033022 - DNA, 23 bp, Homo sapiens
gtatttgtttgcataggtgatct

SEQ ID NO: 5033023 - DNA, 16 bp, Homo sapiens
gtattttatgttatat

SEQ ID NO: 5033024 - DNA, 13 bp, Homo sapiens
gtcaagcccagaa

SEQ ID NO: 5033025 - DNA, 16 bp, Homo sapiens
gtcacctagcaagctg

SEQ ID NO: 5033026 - DNA, 16 bp, Homo sapiens
gtcactccaccatccc

SEQ ID NO: 5033027 - DNA, 21 bp, Homo sapiens
gtcactccaccatccccaccc

SEQ ID NO: 5033028 - DNA, 17 bp, Homo sapiens
gtcactttgttttactg

SEQ ID NO: 5033029 - DNA, 18 bp, Homo sapiens
gtcaggagtgtgtgtgag

SEQ ID NO: 5033030 - DNA, 17 bp, Homo sapiens
gtcatctgattggacag

SEQ ID NO: 5033031 - DNA, 19 bp, Homo sapiens
gtcatctgattggacaggc

SEQ ID NO: 5033032 - DNA, 14 bp, Homo sapiens
gtcatgtttatctg

SEQ ID NO: 5033033 - DNA, 13 bp, Homo sapiens
gtcatttaaatgt

SEQ ID NO: 5033034 - DNA, 15 bp, Homo sapiens
gtcatttaaatgtgt

SEQ ID NO: 5033035 - DNA, 23 bp, Homo sapiens
gtccaatgtacaggaagtagttc

SEQ ID NO: 5033036 - DNA, 11 bp, Homo sapiens
gtccaccctgc

SEQ ID NO: 5033037 - DNA, 16 bp, Homo sapiens
gtccagccctggctga

SEQ ID NO: 5033038 - DNA, 17 bp, Homo sapiens
gtccagccctggctgaa

SEQ ID NO: 5033039 - DNA, 18 bp, Homo sapiens
gtccagctcccgctgtgg

SEQ ID NO: 5033040 - DNA, 15 bp, Homo sapiens
gtccaggccctgtgg

SEQ ID NO: 5033041 - DNA, 15 bp, Homo sapiens
gtcccacccccaccc

SEQ ID NO: 5033042 - DNA, 21 bp, Homo sapiens
gtcccacccccacccccagct

SEQ ID NO: 5033043 - DNA, 17 bp, Homo sapiens
gtcccagcagctgccag

SEQ ID NO: 5033044 - DNA, 13 bp, Homo sapiens
gtcccatgtggtg

SEQ ID NO: 5033045 - DNA, 19 bp, Homo sapiens
gtccctgggagggacatgc

SEQ ID NO: 5033046 - DNA, 22 bp, Homo sapiens
gtccgctgggtggtaccctctg

SEQ ID NO: 5033047 - DNA, 14 bp, Homo sapiens
gtcctcgtttgtgt

SEQ ID NO: 5033048 - DNA, 18 bp, Homo sapiens
gtcctcgtttgtgttctg

SEQ ID NO: 5033049 - DNA, 18 bp, Homo sapiens
gtcctctctctgtggggc

SEQ ID NO: 5033050 - DNA, 13 bp, Homo sapiens
gtcctgccggtgg

SEQ ID NO: 5033051 - DNA, 21 bp, Homo sapiens
gtcctggaagcgcgagggcct

SEQ ID NO: 5033052 - DNA, 20 bp, Homo sapiens
gtcctggtggtattttcaat

SEQ ID NO: 5033053 - DNA, 14 bp, Homo sapiens
gtcgggcaccagcc

SEQ ID NO: 5033054 - DNA, 14 bp, Homo sapiens
gtcgtgggatggca

SEQ ID NO: 5033055 - DNA, 21 bp, Homo sapiens
ggaccactgggtgagagagga

SEQ ID NO: 5033056 - DNA, 18 bp, Homo sapiens
ggacccagcgggcaggtt

SEQ ID NO: 5033057 - DNA, 16 bp, Homo sapiens
ggacctagggtggcct

SEQ ID NO: 5033058 - DNA, 21 bp, Homo sapiens
ggacgtgttacccactgccat

SEQ ID NO: 5033059 - DNA, 18 bp, Homo sapiens
ggactggcctctgctgat

SEQ ID NO: 5033060 - DNA, 19 bp, Homo sapiens
ggactgtgacaggcagcag

SEQ ID NO: 5033061 - DNA, 20 bp, Homo sapiens
ggactgtgacaggcagcaga

SEQ ID NO: 5033062 - DNA, 23 bp, Homo sapiens
ggagaaaattggaactctactca

SEQ ID NO: 5033063 - DNA, 14 bp, Homo sapiens
ggagaagggctggg

SEQ ID NO: 5033064 - DNA, 18 bp, Homo sapiens
ggagaagggctggggccg

SEQ ID NO: 5033065 - DNA, 16 bp, Homo sapiens
ggagactcctggtctg

SEQ ID NO: 5033066 - DNA, 17 bp, Homo sapiens
ggagactcctggtctgt

SEQ ID NO: 5033067 - DNA, 20 bp, Homo sapiens
ggagccccaccttgtctgct

SEQ ID NO: 5033068 - DNA, 18 bp, Homo sapiens
ggagccccagctaccctt

SEQ ID NO: 5033069 - DNA, 16 bp, Homo sapiens
ggagcccgtctcagtg

SEQ ID NO: 5033070 - DNA, 13 bp, Homo sapiens
ggagcggggggga

SEQ ID NO: 5033071 - DNA, 17 bp, Homo sapiens
ggaggcatcatggaaag

SEQ ID NO: 5033072 - DNA, 22 bp, Homo sapiens
ggaggccaagcagtgcctgcct

SEQ ID NO: 5033073 - DNA, 21 bp, Homo sapiens
ggaggcccttgtcgtgggatg

SEQ ID NO: 5033074 - DNA, 18 bp, Homo sapiens
ggaggcgtctcgggagag

SEQ ID NO: 5033075 - DNA, 10 bp, Homo sapiens
ggaggctgcg

SEQ ID NO: 5033076 - DNA, 21 bp, Homo sapiens
ggagggagttttgtctgtctc

SEQ ID NO: 5033077 - DNA, 18 bp, Homo sapiens
ggagtctgtcctgtgacg

SEQ ID NO: 5033078 - DNA, 20 bp, Homo sapiens
ggagtttagggaacaatttg

SEQ ID NO: 5033079 - DNA, 18 bp, Homo sapiens
ggagttttgtctgtctcc

SEQ ID NO: 5033080 - DNA, 20 bp, Homo sapiens
ggagttttgtctgtctccct

SEQ ID NO: 5033081 - DNA, 18 bp, Homo sapiens
ggatcctgggctgggtgg

SEQ ID NO: 5033082 - DNA, 16 bp, Homo sapiens
ctttttttgtatagtt

SEQ ID NO: 5033083 - DNA, 21 bp, Homo sapiens
gaaaaaaaacctgagatttat

SEQ ID NO: 5033084 - DNA, 18 bp, Homo sapiens
gaaaaaaaccacacaaag

SEQ ID NO: 5033085 - DNA, 21 bp, Homo sapiens
gaaaaaaaccacacaaagaca

SEQ ID NO: 5033086 - DNA, 14 bp, Homo sapiens
gaaaaaaatgtatt

SEQ ID NO: 5033087 - DNA, 14 bp, Homo sapiens
gaaaaataaagaaa

SEQ ID NO: 5033088 - DNA, 20 bp, Homo sapiens
gaaaaccagctcagcactgc

SEQ ID NO: 5033089 - DNA, 22 bp, Homo sapiens
gaaaagaattgttgggggtttt

SEQ ID NO: 5033090 - DNA, 11 bp, Homo sapiens
gaaaagatgca

SEQ ID NO: 5033091 - DNA, 13 bp, Homo sapiens
gaaaagtatgttc

SEQ ID NO: 5033092 - DNA, 15 bp, Homo sapiens
gaaaagtatgttcta

SEQ ID NO: 5033093 - DNA, 19 bp, Homo sapiens
gaaaagtatgttctaacct

SEQ ID NO: 5033094 - DNA, 14 bp, Homo sapiens
gaaaagttggaagg

SEQ ID NO: 5033095 - DNA, 22 bp, Homo sapiens
gaaaatggccatgcaggaggtg

SEQ ID NO: 5033096 - DNA, 16 bp, Homo sapiens
gaaaccagaaaagcaa

SEQ ID NO: 5033097 - DNA, 16 bp, Homo sapiens
gaaagagatacagagg

SEQ ID NO: 5033098 - DNA, 13 bp, Homo sapiens
gaaaggattttac

SEQ ID NO: 5033099 - DNA, 19 bp, Homo sapiens
gaaaggattttaccaaagc

SEQ ID NO: 5033100 - DNA, 24 bp, Homo sapiens
gaaaggattttaccaaagcatcaa

SEQ ID NO: 5033101 - DNA, 14 bp, Homo sapiens
gaaagtctgtcctt

SEQ ID NO: 5033102 - DNA, 14 bp, Homo sapiens
gaaagtttacagga

SEQ ID NO: 5033103 - DNA, 21 bp, Homo sapiens
gaaataattgttgttctgtta

SEQ ID NO: 5033104 - DNA, 15 bp, Homo sapiens
gaaatactgtttgag

SEQ ID NO: 5033105 - DNA, 15 bp, Homo sapiens
gaaatagcttatgaa

SEQ ID NO: 5033106 - DNA, 21 bp, Homo sapiens
gaaatagcttatgaaaagaat

SEQ ID NO: 5033107 - DNA, 20 bp, Homo sapiens
gaaatgattcaaattgctgc

SEQ ID NO: 5033108 - DNA, 23 bp, Homo sapiens
gaaatgattcaaattgctgcttg

SEQ ID NO: 5033109 - DNA, 22 bp, Homo sapiens
gaaatggcgtctgctctggtgg

SEQ ID NO: 5033110 - DNA, 17 bp, Homo sapiens
gaaattgggtgaagagc

SEQ ID NO: 5033111 - DNA, 14 bp, Homo sapiens
gaaatttaaagcag

SEQ ID NO: 5033112 - DNA, 12 bp, Homo sapiens
gaaatttagcat

SEQ ID NO: 5033113 - DNA, 17 bp, Homo sapiens
gaaatttttcttcttga

SEQ ID NO: 5033114 - DNA, 15 bp, Homo sapiens
gaacaagagaagcat

SEQ ID NO: 5033115 - DNA, 15 bp, Homo sapiens
gaacaatttggcaat

SEQ ID NO: 5033116 - DNA, 20 bp, Homo sapiens
gaacactccaattaaggatt

SEQ ID NO: 5033117 - DNA, 16 bp, Homo sapiens
gaaccagccgtatttt

SEQ ID NO: 5033118 - DNA, 23 bp, Homo sapiens
gaaccaggagaagggctggggcc

SEQ ID NO: 5033119 - DNA, 20 bp, Homo sapiens
gaacccggtgctccctctgt

SEQ ID NO: 5033120 - DNA, 18 bp, Homo sapiens
gaacctgcacacaggaca

SEQ ID NO: 5033121 - DNA, 14 bp, Homo sapiens
gaactaaactttca

SEQ ID NO: 5033122 - DNA, 16 bp, Homo sapiens
gaactgggctgggcct

SEQ ID NO: 5033123 - DNA, 17 bp, Homo sapiens
gaactgggctgggcctc

SEQ ID NO: 5033124 - DNA, 10 bp, Homo sapiens
gaagaaaaaa

SEQ ID NO: 5033125 - DNA, 14 bp, Homo sapiens
gaagaaagaagaca

SEQ ID NO: 5033126 - DNA, 13 bp, Homo sapiens
gaagaagaaatct

SEQ ID NO: 5033127 - DNA, 15 bp, Homo sapiens
gaagacaaaaagaca

SEQ ID NO: 5033128 - DNA, 17 bp, Homo sapiens
gaagagcccgcagggcc

SEQ ID NO: 5033129 - DNA, 22 bp, Homo sapiens
gaagagcccgcagggccatgca

SEQ ID NO: 5033130 - DNA, 16 bp, Homo sapiens
gaagagccggtggtgc

SEQ ID NO: 5033131 - DNA, 12 bp, Homo sapiens
gaagaggaacca

SEQ ID NO: 5033132 - DNA, 17 bp, Homo sapiens
gaagagggttttaggta

SEQ ID NO: 5033133 - DNA, 23 bp, Homo sapiens
gaagcaacagcttcagaaagagc

SEQ ID NO: 5033134 - DNA, 12 bp, Homo sapiens
gaagcaggaggc

SEQ ID NO: 5033135 - DNA, 17 bp, Homo sapiens
gaagcattttataaatc

SEQ ID NO: 5033136 - DNA, 10 bp, Homo sapiens
gaagcctttg

SEQ ID NO: 5033137 - DNA, 20 bp, Homo sapiens
gaaggactaatagaaaagta

SEQ ID NO: 5033138 - DNA, 19 bp, Homo sapiens
gaaggactgtgacaggcag

SEQ ID NO: 5033139 - DNA, 22 bp, Homo sapiens
gaaggatctgctgaggcccagt

SEQ ID NO: 5033140 - DNA, 16 bp, Homo sapiens
gaaggcaaatgacttt

SEQ ID NO: 5033141 - DNA, 13 bp, Homo sapiens
gaagggcaagaaa

SEQ ID NO: 5033142 - DNA, 16 bp, Homo sapiens
gaagggcgttctaggt

SEQ ID NO: 5033143 - DNA, 19 bp, Homo sapiens
gaaggggaagcactcgtgt

SEQ ID NO: 5033144 - DNA, 16 bp, Homo sapiens
gaagtgagcacagcct

SEQ ID NO: 5033145 - DNA, 18 bp, Homo sapiens
gaagtgttgaagggaggt

SEQ ID NO: 5033146 - DNA, 17 bp, Homo sapiens
gaatacaaacacctgga

SEQ ID NO: 5033147 - DNA, 21 bp, Homo sapiens
gaataccactctgtaattgca

SEQ ID NO: 5033148 - DNA, 14 bp, Homo sapiens
gaatacggaagagc

SEQ ID NO: 5033149 - DNA, 13 bp, Homo sapiens
gaatactgaacat

SEQ ID NO: 5033150 - DNA, 14 bp, Homo sapiens
gaatatctttcgat

SEQ ID NO: 5033151 - DNA, 20 bp, Homo sapiens
gaatattagtgacctcagct

SEQ ID NO: 5033152 - DNA, 19 bp, Homo sapiens
gaatcctttggtgccaact

SEQ ID NO: 5033153 - DNA, 16 bp, Homo sapiens
gaatcgcagctgtggg

SEQ ID NO: 5033154 - DNA, 15 bp, Homo sapiens
gaatctgaatcagcc

SEQ ID NO: 5033155 - DNA, 13 bp, Homo sapiens
gaatgtgtcttta

SEQ ID NO: 5033156 - DNA, 16 bp, Homo sapiens
gaattattcaatttat

SEQ ID NO: 5033157 - DNA, 20 bp, Homo sapiens
gaattattcaatttatttga

SEQ ID NO: 5033158 - DNA, 20 bp, Homo sapiens
gaattctcaggtaggaagca

SEQ ID NO: 5033159 - DNA, 16 bp, Homo sapiens
gacaacagacttctga

SEQ ID NO: 5033160 - DNA, 15 bp, Homo sapiens
gacaacgtgctcttt

SEQ ID NO: 5033161 - DNA, 12 bp, Homo sapiens
gacaccaccacc

SEQ ID NO: 5033162 - DNA, 15 bp, Homo sapiens
gacacctaactcttc

SEQ ID NO: 5033163 - DNA, 19 bp, Homo sapiens
gacacgggcctgtccacag

SEQ ID NO: 5033164 - DNA, 22 bp, Homo sapiens
gacacgggcctgtccacaggct

SEQ ID NO: 5033165 - DNA, 18 bp, Homo sapiens
gacactgttcttagctca

SEQ ID NO: 5033166 - DNA, 23 bp, Homo sapiens
gacactgttcttagctcaatgag

SEQ ID NO: 5033167 - DNA, 15 bp, Homo sapiens
gacagaagcagctct

SEQ ID NO: 5033168 - DNA, 15 bp, Homo sapiens
gacagcgggaaaaat

SEQ ID NO: 5033169 - DNA, 14 bp, Homo sapiens
gacagctttctggg

SEQ ID NO: 5033170 - DNA, 17 bp, Homo sapiens
gacagctttctgggatg

SEQ ID NO: 5033171 - DNA, 23 bp, Homo sapiens
gacagctttctgggatgtcacag

SEQ ID NO: 5033172 - DNA, 18 bp, Homo sapiens
gacaggagacctggcact

SEQ ID NO: 5033173 - DNA, 21 bp, Homo sapiens
gacagggacatgccctgtgtg

SEQ ID NO: 5033174 - DNA, 22 bp, Homo sapiens
gacagtgcctcttccagtgaac

SEQ ID NO: 5033175 - DNA, 16 bp, Homo sapiens
gacatcaggagactgg

SEQ ID NO: 5033176 - DNA, 23 bp, Homo sapiens
gacatccatgttccgagaagaac

SEQ ID NO: 5033177 - DNA, 16 bp, Homo sapiens
gacatgccctgtgtgg

SEQ ID NO: 5033178 - DNA, 13 bp, Homo sapiens
gacatgggtgggg

SEQ ID NO: 5033179 - DNA, 19 bp, Homo sapiens
gacattctgaatgcttcta

SEQ ID NO: 5033180 - DNA, 16 bp, Homo sapiens
gaccacaccctgtact

SEQ ID NO: 5033181 - DNA, 16 bp, Homo sapiens
gaccacactccagctg

SEQ ID NO: 5033182 - DNA, 23 bp, Homo sapiens
gacccatagcagctttgtctctg

SEQ ID NO: 5033183 - DNA, 17 bp, Homo sapiens
gacccctggctctgggc

SEQ ID NO: 5033184 - DNA, 21 bp, Homo sapiens
gaccctccccacagtgccacc

SEQ ID NO: 5033185 - DNA, 21 bp, Homo sapiens
gaccctgtccggcccagtgcc

SEQ ID NO: 5033186 - DNA, 12 bp, Homo sapiens
gaccgccccctc

SEQ ID NO: 5033187 - DNA, 16 bp, Homo sapiens
gaccgccccctcctct

SEQ ID NO: 5033188 - DNA, 17 bp, Homo sapiens
gacctcatgcccagctc

SEQ ID NO: 5033189 - DNA, 21 bp, Homo sapiens
gacctggtaccctcctggctc

SEQ ID NO: 5033190 - DNA, 18 bp, Homo sapiens
gaccttcagagccagccg

SEQ ID NO: 5033191 - DNA, 14 bp, Homo sapiens
gataccagaaggga

SEQ ID NO: 5033192 - DNA, 21 bp, Homo sapiens
gatacccccctctgtcttgtg

SEQ ID NO: 5033193 - DNA, 23 bp, Homo sapiens
gatacttcgacactgttcttagc

SEQ ID NO: 5033194 - DNA, 15 bp, Homo sapiens
gatagacttgggatg

SEQ ID NO: 5033195 - DNA, 21 bp, Homo sapiens
gatagacttgggatggggagg

SEQ ID NO: 5033196 - DNA, 16 bp, Homo sapiens
gatagccctgtcctgg

SEQ ID NO: 5033197 - DNA, 23 bp, Homo sapiens
gatagttttcatccataactgaa

SEQ ID NO: 5033198 - DNA, 16 bp, Homo sapiens
gatcacatgtggactt

SEQ ID NO: 5033199 - DNA, 18 bp, Homo sapiens
gatccgcaatgtggagca

SEQ ID NO: 5033200 - DNA, 16 bp, Homo sapiens
gatcctgtccttttaa

SEQ ID NO: 5033201 - DNA, 19 bp, Homo sapiens
gatcggcaggacaccctga

SEQ ID NO: 5033202 - DNA, 14 bp, Homo sapiens
gcgtgagctgagca

SEQ ID NO: 5033203 - DNA, 23 bp, Homo sapiens
gcgtgccagtcaagaagaaaaag

SEQ ID NO: 5033204 - DNA, 22 bp, Homo sapiens
gcgtgtgggtcccgcactctgc

SEQ ID NO: 5033205 - DNA, 15 bp, Homo sapiens
gcgtgttcagcagaa

SEQ ID NO: 5033206 - DNA, 14 bp, Homo sapiens
gcgttcttgtaatt

SEQ ID NO: 5033207 - DNA, 22 bp, Homo sapiens
gcgttcttgtaattttacacgc

SEQ ID NO: 5033208 - DNA, 15 bp, Homo sapiens
gctaatttaaagaga

SEQ ID NO: 5033209 - DNA, 16 bp, Homo sapiens
gctaccctttttctcc

SEQ ID NO: 5033210 - DNA, 21 bp, Homo sapiens
gctaccctttttctccagctg

SEQ ID NO: 5033211 - DNA, 16 bp, Homo sapiens
gctactataaagagaa

SEQ ID NO: 5033212 - DNA, 12 bp, Homo sapiens
gctaggggctgg

SEQ ID NO: 5033213 - DNA, 22 bp, Homo sapiens
gctagtcttttgcttttgccca

SEQ ID NO: 5033214 - DNA, 16 bp, Homo sapiens
gctattggaggatcag

SEQ ID NO: 5033215 - DNA, 13 bp, Homo sapiens
gctcacccagtgc

SEQ ID NO: 5033216 - DNA, 22 bp, Homo sapiens
gctcactgaactccttccccac

SEQ ID NO: 5033217 - DNA, 12 bp, Homo sapiens
gctcagcccgct

SEQ ID NO: 5033218 - DNA, 19 bp, Homo sapiens
gctcatatggggctgggag

SEQ ID NO: 5033219 - DNA, 18 bp, Homo sapiens
gctccaaaccctcgaggc

SEQ ID NO: 5033220 - DNA, 16 bp, Homo sapiens
gctccagattctgatg

SEQ ID NO: 5033221 - DNA, 20 bp, Homo sapiens
gctccagattctgatgcata

SEQ ID NO: 5033222 - DNA, 21 bp, Homo sapiens
gctccaggtggctctgaggtg

SEQ ID NO: 5033223 - DNA, 16 bp, Homo sapiens
gctccagtttgcattt

SEQ ID NO: 5033224 - DNA, 20 bp, Homo sapiens
ctctgcaattcccctctgct

SEQ ID NO: 5033225 - DNA, 22 bp, Homo sapiens
ctctgcaattcccctctgctgc

SEQ ID NO: 5033226 - DNA, 16 bp, Homo sapiens
ctctgctgctgtccct

SEQ ID NO: 5033227 - DNA, 19 bp, Homo sapiens
ctctggaggggtgtggctc

SEQ ID NO: 5033228 - DNA, 18 bp, Homo sapiens
ctctggcattagaattat

SEQ ID NO: 5033229 - DNA, 20 bp, Homo sapiens
ctctgggccgggcctggggc

SEQ ID NO: 5033230 - DNA, 21 bp, Homo sapiens
ctctggtggcttaagtgagca

SEQ ID NO: 5033231 - DNA, 14 bp, Homo sapiens
ctctggttcctccc

SEQ ID NO: 5033232 - DNA, 14 bp, Homo sapiens
ctctgtccccagcc

SEQ ID NO: 5033233 - DNA, 13 bp, Homo sapiens
ctctgtctaggac

SEQ ID NO: 5033234 - DNA, 20 bp, Homo sapiens
ctctgtgggtctctggaaga

SEQ ID NO: 5033235 - DNA, 18 bp, Homo sapiens
ctctgttcggcctttggg

SEQ ID NO: 5033236 - DNA, 14 bp, Homo sapiens
ctctgttgtaagaa

SEQ ID NO: 5033237 - DNA, 19 bp, Homo sapiens
ctcttatggatgtccccag

SEQ ID NO: 5033238 - DNA, 21 bp, Homo sapiens
ctcttatggatgtccccagca

SEQ ID NO: 5033239 - DNA, 22 bp, Homo sapiens
ctcttatggatgtccccagcag

SEQ ID NO: 5033240 - DNA, 19 bp, Homo sapiens
ctcttcagttaagcctttg

SEQ ID NO: 5033241 - DNA, 22 bp, Homo sapiens
ctcttccctgcgcctgtgatgc

SEQ ID NO: 5033242 - DNA, 14 bp, Homo sapiens
ctcttgctttctat

SEQ ID NO: 5033243 - DNA, 15 bp, Homo sapiens
ctcttggtacctgtg

SEQ ID NO: 5033244 - DNA, 15 bp, Homo sapiens
ctctttaaaaactca

SEQ ID NO: 5033245 - DNA, 14 bp, Homo sapiens
ctctttcacattgt

SEQ ID NO: 5033246 - DNA, 22 bp, Homo sapiens
ctcttttcctttggtccttcaa

SEQ ID NO: 5033247 - DNA, 23 bp, Homo sapiens
ctgaaacacacgagcaaacccag

SEQ ID NO: 5033248 - DNA, 22 bp, Homo sapiens
ctgaaatagacccacaagaggc

SEQ ID NO: 5033249 - DNA, 22 bp, Homo sapiens
ctgaaattcagagcaagttcct

SEQ ID NO: 5033250 - DNA, 19 bp, Homo sapiens
ctgaaatttttcttcttga

SEQ ID NO: 5033251 - DNA, 18 bp, Homo sapiens
ctgaacactccaattaag

SEQ ID NO: 5033252 - DNA, 23 bp, Homo sapiens
ctgaacatctgagtcctggatga

SEQ ID NO: 5033253 - DNA, 23 bp, Homo sapiens
ctgaaggactgtgacaggcagca

SEQ ID NO: 5033254 - DNA, 19 bp, Homo sapiens
ctgaagtgaaactgcttgt

SEQ ID NO: 5033255 - DNA, 19 bp, Homo sapiens
ctgaagtgagcacagccta

SEQ ID NO: 5033256 - DNA, 21 bp, Homo sapiens
ctgaagtgagcacagcctagg

SEQ ID NO: 5033257 - DNA, 17 bp, Homo sapiens
ctgaataccactctgta

SEQ ID NO: 5033258 - DNA, 22 bp, Homo sapiens
ctgaataccactctgtaattgc

SEQ ID NO: 5033259 - DNA, 14 bp, Homo sapiens
ctgaatgcttctaa

SEQ ID NO: 5033260 - DNA, 14 bp, Homo sapiens
ctgaatgtttttct

SEQ ID NO: 5033261 - DNA, 16 bp, Homo sapiens
ctgaatgtttttctaa

SEQ ID NO: 5033262 - DNA, 18 bp, Homo sapiens
ctgaatgtttttctaaag

SEQ ID NO: 5033263 - DNA, 15 bp, Homo sapiens
ctgacatctctgcaa

SEQ ID NO: 5033264 - DNA, 19 bp, Homo sapiens
ctgacgcttgtgacagtgc

SEQ ID NO: 5033265 - DNA, 20 bp, Homo sapiens
ctgacgcttgtgacagtgcc

SEQ ID NO: 5033266 - DNA, 22 bp, Homo sapiens
ctgacgcttgtgacagtgcctc

SEQ ID NO: 5033267 - DNA, 18 bp, Homo sapiens
ctgacttaagcaaaagaa

SEQ ID NO: 5033268 - DNA, 17 bp, Homo sapiens
ctgagatacttcccaaa

SEQ ID NO: 5033269 - DNA, 20 bp, Homo sapiens
ctgagatacttcccaaagcc

SEQ ID NO: 5033270 - DNA, 15 bp, Homo sapiens
ctgagatttattaaa

SEQ ID NO: 5033271 - DNA, 17 bp, Homo sapiens
ctgagatttattaaaga

SEQ ID NO: 5033272 - DNA, 17 bp, Homo sapiens
ctgagcagcgagcctgc

SEQ ID NO: 5033273 - DNA, 11 bp, Homo sapiens
ctgagctgggg

SEQ ID NO: 5033274 - DNA, 12 bp, Homo sapiens
ctgagctgggga

SEQ ID NO: 5033275 - DNA, 17 bp, Homo sapiens
ctgaggcccagtgcata

SEQ ID NO: 5033276 - DNA, 18 bp, Homo sapiens
ctgagggtctgggcggcg

SEQ ID NO: 5033277 - DNA, 15 bp, Homo sapiens
ctgagggtgcccttt

SEQ ID NO: 5033278 - DNA, 19 bp, Homo sapiens
ctgaggtgcctgtcccacc

SEQ ID NO: 5033279 - DNA, 22 bp, Homo sapiens
ctgagtaactggttgctgtgtc

SEQ ID NO: 5033280 - DNA, 16 bp, Homo sapiens
ctgataaagcacagct

SEQ ID NO: 5033281 - DNA, 23 bp, Homo sapiens
ctgatgcatacggctatattggt

SEQ ID NO: 5033282 - DNA, 19 bp, Homo sapiens
ctgattgggaggtgcgtgt

SEQ ID NO: 5033283 - DNA, 17 bp, Homo sapiens
ctgcaactgctcagctc

SEQ ID NO: 5033284 - DNA, 20 bp, Homo sapiens
ctgcacacaggacagcggga

SEQ ID NO: 5033285 - DNA, 22 bp, Homo sapiens
ctgcacaggcacacagggcccg

SEQ ID NO: 5033286 - DNA, 12 bp, Homo sapiens
ctgcagccagct

SEQ ID NO: 5033287 - DNA, 22 bp, Homo sapiens
ctgcagccagctcacgtccagg

SEQ ID NO: 5033288 - DNA, 17 bp, Homo sapiens
ctgcaggcgtgacctga

SEQ ID NO: 5033289 - DNA, 13 bp, Homo sapiens
ctgcagtcctgga

SEQ ID NO: 5033290 - DNA, 16 bp, Homo sapiens
ctgcagtgtggagttc

SEQ ID NO: 5033291 - DNA, 17 bp, Homo sapiens
ctgcagtttttcccaag

SEQ ID NO: 5033292 - DNA, 12 bp, Homo sapiens
ctgccaaacaca

SEQ ID NO: 5033293 - DNA, 13 bp, Homo sapiens
ctgccaaacacat

SEQ ID NO: 5033294 - DNA, 16 bp, Homo sapiens
ctgccaagactcctca

SEQ ID NO: 5033295 - DNA, 18 bp, Homo sapiens
ctgccaagactcctcagg

SEQ ID NO: 5033296 - DNA, 23 bp, Homo sapiens
ctgccaccggaggtcactccacc

SEQ ID NO: 5033297 - DNA, 12 bp, Homo sapiens
ctgccagcccct

SEQ ID NO: 5033298 - DNA, 19 bp, Homo sapiens
ctgccaggggttcttgagc

SEQ ID NO: 5033299 - DNA, 21 bp, Homo sapiens
ctgccagtggggaaggaggcc

SEQ ID NO: 5033300 - DNA, 14 bp, Homo sapiens
ctgccatattaaat

SEQ ID NO: 5033301 - DNA, 14 bp, Homo sapiens
ctgccccagccaga

SEQ ID NO: 5033302 - DNA, 21 bp, Homo sapiens
ctgccccccagcctctggcat

SEQ ID NO: 5033303 - DNA, 18 bp, Homo sapiens
ctgccccccgaggctgct

SEQ ID NO: 5033304 - DNA, 22 bp, Homo sapiens
ctgccgctgcttccaggctggg

SEQ ID NO: 5033305 - DNA, 19 bp, Homo sapiens
ctgccggggcagccccctc

SEQ ID NO: 5033306 - DNA, 20 bp, Homo sapiens
ctgccggggcagccccctca

SEQ ID NO: 5033307 - DNA, 14 bp, Homo sapiens
ctgccggtgggacc

SEQ ID NO: 5033308 - DNA, 15 bp, Homo sapiens
ctgccggtgggaccc

SEQ ID NO: 5033309 - DNA, 18 bp, Homo sapiens
ctgccggtgggaccctgt

SEQ ID NO: 5033310 - DNA, 23 bp, Homo sapiens
ctgccggttcttaaatccatcct

SEQ ID NO: 5033311 - DNA, 19 bp, Homo sapiens
ctgcctctacccaaccagg

SEQ ID NO: 5033312 - DNA, 14 bp, Homo sapiens
ctgcctgccctggt

SEQ ID NO: 5033313 - DNA, 15 bp, Homo sapiens
ctgcctgccctggtg

SEQ ID NO: 5033314 - DNA, 14 bp, Homo sapiens
ctgcctgctcccat

SEQ ID NO: 5033315 - DNA, 12 bp, Homo sapiens
ctgcctgctttg

SEQ ID NO: 5033316 - DNA, 23 bp, Homo sapiens
ctgccttagtctcagtttgtgtg

SEQ ID NO: 5033317 - DNA, 23 bp, Homo sapiens
ctgcgggcgcgggcagccaccca

SEQ ID NO: 5033318 - DNA, 22 bp, Homo sapiens
ctgcgtgccagtcaagaagaaa

SEQ ID NO: 5033319 - DNA, 13 bp, Homo sapiens
ctgctaaataaac

SEQ ID NO: 5033320 - DNA, 15 bp, Homo sapiens
ctgctaatattttcc

SEQ ID NO: 5033321 - DNA, 18 bp, Homo sapiens
ctgctattaggccagcaa

SEQ ID NO: 5033322 - DNA, 18 bp, Homo sapiens
ctgctcagctctggtcca

SEQ ID NO: 5033323 - DNA, 23 bp, Homo sapiens
ctgctcagctctggtccaggccc

SEQ ID NO: 5033324 - DNA, 17 bp, Homo sapiens
ctgctcattttgacaaa

SEQ ID NO: 5033325 - DNA, 19 bp, Homo sapiens
ctgctcccatcctgtgtgt

SEQ ID NO: 5033326 - DNA, 16 bp, Homo sapiens
ctgctctcagcctccc

SEQ ID NO: 5033327 - DNA, 17 bp, Homo sapiens
ctgctgaggcccagtgc

SEQ ID NO: 5033328 - DNA, 21 bp, Homo sapiens
aagagattcgaatgacggtaa

SEQ ID NO: 5033329 - DNA, 12 bp, Homo sapiens
aagagcaggtga

SEQ ID NO: 5033330 - DNA, 22 bp, Homo sapiens
aagagcccgcagggccatgcag

SEQ ID NO: 5033331 - DNA, 15 bp, Homo sapiens
aagagcctttccaaa

SEQ ID NO: 5033332 - DNA, 20 bp, Homo sapiens
aagagcttgctccagattct

SEQ ID NO: 5033333 - DNA, 15 bp, Homo sapiens
aagatgccacattca

SEQ ID NO: 5033334 - DNA, 21 bp, Homo sapiens
aagattggtgtttttttctat

SEQ ID NO: 5033335 - DNA, 20 bp, Homo sapiens
aagatttgtttttaaactgt

SEQ ID NO: 5033336 - DNA, 22 bp, Homo sapiens
aagatttgtttttaaactgtac

SEQ ID NO: 5033337 - DNA, 11 bp, Homo sapiens
aagcaaaagaa

SEQ ID NO: 5033338 - DNA, 14 bp, Homo sapiens
aagcaaaagaaaaa

SEQ ID NO: 5033339 - DNA, 12 bp, Homo sapiens
aagcaaatgtct

SEQ ID NO: 5033340 - DNA, 18 bp, Homo sapiens
aagcaggaggcccttgtc

SEQ ID NO: 5033341 - DNA, 14 bp, Homo sapiens
aagcaggttcttgt

SEQ ID NO: 5033342 - DNA, 15 bp, Homo sapiens
aagcaggttcttgtt

SEQ ID NO: 5033343 - DNA, 19 bp, Homo sapiens
aagcatcattatttatgta

SEQ ID NO: 5033344 - DNA, 23 bp, Homo sapiens
aagcattctcattggaaatttag

SEQ ID NO: 5033345 - DNA, 12 bp, Homo sapiens
aagcattttata

SEQ ID NO: 5033346 - DNA, 19 bp, Homo sapiens
aagcattttataaatcgct

SEQ ID NO: 5033347 - DNA, 21 bp, Homo sapiens
aagcattttataaatcgcttt

SEQ ID NO: 5033348 - DNA, 18 bp, Homo sapiens
aagcccctgcccctcctc

SEQ ID NO: 5033349 - DNA, 19 bp, Homo sapiens
aagcctgctggctgcggcc

SEQ ID NO: 5033350 - DNA, 21 bp, Homo sapiens
aagcctgctggctgcggcccc

SEQ ID NO: 5033351 - DNA, 22 bp, Homo sapiens
aagcgtgagcttaaaatacaag

SEQ ID NO: 5033352 - DNA, 19 bp, Homo sapiens
aagctagtcttttgctttt

SEQ ID NO: 5033353 - DNA, 14 bp, Homo sapiens
aagctatttttcta

SEQ ID NO: 5033354 - DNA, 21 bp, Homo sapiens
aagctatttttctaactacaa

SEQ ID NO: 5033355 - DNA, 14 bp, Homo sapiens
aagctctgctatta

SEQ ID NO: 5033356 - DNA, 21 bp, Homo sapiens
aagctgccgaaccaaaagaat

SEQ ID NO: 5033357 - DNA, 21 bp, Homo sapiens
aagcttcattctccttgttgt

SEQ ID NO: 5033358 - DNA, 22 bp, Homo sapiens
aaggaaaccacagtgagcctga

SEQ ID NO: 5033359 - DNA, 20 bp, Homo sapiens
aaggaaactgggttcctgca

SEQ ID NO: 5033360 - DNA, 20 bp, Homo sapiens
aaggactgtgacaggcagca

SEQ ID NO: 5033361 - DNA, 23 bp, Homo sapiens
aaggatatgattaatattattaa

SEQ ID NO: 5033362 - DNA, 14 bp, Homo sapiens
aaggatctgctgag

SEQ ID NO: 5033363 - DNA, 20 bp, Homo sapiens
aaggatctgctgaggcccag

SEQ ID NO: 5033364 - DNA, 22 bp, Homo sapiens
aaggattttatgctttaaacat

SEQ ID NO: 5033365 - DNA, 23 bp, Homo sapiens
aaggattttatgctttaaacatt

SEQ ID NO: 5033366 - DNA, 15 bp, Homo sapiens
aaggcacaatatggg

SEQ ID NO: 5033367 - DNA, 13 bp, Homo sapiens
aaggctgtgtaag

SEQ ID NO: 5033368 - DNA, 15 bp, Homo sapiens
aagggcaagaaatgg

SEQ ID NO: 5033369 - DNA, 23 bp, Homo sapiens
aagggcaagaaatggcgtctgct

SEQ ID NO: 5033370 - DNA, 19 bp, Homo sapiens
aagggctgccggggcagcc

SEQ ID NO: 5033371 - DNA, 21 bp, Homo sapiens
aagggctgccggggcagcccc

SEQ ID NO: 5033372 - DNA, 20 bp, Homo sapiens
aaggggcggtgcccacaccg

SEQ ID NO: 5033373 - DNA, 16 bp, Homo sapiens
aaggttgggcagggtg

SEQ ID NO: 5033374 - DNA, 14 bp, Homo sapiens
aaggtttaaatgaa

SEQ ID NO: 5033375 - DNA, 21 bp, Homo sapiens
aaggtttaaatgaacaagaga

SEQ ID NO: 5033376 - DNA, 15 bp, Homo sapiens
aagtatctgacatct

SEQ ID NO: 5033377 - DNA, 22 bp, Homo sapiens
aagtatctgacatctctgcaat

SEQ ID NO: 5033378 - DNA, 15 bp, Homo sapiens
aagtatttttaatta

SEQ ID NO: 5033379 - DNA, 22 bp, Homo sapiens
aagtctctgaagtgaaactgct

SEQ ID NO: 5033380 - DNA, 16 bp, Homo sapiens
aagtgactgtatctgt

SEQ ID NO: 5033381 - DNA, 18 bp, Homo sapiens
aagtgagagccagcagca

SEQ ID NO: 5033382 - DNA, 12 bp, Homo sapiens
aagtgagcagaa

SEQ ID NO: 5033383 - DNA, 15 bp, Homo sapiens
aagtgagcagaacag

SEQ ID NO: 5033384 - DNA, 14 bp, Homo sapiens
aagtgccagtattt

SEQ ID NO: 5033385 - DNA, 22 bp, Homo sapiens
aagtggcaatctcagatgcagt

SEQ ID NO: 5033386 - DNA, 17 bp, Homo sapiens
aagtgttctcatgaagc

SEQ ID NO: 5033387 - DNA, 18 bp, Homo sapiens
aagtgttgaagggaggtg

SEQ ID NO: 5033388 - DNA, 14 bp, Homo sapiens
aagttattaatatt

SEQ ID NO: 5033389 - DNA, 19 bp, Homo sapiens
aagttattaatattttaat

SEQ ID NO: 5033390 - DNA, 16 bp, Homo sapiens
aagttgagatagtttt

SEQ ID NO: 5033391 - DNA, 14 bp, Homo sapiens
aagttgcagctgtt

SEQ ID NO: 5033392 - DNA, 15 bp, Homo sapiens
aagttgcagctgttt

SEQ ID NO: 5033393 - DNA, 21 bp, Homo sapiens
aagttgcagctgttttgttga

SEQ ID NO: 5033394 - DNA, 11 bp, Homo sapiens
aagttggaagg

SEQ ID NO: 5033395 - DNA, 17 bp, Homo sapiens
aataaactactctttga

SEQ ID NO: 5033396 - DNA, 18 bp, Homo sapiens
aataaagccttcaaactc

SEQ ID NO: 5033397 - DNA, 21 bp, Homo sapiens
aataaattcccaacttctctt

SEQ ID NO: 5033398 - DNA, 22 bp, Homo sapiens
aataacaaatgccaaattaaaa

SEQ ID NO: 5033399 - DNA, 20 bp, Homo sapiens
aataacattcccactgccag

SEQ ID NO: 5033400 - DNA, 16 bp, Homo sapiens
aataaggcccagagcg

SEQ ID NO: 5033401 - DNA, 16 bp, Homo sapiens
aataattgttgttctg

SEQ ID NO: 5033402 - DNA, 17 bp, Homo sapiens
aatacaaacacctggac

SEQ ID NO: 5033403 - DNA, 20 bp, Homo sapiens
aatacaaccagcccaaccat

SEQ ID NO: 5033404 - DNA, 17 bp, Homo sapiens
aataccactctgtaatt

SEQ ID NO: 5033405 - DNA, 15 bp, Homo sapiens
aatactgaacatctg

SEQ ID NO: 5033406 - DNA, 12 bp, Homo sapiens
aatactgtttga

SEQ ID NO: 5033407 - DNA, 18 bp, Homo sapiens
aatagacccacaagaggc

SEQ ID NO: 5033408 - DNA, 16 bp, Homo sapiens
aatagcttatgaaaag

SEQ ID NO: 5033409 - DNA, 17 bp, Homo sapiens
aatagcttatgaaaaga

SEQ ID NO: 5033410 - DNA, 19 bp, Homo sapiens
aatagggtatattttccta

SEQ ID NO: 5033411 - DNA, 20 bp, Homo sapiens
aatagggtatattttcctat

SEQ ID NO: 5033412 - DNA, 11 bp, Homo sapiens
aatataaagac

SEQ ID NO: 5033413 - DNA, 12 bp, Homo sapiens
aatataaagacg

SEQ ID NO: 5033414 - DNA, 11 bp, Homo sapiens
aatataaatgc

SEQ ID NO: 5033415 - DNA, 16 bp, Homo sapiens
aatataaatgcaaata

SEQ ID NO: 5033416 - DNA, 17 bp, Homo sapiens
aatataaatgcaaataa

SEQ ID NO: 5033417 - DNA, 14 bp, Homo sapiens
aatatataatttat

SEQ ID NO: 5033418 - DNA, 13 bp, Homo sapiens
aatatattattac

SEQ ID NO: 5033419 - DNA, 15 bp, Homo sapiens
aatatttataggtca

SEQ ID NO: 5033420 - DNA, 12 bp, Homo sapiens
aatattttcctc

SEQ ID NO: 5033421 - DNA, 13 bp, Homo sapiens
aatcaaacatttt

SEQ ID NO: 5033422 - DNA, 14 bp, Homo sapiens
aatcaactgggctg

SEQ ID NO: 5033423 - DNA, 20 bp, Homo sapiens
aatcaactttatcatatgct

SEQ ID NO: 5033424 - DNA, 18 bp, Homo sapiens
aatcacatgaattattac

SEQ ID NO: 5033425 - DNA, 15 bp, Homo sapiens
aatccctctccaact

SEQ ID NO: 5033426 - DNA, 15 bp, Homo sapiens
aatctggaagaaaaa

SEQ ID NO: 5033427 - DNA, 15 bp, Homo sapiens
aatctgtttttctca

SEQ ID NO: 5033428 - DNA, 14 bp, Homo sapiens
aatgaagtctctga

SEQ ID NO: 5033429 - DNA, 16 bp, Homo sapiens
aatgaagtctctgaag

SEQ ID NO: 5033430 - DNA, 23 bp, Homo sapiens
aatgaagtctctgaagtgaaact

SEQ ID NO: 5033431 - DNA, 23 bp, Homo sapiens
aatgacggtaagtgttctcatga

SEQ ID NO: 5033432 - DNA, 17 bp, Homo sapiens
aatgagaggttcctaag

SEQ ID NO: 5033433 - DNA, 23 bp, Homo sapiens
aatgagcacccattccaaagctt

SEQ ID NO: 5033434 - DNA, 12 bp, Homo sapiens
aatgagcatgtt

SEQ ID NO: 5033435 - DNA, 16 bp, Homo sapiens
aatgaggtctgtttaa

SEQ ID NO: 5033436 - DNA, 23 bp, Homo sapiens
aatgatgtatgttgaagcctttg

SEQ ID NO: 5033437 - DNA, 20 bp, Homo sapiens
aatgattcaaattgctgctt

SEQ ID NO: 5033438 - DNA, 21 bp, Homo sapiens
aatgattcaaattgctgcttg

SEQ ID NO: 5033439 - DNA, 14 bp, Homo sapiens
aatgcaaataacaa

SEQ ID NO: 5033440 - DNA, 17 bp, Homo sapiens
aatgcaaataacaaatg

SEQ ID NO: 5033441 - DNA, 24 bp, Homo sapiens
aatgcaatctccccttgatttaaa

SEQ ID NO: 5033442 - DNA, 15 bp, Homo sapiens
aatgccaaattaaaa

SEQ ID NO: 5033443 - DNA, 17 bp, Homo sapiens
gactcctggtctgtgaa

SEQ ID NO: 5033444 - DNA, 14 bp, Homo sapiens
gactctattcttta

SEQ ID NO: 5033445 - DNA, 16 bp, Homo sapiens
gactctgtccagctcc

SEQ ID NO: 5033446 - DNA, 20 bp, Homo sapiens
gactctttttttgagtgaca

SEQ ID NO: 5033447 - DNA, 16 bp, Homo sapiens
gactgcagtgtggagt

SEQ ID NO: 5033448 - DNA, 20 bp, Homo sapiens
gactgcagtgtggagttcac

SEQ ID NO: 5033449 - DNA, 17 bp, Homo sapiens
gactgccatattaaatt

SEQ ID NO: 5033450 - DNA, 17 bp, Homo sapiens
gactgggctctggctct

SEQ ID NO: 5033451 - DNA, 19 bp, Homo sapiens
gactgtgacaggcagcaga

SEQ ID NO: 5033452 - DNA, 20 bp, Homo sapiens
gacttaagcaaaagaaaaag

SEQ ID NO: 5033453 - DNA, 23 bp, Homo sapiens
gacttagaaaaccagctcagcac

SEQ ID NO: 5033454 - DNA, 23 bp, Homo sapiens
gacttgagaaacaaataatttgt

SEQ ID NO: 5033455 - DNA, 18 bp, Homo sapiens
gacttggagactcctggt

SEQ ID NO: 5033456 - DNA, 10 bp, Homo sapiens
gagaaaaaaa

SEQ ID NO: 5033457 - DNA, 15 bp, Homo sapiens
gagaagggctggggc

SEQ ID NO: 5033458 - DNA, 17 bp, Homo sapiens
gagacaacgtgctcttt

SEQ ID NO: 5033459 - DNA, 17 bp, Homo sapiens
gagacagttgagagcgg

SEQ ID NO: 5033460 - DNA, 14 bp, Homo sapiens
gagacccccaggcc

SEQ ID NO: 5033461 - DNA, 16 bp, Homo sapiens
gagacccccaggcctg

SEQ ID NO: 5033462 - DNA, 19 bp, Homo sapiens
gagactgggctctggctct

SEQ ID NO: 5033463 - DNA, 21 bp, Homo sapiens
gagactttccattacaagtat

SEQ ID NO: 5033464 - DNA, 11 bp, Homo sapiens
gagagaaaaaa

SEQ ID NO: 5033465 - DNA, 14 bp, Homo sapiens
gagagaaaggactc

SEQ ID NO: 5033466 - DNA, 22 bp, Homo sapiens
gagagggcggtgggtatgcgag

SEQ ID NO: 5033467 - DNA, 17 bp, Homo sapiens
gagatagttttcatcca

SEQ ID NO: 5033468 - DNA, 18 bp, Homo sapiens
gagatctttctttccaaa

SEQ ID NO: 5033469 - DNA, 22 bp, Homo sapiens
gagatctttctttccaaaacat

SEQ ID NO: 5033470 - DNA, 19 bp, Homo sapiens
gagcaaacccagaggtgga

SEQ ID NO: 5033471 - DNA, 23 bp, Homo sapiens
gagcacggctctgtccccagcct

SEQ ID NO: 5033472 - DNA, 12 bp, Homo sapiens
gagcagaacagg

SEQ ID NO: 5033473 - DNA, 15 bp, Homo sapiens
gagcagaacaggtag

SEQ ID NO: 5033474 - DNA, 16 bp, Homo sapiens
gagcagaacaggtagt

SEQ ID NO: 5033475 - DNA, 11 bp, Homo sapiens
gagcagcagcc

SEQ ID NO: 5033476 - DNA, 16 bp, Homo sapiens
gagcaggtgactgtgc

SEQ ID NO: 5033477 - DNA, 21 bp, Homo sapiens
gagcaggtgactgtgctgtgc

SEQ ID NO: 5033478 - DNA, 16 bp, Homo sapiens
gagcagttcagagtgg

SEQ ID NO: 5033479 - DNA, 22 bp, Homo sapiens
gagcatgtttagactttaacat

SEQ ID NO: 5033480 - DNA, 14 bp, Homo sapiens
gagccagccaggcc

SEQ ID NO: 5033481 - DNA, 20 bp, Homo sapiens
gagccccaccttgtctgcta

SEQ ID NO: 5033482 - DNA, 13 bp, Homo sapiens
gagcccctcggct

SEQ ID NO: 5033483 - DNA, 19 bp, Homo sapiens
gagcccctcggctctggag

SEQ ID NO: 5033484 - DNA, 13 bp, Homo sapiens
gagcctttccaaa

SEQ ID NO: 5033485 - DNA, 15 bp, Homo sapiens
gagcgaggaaaggat

SEQ ID NO: 5033486 - DNA, 16 bp, Homo sapiens
gagcgtgagctgagca

SEQ ID NO: 5033487 - DNA, 17 bp, Homo sapiens
gagcgtgagctgagcag

SEQ ID NO: 5033488 - DNA, 19 bp, Homo sapiens
gagcgtgagctgagcaggc

SEQ ID NO: 5033489 - DNA, 19 bp, Homo sapiens
gagctctgtgggtctctgg

SEQ ID NO: 5033490 - DNA, 19 bp, Homo sapiens
gagctgccgacttggagac

SEQ ID NO: 5033491 - DNA, 22 bp, Homo sapiens
gagctggatagacttgggatgg

SEQ ID NO: 5033492 - DNA, 18 bp, Homo sapiens
gagctggccaaagagcct

SEQ ID NO: 5033493 - DNA, 22 bp, Homo sapiens
gagctggccaaagagcctttcc

SEQ ID NO: 5033494 - DNA, 20 bp, Homo sapiens
gagctgggagaccctcccca

SEQ ID NO: 5033495 - DNA, 13 bp, Homo sapiens
gagctggggacct

SEQ ID NO: 5033496 - DNA, 15 bp, Homo sapiens
gagctggggacctgg

SEQ ID NO: 5033497 - DNA, 15 bp, Homo sapiens
gagcttaaaatacaa

SEQ ID NO: 5033498 - DNA, 18 bp, Homo sapiens
gagcttgctccagattct

SEQ ID NO: 5033499 - DNA, 13 bp, Homo sapiens
gaggaaaggattt

SEQ ID NO: 5033500 - DNA, 14 bp, Homo sapiens
gaggaaaggatttt

SEQ ID NO: 5033501 - DNA, 14 bp, Homo sapiens
gaggacaggcggga

SEQ ID NO: 5033502 - DNA, 15 bp, Homo sapiens
gaggagccccagcta

SEQ ID NO: 5033503 - DNA, 13 bp, Homo sapiens
gaggagctgggcc

SEQ ID NO: 5033504 - DNA, 21 bp, Homo sapiens
gaggaggtgtgaggaggaggc

SEQ ID NO: 5033505 - DNA, 15 bp, Homo sapiens
gaggaggtttgcctg

SEQ ID NO: 5033506 - DNA, 20 bp, Homo sapiens
gaggcagatgtggggctgag

SEQ ID NO: 5033507 - DNA, 22 bp, Homo sapiens
gaggcagtacctgggcaagctg

SEQ ID NO: 5033508 - DNA, 17 bp, Homo sapiens
gaggccagtacctttcc

SEQ ID NO: 5033509 - DNA, 19 bp, Homo sapiens
gaggctgacgtgtgaggga

SEQ ID NO: 5033510 - DNA, 23 bp, Homo sapiens
gaggctgcttcccagaggagcag

SEQ ID NO: 5033511 - DNA, 21 bp, Homo sapiens
gagggagttttgtctgtctcc

SEQ ID NO: 5033512 - DNA, 16 bp, Homo sapiens
gagggcaggcttgggg

SEQ ID NO: 5033513 - DNA, 20 bp, Homo sapiens
gagggcaggcttggggaaaa

SEQ ID NO: 5033514 - DNA, 22 bp, Homo sapiens
gagggcctcaaaggcccgctct

SEQ ID NO: 5033515 - DNA, 12 bp, Homo sapiens
gaggggcagcct

SEQ ID NO: 5033516 - DNA, 23 bp, Homo sapiens
gaggtccagccctggctgaagga

SEQ ID NO: 5033517 - DNA, 12 bp, Homo sapiens
gaggtctgttta

SEQ ID NO: 5033518 - DNA, 13 bp, Homo sapiens
gaggtctgtttaa

SEQ ID NO: 5033519 - DNA, 21 bp, Homo sapiens
gaggtgcctgtcccaccccca

SEQ ID NO: 5033520 - DNA, 19 bp, Homo sapiens
gaggtgcgtgttcagcaga

SEQ ID NO: 5033521 - DNA, 24 bp, Homo sapiens
gaggtgcgtgttcagcagaacctg

SEQ ID NO: 5033522 - DNA, 13 bp, Homo sapiens
gaggtggagaaaa

SEQ ID NO: 5033523 - DNA, 15 bp, Homo sapiens
gaggtggagaaaatt

SEQ ID NO: 5033524 - DNA, 14 bp, Homo sapiens
gaggttgggtgggc

SEQ ID NO: 5033525 - DNA, 23 bp, Homo sapiens
gaggtttgtcgggcaccagccag

SEQ ID NO: 5033526 - DNA, 19 bp, Homo sapiens
gagtaactggttgctgtgt

SEQ ID NO: 5033527 - DNA, 13 bp, Homo sapiens
gagtaatcaatct

SEQ ID NO: 5033528 - DNA, 14 bp, Homo sapiens
gagtcaaagctgac

SEQ ID NO: 5033529 - DNA, 14 bp, Homo sapiens
gagtcatttaaatg

SEQ ID NO: 5033530 - DNA, 16 bp, Homo sapiens
gagtcatttaaatgtg

SEQ ID NO: 5033531 - DNA, 11 bp, Homo sapiens
gagtcccctca

SEQ ID NO: 5033532 - DNA, 19 bp, Homo sapiens
gagtcccctcacctcctct

SEQ ID NO: 5033533 - DNA, 20 bp, Homo sapiens
gagtccgtggttgccctaga

SEQ ID NO: 5033534 - DNA, 12 bp, Homo sapiens
gagtgacagctt

SEQ ID NO: 5033535 - DNA, 16 bp, Homo sapiens
gagtgacagctttctg

SEQ ID NO: 5033536 - DNA, 22 bp, Homo sapiens
gagtgcagtggcgcaatcttaa

SEQ ID NO: 5033537 - DNA, 15 bp, Homo sapiens
gagtgctgttttgtt

SEQ ID NO: 5033538 - DNA, 21 bp, Homo sapiens
gagtggggttatctctgtgtt

SEQ ID NO: 5033539 - DNA, 12 bp, Homo sapiens
gagttcaccttg

SEQ ID NO: 5033540 - DNA, 17 bp, Homo sapiens
gagttcaccttggaagg

SEQ ID NO: 5033541 - DNA, 22 bp, Homo sapiens
gagtttagggaacaatttggca

SEQ ID NO: 5033542 - DNA, 18 bp, Homo sapiens
gagtttatgttccattaa

SEQ ID NO: 5033543 - DNA, 13 bp, Homo sapiens
gagtttctgtttg

SEQ ID NO: 5033544 - DNA, 14 bp, Homo sapiens
gataaacacaagat

SEQ ID NO: 5033545 - DNA, 22 bp, Homo sapiens
gataaattaacctctcacagtt

SEQ ID NO: 5033546 - DNA, 18 bp, Homo sapiens
gataactgttatttataa

SEQ ID NO: 5033547 - DNA, 17 bp, Homo sapiens
gcatcatagtagttttt

SEQ ID NO: 5033548 - DNA, 21 bp, Homo sapiens
gcatggaaggggcttctggac

SEQ ID NO: 5033549 - DNA, 16 bp, Homo sapiens
gcatgtatgacgtgac

SEQ ID NO: 5033550 - DNA, 15 bp, Homo sapiens
gcatgtcccacccac

SEQ ID NO: 5033551 - DNA, 16 bp, Homo sapiens
gcatgtcccacccacc

SEQ ID NO: 5033552 - DNA, 16 bp, Homo sapiens
gcatgtttagacttta

SEQ ID NO: 5033553 - DNA, 15 bp, Homo sapiens
gcatgtttgaaatga

SEQ ID NO: 5033554 - DNA, 20 bp, Homo sapiens
gcatttaacccccctgtaca

SEQ ID NO: 5033555 - DNA, 18 bp, Homo sapiens
gcatttgtttatgtaatt

SEQ ID NO: 5033556 - DNA, 13 bp, Homo sapiens
gccaaataaagtc

SEQ ID NO: 5033557 - DNA, 16 bp, Homo sapiens
gccaaattaaaaaaga

SEQ ID NO: 5033558 - DNA, 22 bp, Homo sapiens
gccaaattaaaaaagataaaca

SEQ ID NO: 5033559 - DNA, 14 bp, Homo sapiens
gccaagactcctca

SEQ ID NO: 5033560 - DNA, 22 bp, Homo sapiens
gccacccaagcctgctggctgc

SEQ ID NO: 5033561 - DNA, 21 bp, Homo sapiens
gccacccgtggggtgctgccc

SEQ ID NO: 5033562 - DNA, 19 bp, Homo sapiens
gccaccctgcctctaccca

SEQ ID NO: 5033563 - DNA, 14 bp, Homo sapiens
cgttgtgagctgga

SEQ ID NO: 5033564 - DNA, 11 bp, Homo sapiens
ctaaaaccatt

SEQ ID NO: 5033565 - DNA, 17 bp, Homo sapiens
ctaaaaccattccattt

SEQ ID NO: 5033566 - DNA, 18 bp, Homo sapiens
ctaaaatatataatttat

SEQ ID NO: 5033567 - DNA, 16 bp, Homo sapiens
ctaaaggagtttatgt

SEQ ID NO: 5033568 - DNA, 16 bp, Homo sapiens
ctaaatatggactgct

SEQ ID NO: 5033569 - DNA, 13 bp, Homo sapiens
ctaaccttgcctg

SEQ ID NO: 5033570 - DNA, 16 bp, Homo sapiens
ctaaccttgcctggta

SEQ ID NO: 5033571 - DNA, 17 bp, Homo sapiens
ctaaccttgcctggtac

SEQ ID NO: 5033572 - DNA, 20 bp, Homo sapiens
ctaaccttgcctggtacagt

SEQ ID NO: 5033573 - DNA, 22 bp, Homo sapiens
ctaacgttgagcccctggaggc

SEQ ID NO: 5033574 - DNA, 19 bp, Homo sapiens
ctaactacaaaggtttaaa

SEQ ID NO: 5033575 - DNA, 23 bp, Homo sapiens
ctaactacaaaggtttaaatgaa

SEQ ID NO: 5033576 - DNA, 14 bp, Homo sapiens
ctaagtaaatacaa

SEQ ID NO: 5033577 - DNA, 19 bp, Homo sapiens
ctaagtaaatacaattttt

SEQ ID NO: 5033578 - DNA, 13 bp, Homo sapiens
cttaaataataaa

SEQ ID NO: 5033579 - DNA, 20 bp, Homo sapiens
cttaagtgagcagaacaggt

SEQ ID NO: 5033580 - DNA, 22 bp, Homo sapiens
cttaagtgagcagaacaggtag

SEQ ID NO: 5033581 - DNA, 14 bp, Homo sapiens
cttaatatatttga

SEQ ID NO: 5033582 - DNA, 15 bp, Homo sapiens
cttaattattatttg

SEQ ID NO: 5033583 - DNA, 14 bp, Homo sapiens
cttaattctctgca

SEQ ID NO: 5033584 - DNA, 22 bp, Homo sapiens
cttacatttacaaactgaagag

SEQ ID NO: 5033585 - DNA, 11 bp, Homo sapiens
cttagaaaacc

SEQ ID NO: 5033586 - DNA, 23 bp, Homo sapiens
cttagaaaaccagctcagcactg

SEQ ID NO: 5033587 - DNA, 24 bp, Homo sapiens
cttagaaaaccagctcagcactgc

SEQ ID NO: 5033588 - DNA, 14 bp, Homo sapiens
cttagagtttctgt

SEQ ID NO: 5033589 - DNA, 23 bp, Homo sapiens
cttagagtttctgtttgattctt

SEQ ID NO: 5033590 - DNA, 18 bp, Homo sapiens
cttagcagtccccttccc

SEQ ID NO: 5033591 - DNA, 18 bp, Homo sapiens
cttagctcaatgagcatg

SEQ ID NO: 5033592 - DNA, 13 bp, Homo sapiens
cttagtctcagtt

SEQ ID NO: 5033593 - DNA, 20 bp, Homo sapiens
cttagtctcagtttgtgtgt

SEQ ID NO: 5033594 - DNA, 18 bp, Homo sapiens
cttatacgaaataattgt

SEQ ID NO: 5033595 - DNA, 20 bp, Homo sapiens
cttatacgaaataattgttg

SEQ ID NO: 5033596 - DNA, 21 bp, Homo sapiens
cttatacgaaataattgttgt

SEQ ID NO: 5033597 - DNA, 22 bp, Homo sapiens
cttatacgaaataattgttgtt

SEQ ID NO: 5033598 - DNA, 16 bp, Homo sapiens
cttatggatgtcccca

SEQ ID NO: 5033599 - DNA, 20 bp, Homo sapiens
cttatggatgtccccagcag

SEQ ID NO: 5033600 - DNA, 16 bp, Homo sapiens
cttattgcgctgctac

SEQ ID NO: 5033601 - DNA, 18 bp, Homo sapiens
cttcacctaagtctctgt

SEQ ID NO: 5033602 - DNA, 23 bp, Homo sapiens
cttcagtaccctctcagctccag

SEQ ID NO: 5033603 - DNA, 15 bp, Homo sapiens
cttcagttgtctctg

SEQ ID NO: 5033604 - DNA, 20 bp, Homo sapiens
cttcagttgtctctgatgca

SEQ ID NO: 5033605 - DNA, 22 bp, Homo sapiens
cttcatagatgcaggaggctca

SEQ ID NO: 5033606 - DNA, 16 bp, Homo sapiens
cttcatgccagctact

SEQ ID NO: 5033607 - DNA, 22 bp, Homo sapiens
cttcattctccttgttgttggt

SEQ ID NO: 5033608 - DNA, 12 bp, Homo sapiens
cttccagctcct

SEQ ID NO: 5033609 - DNA, 15 bp, Homo sapiens
cttccaggctgggca

SEQ ID NO: 5033610 - DNA, 15 bp, Homo sapiens
cttcccatcgctgtc

SEQ ID NO: 5033611 - DNA, 18 bp, Homo sapiens
cttccctgcgcctgtgat

SEQ ID NO: 5033612 - DNA, 17 bp, Homo sapiens
cttcctccgaggccagt

SEQ ID NO: 5033613 - DNA, 16 bp, Homo sapiens
cttcctcctccccact

SEQ ID NO: 5033614 - DNA, 20 bp, Homo sapiens
cttcctgccagcccctgcca

SEQ ID NO: 5033615 - DNA, 16 bp, Homo sapiens
cttcctttaaaaaact

SEQ ID NO: 5033616 - DNA, 17 bp, Homo sapiens
cttcgacactgttctta

SEQ ID NO: 5033617 - DNA, 18 bp, Homo sapiens
cttctaagtaaatacaat

SEQ ID NO: 5033618 - DNA, 23 bp, Homo sapiens
cttctcggcttggatcctgggct

SEQ ID NO: 5033619 - DNA, 13 bp, Homo sapiens
cttctctgcccac

SEQ ID NO: 5033620 - DNA, 13 bp, Homo sapiens
cttctcttgcttt

SEQ ID NO: 5033621 - DNA, 21 bp, Homo sapiens
cttctgagcagcgagcctgct

SEQ ID NO: 5033622 - DNA, 12 bp, Homo sapiens
cttctgcctgca

SEQ ID NO: 5033623 - DNA, 13 bp, Homo sapiens
cttctgtgtatct

SEQ ID NO: 5033624 - DNA, 16 bp, Homo sapiens
cttcttcatattctaa

SEQ ID NO: 5033625 - DNA, 22 bp, Homo sapiens
cttgaggacttgggcgggacac

SEQ ID NO: 5033626 - DNA, 23 bp, Homo sapiens
cttgaggggaagctagtcttttg

SEQ ID NO: 5033627 - DNA, 21 bp, Homo sapiens
cttgagtggggttatctctgt

SEQ ID NO: 5033628 - DNA, 22 bp, Homo sapiens
cttgagtggggttatctctgtg

SEQ ID NO: 5033629 - DNA, 16 bp, Homo sapiens
cttgatacccccctct

SEQ ID NO: 5033630 - DNA, 17 bp, Homo sapiens
cttgatacccccctctg

SEQ ID NO: 5033631 - DNA, 20 bp, Homo sapiens
cttgatacccccctctgtct

SEQ ID NO: 5033632 - DNA, 21 bp, Homo sapiens
cttgatacccccctctgtctt

SEQ ID NO: 5033633 - DNA, 19 bp, Homo sapiens
cttgatttaaacacacaga

SEQ ID NO: 5033634 - DNA, 14 bp, Homo sapiens
cttgcaagaatcag

SEQ ID NO: 5033635 - DNA, 20 bp, Homo sapiens
cttgccaagggtccctgtgt

SEQ ID NO: 5033636 - DNA, 17 bp, Homo sapiens
cttgccccactctgcct

SEQ ID NO: 5033637 - DNA, 23 bp, Homo sapiens
cttgcccccatttcacccatggg

SEQ ID NO: 5033638 - DNA, 12 bp, Homo sapiens
cttgctccagat

SEQ ID NO: 5033639 - DNA, 15 bp, Homo sapiens
cttgctccagattct

SEQ ID NO: 5033640 - DNA, 16 bp, Homo sapiens
cttgctccagattctg

SEQ ID NO: 5033641 - DNA, 20 bp, Homo sapiens
cttgctccagattctgatgc

SEQ ID NO: 5033642 - DNA, 21 bp, Homo sapiens
cttgctccagattctgatgca

SEQ ID NO: 5033643 - DNA, 14 bp, Homo sapiens
cttgcttttcatgc

SEQ ID NO: 5033644 - DNA, 18 bp, Homo sapiens
cttgcttttcatgcaaac

SEQ ID NO: 5033645 - DNA, 15 bp, Homo sapiens
cttggacacgctcag

SEQ ID NO: 5033646 - DNA, 16 bp, Homo sapiens
cttggatcctgggctg

SEQ ID NO: 5033647 - DNA, 16 bp, Homo sapiens
cttggattctttccat

SEQ ID NO: 5033648 - DNA, 19 bp, Homo sapiens
cttggctcttggtacctgt

SEQ ID NO: 5033649 - DNA, 12 bp, Homo sapiens
cttgtaaatata

SEQ ID NO: 5033650 - DNA, 13 bp, Homo sapiens
cttgtaaatataa

SEQ ID NO: 5033651 - DNA, 16 bp, Homo sapiens
cttgtaaatataaaga

SEQ ID NO: 5033652 - DNA, 17 bp, Homo sapiens
cttgtcaggagtgtgtg

SEQ ID NO: 5033653 - DNA, 21 bp, Homo sapiens
cttgtcaggagtgtgtgtgag

SEQ ID NO: 5033654 - DNA, 20 bp, Homo sapiens
cttgtcttattcccttcctg

SEQ ID NO: 5033655 - DNA, 18 bp, Homo sapiens
cttgtgacagtgcctctt

SEQ ID NO: 5033656 - DNA, 19 bp, Homo sapiens
cttgtgacagtgcctcttc

SEQ ID NO: 5033657 - DNA, 20 bp, Homo sapiens
cttgtgacagtgcctcttcc

SEQ ID NO: 5033658 - DNA, 20 bp, Homo sapiens
cttgttgttggttgtttttt

SEQ ID NO: 5033659 - DNA, 14 bp, Homo sapiens
ctttaaatggaaac

SEQ ID NO: 5033660 - DNA, 14 bp, Homo sapiens
ctttaatataaatg

SEQ ID NO: 5033661 - DNA, 19 bp, Homo sapiens
ctttaatataaatgcaaat

SEQ ID NO: 5033662 - DNA, 20 bp, Homo sapiens
ctttaatataaatgcaaata

SEQ ID NO: 5033663 - DNA, 19 bp, Homo sapiens
ctttaatatcatcagtatt

SEQ ID NO: 5033664 - DNA, 16 bp, Homo sapiens
ctttatgtaataatgt

SEQ ID NO: 5033665 - DNA, 13 bp, Homo sapiens
ctttcacagctcc

SEQ ID NO: 5033666 - DNA, 21 bp, Homo sapiens
ctttccggtgtttaagacatt

SEQ ID NO: 5033667 - DNA, 20 bp, Homo sapiens
ctttcctggacactcagacc

SEQ ID NO: 5033668 - DNA, 23 bp, Homo sapiens
ctttcctggacactcagacctga

SEQ ID NO: 5033669 - DNA, 19 bp, Homo sapiens
ctttctccctcaactgaag

SEQ ID NO: 5033670 - DNA, 17 bp, Homo sapiens
ctttctttgcaccaaag

SEQ ID NO: 5033671 - DNA, 18 bp, Homo sapiens
ctttctttgcaccaaaga

SEQ ID NO: 5033672 - DNA, 23 bp, Homo sapiens
ctttcttttttggccatctgctc

SEQ ID NO: 5033673 - DNA, 13 bp, Homo sapiens
ctttgaaaagttg

SEQ ID NO: 5033674 - DNA, 17 bp, Homo sapiens
ctttgaaaagttggaag

SEQ ID NO: 5033675 - DNA, 16 bp, Homo sapiens
ctttgaaggggcctca

SEQ ID NO: 5033676 - DNA, 16 bp, Homo sapiens
ctttgcaccaaagaca

SEQ ID NO: 5033677 - DNA, 15 bp, Homo sapiens
ctttgcgcctgtgac

SEQ ID NO: 5033678 - DNA, 19 bp, Homo sapiens
ctttgctttaatataaatg

SEQ ID NO: 5033679 - DNA, 22 bp, Homo sapiens
ctttggagtcccctcacctcct

SEQ ID NO: 5033680 - DNA, 21 bp, Homo sapiens
ctttggccccactttgaaggg

SEQ ID NO: 5033681 - DNA, 15 bp, Homo sapiens
cttttaaagaaaaaa

SEQ ID NO: 5033682 - DNA, 21 bp, Homo sapiens
cttttaaagaaaaaaattgaa

SEQ ID NO: 5033683 - DNA, 19 bp, Homo sapiens
cttttataggtgagaaaaa

SEQ ID NO: 5033684 - DNA, 19 bp, Homo sapiens
cttttcatgcaaactcttt

SEQ ID NO: 5033685 - DNA, 21 bp, Homo sapiens
cttttctagcccgaatacaaa

SEQ ID NO: 5033686 - DNA, 16 bp, Homo sapiens
cttttgcccattttga

SEQ ID NO: 5033687 - DNA, 16 bp, Homo sapiens
cttttgcttttgccca

SEQ ID NO: 5033688 - DNA, 18 bp, Homo sapiens
cttttgcttttgcccatt

SEQ ID NO: 5033689 - DNA, 22 bp, Homo sapiens
cttttgtgatggagtgctgttt

SEQ ID NO: 5033690 - DNA, 21 bp, Homo sapiens
cctgggacatcaggagactgg

SEQ ID NO: 5033691 - DNA, 19 bp, Homo sapiens
cctgggctgggtggcccct

SEQ ID NO: 5033692 - DNA, 21 bp, Homo sapiens
cctgggctgggtggcccctgt

SEQ ID NO: 5033693 - DNA, 20 bp, Homo sapiens
cctgtactgttctgtgtctt

SEQ ID NO: 5033694 - DNA, 15 bp, Homo sapiens
cctgtcagtagtgga

SEQ ID NO: 5033695 - DNA, 22 bp, Homo sapiens
cctgtccacacccagctcagca

SEQ ID NO: 5033696 - DNA, 14 bp, Homo sapiens
cctgtccacaggct

SEQ ID NO: 5033697 - DNA, 17 bp, Homo sapiens
cctgtccaccctgccaa

SEQ ID NO: 5033698 - DNA, 17 bp, Homo sapiens
cctgtcccacccccacc

SEQ ID NO: 5033699 - DNA, 16 bp, Homo sapiens
cctgtccggcccagtg

SEQ ID NO: 5033700 - DNA, 17 bp, Homo sapiens
cctgtcctgcctaaggc

SEQ ID NO: 5033701 - DNA, 19 bp, Homo sapiens
cctgtcctgcctaaggctg

SEQ ID NO: 5033702 - DNA, 15 bp, Homo sapiens
cctgtcctggtggta

SEQ ID NO: 5033703 - DNA, 17 bp, Homo sapiens
cctgtgaactgaactct

SEQ ID NO: 5033704 - DNA, 20 bp, Homo sapiens
cctgtgtgttaagctctgct

SEQ ID NO: 5033705 - DNA, 20 bp, Homo sapiens
ccttaagtgatttgcctgta

SEQ ID NO: 5033706 - DNA, 20 bp, Homo sapiens
ccttaccactgctctgatga

SEQ ID NO: 5033707 - DNA, 14 bp, Homo sapiens
ccttagtctcagtt

SEQ ID NO: 5033708 - DNA, 20 bp, Homo sapiens
ccttagtctcagtttgtgtg

SEQ ID NO: 5033709 - DNA, 15 bp, Homo sapiens
ccttcaaagcaaatg

SEQ ID NO: 5033710 - DNA, 23 bp, Homo sapiens
ccctgcgggcgcgggcagccacc

SEQ ID NO: 5033711 - DNA, 15 bp, Homo sapiens
ccctgctgtctctct

SEQ ID NO: 5033712 - DNA, 20 bp, Homo sapiens
ccctgctgtctctctgggct

SEQ ID NO: 5033713 - DNA, 12 bp, Homo sapiens
ccctggagccca

SEQ ID NO: 5033714 - DNA, 17 bp, Homo sapiens
ccctggcctttcatatt

SEQ ID NO: 5033715 - DNA, 14 bp, Homo sapiens
ccctggctctgggc

SEQ ID NO: 5033716 - DNA, 18 bp, Homo sapiens
ccctgggagggacatgct

SEQ ID NO: 5033717 - DNA, 17 bp, Homo sapiens
ccctggtcctggcctcc

SEQ ID NO: 5033718 - DNA, 18 bp, Homo sapiens
ccctggtcctggcctcct

SEQ ID NO: 5033719 - DNA, 13 bp, Homo sapiens
ccctgtcctggtg

SEQ ID NO: 5033720 - DNA, 23 bp, Homo sapiens
ccctgtcctggtggtattttcaa

SEQ ID NO: 5033721 - DNA, 17 bp, Homo sapiens
ccctgttctcctcccca

SEQ ID NO: 5033722 - DNA, 17 bp, Homo sapiens
cccttcagtaccctctc

SEQ ID NO: 5033723 - DNA, 20 bp, Homo sapiens
cccttcagtaccctctcagc

SEQ ID NO: 5033724 - DNA, 16 bp, Homo sapiens
cccttggacacgctca

SEQ ID NO: 5033725 - DNA, 15 bp, Homo sapiens
cccttttccagcctc

SEQ ID NO: 5033726 - DNA, 16 bp, Homo sapiens
ccctttttctccagct

SEQ ID NO: 5033727 - DNA, 13 bp, Homo sapiens
ccgaatgtgtctt

SEQ ID NO: 5033728 - DNA, 20 bp, Homo sapiens
ccgagacagaccctctgccg

SEQ ID NO: 5033729 - DNA, 14 bp, Homo sapiens
ccgcacagccaccc

SEQ ID NO: 5033730 - DNA, 12 bp, Homo sapiens
ccgcactctgcc

SEQ ID NO: 5033731 - DNA, 20 bp, Homo sapiens
ccgcaggaactgggctgggc

SEQ ID NO: 5033732 - DNA, 22 bp, Homo sapiens
ccgccagctgccgcaccagccc

SEQ ID NO: 5033733 - DNA, 23 bp, Homo sapiens
ccgcccacaggaagcctgcagtc

SEQ ID NO: 5033734 - DNA, 14 bp, Homo sapiens
ccgccgcctcccac

SEQ ID NO: 5033735 - DNA, 18 bp, Homo sapiens
ccgctctacatcttctgc

SEQ ID NO: 5033736 - DNA, 17 bp, Homo sapiens
cattctcattggaaatt

SEQ ID NO: 5033737 - DNA, 22 bp, Homo sapiens
cattctcattggaaatttagca

SEQ ID NO: 5033738 - DNA, 13 bp, Homo sapiens
cattctgaatgct

SEQ ID NO: 5033739 - DNA, 16 bp, Homo sapiens
cattctgaatgcttct

SEQ ID NO: 5033740 - DNA, 21 bp, Homo sapiens
cattgccttctctgcccacag

SEQ ID NO: 5033741 - DNA, 19 bp, Homo sapiens
cattgctggtagagacccc

SEQ ID NO: 5033742 - DNA, 18 bp, Homo sapiens
cattggaaatttagcatt

SEQ ID NO: 5033743 - DNA, 18 bp, Homo sapiens
cattggttcttgtattaa

SEQ ID NO: 5033744 - DNA, 22 bp, Homo sapiens
cattggttcttgtattaagaat

SEQ ID NO: 5033745 - DNA, 14 bp, Homo sapiens
cattgtttgctgct

SEQ ID NO: 5033746 - DNA, 16 bp, Homo sapiens
cattgtttgctgctat

SEQ ID NO: 5033747 - DNA, 21 bp, Homo sapiens
catttaaatgtgtacaatgta

SEQ ID NO: 5033748 - DNA, 23 bp, Homo sapiens
catttaacccccctgtacacaac

SEQ ID NO: 5033749 - DNA, 19 bp, Homo sapiens
catttacaaactgaagagt

SEQ ID NO: 5033750 - DNA, 16 bp, Homo sapiens
catttcaattcctggc

SEQ ID NO: 5033751 - DNA, 19 bp, Homo sapiens
catttcacttgtcaggagt

SEQ ID NO: 5033752 - DNA, 23 bp, Homo sapiens
catttcatacaacagaaaccaga

SEQ ID NO: 5033753 - DNA, 20 bp, Homo sapiens
catttctagcgcatggcctg

SEQ ID NO: 5033754 - DNA, 23 bp, Homo sapiens
catttcttctacaactcatacac

SEQ ID NO: 5033755 - DNA, 18 bp, Homo sapiens
catttgccaagggaggcg

SEQ ID NO: 5033756 - DNA, 15 bp, Homo sapiens
catttggtctcaggc

SEQ ID NO: 5033757 - DNA, 16 bp, Homo sapiens
catttggtctcaggca

SEQ ID NO: 5033758 - DNA, 22 bp, Homo sapiens
catttggtgagagtcaaagctg

SEQ ID NO: 5033759 - DNA, 19 bp, Homo sapiens
catttgtttatgtaatttc

SEQ ID NO: 5033760 - DNA, 13 bp, Homo sapiens
cattttaaaaaca

SEQ ID NO: 5033761 - DNA, 13 bp, Homo sapiens
cattttataaatc

SEQ ID NO: 5033762 - DNA, 15 bp, Homo sapiens
cattttattttcatg

SEQ ID NO: 5033763 - DNA, 20 bp, Homo sapiens
cattttcttattgcgctgct

SEQ ID NO: 5033764 - DNA, 16 bp, Homo sapiens
ccaaaagggaggctct

SEQ ID NO: 5033765 - DNA, 17 bp, Homo sapiens
ccaaacctctgtgagca

SEQ ID NO: 5033766 - DNA, 14 bp, Homo sapiens
ccaaactggagctt

SEQ ID NO: 5033767 - DNA, 13 bp, Homo sapiens
ccaaaggctggtg

SEQ ID NO: 5033768 - DNA, 12 bp, Homo sapiens
ccaaatgcagct

SEQ ID NO: 5033769 - DNA, 13 bp, Homo sapiens
ccaacaaaccatc

SEQ ID NO: 5033770 - DNA, 15 bp, Homo sapiens
ccaacggcaacagca

SEQ ID NO: 5033771 - DNA, 18 bp, Homo sapiens
ccaactgcctaaggccct

SEQ ID NO: 5033772 - DNA, 20 bp, Homo sapiens
ccaacttctcttgctttcta

SEQ ID NO: 5033773 - DNA, 14 bp, Homo sapiens
cagatacacacaca

SEQ ID NO: 5033774 - DNA, 18 bp, Homo sapiens
cagatctttctccttgaa

SEQ ID NO: 5033775 - DNA, 13 bp, Homo sapiens
cagatgttttgat

SEQ ID NO: 5033776 - DNA, 14 bp, Homo sapiens
cagatgttttgatg

SEQ ID NO: 5033777 - DNA, 12 bp, Homo sapiens
cagcaaaccatt

SEQ ID NO: 5033778 - DNA, 15 bp, Homo sapiens
cagcaatttcagaac

SEQ ID NO: 5033779 - DNA, 14 bp, Homo sapiens
cagcaccacactgg

SEQ ID NO: 5033780 - DNA, 22 bp, Homo sapiens
cagcaccacactgggtgcgtct

SEQ ID NO: 5033781 - DNA, 18 bp, Homo sapiens
cagcactgcctgctccca

SEQ ID NO: 5033782 - DNA, 17 bp, Homo sapiens
cagcagaacctgcacac

SEQ ID NO: 5033783 - DNA, 18 bp, Homo sapiens
cagcagaacctgcacaca

SEQ ID NO: 5033784 - DNA, 21 bp, Homo sapiens
cagcagaacctgcacacagga

SEQ ID NO: 5033785 - DNA, 24 bp, Homo sapiens
cagcagaacctgcacacaggacag

SEQ ID NO: 5033786 - DNA, 23 bp, Homo sapiens
cagcagagaggtttgcagtccca

SEQ ID NO: 5033787 - DNA, 20 bp, Homo sapiens
cagcatttccacaccaagca

SEQ ID NO: 5033788 - DNA, 23 bp, Homo sapiens
cagcatttccacaccaagcagca

SEQ ID NO: 5033789 - DNA, 19 bp, Homo sapiens
cagccacccaagcctgctg

SEQ ID NO: 5033790 - DNA, 15 bp, Homo sapiens
cagcccgctgagtgg

SEQ ID NO: 5033791 - DNA, 15 bp, Homo sapiens
cagccctggctgaag

SEQ ID NO: 5033792 - DNA, 16 bp, Homo sapiens
cagccgtattttacat

SEQ ID NO: 5033793 - DNA, 20 bp, Homo sapiens
cagcctactccgctcactga

SEQ ID NO: 5033794 - DNA, 12 bp, Homo sapiens
cagcctcccaca

SEQ ID NO: 5033795 - DNA, 13 bp, Homo sapiens
cagcctctggcat

SEQ ID NO: 5033796 - DNA, 14 bp, Homo sapiens
cagcctgtgcctgc

SEQ ID NO: 5033797 - DNA, 17 bp, Homo sapiens
cagcctgtgcctgcctt

SEQ ID NO: 5033798 - DNA, 14 bp, Homo sapiens
cagcgagcctgcta

SEQ ID NO: 5033799 - DNA, 17 bp, Homo sapiens
cagcggagtctgtcctg

SEQ ID NO: 5033800 - DNA, 13 bp, Homo sapiens
cagcgggcaggtt

SEQ ID NO: 5033801 - DNA, 21 bp, Homo sapiens
cagctacttcctcctccccac

SEQ ID NO: 5033802 - DNA, 21 bp, Homo sapiens
cagctccaggtggctctgagg

SEQ ID NO: 5033803 - DNA, 14 bp, Homo sapiens
cagctccattttct

SEQ ID NO: 5033804 - DNA, 14 bp, Homo sapiens
cagctctccccagg

SEQ ID NO: 5033805 - DNA, 19 bp, Homo sapiens
cagctgccaggagcacggc

SEQ ID NO: 5033806 - DNA, 16 bp, Homo sapiens
cagctgccgcaccagc

SEQ ID NO: 5033807 - DNA, 13 bp, Homo sapiens
cagctgctcccca

SEQ ID NO: 5033808 - DNA, 15 bp, Homo sapiens
cagctgttttgttga

SEQ ID NO: 5033809 - DNA, 17 bp, Homo sapiens
cagctgttttgttgaca

SEQ ID NO: 5033810 - DNA, 16 bp, Homo sapiens
cagcttcagaaagagc

SEQ ID NO: 5033811 - DNA, 18 bp, Homo sapiens
caggaactgggctgggcc

SEQ ID NO: 5033812 - DNA, 14 bp, Homo sapiens
caggaagcagcttt

SEQ ID NO: 5033813 - DNA, 19 bp, Homo sapiens
caggaagcctgcagtcctg

SEQ ID NO: 5033814 - DNA, 14 bp, Homo sapiens
caggacagcgggaa

SEQ ID NO: 5033815 - DNA, 19 bp, Homo sapiens
caggactttgaggcaagtg

SEQ ID NO: 5033816 - DNA, 19 bp, Homo sapiens
caggagaagggctggggcc

SEQ ID NO: 5033817 - DNA, 19 bp, Homo sapiens
caggagcacggctctgtcc

SEQ ID NO: 5033818 - DNA, 20 bp, Homo sapiens
caggaggccctggtcctggc

SEQ ID NO: 5033819 - DNA, 19 bp, Homo sapiens
caggatgtacaaggacagc

SEQ ID NO: 5033820 - DNA, 22 bp, Homo sapiens
caggcaacgcacaaaacagaaa

SEQ ID NO: 5033821 - DNA, 15 bp, Homo sapiens
caggcacacagggcc

SEQ ID NO: 5033822 - DNA, 16 bp, Homo sapiens
caggcacacagggccc

SEQ ID NO: 5033823 - DNA, 23 bp, Homo sapiens
caggcagcagagacttgggacat

SEQ ID NO: 5033824 - DNA, 19 bp, Homo sapiens
caggcattggctcagcccg

SEQ ID NO: 5033825 - DNA, 21 bp, Homo sapiens
caggcattggctcagcccgct

SEQ ID NO: 5033826 - DNA, 19 bp, Homo sapiens
caggccaccccgctgatgg

SEQ ID NO: 5033827 - DNA, 17 bp, Homo sapiens
caggccaccctgcctct

SEQ ID NO: 5033828 - DNA, 23 bp, Homo sapiens
caggccctgccagtggggaagga

SEQ ID NO: 5033829 - DNA, 17 bp, Homo sapiens
caggccctgtggcagga

SEQ ID NO: 5033830 - DNA, 15 bp, Homo sapiens
caggcctcttggcag

SEQ ID NO: 5033831 - DNA, 14 bp, Homo sapiens
caggctggtctcga

SEQ ID NO: 5033832 - DNA, 13 bp, Homo sapiens
caggcttggggaa

SEQ ID NO: 5033833 - DNA, 17 bp, Homo sapiens
cagggacatgccctgtg

SEQ ID NO: 5033834 - DNA, 16 bp, Homo sapiens
cagggaccacaccctg

SEQ ID NO: 5033835 - DNA, 24 bp, Homo sapiens
cagggaccactgggtgagagagga

SEQ ID NO: 5033836 - DNA, 14 bp, Homo sapiens
cagggccatgcaga

SEQ ID NO: 5033837 - DNA, 15 bp, Homo sapiens
cagggccatgcagac

SEQ ID NO: 5033838 - DNA, 22 bp, Homo sapiens
cagggcccggccacacccagcg

SEQ ID NO: 5033839 - DNA, 13 bp, Homo sapiens
caggggagaggca

SEQ ID NO: 5033840 - DNA, 19 bp, Homo sapiens
caggtaggaagcaacagct

SEQ ID NO: 5033841 - DNA, 22 bp, Homo sapiens
caggtgatctgtttgaggagag

SEQ ID NO: 5033842 - DNA, 19 bp, Homo sapiens
caggtgccgccagctgccg

SEQ ID NO: 5033843 - DNA, 13 bp, Homo sapiens
caggtggttttta

SEQ ID NO: 5033844 - DNA, 16 bp, Homo sapiens
caggttcaacccacag

SEQ ID NO: 5033845 - DNA, 12 bp, Homo sapiens
caggtttttccc

SEQ ID NO: 5033846 - DNA, 15 bp, Homo sapiens
cagtaccctctcagc

SEQ ID NO: 5033847 - DNA, 16 bp, Homo sapiens
cagtacctgattgtat

SEQ ID NO: 5033848 - DNA, 19 bp, Homo sapiens
cagtatgggggttgtaaat

SEQ ID NO: 5033849 - DNA, 21 bp, Homo sapiens
cagtatgggggttgtaaattg

SEQ ID NO: 5033850 - DNA, 12 bp, Homo sapiens
cagtattgaagc

SEQ ID NO: 5033851 - DNA, 21 bp, Homo sapiens
cagtattgaagcattttataa

SEQ ID NO: 5033852 - DNA, 16 bp, Homo sapiens
cagtcaaatctgggct

SEQ ID NO: 5033853 - DNA, 14 bp, Homo sapiens
cagtcaagaagaaa

SEQ ID NO: 5033854 - DNA, 20 bp, Homo sapiens
cagtcaagaagaaaaaggtt

SEQ ID NO: 5033855 - DNA, 21 bp, Homo sapiens
cagtcccaagcggtgtctctc

SEQ ID NO: 5033856 - DNA, 20 bp, Homo sapiens
cagtccccgaggagctgggc

SEQ ID NO: 5033857 - DNA, 19 bp, Homo sapiens
cagtccccttccctccaag

SEQ ID NO: 5033858 - DNA, 18 bp, Homo sapiens
cagtgaacattcccagcc

SEQ ID NO: 5033859 - DNA, 21 bp, Homo sapiens
cagtgaacattcccagcccag

SEQ ID NO: 5033860 - DNA, 13 bp, Homo sapiens
cagtgccacccat

SEQ ID NO: 5033861 - DNA, 19 bp, Homo sapiens
cagtgccactgccccccga

SEQ ID NO: 5033862 - DNA, 15 bp, Homo sapiens
cagtgccctccagga

SEQ ID NO: 5033863 - DNA, 14 bp, Homo sapiens
cagtgcctcttcca

SEQ ID NO: 5033864 - DNA, 21 bp, Homo sapiens
cagtgcctcttccagtgaaca

SEQ ID NO: 5033865 - DNA, 12 bp, Homo sapiens
cagtgcctgcct

SEQ ID NO: 5033866 - DNA, 22 bp, Homo sapiens
cagtggccaagatcacagtggc

SEQ ID NO: 5033867 - DNA, 13 bp, Homo sapiens
cagtggggcagag

SEQ ID NO: 5033868 - DNA, 17 bp, Homo sapiens
cagtgtacacgtctgga

SEQ ID NO: 5033869 - DNA, 19 bp, Homo sapiens
cagtgtacacgtctggacc

SEQ ID NO: 5033870 - DNA, 23 bp, Homo sapiens
cagtgtctttttttgtatagtta

SEQ ID NO: 5033871 - DNA, 18 bp, Homo sapiens
cagtgttgagccttttcc

SEQ ID NO: 5033872 - DNA, 15 bp, Homo sapiens
cagttaagaaatttc

SEQ ID NO: 5033873 - DNA, 16 bp, Homo sapiens
cagttaagaaatttca

SEQ ID NO: 5033874 - DNA, 17 bp, Homo sapiens
cagttaagcctttggaa

SEQ ID NO: 5033875 - DNA, 18 bp, Homo sapiens
cagttatattttgcagtt

SEQ ID NO: 5033876 - DNA, 15 bp, Homo sapiens
cagtttgagacagga

SEQ ID NO: 5033877 - DNA, 20 bp, Homo sapiens
cagttttttttttcttgtct

SEQ ID NO: 5033878 - DNA, 21 bp, Homo sapiens
cagttttttttttcttgtcta

SEQ ID NO: 5033879 - DNA, 21 bp, Homo sapiens
cataaagccttggatgtatat

SEQ ID NO: 5033880 - DNA, 18 bp, Homo sapiens
cataagctatttttctaa

SEQ ID NO: 5033881 - DNA, 20 bp, Homo sapiens
cataatgctaatttaaagag

SEQ ID NO: 5033882 - DNA, 21 bp, Homo sapiens
cataatgctaatttaaagaga

SEQ ID NO: 5033883 - DNA, 16 bp, Homo sapiens
cacacagatacacaca

SEQ ID NO: 5033884 - DNA, 22 bp, Homo sapiens
cacactggtacttagagtttct

SEQ ID NO: 5033885 - DNA, 14 bp, Homo sapiens
cacagagcaggact

SEQ ID NO: 5033886 - DNA, 21 bp, Homo sapiens
cacagagcaggactgcacagc

SEQ ID NO: 5033887 - DNA, 19 bp, Homo sapiens
cacagcgctggccgggacc

SEQ ID NO: 5033888 - DNA, 22 bp, Homo sapiens
cacagcgctggccgggaccccg

SEQ ID NO: 5033889 - DNA, 23 bp, Homo sapiens
cacagcggagtctgtcctgtgac

SEQ ID NO: 5033890 - DNA, 13 bp, Homo sapiens
cacaggacagcgg

SEQ ID NO: 5033891 - DNA, 17 bp, Homo sapiens
cacaggcacacagggcc

SEQ ID NO: 5033892 - DNA, 21 bp, Homo sapiens
cacaggtgccgccagctgccg

SEQ ID NO: 5033893 - DNA, 23 bp, Homo sapiens
cacaggtgccgccagctgccgca

SEQ ID NO: 5033894 - DNA, 19 bp, Homo sapiens
cacagtattgctcacccag

SEQ ID NO: 5033895 - DNA, 18 bp, Homo sapiens
cacagtccaaccagaaac

SEQ ID NO: 5033896 - DNA, 19 bp, Homo sapiens
cacagttttggttgcttta

SEQ ID NO: 5033897 - DNA, 22 bp, Homo sapiens
cacataattcaggaagcagctt

SEQ ID NO: 5033898 - DNA, 21 bp, Homo sapiens
cacatagcccacttacattta

SEQ ID NO: 5033899 - DNA, 13 bp, Homo sapiens
cacatcagcaatt

SEQ ID NO: 5033900 - DNA, 17 bp, Homo sapiens
cacatgtggccatggcc

SEQ ID NO: 5033901 - DNA, 12 bp, Homo sapiens
cacattaaagaa

SEQ ID NO: 5033902 - DNA, 20 bp, Homo sapiens
cacattaaagaagacctgag

SEQ ID NO: 5033903 - DNA, 16 bp, Homo sapiens
cacattaatctcaaag

SEQ ID NO: 5033904 - DNA, 23 bp, Homo sapiens
caccaagttggaacatccttgga

SEQ ID NO: 5033905 - DNA, 16 bp, Homo sapiens
caccaccccaacaaac

SEQ ID NO: 5033906 - DNA, 15 bp, Homo sapiens
caccacggtggtcac

SEQ ID NO: 5033907 - DNA, 12 bp, Homo sapiens
caccagccagcg

SEQ ID NO: 5033908 - DNA, 16 bp, Homo sapiens
cacccaagcctgctgg

SEQ ID NO: 5033909 - DNA, 14 bp, Homo sapiens
cacccacctgtttt

SEQ ID NO: 5033910 - DNA, 19 bp, Homo sapiens
cacccatgcagctgctccc

SEQ ID NO: 5033911 - DNA, 14 bp, Homo sapiens
cacccccaccccca

SEQ ID NO: 5033912 - DNA, 17 bp, Homo sapiens
cacccccacccccagct

SEQ ID NO: 5033913 - DNA, 12 bp, Homo sapiens
cacccccagctc

SEQ ID NO: 5033914 - DNA, 14 bp, Homo sapiens
cacccccagctcaa

SEQ ID NO: 5033915 - DNA, 12 bp, Homo sapiens
caccccctttcc

SEQ ID NO: 5033916 - DNA, 22 bp, Homo sapiens
cacccctccagaacacggctca

SEQ ID NO: 5033917 - DNA, 22 bp, Homo sapiens
cacccgccgcctcccacggcac

SEQ ID NO: 5033918 - DNA, 19 bp, Homo sapiens
caccctgccaagactcctc

SEQ ID NO: 5033919 - DNA, 22 bp, Homo sapiens
caccctgcctctacccaaccag

SEQ ID NO: 5033920 - DNA, 17 bp, Homo sapiens
caccctgtactgttctg

SEQ ID NO: 5033921 - DNA, 14 bp, Homo sapiens
caccgtctgtctca

SEQ ID NO: 5033922 - DNA, 16 bp, Homo sapiens
cacctaagtctctgtg

SEQ ID NO: 5033923 - DNA, 23 bp, Homo sapiens
cacctagctgaatgtttttctaa

SEQ ID NO: 5033924 - DNA, 17 bp, Homo sapiens
cacctcctctgtgattt

SEQ ID NO: 5033925 - DNA, 18 bp, Homo sapiens
cacctcggggacaccaga

SEQ ID NO: 5033926 - DNA, 18 bp, Homo sapiens
cacctctttaaaaactca

SEQ ID NO: 5033927 - DNA, 16 bp, Homo sapiens
caccttccagctcctg

SEQ ID NO: 5033928 - DNA, 13 bp, Homo sapiens
caccttgtctgct

SEQ ID NO: 5033929 - DNA, 22 bp, Homo sapiens
caccttgtctgctaaataaaca

SEQ ID NO: 5033930 - DNA, 14 bp, Homo sapiens
cacctttattctgg

SEQ ID NO: 5033931 - DNA, 23 bp, Homo sapiens
cacctttattctggcagaggagg

SEQ ID NO: 5033932 - DNA, 21 bp, Homo sapiens
cacctttcagataactgttat

SEQ ID NO: 5033933 - DNA, 22 bp, Homo sapiens
cacgagcaaacccagaggtgga

SEQ ID NO: 5033934 - DNA, 16 bp, Homo sapiens
cacgcactgcgcctgt

SEQ ID NO: 5033935 - DNA, 19 bp, Homo sapiens
cacgcactgcgcctgtcag

SEQ ID NO: 5033936 - DNA, 14 bp, Homo sapiens
cacgctccttcctc

SEQ ID NO: 5033937 - DNA, 17 bp, Homo sapiens
cacggctctgtccccag

SEQ ID NO: 5033938 - DNA, 17 bp, Homo sapiens
cacggtgactctgtcca

SEQ ID NO: 5033939 - DNA, 15 bp, Homo sapiens
cacgtctggaccccg

SEQ ID NO: 5033940 - DNA, 14 bp, Homo sapiens
cactaaccttgcct

SEQ ID NO: 5033941 - DNA, 20 bp, Homo sapiens
cactaacgttgagcccctgg

SEQ ID NO: 5033942 - DNA, 21 bp, Homo sapiens
cactccaattaaggattttat

SEQ ID NO: 5033943 - DNA, 11 bp, Homo sapiens
cactccagctg

SEQ ID NO: 5033944 - DNA, 13 bp, Homo sapiens
cactccctcctgg

SEQ ID NO: 5033945 - DNA, 23 bp, Homo sapiens
cactccctcctggagctctgtgg

SEQ ID NO: 5033946 - DNA, 11 bp, Homo sapiens
agtctctgtga

SEQ ID NO: 5033947 - DNA, 12 bp, Homo sapiens
agtctctgtgaa

SEQ ID NO: 5033948 - DNA, 13 bp, Homo sapiens
agtctgtcctgtg

SEQ ID NO: 5033949 - DNA, 12 bp, Homo sapiens
agtctgtccttg

SEQ ID NO: 5033950 - DNA, 18 bp, Homo sapiens
agtctgttttatgacttc

SEQ ID NO: 5033951 - DNA, 13 bp, Homo sapiens
agtgaaactgctt

SEQ ID NO: 5033952 - DNA, 24 bp, Homo sapiens
agtgaaactgcttgtttcctagca

SEQ ID NO: 5033953 - DNA, 20 bp, Homo sapiens
agtgaacattcccagcccag

SEQ ID NO: 5033954 - DNA, 15 bp, Homo sapiens
agtgacagctttctg

SEQ ID NO: 5033955 - DNA, 20 bp, Homo sapiens
agtgacataatatattctat

SEQ ID NO: 5033956 - DNA, 22 bp, Homo sapiens
agtgacataatatattctattt

SEQ ID NO: 5033957 - DNA, 18 bp, Homo sapiens
agtgacctcagctttgat

SEQ ID NO: 5033958 - DNA, 17 bp, Homo sapiens
agtgagagccagcagca

SEQ ID NO: 5033959 - DNA, 15 bp, Homo sapiens
agtgagcagaacagg

SEQ ID NO: 5033960 - DNA, 16 bp, Homo sapiens
agtgagcagaacaggt

SEQ ID NO: 5033961 - DNA, 18 bp, Homo sapiens
agtgagcagaacaggtag

SEQ ID NO: 5033962 - DNA, 21 bp, Homo sapiens
agtgcaaagatttgctttaat

SEQ ID NO: 5033963 - DNA, 18 bp, Homo sapiens
agtgcacggggcacagcg

SEQ ID NO: 5033964 - DNA, 23 bp, Homo sapiens
agtgccagtattttaaaatagcg

SEQ ID NO: 5033965 - DNA, 14 bp, Homo sapiens
agtgcctcttccag

SEQ ID NO: 5033966 - DNA, 17 bp, Homo sapiens
agtgcctcttccagtga

SEQ ID NO: 5033967 - DNA, 21 bp, Homo sapiens
agtgcctcttccagtgaacat

SEQ ID NO: 5033968 - DNA, 15 bp, Homo sapiens
agtgctgttttgtta

SEQ ID NO: 5033969 - DNA, 17 bp, Homo sapiens
agtgcttgcttttcatg

SEQ ID NO: 5033970 - DNA, 14 bp, Homo sapiens
agtgctttgagaga

SEQ ID NO: 5033971 - DNA, 19 bp, Homo sapiens
agtggaggcgggcttggaa

SEQ ID NO: 5033972 - DNA, 23 bp, Homo sapiens
agtggccaagatcacagtggcca

SEQ ID NO: 5033973 - DNA, 20 bp, Homo sapiens
agtggggttatctctgtgtt

SEQ ID NO: 5033974 - DNA, 21 bp, Homo sapiens
agtggggttatctctgtgtta

SEQ ID NO: 5033975 - DNA, 16 bp, Homo sapiens
agtgtctttttttgta

SEQ ID NO: 5033976 - DNA, 17 bp, Homo sapiens
agtgtctttttttgtat

SEQ ID NO: 5033977 - DNA, 23 bp, Homo sapiens
agtgtggagttcaccttggaagg

SEQ ID NO: 5033978 - DNA, 16 bp, Homo sapiens
agtgtttatcctttca

SEQ ID NO: 5033979 - DNA, 16 bp, Homo sapiens
agttaacacactaccg

SEQ ID NO: 5033980 - DNA, 14 bp, Homo sapiens
agttaagcctttgg

SEQ ID NO: 5033981 - DNA, 21 bp, Homo sapiens
agttactcttcagttaagcct

SEQ ID NO: 5033982 - DNA, 17 bp, Homo sapiens
agttcccacattaaaga

SEQ ID NO: 5033983 - DNA, 19 bp, Homo sapiens
agttcccacattaaagaag

SEQ ID NO: 5033984 - DNA, 22 bp, Homo sapiens
agttcccacattaaagaagacc

SEQ ID NO: 5033985 - DNA, 20 bp, Homo sapiens
agttcctgagaccagccaac

SEQ ID NO: 5033986 - DNA, 19 bp, Homo sapiens
agttcctttccttttcttt

SEQ ID NO: 5033987 - DNA, 22 bp, Homo sapiens
agttctacctcaggcagctcaa

SEQ ID NO: 5033988 - DNA, 14 bp, Homo sapiens
agttgcagctgttt

SEQ ID NO: 5033989 - DNA, 10 bp, Homo sapiens
agttggaagg

SEQ ID NO: 5033990 - DNA, 12 bp, Homo sapiens
agttggaaggat

SEQ ID NO: 5033991 - DNA, 18 bp, Homo sapiens
agttggaaggatctgctg

SEQ ID NO: 5033992 - DNA, 19 bp, Homo sapiens
agttggaaggatctgctga

SEQ ID NO: 5033993 - DNA, 23 bp, Homo sapiens
agtttagggaacaatttggcaat

SEQ ID NO: 5033994 - DNA, 20 bp, Homo sapiens
agtttgtggcatcttgccaa

SEQ ID NO: 5033995 - DNA, 22 bp, Homo sapiens
agtttgtgtgtcttaattatta

SEQ ID NO: 5033996 - DNA, 15 bp, Homo sapiens
agttttagttttctc

SEQ ID NO: 5033997 - DNA, 22 bp, Homo sapiens
agttttggttgctttaatatca

SEQ ID NO: 5033998 - DNA, 17 bp, Homo sapiens
agttttgtctgtctccc

SEQ ID NO: 5033999 - DNA, 20 bp, Homo sapiens
agttttttcatcttcagttg

SEQ ID NO: 5034000 - DNA, 17 bp, Homo sapiens
ataaacaagaaaaataa

SEQ ID NO: 5034001 - DNA, 21 bp, Homo sapiens
ataaacaagaaaaataaagaa

SEQ ID NO: 5034002 - DNA, 15 bp, Homo sapiens
ataaactaataattg

SEQ ID NO: 5034003 - DNA, 17 bp, Homo sapiens
ataaactactctttgat

SEQ ID NO: 5034004 - DNA, 15 bp, Homo sapiens
ataaagaaaagatgc

SEQ ID NO: 5034005 - DNA, 20 bp, Homo sapiens
ataaagacgttttataagca

SEQ ID NO: 5034006 - DNA, 24 bp, Homo sapiens
ataaagacgttttataagcatcat

SEQ ID NO: 5034007 - DNA, 12 bp, Homo sapiens
ataaatatatta

SEQ ID NO: 5034008 - DNA, 14 bp, Homo sapiens
ataaatatattatt

SEQ ID NO: 5034009 - DNA, 16 bp, Homo sapiens
ataaatcgcttttgat

SEQ ID NO: 5034010 - DNA, 21 bp, Homo sapiens
ataaatcgcttttgataatca

SEQ ID NO: 5034011 - DNA, 23 bp, Homo sapiens
ataaattcccaacttctcttgct

SEQ ID NO: 5034012 - DNA, 22 bp, Homo sapiens
ataaattccctggcctttcata

SEQ ID NO: 5034013 - DNA, 14 bp, Homo sapiens
atgcccgcctagtt

SEQ ID NO: 5034014 - DNA, 18 bp, Homo sapiens
atgctaatttaaagagac

SEQ ID NO: 5034015 - DNA, 21 bp, Homo sapiens
atgctggctatagatgtcttt

SEQ ID NO: 5034016 - DNA, 22 bp, Homo sapiens
atgctggctatagatgtctttt

SEQ ID NO: 5034017 - DNA, 11 bp, Homo sapiens
atgctgtttgt

SEQ ID NO: 5034018 - DNA, 23 bp, Homo sapiens
atgcttctaagtaaatacaattt

SEQ ID NO: 5034019 - DNA, 17 bp, Homo sapiens
atggaaatttaaagcag

SEQ ID NO: 5034020 - DNA, 14 bp, Homo sapiens
atggaaggggcttc

SEQ ID NO: 5034021 - DNA, 17 bp, Homo sapiens
atggaaggggcttctgg

SEQ ID NO: 5034022 - DNA, 14 bp, Homo sapiens
atggactgctcagg

SEQ ID NO: 5034023 - DNA, 18 bp, Homo sapiens
atggagtgctgttttgtt

SEQ ID NO: 5034024 - DNA, 20 bp, Homo sapiens
atggagtgctgttttgttat

SEQ ID NO: 5034025 - DNA, 17 bp, Homo sapiens
atggatgtccccagcag

SEQ ID NO: 5034026 - DNA, 18 bp, Homo sapiens
atggatgtccccagcaga

SEQ ID NO: 5034027 - DNA, 21 bp, Homo sapiens
atggcatttggtctcaggcag

SEQ ID NO: 5034028 - DNA, 22 bp, Homo sapiens
atggcatttggtctcaggcagc

SEQ ID NO: 5034029 - DNA, 10 bp, Homo sapiens
atggccatgc

SEQ ID NO: 5034030 - DNA, 16 bp, Homo sapiens
atggccatgcaggagg

SEQ ID NO: 5034031 - DNA, 14 bp, Homo sapiens
atggcgtctgctct

SEQ ID NO: 5034032 - DNA, 16 bp, Homo sapiens
atggggagggagggag

SEQ ID NO: 5034033 - DNA, 20 bp, Homo sapiens
atgggtgcaaggaaaattag

SEQ ID NO: 5034034 - DNA, 23 bp, Homo sapiens
atgtaaggctgtgtaagatttgt

SEQ ID NO: 5034035 - DNA, 15 bp, Homo sapiens
atgtactagtgttct

SEQ ID NO: 5034036 - DNA, 15 bp, Homo sapiens
atgtagtcagttgca

SEQ ID NO: 5034037 - DNA, 22 bp, Homo sapiens
atgtattgtgcaatgtgtataa

SEQ ID NO: 5034038 - DNA, 14 bp, Homo sapiens
atgtattttatgtt

SEQ ID NO: 5034039 - DNA, 13 bp, Homo sapiens
atgtcacagtcca

SEQ ID NO: 5034040 - DNA, 22 bp, Homo sapiens
atgtcatatactgccatgtact

SEQ ID NO: 5034041 - DNA, 14 bp, Homo sapiens
atgtcccacccacc

SEQ ID NO: 5034042 - DNA, 15 bp, Homo sapiens
atgtcccacccaccc

SEQ ID NO: 5034043 - DNA, 13 bp, Homo sapiens
atgtcccctgcgg

SEQ ID NO: 5034044 - DNA, 22 bp, Homo sapiens
atgtcttcatacctacatgtat

SEQ ID NO: 5034045 - DNA, 18 bp, Homo sapiens
atgtggtggcacaggccc

SEQ ID NO: 5034046 - DNA, 21 bp, Homo sapiens
atgtgtctttagatagccctg

SEQ ID NO: 5034047 - DNA, 13 bp, Homo sapiens
atgtgtgtgcatg

SEQ ID NO: 5034048 - DNA, 14 bp, Homo sapiens
atgttccattaaac

SEQ ID NO: 5034049 - DNA, 15 bp, Homo sapiens
atgttccattaaacg

SEQ ID NO: 5034050 - DNA, 15 bp, Homo sapiens
atgttgaagcctttg

SEQ ID NO: 5034051 - DNA, 16 bp, Homo sapiens
atgttgaagcctttgt

SEQ ID NO: 5034052 - DNA, 14 bp, Homo sapiens
atgtttaatctgtt

SEQ ID NO: 5034053 - DNA, 19 bp, Homo sapiens
atgtttccagcagaagaca

SEQ ID NO: 5034054 - DNA, 24 bp, Homo sapiens
atgtttccagcagaagacaaaaag

SEQ ID NO: 5034055 - DNA, 14 bp, Homo sapiens
atgtttttctaaag

SEQ ID NO: 5034056 - DNA, 13 bp, Homo sapiens
attaaaaaagata

SEQ ID NO: 5034057 - DNA, 15 bp, Homo sapiens
attaaaaaagataaa

SEQ ID NO: 5034058 - DNA, 17 bp, Homo sapiens
attaaaaaagataaaca

SEQ ID NO: 5034059 - DNA, 18 bp, Homo sapiens
attaaagaaaaaaatgta

SEQ ID NO: 5034060 - DNA, 14 bp, Homo sapiens
attaaagaagacct

SEQ ID NO: 5034061 - DNA, 15 bp, Homo sapiens
attaaagaagacctg

SEQ ID NO: 5034062 - DNA, 16 bp, Homo sapiens
attaagaatgaaatac

SEQ ID NO: 5034063 - DNA, 17 bp, Homo sapiens
attaaggattttatgct

SEQ ID NO: 5034064 - DNA, 17 bp, Homo sapiens
attaagtatctgacatc

SEQ ID NO: 5034065 - DNA, 13 bp, Homo sapiens
attaatattatta

SEQ ID NO: 5034066 - DNA, 22 bp, Homo sapiens
aaaagaattgttgggggttttt

SEQ ID NO: 5034067 - DNA, 17 bp, Homo sapiens
aaaagaggtttttctta

SEQ ID NO: 5034068 - DNA, 12 bp, Homo sapiens
aaaagataaaca

SEQ ID NO: 5034069 - DNA, 17 bp, Homo sapiens
aaaagataaacacaaga

SEQ ID NO: 5034070 - DNA, 17 bp, Homo sapiens
aaaagcgtgagcttaaa

SEQ ID NO: 5034071 - DNA, 23 bp, Homo sapiens
aaaagcgtgagcttaaaatacaa

SEQ ID NO: 5034072 - DNA, 15 bp, Homo sapiens
aaaagttgcagctgt

SEQ ID NO: 5034073 - DNA, 18 bp, Homo sapiens
aaaagttgcagctgtttt

SEQ ID NO: 5034074 - DNA, 22 bp, Homo sapiens
aaaagttggaaggatctgctga

SEQ ID NO: 5034075 - DNA, 16 bp, Homo sapiens
aaaataaagaaaagat

SEQ ID NO: 5034076 - DNA, 21 bp, Homo sapiens
aaaataaagaaaagatgcact

SEQ ID NO: 5034077 - DNA, 19 bp, Homo sapiens
aaaatagcgttcttgtaat

SEQ ID NO: 5034078 - DNA, 20 bp, Homo sapiens
aaaatagggtatattttcct

SEQ ID NO: 5034079 - DNA, 22 bp, Homo sapiens
aaaatatgaccacactccagct

SEQ ID NO: 5034080 - DNA, 15 bp, Homo sapiens
aaaatcgatgagcgc

SEQ ID NO: 5034081 - DNA, 15 bp, Homo sapiens
aaaatcttgatcagt

SEQ ID NO: 5034082 - DNA, 18 bp, Homo sapiens
aaaatcttgatcagttaa

SEQ ID NO: 5034083 - DNA, 15 bp, Homo sapiens
aaaatgtattttatg

SEQ ID NO: 5034084 - DNA, 17 bp, Homo sapiens
aaaatgtattttatgtt

SEQ ID NO: 5034085 - DNA, 22 bp, Homo sapiens
aaaatgtattttatgttatata

SEQ ID NO: 5034086 - DNA, 14 bp, Homo sapiens
aaaatgttttacat

SEQ ID NO: 5034087 - DNA, 19 bp, Homo sapiens
aaacaagaaaaataaagaa

SEQ ID NO: 5034088 - DNA, 13 bp, Homo sapiens
aaacacccctctg

SEQ ID NO: 5034089 - DNA, 14 bp, Homo sapiens
aaacacccctctgt

SEQ ID NO: 5034090 - DNA, 18 bp, Homo sapiens
aaacacctcctcatgtac

SEQ ID NO: 5034091 - DNA, 20 bp, Homo sapiens
aaacattggttcttgtatta

SEQ ID NO: 5034092 - DNA, 13 bp, Homo sapiens
aaaccagctcagc

SEQ ID NO: 5034093 - DNA, 13 bp, Homo sapiens
aaacccagaggtg

SEQ ID NO: 5034094 - DNA, 16 bp, Homo sapiens
aaactacattttgcaa

SEQ ID NO: 5034095 - DNA, 13 bp, Homo sapiens
aaactgcttgttt

SEQ ID NO: 5034096 - DNA, 14 bp, Homo sapiens
aaactgcttgtttc

SEQ ID NO: 5034097 - DNA, 22 bp, Homo sapiens
aaactgcttgtttcctagcaca

SEQ ID NO: 5034098 - DNA, 11 bp, Homo sapiens
aaactgtacag

SEQ ID NO: 5034099 - DNA, 19 bp, Homo sapiens
aaactgtctttaaaagaga

SEQ ID NO: 5034100 - DNA, 11 bp, Homo sapiens
aaagaaaaaaa

SEQ ID NO: 5034101 - DNA, 17 bp, Homo sapiens
aaagaaaaaaatgtatt

SEQ ID NO: 5034102 - DNA, 16 bp, Homo sapiens
aaagaaaaaaattgaa

SEQ ID NO: 5034103 - DNA, 19 bp, Homo sapiens
aaagaaaaaaattgaaatg

SEQ ID NO: 5034104 - DNA, 22 bp, Homo sapiens
aaagaaaaaaattgaaatgtaa

SEQ ID NO: 5034105 - DNA, 15 bp, Homo sapiens
aaagaagacaaactt

SEQ ID NO: 5034106 - DNA, 14 bp, Homo sapiens
aaagaagacctgag

SEQ ID NO: 5034107 - DNA, 22 bp, Homo sapiens
aaagaattgttgggggtttttt

SEQ ID NO: 5034108 - DNA, 19 bp, Homo sapiens
aaagacgatttgtcagtta

SEQ ID NO: 5034109 - DNA, 12 bp, Homo sapiens
aaagataaacac

SEQ ID NO: 5034110 - DNA, 19 bp, Homo sapiens
aaagatgcactttgcttta

SEQ ID NO: 5034111 - DNA, 22 bp, Homo sapiens
aaagatgcactttgctttaata

SEQ ID NO: 5034112 - DNA, 23 bp, Homo sapiens
aaagatgcactttgctttaatat

SEQ ID NO: 5034113 - DNA, 13 bp, Homo sapiens
aaagcaaatgtct

SEQ ID NO: 5034114 - DNA, 13 bp, Homo sapiens
aaagcaagggcca

SEQ ID NO: 5034115 - DNA, 18 bp, Homo sapiens
aaagcacaagtacttttg

SEQ ID NO: 5034116 - DNA, 16 bp, Homo sapiens
aaagcaggttcttgtt

SEQ ID NO: 5034117 - DNA, 14 bp, Homo sapiens
aaagcataaaaaca

SEQ ID NO: 5034118 - DNA, 16 bp, Homo sapiens
aaagcataaaaacatt

SEQ ID NO: 5034119 - DNA, 23 bp, Homo sapiens
aaagcccttatgtttaatcagcg

SEQ ID NO: 5034120 - DNA, 18 bp, Homo sapiens
aaaggattttaccaaagc

SEQ ID NO: 5034121 - DNA, 19 bp, Homo sapiens
aaaggattttaccaaagca

SEQ ID NO: 5034122 - DNA, 20 bp, Homo sapiens
aaaggattttaccaaagcat

SEQ ID NO: 5034123 - DNA, 19 bp, Homo sapiens
aaaggttgctgtttcacaa

SEQ ID NO: 5034124 - DNA, 14 bp, Homo sapiens
aaaggtttaaatga

SEQ ID NO: 5034125 - DNA, 22 bp, Homo sapiens
aaaggtttaaatgaacaagaga

SEQ ID NO: 5034126 - DNA, 14 bp, Homo sapiens
aaagtgcaagtcca

SEQ ID NO: 5034127 - DNA, 18 bp, Homo sapiens
aaagttggaaggatctgc

SEQ ID NO: 5034128 - DNA, 20 bp, Homo sapiens
aaagttggaaggatctgctg

SEQ ID NO: 5034129 - DNA, 18 bp, Homo sapiens
aaatagcgctgtttttgt

SEQ ID NO: 5034130 - DNA, 19 bp, Homo sapiens
aaatagcgttcttgtaatt

SEQ ID NO: 5034131 - DNA, 21 bp, Homo sapiens
aaatagtgacataatatattc

SEQ ID NO: 5034132 - DNA, 24 bp, Homo sapiens
aaatataaagacgttttataagca

SEQ ID NO: 5034133 - DNA, 21 bp, Homo sapiens
aaatatattattacttgtaaa

SEQ ID NO: 5034134 - DNA, 18 bp, Homo sapiens
aaatatggactgctcagg

SEQ ID NO: 5034135 - DNA, 14 bp, Homo sapiens
aaatcgcttttgat

SEQ ID NO: 5034136 - DNA, 16 bp, Homo sapiens
aaatctgtttttctca

SEQ ID NO: 5034137 - DNA, 17 bp, Homo sapiens
aaatctgtttttctcat

SEQ ID NO: 5034138 - DNA, 21 bp, Homo sapiens
aaatgaggtctgtttaaagtg

SEQ ID NO: 5034139 - DNA, 20 bp, Homo sapiens
aaatgattcaaattgctgct

SEQ ID NO: 5034140 - DNA, 21 bp, Homo sapiens
aaatgattcaaattgctgctt

SEQ ID NO: 5034141 - DNA, 15 bp, Homo sapiens
aaatgattcttagtg

SEQ ID NO: 5034142 - DNA, 14 bp, Homo sapiens
aaatgcaaataaca

SEQ ID NO: 5034143 - DNA, 16 bp, Homo sapiens
aaatgccaaattaaaa

SEQ ID NO: 5034144 - DNA, 17 bp, Homo sapiens
aaatgccaaattaaaaa

SEQ ID NO: 5034145 - DNA, 18 bp, Homo sapiens
aaatgccaaattaaaaaa

SEQ ID NO: 5034146 - DNA, 18 bp, Homo sapiens
aaatgctgctctcagcct

SEQ ID NO: 5034147 - DNA, 16 bp, Homo sapiens
aaatggcgtctgctct

SEQ ID NO: 5034148 - DNA, 21 bp, Homo sapiens
aaatggcgtctgctctggtgg

SEQ ID NO: 5034149 - DNA, 21 bp, Homo sapiens
aaatgggaattctcaggtagg

SEQ ID NO: 5034150 - DNA, 11 bp, Homo sapiens
aaatggttaaa

SEQ ID NO: 5034151 - DNA, 13 bp, Homo sapiens
aaatggttaaaag

SEQ ID NO: 5034152 - DNA, 13 bp, Homo sapiens
aaatgtaaggctg

SEQ ID NO: 5034153 - DNA, 17 bp, Homo sapiens
aaatgtaaggctgtgta

SEQ ID NO: 5034154 - DNA, 15 bp, Homo sapiens
aaattaaaaaagata

SEQ ID NO: 5034155 - DNA, 16 bp, Homo sapiens
aaattaaaaaagataa

SEQ ID NO: 5034156 - DNA, 20 bp, Homo sapiens
aaattaaaaaagataaacac

SEQ ID NO: 5034157 - DNA, 14 bp, Homo sapiens
aaattaatctgggc

SEQ ID NO: 5034158 - DNA, 13 bp, Homo sapiens
aaattagttatat

SEQ ID NO: 5034159 - DNA, 21 bp, Homo sapiens
aaattcagcaaaccattttta

SEQ ID NO: 5034160 - DNA, 16 bp, Homo sapiens
aaattggcatggaaat

SEQ ID NO: 5034161 - DNA, 21 bp, Homo sapiens
aaattggcatggaaatttaaa

SEQ ID NO: 5034162 - DNA, 18 bp, Homo sapiens
aaattgggtgaagagctt

SEQ ID NO: 5034163 - DNA, 18 bp, Homo sapiens
aaattgtcagatgctgtg

SEQ ID NO: 5034164 - DNA, 22 bp, Homo sapiens
aaatttagcattgtagtgcttt

SEQ ID NO: 5034165 - DNA, 18 bp, Homo sapiens
aaattttcacataaaata

SEQ ID NO: 5034166 - DNA, 14 bp, Homo sapiens
aaattttttgttga

SEQ ID NO: 5034167 - DNA, 17 bp, Homo sapiens
aacaaatgccaaattaa

SEQ ID NO: 5034168 - DNA, 19 bp, Homo sapiens
aacaaatgccaaattaaaa

SEQ ID NO: 5034169 - DNA, 15 bp, Homo sapiens
aacaagagaagcatt

SEQ ID NO: 5034170 - DNA, 21 bp, Homo sapiens
aacaagagaagcattctcatt

SEQ ID NO: 5034171 - DNA, 20 bp, Homo sapiens
aacacacgagcaaacccaga

SEQ ID NO: 5034172 - DNA, 19 bp, Homo sapiens
aacacactaccgaatgtgt

SEQ ID NO: 5034173 - DNA, 23 bp, Homo sapiens
aacacactaccgaatgtgtcttt

SEQ ID NO: 5034174 - DNA, 16 bp, Homo sapiens
aacacctcctcatgta

SEQ ID NO: 5034175 - DNA, 17 bp, Homo sapiens
aacactccaattaagga

SEQ ID NO: 5034176 - DNA, 17 bp, Homo sapiens
aacagacaagtgactgt

SEQ ID NO: 5034177 - DNA, 11 bp, Homo sapiens
aacagctgtgt

SEQ ID NO: 5034178 - DNA, 13 bp, Homo sapiens
aacataagctatt

SEQ ID NO: 5034179 - DNA, 21 bp, Homo sapiens
accagaaccaattattttcat

SEQ ID NO: 5034180 - DNA, 13 bp, Homo sapiens
accagaagggaaa

SEQ ID NO: 5034181 - DNA, 21 bp, Homo sapiens
accagactacttgggagcacc

SEQ ID NO: 5034182 - DNA, 17 bp, Homo sapiens
accagcccgaacaccat

SEQ ID NO: 5034183 - DNA, 15 bp, Homo sapiens
accagccgtatttta

SEQ ID NO: 5034184 - DNA, 13 bp, Homo sapiens
accagctcagcac

SEQ ID NO: 5034185 - DNA, 14 bp, Homo sapiens
accagctcagcact

SEQ ID NO: 5034186 - DNA, 16 bp, Homo sapiens
accagctcagcactgc

SEQ ID NO: 5034187 - DNA, 23 bp, Homo sapiens
accaggagaagggctggggccgg

SEQ ID NO: 5034188 - DNA, 21 bp, Homo sapiens
accagtggcgttgttgcatgt

SEQ ID NO: 5034189 - DNA, 19 bp, Homo sapiens
accataaccccggaagcca

SEQ ID NO: 5034190 - DNA, 19 bp, Homo sapiens
accatgagtggcatggcca

SEQ ID NO: 5034191 - DNA, 12 bp, Homo sapiens
accatgtaatgg

SEQ ID NO: 5034192 - DNA, 16 bp, Homo sapiens
accatttccaacagca

SEQ ID NO: 5034193 - DNA, 22 bp, Homo sapiens
accatttttaaagtagaagagg

SEQ ID NO: 5034194 - DNA, 15 bp, Homo sapiens
acccaagcctgctgg

SEQ ID NO: 5034195 - DNA, 22 bp, Homo sapiens
acccagtgaggatgctgcagtg

SEQ ID NO: 5034196 - DNA, 18 bp, Homo sapiens
acccatgcagctgctccc

SEQ ID NO: 5034197 - DNA, 18 bp, Homo sapiens
accccaaacaccttccag

SEQ ID NO: 5034198 - DNA, 16 bp, Homo sapiens
accccaccccaccccc

SEQ ID NO: 5034199 - DNA, 14 bp, Homo sapiens
acccccacccccag

SEQ ID NO: 5034200 - DNA, 18 bp, Homo sapiens
acccccacccccagctca

SEQ ID NO: 5034201 - DNA, 20 bp, Homo sapiens
acccccagctcaatggactg

SEQ ID NO: 5034202 - DNA, 17 bp, Homo sapiens
acccccaggcctgtcca

SEQ ID NO: 5034203 - DNA, 19 bp, Homo sapiens
accccgcctgccctcatgg

SEQ ID NO: 5034204 - DNA, 16 bp, Homo sapiens
acccgccgcctcccac

SEQ ID NO: 5034205 - DNA, 17 bp, Homo sapiens
acccggtgctccctctg

SEQ ID NO: 5034206 - DNA, 19 bp, Homo sapiens
accctcgaggcggatcttt

SEQ ID NO: 5034207 - DNA, 13 bp, Homo sapiens
accctgccctcct

SEQ ID NO: 5034208 - DNA, 20 bp, Homo sapiens
accctgcctctacccaacca

SEQ ID NO: 5034209 - DNA, 13 bp, Homo sapiens
accctggagccca

SEQ ID NO: 5034210 - DNA, 18 bp, Homo sapiens
accctgtccggcccagtg

SEQ ID NO: 5034211 - DNA, 16 bp, Homo sapiens
accctttggccccact

SEQ ID NO: 5034212 - DNA, 14 bp, Homo sapiens
accgccccctcctc

SEQ ID NO: 5034213 - DNA, 15 bp, Homo sapiens
acctaagtctctgtg

SEQ ID NO: 5034214 - DNA, 18 bp, Homo sapiens
acctaagtctctgtgaat

SEQ ID NO: 5034215 - DNA, 20 bp, Homo sapiens
acctagctgaatgtttttct

SEQ ID NO: 5034216 - DNA, 12 bp, Homo sapiens
acctcaggcagc

SEQ ID NO: 5034217 - DNA, 17 bp, Homo sapiens
acctcatgcccagctct

SEQ ID NO: 5034218 - DNA, 22 bp, Homo sapiens
acctcatgcccagctctctgac

SEQ ID NO: 5034219 - DNA, 21 bp, Homo sapiens
acctccattctattttagaat

SEQ ID NO: 5034220 - DNA, 21 bp, Homo sapiens
acctcctctgtgatttctttc

SEQ ID NO: 5034221 - DNA, 21 bp, Homo sapiens
acctcggggacaccagagctg

SEQ ID NO: 5034222 - DNA, 14 bp, Homo sapiens
acctgattgtattt

SEQ ID NO: 5034223 - DNA, 15 bp, Homo sapiens
acctgattgtatttt

SEQ ID NO: 5034224 - DNA, 16 bp, Homo sapiens
acctgattgtattttt

SEQ ID NO: 5034225 - DNA, 13 bp, Homo sapiens
acctgcacacagg

SEQ ID NO: 5034226 - DNA, 17 bp, Homo sapiens
acctgcacacaggacag

SEQ ID NO: 5034227 - DNA, 12 bp, Homo sapiens
acctgcaggcgt

SEQ ID NO: 5034228 - DNA, 17 bp, Homo sapiens
acctgttgccagcagat

SEQ ID NO: 5034229 - DNA, 14 bp, Homo sapiens
acctgttttctgaa

SEQ ID NO: 5034230 - DNA, 16 bp, Homo sapiens
acctgttttctgaaac

SEQ ID NO: 5034231 - DNA, 14 bp, Homo sapiens
accttagcctgccc

SEQ ID NO: 5034232 - DNA, 14 bp, Homo sapiens
accttccagctcct

SEQ ID NO: 5034233 - DNA, 17 bp, Homo sapiens
accttccagctcctgta

SEQ ID NO: 5034234 - DNA, 19 bp, Homo sapiens
accttctgcctttgatgtt

SEQ ID NO: 5034235 - DNA, 15 bp, Homo sapiens
accttgcctggtaca

SEQ ID NO: 5034236 - DNA, 16 bp, Homo sapiens
accttgggtggcccct

SEQ ID NO: 5034237 - DNA, 17 bp, Homo sapiens
accttttgaggagcccc

SEQ ID NO: 5034238 - DNA, 21 bp, Homo sapiens
accttttgaggagccccagct

SEQ ID NO: 5034239 - DNA, 21 bp, Homo sapiens
acgagcctttgtttttctcca

SEQ ID NO: 5034240 - DNA, 13 bp, Homo sapiens
acgctcagtgggg

SEQ ID NO: 5034241 - DNA, 15 bp, Homo sapiens
acgctccttcctctg

SEQ ID NO: 5034242 - DNA, 23 bp, Homo sapiens
acgcttttgtgatggagtgctgt

SEQ ID NO: 5034243 - DNA, 14 bp, Homo sapiens
acggcaacagcatg

SEQ ID NO: 5034244 - DNA, 19 bp, Homo sapiens
acggcgttgtacctgtagg

SEQ ID NO: 5034245 - DNA, 20 bp, Homo sapiens
acggctctgtccccagcctg

SEQ ID NO: 5034246 - DNA, 14 bp, Homo sapiens
acggtaagtgttct

SEQ ID NO: 5034247 - DNA, 18 bp, Homo sapiens
acggtaagtgttctcatg

SEQ ID NO: 5034248 - DNA, 17 bp, Homo sapiens
actaaccttgcctggta

SEQ ID NO: 5034249 - DNA, 22 bp, Homo sapiens
actaaccttgcctggtacagta

SEQ ID NO: 5034250 - DNA, 18 bp, Homo sapiens
actaacgttgagcccctg

SEQ ID NO: 5034251 - DNA, 11 bp, Homo sapiens
actaataattg

SEQ ID NO: 5034252 - DNA, 17 bp, Homo sapiens
actacaaaggtttaaat

SEQ ID NO: 5034253 - DNA, 15 bp, Homo sapiens
actactctttgattt

SEQ ID NO: 5034254 - DNA, 16 bp, Homo sapiens
actactttgctgctaa

SEQ ID NO: 5034255 - DNA, 17 bp, Homo sapiens
actagttttagttttct

SEQ ID NO: 5034256 - DNA, 14 bp, Homo sapiens
actataaagagaag

SEQ ID NO: 5034257 - DNA, 19 bp, Homo sapiens
actatttgcttatttaata

SEQ ID NO: 5034258 - DNA, 12 bp, Homo sapiens
actcacagagct

SEQ ID NO: 5034259 - DNA, 16 bp, Homo sapiens
actcactccttttaaa

SEQ ID NO: 5034260 - DNA, 18 bp, Homo sapiens
actcactccttttaaaga

SEQ ID NO: 5034261 - DNA, 23 bp, Homo sapiens
actcctgcacacgctccttcctc

SEQ ID NO: 5034262 - DNA, 19 bp, Homo sapiens
actccttccccacttctgt

SEQ ID NO: 5034263 - DNA, 18 bp, Homo sapiens
actcgagtcacactcaag

SEQ ID NO: 5034264 - DNA, 12 bp, Homo sapiens
actctattcttt

SEQ ID NO: 5034265 - DNA, 22 bp, Homo sapiens
actctgacaacagacttctgaa

SEQ ID NO: 5034266 - DNA, 14 bp, Homo sapiens
actctgtaattgca

SEQ ID NO: 5034267 - DNA, 15 bp, Homo sapiens
actctgtaattgcaa

SEQ ID NO: 5034268 - DNA, 22 bp, Homo sapiens
actcttcctatttttgtagtga

SEQ ID NO: 5034269 - DNA, 19 bp, Homo sapiens
actctttggtcgttttttt

SEQ ID NO: 5034270 - DNA, 15 bp, Homo sapiens
actgaaggggtgcac

SEQ ID NO: 5034271 - DNA, 13 bp, Homo sapiens
actgaagtgctta

SEQ ID NO: 5034272 - DNA, 17 bp, Homo sapiens
actgaagtgcttagtgt

SEQ ID NO: 5034273 - DNA, 18 bp, Homo sapiens
actgcacagcgtcctgtc

SEQ ID NO: 5034274 - DNA, 16 bp, Homo sapiens
actgcacaggaggagg

SEQ ID NO: 5034275 - DNA, 10 bp, Homo sapiens
actgcatttt

SEQ ID NO: 5034276 - DNA, 11 bp, Homo sapiens
actgcctgctc

SEQ ID NO: 5034277 - DNA, 16 bp, Homo sapiens
actgctcagctctggt

SEQ ID NO: 5034278 - DNA, 17 bp, Homo sapiens
actgctcagctctggtc

SEQ ID NO: 5034279 - DNA, 14 bp, Homo sapiens
actggcctctgctg

SEQ ID NO: 5034280 - DNA, 16 bp, Homo sapiens
actggcctgctggatg

SEQ ID NO: 5034281 - DNA, 13 bp, Homo sapiens
actggggagcccg

SEQ ID NO: 5034282 - DNA, 16 bp, Homo sapiens
actgggtgcgtctcca

SEQ ID NO: 5034283 - DNA, 14 bp, Homo sapiens
actgtaactgtcag

SEQ ID NO: 5034284 - DNA, 21 bp, Homo sapiens
actgtacagtgtctttttttg

SEQ ID NO: 5034285 - DNA, 18 bp, Homo sapiens
actgtgacaggcagcaga

SEQ ID NO: 5034286 - DNA, 13 bp, Homo sapiens
actgttatttata

SEQ ID NO: 5034287 - DNA, 15 bp, Homo sapiens
actgttatttataat

SEQ ID NO: 5034288 - DNA, 21 bp, Homo sapiens
actgttatttataatcacttt

SEQ ID NO: 5034289 - DNA, 13 bp, Homo sapiens
actgttctgtgtc

SEQ ID NO: 5034290 - DNA, 20 bp, Homo sapiens
actgttcttagctcaatgag

SEQ ID NO: 5034291 - DNA, 18 bp, Homo sapiens
actgtttgaggtttttaa

SEQ ID NO: 5034292 - DNA, 23 bp, Homo sapiens
actgtttgaggtttttaagcctt

SEQ ID NO: 5034293 - DNA, 18 bp, Homo sapiens
aggaggaatactgaacat

SEQ ID NO: 5034294 - DNA, 23 bp, Homo sapiens
aggaggcccttgtcgtgggatgg

SEQ ID NO: 5034295 - DNA, 16 bp, Homo sapiens
aggagggagacactgg

SEQ ID NO: 5034296 - DNA, 20 bp, Homo sapiens
aggaggtgtgaggaggaggc

SEQ ID NO: 5034297 - DNA, 16 bp, Homo sapiens
aggaggtttgcctgtg

SEQ ID NO: 5034298 - DNA, 21 bp, Homo sapiens
aggatgctgcagtgaggctgt

SEQ ID NO: 5034299 - DNA, 22 bp, Homo sapiens
aggatgtacaaggacagcccct

SEQ ID NO: 5034300 - DNA, 13 bp, Homo sapiens
aggattttaccaa

SEQ ID NO: 5034301 - DNA, 17 bp, Homo sapiens
aggattttaccaaagca

SEQ ID NO: 5034302 - DNA, 19 bp, Homo sapiens
aggattttaccaaagcatc

SEQ ID NO: 5034303 - DNA, 15 bp, Homo sapiens
aggattttatgcttt

SEQ ID NO: 5034304 - DNA, 20 bp, Homo sapiens
aggattttatgctttaaaca

SEQ ID NO: 5034305 - DNA, 14 bp, Homo sapiens
aggcaaatgacttt

SEQ ID NO: 5034306 - DNA, 15 bp, Homo sapiens
aggcaaatgactttg

SEQ ID NO: 5034307 - DNA, 15 bp, Homo sapiens
aggcacacagggccc

SEQ ID NO: 5034308 - DNA, 17 bp, Homo sapiens
aggcactgaagtgctta

SEQ ID NO: 5034309 - DNA, 13 bp, Homo sapiens
aggcagaggctgc

SEQ ID NO: 5034310 - DNA, 18 bp, Homo sapiens
aggcagatgtggggctga

SEQ ID NO: 5034311 - DNA, 23 bp, Homo sapiens
aggcagatgtggggctgagctgg

SEQ ID NO: 5034312 - DNA, 13 bp, Homo sapiens
aggcagcaccaca

SEQ ID NO: 5034313 - DNA, 16 bp, Homo sapiens
aggcagcaccacactg

SEQ ID NO: 5034314 - DNA, 23 bp, Homo sapiens
aggcagcaccacactgggtgcgt

SEQ ID NO: 5034315 - DNA, 15 bp, Homo sapiens
aggcagtagttttca

SEQ ID NO: 5034316 - DNA, 21 bp, Homo sapiens
aggcatctctgtactttgctt

SEQ ID NO: 5034317 - DNA, 21 bp, Homo sapiens
aggcatgggtgcaaggaaaat

SEQ ID NO: 5034318 - DNA, 19 bp, Homo sapiens
aggcattaacacaaaggag

SEQ ID NO: 5034319 - DNA, 23 bp, Homo sapiens
aggcattgccttctctgcccaca

SEQ ID NO: 5034320 - DNA, 21 bp, Homo sapiens
aggcatttgccaagggaggcg

SEQ ID NO: 5034321 - DNA, 19 bp, Homo sapiens
aggccaagcagtgcctgcc

SEQ ID NO: 5034322 - DNA, 23 bp, Homo sapiens
aggccaccccgctgatggagccc

SEQ ID NO: 5034323 - DNA, 15 bp, Homo sapiens
aggccaccctgcctc

SEQ ID NO: 5034324 - DNA, 18 bp, Homo sapiens
aggccaggccaccctgcc

SEQ ID NO: 5034325 - DNA, 18 bp, Homo sapiens
aggccctggtcctggcct

SEQ ID NO: 5034326 - DNA, 17 bp, Homo sapiens
aggcccttcctctttgg

SEQ ID NO: 5034327 - DNA, 15 bp, Homo sapiens
aggccttgcctggcc

SEQ ID NO: 5034328 - DNA, 16 bp, Homo sapiens
aggccttgcctggcct

SEQ ID NO: 5034329 - DNA, 14 bp, Homo sapiens
aggctaagctgccg

SEQ ID NO: 5034330 - DNA, 16 bp, Homo sapiens
aggctgacgtgtgagg

SEQ ID NO: 5034331 - DNA, 23 bp, Homo sapiens
aggctgatgccaagttgtttgag

SEQ ID NO: 5034332 - DNA, 22 bp, Homo sapiens
aggctgcttcccagaggagcag

SEQ ID NO: 5034333 - DNA, 18 bp, Homo sapiens
aggctggagtgcagtggc

SEQ ID NO: 5034334 - DNA, 23 bp, Homo sapiens
aggcttctggttgatgcctgtga

SEQ ID NO: 5034335 - DNA, 16 bp, Homo sapiens
aggcttggggaaaatg

SEQ ID NO: 5034336 - DNA, 21 bp, Homo sapiens
agggaacaatttggcaatttt

SEQ ID NO: 5034337 - DNA, 19 bp, Homo sapiens
agggacatgcttagcagtc

SEQ ID NO: 5034338 - DNA, 18 bp, Homo sapiens
agggaccacaccctgtac

SEQ ID NO: 5034339 - DNA, 18 bp, Homo sapiens
agggaccactgggtgaga

SEQ ID NO: 5034340 - DNA, 21 bp, Homo sapiens
agggaccactgggtgagagag

SEQ ID NO: 5034341 - DNA, 23 bp, Homo sapiens
agggaccactgggtgagagagga

SEQ ID NO: 5034342 - DNA, 14 bp, Homo sapiens
agggacgctttgtc

SEQ ID NO: 5034343 - DNA, 17 bp, Homo sapiens
agggagggcagttttct

SEQ ID NO: 5034344 - DNA, 20 bp, Homo sapiens
agggagttttgtctgtctcc

SEQ ID NO: 5034345 - DNA, 20 bp, Homo sapiens
agggcacaagtcctggatgt

SEQ ID NO: 5034346 - DNA, 19 bp, Homo sapiens
agggcaggcttggggaaaa

SEQ ID NO: 5034347 - DNA, 16 bp, Homo sapiens
agggcattcaaatggg

SEQ ID NO: 5034348 - DNA, 16 bp, Homo sapiens
agggcccggccacacc

SEQ ID NO: 5034349 - DNA, 23 bp, Homo sapiens
agggcgttctaggtaggaagagc

SEQ ID NO: 5034350 - DNA, 16 bp, Homo sapiens
agggctgagctgggga

SEQ ID NO: 5034351 - DNA, 21 bp, Homo sapiens
aggggaataaactgttgagtc

SEQ ID NO: 5034352 - DNA, 12 bp, Homo sapiens
aggggctggggc

SEQ ID NO: 5034353 - DNA, 20 bp, Homo sapiens
agggtcctgccggtgggacc

SEQ ID NO: 5034354 - DNA, 15 bp, Homo sapiens
agggtggggagggag

SEQ ID NO: 5034355 - DNA, 18 bp, Homo sapiens
aggtagtattacaccacc

SEQ ID NO: 5034356 - DNA, 12 bp, Homo sapiens
aggtctgtttaa

SEQ ID NO: 5034357 - DNA, 15 bp, Homo sapiens
aggtgagaaaaaaac

SEQ ID NO: 5034358 - DNA, 17 bp, Homo sapiens
aggtggagaaaattgga

SEQ ID NO: 5034359 - DNA, 19 bp, Homo sapiens
aggtggagaaaattggaac

SEQ ID NO: 5034360 - DNA, 20 bp, Homo sapiens
aggtggatgttatgaacagc

SEQ ID NO: 5034361 - DNA, 22 bp, Homo sapiens
aggtggatgttatgaacagctg

SEQ ID NO: 5034362 - DNA, 23 bp, Homo sapiens
aggtggatgttatgaacagctgt

SEQ ID NO: 5034363 - DNA, 16 bp, Homo sapiens
aggtggtgtgatctta

SEQ ID NO: 5034364 - DNA, 22 bp, Homo sapiens
aggttaagcactttaacacagt

SEQ ID NO: 5034365 - DNA, 23 bp, Homo sapiens
aggtttttaaacactaaaatata

SEQ ID NO: 5034366 - DNA, 17 bp, Homo sapiens
agtaactggttgctgtg

SEQ ID NO: 5034367 - DNA, 17 bp, Homo sapiens
agtatgaattattcaat

SEQ ID NO: 5034368 - DNA, 22 bp, Homo sapiens
agtatgaattattcaatttatt

SEQ ID NO: 5034369 - DNA, 12 bp, Homo sapiens
agtattgttgtc

SEQ ID NO: 5034370 - DNA, 15 bp, Homo sapiens
agtattgttgtcctt

SEQ ID NO: 5034371 - DNA, 19 bp, Homo sapiens
agtattgttgtccttttca

SEQ ID NO: 5034372 - DNA, 20 bp, Homo sapiens
agtattgttgtccttttcat

SEQ ID NO: 5034373 - DNA, 15 bp, Homo sapiens
agtcatctgtaagag

SEQ ID NO: 5034374 - DNA, 22 bp, Homo sapiens
agtcctggatgatactaataaa

SEQ ID NO: 5034375 - DNA, 13 bp, Homo sapiens
agtcctgggaggt

SEQ ID NO: 5034376 - DNA, 19 bp, Homo sapiens
agtctcagtgaagactatg

SEQ ID NO: 5034377 - DNA, 10 bp, Homo sapiens
agtctcagtt

SEQ ID NO: 5034378 - DNA, 21 bp, Homo sapiens
agtctcagtttgtgtgtctta

SEQ ID NO: 5034379 - DNA, 17 bp, Homo sapiens
agtctcttacaaaagct

SEQ ID NO: 5034380 - DNA, 16 bp, Homo sapiens
agtctgtcctgtgacg

SEQ ID NO: 5034381 - DNA, 13 bp, Homo sapiens
agtctgtccttga

SEQ ID NO: 5034382 - DNA, 14 bp, Homo sapiens
agtctgttttatga

SEQ ID NO: 5034383 - DNA, 13 bp, Homo sapiens
agtcttttgcttt

SEQ ID NO: 5034384 - DNA, 21 bp, Homo sapiens
agtgaaactgcttgtttccta

SEQ ID NO: 5034385 - DNA, 14 bp, Homo sapiens
agtgacaaaataga

SEQ ID NO: 5034386 - DNA, 17 bp, Homo sapiens
agtgacctcagctttga

SEQ ID NO: 5034387 - DNA, 16 bp, Homo sapiens
agtgactgtatctgtg

SEQ ID NO: 5034388 - DNA, 20 bp, Homo sapiens
agtgactgtatctgtgtaga

SEQ ID NO: 5034389 - DNA, 13 bp, Homo sapiens
agtgagcagaaca

SEQ ID NO: 5034390 - DNA, 17 bp, Homo sapiens
agtgagcagaacaggta

SEQ ID NO: 5034391 - DNA, 19 bp, Homo sapiens
agtgaggatgctgcagtga

SEQ ID NO: 5034392 - DNA, 13 bp, Homo sapiens
agtgcagggagga

SEQ ID NO: 5034393 - DNA, 18 bp, Homo sapiens
agtgccactgccccccga

SEQ ID NO: 5034394 - DNA, 14 bp, Homo sapiens
agtgcgtggatctg

SEQ ID NO: 5034395 - DNA, 21 bp, Homo sapiens
agtgctgggaattacaggcgt

SEQ ID NO: 5034396 - DNA, 14 bp, Homo sapiens
agtggaggtttgtc

SEQ ID NO: 5034397 - DNA, 18 bp, Homo sapiens
agtggcgcgcgccaccac

SEQ ID NO: 5034398 - DNA, 15 bp, Homo sapiens
agtggcgttgttgca

SEQ ID NO: 5034399 - DNA, 17 bp, Homo sapiens
agtgtacacgtctggac

SEQ ID NO: 5034400 - DNA, 23 bp, Homo sapiens
agtgtagctgtgtggctttcctt

SEQ ID NO: 5034401 - DNA, 19 bp, Homo sapiens
agtgtctttttttgtatag

SEQ ID NO: 5034402 - DNA, 17 bp, Homo sapiens
agtgtgcggctgtgtgt

SEQ ID NO: 5034403 - DNA, 14 bp, Homo sapiens
agtgttctcatgaa

SEQ ID NO: 5034404 - DNA, 22 bp, Homo sapiens
agtgttctcatgaagcaggagg

SEQ ID NO: 5034405 - DNA, 18 bp, Homo sapiens
attcctcatttgttcatt

SEQ ID NO: 5034406 - DNA, 22 bp, Homo sapiens
attctcaggtaggaagcaacag

SEQ ID NO: 5034407 - DNA, 12 bp, Homo sapiens
attctccctggg

SEQ ID NO: 5034408 - DNA, 18 bp, Homo sapiens
attctccttgttgttggt

SEQ ID NO: 5034409 - DNA, 15 bp, Homo sapiens
attctgaatgcttct

SEQ ID NO: 5034410 - DNA, 22 bp, Homo sapiens
attctgaatgcttctaagtaaa

SEQ ID NO: 5034411 - DNA, 18 bp, Homo sapiens
attcttgtgcttttcctg

SEQ ID NO: 5034412 - DNA, 17 bp, Homo sapiens
attctttccatttgcat

SEQ ID NO: 5034413 - DNA, 11 bp, Homo sapiens
attgacttctt

SEQ ID NO: 5034414 - DNA, 14 bp, Homo sapiens
attgagcatttgaa

SEQ ID NO: 5034415 - DNA, 14 bp, Homo sapiens
attgcattgctggt

SEQ ID NO: 5034416 - DNA, 13 bp, Homo sapiens
attgcgctgctac

SEQ ID NO: 5034417 - DNA, 21 bp, Homo sapiens
attgctggtagagacccccag

SEQ ID NO: 5034418 - DNA, 22 bp, Homo sapiens
attgctggtagagacccccagg

SEQ ID NO: 5034419 - DNA, 16 bp, Homo sapiens
attggcaagtcacgtt

SEQ ID NO: 5034420 - DNA, 13 bp, Homo sapiens
attgtctttgaat

SEQ ID NO: 5034421 - DNA, 15 bp, Homo sapiens
attgtgcaatgtgta

SEQ ID NO: 5034422 - DNA, 18 bp, Homo sapiens
attgtgcaatgtgtataa

SEQ ID NO: 5034423 - DNA, 22 bp, Homo sapiens
attgtgcaatgtgtataaacaa

SEQ ID NO: 5034424 - DNA, 15 bp, Homo sapiens
attgttgtccttttc

SEQ ID NO: 5034425 - DNA, 19 bp, Homo sapiens
attgttgttctgttaactg

SEQ ID NO: 5034426 - DNA, 15 bp, Homo sapiens
attgtttgctgctat

SEQ ID NO: 5034427 - DNA, 13 bp, Homo sapiens
atttaaacacaca

SEQ ID NO: 5034428 - DNA, 15 bp, Homo sapiens
atttaaagcaggttc

SEQ ID NO: 5034429 - DNA, 16 bp, Homo sapiens
atttaaatgtgtacaa

SEQ ID NO: 5034430 - DNA, 16 bp, Homo sapiens
atttaacccccctgta

SEQ ID NO: 5034431 - DNA, 14 bp, Homo sapiens
atttacaaactgaa

SEQ ID NO: 5034432 - DNA, 15 bp, Homo sapiens
atttacaaactgaag

SEQ ID NO: 5034433 - DNA, 20 bp, Homo sapiens
atttagcattgtagtgcttt

SEQ ID NO: 5034434 - DNA, 13 bp, Homo sapiens
atttataatcact

SEQ ID NO: 5034435 - DNA, 15 bp, Homo sapiens
atttatctaaatatg

SEQ ID NO: 5034436 - DNA, 22 bp, Homo sapiens
atttatgtattgtgcaatgtgt

SEQ ID NO: 5034437 - DNA, 12 bp, Homo sapiens
atttattaaaga

SEQ ID NO: 5034438 - DNA, 24 bp, Homo sapiens
atttattgcagaggatgttcataa

SEQ ID NO: 5034439 - DNA, 22 bp, Homo sapiens
atttcatttgtgccagaatgct

SEQ ID NO: 5034440 - DNA, 19 bp, Homo sapiens
atttccccgatgtcccctg

SEQ ID NO: 5034441 - DNA, 21 bp, Homo sapiens
atttctttctttgcaccaaag

SEQ ID NO: 5034442 - DNA, 16 bp, Homo sapiens
atttgaaaaaaacttc

SEQ ID NO: 5034443 - DNA, 16 bp, Homo sapiens
atttgcatttgtttat

SEQ ID NO: 5034444 - DNA, 23 bp, Homo sapiens
atttgcatttgtttatgtaattt

SEQ ID NO: 5034445 - DNA, 19 bp, Homo sapiens
atttggtaaaaatgctgct

SEQ ID NO: 5034446 - DNA, 20 bp, Homo sapiens
atttggtaaaaatgctgctc

SEQ ID NO: 5034447 - DNA, 13 bp, Homo sapiens
atttgtgttttaa

SEQ ID NO: 5034448 - DNA, 15 bp, Homo sapiens
atttgttcattaaac

SEQ ID NO: 5034449 - DNA, 12 bp, Homo sapiens
atttgtttgcat

SEQ ID NO: 5034450 - DNA, 18 bp, Homo sapiens
atttgtttttaaactgta

SEQ ID NO: 5034451 - DNA, 14 bp, Homo sapiens
attttaccaaagca

SEQ ID NO: 5034452 - DNA, 21 bp, Homo sapiens
attttaccagatgttttgatg

SEQ ID NO: 5034453 - DNA, 16 bp, Homo sapiens
attttagaataaattc

SEQ ID NO: 5034454 - DNA, 12 bp, Homo sapiens
attttatgttat

SEQ ID NO: 5034455 - DNA, 17 bp, Homo sapiens
attttatgttatatata

SEQ ID NO: 5034456 - DNA, 20 bp, Homo sapiens
attttcctatattacggttt

SEQ ID NO: 5034457 - DNA, 16 bp, Homo sapiens
attttgacaaagtgcc

SEQ ID NO: 5034458 - DNA, 14 bp, Homo sapiens
atttttaaaatgta

SEQ ID NO: 5034459 - DNA, 16 bp, Homo sapiens
atttttaaaatgtaca

SEQ ID NO: 5034460 - DNA, 22 bp, Homo sapiens
atttttaattaattgggccagc

SEQ ID NO: 5034461 - DNA, 21 bp, Homo sapiens
attttttgttgacattagtct

SEQ ID NO: 5034462 - DNA, 17 bp, Homo sapiens
attttttttctgttata

SEQ ID NO: 5034463 - DNA, 19 bp, Homo sapiens
attttttttctgttatata

SEQ ID NO: 5034464 - DNA, 22 bp, Homo sapiens
attttttttttaaataaaagca

SEQ ID NO: 5034465 - DNA, 14 bp, Homo sapiens
caaaaacattttat

SEQ ID NO: 5034466 - DNA, 22 bp, Homo sapiens
caaaaactgtctttaaaagaga

SEQ ID NO: 5034467 - DNA, 13 bp, Homo sapiens
caaaaaggttgct

SEQ ID NO: 5034468 - DNA, 14 bp, Homo sapiens
caaaacaaactcat

SEQ ID NO: 5034469 - DNA, 17 bp, Homo sapiens
caaaatagggtatattt

SEQ ID NO: 5034470 - DNA, 19 bp, Homo sapiens
caaacacatttaccctttg

SEQ ID NO: 5034471 - DNA, 22 bp, Homo sapiens
caaacacccacttatttttcaa

SEQ ID NO: 5034472 - DNA, 15 bp, Homo sapiens
caaacacctggactt

SEQ ID NO: 5034473 - DNA, 14 bp, Homo sapiens
caaactctttggtc

SEQ ID NO: 5034474 - DNA, 19 bp, Homo sapiens
caaactgaaattcagagca

SEQ ID NO: 5034475 - DNA, 13 bp, Homo sapiens
caaactttgcatc

SEQ ID NO: 5034476 - DNA, 16 bp, Homo sapiens
caaagaaattcagaac

SEQ ID NO: 5034477 - DNA, 19 bp, Homo sapiens
caaagaaattcagaacagc

SEQ ID NO: 5034478 - DNA, 23 bp, Homo sapiens
caaagaaattcagaacagcctgc

SEQ ID NO: 5034479 - DNA, 16 bp, Homo sapiens
caaagagcctttccaa

SEQ ID NO: 5034480 - DNA, 11 bp, Homo sapiens
caaataaagtc

SEQ ID NO: 5034481 - DNA, 15 bp, Homo sapiens
caaataaagtctctt

SEQ ID NO: 5034482 - DNA, 19 bp, Homo sapiens
caaatcgtccagcgacctt

SEQ ID NO: 5034483 - DNA, 21 bp, Homo sapiens
caaatcgtccagcgaccttcc

SEQ ID NO: 5034484 - DNA, 15 bp, Homo sapiens
caaattaaaaaagat

SEQ ID NO: 5034485 - DNA, 20 bp, Homo sapiens
caaattaaaaaagataaaca

SEQ ID NO: 5034486 - DNA, 14 bp, Homo sapiens
caaattagttatat

SEQ ID NO: 5034487 - DNA, 16 bp, Homo sapiens
caaccacctttcagat

SEQ ID NO: 5034488 - DNA, 22 bp, Homo sapiens
caacccattgttgtcaaggaag

SEQ ID NO: 5034489 - DNA, 17 bp, Homo sapiens
caaccctggcacccagg

SEQ ID NO: 5034490 - DNA, 16 bp, Homo sapiens
caacctccaccttctg

SEQ ID NO: 5034491 - DNA, 16 bp, Homo sapiens
caactcactcctttta

SEQ ID NO: 5034492 - DNA, 20 bp, Homo sapiens
caactcactccttttaaaga

SEQ ID NO: 5034493 - DNA, 14 bp, Homo sapiens
caactgaaggggtg

SEQ ID NO: 5034494 - DNA, 13 bp, Homo sapiens
caactgctcagct

SEQ ID NO: 5034495 - DNA, 17 bp, Homo sapiens
caactgctcagctctgg

SEQ ID NO: 5034496 - DNA, 15 bp, Homo sapiens
caacttctcttgctt

SEQ ID NO: 5034497 - DNA, 16 bp, Homo sapiens
caagaaaaataaagaa

SEQ ID NO: 5034498 - DNA, 18 bp, Homo sapiens
caagaaaaataaagaaaa

SEQ ID NO: 5034499 - DNA, 22 bp, Homo sapiens
caagaaatggcgtctgctctgg

SEQ ID NO: 5034500 - DNA, 13 bp, Homo sapiens
caagaagaaaaag

SEQ ID NO: 5034501 - DNA, 19 bp, Homo sapiens
caagaagaagggcacccta

SEQ ID NO: 5034502 - DNA, 19 bp, Homo sapiens
caagaatcagtgcaaagat

SEQ ID NO: 5034503 - DNA, 11 bp, Homo sapiens
caagactcctc

SEQ ID NO: 5034504 - DNA, 14 bp, Homo sapiens
caagagaagcattc

SEQ ID NO: 5034505 - DNA, 18 bp, Homo sapiens
caagagaagcattctcat

SEQ ID NO: 5034506 - DNA, 22 bp, Homo sapiens
caagcaccaccaaacacagtgt

SEQ ID NO: 5034507 - DNA, 22 bp, Homo sapiens
caagcagcgaccgccccctcct

SEQ ID NO: 5034508 - DNA, 13 bp, Homo sapiens
caagcctgctggc

SEQ ID NO: 5034509 - DNA, 20 bp, Homo sapiens
caagcctgctggctgcggcc

SEQ ID NO: 5034510 - DNA, 18 bp, Homo sapiens
caaggacagcccctcctc

SEQ ID NO: 5034511 - DNA, 16 bp, Homo sapiens
caaggagtcagacatt

SEQ ID NO: 5034512 - DNA, 17 bp, Homo sapiens
caaggtggtgtgatctt

SEQ ID NO: 5034513 - DNA, 20 bp, Homo sapiens
caagtatggtaggggagggc

SEQ ID NO: 5034514 - DNA, 15 bp, Homo sapiens
caagtatttttaatt

SEQ ID NO: 5034515 - DNA, 16 bp, Homo sapiens
caagtatttttaatta

SEQ ID NO: 5034516 - DNA, 18 bp, Homo sapiens
caagtcttctcccgtcca

SEQ ID NO: 5034517 - DNA, 19 bp, Homo sapiens
caagtgactgtatctgtgt

SEQ ID NO: 5034518 - DNA, 20 bp, Homo sapiens
caagtgcacggggcacagcg

SEQ ID NO: 5034519 - DNA, 14 bp, Homo sapiens
cattagaattattt

SEQ ID NO: 5034520 - DNA, 22 bp, Homo sapiens
cattagtcatgtttatctgctt

SEQ ID NO: 5034521 - DNA, 22 bp, Homo sapiens
cattagttactttattgaaggt

SEQ ID NO: 5034522 - DNA, 13 bp, Homo sapiens
cattatgatgtgt

SEQ ID NO: 5034523 - DNA, 15 bp, Homo sapiens
cattatttatgtatt

SEQ ID NO: 5034524 - DNA, 21 bp, Homo sapiens
cattatttttgttagcaaaga

SEQ ID NO: 5034525 - DNA, 17 bp, Homo sapiens
cattccccgtctctggt

SEQ ID NO: 5034526 - DNA, 19 bp, Homo sapiens
cattctacacagagcagga

SEQ ID NO: 5034527 - DNA, 15 bp, Homo sapiens
cattctcattggaaa

SEQ ID NO: 5034528 - DNA, 19 bp, Homo sapiens
cattctcgtgagtcattta

SEQ ID NO: 5034529 - DNA, 23 bp, Homo sapiens
cattctcgtgagtcatttaaatg

SEQ ID NO: 5034530 - DNA, 15 bp, Homo sapiens
cattctgaatgcttc

SEQ ID NO: 5034531 - DNA, 18 bp, Homo sapiens
cattctgaatgcttctaa

SEQ ID NO: 5034532 - DNA, 18 bp, Homo sapiens
cattctggatagagtcct

SEQ ID NO: 5034533 - DNA, 17 bp, Homo sapiens
cattgagcatttgaaag

SEQ ID NO: 5034534 - DNA, 13 bp, Homo sapiens
cattgccttttct

SEQ ID NO: 5034535 - DNA, 19 bp, Homo sapiens
cattggaaatttagcattg

SEQ ID NO: 5034536 - DNA, 20 bp, Homo sapiens
cattggaaatttagcattgt

SEQ ID NO: 5034537 - DNA, 13 bp, Homo sapiens
cattggaagccat

SEQ ID NO: 5034538 - DNA, 15 bp, Homo sapiens
cattgtagtgctttg

SEQ ID NO: 5034539 - DNA, 16 bp, Homo sapiens
cattgttgtcaaggaa

SEQ ID NO: 5034540 - DNA, 20 bp, Homo sapiens
catttaaatgtgtacaatgt

SEQ ID NO: 5034541 - DNA, 20 bp, Homo sapiens
catttatctaaatatggact

SEQ ID NO: 5034542 - DNA, 15 bp, Homo sapiens
catttcatacaacag

SEQ ID NO: 5034543 - DNA, 18 bp, Homo sapiens
catttcatttgtgccaga

SEQ ID NO: 5034544 - DNA, 13 bp, Homo sapiens
catttgcatttgt

SEQ ID NO: 5034545 - DNA, 14 bp, Homo sapiens
catttgcatttgtt

SEQ ID NO: 5034546 - DNA, 18 bp, Homo sapiens
catttggtctcaggcagc

SEQ ID NO: 5034547 - DNA, 21 bp, Homo sapiens
catttggtgagagtcaaagct

SEQ ID NO: 5034548 - DNA, 17 bp, Homo sapiens
catttgtttatgtaatt

SEQ ID NO: 5034549 - DNA, 18 bp, Homo sapiens
catttgtttatgtaattt

SEQ ID NO: 5034550 - DNA, 23 bp, Homo sapiens
cattttcttattgcgctgctacc

SEQ ID NO: 5034551 - DNA, 12 bp, Homo sapiens
cattttgaaagt

SEQ ID NO: 5034552 - DNA, 15 bp, Homo sapiens
cattttgaatcacat

SEQ ID NO: 5034553 - DNA, 18 bp, Homo sapiens
cattttgacaaagtgcct

SEQ ID NO: 5034554 - DNA, 23 bp, Homo sapiens
catttttaaagtagaagagggtt

SEQ ID NO: 5034555 - DNA, 22 bp, Homo sapiens
ccaaaaaggttgctgtttcaca

SEQ ID NO: 5034556 - DNA, 23 bp, Homo sapiens
ccaaaaaggttgctgtttcacaa

SEQ ID NO: 5034557 - DNA, 19 bp, Homo sapiens
ccaaacaccttccagctcc

SEQ ID NO: 5034558 - DNA, 20 bp, Homo sapiens
ccaaacaccttccagctcct

SEQ ID NO: 5034559 - DNA, 15 bp, Homo sapiens
ccaaaggctggtggc

SEQ ID NO: 5034560 - DNA, 18 bp, Homo sapiens
ccaaatgcagctttaaaa

SEQ ID NO: 5034561 - DNA, 16 bp, Homo sapiens
ccaacaaaccatccag

SEQ ID NO: 5034562 - DNA, 21 bp, Homo sapiens
ccaacggccctgcagccagct

SEQ ID NO: 5034563 - DNA, 19 bp, Homo sapiens
ccaacttctcttgctttct

SEQ ID NO: 5034564 - DNA, 15 bp, Homo sapiens
ccaagactcctcagg

SEQ ID NO: 5034565 - DNA, 19 bp, Homo sapiens
ccaagcactttcagtccaa

SEQ ID NO: 5034566 - DNA, 16 bp, Homo sapiens
ccaagcctgctggctg

SEQ ID NO: 5034567 - DNA, 17 bp, Homo sapiens
ccaagcctgctggctgc

SEQ ID NO: 5034568 - DNA, 15 bp, Homo sapiens
ccaagcggtgtctct

SEQ ID NO: 5034569 - DNA, 16 bp, Homo sapiens
ccaaggtaccatccta

SEQ ID NO: 5034570 - DNA, 17 bp, Homo sapiens
ccaagtcggcacccttt

SEQ ID NO: 5034571 - DNA, 13 bp, Homo sapiens
ccaattaaggatt

SEQ ID NO: 5034572 - DNA, 18 bp, Homo sapiens
ccaattaaggattttatg

SEQ ID NO: 5034573 - DNA, 22 bp, Homo sapiens
ccaattaaggattttatgcttt

SEQ ID NO: 5034574 - DNA, 14 bp, Homo sapiens
ccaattcctcattt

SEQ ID NO: 5034575 - DNA, 20 bp, Homo sapiens
ccaattccttgcacatagta

SEQ ID NO: 5034576 - DNA, 22 bp, Homo sapiens
ccaatttggtaaaaatgctgct

SEQ ID NO: 5034577 - DNA, 14 bp, Homo sapiens
ccacactccagctg

SEQ ID NO: 5034578 - DNA, 14 bp, Homo sapiens
ccacacttcaaact

SEQ ID NO: 5034579 - DNA, 17 bp, Homo sapiens
ccacacttcaaactact

SEQ ID NO: 5034580 - DNA, 18 bp, Homo sapiens
ccacacttcaaactactt

SEQ ID NO: 5034581 - DNA, 13 bp, Homo sapiens
ccacagagtataa

SEQ ID NO: 5034582 - DNA, 14 bp, Homo sapiens
ccacaggcttctga

SEQ ID NO: 5034583 - DNA, 16 bp, Homo sapiens
ccacagtgccacccat

SEQ ID NO: 5034584 - DNA, 18 bp, Homo sapiens
ccacccaagcctgctggc

SEQ ID NO: 5034585 - DNA, 20 bp, Homo sapiens
ccacccaagcctgctggctg

SEQ ID NO: 5034586 - DNA, 20 bp, Homo sapiens
ccacccatgcagctgctccc

SEQ ID NO: 5034587 - DNA, 23 bp, Homo sapiens
ccacccatgcagctgctccccag

SEQ ID NO: 5034588 - DNA, 15 bp, Homo sapiens
ccacccccaccccca

SEQ ID NO: 5034589 - DNA, 16 bp, Homo sapiens
ccaccccgcctgccct

SEQ ID NO: 5034590 - DNA, 13 bp, Homo sapiens
ccacccctccaga

SEQ ID NO: 5034591 - DNA, 18 bp, Homo sapiens
ccacccgtggggtgctgc

SEQ ID NO: 5034592 - DNA, 21 bp, Homo sapiens
ccacccgtggggtgctgccct

SEQ ID NO: 5034593 - DNA, 19 bp, Homo sapiens
ccaccctgccaagactcct

SEQ ID NO: 5034594 - DNA, 22 bp, Homo sapiens
ccactgatagatgtctattctt

SEQ ID NO: 5034595 - DNA, 17 bp, Homo sapiens
ccactgggtgagagagg

SEQ ID NO: 5034596 - DNA, 19 bp, Homo sapiens
ccactttgaagggcaagaa

SEQ ID NO: 5034597 - DNA, 22 bp, Homo sapiens
ccagagagcctggtgctgctgc

SEQ ID NO: 5034598 - DNA, 16 bp, Homo sapiens
ccagagcgaggaaagg

SEQ ID NO: 5034599 - DNA, 23 bp, Homo sapiens
ccagagcgaggaaaggattttac

SEQ ID NO: 5034600 - DNA, 14 bp, Homo sapiens
ccagaggagcagct

SEQ ID NO: 5034601 - DNA, 14 bp, Homo sapiens
ccagaggtggatgt

SEQ ID NO: 5034602 - DNA, 16 bp, Homo sapiens
ccagaggtggatgtta

SEQ ID NO: 5034603 - DNA, 18 bp, Homo sapiens
ccagatgcacatccctgg

SEQ ID NO: 5034604 - DNA, 12 bp, Homo sapiens
ccagatgttttg

SEQ ID NO: 5034605 - DNA, 14 bp, Homo sapiens
ccagattctgatgc

SEQ ID NO: 5034606 - DNA, 22 bp, Homo sapiens
ccagcagaagacaaaaagacaa

SEQ ID NO: 5034607 - DNA, 15 bp, Homo sapiens
ccagccaggccctgc

SEQ ID NO: 5034608 - DNA, 16 bp, Homo sapiens
ccagcccgaacaccat

SEQ ID NO: 5034609 - DNA, 14 bp, Homo sapiens
ccagccctggctga

SEQ ID NO: 5034610 - DNA, 13 bp, Homo sapiens
ccagcctcagcct

SEQ ID NO: 5034611 - DNA, 21 bp, Homo sapiens
ccagcgagagagtttcaaaag

SEQ ID NO: 5034612 - DNA, 15 bp, Homo sapiens
ccagcgagctctcaa

SEQ ID NO: 5034613 - DNA, 23 bp, Homo sapiens
ccagcggccccccgcacagccac

SEQ ID NO: 5034614 - DNA, 22 bp, Homo sapiens
ccagctaccctttttctccagc

SEQ ID NO: 5034615 - DNA, 15 bp, Homo sapiens
ccagctacttcctcc

SEQ ID NO: 5034616 - DNA, 22 bp, Homo sapiens
ccagctcaatggactggaaggg

SEQ ID NO: 5034617 - DNA, 23 bp, Homo sapiens
ccagctctctgacgcttgtgaca

SEQ ID NO: 5034618 - DNA, 17 bp, Homo sapiens
ccagctgccgcaccagc

SEQ ID NO: 5034619 - DNA, 18 bp, Homo sapiens
ccagctgccgcaccagcc

SEQ ID NO: 5034620 - DNA, 16 bp, Homo sapiens
ccagctgggctctgca

SEQ ID NO: 5034621 - DNA, 18 bp, Homo sapiens
ccagctgggctctgcaat

SEQ ID NO: 5034622 - DNA, 13 bp, Homo sapiens
ccagcttttcaaa

SEQ ID NO: 5034623 - DNA, 20 bp, Homo sapiens
ccaggagaagggctggggcc

SEQ ID NO: 5034624 - DNA, 17 bp, Homo sapiens
ccaggagcacggctctg

SEQ ID NO: 5034625 - DNA, 18 bp, Homo sapiens
ccaggagcacggctctgt

SEQ ID NO: 5034626 - DNA, 23 bp, Homo sapiens
ccaggaggccctggtcctggcct

SEQ ID NO: 5034627 - DNA, 16 bp, Homo sapiens
ccaggcacggtttgga

SEQ ID NO: 5034628 - DNA, 16 bp, Homo sapiens
ccaggcctgtccaccc

SEQ ID NO: 5034629 - DNA, 18 bp, Homo sapiens
ccaggcctgtccaccctg

SEQ ID NO: 5034630 - DNA, 15 bp, Homo sapiens
ccaggttcaacccac

SEQ ID NO: 5034631 - DNA, 16 bp, Homo sapiens
ccagtcaagaagaaaa

SEQ ID NO: 5034632 - DNA, 14 bp, Homo sapiens
cctggatgatacta

SEQ ID NO: 5034633 - DNA, 23 bp, Homo sapiens
cctggcactaacgttgagcccct

SEQ ID NO: 5034634 - DNA, 23 bp, Homo sapiens
cctggccctgttctcctccccaa

SEQ ID NO: 5034635 - DNA, 21 bp, Homo sapiens
cctggccgccccctgcccccc

SEQ ID NO: 5034636 - DNA, 22 bp, Homo sapiens
cctggccgccccctgcccccca

SEQ ID NO: 5034637 - DNA, 20 bp, Homo sapiens
cctggctccaaaccctcgag

SEQ ID NO: 5034638 - DNA, 23 bp, Homo sapiens
cctggctctgggccgggcctggg

SEQ ID NO: 5034639 - DNA, 19 bp, Homo sapiens
cctggctgaaggactgtga

SEQ ID NO: 5034640 - DNA, 19 bp, Homo sapiens
cctgggcatttggtgagag

SEQ ID NO: 5034641 - DNA, 15 bp, Homo sapiens
cctggtaccctcctg

SEQ ID NO: 5034642 - DNA, 23 bp, Homo sapiens
cctggtcctggcctccttccccg

SEQ ID NO: 5034643 - DNA, 23 bp, Homo sapiens
cctggtgacatcaggtttttccc

SEQ ID NO: 5034644 - DNA, 12 bp, Homo sapiens
cctggtgctgct

SEQ ID NO: 5034645 - DNA, 13 bp, Homo sapiens
cctggtgctgctg

SEQ ID NO: 5034646 - DNA, 23 bp, Homo sapiens
cctgtaccttttgaggagcccca

SEQ ID NO: 5034647 - DNA, 17 bp, Homo sapiens
cctgtactgttctgtgt

SEQ ID NO: 5034648 - DNA, 18 bp, Homo sapiens
cctgtccacacccagctc

SEQ ID NO: 5034649 - DNA, 18 bp, Homo sapiens
cctgtccacaggcttctg

SEQ ID NO: 5034650 - DNA, 21 bp, Homo sapiens
cctgtccacaggcttctgagc

SEQ ID NO: 5034651 - DNA, 15 bp, Homo sapiens
cctgtcccaccccca

SEQ ID NO: 5034652 - DNA, 16 bp, Homo sapiens
cctgtgatgctgggca

SEQ ID NO: 5034653 - DNA, 13 bp, Homo sapiens
cctgttttctgaa

SEQ ID NO: 5034654 - DNA, 14 bp, Homo sapiens
cctgttttctgaaa

SEQ ID NO: 5034655 - DNA, 18 bp, Homo sapiens
ccttaataaacgtccaca

SEQ ID NO: 5034656 - DNA, 17 bp, Homo sapiens
ccttaccactgctctga

SEQ ID NO: 5034657 - DNA, 22 bp, Homo sapiens
ccttatgcccggcgccgggcac

SEQ ID NO: 5034658 - DNA, 23 bp, Homo sapiens
ccttatgcccggcgccgggcacc

SEQ ID NO: 5034659 - DNA, 19 bp, Homo sapiens
ccttcaaagcaaatgtctt

SEQ ID NO: 5034660 - DNA, 19 bp, Homo sapiens
ccttcagtaccctctcagc

SEQ ID NO: 5034661 - DNA, 24 bp, Homo sapiens
ccttcagtaccctctcagctccag

SEQ ID NO: 5034662 - DNA, 16 bp, Homo sapiens
ccttcctcatccaccc

SEQ ID NO: 5034663 - DNA, 18 bp, Homo sapiens
ccttcctcatccacccca

SEQ ID NO: 5034664 - DNA, 13 bp, Homo sapiens
ccttcctctgagg

SEQ ID NO: 5034665 - DNA, 14 bp, Homo sapiens
ccttcctctgaggc

SEQ ID NO: 5034666 - DNA, 17 bp, Homo sapiens
ccttgaagaacctctca

SEQ ID NO: 5034667 - DNA, 15 bp, Homo sapiens
ccttgcaagaatcag

SEQ ID NO: 5034668 - DNA, 18 bp, Homo sapiens
ccttgccatccattctgg

SEQ ID NO: 5034669 - DNA, 12 bp, Homo sapiens
ccttgcctggcc

SEQ ID NO: 5034670 - DNA, 16 bp, Homo sapiens
ccttggacacgctcag

SEQ ID NO: 5034671 - DNA, 16 bp, Homo sapiens
cctttaactcatgagg

SEQ ID NO: 5034672 - DNA, 12 bp, Homo sapiens
cctttacatgag

SEQ ID NO: 5034673 - DNA, 18 bp, Homo sapiens
cctttacatgaggactct

SEQ ID NO: 5034674 - DNA, 17 bp, Homo sapiens
cctttcaactagaaaat

SEQ ID NO: 5034675 - DNA, 12 bp, Homo sapiens
cctttcatattt

SEQ ID NO: 5034676 - DNA, 16 bp, Homo sapiens
cctttgcgcctgtgac

SEQ ID NO: 5034677 - DNA, 23 bp, Homo sapiens
cctttgtgtcagaaaaaggaaac

SEQ ID NO: 5034678 - DNA, 17 bp, Homo sapiens
cctttttcactttgaaa

SEQ ID NO: 5034679 - DNA, 14 bp, Homo sapiens
ccttttttgtagtt

SEQ ID NO: 5034680 - DNA, 19 bp, Homo sapiens
cgaaataattgttgttctg

SEQ ID NO: 5034681 - DNA, 22 bp, Homo sapiens
cgaatgacggtaagtgttctca

SEQ ID NO: 5034682 - DNA, 13 bp, Homo sapiens
cgaatgtgtcttt

SEQ ID NO: 5034683 - DNA, 22 bp, Homo sapiens
cgacttggagactcctggtctg

SEQ ID NO: 5034684 - DNA, 14 bp, Homo sapiens
cgagagctggccaa

SEQ ID NO: 5034685 - DNA, 23 bp, Homo sapiens
cgagattatcgttttcttaaagt

SEQ ID NO: 5034686 - DNA, 16 bp, Homo sapiens
cgagcccctcggctct

SEQ ID NO: 5034687 - DNA, 20 bp, Homo sapiens
cgagcccctcggctctggag

SEQ ID NO: 5034688 - DNA, 13 bp, Homo sapiens
cgagcctggctcc

SEQ ID NO: 5034689 - DNA, 22 bp, Homo sapiens
cgagctctcaaatccctctcca

SEQ ID NO: 5034690 - DNA, 13 bp, Homo sapiens
cgaggaaaggatt

SEQ ID NO: 5034691 - DNA, 15 bp, Homo sapiens
cgaggaaaggatttt

SEQ ID NO: 5034692 - DNA, 19 bp, Homo sapiens
cgaggccagtacctttcca

SEQ ID NO: 5034693 - DNA, 12 bp, Homo sapiens
cgaggctgctag

SEQ ID NO: 5034694 - DNA, 15 bp, Homo sapiens
cgaggctgcttccca

SEQ ID NO: 5034695 - DNA, 17 bp, Homo sapiens
cgcaatagttttttact

SEQ ID NO: 5034696 - DNA, 17 bp, Homo sapiens
cgcacagccacccgtgg

SEQ ID NO: 5034697 - DNA, 20 bp, Homo sapiens
cgcaccagcccgaacaccat

SEQ ID NO: 5034698 - DNA, 16 bp, Homo sapiens
cgcagggccatgcaga

SEQ ID NO: 5034699 - DNA, 18 bp, Homo sapiens
cgcagggccatgcagacc

SEQ ID NO: 5034700 - DNA, 12 bp, Homo sapiens
cgcagttttttt

SEQ ID NO: 5034701 - DNA, 21 bp, Homo sapiens
cgcagttttttttttcttgtc

SEQ ID NO: 5034702 - DNA, 20 bp, Homo sapiens
cgccagctgccgcaccagcc

SEQ ID NO: 5034703 - DNA, 18 bp, Homo sapiens
cgcccacaggaagcctgc

SEQ ID NO: 5034704 - DNA, 21 bp, Homo sapiens
cgcccacaggaagcctgcagt

SEQ ID NO: 5034705 - DNA, 16 bp, Homo sapiens
cgcccgtggggtctgc

SEQ ID NO: 5034706 - DNA, 15 bp, Homo sapiens
cgcctcccacggcac

SEQ ID NO: 5034707 - DNA, 22 bp, Homo sapiens
cgcctgccctcatggcccctct

SEQ ID NO: 5034708 - DNA, 14 bp, Homo sapiens
cgcctgcctgccac

SEQ ID NO: 5034709 - DNA, 15 bp, Homo sapiens
cgcctgtgatgctgg

SEQ ID NO: 5034710 - DNA, 17 bp, Homo sapiens
cgcctgtgatgctgggc

SEQ ID NO: 5034711 - DNA, 16 bp, Homo sapiens
cgcgatcccacacagg

SEQ ID NO: 5034712 - DNA, 14 bp, Homo sapiens
cgcgcgccaccacg

SEQ ID NO: 5034713 - DNA, 17 bp, Homo sapiens
cgctactataaagagaa

SEQ ID NO: 5034714 - DNA, 15 bp, Homo sapiens
cgctcagcccagctg

SEQ ID NO: 5034715 - DNA, 14 bp, Homo sapiens
cgctgatggagccc

SEQ ID NO: 5034716 - DNA, 15 bp, Homo sapiens
cgctgcttccaggct

SEQ ID NO: 5034717 - DNA, 22 bp, Homo sapiens
cgctgggtggtaccctctggag

SEQ ID NO: 5034718 - DNA, 14 bp, Homo sapiens
cgcttctgcctgca

SEQ ID NO: 5034719 - DNA, 15 bp, Homo sapiens
cgcttgtgacagtgc

SEQ ID NO: 5034720 - DNA, 13 bp, Homo sapiens
cggaaagtgagag

SEQ ID NO: 5034721 - DNA, 19 bp, Homo sapiens
cggaaagtgagagccagca

SEQ ID NO: 5034722 - DNA, 22 bp, Homo sapiens
cggacttagaaaaccagctcag

SEQ ID NO: 5034723 - DNA, 23 bp, Homo sapiens
cggacttagaaaaccagctcagc

SEQ ID NO: 5034724 - DNA, 14 bp, Homo sapiens
cggccacacccagc

SEQ ID NO: 5034725 - DNA, 19 bp, Homo sapiens
cggccacacccagcggccc

SEQ ID NO: 5034726 - DNA, 15 bp, Homo sapiens
cggctccccatgtgt

SEQ ID NO: 5034727 - DNA, 11 bp, Homo sapiens
cggctctggag

SEQ ID NO: 5034728 - DNA, 11 bp, Homo sapiens
cggctgtgtgt

SEQ ID NO: 5034729 - DNA, 18 bp, Homo sapiens
cggcttggatcctgggct

SEQ ID NO: 5034730 - DNA, 21 bp, Homo sapiens
cgggattgaagggtcctgccg

SEQ ID NO: 5034731 - DNA, 15 bp, Homo sapiens
cgggcaccagccagc

SEQ ID NO: 5034732 - DNA, 17 bp, Homo sapiens
cgggcccagaccggctt

SEQ ID NO: 5034733 - DNA, 15 bp, Homo sapiens
cgggcctgtccacag

SEQ ID NO: 5034734 - DNA, 17 bp, Homo sapiens
cgggcctgtccacaggc

SEQ ID NO: 5034735 - DNA, 22 bp, Homo sapiens
cgggcctgtccacaggcttctg

SEQ ID NO: 5034736 - DNA, 13 bp, Homo sapiens
cggtaagtgttct

SEQ ID NO: 5034737 - DNA, 13 bp, Homo sapiens
cggtgcccacacc

SEQ ID NO: 5034738 - DNA, 21 bp, Homo sapiens
cggtggtgcccgtgcccgcag

SEQ ID NO: 5034739 - DNA, 14 bp, Homo sapiens
cggtgtccccagag

SEQ ID NO: 5034740 - DNA, 20 bp, Homo sapiens
cggttatgaaattcaccccc

SEQ ID NO: 5034741 - DNA, 19 bp, Homo sapiens
cgtccacagagtataaata

SEQ ID NO: 5034742 - DNA, 16 bp, Homo sapiens
cgtctccagtcatctg

SEQ ID NO: 5034743 - DNA, 20 bp, Homo sapiens
cgtgagctgagcaggccaca

SEQ ID NO: 5034744 - DNA, 16 bp, Homo sapiens
cgtgagtcatttaaat

SEQ ID NO: 5034745 - DNA, 22 bp, Homo sapiens
ctgtggccgcacgcctctccct

SEQ ID NO: 5034746 - DNA, 15 bp, Homo sapiens
ctgtgggaaggccag

SEQ ID NO: 5034747 - DNA, 16 bp, Homo sapiens
ctgtgggaaggccagc

SEQ ID NO: 5034748 - DNA, 18 bp, Homo sapiens
ctgtgggaaggccagctg

SEQ ID NO: 5034749 - DNA, 16 bp, Homo sapiens
ctgtgtaaccttgggt

SEQ ID NO: 5034750 - DNA, 13 bp, Homo sapiens
ctgtgtaagattt

SEQ ID NO: 5034751 - DNA, 19 bp, Homo sapiens
ctgtgtgttaagctctgct

SEQ ID NO: 5034752 - DNA, 17 bp, Homo sapiens
ctgttaactgaatacca

SEQ ID NO: 5034753 - DNA, 13 bp, Homo sapiens
ctgttatataaat

SEQ ID NO: 5034754 - DNA, 14 bp, Homo sapiens
ctgttatataaatg

SEQ ID NO: 5034755 - DNA, 15 bp, Homo sapiens
ctgttatataaatgg

SEQ ID NO: 5034756 - DNA, 14 bp, Homo sapiens
ctgttatttataat

SEQ ID NO: 5034757 - DNA, 19 bp, Homo sapiens
ctgttcttagctcaatgag

SEQ ID NO: 5034758 - DNA, 17 bp, Homo sapiens
ctgttgggaacagcatg

SEQ ID NO: 5034759 - DNA, 12 bp, Homo sapiens
ctgtttgattct

SEQ ID NO: 5034760 - DNA, 14 bp, Homo sapiens
ctgtttgattcttt

SEQ ID NO: 5034761 - DNA, 17 bp, Homo sapiens
ctgtttgtagtgaaata

SEQ ID NO: 5034762 - DNA, 12 bp, Homo sapiens
ctgttttctgaa

SEQ ID NO: 5034763 - DNA, 13 bp, Homo sapiens
ctgttttctgaaa

SEQ ID NO: 5034764 - DNA, 20 bp, Homo sapiens
ctgttttctgaaacacacga

SEQ ID NO: 5034765 - DNA, 17 bp, Homo sapiens
ctgttttgttatataat

SEQ ID NO: 5034766 - DNA, 21 bp, Homo sapiens
ctgttttgttgacattctgaa

SEQ ID NO: 5034767 - DNA, 13 bp, Homo sapiens
ctgtttttgttgt

SEQ ID NO: 5034768 - DNA, 16 bp, Homo sapiens
cttaaaatacaagact

SEQ ID NO: 5034769 - DNA, 18 bp, Homo sapiens
cttaaaatacaagactgc

SEQ ID NO: 5034770 - DNA, 21 bp, Homo sapiens
cttaactcattgcaacctcca

SEQ ID NO: 5034771 - DNA, 17 bp, Homo sapiens
cttaagcaaaagaaaaa

SEQ ID NO: 5034772 - DNA, 14 bp, Homo sapiens
cttaagtgagcaga

SEQ ID NO: 5034773 - DNA, 16 bp, Homo sapiens
cttaagtgagcagaac

SEQ ID NO: 5034774 - DNA, 17 bp, Homo sapiens
cttaagtgagcagaaca

SEQ ID NO: 5034775 - DNA, 18 bp, Homo sapiens
cttaagtgagcagaacag

SEQ ID NO: 5034776 - DNA, 16 bp, Homo sapiens
cttaagtttatactct

SEQ ID NO: 5034777 - DNA, 22 bp, Homo sapiens
cttaatgtgattactgctctat

SEQ ID NO: 5034778 - DNA, 18 bp, Homo sapiens
cttaattattatttgtgt

SEQ ID NO: 5034779 - DNA, 19 bp, Homo sapiens
cttagaaaaccagctcagc

SEQ ID NO: 5034780 - DNA, 18 bp, Homo sapiens
cttagagtttctgtttga

SEQ ID NO: 5034781 - DNA, 16 bp, Homo sapiens
cttagatgtttcacac

SEQ ID NO: 5034782 - DNA, 12 bp, Homo sapiens
cttagcagtccc

SEQ ID NO: 5034783 - DNA, 22 bp, Homo sapiens
cttagctcaatgagcatgttta

SEQ ID NO: 5034784 - DNA, 12 bp, Homo sapiens
cttagtctcagt

SEQ ID NO: 5034785 - DNA, 18 bp, Homo sapiens
cttagtctcagtttgtgt

SEQ ID NO: 5034786 - DNA, 16 bp, Homo sapiens
cttatacgaaataatt

SEQ ID NO: 5034787 - DNA, 14 bp, Homo sapiens
cttatagacaacat

SEQ ID NO: 5034788 - DNA, 11 bp, Homo sapiens
cttatgaaaag

SEQ ID NO: 5034789 - DNA, 14 bp, Homo sapiens
cttatgaaaagaat

SEQ ID NO: 5034790 - DNA, 14 bp, Homo sapiens
cttattgcgctgct

SEQ ID NO: 5034791 - DNA, 11 bp, Homo sapiens
cttcaaactac

SEQ ID NO: 5034792 - DNA, 21 bp, Homo sapiens
cttcaatcggcttgtgggtga

SEQ ID NO: 5034793 - DNA, 20 bp, Homo sapiens
cttcacctaagtctctgtga

SEQ ID NO: 5034794 - DNA, 17 bp, Homo sapiens
cttcagttaagcctttg

SEQ ID NO: 5034795 - DNA, 23 bp, Homo sapiens
cttcagttgtctctgatgcagct

SEQ ID NO: 5034796 - DNA, 20 bp, Homo sapiens
cttcatacctacatgtattt

SEQ ID NO: 5034797 - DNA, 14 bp, Homo sapiens
cttcatgccagcta

SEQ ID NO: 5034798 - DNA, 17 bp, Homo sapiens
cttcattaataataaat

SEQ ID NO: 5034799 - DNA, 12 bp, Homo sapiens
cttcattctcgt

SEQ ID NO: 5034800 - DNA, 22 bp, Homo sapiens
cttcattctcgtgagtcattta

SEQ ID NO: 5034801 - DNA, 15 bp, Homo sapiens
cttccagtgaacatt

SEQ ID NO: 5034802 - DNA, 20 bp, Homo sapiens
cttccagtgaacattcccag

SEQ ID NO: 5034803 - DNA, 18 bp, Homo sapiens
cttcctcatccaccccat

SEQ ID NO: 5034804 - DNA, 20 bp, Homo sapiens
cttcctccgaggccagtacc

SEQ ID NO: 5034805 - DNA, 21 bp, Homo sapiens
cttcctccgaggccagtacct

SEQ ID NO: 5034806 - DNA, 22 bp, Homo sapiens
cttcctctgaggctgaaattca

SEQ ID NO: 5034807 - DNA, 20 bp, Homo sapiens
cttcctctttggtggcatgg

SEQ ID NO: 5034808 - DNA, 14 bp, Homo sapiens
cttcctgccagccc

SEQ ID NO: 5034809 - DNA, 18 bp, Homo sapiens
cttcctgccagcccctgc

SEQ ID NO: 5034810 - DNA, 15 bp, Homo sapiens
cttcctttaaaaaac

SEQ ID NO: 5034811 - DNA, 16 bp, Homo sapiens
cttcgacactgttctt

SEQ ID NO: 5034812 - DNA, 14 bp, Homo sapiens
cttctaagtaaata

SEQ ID NO: 5034813 - DNA, 16 bp, Homo sapiens
cttctcagaaggcaaa

SEQ ID NO: 5034814 - DNA, 15 bp, Homo sapiens
cttctcttgctttct

SEQ ID NO: 5034815 - DNA, 22 bp, Homo sapiens
cttctgagcagcgagcctgcta

SEQ ID NO: 5034816 - DNA, 20 bp, Homo sapiens
cttctgccttagtctcagtt

SEQ ID NO: 5034817 - DNA, 21 bp, Homo sapiens
cttctgccttagtctcagttt

SEQ ID NO: 5034818 - DNA, 16 bp, Homo sapiens
cttctggaatttgttc

SEQ ID NO: 5034819 - DNA, 19 bp, Homo sapiens
cttctgggttcaagcgatt

SEQ ID NO: 5034820 - DNA, 14 bp, Homo sapiens
cttctggttgatgc

SEQ ID NO: 5034821 - DNA, 14 bp, Homo sapiens
cttctgtgccaccc

SEQ ID NO: 5034822 - DNA, 16 bp, Homo sapiens
cttgaaggactaatag

SEQ ID NO: 5034823 - DNA, 21 bp, Homo sapiens
cttgaggggaagctagtcttt

SEQ ID NO: 5034824 - DNA, 18 bp, Homo sapiens
cttgatacccccctctgt

SEQ ID NO: 5034825 - DNA, 18 bp, Homo sapiens
cttgatttaaacacacag

SEQ ID NO: 5034826 - DNA, 19 bp, Homo sapiens
cttgccaagggtccctgtg

SEQ ID NO: 5034827 - DNA, 21 bp, Homo sapiens
cttgccccactctgcctgcct

SEQ ID NO: 5034828 - DNA, 15 bp, Homo sapiens
cttgcctggtacagt

SEQ ID NO: 5034829 - DNA, 11 bp, Homo sapiens
cttgctttcta

SEQ ID NO: 5034830 - DNA, 12 bp, Homo sapiens
cttggaagggcg

SEQ ID NO: 5034831 - DNA, 16 bp, Homo sapiens
cttggagactcctggt

SEQ ID NO: 5034832 - DNA, 19 bp, Homo sapiens
cttggagactcctggtctg

SEQ ID NO: 5034833 - DNA, 20 bp, Homo sapiens
cttggagactcctggtctgt

SEQ ID NO: 5034834 - DNA, 18 bp, Homo sapiens
cttggagtattggggtct

SEQ ID NO: 5034835 - DNA, 22 bp, Homo sapiens
cttggagtattggggtctgacc

SEQ ID NO: 5034836 - DNA, 17 bp, Homo sapiens
cttggatcctgggctgg

SEQ ID NO: 5034837 - DNA, 17 bp, Homo sapiens
cttggattctttccatt

SEQ ID NO: 5034838 - DNA, 14 bp, Homo sapiens
cttgtaaatataaa

SEQ ID NO: 5034839 - DNA, 22 bp, Homo sapiens
cttgtaattttacacgcttttg

SEQ ID NO: 5034840 - DNA, 20 bp, Homo sapiens
cttgtcaggagtgtgtgtga

SEQ ID NO: 5034841 - DNA, 20 bp, Homo sapiens
cttgtctataaagcatttaa

SEQ ID NO: 5034842 - DNA, 13 bp, Homo sapiens
cttgtgacagtgc

SEQ ID NO: 5034843 - DNA, 15 bp, Homo sapiens
ctttaaaagagagag

SEQ ID NO: 5034844 - DNA, 21 bp, Homo sapiens
ctttaaacattggttcttgta

SEQ ID NO: 5034845 - DNA, 10 bp, Homo sapiens
ctttaaagaa

SEQ ID NO: 5034846 - DNA, 15 bp, Homo sapiens
ctttaacacagtgtc

SEQ ID NO: 5034847 - DNA, 16 bp, Homo sapiens
ctttaacacagtgtct

SEQ ID NO: 5034848 - DNA, 17 bp, Homo sapiens
ctttaactcccattacc

SEQ ID NO: 5034849 - DNA, 22 bp, Homo sapiens
ctttaactcccattaccatgta

SEQ ID NO: 5034850 - DNA, 15 bp, Homo sapiens
ctttaatataaatgc

SEQ ID NO: 5034851 - DNA, 16 bp, Homo sapiens
ctttaatataaatgca

SEQ ID NO: 5034852 - DNA, 18 bp, Homo sapiens
ctttaatataaatgcaaa

SEQ ID NO: 5034853 - DNA, 18 bp, Homo sapiens
ctttaatatcatcagtat

SEQ ID NO: 5034854 - DNA, 21 bp, Homo sapiens
ctttaatatcatcagtattga

SEQ ID NO: 5034855 - DNA, 23 bp, Homo sapiens
ctttacaaaacaaactcattcat

SEQ ID NO: 5034856 - DNA, 15 bp, Homo sapiens
ctttagatagccctg

SEQ ID NO: 5034857 - DNA, 20 bp, Homo sapiens
ctttagatagccctgtcctg

SEQ ID NO: 5034858 - DNA, 20 bp, Homo sapiens
ctttattctggcagaggagg

SEQ ID NO: 5034859 - DNA, 19 bp, Homo sapiens
gagtgacagctttctggga

SEQ ID NO: 5034860 - DNA, 10 bp, Homo sapiens
gagtgatctt

SEQ ID NO: 5034861 - DNA, 12 bp, Homo sapiens
gagtgctgtttt

SEQ ID NO: 5034862 - DNA, 19 bp, Homo sapiens
gagtgcttgcttttcatgc

SEQ ID NO: 5034863 - DNA, 22 bp, Homo sapiens
gagtttatgttccattaaacga

SEQ ID NO: 5034864 - DNA, 15 bp, Homo sapiens
gagtttctgtttgat

SEQ ID NO: 5034865 - DNA, 16 bp, Homo sapiens
gataaacaacaaggtg

SEQ ID NO: 5034866 - DNA, 15 bp, Homo sapiens
gataaacacaagatt

SEQ ID NO: 5034867 - DNA, 14 bp, Homo sapiens
gataaagcacagct

SEQ ID NO: 5034868 - DNA, 21 bp, Homo sapiens
gataatcaactgggctgaaca

SEQ ID NO: 5034869 - DNA, 13 bp, Homo sapiens
gatacccccctct

SEQ ID NO: 5034870 - DNA, 22 bp, Homo sapiens
gatacgctactataaagagaag

SEQ ID NO: 5034871 - DNA, 22 bp, Homo sapiens
gatacttcgacactgttcttag

SEQ ID NO: 5034872 - DNA, 15 bp, Homo sapiens
gatagccctgtcctg

SEQ ID NO: 5034873 - DNA, 21 bp, Homo sapiens
gatcacagtggccacggccac

SEQ ID NO: 5034874 - DNA, 22 bp, Homo sapiens
gatccccaagacatgtggaggg

SEQ ID NO: 5034875 - DNA, 16 bp, Homo sapiens
gatcctcccaggcttc

SEQ ID NO: 5034876 - DNA, 16 bp, Homo sapiens
gatctccctgagatgg

SEQ ID NO: 5034877 - DNA, 18 bp, Homo sapiens
gatctgtttgaggagagc

SEQ ID NO: 5034878 - DNA, 21 bp, Homo sapiens
gatctttggacagaagcagct

SEQ ID NO: 5034879 - DNA, 18 bp, Homo sapiens
gatgaaaactaaggattt

SEQ ID NO: 5034880 - DNA, 22 bp, Homo sapiens
gatgactatgcagaggcctggg

SEQ ID NO: 5034881 - DNA, 16 bp, Homo sapiens
gatgagcgccacctct

SEQ ID NO: 5034882 - DNA, 14 bp, Homo sapiens
gatgatgatgaaaa

SEQ ID NO: 5034883 - DNA, 15 bp, Homo sapiens
gatgcacatccctgg

SEQ ID NO: 5034884 - DNA, 23 bp, Homo sapiens
gatgcactttgctttaatataaa

SEQ ID NO: 5034885 - DNA, 20 bp, Homo sapiens
gatgccaagttgtttgagaa

SEQ ID NO: 5034886 - DNA, 18 bp, Homo sapiens
gatggagccccaccttgt

SEQ ID NO: 5034887 - DNA, 15 bp, Homo sapiens
gatggagtgctgttt

SEQ ID NO: 5034888 - DNA, 20 bp, Homo sapiens
gatggcatttggtctcaggc

SEQ ID NO: 5034889 - DNA, 23 bp, Homo sapiens
gatggcatttggtctcaggcagc

SEQ ID NO: 5034890 - DNA, 11 bp, Homo sapiens
gatgtccccag

SEQ ID NO: 5034891 - DNA, 19 bp, Homo sapiens
gatgtgcttgttaactgag

SEQ ID NO: 5034892 - DNA, 15 bp, Homo sapiens
gatgttatgaacagc

SEQ ID NO: 5034893 - DNA, 18 bp, Homo sapiens
gatgttatgaacagctgt

SEQ ID NO: 5034894 - DNA, 13 bp, Homo sapiens
gattcaaattgct

SEQ ID NO: 5034895 - DNA, 18 bp, Homo sapiens
gattcaaattgctgcttg

SEQ ID NO: 5034896 - DNA, 12 bp, Homo sapiens
gattcagcaaaa

SEQ ID NO: 5034897 - DNA, 13 bp, Homo sapiens
gattctccctggg

SEQ ID NO: 5034898 - DNA, 22 bp, Homo sapiens
gattctttccatttgcatttgt

SEQ ID NO: 5034899 - DNA, 16 bp, Homo sapiens
gattgaagggtcctgc

SEQ ID NO: 5034900 - DNA, 22 bp, Homo sapiens
gattgggaggtgcgtgttcagc

SEQ ID NO: 5034901 - DNA, 17 bp, Homo sapiens
gattggtgtttttttct

SEQ ID NO: 5034902 - DNA, 20 bp, Homo sapiens
gattggtgtttttttctatg

SEQ ID NO: 5034903 - DNA, 17 bp, Homo sapiens
gatttaaacacacagat

SEQ ID NO: 5034904 - DNA, 19 bp, Homo sapiens
gatttattaaagaaaaaaa

SEQ ID NO: 5034905 - DNA, 23 bp, Homo sapiens
gatttctttctttgcaccaaaga

SEQ ID NO: 5034906 - DNA, 12 bp, Homo sapiens
gattttaccaaa

SEQ ID NO: 5034907 - DNA, 19 bp, Homo sapiens
gattttaccaaagcatcaa

SEQ ID NO: 5034908 - DNA, 19 bp, Homo sapiens
gattttatgctttaaacat

SEQ ID NO: 5034909 - DNA, 13 bp, Homo sapiens
gatttttaaaatg

SEQ ID NO: 5034910 - DNA, 14 bp, Homo sapiens
gatttttctttaca

SEQ ID NO: 5034911 - DNA, 19 bp, Homo sapiens
gcaaaaactacattttgca

SEQ ID NO: 5034912 - DNA, 20 bp, Homo sapiens
gcaaacccagaggtggatgt

SEQ ID NO: 5034913 - DNA, 10 bp, Homo sapiens
gcaaactctt

SEQ ID NO: 5034914 - DNA, 17 bp, Homo sapiens
gcaaataacaaatgcca

SEQ ID NO: 5034915 - DNA, 16 bp, Homo sapiens
gcaaattgctagtcag

SEQ ID NO: 5034916 - DNA, 15 bp, Homo sapiens
gcaacacagccacta

SEQ ID NO: 5034917 - DNA, 13 bp, Homo sapiens
gcaacagcttcag

SEQ ID NO: 5034918 - DNA, 22 bp, Homo sapiens
gcaagaaatggcgtctgctctg

SEQ ID NO: 5034919 - DNA, 19 bp, Homo sapiens
gcaagagtgtggaggctga

SEQ ID NO: 5034920 - DNA, 21 bp, Homo sapiens
gcaatctccccttgatttaaa

SEQ ID NO: 5034921 - DNA, 23 bp, Homo sapiens
gcaatctccccttgatttaaaca

SEQ ID NO: 5034922 - DNA, 17 bp, Homo sapiens
gcaatgaagtctctgaa

SEQ ID NO: 5034923 - DNA, 20 bp, Homo sapiens
gcaatgtgtataaacaagaa

SEQ ID NO: 5034924 - DNA, 12 bp, Homo sapiens
gcaattttgtgg

SEQ ID NO: 5034925 - DNA, 21 bp, Homo sapiens
gcacaaggccttgcctggcct

SEQ ID NO: 5034926 - DNA, 23 bp, Homo sapiens
gcacaaggccttgcctggcctga

SEQ ID NO: 5034927 - DNA, 12 bp, Homo sapiens
gcacacaggaca

SEQ ID NO: 5034928 - DNA, 14 bp, Homo sapiens
gcacacaggacagc

SEQ ID NO: 5034929 - DNA, 13 bp, Homo sapiens
gcacacagggccc

SEQ ID NO: 5034930 - DNA, 14 bp, Homo sapiens
gcacacagggcccg

SEQ ID NO: 5034931 - DNA, 14 bp, Homo sapiens
gcacagccacccgt

SEQ ID NO: 5034932 - DNA, 13 bp, Homo sapiens
gcaccaaagacat

SEQ ID NO: 5034933 - DNA, 13 bp, Homo sapiens
gcaccacactggg

SEQ ID NO: 5034934 - DNA, 15 bp, Homo sapiens
gcaccacactgggtg

SEQ ID NO: 5034935 - DNA, 11 bp, Homo sapiens
gcaccagccag

SEQ ID NO: 5034936 - DNA, 20 bp, Homo sapiens
gcacccacctgttttctgaa

SEQ ID NO: 5034937 - DNA, 22 bp, Homo sapiens
gcacccacctgttttctgaaac

SEQ ID NO: 5034938 - DNA, 23 bp, Homo sapiens
gcacccacctgttttctgaaaca

SEQ ID NO: 5034939 - DNA, 14 bp, Homo sapiens
gcaccccgctgcgg

SEQ ID NO: 5034940 - DNA, 22 bp, Homo sapiens
gcacctcggggacaccagagct

SEQ ID NO: 5034941 - DNA, 14 bp, Homo sapiens
gcacggctctgtcc

SEQ ID NO: 5034942 - DNA, 18 bp, Homo sapiens
gcacggctctgtccccag

SEQ ID NO: 5034943 - DNA, 19 bp, Homo sapiens
gcacggctctgtccccagc

SEQ ID NO: 5034944 - DNA, 22 bp, Homo sapiens
gcacggctctgtccccagcctg

SEQ ID NO: 5034945 - DNA, 14 bp, Homo sapiens
gcactccctcctgg

SEQ ID NO: 5034946 - DNA, 15 bp, Homo sapiens
gcactccctcctgga

SEQ ID NO: 5034947 - DNA, 16 bp, Homo sapiens
gcactgactgggcata

SEQ ID NO: 5034948 - DNA, 17 bp, Homo sapiens
gcactgactgggcatag

SEQ ID NO: 5034949 - DNA, 19 bp, Homo sapiens
gcactggggagcccgtctc

SEQ ID NO: 5034950 - DNA, 18 bp, Homo sapiens
gcactttaaatgaagcta

SEQ ID NO: 5034951 - DNA, 18 bp, Homo sapiens
gcagaacctgcacacagg

SEQ ID NO: 5034952 - DNA, 19 bp, Homo sapiens
gcagaacctgcacacagga

SEQ ID NO: 5034953 - DNA, 23 bp, Homo sapiens
gcagaacctgcacacaggacagc

SEQ ID NO: 5034954 - DNA, 17 bp, Homo sapiens
gcagaccaccccgcctg

SEQ ID NO: 5034955 - DNA, 13 bp, Homo sapiens
gcagacctcatgc

SEQ ID NO: 5034956 - DNA, 22 bp, Homo sapiens
gcagagaggtttgcagtcccaa

SEQ ID NO: 5034957 - DNA, 14 bp, Homo sapiens
gcagcctgtgcctg

SEQ ID NO: 5034958 - DNA, 22 bp, Homo sapiens
gcagcgaccgccccctcctcta

SEQ ID NO: 5034959 - DNA, 12 bp, Homo sapiens
gcagcgagcctg

SEQ ID NO: 5034960 - DNA, 18 bp, Homo sapiens
gcagcgtgtgggtcccgc

SEQ ID NO: 5034961 - DNA, 14 bp, Homo sapiens
gcagctgctcccca

SEQ ID NO: 5034962 - DNA, 22 bp, Homo sapiens
gcagctgctccccaggccaccc

SEQ ID NO: 5034963 - DNA, 18 bp, Homo sapiens
gcaggaactgggctgggc

SEQ ID NO: 5034964 - DNA, 20 bp, Homo sapiens
gcaggccacacttcaaacta

SEQ ID NO: 5034965 - DNA, 14 bp, Homo sapiens
gcagggagggcagt

SEQ ID NO: 5034966 - DNA, 18 bp, Homo sapiens
gcagggccatgcagacct

SEQ ID NO: 5034967 - DNA, 17 bp, Homo sapiens
gcaggtgactgtgctgt

SEQ ID NO: 5034968 - DNA, 19 bp, Homo sapiens
gcaggttctgcctgctttg

SEQ ID NO: 5034969 - DNA, 23 bp, Homo sapiens
gcaggttcttgttggtgcacagc

SEQ ID NO: 5034970 - DNA, 21 bp, Homo sapiens
gcagtagaggctatggacagg

SEQ ID NO: 5034971 - DNA, 14 bp, Homo sapiens
gcagtggaggtggg

SEQ ID NO: 5034972 - DNA, 13 bp, Homo sapiens
gctttgtctctgt

SEQ ID NO: 5034973 - DNA, 21 bp, Homo sapiens
gcttttgcccattttgaatca

SEQ ID NO: 5034974 - DNA, 20 bp, Homo sapiens
gcttttgtctacacaccctg

SEQ ID NO: 5034975 - DNA, 12 bp, Homo sapiens
ggaaaaccagac

SEQ ID NO: 5034976 - DNA, 22 bp, Homo sapiens
ggaaaaccagactacttgggag

SEQ ID NO: 5034977 - DNA, 16 bp, Homo sapiens
ggaaaatggccatgca

SEQ ID NO: 5034978 - DNA, 18 bp, Homo sapiens
ggaaactgggttcctgca

SEQ ID NO: 5034979 - DNA, 16 bp, Homo sapiens
ggaaagcccctgcccc

SEQ ID NO: 5034980 - DNA, 21 bp, Homo sapiens
ggaaatttaaagcaggttctt

SEQ ID NO: 5034981 - DNA, 23 bp, Homo sapiens
ggaaccaggagaagggctggggc

SEQ ID NO: 5034982 - DNA, 15 bp, Homo sapiens
ggaagaaagaagaca

SEQ ID NO: 5034983 - DNA, 22 bp, Homo sapiens
ggaagaagaaatctttctccct

SEQ ID NO: 5034984 - DNA, 21 bp, Homo sapiens
ggaagagcaggtgactgtgct

SEQ ID NO: 5034985 - DNA, 18 bp, Homo sapiens
ggaagcagaaatccaagc

SEQ ID NO: 5034986 - DNA, 22 bp, Homo sapiens
ggaagccaaacctctgtgagca

SEQ ID NO: 5034987 - DNA, 20 bp, Homo sapiens
ggaagccatcccttttttta

SEQ ID NO: 5034988 - DNA, 16 bp, Homo sapiens
ggaagctagtcttttg

SEQ ID NO: 5034989 - DNA, 13 bp, Homo sapiens
ggaaggatctgct

SEQ ID NO: 5034990 - DNA, 21 bp, Homo sapiens
ggacacacatggtgagcctag

SEQ ID NO: 5034991 - DNA, 12 bp, Homo sapiens
ggacaccagagc

SEQ ID NO: 5034992 - DNA, 22 bp, Homo sapiens
ggacacgctcagtggggcagag

SEQ ID NO: 5034993 - DNA, 14 bp, Homo sapiens
ggacagaagcagct

SEQ ID NO: 5034994 - DNA, 16 bp, Homo sapiens
ggacagaagcagctct

SEQ ID NO: 5034995 - DNA, 15 bp, Homo sapiens
ggaccaggggagagg

SEQ ID NO: 5034996 - DNA, 15 bp, Homo sapiens
ggaccccgagcctgg

SEQ ID NO: 5034997 - DNA, 21 bp, Homo sapiens
ggaccccgagcctggctccaa

SEQ ID NO: 5034998 - DNA, 12 bp, Homo sapiens
ggaccctgtccg

SEQ ID NO: 5034999 - DNA, 21 bp, Homo sapiens
ggaccctgtccggcccagtgc

SEQ ID NO: 5035000 - DNA, 11 bp, Homo sapiens
ggactcctgaa

SEQ ID NO: 5035001 - DNA, 22 bp, Homo sapiens
ggactgcacagcgtcctgtcca

SEQ ID NO: 5035002 - DNA, 12 bp, Homo sapiens
ggactgcagtgt

SEQ ID NO: 5035003 - DNA, 16 bp, Homo sapiens
ggactgcagtgtggag

SEQ ID NO: 5035004 - DNA, 23 bp, Homo sapiens
ggacttagaaaaccagctcagca

SEQ ID NO: 5035005 - DNA, 17 bp, Homo sapiens
ggagacactggcccctc

SEQ ID NO: 5035006 - DNA, 22 bp, Homo sapiens
ggagcacggctctgtccccagc

SEQ ID NO: 5035007 - DNA, 23 bp, Homo sapiens
ggagcacggctctgtccccagcc

SEQ ID NO: 5035008 - DNA, 17 bp, Homo sapiens
ggagcagcagccactgc

SEQ ID NO: 5035009 - DNA, 12 bp, Homo sapiens
ggagccccacct

SEQ ID NO: 5035010 - DNA, 15 bp, Homo sapiens
ggagcggcagatggg

SEQ ID NO: 5035011 - DNA, 21 bp, Homo sapiens
ggagctctgtgggtctctgga

SEQ ID NO: 5035012 - DNA, 21 bp, Homo sapiens
ggagctgggagaccctcccca

SEQ ID NO: 5035013 - DNA, 16 bp, Homo sapiens
ggagctgggcccctgc

SEQ ID NO: 5035014 - DNA, 12 bp, Homo sapiens
ggaggaatactg

SEQ ID NO: 5035015 - DNA, 22 bp, Homo sapiens
ggaggacaggcgggaggaggtg

SEQ ID NO: 5035016 - DNA, 18 bp, Homo sapiens
ggaggatcagttttttgt

SEQ ID NO: 5035017 - DNA, 20 bp, Homo sapiens
ggaggcagatgtggggctga

SEQ ID NO: 5035018 - DNA, 16 bp, Homo sapiens
ggaggcccttgtcgtg

SEQ ID NO: 5035019 - DNA, 20 bp, Homo sapiens
ggaggctcccgaggggaagg

SEQ ID NO: 5035020 - DNA, 14 bp, Homo sapiens
ggaggctctctgta

SEQ ID NO: 5035021 - DNA, 22 bp, Homo sapiens
ggaggtgcgtgttcagcagaac

SEQ ID NO: 5035022 - DNA, 15 bp, Homo sapiens
ggaggttgggtgggc

SEQ ID NO: 5035023 - DNA, 14 bp, Homo sapiens
ggaggtttgtcggg

SEQ ID NO: 5035024 - DNA, 15 bp, Homo sapiens
ggagtcccctcacct

SEQ ID NO: 5035025 - DNA, 21 bp, Homo sapiens
ggagtgctgttttgttatata

SEQ ID NO: 5035026 - DNA, 15 bp, Homo sapiens
ggagttcaccttgga

SEQ ID NO: 5035027 - DNA, 21 bp, Homo sapiens
ggagttcaccttggaagggcg

SEQ ID NO: 5035028 - DNA, 21 bp, Homo sapiens
ggagtttatgttccattaaac

SEQ ID NO: 5035029 - DNA, 12 bp, Homo sapiens
ggatcagttttt

SEQ ID NO: 5035030 - DNA, 14 bp, Homo sapiens
ggatctgctgaggc

SEQ ID NO: 5035031 - DNA, 18 bp, Homo sapiens
ggatctgctgaggcccag

SEQ ID NO: 5035032 - DNA, 17 bp, Homo sapiens
ggatggcatttggtctc

SEQ ID NO: 5035033 - DNA, 16 bp, Homo sapiens
ggatggtagttttttc

SEQ ID NO: 5035034 - DNA, 20 bp, Homo sapiens
ggatggtagttttttcatct

SEQ ID NO: 5035035 - DNA, 18 bp, Homo sapiens
ggatgtatatgtcatctc

SEQ ID NO: 5035036 - DNA, 12 bp, Homo sapiens
ggatgtcacagt

SEQ ID NO: 5035037 - DNA, 14 bp, Homo sapiens
ggatgtcacagtcc

SEQ ID NO: 5035038 - DNA, 12 bp, Homo sapiens
ggatgtccctgg

SEQ ID NO: 5035039 - DNA, 15 bp, Homo sapiens
ggatgttatgaacag

SEQ ID NO: 5035040 - DNA, 19 bp, Homo sapiens
ggatgttatgaacagctgt

SEQ ID NO: 5035041 - DNA, 13 bp, Homo sapiens
ggattcaagtgat

SEQ ID NO: 5035042 - DNA, 19 bp, Homo sapiens
ggattcttaattctctgca

SEQ ID NO: 5035043 - DNA, 17 bp, Homo sapiens
ggattttaccaaagcat

SEQ ID NO: 5035044 - DNA, 23 bp, Homo sapiens
ggcaaacaggcagttggccagag

SEQ ID NO: 5035045 - DNA, 13 bp, Homo sapiens
ggcaaatgacttt

SEQ ID NO: 5035046 - DNA, 16 bp, Homo sapiens
ggcaacgcacaaaaca

SEQ ID NO: 5035047 - DNA, 13 bp, Homo sapiens
ggcaagtgtgggc

SEQ ID NO: 5035048 - DNA, 20 bp, Homo sapiens
ggcacagcggagtctgtcct

SEQ ID NO: 5035049 - DNA, 13 bp, Homo sapiens
ggcaccagccagc

SEQ ID NO: 5035050 - DNA, 20 bp, Homo sapiens
ggcacttgggacaaaaacaa

SEQ ID NO: 5035051 - DNA, 15 bp, Homo sapiens
ggcagaggcagtacc

SEQ ID NO: 5035052 - DNA, 22 bp, Homo sapiens
ggcagatgtggggctgagctgg

SEQ ID NO: 5035053 - DNA, 14 bp, Homo sapiens
ggcagccacccaag

SEQ ID NO: 5035054 - DNA, 17 bp, Homo sapiens
ggcagccacccaagcct

SEQ ID NO: 5035055 - DNA, 22 bp, Homo sapiens
ggcaggctgtctggccaggcct

SEQ ID NO: 5035056 - DNA, 17 bp, Homo sapiens
ggcaggcttggggaaaa

SEQ ID NO: 5035057 - DNA, 16 bp, Homo sapiens
ggcagttatattttgc

SEQ ID NO: 5035058 - DNA, 12 bp, Homo sapiens
ggcatggaaatt

SEQ ID NO: 5035059 - DNA, 20 bp, Homo sapiens
ggcatgtcccacccacccgc

SEQ ID NO: 5035060 - DNA, 17 bp, Homo sapiens
ggcattagaattattta

SEQ ID NO: 5035061 - DNA, 20 bp, Homo sapiens
ggcatttggtctcaggcagc

SEQ ID NO: 5035062 - DNA, 14 bp, Homo sapiens
ggccaaataaagtc

SEQ ID NO: 5035063 - DNA, 17 bp, Homo sapiens
ggccaaataaagtctct

SEQ ID NO: 5035064 - DNA, 17 bp, Homo sapiens
ggccaagcagtgcctgc

SEQ ID NO: 5035065 - DNA, 16 bp, Homo sapiens
ggccacacccagcggc

SEQ ID NO: 5035066 - DNA, 22 bp, Homo sapiens
ggccacagtcatggtggccacg

SEQ ID NO: 5035067 - DNA, 23 bp, Homo sapiens
ggccacgtgggcaaacaggcagt

SEQ ID NO: 5035068 - DNA, 18 bp, Homo sapiens
ggccagagagcctggtgc

SEQ ID NO: 5035069 - DNA, 21 bp, Homo sapiens
ggccagagagcctggtgctgc

SEQ ID NO: 5035070 - DNA, 15 bp, Homo sapiens
ggccagcttttcaaa

SEQ ID NO: 5035071 - DNA, 19 bp, Homo sapiens
ggccagtccccgaggagct

SEQ ID NO: 5035072 - DNA, 23 bp, Homo sapiens
ggccagtccccgaggagctgggc

SEQ ID NO: 5035073 - DNA, 13 bp, Homo sapiens
ggccatctgctcc

SEQ ID NO: 5035074 - DNA, 14 bp, Homo sapiens
ggccatgcagacct

SEQ ID NO: 5035075 - DNA, 13 bp, Homo sapiens
ggccatgcaggag

SEQ ID NO: 5035076 - DNA, 15 bp, Homo sapiens
ggccatgcaggaggt

SEQ ID NO: 5035077 - DNA, 18 bp, Homo sapiens
ggccatgcaggaggtgga

SEQ ID NO: 5035078 - DNA, 13 bp, Homo sapiens
ggccatggcctct

SEQ ID NO: 5035079 - DNA, 20 bp, Homo sapiens
ggccatttagattaggaagg

SEQ ID NO: 5035080 - DNA, 18 bp, Homo sapiens
ggcccagaccggcttctc

SEQ ID NO: 5035081 - DNA, 14 bp, Homo sapiens
ggcccagtgccact

SEQ ID NO: 5035082 - DNA, 16 bp, Homo sapiens
ggcccagtgccactgc

SEQ ID NO: 5035083 - DNA, 19 bp, Homo sapiens
ggccccactttgaagggca

SEQ ID NO: 5035084 - DNA, 19 bp, Homo sapiens
ggccccccgcacagccacc

SEQ ID NO: 5035085 - DNA, 21 bp, Homo sapiens
gtgatcttaatatatttgaaa

SEQ ID NO: 5035086 - DNA, 14 bp, Homo sapiens
gtgatggggcaagg

SEQ ID NO: 5035087 - DNA, 13 bp, Homo sapiens
gtgcaacagacaa

SEQ ID NO: 5035088 - DNA, 15 bp, Homo sapiens
gtgcaacagacaagt

SEQ ID NO: 5035089 - DNA, 19 bp, Homo sapiens
gtgcacagcacaaattagt

SEQ ID NO: 5035090 - DNA, 22 bp, Homo sapiens
gtgcacccacctgttttctgaa

SEQ ID NO: 5035091 - DNA, 21 bp, Homo sapiens
gtgccacccatgcagctgctc

SEQ ID NO: 5035092 - DNA, 12 bp, Homo sapiens
gtgccactgccc

SEQ ID NO: 5035093 - DNA, 19 bp, Homo sapiens
gtgcccccgcctgccaccg

SEQ ID NO: 5035094 - DNA, 17 bp, Homo sapiens
gtgcccgcaggaactgg

SEQ ID NO: 5035095 - DNA, 19 bp, Homo sapiens
gtgcctcttccagtgaaca

SEQ ID NO: 5035096 - DNA, 21 bp, Homo sapiens
gtgcctgcctttgtgtcagaa

SEQ ID NO: 5035097 - DNA, 15 bp, Homo sapiens
gtgcctgtcccaccc

SEQ ID NO: 5035098 - DNA, 13 bp, Homo sapiens
gtgcgtctccagt

SEQ ID NO: 5035099 - DNA, 19 bp, Homo sapiens
gtgctccctctgtcatcct

SEQ ID NO: 5035100 - DNA, 14 bp, Homo sapiens
gtgctgctgctgct

SEQ ID NO: 5035101 - DNA, 12 bp, Homo sapiens
gtgctgtgtgcc

SEQ ID NO: 5035102 - DNA, 16 bp, Homo sapiens
gtgctgttttgttata

SEQ ID NO: 5035103 - DNA, 19 bp, Homo sapiens
gtgctgttttgttatataa

SEQ ID NO: 5035104 - DNA, 21 bp, Homo sapiens
gtgctgttttgttatataatt

SEQ ID NO: 5035105 - DNA, 15 bp, Homo sapiens
gtgctttgagagaga

SEQ ID NO: 5035106 - DNA, 17 bp, Homo sapiens
gtgctttgagagagaaa

SEQ ID NO: 5035107 - DNA, 19 bp, Homo sapiens
gtggacccagcgggcaggt

SEQ ID NO: 5035108 - DNA, 14 bp, Homo sapiens
gtggagcagcagcc

SEQ ID NO: 5035109 - DNA, 19 bp, Homo sapiens
gtggagttcaccttggaag

SEQ ID NO: 5035110 - DNA, 15 bp, Homo sapiens
gtggatgttatgaac

SEQ ID NO: 5035111 - DNA, 16 bp, Homo sapiens
gtggatgttatgaaca

SEQ ID NO: 5035112 - DNA, 18 bp, Homo sapiens
gtggcagtggaggtgggg

SEQ ID NO: 5035113 - DNA, 14 bp, Homo sapiens
gtggcatggaaggg

SEQ ID NO: 5035114 - DNA, 12 bp, Homo sapiens
gtggccatggcc

SEQ ID NO: 5035115 - DNA, 20 bp, Homo sapiens
gtggcccctgctgtctctct

SEQ ID NO: 5035116 - DNA, 22 bp, Homo sapiens
gtggcccctgctgtctctctgg

SEQ ID NO: 5035117 - DNA, 16 bp, Homo sapiens
gtggccgcacgcctct

SEQ ID NO: 5035118 - DNA, 19 bp, Homo sapiens
gtggcttaagtgagcagaa

SEQ ID NO: 5035119 - DNA, 23 bp, Homo sapiens
gtgggacagttcctgagaccagc

SEQ ID NO: 5035120 - DNA, 17 bp, Homo sapiens
gtgggcaaacaggcagt

SEQ ID NO: 5035121 - DNA, 18 bp, Homo sapiens
gtgggtcccgcactctgc

SEQ ID NO: 5035122 - DNA, 21 bp, Homo sapiens
gtggtattttcaatagccact

SEQ ID NO: 5035123 - DNA, 23 bp, Homo sapiens
gtggtattttcaatagccactaa

SEQ ID NO: 5035124 - DNA, 14 bp, Homo sapiens
gtggtgtgatctta

SEQ ID NO: 5035125 - DNA, 21 bp, Homo sapiens
gtgtaagatttgtttttaaac

SEQ ID NO: 5035126 - DNA, 16 bp, Homo sapiens
gtgtctgccaaacaca

SEQ ID NO: 5035127 - DNA, 20 bp, Homo sapiens
gtgtctgccaaacacattta

SEQ ID NO: 5035128 - DNA, 22 bp, Homo sapiens
gtgtgatcttaatatatttgaa

SEQ ID NO: 5035129 - DNA, 15 bp, Homo sapiens
gtgtgcaacagacaa

SEQ ID NO: 5035130 - DNA, 19 bp, Homo sapiens
gtgtgcacgcgtgtgcagg

SEQ ID NO: 5035131 - DNA, 13 bp, Homo sapiens
gtgtgggtcccgc

SEQ ID NO: 5035132 - DNA, 16 bp, Homo sapiens
gtgtgttaagctctgc

SEQ ID NO: 5035133 - DNA, 15 bp, Homo sapiens
gtgttaagctctgct

SEQ ID NO: 5035134 - DNA, 11 bp, Homo sapiens
gtgttctcctt

SEQ ID NO: 5035135 - DNA, 14 bp, Homo sapiens
gtgttctgtttgtt

SEQ ID NO: 5035136 - DNA, 13 bp, Homo sapiens
gtgttctgttttg

SEQ ID NO: 5035137 - DNA, 15 bp, Homo sapiens
gtgttctgttttgtt

SEQ ID NO: 5035138 - DNA, 13 bp, Homo sapiens
gtgtttaagacat

SEQ ID NO: 5035139 - DNA, 22 bp, Homo sapiens
gtgtttaagacatttttggaag

SEQ ID NO: 5035140 - DNA, 16 bp, Homo sapiens
gttaactgaataccac

SEQ ID NO: 5035141 - DNA, 15 bp, Homo sapiens
gttaagatatgatgt

SEQ ID NO: 5035142 - DNA, 12 bp, Homo sapiens
gttaagcctttg

SEQ ID NO: 5035143 - DNA, 16 bp, Homo sapiens
gttaagcctttggaaa

SEQ ID NO: 5035144 - DNA, 12 bp, Homo sapiens
gttaagctctgc

SEQ ID NO: 5035145 - DNA, 13 bp, Homo sapiens
gttaagtctgttt

SEQ ID NO: 5035146 - DNA, 22 bp, Homo sapiens
gttaagtctgttttatgacttc

SEQ ID NO: 5035147 - DNA, 11 bp, Homo sapiens
gttagcaaaga

SEQ ID NO: 5035148 - DNA, 21 bp, Homo sapiens
gttagctaataaaaagctttt

SEQ ID NO: 5035149 - DNA, 13 bp, Homo sapiens
gttatataaatgg

SEQ ID NO: 5035150 - DNA, 14 bp, Homo sapiens
gttatatataaata

SEQ ID NO: 5035151 - DNA, 22 bp, Homo sapiens
gttatatatggggatggtagtt

SEQ ID NO: 5035152 - DNA, 14 bp, Homo sapiens
gttatctctgtgtt

SEQ ID NO: 5035153 - DNA, 15 bp, Homo sapiens
gttatgaacagctgt

SEQ ID NO: 5035154 - DNA, 16 bp, Homo sapiens
gttatgaacagctgtg

SEQ ID NO: 5035155 - DNA, 18 bp, Homo sapiens
gttatgaacagctgtgtc

SEQ ID NO: 5035156 - DNA, 14 bp, Homo sapiens
gttattgttttgtt

SEQ ID NO: 5035157 - DNA, 22 bp, Homo sapiens
gttcaccttggaagggcgttct

SEQ ID NO: 5035158 - DNA, 15 bp, Homo sapiens
gttcagcagaacctg

SEQ ID NO: 5035159 - DNA, 17 bp, Homo sapiens
gttcccacattaaagaa

SEQ ID NO: 5035160 - DNA, 21 bp, Homo sapiens
gttcccacattaaagaagacc

SEQ ID NO: 5035161 - DNA, 15 bp, Homo sapiens
gttccccaagacatt

SEQ ID NO: 5035162 - DNA, 16 bp, Homo sapiens
gttcccgtttctccac

SEQ ID NO: 5035163 - DNA, 18 bp, Homo sapiens
gttcccgtttctccacct

SEQ ID NO: 5035164 - DNA, 23 bp, Homo sapiens
gttcctcccctcctcctggactc

SEQ ID NO: 5035165 - DNA, 21 bp, Homo sapiens
gttcctgagtgcgtggatctg

SEQ ID NO: 5035166 - DNA, 15 bp, Homo sapiens
gttcctgcaatgaag

SEQ ID NO: 5035167 - DNA, 23 bp, Homo sapiens
gttcctttccttttctttaaaga

SEQ ID NO: 5035168 - DNA, 12 bp, Homo sapiens
gttctcatgaag

SEQ ID NO: 5035169 - DNA, 19 bp, Homo sapiens
gttctcatgaagcaggagg

SEQ ID NO: 5035170 - DNA, 22 bp, Homo sapiens
gttctccttttcctctctcccg

SEQ ID NO: 5035171 - DNA, 22 bp, Homo sapiens
gttctgagattattttaatcta

SEQ ID NO: 5035172 - DNA, 13 bp, Homo sapiens
gttctgttaactg

SEQ ID NO: 5035173 - DNA, 19 bp, Homo sapiens
gttctgttaactgaatacc

SEQ ID NO: 5035174 - DNA, 21 bp, Homo sapiens
gttctgttaactgaataccac

SEQ ID NO: 5035175 - DNA, 14 bp, Homo sapiens
gttctgtttgttat

SEQ ID NO: 5035176 - DNA, 23 bp, Homo sapiens
gttctgtttgttattgttttgtt

SEQ ID NO: 5035177 - DNA, 18 bp, Homo sapiens
gttcttgtaattttacac

SEQ ID NO: 5035178 - DNA, 14 bp, Homo sapiens
gttcttgttggtgc

SEQ ID NO: 5035179 - DNA, 14 bp, Homo sapiens
gttgaagcctttgt

SEQ ID NO: 5035180 - DNA, 14 bp, Homo sapiens
gttgacattctgaa

SEQ ID NO: 5035181 - DNA, 19 bp, Homo sapiens
gttgacattctgaatgctt

SEQ ID NO: 5035182 - DNA, 14 bp, Homo sapiens
gttgagccttttcc

SEQ ID NO: 5035183 - DNA, 12 bp, Homo sapiens
gttgccagcaga

SEQ ID NO: 5035184 - DNA, 15 bp, Homo sapiens
gttgctgtttcacaa

SEQ ID NO: 5035185 - DNA, 18 bp, Homo sapiens
gttggaaggatctgctga

SEQ ID NO: 5035186 - DNA, 22 bp, Homo sapiens
gttgggcagggtgaccctgaag

SEQ ID NO: 5035187 - DNA, 14 bp, Homo sapiens
gttggttggttttc

SEQ ID NO: 5035188 - DNA, 18 bp, Homo sapiens
gttgtctctgatgcagct

SEQ ID NO: 5035189 - DNA, 14 bp, Homo sapiens
gttgttctgttaac

SEQ ID NO: 5035190 - DNA, 15 bp, Homo sapiens
gttgttctgttaact

SEQ ID NO: 5035191 - DNA, 11 bp, Homo sapiens
gtttaaatgaa

SEQ ID NO: 5035192 - DNA, 19 bp, Homo sapiens
gtttaaatgaacaagagaa

SEQ ID NO: 5035193 - DNA, 20 bp, Homo sapiens
gtttaagacatttttggaag

SEQ ID NO: 5035194 - DNA, 15 bp, Homo sapiens
gtttatcctttcata

SEQ ID NO: 5035195 - DNA, 22 bp, Homo sapiens
gtttatcctttcatatagttag

SEQ ID NO: 5035196 - DNA, 14 bp, Homo sapiens
gtttcatttctgca

SEQ ID NO: 5035197 - DNA, 17 bp, Homo sapiens
gtttctgtttgattctt

SEQ ID NO: 5035198 - DNA, 16 bp, Homo sapiens
gtttgaggtttttaag

SEQ ID NO: 5035199 - DNA, 13 bp, Homo sapiens
tacagtgtctttt

SEQ ID NO: 5035200 - DNA, 21 bp, Homo sapiens
tacagtgtctttttttgtata

SEQ ID NO: 5035201 - DNA, 23 bp, Homo sapiens
tacagtgtttatcctttcatata

SEQ ID NO: 5035202 - DNA, 19 bp, Homo sapiens
tacatatttgcatatgtat

SEQ ID NO: 5035203 - DNA, 21 bp, Homo sapiens
tacatatttgcatatgtatga

SEQ ID NO: 5035204 - DNA, 20 bp, Homo sapiens
taccaccgtctgtctcagag

SEQ ID NO: 5035205 - DNA, 16 bp, Homo sapiens
taccactctgtaattg

SEQ ID NO: 5035206 - DNA, 23 bp, Homo sapiens
tacccaacggccctgcagccagc

SEQ ID NO: 5035207 - DNA, 15 bp, Homo sapiens
taccctcctggctct

SEQ ID NO: 5035208 - DNA, 13 bp, Homo sapiens
taccctctcagct

SEQ ID NO: 5035209 - DNA, 15 bp, Homo sapiens
taccctctcagctcc

SEQ ID NO: 5035210 - DNA, 16 bp, Homo sapiens
taccctctcagctcca

SEQ ID NO: 5035211 - DNA, 17 bp, Homo sapiens
taccctctcagctccag

SEQ ID NO: 5035212 - DNA, 22 bp, Homo sapiens
taccctctggaggggtgtggct

SEQ ID NO: 5035213 - DNA, 15 bp, Homo sapiens
taccgaatgtgtctt

SEQ ID NO: 5035214 - DNA, 16 bp, Homo sapiens
taccgaatgtgtcttt

SEQ ID NO: 5035215 - DNA, 16 bp, Homo sapiens
tacctcaggcagctca

SEQ ID NO: 5035216 - DNA, 17 bp, Homo sapiens
tacctcaggcagctcaa

SEQ ID NO: 5035217 - DNA, 17 bp, Homo sapiens
tacctgattgtattttt

SEQ ID NO: 5035218 - DNA, 14 bp, Homo sapiens
tacgatacgctact

SEQ ID NO: 5035219 - DNA, 15 bp, Homo sapiens
tactagtgttctgtt

SEQ ID NO: 5035220 - DNA, 12 bp, Homo sapiens
tactatttaaag

SEQ ID NO: 5035221 - DNA, 21 bp, Homo sapiens
tactatttaaagcctcctcat

SEQ ID NO: 5035222 - DNA, 22 bp, Homo sapiens
tactcttcagttaagcctttgg

SEQ ID NO: 5035223 - DNA, 20 bp, Homo sapiens
tactgaacatctgagtcctg

SEQ ID NO: 5035224 - DNA, 21 bp, Homo sapiens
tactgaacatctgagtcctgg

SEQ ID NO: 5035225 - DNA, 17 bp, Homo sapiens
tactgattgggaggtgc

SEQ ID NO: 5035226 - DNA, 16 bp, Homo sapiens
tactgttctgtgtctt

SEQ ID NO: 5035227 - DNA, 18 bp, Homo sapiens
tacttagagtttctgttt

SEQ ID NO: 5035228 - DNA, 14 bp, Homo sapiens
tacttcccaaagcc

SEQ ID NO: 5035229 - DNA, 20 bp, Homo sapiens
tacttggtttgtgttcttct

SEQ ID NO: 5035230 - DNA, 14 bp, Homo sapiens
tacttgtaaatata

SEQ ID NO: 5035231 - DNA, 16 bp, Homo sapiens
tacttgtttctctgtt

SEQ ID NO: 5035232 - DNA, 17 bp, Homo sapiens
tagaaagagatacagag

SEQ ID NO: 5035233 - DNA, 19 bp, Homo sapiens
tagacccatagcagctttg

SEQ ID NO: 5035234 - DNA, 20 bp, Homo sapiens
tagacttggattctttccat

SEQ ID NO: 5035235 - DNA, 22 bp, Homo sapiens
tagacttgggatggggagggag

SEQ ID NO: 5035236 - DNA, 14 bp, Homo sapiens
tagactttaacata

SEQ ID NO: 5035237 - DNA, 17 bp, Homo sapiens
tagatgcaggaggctca

SEQ ID NO: 5035238 - DNA, 16 bp, Homo sapiens
tagcagtccccttccc

SEQ ID NO: 5035239 - DNA, 21 bp, Homo sapiens
tagccactaaccttgcctggt

SEQ ID NO: 5035240 - DNA, 22 bp, Homo sapiens
tagccctgtcctggtggtattt

SEQ ID NO: 5035241 - DNA, 13 bp, Homo sapiens
tagcgctgttttt

SEQ ID NO: 5035242 - DNA, 14 bp, Homo sapiens
tagcgttcttgtaa

SEQ ID NO: 5035243 - DNA, 15 bp, Homo sapiens
tagcgttcttgtaat

SEQ ID NO: 5035244 - DNA, 20 bp, Homo sapiens
tagctaataaaaagcttttg

SEQ ID NO: 5035245 - DNA, 21 bp, Homo sapiens
tagctaataaaaagcttttgt

SEQ ID NO: 5035246 - DNA, 12 bp, Homo sapiens
tagctcaatgag

SEQ ID NO: 5035247 - DNA, 18 bp, Homo sapiens
tagctcaatgagcatgtt

SEQ ID NO: 5035248 - DNA, 16 bp, Homo sapiens
tagcttgcaccttgtc

SEQ ID NO: 5035249 - DNA, 12 bp, Homo sapiens
taggaagaaaga

SEQ ID NO: 5035250 - DNA, 23 bp, Homo sapiens
taggagtttagggaacaatttgg

SEQ ID NO: 5035251 - DNA, 13 bp, Homo sapiens
taggcagaggctg

SEQ ID NO: 5035252 - DNA, 16 bp, Homo sapiens
taggcatgtcccaccc

SEQ ID NO: 5035253 - DNA, 15 bp, Homo sapiens
taggggagggcaggc

SEQ ID NO: 5035254 - DNA, 14 bp, Homo sapiens
taggggctggggcc

SEQ ID NO: 5035255 - DNA, 12 bp, Homo sapiens
taggtctgaaat

SEQ ID NO: 5035256 - DNA, 17 bp, Homo sapiens
tagtctcagtgaagact

SEQ ID NO: 5035257 - DNA, 11 bp, Homo sapiens
tagtctcagtt

SEQ ID NO: 5035258 - DNA, 13 bp, Homo sapiens
tagtcttttgctt

SEQ ID NO: 5035259 - DNA, 17 bp, Homo sapiens
tagtcttttgcttttgc

SEQ ID NO: 5035260 - DNA, 15 bp, Homo sapiens
tagtgatcctgtcct

SEQ ID NO: 5035261 - DNA, 14 bp, Homo sapiens
tagttaacacacta

SEQ ID NO: 5035262 - DNA, 20 bp, Homo sapiens
tagtttttacagctgtgtta

SEQ ID NO: 5035263 - DNA, 15 bp, Homo sapiens
tagttttttcatctt

SEQ ID NO: 5035264 - DNA, 15 bp, Homo sapiens
tataaacaagaaaaa

SEQ ID NO: 5035265 - DNA, 20 bp, Homo sapiens
tataaacaagaaaaataaag

SEQ ID NO: 5035266 - DNA, 15 bp, Homo sapiens
tataaatgcaaataa

SEQ ID NO: 5035267 - DNA, 17 bp, Homo sapiens
tataaatgcaaataaca

SEQ ID NO: 5035268 - DNA, 14 bp, Homo sapiens
tatagatgtctttt

SEQ ID NO: 5035269 - DNA, 17 bp, Homo sapiens
tatagttaacacactac

SEQ ID NO: 5035270 - DNA, 22 bp, Homo sapiens
tatataattacatatttgcata

SEQ ID NO: 5035271 - DNA, 11 bp, Homo sapiens
tatatataaat

SEQ ID NO: 5035272 - DNA, 22 bp, Homo sapiens
tatatatggggatggtagtttt

SEQ ID NO: 5035273 - DNA, 20 bp, Homo sapiens
tatatggggatggtagtttt

SEQ ID NO: 5035274 - DNA, 21 bp, Homo sapiens
tatatggggatggtagttttt

SEQ ID NO: 5035275 - DNA, 17 bp, Homo sapiens
tatattagctaattaga

SEQ ID NO: 5035276 - DNA, 21 bp, Homo sapiens
tatatttgtttcatttctgca

SEQ ID NO: 5035277 - DNA, 14 bp, Homo sapiens
tatattttcctata

SEQ ID NO: 5035278 - DNA, 15 bp, Homo sapiens
tatcatcagtattga

SEQ ID NO: 5035279 - DNA, 15 bp, Homo sapiens
tatccatgtacttgt

SEQ ID NO: 5035280 - DNA, 18 bp, Homo sapiens
tatcctttcatatagtta

SEQ ID NO: 5035281 - DNA, 18 bp, Homo sapiens
tatcgttttcttaaagtg

SEQ ID NO: 5035282 - DNA, 22 bp, Homo sapiens
tatctaaatatggactgctcag

SEQ ID NO: 5035283 - DNA, 15 bp, Homo sapiens
tatgaacagctgtgt

SEQ ID NO: 5035284 - DNA, 19 bp, Homo sapiens
tatgaccacactccagctg

SEQ ID NO: 5035285 - DNA, 16 bp, Homo sapiens
tatgacttcattaata

SEQ ID NO: 5035286 - DNA, 16 bp, Homo sapiens
tatgagctttatgtaa

SEQ ID NO: 5035287 - DNA, 19 bp, Homo sapiens
tatgcccggcgccgggcac

SEQ ID NO: 5035288 - DNA, 15 bp, Homo sapiens
tatggatgtccccag

SEQ ID NO: 5035289 - DNA, 18 bp, Homo sapiens
tatggtaggggagggcag

SEQ ID NO: 5035290 - DNA, 17 bp, Homo sapiens
tatgtattgtgcaatgt

SEQ ID NO: 5035291 - DNA, 18 bp, Homo sapiens
tatgtcgagagctggcca

SEQ ID NO: 5035292 - DNA, 22 bp, Homo sapiens
tatgtcgagagctggccaaaga

SEQ ID NO: 5035293 - DNA, 20 bp, Homo sapiens
tatgttatatataaatatat

SEQ ID NO: 5035294 - DNA, 21 bp, Homo sapiens
tatgttatatataaatatatt

SEQ ID NO: 5035295 - DNA, 14 bp, Homo sapiens
tatgttccattaaa

SEQ ID NO: 5035296 - DNA, 15 bp, Homo sapiens
tatgttccattaaac

SEQ ID NO: 5035297 - DNA, 18 bp, Homo sapiens
tattaaagaaaaaaatgt

SEQ ID NO: 5035298 - DNA, 20 bp, Homo sapiens
tattaaagaaaaaaatgtat

SEQ ID NO: 5035299 - DNA, 22 bp, Homo sapiens
tattaaagaaaaaaatgtattt

SEQ ID NO: 5035300 - DNA, 20 bp, Homo sapiens
tattaaattttttgttgaca

SEQ ID NO: 5035301 - DNA, 15 bp, Homo sapiens
tattaatattttaat

SEQ ID NO: 5035302 - DNA, 16 bp, Homo sapiens
tattacagtgtttatc

SEQ ID NO: 5035303 - DNA, 19 bp, Homo sapiens
tattacagtgtttatcctt

SEQ ID NO: 5035304 - DNA, 22 bp, Homo sapiens
tattaccagtggcgttgttgca

SEQ ID NO: 5035305 - DNA, 18 bp, Homo sapiens
tattacttgtaaatataa

SEQ ID NO: 5035306 - DNA, 21 bp, Homo sapiens
tattacttgtaaatataaaga

SEQ ID NO: 5035307 - DNA, 23 bp, Homo sapiens
tattacttgtaaatataaagacg

SEQ ID NO: 5035308 - DNA, 22 bp, Homo sapiens
tattagaatcaaacattttgaa

SEQ ID NO: 5035309 - DNA, 13 bp, Homo sapiens
tattagtattgtt

SEQ ID NO: 5035310 - DNA, 15 bp, Homo sapiens
tattagtattgttgt

SEQ ID NO: 5035311 - DNA, 19 bp, Homo sapiens
tattagtgacctcagcttt

SEQ ID NO: 5035312 - DNA, 23 bp, Homo sapiens
tgacagctttctgggatgtcaca

SEQ ID NO: 5035313 - DNA, 14 bp, Homo sapiens
tgacaggcagcaga

SEQ ID NO: 5035314 - DNA, 22 bp, Homo sapiens
tgacagtgcctcttccagtgaa

SEQ ID NO: 5035315 - DNA, 13 bp, Homo sapiens
tgacatctctgca

SEQ ID NO: 5035316 - DNA, 14 bp, Homo sapiens
tgacatctctgcaa

SEQ ID NO: 5035317 - DNA, 17 bp, Homo sapiens
tgaccacactccagctg

SEQ ID NO: 5035318 - DNA, 15 bp, Homo sapiens
tgaccctgaagtgag

SEQ ID NO: 5035319 - DNA, 16 bp, Homo sapiens
tgacctgacagcccaa

SEQ ID NO: 5035320 - DNA, 19 bp, Homo sapiens
tgacctgttgccagcagat

SEQ ID NO: 5035321 - DNA, 19 bp, Homo sapiens
tgacgcttgtgacagtgcc

SEQ ID NO: 5035322 - DNA, 16 bp, Homo sapiens
tgactgtatctgtgta

SEQ ID NO: 5035323 - DNA, 15 bp, Homo sapiens
tgactgtgctgtgca

SEQ ID NO: 5035324 - DNA, 13 bp, Homo sapiens
tgacttaatgtga

SEQ ID NO: 5035325 - DNA, 16 bp, Homo sapiens
tgacttaatgtgatta

SEQ ID NO: 5035326 - DNA, 13 bp, Homo sapiens
tgagaaattaagt

SEQ ID NO: 5035327 - DNA, 14 bp, Homo sapiens
tgagaaattaagta

SEQ ID NO: 5035328 - DNA, 20 bp, Homo sapiens
tgagaaggcagtagttttca

SEQ ID NO: 5035329 - DNA, 13 bp, Homo sapiens
tgagaccagccaa

SEQ ID NO: 5035330 - DNA, 14 bp, Homo sapiens
tgagagtcaaagct

SEQ ID NO: 5035331 - DNA, 16 bp, Homo sapiens
tgagagtcaaagctga

SEQ ID NO: 5035332 - DNA, 15 bp, Homo sapiens
tgagatagttttcat

SEQ ID NO: 5035333 - DNA, 21 bp, Homo sapiens
tgagatttattaaagaaaaaa

SEQ ID NO: 5035334 - DNA, 23 bp, Homo sapiens
tgagcacctgcaggcgtgacctg

SEQ ID NO: 5035335 - DNA, 14 bp, Homo sapiens
tgagcagaacaggt

SEQ ID NO: 5035336 - DNA, 14 bp, Homo sapiens
tgagcatcacagtt

SEQ ID NO: 5035337 - DNA, 15 bp, Homo sapiens
tgagcatgtttagac

SEQ ID NO: 5035338 - DNA, 23 bp, Homo sapiens
tgagcatgtttagactttaacat

SEQ ID NO: 5035339 - DNA, 20 bp, Homo sapiens
tgagccagccaggccctgcc

SEQ ID NO: 5035340 - DNA, 21 bp, Homo sapiens
tgagccagccaggccctgcca

SEQ ID NO: 5035341 - DNA, 15 bp, Homo sapiens
tgagcccctggaggc

SEQ ID NO: 5035342 - DNA, 16 bp, Homo sapiens
tgagcctagccctggg

SEQ ID NO: 5035343 - DNA, 21 bp, Homo sapiens
tgagctggatagacttgggat

SEQ ID NO: 5035344 - DNA, 22 bp, Homo sapiens
tgagctggggacctggtaccct

SEQ ID NO: 5035345 - DNA, 19 bp, Homo sapiens
tgagcttaaaatacaagac

SEQ ID NO: 5035346 - DNA, 21 bp, Homo sapiens
tgagcttaaaatacaagactg

SEQ ID NO: 5035347 - DNA, 22 bp, Homo sapiens
tgagcttaaaatacaagactgc

SEQ ID NO: 5035348 - DNA, 13 bp, Homo sapiens
tgaggatgctgca

SEQ ID NO: 5035349 - DNA, 23 bp, Homo sapiens
tgaggatgctgcagtgaggctgt

SEQ ID NO: 5035350 - DNA, 17 bp, Homo sapiens
tgaggtctgtttaaagt

SEQ ID NO: 5035351 - DNA, 14 bp, Homo sapiens
tgaggtgcctgtcc

SEQ ID NO: 5035352 - DNA, 15 bp, Homo sapiens
tgaggtgcctgtccc

SEQ ID NO: 5035353 - DNA, 15 bp, Homo sapiens
tgaggtttttaagcc

SEQ ID NO: 5035354 - DNA, 19 bp, Homo sapiens
tgagtaactggttgctgtg

SEQ ID NO: 5035355 - DNA, 13 bp, Homo sapiens
tgagtcatttaaa

SEQ ID NO: 5035356 - DNA, 16 bp, Homo sapiens
tgagtcatttaaatgt

SEQ ID NO: 5035357 - DNA, 23 bp, Homo sapiens
tgagtcatttaaatgtgtacaat

SEQ ID NO: 5035358 - DNA, 19 bp, Homo sapiens
tgagtcctggatgatacta

SEQ ID NO: 5035359 - DNA, 16 bp, Homo sapiens
tgagtgacagctttct

SEQ ID NO: 5035360 - DNA, 17 bp, Homo sapiens
tgagtgacagctttctg

SEQ ID NO: 5035361 - DNA, 23 bp, Homo sapiens
tgagtgacagctttctgggatgt

SEQ ID NO: 5035362 - DNA, 22 bp, Homo sapiens
tgagtgtgcggctgtgtgtgca

SEQ ID NO: 5035363 - DNA, 22 bp, Homo sapiens
tgagtttgggccccagaggctg

SEQ ID NO: 5035364 - DNA, 18 bp, Homo sapiens
tgataccagaagggaaag

SEQ ID NO: 5035365 - DNA, 15 bp, Homo sapiens
tgatactaataaact

SEQ ID NO: 5035366 - DNA, 22 bp, Homo sapiens
tgatactaataaactaataatt

SEQ ID NO: 5035367 - DNA, 16 bp, Homo sapiens
tgatcaattttgactt

SEQ ID NO: 5035368 - DNA, 13 bp, Homo sapiens
tgatcctgtcctt

SEQ ID NO: 5035369 - DNA, 15 bp, Homo sapiens
tgatctcatttaatc

SEQ ID NO: 5035370 - DNA, 19 bp, Homo sapiens
tgatgaaaactaaggattt

SEQ ID NO: 5035371 - DNA, 15 bp, Homo sapiens
tgatgatgatgaaaa

SEQ ID NO: 5035372 - DNA, 19 bp, Homo sapiens
tgatgccaagttgtttgag

SEQ ID NO: 5035373 - DNA, 15 bp, Homo sapiens
tgatgcctgtgaact

SEQ ID NO: 5035374 - DNA, 24 bp, Homo sapiens
tgatggggcaagggcacaagtcct

SEQ ID NO: 5035375 - DNA, 15 bp, Homo sapiens
tgatgtccctatgga

SEQ ID NO: 5035376 - DNA, 19 bp, Homo sapiens
tgattcaaattgctgcttg

SEQ ID NO: 5035377 - DNA, 18 bp, Homo sapiens
tgattgggaggtgcgtgt

SEQ ID NO: 5035378 - DNA, 13 bp, Homo sapiens
tgatttgcctgta

SEQ ID NO: 5035379 - DNA, 14 bp, Homo sapiens
tgatttttctttac

SEQ ID NO: 5035380 - DNA, 15 bp, Homo sapiens
tgatttttctttaca

SEQ ID NO: 5035381 - DNA, 13 bp, Homo sapiens
tgcaacagacaag

SEQ ID NO: 5035382 - DNA, 20 bp, Homo sapiens
tgcaactgctcagctctggt

SEQ ID NO: 5035383 - DNA, 14 bp, Homo sapiens
tgcaatgtgtataa

SEQ ID NO: 5035384 - DNA, 15 bp, Homo sapiens
tgcaatgtgtataaa

SEQ ID NO: 5035385 - DNA, 16 bp, Homo sapiens
tgcaatgtgtataaac

SEQ ID NO: 5035386 - DNA, 17 bp, Homo sapiens
tgcacacaggacagcgg

SEQ ID NO: 5035387 - DNA, 16 bp, Homo sapiens
tgcacagcacaaatta

SEQ ID NO: 5035388 - DNA, 18 bp, Homo sapiens
tgcacagcacaaattagt

SEQ ID NO: 5035389 - DNA, 23 bp, Homo sapiens
tgcacagcacaaattagttatat

SEQ ID NO: 5035390 - DNA, 17 bp, Homo sapiens
tgcacagcgtcctgtcc

SEQ ID NO: 5035391 - DNA, 13 bp, Homo sapiens
tgcacccacctgt

SEQ ID NO: 5035392 - DNA, 22 bp, Homo sapiens
tgcacccacctgttttctgaaa

SEQ ID NO: 5035393 - DNA, 16 bp, Homo sapiens
tgcactggggagcccg

SEQ ID NO: 5035394 - DNA, 16 bp, Homo sapiens
tgcactttgctttaat

SEQ ID NO: 5035395 - DNA, 21 bp, Homo sapiens
tgcactttgctttaatataaa

SEQ ID NO: 5035396 - DNA, 14 bp, Homo sapiens
tgcagacctcatgc

SEQ ID NO: 5035397 - DNA, 12 bp, Homo sapiens
tgcagctgctcc

SEQ ID NO: 5035398 - DNA, 13 bp, Homo sapiens
tgcagctgctccc

SEQ ID NO: 5035399 - DNA, 15 bp, Homo sapiens
tgcagctgctcccca

SEQ ID NO: 5035400 - DNA, 21 bp, Homo sapiens
tgcagctgttttgttgacatt

SEQ ID NO: 5035401 - DNA, 23 bp, Homo sapiens
tgcagctgttttgttgacattct

SEQ ID NO: 5035402 - DNA, 16 bp, Homo sapiens
tgcaggaggtggagaa

SEQ ID NO: 5035403 - DNA, 20 bp, Homo sapiens
tgcagggagggcagttttct

SEQ ID NO: 5035404 - DNA, 23 bp, Homo sapiens
tgcaggtgtggagagagaggctt

SEQ ID NO: 5035405 - DNA, 20 bp, Homo sapiens
tgcagtcccaagcggtgtct

SEQ ID NO: 5035406 - DNA, 21 bp, Homo sapiens
tgcagtcccaagcggtgtctc

SEQ ID NO: 5035407 - DNA, 15 bp, Homo sapiens
tgcagtgtggagttc

SEQ ID NO: 5035408 - DNA, 21 bp, Homo sapiens
tgcagtgtggagttcaccttg

SEQ ID NO: 5035409 - DNA, 22 bp, Homo sapiens
tgcatacggctatattggttta

SEQ ID NO: 5035410 - DNA, 18 bp, Homo sapiens
tgcatatttattgcattg

SEQ ID NO: 5035411 - DNA, 16 bp, Homo sapiens
tgcattgctggtagag

SEQ ID NO: 5035412 - DNA, 13 bp, Homo sapiens
tgcatttgtttat

SEQ ID NO: 5035413 - DNA, 22 bp, Homo sapiens
tgcatttgtttatgtaatttca

SEQ ID NO: 5035414 - DNA, 17 bp, Homo sapiens
tgccaaattaaaaaaga

SEQ ID NO: 5035415 - DNA, 19 bp, Homo sapiens
tgccaaattaaaaaagata

SEQ ID NO: 5035416 - DNA, 17 bp, Homo sapiens
tgccagagccttaataa

SEQ ID NO: 5035417 - DNA, 11 bp, Homo sapiens
tgccagcccct

SEQ ID NO: 5035418 - DNA, 19 bp, Homo sapiens
tgccagctacttcctcctc

SEQ ID NO: 5035419 - DNA, 19 bp, Homo sapiens
tgccaggagcacggctctg

SEQ ID NO: 5035420 - DNA, 17 bp, Homo sapiens
tgccagtattttaaaat

SEQ ID NO: 5035421 - DNA, 17 bp, Homo sapiens
tgccagtcaagaagaaa

SEQ ID NO: 5035422 - DNA, 14 bp, Homo sapiens
tgccatattaaatt

SEQ ID NO: 5035423 - DNA, 23 bp, Homo sapiens
tgccatattaaattttttgttga

SEQ ID NO: 5035424 - DNA, 11 bp, Homo sapiens
tgccattgtag

SEQ ID NO: 5035425 - DNA, 17 bp, Homo sapiens
tgtgacaggcagcagag

SEQ ID NO: 5035426 - DNA, 20 bp, Homo sapiens
tgtgacagtgcctcttccag

SEQ ID NO: 5035427 - DNA, 21 bp, Homo sapiens
tgtgacagtgcctcttccagt

SEQ ID NO: 5035428 - DNA, 16 bp, Homo sapiens
tgtgacgcgcaagtct

SEQ ID NO: 5035429 - DNA, 11 bp, Homo sapiens
tgtgagctgga

SEQ ID NO: 5035430 - DNA, 15 bp, Homo sapiens
tgtgatttctttctt

SEQ ID NO: 5035431 - DNA, 15 bp, Homo sapiens
tgtgcaacagacaag

SEQ ID NO: 5035432 - DNA, 14 bp, Homo sapiens
tgtgcaatgtgtat

SEQ ID NO: 5035433 - DNA, 15 bp, Homo sapiens
tgtgcaatgtgtata

SEQ ID NO: 5035434 - DNA, 15 bp, Homo sapiens
tgtgcagggagggca

SEQ ID NO: 5035435 - DNA, 17 bp, Homo sapiens
tgtgcagggagggcagt

SEQ ID NO: 5035436 - DNA, 12 bp, Homo sapiens
tgtgctgtgact

SEQ ID NO: 5035437 - DNA, 14 bp, Homo sapiens
tgtggccatggcct

SEQ ID NO: 5035438 - DNA, 14 bp, Homo sapiens
tgtgggtcccgcac

SEQ ID NO: 5035439 - DNA, 18 bp, Homo sapiens
tgtggtggattctccctg

SEQ ID NO: 5035440 - DNA, 19 bp, Homo sapiens
tgtgtaacctcttcacctt

SEQ ID NO: 5035441 - DNA, 12 bp, Homo sapiens
tgtgtaagattt

SEQ ID NO: 5035442 - DNA, 13 bp, Homo sapiens
tgtgtaagatttg

SEQ ID NO: 5035443 - DNA, 16 bp, Homo sapiens
tgtgtcttaattatta

SEQ ID NO: 5035444 - DNA, 22 bp, Homo sapiens
tgtgtctttcacagctcctccc

SEQ ID NO: 5035445 - DNA, 21 bp, Homo sapiens
tgtgtggtggattctccctgg

SEQ ID NO: 5035446 - DNA, 16 bp, Homo sapiens
tgtgtgtcttaattat

SEQ ID NO: 5035447 - DNA, 18 bp, Homo sapiens
tgttaactgaataccact

SEQ ID NO: 5035448 - DNA, 16 bp, Homo sapiens
tgttaactgagtgcct

SEQ ID NO: 5035449 - DNA, 22 bp, Homo sapiens
tgttaactgagtgccttttggt

SEQ ID NO: 5035450 - DNA, 14 bp, Homo sapiens
tgttaagctctgct

SEQ ID NO: 5035451 - DNA, 15 bp, Homo sapiens
tgttaattacaccat

SEQ ID NO: 5035452 - DNA, 15 bp, Homo sapiens
tgttagcaaagatta

SEQ ID NO: 5035453 - DNA, 13 bp, Homo sapiens
tgttatgaacagc

SEQ ID NO: 5035454 - DNA, 16 bp, Homo sapiens
tgttattgttttgtta

SEQ ID NO: 5035455 - DNA, 18 bp, Homo sapiens
tgttatttataatcactt

SEQ ID NO: 5035456 - DNA, 15 bp, Homo sapiens
tgttcagcagaacct

SEQ ID NO: 5035457 - DNA, 18 bp, Homo sapiens
tgttcattttattttcat

SEQ ID NO: 5035458 - DNA, 17 bp, Homo sapiens
tgttctcatgaagcagg

SEQ ID NO: 5035459 - DNA, 21 bp, Homo sapiens
tgttctcatgaagcaggaggc

SEQ ID NO: 5035460 - DNA, 21 bp, Homo sapiens
tgttctccttttcctctctcc

SEQ ID NO: 5035461 - DNA, 16 bp, Homo sapiens
tgttctgttaactgaa

SEQ ID NO: 5035462 - DNA, 17 bp, Homo sapiens
tgttctgttaactgaat

SEQ ID NO: 5035463 - DNA, 22 bp, Homo sapiens
tgttctgttaactgaataccac

SEQ ID NO: 5035464 - DNA, 23 bp, Homo sapiens
tgttctgttaactgaataccact

SEQ ID NO: 5035465 - DNA, 19 bp, Homo sapiens
tgttctgtttgttattgtt

SEQ ID NO: 5035466 - DNA, 22 bp, Homo sapiens
tgttcttagctcaatgagcatg

SEQ ID NO: 5035467 - DNA, 12 bp, Homo sapiens
tgttgacattag

SEQ ID NO: 5035468 - DNA, 16 bp, Homo sapiens
tgttgagccttttccc

SEQ ID NO: 5035469 - DNA, 18 bp, Homo sapiens
tgttggtcctctctctgt

SEQ ID NO: 5035470 - DNA, 11 bp, Homo sapiens
tgttggtgcac

SEQ ID NO: 5035471 - DNA, 14 bp, Homo sapiens
tgttggtgcacagc

SEQ ID NO: 5035472 - DNA, 20 bp, Homo sapiens
tgttggttggttttcttctt

SEQ ID NO: 5035473 - DNA, 20 bp, Homo sapiens
tgttggttgttttttccttt

SEQ ID NO: 5035474 - DNA, 16 bp, Homo sapiens
tgttgtccttttcata

SEQ ID NO: 5035475 - DNA, 14 bp, Homo sapiens
tgtttaatctgtta

SEQ ID NO: 5035476 - DNA, 15 bp, Homo sapiens
tgtttatcctttcat

SEQ ID NO: 5035477 - DNA, 14 bp, Homo sapiens
tgtttatgtaattt

SEQ ID NO: 5035478 - DNA, 15 bp, Homo sapiens
tgtttatgtaatttc

SEQ ID NO: 5035479 - DNA, 16 bp, Homo sapiens
tgtttatgtaatttca

SEQ ID NO: 5035480 - DNA, 23 bp, Homo sapiens
tgtttcacaccggaaggttttta

SEQ ID NO: 5035481 - DNA, 18 bp, Homo sapiens
tgtttccagcagaagaca

SEQ ID NO: 5035482 - DNA, 20 bp, Homo sapiens
tgtttccagcagaagacaaa

SEQ ID NO: 5035483 - DNA, 23 bp, Homo sapiens
tgtttcctagcacacacttttgg

SEQ ID NO: 5035484 - DNA, 14 bp, Homo sapiens
tgtttcgctctttg

SEQ ID NO: 5035485 - DNA, 21 bp, Homo sapiens
tgtttgaaatgaggtctgttt

SEQ ID NO: 5035486 - DNA, 13 bp, Homo sapiens
tgtttgctgctat

SEQ ID NO: 5035487 - DNA, 11 bp, Homo sapiens
tgtttgttggt

SEQ ID NO: 5035488 - DNA, 18 bp, Homo sapiens
tgttttatgacttcatta

SEQ ID NO: 5035489 - DNA, 12 bp, Homo sapiens
tgttttctgaaa

SEQ ID NO: 5035490 - DNA, 12 bp, Homo sapiens
tgttttgttaat

SEQ ID NO: 5035491 - DNA, 19 bp, Homo sapiens
tgttttgttgacattctga

SEQ ID NO: 5035492 - DNA, 13 bp, Homo sapiens
ttaaaaaagataa

SEQ ID NO: 5035493 - DNA, 16 bp, Homo sapiens
ttaaaaacatagaaaa

SEQ ID NO: 5035494 - DNA, 16 bp, Homo sapiens
ttaaaaactcacttac

SEQ ID NO: 5035495 - DNA, 11 bp, Homo sapiens
ttaaaagagag

SEQ ID NO: 5035496 - DNA, 23 bp, Homo sapiens
ttaaaagagagagagagaaaaaa

SEQ ID NO: 5035497 - DNA, 20 bp, Homo sapiens
ttaaaatagcgttcttgtaa

SEQ ID NO: 5035498 - DNA, 22 bp, Homo sapiens
ttaaacacacagatacacacac

SEQ ID NO: 5035499 - DNA, 23 bp, Homo sapiens
ttaaacacacagatacacacaca

SEQ ID NO: 5035500 - DNA, 22 bp, Homo sapiens
ttaaacattggttcttgtatta

SEQ ID NO: 5035501 - DNA, 12 bp, Homo sapiens
ttaaactgtaca

SEQ ID NO: 5035502 - DNA, 15 bp, Homo sapiens
ttaaactgtacagtg

SEQ ID NO: 5035503 - DNA, 17 bp, Homo sapiens
ttaaactgtacagtgtc

SEQ ID NO: 5035504 - DNA, 18 bp, Homo sapiens
ttaaactgtacagtgtct

SEQ ID NO: 5035505 - DNA, 17 bp, Homo sapiens
ttaaagaaaaaaattga

SEQ ID NO: 5035506 - DNA, 20 bp, Homo sapiens
ttaaagaaaaaaattgaaat

SEQ ID NO: 5035507 - DNA, 22 bp, Homo sapiens
ttaaagaaaaaaattgaaatgt

SEQ ID NO: 5035508 - DNA, 12 bp, Homo sapiens
ttaaagaagacc

SEQ ID NO: 5035509 - DNA, 17 bp, Homo sapiens
ttaaagtggcaatctca

SEQ ID NO: 5035510 - DNA, 16 bp, Homo sapiens
ttaaataataaagatc

SEQ ID NO: 5035511 - DNA, 17 bp, Homo sapiens
ttaaatgtgtacaatgt

SEQ ID NO: 5035512 - DNA, 13 bp, Homo sapiens
ttaacataagcta

SEQ ID NO: 5035513 - DNA, 14 bp, Homo sapiens
ttaacataagctat

SEQ ID NO: 5035514 - DNA, 16 bp, Homo sapiens
ttaacataagctattt

SEQ ID NO: 5035515 - DNA, 17 bp, Homo sapiens
ttaacccccctgtacac

SEQ ID NO: 5035516 - DNA, 13 bp, Homo sapiens
ttaaggattttat

SEQ ID NO: 5035517 - DNA, 15 bp, Homo sapiens
ttaaggattttatgc

SEQ ID NO: 5035518 - DNA, 20 bp, Homo sapiens
ttaaggattttatgctttaa

SEQ ID NO: 5035519 - DNA, 17 bp, Homo sapiens
ttaagtatctgacatct

SEQ ID NO: 5035520 - DNA, 15 bp, Homo sapiens
ttaagtctgttttat

SEQ ID NO: 5035521 - DNA, 17 bp, Homo sapiens
ttaagtctgttttatga

SEQ ID NO: 5035522 - DNA, 18 bp, Homo sapiens
ttaagtctgttttatgac

SEQ ID NO: 5035523 - DNA, 20 bp, Homo sapiens
ttaagtctgttttatgactt

SEQ ID NO: 5035524 - DNA, 18 bp, Homo sapiens
ttaagtgagcagaacagg

SEQ ID NO: 5035525 - DNA, 22 bp, Homo sapiens
ttaagttgagatagttttcatc

SEQ ID NO: 5035526 - DNA, 18 bp, Homo sapiens
ttaatatatttgaaaaaa

SEQ ID NO: 5035527 - DNA, 18 bp, Homo sapiens
ttaatatcatcagtattg

SEQ ID NO: 5035528 - DNA, 21 bp, Homo sapiens
ttaatctgggccagaatttca

SEQ ID NO: 5035529 - DNA, 18 bp, Homo sapiens
ttacaaaacaaactcatt

SEQ ID NO: 5035530 - DNA, 21 bp, Homo sapiens
ttacaccaccggccccctccc

SEQ ID NO: 5035531 - DNA, 16 bp, Homo sapiens
ttacagatttaataca

SEQ ID NO: 5035532 - DNA, 20 bp, Homo sapiens
ttacatttacaaactgaaga

SEQ ID NO: 5035533 - DNA, 10 bp, Homo sapiens
ttaccaaagc

SEQ ID NO: 5035534 - DNA, 14 bp, Homo sapiens
ttaccatgtaatgg

SEQ ID NO: 5035535 - DNA, 22 bp, Homo sapiens
ttaccctttggccccactttga

SEQ ID NO: 5035536 - DNA, 11 bp, Homo sapiens
ttacttctctt

SEQ ID NO: 5035537 - DNA, 13 bp, Homo sapiens
ttacttgtaaata

SEQ ID NO: 5035538 - DNA, 16 bp, Homo sapiens
ttacttgtaaatataa

SEQ ID NO: 5035539 - DNA, 18 bp, Homo sapiens
tttaacccccctgtacac

SEQ ID NO: 5035540 - DNA, 14 bp, Homo sapiens
tttaataaactact

SEQ ID NO: 5035541 - DNA, 14 bp, Homo sapiens
tttacaaactgaag

SEQ ID NO: 5035542 - DNA, 16 bp, Homo sapiens
tttacaaactgaagag

SEQ ID NO: 5035543 - DNA, 11 bp, Homo sapiens
tttaccaaagc

SEQ ID NO: 5035544 - DNA, 13 bp, Homo sapiens
tttaccaaagcat

SEQ ID NO: 5035545 - DNA, 14 bp, Homo sapiens
tttaccaaagcatc

SEQ ID NO: 5035546 - DNA, 14 bp, Homo sapiens
tttagatagccctg

SEQ ID NO: 5035547 - DNA, 18 bp, Homo sapiens
tttagatagccctgtcct

SEQ ID NO: 5035548 - DNA, 20 bp, Homo sapiens
tttagcattgtagtgctttg

SEQ ID NO: 5035549 - DNA, 13 bp, Homo sapiens
tttaggaagtgtt

SEQ ID NO: 5035550 - DNA, 15 bp, Homo sapiens
tttagttttctctta

SEQ ID NO: 5035551 - DNA, 13 bp, Homo sapiens
tttataaatccaa

SEQ ID NO: 5035552 - DNA, 20 bp, Homo sapiens
tttataagcatcattattta

SEQ ID NO: 5035553 - DNA, 17 bp, Homo sapiens
tttataagtcattgtat

SEQ ID NO: 5035554 - DNA, 16 bp, Homo sapiens
tttataggtgagaaaa

SEQ ID NO: 5035555 - DNA, 18 bp, Homo sapiens
tttataggtgagaaaaaa

SEQ ID NO: 5035556 - DNA, 20 bp, Homo sapiens
tttatgacttcattaataat

SEQ ID NO: 5035557 - DNA, 15 bp, Homo sapiens
tttatgctttaaaca

SEQ ID NO: 5035558 - DNA, 16 bp, Homo sapiens
tttatgctttaaacat

SEQ ID NO: 5035559 - DNA, 14 bp, Homo sapiens
tttatgtaatttca

SEQ ID NO: 5035560 - DNA, 11 bp, Homo sapiens
tttatgtattg

SEQ ID NO: 5035561 - DNA, 17 bp, Homo sapiens
tttatgttatatataaa

SEQ ID NO: 5035562 - DNA, 14 bp, Homo sapiens
tttattaaagaaaa

SEQ ID NO: 5035563 - DNA, 14 bp, Homo sapiens
tttattaccagtgg

SEQ ID NO: 5035564 - DNA, 20 bp, Homo sapiens
tttcaactagaaaattctaa

SEQ ID NO: 5035565 - DNA, 14 bp, Homo sapiens
tttcaatagccact

SEQ ID NO: 5035566 - DNA, 21 bp, Homo sapiens
tttcaatagccactaaccttg

SEQ ID NO: 5035567 - DNA, 19 bp, Homo sapiens
tttcacattgtttgctgct

SEQ ID NO: 5035568 - DNA, 13 bp, Homo sapiens
tttcactttgaaa

SEQ ID NO: 5035569 - DNA, 16 bp, Homo sapiens
tttcactttgaaaagt

SEQ ID NO: 5035570 - DNA, 18 bp, Homo sapiens
tttcaggaggaatactga

SEQ ID NO: 5035571 - DNA, 21 bp, Homo sapiens
tttcatattttagctactata

SEQ ID NO: 5035572 - DNA, 17 bp, Homo sapiens
tttcatccataactgaa

SEQ ID NO: 5035573 - DNA, 16 bp, Homo sapiens
tttcatcttcagttgt

SEQ ID NO: 5035574 - DNA, 21 bp, Homo sapiens
tttcatgcaaactctttggtc

SEQ ID NO: 5035575 - DNA, 12 bp, Homo sapiens
tttccaaaacat

SEQ ID NO: 5035576 - DNA, 23 bp, Homo sapiens
tttccacataaggaaactgggtt

SEQ ID NO: 5035577 - DNA, 16 bp, Homo sapiens
tttccagcagaagaca

SEQ ID NO: 5035578 - DNA, 15 bp, Homo sapiens
tttccattacaagta

SEQ ID NO: 5035579 - DNA, 18 bp, Homo sapiens
tttccattacaagtattt

SEQ ID NO: 5035580 - DNA, 18 bp, Homo sapiens
tttcctagcacacacttt

SEQ ID NO: 5035581 - DNA, 22 bp, Homo sapiens
tttctaactacaaaggtttaaa

SEQ ID NO: 5035582 - DNA, 13 bp, Homo sapiens
tttctgaaacaca

SEQ ID NO: 5035583 - DNA, 19 bp, Homo sapiens
tttctgttatataaatggt

SEQ ID NO: 5035584 - DNA, 13 bp, Homo sapiens
tttcttattgcgc

SEQ ID NO: 5035585 - DNA, 14 bp, Homo sapiens
tttcttattgcgct

SEQ ID NO: 5035586 - DNA, 14 bp, Homo sapiens
tttctttccaaaac

SEQ ID NO: 5035587 - DNA, 20 bp, Homo sapiens
tttctttccaaaacatttct

SEQ ID NO: 5035588 - DNA, 18 bp, Homo sapiens
tttctttgcaccaaagac

SEQ ID NO: 5035589 - DNA, 16 bp, Homo sapiens
tttgaaaaaaacttca

SEQ ID NO: 5035590 - DNA, 16 bp, Homo sapiens
tttgaaagtctgtcct

SEQ ID NO: 5035591 - DNA, 21 bp, Homo sapiens
tttgaaatgaggtctgtttaa

SEQ ID NO: 5035592 - DNA, 14 bp, Homo sapiens
tttgacttaatgtg

SEQ ID NO: 5035593 - DNA, 16 bp, Homo sapiens
tttgacttaatgtgat

SEQ ID NO: 5035594 - DNA, 13 bp, Homo sapiens
tttgagacaggag

SEQ ID NO: 5035595 - DNA, 13 bp, Homo sapiens
tttgcaccaaaga

SEQ ID NO: 5035596 - DNA, 17 bp, Homo sapiens
tttgcaccaaagacatc

SEQ ID NO: 5035597 - DNA, 22 bp, Homo sapiens
tttgcataggtgatctcattta

SEQ ID NO: 5035598 - DNA, 13 bp, Homo sapiens
tttgcccattttg

SEQ ID NO: 5035599 - DNA, 17 bp, Homo sapiens
tttggagtcccctcacc

SEQ ID NO: 5035600 - DNA, 16 bp, Homo sapiens
tttggtaaaaatgctg

SEQ ID NO: 5035601 - DNA, 21 bp, Homo sapiens
tttggtccttcaaaggcttgt

SEQ ID NO: 5035602 - DNA, 13 bp, Homo sapiens
tttgtaaattgtc

SEQ ID NO: 5035603 - DNA, 12 bp, Homo sapiens
tttgtagttttt

SEQ ID NO: 5035604 - DNA, 17 bp, Homo sapiens
tttgtcctttttcactt

SEQ ID NO: 5035605 - DNA, 16 bp, Homo sapiens
tttgtctctgtcacat

SEQ ID NO: 5035606 - DNA, 13 bp, Homo sapiens
tttgtctgtctcc

SEQ ID NO: 5035607 - DNA, 17 bp, Homo sapiens
tttgtgttctgttttgt

SEQ ID NO: 5035608 - DNA, 13 bp, Homo sapiens
tttgttgacatta

SEQ ID NO: 5035609 - DNA, 13 bp, Homo sapiens
tttgttggttggt

SEQ ID NO: 5035610 - DNA, 14 bp, Homo sapiens
tttgttttgtgtct

SEQ ID NO: 5035611 - DNA, 13 bp, Homo sapiens
ttttaaactgtac

SEQ ID NO: 5035612 - DNA, 17 bp, Homo sapiens
ttttaaactgtacagtg

SEQ ID NO: 5035613 - DNA, 15 bp, Homo sapiens
ttttaaataaaagca

SEQ ID NO: 5035614 - DNA, 17 bp, Homo sapiens
ttttaaataaaagcaca

SEQ ID NO: 5035615 - DNA, 13 bp, Homo sapiens
ttttaataaacta

SEQ ID NO: 5035616 - DNA, 15 bp, Homo sapiens
ttttaataaactact

SEQ ID NO: 5035617 - DNA, 18 bp, Homo sapiens
ttttacattccatttcat

SEQ ID NO: 5035618 - DNA, 11 bp, Homo sapiens
ttttaccaaag

SEQ ID NO: 5035619 - DNA, 15 bp, Homo sapiens
ttttaccaaagcatc

SEQ ID NO: 5035620 - DNA, 12 bp, Homo sapiens
ttttataaatcg

SEQ ID NO: 5035621 - DNA, 17 bp, Homo sapiens
ttttatattaatgtact

SEQ ID NO: 5035622 - DNA, 20 bp, Homo sapiens
ttttattagtattgttgtcc

SEQ ID NO: 5035623 - DNA, 22 bp, Homo sapiens
ttttattagtattgttgtcctt

SEQ ID NO: 5035624 - DNA, 16 bp, Homo sapiens
ttttcaaacaaagatg

SEQ ID NO: 5035625 - DNA, 15 bp, Homo sapiens
ttttcataggtctga

SEQ ID NO: 5035626 - DNA, 17 bp, Homo sapiens
ttttcataggtctgaaa

SEQ ID NO: 5035627 - DNA, 18 bp, Homo sapiens
ttttcatccataactgaa

SEQ ID NO: 5035628 - DNA, 19 bp, Homo sapiens
ttttcatcttcagttgtct

SEQ ID NO: 5035629 - DNA, 20 bp, Homo sapiens
ttttcccatttatctaaata

SEQ ID NO: 5035630 - DNA, 20 bp, Homo sapiens
ttttctaaaggagtttatgt

SEQ ID NO: 5035631 - DNA, 23 bp, Homo sapiens
ttttcttaaataataaagatcat

SEQ ID NO: 5035632 - DNA, 23 bp, Homo sapiens
ttttctttcctgtaaagaaacat

SEQ ID NO: 5035633 - DNA, 14 bp, Homo sapiens
ttttgacttaatgt

SEQ ID NO: 5035634 - DNA, 19 bp, Homo sapiens
ttttgcccattttgaatca

SEQ ID NO: 5035635 - DNA, 15 bp, Homo sapiens
ttttgtctacacacc

SEQ ID NO: 5035636 - DNA, 10 bp, Homo sapiens
ttttgtctgt

SEQ ID NO: 5035637 - DNA, 19 bp, Homo sapiens
ttttgtgatggagtgctgt

SEQ ID NO: 5035638 - DNA, 12 bp, Homo sapiens
ttttgttgacat

SEQ ID NO: 5035639 - DNA, 19 bp, Homo sapiens
ttttgttgacattctgaat

SEQ ID NO: 5035640 - DNA, 20 bp, Homo sapiens
ttttgttgacattctgaatg

SEQ ID NO: 5035641 - DNA, 16 bp, Homo sapiens
tttttaaactgtacag

SEQ ID NO: 5035642 - DNA, 17 bp, Homo sapiens
tttttaaactgtacagt

SEQ ID NO: 5035643 - DNA, 18 bp, Homo sapiens
tttttaaactgtacagtg

SEQ ID NO: 5035644 - DNA, 18 bp, Homo sapiens
tttttaaataaaagcaca

SEQ ID NO: 5035645 - DNA, 19 bp, Homo sapiens
tttttaaataaaagcacaa

SEQ ID NO: 5035646 - DNA, 23 bp, Homo sapiens
tttttaagggttatcttagatgt

SEQ ID NO: 5035647 - DNA, 12 bp, Homo sapiens
tttttaataaac

SEQ ID NO: 5035648 - DNA, 12 bp, Homo sapiens
tttttatgtgat

SEQ ID NO: 5035649 - DNA, 14 bp, Homo sapiens
tttttctaaaggag

SEQ ID NO: 5035650 - DNA, 23 bp, Homo sapiens
tttttcttaaataataaagatca

SEQ ID NO: 5035651 - DNA, 22 bp, Homo sapiens
tttttcttgtctataaagcatt

SEQ ID NO: 5035652 - DNA, 20 bp, Homo sapiens
tttttgtagtgacctgttta

SEQ ID NO: 5035653 - DNA, 18 bp, Homo sapiens
tttttgtatagttaacac

SEQ ID NO: 5035654 - DNA, 21 bp, Homo sapiens
taactacaaaggtttaaatga

SEQ ID NO: 5035655 - DNA, 23 bp, Homo sapiens
taactacaaaggtttaaatgaac

SEQ ID NO: 5035656 - DNA, 14 bp, Homo sapiens
taactcccattacc

SEQ ID NO: 5035657 - DNA, 16 bp, Homo sapiens
taactgaataccactc

SEQ ID NO: 5035658 - DNA, 19 bp, Homo sapiens
taactgaataccactctgt

SEQ ID NO: 5035659 - DNA, 15 bp, Homo sapiens
taagatttgttttta

SEQ ID NO: 5035660 - DNA, 19 bp, Homo sapiens
taagatttgtttttaaact

SEQ ID NO: 5035661 - DNA, 22 bp, Homo sapiens
taagatttgtttttaaactgta

SEQ ID NO: 5035662 - DNA, 23 bp, Homo sapiens
taagatttgtttttaaactgtac

SEQ ID NO: 5035663 - DNA, 20 bp, Homo sapiens
taagcatcattatttatgta

SEQ ID NO: 5035664 - DNA, 23 bp, Homo sapiens
taagcatcattatttatgtattg

SEQ ID NO: 5035665 - DNA, 17 bp, Homo sapiens
taagcctttggaaacag

SEQ ID NO: 5035666 - DNA, 16 bp, Homo sapiens
taagctatttttctaa

SEQ ID NO: 5035667 - DNA, 12 bp, Homo sapiens
taaggaaactgg

SEQ ID NO: 5035668 - DNA, 14 bp, Homo sapiens
taaggaaactgggt

SEQ ID NO: 5035669 - DNA, 19 bp, Homo sapiens
taaggattttatgctttaa

SEQ ID NO: 5035670 - DNA, 13 bp, Homo sapiens
taaggctgtgtaa

SEQ ID NO: 5035671 - DNA, 15 bp, Homo sapiens
taagtatctgacatc

SEQ ID NO: 5035672 - DNA, 20 bp, Homo sapiens
taagtccttgcaagaatcag

SEQ ID NO: 5035673 - DNA, 11 bp, Homo sapiens
taagtctctgt

SEQ ID NO: 5035674 - DNA, 19 bp, Homo sapiens
taagtctcttacaaaagct

SEQ ID NO: 5035675 - DNA, 19 bp, Homo sapiens
taagtctgttttatgactt

SEQ ID NO: 5035676 - DNA, 20 bp, Homo sapiens
taagtctgttttatgacttc

SEQ ID NO: 5035677 - DNA, 14 bp, Homo sapiens
taagtgttctcatg

SEQ ID NO: 5035678 - DNA, 20 bp, Homo sapiens
taagttgagatagttttcat

SEQ ID NO: 5035679 - DNA, 20 bp, Homo sapiens
taataaactaataattgcag

SEQ ID NO: 5035680 - DNA, 13 bp, Homo sapiens
taatataaatgca

SEQ ID NO: 5035681 - DNA, 14 bp, Homo sapiens
taatataaatgcaa

SEQ ID NO: 5035682 - DNA, 20 bp, Homo sapiens
taatattttcctcctgagtg

SEQ ID NO: 5035683 - DNA, 21 bp, Homo sapiens
taatattttcctcctgagtgc

SEQ ID NO: 5035684 - DNA, 19 bp, Homo sapiens
taatcacttttttccacat

SEQ ID NO: 5035685 - DNA, 13 bp, Homo sapiens
taatcccatttcc

SEQ ID NO: 5035686 - DNA, 20 bp, Homo sapiens
taatcccatttcccaaacct

SEQ ID NO: 5035687 - DNA, 19 bp, Homo sapiens
taatgctaatttaaagaga

SEQ ID NO: 5035688 - DNA, 15 bp, Homo sapiens
taatggcagttatat

SEQ ID NO: 5035689 - DNA, 14 bp, Homo sapiens
taattattatttgt

SEQ ID NO: 5035690 - DNA, 17 bp, Homo sapiens
taattattatttgtgtt

SEQ ID NO: 5035691 - DNA, 21 bp, Homo sapiens
taattctaaggaatatgagct

SEQ ID NO: 5035692 - DNA, 12 bp, Homo sapiens
taattgtcatta

SEQ ID NO: 5035693 - DNA, 15 bp, Homo sapiens
taattgttgttctgt

SEQ ID NO: 5035694 - DNA, 17 bp, Homo sapiens
taattgttgttctgtta

SEQ ID NO: 5035695 - DNA, 17 bp, Homo sapiens
taatttaaacacctcct

SEQ ID NO: 5035696 - DNA, 22 bp, Homo sapiens
taatttcaggaggaatactgaa

SEQ ID NO: 5035697 - DNA, 23 bp, Homo sapiens
taatttcaggaggaatactgaac

SEQ ID NO: 5035698 - DNA, 20 bp, Homo sapiens
taatttcttcccccaaagcc

SEQ ID NO: 5035699 - DNA, 18 bp, Homo sapiens
taattttacacgcttttg

SEQ ID NO: 5035700 - DNA, 21 bp, Homo sapiens
taattttacacgcttttgtga

SEQ ID NO: 5035701 - DNA, 14 bp, Homo sapiens
tacaaaacaaactc

SEQ ID NO: 5035702 - DNA, 17 bp, Homo sapiens
tacaaaacaaactcatt

SEQ ID NO: 5035703 - DNA, 22 bp, Homo sapiens
tacaaaacaaactcattcatta

SEQ ID NO: 5035704 - DNA, 19 bp, Homo sapiens
tacaaactgaagagtaatc

SEQ ID NO: 5035705 - DNA, 15 bp, Homo sapiens
tacaaaggtttaaat

SEQ ID NO: 5035706 - DNA, 18 bp, Homo sapiens
tacaaaggtttaaatgaa

SEQ ID NO: 5035707 - DNA, 20 bp, Homo sapiens
tacaaaggtttaaatgaaca

SEQ ID NO: 5035708 - DNA, 22 bp, Homo sapiens
tacaagactgccatattaaatt

SEQ ID NO: 5035709 - DNA, 17 bp, Homo sapiens
tacaagtatttttaatt

SEQ ID NO: 5035710 - DNA, 15 bp, Homo sapiens
tacacaactcactcc

SEQ ID NO: 5035711 - DNA, 22 bp, Homo sapiens
tacacaactcactccttttaaa

SEQ ID NO: 5035712 - DNA, 17 bp, Homo sapiens
tacacgtctggaccccg

SEQ ID NO: 5035713 - DNA, 14 bp, Homo sapiens
tacagatgcctttt

SEQ ID NO: 5035714 - DNA, 20 bp, Homo sapiens
tacaggggtagtttgtttta

SEQ ID NO: 5035715 - DNA, 20 bp, Homo sapiens
tacagtatgggggttgtaaa

SEQ ID NO: 5035716 - DNA, 22 bp, Homo sapiens
tacagtatgggggttgtaaatt

SEQ ID NO: 5035717 - DNA, 12 bp, Homo sapiens
tacagtgtcttt

SEQ ID NO: 5035718 - DNA, 15 bp, Homo sapiens
tacagtgtttatcct

SEQ ID NO: 5035719 - DNA, 22 bp, Homo sapiens
tacatgaggactctattcttta

SEQ ID NO: 5035720 - DNA, 15 bp, Homo sapiens
tacattccatttcat

SEQ ID NO: 5035721 - DNA, 16 bp, Homo sapiens
tacatttacaaactga

SEQ ID NO: 5035722 - DNA, 15 bp, Homo sapiens
tacatttcatacaac

SEQ ID NO: 5035723 - DNA, 19 bp, Homo sapiens
taccactctgtaattgcaa

SEQ ID NO: 5035724 - DNA, 15 bp, Homo sapiens
taccatgtaatggca

SEQ ID NO: 5035725 - DNA, 14 bp, Homo sapiens
tacccactgccatg

SEQ ID NO: 5035726 - DNA, 20 bp, Homo sapiens
taccccctcaaaccctgccc

SEQ ID NO: 5035727 - DNA, 12 bp, Homo sapiens
taccctctggag

SEQ ID NO: 5035728 - DNA, 18 bp, Homo sapiens
taccctggccgccccctg

SEQ ID NO: 5035729 - DNA, 18 bp, Homo sapiens
taccctttttctccagct

SEQ ID NO: 5035730 - DNA, 13 bp, Homo sapiens
tacctacatgtat

SEQ ID NO: 5035731 - DNA, 23 bp, Homo sapiens
tacctacatgtatttgtttgcat

SEQ ID NO: 5035732 - DNA, 19 bp, Homo sapiens
tacctcaaccatcctggct

SEQ ID NO: 5035733 - DNA, 16 bp, Homo sapiens
tacgaaataattgttg

SEQ ID NO: 5035734 - DNA, 17 bp, Homo sapiens
tacgaaataattgttgt

SEQ ID NO: 5035735 - DNA, 23 bp, Homo sapiens
tacgatacgctactataaagaga

SEQ ID NO: 5035736 - DNA, 21 bp, Homo sapiens
tacggctatattggtttatgt

SEQ ID NO: 5035737 - DNA, 20 bp, Homo sapiens
tacggtttgcccctttataa

SEQ ID NO: 5035738 - DNA, 20 bp, Homo sapiens
tactaataaactaataattg

SEQ ID NO: 5035739 - DNA, 22 bp, Homo sapiens
tactaataaactaataattgca

SEQ ID NO: 5035740 - DNA, 19 bp, Homo sapiens
tactagttttagttttctc

SEQ ID NO: 5035741 - DNA, 14 bp, Homo sapiens
tactataaagagaa

SEQ ID NO: 5035742 - DNA, 19 bp, Homo sapiens
tactatatatgtgatgatc

SEQ ID NO: 5035743 - DNA, 22 bp, Homo sapiens
tactcaacccattgttgtcaag

SEQ ID NO: 5035744 - DNA, 18 bp, Homo sapiens
tactgaacatctgagtcc

SEQ ID NO: 5035745 - DNA, 19 bp, Homo sapiens
tactgccatgtactagttt

SEQ ID NO: 5035746 - DNA, 14 bp, Homo sapiens
tactgttctgtgtc

SEQ ID NO: 5035747 - DNA, 19 bp, Homo sapiens
tacttagagtttctgtttg

SEQ ID NO: 5035748 - DNA, 20 bp, Homo sapiens
tacttagagtttctgtttga

SEQ ID NO: 5035749 - DNA, 19 bp, Homo sapiens
tacttgtaaatataaagac

SEQ ID NO: 5035750 - DNA, 20 bp, Homo sapiens
tacttgtaaatataaagacg

SEQ ID NO: 5035751 - DNA, 20 bp, Homo sapiens
tacttgtttctctgttgtaa

SEQ ID NO: 5035752 - DNA, 20 bp, Homo sapiens
tagaaaaattcagcaaacca

SEQ ID NO: 5035753 - DNA, 15 bp, Homo sapiens
tagaacctaacaccc

SEQ ID NO: 5035754 - DNA, 19 bp, Homo sapiens
tagaagagggttttaggta

SEQ ID NO: 5035755 - DNA, 22 bp, Homo sapiens
tagaagatagcatgggaggtga

SEQ ID NO: 5035756 - DNA, 21 bp, Homo sapiens
tagaatcaaacattttgaaag

SEQ ID NO: 5035757 - DNA, 21 bp, Homo sapiens
tagactttaacataagctatt

SEQ ID NO: 5035758 - DNA, 15 bp, Homo sapiens
tagagtttctgtttg

SEQ ID NO: 5035759 - DNA, 21 bp, Homo sapiens
tagagtttctgtttgattctt

SEQ ID NO: 5035760 - DNA, 19 bp, Homo sapiens
tagatagccctgtcctggt

SEQ ID NO: 5035761 - DNA, 13 bp, Homo sapiens
tagatgtttcaca

SEQ ID NO: 5035762 - DNA, 11 bp, Homo sapiens
tagcaaagatt

SEQ ID NO: 5035763 - DNA, 13 bp, Homo sapiens
tagcatgggaggt

SEQ ID NO: 5035764 - DNA, 20 bp, Homo sapiens
tagccactaaccttgcctgg

SEQ ID NO: 5035765 - DNA, 13 bp, Homo sapiens
tagccctgtcctg

SEQ ID NO: 5035766 - DNA, 15 bp, Homo sapiens
tagccctgtcctggt

SEQ ID NO: 5035767 - DNA, 17 bp, Homo sapiens
tagccctgtcctggtgg

SEQ ID NO: 5035768 - DNA, 19 bp, Homo sapiens
tagcgtgcccgtgtgcatg

SEQ ID NO: 5035769 - DNA, 21 bp, Homo sapiens
tagcgttcttgtaattttaca

SEQ ID NO: 5035770 - DNA, 16 bp, Homo sapiens
tagctcaatgagcatg

SEQ ID NO: 5035771 - DNA, 10 bp, Homo sapiens
tagctgtggg

SEQ ID NO: 5035772 - DNA, 13 bp, Homo sapiens
tagctgtgggggt

SEQ ID NO: 5035773 - DNA, 12 bp, Homo sapiens
tagcttatgaaa

SEQ ID NO: 5035774 - DNA, 17 bp, Homo sapiens
taggaagaaagaagaca

SEQ ID NO: 5035775 - DNA, 19 bp, Homo sapiens
taggaagaaagaagacaaa

SEQ ID NO: 5035776 - DNA, 14 bp, Homo sapiens
taggagggagacac

SEQ ID NO: 5035777 - DNA, 23 bp, Homo sapiens
taggccagcaagcggggatgtcc

SEQ ID NO: 5035778 - DNA, 15 bp, Homo sapiens
tagggaacaatttgg

SEQ ID NO: 5035779 - DNA, 12 bp, Homo sapiens
taggggctgggg

SEQ ID NO: 5035780 - DNA, 23 bp, Homo sapiens
taggggctggggccaaataaagt

SEQ ID NO: 5035781 - DNA, 15 bp, Homo sapiens
tagggtatattttcc

SEQ ID NO: 5035782 - DNA, 14 bp, Homo sapiens
taggtaggaagagc

SEQ ID NO: 5035783 - DNA, 12 bp, Homo sapiens
tagtagatttta

SEQ ID NO: 5035784 - DNA, 13 bp, Homo sapiens
tagtattgttgtc

SEQ ID NO: 5035785 - DNA, 12 bp, Homo sapiens
tagtcttttgct

SEQ ID NO: 5035786 - DNA, 23 bp, Homo sapiens
tagtgtagctgtgtggctttcct

SEQ ID NO: 5035787 - DNA, 12 bp, Homo sapiens
tagtgttctgtt

SEQ ID NO: 5035788 - DNA, 20 bp, Homo sapiens
tagttaacacactaccgaat

SEQ ID NO: 5035789 - DNA, 16 bp, Homo sapiens
tagtttctttctgtct

SEQ ID NO: 5035790 - DNA, 17 bp, Homo sapiens
tagttttttcatcttca

SEQ ID NO: 5035791 - DNA, 23 bp, Homo sapiens
tagttttttttttttttatgtga

SEQ ID NO: 5035792 - DNA, 21 bp, Homo sapiens
tataaacaagaaaaataaaga

SEQ ID NO: 5035793 - DNA, 21 bp, Homo sapiens
tataaagacgttttataagca

SEQ ID NO: 5035794 - DNA, 12 bp, Homo sapiens
tataaagcattt

SEQ ID NO: 5035795 - DNA, 19 bp, Homo sapiens
tataaatatattattactt

SEQ ID NO: 5035796 - DNA, 18 bp, Homo sapiens
tataaatcgcttttgata

SEQ ID NO: 5035797 - DNA, 23 bp, Homo sapiens
tataaatcgcttttgataatcaa

SEQ ID NO: 5035798 - DNA, 15 bp, Homo sapiens
tataagcatcattat

SEQ ID NO: 5035799 - DNA, 18 bp, Homo sapiens
tataagtcattgtatgtt

SEQ ID NO: 5035800 - DNA, 20 bp, Homo sapiens
tataatcacttttttccaca

SEQ ID NO: 5035801 - DNA, 16 bp, Homo sapiens
tatacgaaataattgt

SEQ ID NO: 5035802 - DNA, 20 bp, Homo sapiens
tatactcttatagacaacat

SEQ ID NO: 5035803 - DNA, 15 bp, Homo sapiens
tatagatgtcttttc

SEQ ID NO: 5035804 - DNA, 15 bp, Homo sapiens
tatagttaacacact

SEQ ID NO: 5035805 - DNA, 19 bp, Homo sapiens
tatataaatatattattac

SEQ ID NO: 5035806 - DNA, 22 bp, Homo sapiens
tatataaatatattattacttg

SEQ ID NO: 5035807 - DNA, 12 bp, Homo sapiens
tatatataaata

SEQ ID NO: 5035808 - DNA, 13 bp, Homo sapiens
tatatgatggggg

SEQ ID NO: 5035809 - DNA, 20 bp, Homo sapiens
tatcacattaatctcaaaga

SEQ ID NO: 5035810 - DNA, 18 bp, Homo sapiens
tatcacctagctgaatgt

SEQ ID NO: 5035811 - DNA, 16 bp, Homo sapiens
tatcatcagtattgaa

SEQ ID NO: 5035812 - DNA, 20 bp, Homo sapiens
tatccatgtacttgtttgca

SEQ ID NO: 5035813 - DNA, 11 bp, Homo sapiens
tatctctgtgt

SEQ ID NO: 5035814 - DNA, 19 bp, Homo sapiens
tatcttagatgtttcacac

SEQ ID NO: 5035815 - DNA, 16 bp, Homo sapiens
tatgaacagctgtgtc

SEQ ID NO: 5035816 - DNA, 14 bp, Homo sapiens
tatgaattattcaa

SEQ ID NO: 5035817 - DNA, 18 bp, Homo sapiens
tatgaattattcaattta

SEQ ID NO: 5035818 - DNA, 19 bp, Homo sapiens
tatgaattattcaatttat

SEQ ID NO: 5035819 - DNA, 16 bp, Homo sapiens
tatgactcccaaattt

SEQ ID NO: 5035820 - DNA, 20 bp, Homo sapiens
tatgatacttcgacactgtt

SEQ ID NO: 5035821 - DNA, 20 bp, Homo sapiens
tatgcaatgtatagtgtcta

SEQ ID NO: 5035822 - DNA, 19 bp, Homo sapiens
tatgggggttgtaaattgg

SEQ ID NO: 5035823 - DNA, 23 bp, Homo sapiens
tatgggggttgtaaattggcatg

SEQ ID NO: 5035824 - DNA, 15 bp, Homo sapiens
tatgtattgtgcaat

SEQ ID NO: 5035825 - DNA, 16 bp, Homo sapiens
tatgttccattaaacg

SEQ ID NO: 5035826 - DNA, 18 bp, Homo sapiens
tatgttctaacctttaca

SEQ ID NO: 5035827 - DNA, 17 bp, Homo sapiens
tatgttgaagcctttgt

SEQ ID NO: 5035828 - DNA, 12 bp, Homo sapiens
tattaaagacag

SEQ ID NO: 5035829 - DNA, 13 bp, Homo sapiens
tattaagaatgaa

SEQ ID NO: 5035830 - DNA, 19 bp, Homo sapiens
tattacttgtaaatataaa

SEQ ID NO: 5035831 - DNA, 21 bp, Homo sapiens
tattagtattgttgtcctttt

SEQ ID NO: 5035832 - DNA, 19 bp, Homo sapiens
tattataacaagtgtgtct

SEQ ID NO: 5035833 - DNA, 22 bp, Homo sapiens
tattcacatcgcttctgtgtat

SEQ ID NO: 5035834 - DNA, 21 bp, Homo sapiens
tattccaaaaaggttgctgtt

SEQ ID NO: 5035835 - DNA, 13 bp, Homo sapiens
tattcttgtgctt

SEQ ID NO: 5035836 - DNA, 17 bp, Homo sapiens
tattgaagcattttata

SEQ ID NO: 5035837 - DNA, 14 bp, Homo sapiens
tattgtgcaatgtg

SEQ ID NO: 5035838 - DNA, 12 bp, Homo sapiens
tatttatgtatt

SEQ ID NO: 5035839 - DNA, 13 bp, Homo sapiens
tatttatgtattg

SEQ ID NO: 5035840 - DNA, 20 bp, Homo sapiens
tatttattgcattgctggta

SEQ ID NO: 5035841 - DNA, 22 bp, Homo sapiens
tatttattgcattgctggtaga

SEQ ID NO: 5035842 - DNA, 19 bp, Homo sapiens
tatttgtgttttaatttaa

SEQ ID NO: 5035843 - DNA, 21 bp, Homo sapiens
tatttgtgttttaatttaaac

SEQ ID NO: 5035844 - DNA, 14 bp, Homo sapiens
tattttatgttata

SEQ ID NO: 5035845 - DNA, 18 bp, Homo sapiens
tattttcaatagccacta

SEQ ID NO: 5035846 - DNA, 14 bp, Homo sapiens
tattttctgttcta

SEQ ID NO: 5035847 - DNA, 21 bp, Homo sapiens
tatttttaattaattgggcca

SEQ ID NO: 5035848 - DNA, 12 bp, Homo sapiens
tcaaacattttg

SEQ ID NO: 5035849 - DNA, 17 bp, Homo sapiens
tcaaacattttgaaagt

SEQ ID NO: 5035850 - DNA, 18 bp, Homo sapiens
tcaaacattttgaaagtc

SEQ ID NO: 5035851 - DNA, 16 bp, Homo sapiens
tcaaactactttgctg

SEQ ID NO: 5035852 - DNA, 17 bp, Homo sapiens
tcaaactgaaattcaga

SEQ ID NO: 5035853 - DNA, 20 bp, Homo sapiens
tcaaagaaattcagaacagc

SEQ ID NO: 5035854 - DNA, 15 bp, Homo sapiens
tcaaagagattcgaa

SEQ ID NO: 5035855 - DNA, 20 bp, Homo sapiens
tcaaagcatgggattattag

SEQ ID NO: 5035856 - DNA, 20 bp, Homo sapiens
tcaaagtgtaaacaccatag

SEQ ID NO: 5035857 - DNA, 18 bp, Homo sapiens
tcaactgggctgaacact

SEQ ID NO: 5035858 - DNA, 18 bp, Homo sapiens
tcaagaagaaaaaggttt

SEQ ID NO: 5035859 - DNA, 16 bp, Homo sapiens
tcaagagatctttctt

SEQ ID NO: 5035860 - DNA, 18 bp, Homo sapiens
tcaagagttcagtgctca

SEQ ID NO: 5035861 - DNA, 21 bp, Homo sapiens
tcaagcagcgaccgccccctc

SEQ ID NO: 5035862 - DNA, 15 bp, Homo sapiens
tcaaggttttaaaac

SEQ ID NO: 5035863 - DNA, 19 bp, Homo sapiens
tcaagttttgggtatgttt

SEQ ID NO: 5035864 - DNA, 16 bp, Homo sapiens
tcaatgaagccagctc

SEQ ID NO: 5035865 - DNA, 14 bp, Homo sapiens
tcaatttatttgaa

SEQ ID NO: 5035866 - DNA, 16 bp, Homo sapiens
tcaatttatttgaatg

SEQ ID NO: 5035867 - DNA, 16 bp, Homo sapiens
tcacagctcctcccac

SEQ ID NO: 5035868 - DNA, 14 bp, Homo sapiens
tcacagtattgctc

SEQ ID NO: 5035869 - DNA, 20 bp, Homo sapiens
tcacagtccaaccagaaaca

SEQ ID NO: 5035870 - DNA, 14 bp, Homo sapiens
tcacagtgctgtgt

SEQ ID NO: 5035871 - DNA, 17 bp, Homo sapiens
tcacagtgctgtgtgcc

SEQ ID NO: 5035872 - DNA, 14 bp, Homo sapiens
tcacatagcccact

SEQ ID NO: 5035873 - DNA, 21 bp, Homo sapiens
tcacatcgcttctgtgtatct

SEQ ID NO: 5035874 - DNA, 20 bp, Homo sapiens
tcacattaatctcaaagaga

SEQ ID NO: 5035875 - DNA, 21 bp, Homo sapiens
tcacatttttaaaagaacaat

SEQ ID NO: 5035876 - DNA, 19 bp, Homo sapiens
tcacctaagtctctgtgaa

SEQ ID NO: 5035877 - DNA, 12 bp, Homo sapiens
tcacctcctcta

SEQ ID NO: 5035878 - DNA, 22 bp, Homo sapiens
tcacctcctctaaggttgggca

SEQ ID NO: 5035879 - DNA, 16 bp, Homo sapiens
tcaccttggaagggcg

SEQ ID NO: 5035880 - DNA, 13 bp, Homo sapiens
tcacctttattct

SEQ ID NO: 5035881 - DNA, 17 bp, Homo sapiens
tcactccttttaaagaa

SEQ ID NO: 5035882 - DNA, 18 bp, Homo sapiens
tcactgtgggaaggccag

SEQ ID NO: 5035883 - DNA, 15 bp, Homo sapiens
tcacttcaccctgga

SEQ ID NO: 5035884 - DNA, 13 bp, Homo sapiens
tcacttttttcca

SEQ ID NO: 5035885 - DNA, 13 bp, Homo sapiens
tcagaaagagctc

SEQ ID NO: 5035886 - DNA, 16 bp, Homo sapiens
tcagatctttctcctt

SEQ ID NO: 5035887 - DNA, 18 bp, Homo sapiens
tcagatctttctccttga

SEQ ID NO: 5035888 - DNA, 13 bp, Homo sapiens
tcagcaaaccatt

SEQ ID NO: 5035889 - DNA, 19 bp, Homo sapiens
tcagcagaacctgcacaca

SEQ ID NO: 5035890 - DNA, 18 bp, Homo sapiens
tcagccagtctcagatgc

SEQ ID NO: 5035891 - DNA, 19 bp, Homo sapiens
tcagctccaggtggctctg

SEQ ID NO: 5035892 - DNA, 17 bp, Homo sapiens
tcaggaggaatactgaa

SEQ ID NO: 5035893 - DNA, 19 bp, Homo sapiens
tcaggaggaatactgaaca

SEQ ID NO: 5035894 - DNA, 18 bp, Homo sapiens
tcaggcagcaccacactg

SEQ ID NO: 5035895 - DNA, 20 bp, Homo sapiens
tcaggcagcaccacactggg

SEQ ID NO: 5035896 - DNA, 22 bp, Homo sapiens
tcaggcagcaccacactgggtg

SEQ ID NO: 5035897 - DNA, 23 bp, Homo sapiens
tcaggcagcaccacactgggtgc

SEQ ID NO: 5035898 - DNA, 17 bp, Homo sapiens
tcagtaccctctcagct

SEQ ID NO: 5035899 - DNA, 17 bp, Homo sapiens
tcagtatgaattattca

SEQ ID NO: 5035900 - DNA, 14 bp, Homo sapiens
tcagtattgaagca

SEQ ID NO: 5035901 - DNA, 15 bp, Homo sapiens
tcagtattgaagcat

SEQ ID NO: 5035902 - DNA, 17 bp, Homo sapiens
tcagtattgaagcattt

SEQ ID NO: 5035903 - DNA, 18 bp, Homo sapiens
tcagtattgaagcatttt

SEQ ID NO: 5035904 - DNA, 22 bp, Homo sapiens
tcagtattgaagcattttataa

SEQ ID NO: 5035905 - DNA, 23 bp, Homo sapiens
tcagtattgaagcattttataaa

SEQ ID NO: 5035906 - DNA, 14 bp, Homo sapiens
tcagtgcaaagatt

SEQ ID NO: 5035907 - DNA, 16 bp, Homo sapiens
tcagtttgtgtgtctt

SEQ ID NO: 5035908 - DNA, 17 bp, Homo sapiens
tcagtttgtgtgtctta

SEQ ID NO: 5035909 - DNA, 17 bp, Homo sapiens
tcagttttttgttttac

SEQ ID NO: 5035910 - DNA, 14 bp, Homo sapiens
tcataggtctgaaa

SEQ ID NO: 5035911 - DNA, 14 bp, Homo sapiens
tcatagtagttttt

SEQ ID NO: 5035912 - DNA, 15 bp, Homo sapiens
tcatatactgccatg

SEQ ID NO: 5035913 - DNA, 20 bp, Homo sapiens
tcatatagttagctaataaa

SEQ ID NO: 5035914 - DNA, 12 bp, Homo sapiens
tcatccacccca

SEQ ID NO: 5035915 - DNA, 15 bp, Homo sapiens
tcatccataactgaa

SEQ ID NO: 5035916 - DNA, 15 bp, Homo sapiens
tcatcgtaaagtgct

SEQ ID NO: 5035917 - DNA, 20 bp, Homo sapiens
tcatcttcagttgtctctga

SEQ ID NO: 5035918 - DNA, 13 bp, Homo sapiens
tcatgcaaactct

SEQ ID NO: 5035919 - DNA, 14 bp, Homo sapiens
tcatgcaaactctt

SEQ ID NO: 5035920 - DNA, 15 bp, Homo sapiens
tcatgcccagctctc

SEQ ID NO: 5035921 - DNA, 19 bp, Homo sapiens
tcatgcccagctctctgac

SEQ ID NO: 5035922 - DNA, 20 bp, Homo sapiens
tcatgcccagctctctgacg

SEQ ID NO: 5035923 - DNA, 18 bp, Homo sapiens
tcatggcccctctgacct

SEQ ID NO: 5035924 - DNA, 14 bp, Homo sapiens
tcattaaacgtcat

SEQ ID NO: 5035925 - DNA, 19 bp, Homo sapiens
tcattagtcatgtttatct

SEQ ID NO: 5035926 - DNA, 22 bp, Homo sapiens
tcattatttttgttagcaaaga

SEQ ID NO: 5035927 - DNA, 18 bp, Homo sapiens
tcattcattagtcatgtt

SEQ ID NO: 5035928 - DNA, 14 bp, Homo sapiens
tcattggaaattta

SEQ ID NO: 5035929 - DNA, 21 bp, Homo sapiens
tcattggaaatttagcattgt

SEQ ID NO: 5035930 - DNA, 13 bp, Homo sapiens
tcatttctgcaga

SEQ ID NO: 5035931 - DNA, 18 bp, Homo sapiens
tcatttgtgccagaatgc

SEQ ID NO: 5035932 - DNA, 12 bp, Homo sapiens
tcatttgttcat

SEQ ID NO: 5035933 - DNA, 16 bp, Homo sapiens
tcatttgttcattaaa

SEQ ID NO: 5035934 - DNA, 18 bp, Homo sapiens
tcatttgttcattaaacg

SEQ ID NO: 5035935 - DNA, 18 bp, Homo sapiens
tccaaaatcttgatcagt

SEQ ID NO: 5035936 - DNA, 21 bp, Homo sapiens
tccaaagctttattaccagtg

SEQ ID NO: 5035937 - DNA, 15 bp, Homo sapiens
tccaattaaggattt

SEQ ID NO: 5035938 - DNA, 19 bp, Homo sapiens
tccaccatccccaccccac

SEQ ID NO: 5035939 - DNA, 12 bp, Homo sapiens
tccaccccatcc

SEQ ID NO: 5035940 - DNA, 22 bp, Homo sapiens
tccaccccatccctccccagtt

SEQ ID NO: 5035941 - DNA, 13 bp, Homo sapiens
tccaccctgccaa

SEQ ID NO: 5035942 - DNA, 17 bp, Homo sapiens
tccagattctgatgcat

SEQ ID NO: 5035943 - DNA, 17 bp, Homo sapiens
tccagccctggctgaag

SEQ ID NO: 5035944 - DNA, 17 bp, Homo sapiens
tccagcgagagagtttc

SEQ ID NO: 5035945 - DNA, 15 bp, Homo sapiens
tccaggctgggcagc

SEQ ID NO: 5035946 - DNA, 16 bp, Homo sapiens
tccagtcaaatctggg

SEQ ID NO: 5035947 - DNA, 18 bp, Homo sapiens
tccagtcatctgtaagag

SEQ ID NO: 5035948 - DNA, 18 bp, Homo sapiens
tgctaccgttgacttcca

SEQ ID NO: 5035949 - DNA, 14 bp, Homo sapiens
tgctcacccagtgc

SEQ ID NO: 5035950 - DNA, 21 bp, Homo sapiens
tgctcagctctggtccaggcc

SEQ ID NO: 5035951 - DNA, 17 bp, Homo sapiens
tgctccagattctgatg

SEQ ID NO: 5035952 - DNA, 14 bp, Homo sapiens
tgctccccaggcca

SEQ ID NO: 5035953 - DNA, 15 bp, Homo sapiens
tgctccccaggccac

SEQ ID NO: 5035954 - DNA, 16 bp, Homo sapiens
tgctccccaggccacc

SEQ ID NO: 5035955 - DNA, 18 bp, Homo sapiens
tgctccccaggccacccc

SEQ ID NO: 5035956 - DNA, 14 bp, Homo sapiens
tgctccctctgtca

SEQ ID NO: 5035957 - DNA, 16 bp, Homo sapiens
tgctctcagcctccca

SEQ ID NO: 5035958 - DNA, 17 bp, Homo sapiens
tgctctcagcctcccac

SEQ ID NO: 5035959 - DNA, 23 bp, Homo sapiens
tgctctttcccccttccatctct

SEQ ID NO: 5035960 - DNA, 16 bp, Homo sapiens
tgctgaggcccagtgc

SEQ ID NO: 5035961 - DNA, 14 bp, Homo sapiens
tgctgctctcagcc

SEQ ID NO: 5035962 - DNA, 15 bp, Homo sapiens
tgctgtctctctggg

SEQ ID NO: 5035963 - DNA, 13 bp, Homo sapiens
tgctgtgcaaatg

SEQ ID NO: 5035964 - DNA, 14 bp, Homo sapiens
tgctgtgcagctct

SEQ ID NO: 5035965 - DNA, 16 bp, Homo sapiens
tgctgtgcagctctct

SEQ ID NO: 5035966 - DNA, 12 bp, Homo sapiens
tgctgttttgtt

SEQ ID NO: 5035967 - DNA, 20 bp, Homo sapiens
tgcttagtgtacttggagta

SEQ ID NO: 5035968 - DNA, 17 bp, Homo sapiens
tgcttctaagtaaatac

SEQ ID NO: 5035969 - DNA, 18 bp, Homo sapiens
tgcttctaagtaaataca

SEQ ID NO: 5035970 - DNA, 18 bp, Homo sapiens
tgcttgctcatatgcatg

SEQ ID NO: 5035971 - DNA, 13 bp, Homo sapiens
tgctttaatataa

SEQ ID NO: 5035972 - DNA, 18 bp, Homo sapiens
tgctttaatataaatgca

SEQ ID NO: 5035973 - DNA, 20 bp, Homo sapiens
tgctttaatataaatgcaaa

SEQ ID NO: 5035974 - DNA, 21 bp, Homo sapiens
tgctttaatataaatgcaaat

SEQ ID NO: 5035975 - DNA, 13 bp, Homo sapiens
tgctttaatatca

SEQ ID NO: 5035976 - DNA, 18 bp, Homo sapiens
tgctttaatatcatcagt

SEQ ID NO: 5035977 - DNA, 17 bp, Homo sapiens
tgcttttcatgcaaact

SEQ ID NO: 5035978 - DNA, 14 bp, Homo sapiens
tgcttttgcccatt

SEQ ID NO: 5035979 - DNA, 17 bp, Homo sapiens
tggaaattggaagagca

SEQ ID NO: 5035980 - DNA, 19 bp, Homo sapiens
tggaactctactcaaccca

SEQ ID NO: 5035981 - DNA, 16 bp, Homo sapiens
tggaagaaggggcagg

SEQ ID NO: 5035982 - DNA, 19 bp, Homo sapiens
tggaagggcgttctaggta

SEQ ID NO: 5035983 - DNA, 14 bp, Homo sapiens
tgtaaaaactgtgg

SEQ ID NO: 5035984 - DNA, 13 bp, Homo sapiens
tgtaaatataaag

SEQ ID NO: 5035985 - DNA, 11 bp, Homo sapiens
tgtaaattggc

SEQ ID NO: 5035986 - DNA, 17 bp, Homo sapiens
tgtaacatactggcctg

SEQ ID NO: 5035987 - DNA, 18 bp, Homo sapiens
tgtaagagcttgctccag

SEQ ID NO: 5035988 - DNA, 13 bp, Homo sapiens
tgtaataatgtga

SEQ ID NO: 5035989 - DNA, 17 bp, Homo sapiens
tgtaatggcagttatat

SEQ ID NO: 5035990 - DNA, 19 bp, Homo sapiens
tgtaatttcaggaggaata

SEQ ID NO: 5035991 - DNA, 21 bp, Homo sapiens
tgtacacaactcactcctttt

SEQ ID NO: 5035992 - DNA, 15 bp, Homo sapiens
tgtacagtgtctttt

SEQ ID NO: 5035993 - DNA, 21 bp, Homo sapiens
tgtacataccctggccgcccc

SEQ ID NO: 5035994 - DNA, 13 bp, Homo sapiens
tgtactagtttta

SEQ ID NO: 5035995 - DNA, 15 bp, Homo sapiens
tgtactgttctgtgt

SEQ ID NO: 5035996 - DNA, 20 bp, Homo sapiens
tgtagctgtgtggctttcct

SEQ ID NO: 5035997 - DNA, 15 bp, Homo sapiens
tgtagtcagttgcat

SEQ ID NO: 5035998 - DNA, 15 bp, Homo sapiens
tgtagtgctttgaga

SEQ ID NO: 5035999 - DNA, 22 bp, Homo sapiens
tgtagtgctttgagagagaaag

SEQ ID NO: 5036000 - DNA, 17 bp, Homo sapiens
tgtataaacaagaaaaa

SEQ ID NO: 5036001 - DNA, 23 bp, Homo sapiens
tgtataaacaagaaaaataaaga

SEQ ID NO: 5036002 - DNA, 16 bp, Homo sapiens
tgtatagttaacacac

SEQ ID NO: 5036003 - DNA, 12 bp, Homo sapiens
tgtatctgtgta

SEQ ID NO: 5036004 - DNA, 21 bp, Homo sapiens
tgtatgttattatattccgta

SEQ ID NO: 5036005 - DNA, 16 bp, Homo sapiens
tgtattaagaatgaaa

SEQ ID NO: 5036006 - DNA, 19 bp, Homo sapiens
tgtattgtgcaatgtgtat

SEQ ID NO: 5036007 - DNA, 20 bp, Homo sapiens
tgtattgtgcaatgtgtata

SEQ ID NO: 5036008 - DNA, 12 bp, Homo sapiens
tgtattttatgt

SEQ ID NO: 5036009 - DNA, 13 bp, Homo sapiens
tgtattttatgtt

SEQ ID NO: 5036010 - DNA, 17 bp, Homo sapiens
tgtattttatgttatat

SEQ ID NO: 5036011 - DNA, 13 bp, Homo sapiens
tgtcaaggaagaa

SEQ ID NO: 5036012 - DNA, 17 bp, Homo sapiens
tgtcatatactgccatg

SEQ ID NO: 5036013 - DNA, 17 bp, Homo sapiens
tgtcattggaagccatc

SEQ ID NO: 5036014 - DNA, 18 bp, Homo sapiens
tgtccacacccagctcag

SEQ ID NO: 5036015 - DNA, 18 bp, Homo sapiens
tgtcccacccccaccccc

SEQ ID NO: 5036016 - DNA, 23 bp, Homo sapiens
tgtcccacccccacccccagctc

SEQ ID NO: 5036017 - DNA, 12 bp, Homo sapiens
tgtccccagcag

SEQ ID NO: 5036018 - DNA, 14 bp, Homo sapiens
tgtcccctgcgggc

SEQ ID NO: 5036019 - DNA, 19 bp, Homo sapiens
tgtccctctgggccaatgc

SEQ ID NO: 5036020 - DNA, 23 bp, Homo sapiens
tgtccgctgggtggtaccctctg

SEQ ID NO: 5036021 - DNA, 13 bp, Homo sapiens
tgtcctggtggta

SEQ ID NO: 5036022 - DNA, 20 bp, Homo sapiens
tgtcctggtggtattttcaa

SEQ ID NO: 5036023 - DNA, 14 bp, Homo sapiens
tgtcctttcccttc

SEQ ID NO: 5036024 - DNA, 19 bp, Homo sapiens
tgtcgggcaccagccagcg

SEQ ID NO: 5036025 - DNA, 16 bp, Homo sapiens
tgtcgtgggatggcat

SEQ ID NO: 5036026 - DNA, 20 bp, Homo sapiens
tgtctaggactgcagtgtgg

SEQ ID NO: 5036027 - DNA, 13 bp, Homo sapiens
tgtctataaagca

SEQ ID NO: 5036028 - DNA, 20 bp, Homo sapiens
tgtctccctcccctctcaga

SEQ ID NO: 5036029 - DNA, 13 bp, Homo sapiens
tgtctctgatgca

SEQ ID NO: 5036030 - DNA, 14 bp, Homo sapiens
tgtctctgatgcag

SEQ ID NO: 5036031 - DNA, 15 bp, Homo sapiens
tgtctcttatggatg

SEQ ID NO: 5036032 - DNA, 20 bp, Homo sapiens
tgtctcttatggatgtcccc

SEQ ID NO: 5036033 - DNA, 12 bp, Homo sapiens
tgtctgtctccc

SEQ ID NO: 5036034 - DNA, 15 bp, Homo sapiens
tgtctgtctccctcc

SEQ ID NO: 5036035 - DNA, 22 bp, Homo sapiens
tgtcttcatacctacatgtatt

SEQ ID NO: 5036036 - DNA, 17 bp, Homo sapiens
tgtcttggctgtggggc

SEQ ID NO: 5036037 - DNA, 15 bp, Homo sapiens
tgtctttaaaagaga

SEQ ID NO: 5036038 - DNA, 17 bp, Homo sapiens
tgtctttagatagccct

SEQ ID NO: 5036039 - DNA, 18 bp, Homo sapiens
tgtctttagatagccctg

SEQ ID NO: 5036040 - DNA, 19 bp, Homo sapiens
tgtgaactaaactttcaca

SEQ ID NO: 5036041 - DNA, 20 bp, Homo sapiens
tgtgaactaaactttcacac

SEQ ID NO: 5036042 - DNA, 16 bp, Homo sapiens
tgtgacaggcagcaga

SEQ ID NO: 5036043 - DNA, 15 bp, Homo sapiens
tgtgacagtgcctct

SEQ ID NO: 5036044 - DNA, 18 bp, Homo sapiens
tgtgagctggatagactt

SEQ ID NO: 5036045 - DNA, 22 bp, Homo sapiens
tgtgagctggatagacttggga

SEQ ID NO: 5036046 - DNA, 17 bp, Homo sapiens
tgtgatggagtgctgtt

SEQ ID NO: 5036047 - DNA, 11 bp, Homo sapiens
tgtgcaatgtg

SEQ ID NO: 5036048 - DNA, 22 bp, Homo sapiens
tgtgcaatgtgtataaacaaga

SEQ ID NO: 5036049 - DNA, 21 bp, Homo sapiens
tgtggagttcaccttggaagg

SEQ ID NO: 5036050 - DNA, 22 bp, Homo sapiens
tgtggagttcaccttggaaggg

SEQ ID NO: 5036051 - DNA, 18 bp, Homo sapiens
tgtggttttcgagattat

SEQ ID NO: 5036052 - DNA, 14 bp, Homo sapiens
tgtgtataaacaag

SEQ ID NO: 5036053 - DNA, 17 bp, Homo sapiens
tgtgtatctctttcaca

SEQ ID NO: 5036054 - DNA, 17 bp, Homo sapiens
tgtgtccctcttctctt

SEQ ID NO: 5036055 - DNA, 14 bp, Homo sapiens
tgtgtcctggttcc

SEQ ID NO: 5036056 - DNA, 12 bp, Homo sapiens
tgtgtctgccaa

SEQ ID NO: 5036057 - DNA, 18 bp, Homo sapiens
tgtgtctgccaaacacat

SEQ ID NO: 5036058 - DNA, 21 bp, Homo sapiens
tgtgtctgccaaacacattta

SEQ ID NO: 5036059 - DNA, 14 bp, Homo sapiens
tgtgtctttagata

SEQ ID NO: 5036060 - DNA, 18 bp, Homo sapiens
tgtgtctttcacagctcc

SEQ ID NO: 5036061 - DNA, 12 bp, Homo sapiens
tgttaactgaat

SEQ ID NO: 5036062 - DNA, 14 bp, Homo sapiens
tgttaactgaatac

SEQ ID NO: 5036063 - DNA, 17 bp, Homo sapiens
tgttaactgaataccac

SEQ ID NO: 5036064 - DNA, 13 bp, Homo sapiens
tgttaagctctgc

SEQ ID NO: 5036065 - DNA, 12 bp, Homo sapiens
tgttagcaaaga

SEQ ID NO: 5036066 - DNA, 21 bp, Homo sapiens
tcctccccacttgtccgctgg

SEQ ID NO: 5036067 - DNA, 20 bp, Homo sapiens
tcctcccctcctcctggact

SEQ ID NO: 5036068 - DNA, 22 bp, Homo sapiens
tcctcccctcctcctggactcc

SEQ ID NO: 5036069 - DNA, 15 bp, Homo sapiens
tcctccgaggccagt

SEQ ID NO: 5036070 - DNA, 15 bp, Homo sapiens
tcctcgtttgtgttc

SEQ ID NO: 5036071 - DNA, 21 bp, Homo sapiens
tcctctagctgtgggggtgag

SEQ ID NO: 5036072 - DNA, 11 bp, Homo sapiens
tcctctctctg

SEQ ID NO: 5036073 - DNA, 18 bp, Homo sapiens
tcctgataaagcacagct

SEQ ID NO: 5036074 - DNA, 14 bp, Homo sapiens
tcctgcacacgctc

SEQ ID NO: 5036075 - DNA, 12 bp, Homo sapiens
tcctgcctgtgc

SEQ ID NO: 5036076 - DNA, 18 bp, Homo sapiens
tcctgctaagttaatgtt

SEQ ID NO: 5036077 - DNA, 19 bp, Homo sapiens
tcctggacactcagacctg

SEQ ID NO: 5036078 - DNA, 19 bp, Homo sapiens
tcctggagcagaccacccc

SEQ ID NO: 5036079 - DNA, 18 bp, Homo sapiens
tcctggagctctgtgggt

SEQ ID NO: 5036080 - DNA, 18 bp, Homo sapiens
tcctggatgttgtgtgta

SEQ ID NO: 5036081 - DNA, 12 bp, Homo sapiens
tcctggctgcgg

SEQ ID NO: 5036082 - DNA, 20 bp, Homo sapiens
tcctgtgtgttaagctctgc

SEQ ID NO: 5036083 - DNA, 23 bp, Homo sapiens
tccttagacctgagggacccttc

SEQ ID NO: 5036084 - DNA, 16 bp, Homo sapiens
tccttcaaagcaaatg

SEQ ID NO: 5036085 - DNA, 19 bp, Homo sapiens
tcctttcatatagttagct

SEQ ID NO: 5036086 - DNA, 22 bp, Homo sapiens
tcctttgaacttgattgcctat

SEQ ID NO: 5036087 - DNA, 13 bp, Homo sapiens
tccttttaaagaa

SEQ ID NO: 5036088 - DNA, 15 bp, Homo sapiens
tccttttcacatttt

SEQ ID NO: 5036089 - DNA, 13 bp, Homo sapiens
tccttttctttaa

SEQ ID NO: 5036090 - DNA, 19 bp, Homo sapiens
tcgagagctggccaaagag

SEQ ID NO: 5036091 - DNA, 22 bp, Homo sapiens
tcgaggcggatctttggacaga

SEQ ID NO: 5036092 - DNA, 16 bp, Homo sapiens
tcgctgtcacaggcgg

SEQ ID NO: 5036093 - DNA, 15 bp, Homo sapiens
tcgcttttgataatc

SEQ ID NO: 5036094 - DNA, 17 bp, Homo sapiens
tcgggcaccagccagcg

SEQ ID NO: 5036095 - DNA, 17 bp, Homo sapiens
tcggggcttgccccact

SEQ ID NO: 5036096 - DNA, 14 bp, Homo sapiens
tcgtttgtgttctg

SEQ ID NO: 5036097 - DNA, 15 bp, Homo sapiens
tcgtttgtgttctgt

SEQ ID NO: 5036098 - DNA, 21 bp, Homo sapiens
tcgttttcttaaagtgccagt

SEQ ID NO: 5036099 - DNA, 18 bp, Homo sapiens
tctaaaggagtttatgtt

SEQ ID NO: 5036100 - DNA, 16 bp, Homo sapiens
tctaaatatggactgc

SEQ ID NO: 5036101 - DNA, 17 bp, Homo sapiens
tctaactacaaaggttt

SEQ ID NO: 5036102 - DNA, 16 bp, Homo sapiens
tctaagtaaatacaat

SEQ ID NO: 5036103 - DNA, 21 bp, Homo sapiens
tctacaactcatacactcgta

SEQ ID NO: 5036104 - DNA, 14 bp, Homo sapiens
tctacacagagcag

SEQ ID NO: 5036105 - DNA, 15 bp, Homo sapiens
tctacctcaggcagc

SEQ ID NO: 5036106 - DNA, 22 bp, Homo sapiens
tctactcaacccattgttgtca

SEQ ID NO: 5036107 - DNA, 23 bp, Homo sapiens
tctagcgcagttttttttttctt

SEQ ID NO: 5036108 - DNA, 14 bp, Homo sapiens
tctaggactgcagt

SEQ ID NO: 5036109 - DNA, 12 bp, Homo sapiens
tctataaagcat

SEQ ID NO: 5036110 - DNA, 15 bp, Homo sapiens
tctataaagcattta

SEQ ID NO: 5036111 - DNA, 17 bp, Homo sapiens
tctataaagcatttaac

SEQ ID NO: 5036112 - DNA, 19 bp, Homo sapiens
tctataaagcatttaaccc

SEQ ID NO: 5036113 - DNA, 15 bp, Homo sapiens
tctattatcacatta

SEQ ID NO: 5036114 - DNA, 16 bp, Homo sapiens
tctattctttaactcc

SEQ ID NO: 5036115 - DNA, 17 bp, Homo sapiens
tctcaatgaagccagct

SEQ ID NO: 5036116 - DNA, 20 bp, Homo sapiens
tctcactgtgggaaggccag

SEQ ID NO: 5036117 - DNA, 21 bp, Homo sapiens
tctcactgtgggaaggccagc

SEQ ID NO: 5036118 - DNA, 19 bp, Homo sapiens
tctcagaaggcaaatgact

SEQ ID NO: 5036119 - DNA, 20 bp, Homo sapiens
tctcagaaggcaaatgactt

SEQ ID NO: 5036120 - DNA, 15 bp, Homo sapiens
tctcagatgcagttt

SEQ ID NO: 5036121 - DNA, 15 bp, Homo sapiens
tctcagcctcccaca

SEQ ID NO: 5036122 - DNA, 21 bp, Homo sapiens
tctcagctccaggtggctctg

SEQ ID NO: 5036123 - DNA, 22 bp, Homo sapiens
tctcaggcagcaccacactggg

SEQ ID NO: 5036124 - DNA, 16 bp, Homo sapiens
tctcagtttgtgtgtc

SEQ ID NO: 5036125 - DNA, 24 bp, Homo sapiens
tctcattggaaatttagcattgta

SEQ ID NO: 5036126 - DNA, 20 bp, Homo sapiens
tctcccggaggttgggtggg

SEQ ID NO: 5036127 - DNA, 19 bp, Homo sapiens
tctccctcaactgaagggg

SEQ ID NO: 5036128 - DNA, 16 bp, Homo sapiens
tctcgaactgctggat

SEQ ID NO: 5036129 - DNA, 20 bp, Homo sapiens
tctcggcttggatcctgggc

SEQ ID NO: 5036130 - DNA, 15 bp, Homo sapiens
tctcgtgagtcattt

SEQ ID NO: 5036131 - DNA, 15 bp, Homo sapiens
tctctcggctcccca

SEQ ID NO: 5036132 - DNA, 20 bp, Homo sapiens
tctctgacgcttgtgacagt

SEQ ID NO: 5036133 - DNA, 16 bp, Homo sapiens
tctctgatgcagctta

SEQ ID NO: 5036134 - DNA, 23 bp, Homo sapiens
tctctggaagaggaaccaggaga

SEQ ID NO: 5036135 - DNA, 19 bp, Homo sapiens
tctgaatgcttctaagtaa

SEQ ID NO: 5036136 - DNA, 16 bp, Homo sapiens
tctgacaacagacttc

SEQ ID NO: 5036137 - DNA, 15 bp, Homo sapiens
tctgacatctctgca

SEQ ID NO: 5036138 - DNA, 18 bp, Homo sapiens
tctgacctgcactgggga

SEQ ID NO: 5036139 - DNA, 13 bp, Homo sapiens
tctgacgcttgtg

SEQ ID NO: 5036140 - DNA, 22 bp, Homo sapiens
tctgacgcttgtgacagtgcct

SEQ ID NO: 5036141 - DNA, 20 bp, Homo sapiens
tctgagattattttaatcta

SEQ ID NO: 5036142 - DNA, 13 bp, Homo sapiens
tctgagtcctgga

SEQ ID NO: 5036143 - DNA, 17 bp, Homo sapiens
tctgcaactgctcagct

SEQ ID NO: 5036144 - DNA, 14 bp, Homo sapiens
tctgcaatcttctc

SEQ ID NO: 5036145 - DNA, 17 bp, Homo sapiens
tctgcaatcttctcaga

SEQ ID NO: 5036146 - DNA, 16 bp, Homo sapiens
tctgcaattcccctct

SEQ ID NO: 5036147 - DNA, 18 bp, Homo sapiens
tctgcaattcccctctgc

SEQ ID NO: 5036148 - DNA, 21 bp, Homo sapiens
tctgcaattcccctctgctgc

SEQ ID NO: 5036149 - DNA, 22 bp, Homo sapiens
tctgcaattcccctctgctgct

SEQ ID NO: 5036150 - DNA, 16 bp, Homo sapiens
tctgcagatggaaagt

SEQ ID NO: 5036151 - DNA, 13 bp, Homo sapiens
tctgccaaacaca

SEQ ID NO: 5036152 - DNA, 20 bp, Homo sapiens
tctgcccacagtctttccgt

SEQ ID NO: 5036153 - DNA, 10 bp, Homo sapiens
tctgcctttg

SEQ ID NO: 5036154 - DNA, 12 bp, Homo sapiens
tctgctgaggcc

SEQ ID NO: 5036155 - DNA, 14 bp, Homo sapiens
tctggaagaaaaaa

SEQ ID NO: 5036156 - DNA, 15 bp, Homo sapiens
tctggacagtacctg

SEQ ID NO: 5036157 - DNA, 14 bp, Homo sapiens
tctgggccagaatt

SEQ ID NO: 5036158 - DNA, 20 bp, Homo sapiens
tctgtaagagcttgctccag

SEQ ID NO: 5036159 - DNA, 14 bp, Homo sapiens
tctgtaattgcaaa

SEQ ID NO: 5036160 - DNA, 19 bp, Homo sapiens
tctgtaggcacagagctgc

SEQ ID NO: 5036161 - DNA, 23 bp, Homo sapiens
tctgtctaggactgcagtgtgga

SEQ ID NO: 5036162 - DNA, 23 bp, Homo sapiens
tctgtctccctcccctctcagaa

SEQ ID NO: 5036163 - DNA, 13 bp, Homo sapiens
tctgttaactgaa

SEQ ID NO: 5036164 - DNA, 16 bp, Homo sapiens
tctgttaactgaatac

SEQ ID NO: 5036165 - DNA, 21 bp, Homo sapiens
tctgttaactgaataccactc

SEQ ID NO: 5036166 - DNA, 14 bp, Homo sapiens
tctgttgtcaaact

SEQ ID NO: 5036167 - DNA, 13 bp, Homo sapiens
tctgtttaaagtg

SEQ ID NO: 5036168 - DNA, 14 bp, Homo sapiens
tctgtttaaagtgg

SEQ ID NO: 5036169 - DNA, 15 bp, Homo sapiens
tctgtttgaggagag

SEQ ID NO: 5036170 - DNA, 14 bp, Homo sapiens
tctgtttgattctt

SEQ ID NO: 5036171 - DNA, 17 bp, Homo sapiens
tctgttttatgacttca

SEQ ID NO: 5036172 - DNA, 21 bp, Homo sapiens
tcttaaagtgccagtatttta

SEQ ID NO: 5036173 - DNA, 16 bp, Homo sapiens
tcttacaaaagctttg

SEQ ID NO: 5036174 - DNA, 16 bp, Homo sapiens
tcttagctcaatgagc

SEQ ID NO: 5036175 - DNA, 22 bp, Homo sapiens
tcttagctcaatgagcatgttt

SEQ ID NO: 5036176 - DNA, 18 bp, Homo sapiens
tcttatggatgtccccag

SEQ ID NO: 5036177 - DNA, 16 bp, Homo sapiens
tcttattgcgctgcta

SEQ ID NO: 5036178 - DNA, 17 bp, Homo sapiens
tcttattgcgctgctac

SEQ ID NO: 5036179 - DNA, 20 bp, Homo sapiens
tcttcagttaagcctttgga

SEQ ID NO: 5036180 - DNA, 17 bp, Homo sapiens
tcttcagttgtctctga

SEQ ID NO: 5036181 - DNA, 21 bp, Homo sapiens
tcttcatacctacatgtattt

SEQ ID NO: 5036182 - DNA, 17 bp, Homo sapiens
tcttcctggattattca

SEQ ID NO: 5036183 - DNA, 21 bp, Homo sapiens
tcttctcagaaggcaaatgac

SEQ ID NO: 5036184 - DNA, 13 bp, Homo sapiens
tcttggcagtcac

SEQ ID NO: 5036185 - DNA, 13 bp, Homo sapiens
tcttgtaatttta

SEQ ID NO: 5036186 - DNA, 15 bp, Homo sapiens
tcttgtaattttaca

SEQ ID NO: 5036187 - DNA, 19 bp, Homo sapiens
tcttgtaattttacacgct

SEQ ID NO: 5036188 - DNA, 14 bp, Homo sapiens
tcttgtattaagaa

SEQ ID NO: 5036189 - DNA, 12 bp, Homo sapiens
tcttgtctataa

SEQ ID NO: 5036190 - DNA, 16 bp, Homo sapiens
tcttgtctataaagca

SEQ ID NO: 5036191 - DNA, 17 bp, Homo sapiens
tcttgttggtgcacagc

SEQ ID NO: 5036192 - DNA, 14 bp, Homo sapiens
tctttaaaagagag

SEQ ID NO: 5036193 - DNA, 14 bp, Homo sapiens
tctttacaaaacaa

SEQ ID NO: 5036194 - DNA, 21 bp, Homo sapiens
tctttagatagccctgtcctg

SEQ ID NO: 5036195 - DNA, 14 bp, Homo sapiens
tctttcacagctcc

SEQ ID NO: 5036196 - DNA, 15 bp, Homo sapiens
tctttcacagctcct

SEQ ID NO: 5036197 - DNA, 20 bp, Homo sapiens
tctttcacagctcctcccac

SEQ ID NO: 5036198 - DNA, 23 bp, Homo sapiens
tctttcacattgtttgctgctat

SEQ ID NO: 5036199 - DNA, 13 bp, Homo sapiens
tctttccatttgc

SEQ ID NO: 5036200 - DNA, 24 bp, Homo sapiens
tctttctccttgaatatctttcga

SEQ ID NO: 5036201 - DNA, 19 bp, Homo sapiens
tctttctgtgcttggattt

SEQ ID NO: 5036202 - DNA, 18 bp, Homo sapiens
tctttctttgcaccaaag

SEQ ID NO: 5036203 - DNA, 19 bp, Homo sapiens
tctttctttgcaccaaaga

SEQ ID NO: 5036204 - DNA, 22 bp, Homo sapiens
tctttggctcccctgtaccttt

SEQ ID NO: 5036205 - DNA, 17 bp, Homo sapiens
tctttgttttgtgtctc

SEQ ID NO: 5036206 - DNA, 19 bp, Homo sapiens
tcttttgcttttgcccatt

SEQ ID NO: 5036207 - DNA, 21 bp, Homo sapiens
tcttttttggccatctgctcc

SEQ ID NO: 5036208 - DNA, 17 bp, Homo sapiens
tctttttttgagtgaca

SEQ ID NO: 5036209 - DNA, 23 bp, Homo sapiens
tctttttttgtatagttaacaca

SEQ ID NO: 5036210 - DNA, 16 bp, Homo sapiens
tgaaaaaaacttcatt

SEQ ID NO: 5036211 - DNA, 16 bp, Homo sapiens
tgaaaagttggaagga

SEQ ID NO: 5036212 - DNA, 15 bp, Homo sapiens
tgaaacacacgagca

SEQ ID NO: 5036213 - DNA, 19 bp, Homo sapiens
tgaaactgcttgtttccta

SEQ ID NO: 5036214 - DNA, 20 bp, Homo sapiens
tgaaactgcttgtttcctag

SEQ ID NO: 5036215 - DNA, 22 bp, Homo sapiens
tgaaagaggacgtgttacccac

SEQ ID NO: 5036216 - DNA, 14 bp, Homo sapiens
tgaaaggtgtgcta

SEQ ID NO: 5036217 - DNA, 15 bp, Homo sapiens
tgaaagtctgtcctt

SEQ ID NO: 5036218 - DNA, 12 bp, Homo sapiens
tgaaataataga

SEQ ID NO: 5036219 - DNA, 17 bp, Homo sapiens
tgaaatgaggtctgttt

SEQ ID NO: 5036220 - DNA, 23 bp, Homo sapiens
tgaaatgaggtctgtttaaagtg

SEQ ID NO: 5036221 - DNA, 19 bp, Homo sapiens
tgaaatgtaaggctgtgta

SEQ ID NO: 5036222 - DNA, 23 bp, Homo sapiens
tgaaattcagagcaagttcctga

SEQ ID NO: 5036223 - DNA, 13 bp, Homo sapiens
tgaaatttttctt

SEQ ID NO: 5036224 - DNA, 17 bp, Homo sapiens
tgaacaagagaagcatt

SEQ ID NO: 5036225 - DNA, 23 bp, Homo sapiens
tgaacaagagaagcattctcatt

SEQ ID NO: 5036226 - DNA, 20 bp, Homo sapiens
tgaacagctgtgtctgccaa

SEQ ID NO: 5036227 - DNA, 13 bp, Homo sapiens
tgaacattcccag

SEQ ID NO: 5036228 - DNA, 18 bp, Homo sapiens
tgaacattcccagcccag

SEQ ID NO: 5036229 - DNA, 19 bp, Homo sapiens
tgaactaaactttcacacc

SEQ ID NO: 5036230 - DNA, 16 bp, Homo sapiens
tgaactctgacaacag

SEQ ID NO: 5036231 - DNA, 17 bp, Homo sapiens
tgaagactatgaaaatg

SEQ ID NO: 5036232 - DNA, 12 bp, Homo sapiens
tgaagcaggagg

SEQ ID NO: 5036233 - DNA, 15 bp, Homo sapiens
tgaagcaggaggccc

SEQ ID NO: 5036234 - DNA, 16 bp, Homo sapiens
tgaagcattttataaa

SEQ ID NO: 5036235 - DNA, 17 bp, Homo sapiens
tgaagcattttataaat

SEQ ID NO: 5036236 - DNA, 17 bp, Homo sapiens
tgaaggactaatagaaa

SEQ ID NO: 5036237 - DNA, 22 bp, Homo sapiens
tgaaggactaatagaaaagtat

SEQ ID NO: 5036238 - DNA, 10 bp, Homo sapiens
tgaaggactg

SEQ ID NO: 5036239 - DNA, 20 bp, Homo sapiens
tgaaggggtgcacccacctg

SEQ ID NO: 5036240 - DNA, 12 bp, Homo sapiens
tgaagtgaaact

SEQ ID NO: 5036241 - DNA, 14 bp, Homo sapiens
tgaagtgaaactgc

SEQ ID NO: 5036242 - DNA, 18 bp, Homo sapiens
tgaagtgagcacagccta

SEQ ID NO: 5036243 - DNA, 19 bp, Homo sapiens
tgaataccactctgtaatt

SEQ ID NO: 5036244 - DNA, 15 bp, Homo sapiens
tgaatgatttttctt

SEQ ID NO: 5036245 - DNA, 17 bp, Homo sapiens
tgaatgcttctaagtaa

SEQ ID NO: 5036246 - DNA, 13 bp, Homo sapiens
tgaatgtttttct

SEQ ID NO: 5036247 - DNA, 16 bp, Homo sapiens
tgaatgtttttctaaa

SEQ ID NO: 5036248 - DNA, 18 bp, Homo sapiens
tgaattattacagtgttt

SEQ ID NO: 5036249 - DNA, 18 bp, Homo sapiens
tgacaacagacttctgaa

SEQ ID NO: 5036250 - DNA, 21 bp, Homo sapiens
tgacaacctccattctatttt

SEQ ID NO: 5036251 - DNA, 17 bp, Homo sapiens
tgacagctttctgggat

SEQ ID NO: 5036252 - DNA, 17 bp, Homo sapiens
tgacagggacatgccct

SEQ ID NO: 5036253 - DNA, 13 bp, Homo sapiens
tgtttagacttta

SEQ ID NO: 5036254 - DNA, 23 bp, Homo sapiens
tgtttagactttaacataagcta

SEQ ID NO: 5036255 - DNA, 17 bp, Homo sapiens
tgtttatcctttcatat

SEQ ID NO: 5036256 - DNA, 17 bp, Homo sapiens
tgtttatgtaatttcag

SEQ ID NO: 5036257 - DNA, 22 bp, Homo sapiens
tgtttctctgttgtaagaatag

SEQ ID NO: 5036258 - DNA, 22 bp, Homo sapiens
tgtttgaaatgaggtctgttta

SEQ ID NO: 5036259 - DNA, 14 bp, Homo sapiens
tgtttgagaaatta

SEQ ID NO: 5036260 - DNA, 14 bp, Homo sapiens
tgtttgcaagcagg

SEQ ID NO: 5036261 - DNA, 20 bp, Homo sapiens
tgtttggtgtttgtctgtgt

SEQ ID NO: 5036262 - DNA, 22 bp, Homo sapiens
tgttttaatttaaacacctcct

SEQ ID NO: 5036263 - DNA, 23 bp, Homo sapiens
tgttttaatttaaacacctcctc

SEQ ID NO: 5036264 - DNA, 13 bp, Homo sapiens
tgttttacaatgt

SEQ ID NO: 5036265 - DNA, 16 bp, Homo sapiens
tgttttagaaccagcc

SEQ ID NO: 5036266 - DNA, 17 bp, Homo sapiens
tgttttctgaaacacac

SEQ ID NO: 5036267 - DNA, 22 bp, Homo sapiens
tgttttctgaaacacacgagca

SEQ ID NO: 5036268 - DNA, 15 bp, Homo sapiens
tgttttgttgacatt

SEQ ID NO: 5036269 - DNA, 21 bp, Homo sapiens
tgttttgttgacattctgaat

SEQ ID NO: 5036270 - DNA, 15 bp, Homo sapiens
tgtttttaaactgta

SEQ ID NO: 5036271 - DNA, 16 bp, Homo sapiens
tgtttttaaactgtac

SEQ ID NO: 5036272 - DNA, 19 bp, Homo sapiens
tgtttttaaactgtacagt

SEQ ID NO: 5036273 - DNA, 23 bp, Homo sapiens
tgtttttaaactgtacagtgtct

SEQ ID NO: 5036274 - DNA, 17 bp, Homo sapiens
ttaaaaaagataaacac

SEQ ID NO: 5036275 - DNA, 11 bp, Homo sapiens
ttaaaatacaa

SEQ ID NO: 5036276 - DNA, 13 bp, Homo sapiens
ttaaaatacaaga

SEQ ID NO: 5036277 - DNA, 21 bp, Homo sapiens
ttaaaatagcgttcttgtaat

SEQ ID NO: 5036278 - DNA, 13 bp, Homo sapiens
ttaaacacctcct

SEQ ID NO: 5036279 - DNA, 18 bp, Homo sapiens
ttaaacattggttcttgt

SEQ ID NO: 5036280 - DNA, 20 bp, Homo sapiens
ttaaacattggttcttgtat

SEQ ID NO: 5036281 - DNA, 15 bp, Homo sapiens
ttaaacgatttttaa

SEQ ID NO: 5036282 - DNA, 18 bp, Homo sapiens
ttaaacgatttttaaaat

SEQ ID NO: 5036283 - DNA, 22 bp, Homo sapiens
ttaaacgatttttaaaatgtac

SEQ ID NO: 5036284 - DNA, 13 bp, Homo sapiens
ttaaactgtacag

SEQ ID NO: 5036285 - DNA, 16 bp, Homo sapiens
ttaaactgtacagtgt

SEQ ID NO: 5036286 - DNA, 20 bp, Homo sapiens
ttaaactgtacagtgtcttt

SEQ ID NO: 5036287 - DNA, 21 bp, Homo sapiens
ttaaactgtacagtgtctttt

SEQ ID NO: 5036288 - DNA, 16 bp, Homo sapiens
ttaaataaaagcacaa

SEQ ID NO: 5036289 - DNA, 19 bp, Homo sapiens
ttaaataaaagcacaagta

SEQ ID NO: 5036290 - DNA, 20 bp, Homo sapiens
ttaaatgaacaagagaagca

SEQ ID NO: 5036291 - DNA, 18 bp, Homo sapiens
ttaaatgtgtacaatgta

SEQ ID NO: 5036292 - DNA, 18 bp, Homo sapiens
ttaaattttttgttgaca

SEQ ID NO: 5036293 - DNA, 12 bp, Homo sapiens
ttaacacactac

SEQ ID NO: 5036294 - DNA, 18 bp, Homo sapiens
ttaacataagctattttt

SEQ ID NO: 5036295 - DNA, 18 bp, Homo sapiens
ttaacccccctgtacaca

SEQ ID NO: 5036296 - DNA, 22 bp, Homo sapiens
ttaactcccattaccatgtaat

SEQ ID NO: 5036297 - DNA, 21 bp, Homo sapiens
ttaactgaataccactctgta

SEQ ID NO: 5036298 - DNA, 22 bp, Homo sapiens
ttaactgaataccactctgtaa

SEQ ID NO: 5036299 - DNA, 20 bp, Homo sapiens
ttaagaatgaaatactgttt

SEQ ID NO: 5036300 - DNA, 22 bp, Homo sapiens
ttaagaatgaaatactgtttga

SEQ ID NO: 5036301 - DNA, 16 bp, Homo sapiens
ttaagcctttggaaac

SEQ ID NO: 5036302 - DNA, 11 bp, Homo sapiens
ttaagttgaga

SEQ ID NO: 5036303 - DNA, 23 bp, Homo sapiens
ttaagttgagatagttttcatcc

SEQ ID NO: 5036304 - DNA, 22 bp, Homo sapiens
ttaatacagtttatttttaaag

SEQ ID NO: 5036305 - DNA, 14 bp, Homo sapiens
ttaatataaatgca

SEQ ID NO: 5036306 - DNA, 15 bp, Homo sapiens
ttaatataaatgcaa

SEQ ID NO: 5036307 - DNA, 13 bp, Homo sapiens
ttaattacaccat

SEQ ID NO: 5036308 - DNA, 21 bp, Homo sapiens
ttaattattatttgtgtttta

SEQ ID NO: 5036309 - DNA, 13 bp, Homo sapiens
ttacaaactgaag

SEQ ID NO: 5036310 - DNA, 14 bp, Homo sapiens
ttacacgcttttgt

SEQ ID NO: 5036311 - DNA, 12 bp, Homo sapiens
ttacagtgttta

SEQ ID NO: 5036312 - DNA, 22 bp, Homo sapiens
ttacatatttgcatatgtatga

SEQ ID NO: 5036313 - DNA, 12 bp, Homo sapiens
ttacatgaagct

SEQ ID NO: 5036314 - DNA, 19 bp, Homo sapiens
ttacatttacaaactgaag

SEQ ID NO: 5036315 - DNA, 24 bp, Homo sapiens
ttaccagtggcgttgttgcatgtt

SEQ ID NO: 5036316 - DNA, 17 bp, Homo sapiens
ttacccaagtcttctcc

SEQ ID NO: 5036317 - DNA, 13 bp, Homo sapiens
ttacgtttgtcct

SEQ ID NO: 5036318 - DNA, 22 bp, Homo sapiens
ttacttgtaaatataaagacgt

SEQ ID NO: 5036319 - DNA, 23 bp, Homo sapiens
ttacttgtaaatataaagacgtt

SEQ ID NO: 5036320 - DNA, 22 bp, Homo sapiens
ttagaaccagccgtattttaca

SEQ ID NO: 5036321 - DNA, 15 bp, Homo sapiens
ttagaattatttaaa

SEQ ID NO: 5036322 - DNA, 16 bp, Homo sapiens
ttagaattatttaaac

SEQ ID NO: 5036323 - DNA, 16 bp, Homo sapiens
ttagatagccctgtcc

SEQ ID NO: 5036324 - DNA, 22 bp, Homo sapiens
ttagcattgtagtgctttgaga

SEQ ID NO: 5036325 - DNA, 22 bp, Homo sapiens
ttagctaataaaaagcttttgt

SEQ ID NO: 5036326 - DNA, 13 bp, Homo sapiens
ttagctcaatgag

SEQ ID NO: 5036327 - DNA, 17 bp, Homo sapiens
ttagcttgcaccttgtc

SEQ ID NO: 5036328 - DNA, 17 bp, Homo sapiens
ttaggcatgtcccaccc

SEQ ID NO: 5036329 - DNA, 19 bp, Homo sapiens
ttaggcatgtcccacccac

SEQ ID NO: 5036330 - DNA, 14 bp, Homo sapiens
ttaggtagaaaaac

SEQ ID NO: 5036331 - DNA, 15 bp, Homo sapiens
ttaggtagaaaaaca

SEQ ID NO: 5036332 - DNA, 23 bp, Homo sapiens
ttagtattgttgtccttttcata

SEQ ID NO: 5036333 - DNA, 19 bp, Homo sapiens
ttagtcatgtttatctgct

SEQ ID NO: 5036334 - DNA, 17 bp, Homo sapiens
ttataaatcgcttttga

SEQ ID NO: 5036335 - DNA, 17 bp, Homo sapiens
ttatacgaaataattgt

SEQ ID NO: 5036336 - DNA, 14 bp, Homo sapiens
ttataggtgagaaa

SEQ ID NO: 5036337 - DNA, 18 bp, Homo sapiens
ttataggtgagaaaaaaa

SEQ ID NO: 5036338 - DNA, 15 bp, Homo sapiens
ttatatataaatata

SEQ ID NO: 5036339 - DNA, 21 bp, Homo sapiens
ttatatatggggatggtagtt

SEQ ID NO: 5036340 - DNA, 15 bp, Homo sapiens
ttatattttgcagtt

SEQ ID NO: 5036341 - DNA, 23 bp, Homo sapiens
ttatcacctagctgaatgttttt

SEQ ID NO: 5036342 - DNA, 12 bp, Homo sapiens
ttatctctgtgt

SEQ ID NO: 5036343 - DNA, 14 bp, Homo sapiens
ttatgaacagctgt

SEQ ID NO: 5036344 - DNA, 15 bp, Homo sapiens
ttatgaacagctgtg

SEQ ID NO: 5036345 - DNA, 16 bp, Homo sapiens
ttatgtaataatgtga

SEQ ID NO: 5036346 - DNA, 13 bp, Homo sapiens
ttatgtaatttca

SEQ ID NO: 5036347 - DNA, 14 bp, Homo sapiens
ttatgtattgtgca

SEQ ID NO: 5036348 - DNA, 14 bp, Homo sapiens
ttatgtgatcaatt

SEQ ID NO: 5036349 - DNA, 13 bp, Homo sapiens
ttatgttatatat

SEQ ID NO: 5036350 - DNA, 15 bp, Homo sapiens
ttatgttatatataa

SEQ ID NO: 5036351 - DNA, 12 bp, Homo sapiens
ttattaaagaaa

SEQ ID NO: 5036352 - DNA, 14 bp, Homo sapiens
ttattaaagaaaaa

SEQ ID NO: 5036353 - DNA, 21 bp, Homo sapiens
ttattaaagaaaaaaatgtat

SEQ ID NO: 5036354 - DNA, 19 bp, Homo sapiens
ttattacccaagtcttctc

SEQ ID NO: 5036355 - DNA, 20 bp, Homo sapiens
ttattacttgtaaatataaa

SEQ ID NO: 5036356 - DNA, 21 bp, Homo sapiens
ttattagaatcaaacattttg

SEQ ID NO: 5036357 - DNA, 18 bp, Homo sapiens
ttattcaatttatttgaa

SEQ ID NO: 5036358 - DNA, 21 bp, Homo sapiens
ttattcaatttatttgaatga

SEQ ID NO: 5036359 - DNA, 13 bp, Homo sapiens
ttattcccttcct

SEQ ID NO: 5036360 - DNA, 18 bp, Homo sapiens
ttattcccttcctgccag

SEQ ID NO: 5036361 - DNA, 17 bp, Homo sapiens
ttatttataatcacttt

SEQ ID NO: 5036362 - DNA, 13 bp, Homo sapiens
ttatttatgtatt

SEQ ID NO: 5036363 - DNA, 14 bp, Homo sapiens
ttatttatgtattg

SEQ ID NO: 5036364 - DNA, 21 bp, Homo sapiens
ttatttatgtattgtgcaatg

SEQ ID NO: 5036365 - DNA, 17 bp, Homo sapiens
ttcaacccacagctact

SEQ ID NO: 5036366 - DNA, 16 bp, Homo sapiens
tttcccttcagtaccc

SEQ ID NO: 5036367 - DNA, 19 bp, Homo sapiens
tttcccttcagtaccctct

SEQ ID NO: 5036368 - DNA, 21 bp, Homo sapiens
tttcctagcacacacttttgg

SEQ ID NO: 5036369 - DNA, 16 bp, Homo sapiens
tttcctggacactcag

SEQ ID NO: 5036370 - DNA, 20 bp, Homo sapiens
tttcctggacactcagacct

SEQ ID NO: 5036371 - DNA, 13 bp, Homo sapiens
tttcgataaacaa

SEQ ID NO: 5036372 - DNA, 16 bp, Homo sapiens
tttctaaaggagttta

SEQ ID NO: 5036373 - DNA, 21 bp, Homo sapiens
tttctaaaggagtttatgttc

SEQ ID NO: 5036374 - DNA, 20 bp, Homo sapiens
tttctagcccgaatacaaac

SEQ ID NO: 5036375 - DNA, 23 bp, Homo sapiens
tttctatgggtgttatcacctag

SEQ ID NO: 5036376 - DNA, 11 bp, Homo sapiens
tttctccagct

SEQ ID NO: 5036377 - DNA, 14 bp, Homo sapiens
tttctgaaacacac

SEQ ID NO: 5036378 - DNA, 19 bp, Homo sapiens
tttctgggatgtcacagtc

SEQ ID NO: 5036379 - DNA, 13 bp, Homo sapiens
tttcttgtctata

SEQ ID NO: 5036380 - DNA, 20 bp, Homo sapiens
tttcttgtctataaagcatt

SEQ ID NO: 5036381 - DNA, 19 bp, Homo sapiens
tttctttcctgtaaagaaa

SEQ ID NO: 5036382 - DNA, 20 bp, Homo sapiens
tttctttgcaccaaagacat

SEQ ID NO: 5036383 - DNA, 14 bp, Homo sapiens
tttgaaaagttgga

SEQ ID NO: 5036384 - DNA, 17 bp, Homo sapiens
tttgaaagtctgtcctt

SEQ ID NO: 5036385 - DNA, 17 bp, Homo sapiens
tttgaagggcaagaaat

SEQ ID NO: 5036386 - DNA, 22 bp, Homo sapiens
tttgaatgatttttctttacaa

SEQ ID NO: 5036387 - DNA, 17 bp, Homo sapiens
tttgacaaagtgcctca

SEQ ID NO: 5036388 - DNA, 13 bp, Homo sapiens
tttgagtgacagc

SEQ ID NO: 5036389 - DNA, 22 bp, Homo sapiens
tttgagtgacagctttctggga

SEQ ID NO: 5036390 - DNA, 20 bp, Homo sapiens
tttgataatcaactgggctg

SEQ ID NO: 5036391 - DNA, 15 bp, Homo sapiens
tttgcaccaaagaca

SEQ ID NO: 5036392 - DNA, 21 bp, Homo sapiens
tttgcatttgtttatgtaatt

SEQ ID NO: 5036393 - DNA, 23 bp, Homo sapiens
tttgcatttgtttatgtaatttc

SEQ ID NO: 5036394 - DNA, 18 bp, Homo sapiens
tttgctttaatataaatg

SEQ ID NO: 5036395 - DNA, 13 bp, Homo sapiens
tttggccccactt

SEQ ID NO: 5036396 - DNA, 16 bp, Homo sapiens
tttggccccactttga

SEQ ID NO: 5036397 - DNA, 16 bp, Homo sapiens
tttggctagtccttgt

SEQ ID NO: 5036398 - DNA, 14 bp, Homo sapiens
tttggtaaaaatgc

SEQ ID NO: 5036399 - DNA, 17 bp, Homo sapiens
tttggtccgtcataacc

SEQ ID NO: 5036400 - DNA, 19 bp, Homo sapiens
tttggtgagagtcaaagct

SEQ ID NO: 5036401 - DNA, 16 bp, Homo sapiens
tttggtgtttgtctgt

SEQ ID NO: 5036402 - DNA, 19 bp, Homo sapiens
tttggttaagtctgtttta

SEQ ID NO: 5036403 - DNA, 22 bp, Homo sapiens
tttggttaagtctgttttatga

SEQ ID NO: 5036404 - DNA, 18 bp, Homo sapiens
tttgtagtgaaataatag

SEQ ID NO: 5036405 - DNA, 22 bp, Homo sapiens
tttgtcctttttcactttgaaa

SEQ ID NO: 5036406 - DNA, 21 bp, Homo sapiens
tttgtcgggcaccagccagcg

SEQ ID NO: 5036407 - DNA, 16 bp, Homo sapiens
tttgtgagcaggctgt

SEQ ID NO: 5036408 - DNA, 18 bp, Homo sapiens
tttgtgatggagtgctgt

SEQ ID NO: 5036409 - DNA, 13 bp, Homo sapiens
tttgtgtgtctta

SEQ ID NO: 5036410 - DNA, 14 bp, Homo sapiens
tttgtgttcttctt

SEQ ID NO: 5036411 - DNA, 15 bp, Homo sapiens
tttgttagcaaagat

SEQ ID NO: 5036412 - DNA, 18 bp, Homo sapiens
tttgttatataatttaga

SEQ ID NO: 5036413 - DNA, 15 bp, Homo sapiens
tttgttgacattctg

SEQ ID NO: 5036414 - DNA, 16 bp, Homo sapiens
tttgttgacattctga

SEQ ID NO: 5036415 - DNA, 19 bp, Homo sapiens
tttgttgacattctgaatg

SEQ ID NO: 5036416 - DNA, 18 bp, Homo sapiens
tttgttttacaatgtcat

SEQ ID NO: 5036417 - DNA, 15 bp, Homo sapiens
tttgttttgtgtctc

SEQ ID NO: 5036418 - DNA, 16 bp, Homo sapiens
tttgtttttaaactgt

SEQ ID NO: 5036419 - DNA, 21 bp, Homo sapiens
tttgtttttaaactgtacagt

SEQ ID NO: 5036420 - DNA, 23 bp, Homo sapiens
tttgtttttaaactgtacagtgt

SEQ ID NO: 5036421 - DNA, 20 bp, Homo sapiens
ttttaaactgtacagtgtct

SEQ ID NO: 5036422 - DNA, 16 bp, Homo sapiens
ttttaaataaaagcac

SEQ ID NO: 5036423 - DNA, 21 bp, Homo sapiens
ttttaaataaaagcacaagta

SEQ ID NO: 5036424 - DNA, 21 bp, Homo sapiens
ttttaataaactactctttga

SEQ ID NO: 5036425 - DNA, 12 bp, Homo sapiens
ttttacatttca

SEQ ID NO: 5036426 - DNA, 17 bp, Homo sapiens
ttttaccaaagcatcaa

SEQ ID NO: 5036427 - DNA, 18 bp, Homo sapiens
ttttaccaccgtctgtct

SEQ ID NO: 5036428 - DNA, 15 bp, Homo sapiens
ttttaggtagaaaaa

SEQ ID NO: 5036429 - DNA, 21 bp, Homo sapiens
ttttatgacttcattaataat

SEQ ID NO: 5036430 - DNA, 23 bp, Homo sapiens
ttttattagtattgttgtccttt

SEQ ID NO: 5036431 - DNA, 16 bp, Homo sapiens
ttttcaatagccacta

SEQ ID NO: 5036432 - DNA, 16 bp, Homo sapiens
ttttcataggtctgaa

SEQ ID NO: 5036433 - DNA, 14 bp, Homo sapiens
ttttcatcttcagt

SEQ ID NO: 5036434 - DNA, 21 bp, Homo sapiens
ttttcatcttcagttgtctct

SEQ ID NO: 5036435 - DNA, 22 bp, Homo sapiens
ttttccctctttggctcccctg

SEQ ID NO: 5036436 - DNA, 11 bp, Homo sapiens
ttttcctatat

SEQ ID NO: 5036437 - DNA, 21 bp, Homo sapiens
ttttctcttagaacattgtat

SEQ ID NO: 5036438 - DNA, 12 bp, Homo sapiens
ttttctgaaaca

SEQ ID NO: 5036439 - DNA, 15 bp, Homo sapiens
ttttctgaaacacac

SEQ ID NO: 5036440 - DNA, 12 bp, Homo sapiens
ttttctgttata

SEQ ID NO: 5036441 - DNA, 13 bp, Homo sapiens
ttttcttaaagtg

SEQ ID NO: 5036442 - DNA, 20 bp, Homo sapiens
ttttcttgtctataaagcat

SEQ ID NO: 5036443 - DNA, 18 bp, Homo sapiens
ttttctttaaagaagttg

SEQ ID NO: 5036444 - DNA, 16 bp, Homo sapiens
ttttgaaatttactgt

SEQ ID NO: 5036445 - DNA, 16 bp, Homo sapiens
ttttgacaaagtgcct

SEQ ID NO: 5036446 - DNA, 15 bp, Homo sapiens
ttttgacttaatgtg

SEQ ID NO: 5036447 - DNA, 19 bp, Homo sapiens
ttttggatgattaaaaaat

SEQ ID NO: 5036448 - DNA, 15 bp, Homo sapiens
ttttggttgctttaa

SEQ ID NO: 5036449 - DNA, 16 bp, Homo sapiens
ttttggttgctttaat

SEQ ID NO: 5036450 - DNA, 13 bp, Homo sapiens
ttttgttgacatt

SEQ ID NO: 5036451 - DNA, 21 bp, Homo sapiens
tttttaaactgtacagtgtct

SEQ ID NO: 5036452 - DNA, 16 bp, Homo sapiens
tttttaaataaaagca

SEQ ID NO: 5036453 - DNA, 17 bp, Homo sapiens
tttttaaataaaagcac

SEQ ID NO: 5036454 - DNA, 13 bp, Homo sapiens
tttttacagctgt

SEQ ID NO: 5036455 - DNA, 15 bp, Homo sapiens
tttttatattaatgt

SEQ ID NO: 5036456 - DNA, 20 bp, Homo sapiens
tttttcatcttcagttgtct

SEQ ID NO: 5036457 - DNA, 23 bp, Homo sapiens
tttttcatcttcagttgtctctg

SEQ ID NO: 5036458 - DNA, 13 bp, Homo sapiens
ttttttcatcttc

SEQ ID NO: 5036459 - DNA, 14 bp, Homo sapiens
ttttttttgtttgt

SEQ ID NO: 5036460 - DNA, 16 bp, Homo sapiens
tgatactaataaacta

SEQ ID NO: 5036461 - DNA, 21 bp, Homo sapiens
tgatacttcgacactgttctt

SEQ ID NO: 5036462 - DNA, 22 bp, Homo sapiens
tgataggaagaggggaagcaga

SEQ ID NO: 5036463 - DNA, 18 bp, Homo sapiens
tgatccgtccgaggctgc

SEQ ID NO: 5036464 - DNA, 20 bp, Homo sapiens
tgatgaaaactaaggatttt

SEQ ID NO: 5036465 - DNA, 14 bp, Homo sapiens
tgatgaagaggagt

SEQ ID NO: 5036466 - DNA, 16 bp, Homo sapiens
tgatgatgatgatgaa

SEQ ID NO: 5036467 - DNA, 21 bp, Homo sapiens
tgatgcctgtgaactgaactc

SEQ ID NO: 5036468 - DNA, 22 bp, Homo sapiens
tgatggagccccaccttgtctg

SEQ ID NO: 5036469 - DNA, 18 bp, Homo sapiens
tgattcaaattgctgctt

SEQ ID NO: 5036470 - DNA, 22 bp, Homo sapiens
tgattggacaggcatgggtgca

SEQ ID NO: 5036471 - DNA, 15 bp, Homo sapiens
tgatttaaacacaca

SEQ ID NO: 5036472 - DNA, 16 bp, Homo sapiens
tgatttaaacacacag

SEQ ID NO: 5036473 - DNA, 17 bp, Homo sapiens
tgcaaataacaaatgcc

SEQ ID NO: 5036474 - DNA, 21 bp, Homo sapiens
tgcaacctccaccttctgggt

SEQ ID NO: 5036475 - DNA, 19 bp, Homo sapiens
tgcaacgggattgaagggt

SEQ ID NO: 5036476 - DNA, 19 bp, Homo sapiens
tgcaagcaggactttgagg

SEQ ID NO: 5036477 - DNA, 15 bp, Homo sapiens
tgcaatgaagtctct

SEQ ID NO: 5036478 - DNA, 18 bp, Homo sapiens
tgcaatgaagtctctgaa

SEQ ID NO: 5036479 - DNA, 14 bp, Homo sapiens
tgcaattcccctct

SEQ ID NO: 5036480 - DNA, 13 bp, Homo sapiens
tgcacacaggaca

SEQ ID NO: 5036481 - DNA, 22 bp, Homo sapiens
tgcacagcacaaattagttata

SEQ ID NO: 5036482 - DNA, 20 bp, Homo sapiens
tgcacaggcacacagggccc

SEQ ID NO: 5036483 - DNA, 14 bp, Homo sapiens
tgcaccaaagacat

SEQ ID NO: 5036484 - DNA, 16 bp, Homo sapiens
tgcacccacctgtttt

SEQ ID NO: 5036485 - DNA, 18 bp, Homo sapiens
tgcagacctcatgcccag

SEQ ID NO: 5036486 - DNA, 14 bp, Homo sapiens
tgcagaggcctggg

SEQ ID NO: 5036487 - DNA, 17 bp, Homo sapiens
tgcagaggcctggggga

SEQ ID NO: 5036488 - DNA, 11 bp, Homo sapiens
tgcagccagct

SEQ ID NO: 5036489 - DNA, 15 bp, Homo sapiens
tgcaggaggtggaga

SEQ ID NO: 5036490 - DNA, 14 bp, Homo sapiens
tgcagtcccaagcg

SEQ ID NO: 5036491 - DNA, 19 bp, Homo sapiens
tgcagtttgagacaggaga

SEQ ID NO: 5036492 - DNA, 20 bp, Homo sapiens
tgcataggtgatctcattta

SEQ ID NO: 5036493 - DNA, 15 bp, Homo sapiens
tgcatatgtatgact

SEQ ID NO: 5036494 - DNA, 22 bp, Homo sapiens
tgcatgtgtgcgtgtctccatg

SEQ ID NO: 5036495 - DNA, 16 bp, Homo sapiens
tgcatgtttgaaatga

SEQ ID NO: 5036496 - DNA, 18 bp, Homo sapiens
tgccaaattaaaaaagat

SEQ ID NO: 5036497 - DNA, 15 bp, Homo sapiens
tgccaagttgtttga

SEQ ID NO: 5036498 - DNA, 20 bp, Homo sapiens
tgccaagttgtttgagaaat

SEQ ID NO: 5036499 - DNA, 23 bp, Homo sapiens
tgccactgccccccgaggctgct

SEQ ID NO: 5036500 - DNA, 19 bp, Homo sapiens
tgccagcccctgccattgt

SEQ ID NO: 5036501 - DNA, 15 bp, Homo sapiens
tgccaggagcacggc

SEQ ID NO: 5036502 - DNA, 21 bp, Homo sapiens
tgccagtattttaaaatagcg

SEQ ID NO: 5036503 - DNA, 16 bp, Homo sapiens
tgccatattaaatttt

SEQ ID NO: 5036504 - DNA, 16 bp, Homo sapiens
tgccatccattctgga

SEQ ID NO: 5036505 - DNA, 14 bp, Homo sapiens
tgcccagctctctg

SEQ ID NO: 5036506 - DNA, 21 bp, Homo sapiens
tgcccagctctctgacgcttg

SEQ ID NO: 5036507 - DNA, 22 bp, Homo sapiens
tgccccacatgtggccatggcc

SEQ ID NO: 5036508 - DNA, 16 bp, Homo sapiens
tgccccactctgcctg

SEQ ID NO: 5036509 - DNA, 19 bp, Homo sapiens
tgccccactctgcctgcct

SEQ ID NO: 5036510 - DNA, 12 bp, Homo sapiens
tgccccagccag

SEQ ID NO: 5036511 - DNA, 13 bp, Homo sapiens
tgccccagccaga

SEQ ID NO: 5036512 - DNA, 15 bp, Homo sapiens
tgcccgctcagccca

SEQ ID NO: 5036513 - DNA, 15 bp, Homo sapiens
tgcccgtgcccgcag

SEQ ID NO: 5036514 - DNA, 23 bp, Homo sapiens
tgccctcatggcccctctgacct

SEQ ID NO: 5036515 - DNA, 22 bp, Homo sapiens
tgccctggcagggtcatcctgt

SEQ ID NO: 5036516 - DNA, 20 bp, Homo sapiens
tgccgagacagaccctctgc

SEQ ID NO: 5036517 - DNA, 12 bp, Homo sapiens
tgccgcaccagc

SEQ ID NO: 5036518 - DNA, 17 bp, Homo sapiens
tgccgccagctgccgca

SEQ ID NO: 5036519 - DNA, 20 bp, Homo sapiens
tgccgccagctgccgcacca

SEQ ID NO: 5036520 - DNA, 23 bp, Homo sapiens
tgccgccagctgccgcaccagcc

SEQ ID NO: 5036521 - DNA, 19 bp, Homo sapiens
tgcctaaggctgaacttgt

SEQ ID NO: 5036522 - DNA, 12 bp, Homo sapiens
tgcctcttccag

SEQ ID NO: 5036523 - DNA, 16 bp, Homo sapiens
tgcctcttccagtgaa

SEQ ID NO: 5036524 - DNA, 13 bp, Homo sapiens
tgcctgccctggt

SEQ ID NO: 5036525 - DNA, 18 bp, Homo sapiens
tgcctgctcccatcctgt

SEQ ID NO: 5036526 - DNA, 23 bp, Homo sapiens
tgcctggcaggctgtctggccag

SEQ ID NO: 5036527 - DNA, 15 bp, Homo sapiens
tgcctggtacagtat

SEQ ID NO: 5036528 - DNA, 19 bp, Homo sapiens
tgcctgtgatttcctaatt

SEQ ID NO: 5036529 - DNA, 14 bp, Homo sapiens
tgcgcctgtgacca

SEQ ID NO: 5036530 - DNA, 18 bp, Homo sapiens
tgcgcctgtgatgctggg

SEQ ID NO: 5036531 - DNA, 12 bp, Homo sapiens
tgcggctgtgtg

SEQ ID NO: 5036532 - DNA, 14 bp, Homo sapiens
tgcggctgtgtgtg

SEQ ID NO: 5036533 - DNA, 20 bp, Homo sapiens
tgcgtgttcagcagaacctg

SEQ ID NO: 5036534 - DNA, 24 bp, Homo sapiens
tgctaaataaacatgtgccctcag

SEQ ID NO: 5036535 - DNA, 20 bp, Homo sapiens
tgctacagatgatagaggat

SEQ ID NO: 5036536 - DNA, 11 bp, Homo sapiens
aaaaaaggaag

SEQ ID NO: 5036537 - DNA, 19 bp, Homo sapiens
aaacttattggaatgttga

SEQ ID NO: 5036538 - DNA, 19 bp, Homo sapiens
aaatgtaattatgttctaa

SEQ ID NO: 5036539 - DNA, 17 bp, Homo sapiens
aacaaaaatcaaacttt

SEQ ID NO: 5036540 - DNA, 13 bp, Homo sapiens
aacagatttcaaa

SEQ ID NO: 5036541 - DNA, 15 bp, Homo sapiens
aagaaaggagataca

SEQ ID NO: 5036542 - DNA, 13 bp, Homo sapiens
aagcaaacttaca

SEQ ID NO: 5036543 - DNA, 21 bp, Homo sapiens
aagttgattaagaaaggaagt

SEQ ID NO: 5036544 - DNA, 14 bp, Homo sapiens
aataaaaacaaagt

SEQ ID NO: 5036545 - DNA, 18 bp, Homo sapiens
aatacgttaggaggacaa

SEQ ID NO: 5036546 - DNA, 21 bp, Homo sapiens
aatacgttaggaggacaaaag

SEQ ID NO: 5036547 - DNA, 11 bp, Homo sapiens
acaaaaggaat

SEQ ID NO: 5036548 - DNA, 18 bp, Homo sapiens
acagtggctcacacctgt

SEQ ID NO: 5036549 - DNA, 23 bp, Homo sapiens
acatctggaaagttttctccact

SEQ ID NO: 5036550 - DNA, 20 bp, Homo sapiens
accagcctggtcaacatagt

SEQ ID NO: 5036551 - DNA, 21 bp, Homo sapiens
accattatggataaagatgag

SEQ ID NO: 5036552 - DNA, 18 bp, Homo sapiens
acccatcagttccagcct

SEQ ID NO: 5036553 - DNA, 21 bp, Homo sapiens
actccagccagggcaagagag

SEQ ID NO: 5036554 - DNA, 14 bp, Homo sapiens
actctgcaagaaga

SEQ ID NO: 5036555 - DNA, 15 bp, Homo sapiens
actctgcaagaagaa

SEQ ID NO: 5036556 - DNA, 16 bp, Homo sapiens
agaaagatttgatgta

SEQ ID NO: 5036557 - DNA, 22 bp, Homo sapiens
agaaggagtagctgccctttct

SEQ ID NO: 5036558 - DNA, 17 bp, Homo sapiens
agaatgactgacaaaga

SEQ ID NO: 5036559 - DNA, 22 bp, Homo sapiens
agacactgtctctaccaaaaaa

SEQ ID NO: 5036560 - DNA, 18 bp, Homo sapiens
agaccctgtctcaataaa

SEQ ID NO: 5036561 - DNA, 20 bp, Homo sapiens
agagatctctgtagaaggag

SEQ ID NO: 5036562 - DNA, 15 bp, Homo sapiens
agagtgcactactgt

SEQ ID NO: 5036563 - DNA, 22 bp, Homo sapiens
agatgatgctttgagaacatac

SEQ ID NO: 5036564 - DNA, 13 bp, Homo sapiens
agatttgatgtat

SEQ ID NO: 5036565 - DNA, 12 bp, Homo sapiens
agccagggcaag

SEQ ID NO: 5036566 - DNA, 16 bp, Homo sapiens
agctgccctttctcag

SEQ ID NO: 5036567 - DNA, 20 bp, Homo sapiens
aggagaggcaaagaaaggag

SEQ ID NO: 5036568 - DNA, 17 bp, Homo sapiens
aggaggacaaaaggaat

SEQ ID NO: 5036569 - DNA, 21 bp, Homo sapiens
aggaggtcaagatcagcctgg

SEQ ID NO: 5036570 - DNA, 16 bp, Homo sapiens
aggatgggaacaagga

SEQ ID NO: 5036571 - DNA, 15 bp, Homo sapiens
aggctacagaactaa

SEQ ID NO: 5036572 - DNA, 22 bp, Homo sapiens
aggctgttctttaaatgtctga

SEQ ID NO: 5036573 - DNA, 16 bp, Homo sapiens
agggacacatatcaaa

SEQ ID NO: 5036574 - DNA, 19 bp, Homo sapiens
agttccagccttctctcaa

SEQ ID NO: 5036575 - DNA, 17 bp, Homo sapiens
ataaagcttaggtcaaa

SEQ ID NO: 5036576 - DNA, 15 bp, Homo sapiens
ataaataaataaata

SEQ ID NO: 5036577 - DNA, 17 bp, Homo sapiens
atcagttccagccttct

SEQ ID NO: 5036578 - DNA, 17 bp, Homo sapiens
atggaacagatttcaaa

SEQ ID NO: 5036579 - DNA, 16 bp, Homo sapiens
atgtctagagaacact

SEQ ID NO: 5036580 - DNA, 16 bp, Homo sapiens
atgttccttttaaaga

SEQ ID NO: 5036581 - DNA, 22 bp, Homo sapiens
atgttttagggacccccaacct

SEQ ID NO: 5036582 - DNA, 14 bp, Homo sapiens
attaagaaaggaag

SEQ ID NO: 5036583 - DNA, 15 bp, Homo sapiens
attaagaaaggaagt

SEQ ID NO: 5036584 - DNA, 19 bp, Homo sapiens
caacatagtgagacactgt

SEQ ID NO: 5036585 - DNA, 20 bp, Homo sapiens
caagagagcgagaccctgtc

SEQ ID NO: 5036586 - DNA, 23 bp, Homo sapiens
caagagagcgagaccctgtctca

SEQ ID NO: 5036587 - DNA, 17 bp, Homo sapiens
caaggaaggaaagatgt

SEQ ID NO: 5036588 - DNA, 16 bp, Homo sapiens
caaggagaggcaaaga

SEQ ID NO: 5036589 - DNA, 20 bp, Homo sapiens
cacagtggctcacacctgta

SEQ ID NO: 5036590 - DNA, 16 bp, Homo sapiens
cacatcaggaaagaga

SEQ ID NO: 5036591 - DNA, 15 bp, Homo sapiens
cactctgcaagaaga

SEQ ID NO: 5036592 - DNA, 19 bp, Homo sapiens
cactgtctctaccaaaaaa

SEQ ID NO: 5036593 - DNA, 19 bp, Homo sapiens
cacttgagctcaggaggtc

SEQ ID NO: 5036594 - DNA, 17 bp, Homo sapiens
cagaaaacctaagcaaa

SEQ ID NO: 5036595 - DNA, 18 bp, Homo sapiens
cagaatgactgacaaaga

SEQ ID NO: 5036596 - DNA, 15 bp, Homo sapiens
cagccttctctcaag

SEQ ID NO: 5036597 - DNA, 18 bp, Homo sapiens
cagtggctcacacctgta

SEQ ID NO: 5036598 - DNA, 23 bp, Homo sapiens
cagttccagccttctctcaagga

SEQ ID NO: 5036599 - DNA, 14 bp, Homo sapiens
catagtgagacact

SEQ ID NO: 5036600 - DNA, 15 bp, Homo sapiens
catcaggaaagagag

SEQ ID NO: 5036601 - DNA, 16 bp, Homo sapiens
catcaggaaagagagc

SEQ ID NO: 5036602 - DNA, 15 bp, Homo sapiens
catcagttccagcct

SEQ ID NO: 5036603 - DNA, 16 bp, Homo sapiens
ccaagagtgcactact

SEQ ID NO: 5036604 - DNA, 14 bp, Homo sapiens
ccagcctggtcaac

SEQ ID NO: 5036605 - DNA, 14 bp, Homo sapiens
ccagggcaagagag

SEQ ID NO: 5036606 - DNA, 20 bp, Homo sapiens
cccagctttgaggaaaatgg

SEQ ID NO: 5036607 - DNA, 17 bp, Homo sapiens
cctataatcccagcatt

SEQ ID NO: 5036608 - DNA, 17 bp, Homo sapiens
cgatatcttcagaaaac

SEQ ID NO: 5036609 - DNA, 21 bp, Homo sapiens
cgttaggaggacaaaaggaat

SEQ ID NO: 5036610 - DNA, 16 bp, Homo sapiens
ctctaccaaaaaaagg

SEQ ID NO: 5036611 - DNA, 19 bp, Homo sapiens
ctctaccaaaaaaaggaag

SEQ ID NO: 5036612 - DNA, 13 bp, Homo sapiens
ctcttcacctgac

SEQ ID NO: 5036613 - DNA, 20 bp, Homo sapiens
ctgcccactctgcaagaaga

SEQ ID NO: 5036614 - DNA, 21 bp, Homo sapiens
ctgcccactctgcaagaagaa

SEQ ID NO: 5036615 - DNA, 12 bp, Homo sapiens
ctgctgaaactg

SEQ ID NO: 5036616 - DNA, 18 bp, Homo sapiens
ctgctgaaactgcccact

SEQ ID NO: 5036617 - DNA, 22 bp, Homo sapiens
ctgttctttaaatgtctgaaat

SEQ ID NO: 5036618 - DNA, 15 bp, Homo sapiens
cttacaggtcctgct

SEQ ID NO: 5036619 - DNA, 22 bp, Homo sapiens
gaaatacgttaggaggacaaaa

SEQ ID NO: 5036620 - DNA, 14 bp, Homo sapiens
gacaaaaggaatgt

SEQ ID NO: 5036621 - DNA, 15 bp, Homo sapiens
gaccctgcccccact

SEQ ID NO: 5036622 - DNA, 15 bp, Homo sapiens
gagagcgagaccctg

SEQ ID NO: 5036623 - DNA, 17 bp, Homo sapiens
gataaagcttaggtcaa

SEQ ID NO: 5036624 - DNA, 15 bp, Homo sapiens
gatgagaacaagcta

SEQ ID NO: 5036625 - DNA, 17 bp, Homo sapiens
gatgggaacaaggaagg

SEQ ID NO: 5036626 - DNA, 18 bp, Homo sapiens
gcaaagaaaggagataca

SEQ ID NO: 5036627 - DNA, 20 bp, Homo sapiens
gcacagtggctcacacctgt

SEQ ID NO: 5036628 - DNA, 20 bp, Homo sapiens
gcactactgtactccagcca

SEQ ID NO: 5036629 - DNA, 19 bp, Homo sapiens
gcagatctacatgtctaga

SEQ ID NO: 5036630 - DNA, 20 bp, Homo sapiens
gccagggcaagagagcgaga

SEQ ID NO: 5036631 - DNA, 15 bp, Homo sapiens
ggaaagttttctcca

SEQ ID NO: 5036632 - DNA, 20 bp, Homo sapiens
ggaaagttttctccactgga

SEQ ID NO: 5036633 - DNA, 13 bp, Homo sapiens
ggaacaaggaagg

SEQ ID NO: 5036634 - DNA, 22 bp, Homo sapiens
ggagatacagtggagacatctg

SEQ ID NO: 5036635 - DNA, 16 bp, Homo sapiens
ggaggacaaaaggaat

SEQ ID NO: 5036636 - DNA, 15 bp, Homo sapiens
ggcaggaggatcact

SEQ ID NO: 5036637 - DNA, 11 bp, Homo sapiens
ggggctaaggc

SEQ ID NO: 5036638 - DNA, 12 bp, Homo sapiens
ggtcctggaaca

SEQ ID NO: 5036639 - DNA, 22 bp, Homo sapiens
ggtgtgttcaagaccagcctgg

SEQ ID NO: 5036640 - DNA, 15 bp, Homo sapiens
gtctagagaacactg

SEQ ID NO: 5036641 - DNA, 20 bp, Homo sapiens
gttaggaggacaaaaggaat

SEQ ID NO: 5036642 - DNA, 22 bp, Homo sapiens
gttcatagagttcccatgaact

SEQ ID NO: 5036643 - DNA, 18 bp, Homo sapiens
gttccagccttctctcaa

SEQ ID NO: 5036644 - DNA, 20 bp, Homo sapiens
taaagtcattattaggaagt

SEQ ID NO: 5036645 - DNA, 13 bp, Homo sapiens
taaataaaaacaa

SEQ ID NO: 5036646 - DNA, 20 bp, Homo sapiens
taattatgttctaagtgcct

SEQ ID NO: 5036647 - DNA, 14 bp, Homo sapiens
tacatatagcagct

SEQ ID NO: 5036648 - DNA, 16 bp, Homo sapiens
taccaaaaaaaggaag

SEQ ID NO: 5036649 - DNA, 22 bp, Homo sapiens
taccattatggataaagatgag

SEQ ID NO: 5036650 - DNA, 15 bp, Homo sapiens
tacctcttcacctga

SEQ ID NO: 5036651 - DNA, 21 bp, Homo sapiens
tactccagccagggcaagaga

SEQ ID NO: 5036652 - DNA, 18 bp, Homo sapiens
taggaggacaaaaggaat

SEQ ID NO: 5036653 - DNA, 19 bp, Homo sapiens
taggaggacaaaaggaatg

SEQ ID NO: 5036654 - DNA, 19 bp, Homo sapiens
taggatgggaacaaggaag

SEQ ID NO: 5036655 - DNA, 20 bp, Homo sapiens
taggatgggaacaaggaagg

SEQ ID NO: 5036656 - DNA, 19 bp, Homo sapiens
taggctgatgggcaaaaaa

SEQ ID NO: 5036657 - DNA, 20 bp, Homo sapiens
tatagtcccactacttgtgg

SEQ ID NO: 5036658 - DNA, 16 bp, Homo sapiens
tatggataaagatgag

SEQ ID NO: 5036659 - DNA, 17 bp, Homo sapiens
tatggataaagatgaga

SEQ ID NO: 5036660 - DNA, 18 bp, Homo sapiens
tcaaactttacagaaaga

SEQ ID NO: 5036661 - DNA, 17 bp, Homo sapiens
tcaaagttcatagagtt

SEQ ID NO: 5036662 - DNA, 18 bp, Homo sapiens
tcaagaccagcctggtca

SEQ ID NO: 5036663 - DNA, 16 bp, Homo sapiens
tcagcgttaatgtaaa

SEQ ID NO: 5036664 - DNA, 13 bp, Homo sapiens
tcaggaaagagag

SEQ ID NO: 5036665 - DNA, 18 bp, Homo sapiens
tcaggaaagagagcacca

SEQ ID NO: 5036666 - DNA, 22 bp, Homo sapiens
tcaggcaattcctacctcttca

SEQ ID NO: 5036667 - DNA, 13 bp, Homo sapiens
tccaagttcaaaa

SEQ ID NO: 5036668 - DNA, 18 bp, Homo sapiens
cattatggataaagatga

SEQ ID NO: 5036669 - DNA, 19 bp, Homo sapiens
ccagccagggcaagagagc

SEQ ID NO: 5036670 - DNA, 17 bp, Homo sapiens
ccatcagttccagcctt

SEQ ID NO: 5036671 - DNA, 19 bp, Homo sapiens
cctgctgaaactgcccact

SEQ ID NO: 5036672 - DNA, 12 bp, Homo sapiens
ccttctctcaag

SEQ ID NO: 5036673 - DNA, 19 bp, Homo sapiens
ctaaggcaggaggatcact

SEQ ID NO: 5036674 - DNA, 17 bp, Homo sapiens
ctaccaaaaaaaggaag

SEQ ID NO: 5036675 - DNA, 18 bp, Homo sapiens
ctaccaaaaaaaggaagg

SEQ ID NO: 5036676 - DNA, 21 bp, Homo sapiens
ctcaaggagaggcaaagaaag

SEQ ID NO: 5036677 - DNA, 18 bp, Homo sapiens
ctctaccaaaaaaaggaa

SEQ ID NO: 5036678 - DNA, 13 bp, Homo sapiens
ctctagaagctcc

SEQ ID NO: 5036679 - DNA, 22 bp, Homo sapiens
ctctgtagaaggagtagctgcc

SEQ ID NO: 5036680 - DNA, 20 bp, Homo sapiens
ctgaggcaggaggatcactt

SEQ ID NO: 5036681 - DNA, 18 bp, Homo sapiens
ctgatgggcaaaaaacca

SEQ ID NO: 5036682 - DNA, 22 bp, Homo sapiens
ctgcaagaagaaatcatgatat

SEQ ID NO: 5036683 - DNA, 15 bp, Homo sapiens
ctgcccactctgcaa

SEQ ID NO: 5036684 - DNA, 23 bp, Homo sapiens
ctggtgtgttcaagaccagcctg

SEQ ID NO: 5036685 - DNA, 23 bp, Homo sapiens
ctgtctctaccaaaaaaaggaag

SEQ ID NO: 5036686 - DNA, 20 bp, Homo sapiens
cttgcattttggaaggctga

SEQ ID NO: 5036687 - DNA, 21 bp, Homo sapiens
gaaactgcccactctgcaaga

SEQ ID NO: 5036688 - DNA, 19 bp, Homo sapiens
gaaatacgttaggaggaca

SEQ ID NO: 5036689 - DNA, 17 bp, Homo sapiens
gaacagatttcaaaaaa

SEQ ID NO: 5036690 - DNA, 12 bp, Homo sapiens
gacaaaaggaat

SEQ ID NO: 5036691 - DNA, 12 bp, Homo sapiens
gaccctgtctca

SEQ ID NO: 5036692 - DNA, 15 bp, Homo sapiens
gaggacaaaaggaat

SEQ ID NO: 5036693 - DNA, 20 bp, Homo sapiens
gataaggctgttctttaaat

SEQ ID NO: 5036694 - DNA, 14 bp, Homo sapiens
gatgagaacaagct

SEQ ID NO: 5036695 - DNA, 20 bp, Homo sapiens
gatgggaacaaggaaggaaa

SEQ ID NO: 5036696 - DNA, 15 bp, Homo sapiens
gattaagaaaggaag

SEQ ID NO: 5036697 - DNA, 16 bp, Homo sapiens
gattaagaaaggaagt

SEQ ID NO: 5036698 - DNA, 22 bp, Homo sapiens
gcaaacttacaggtcctgctga

SEQ ID NO: 5036699 - DNA, 16 bp, Homo sapiens
gcaaagaaaggagata

SEQ ID NO: 5036700 - DNA, 14 bp, Homo sapiens
gcagatcacttgag

SEQ ID NO: 5036701 - DNA, 18 bp, Homo sapiens
gcaggaggatcacttgag

SEQ ID NO: 5036702 - DNA, 19 bp, Homo sapiens
gcatggtggtgtgtgccta

SEQ ID NO: 5036703 - DNA, 18 bp, Homo sapiens
gccatccccgctcctggt

SEQ ID NO: 5036704 - DNA, 16 bp, Homo sapiens
gcgagaccctgtctca

SEQ ID NO: 5036705 - DNA, 20 bp, Homo sapiens
ggcacaacacatcaggaaag

SEQ ID NO: 5036706 - DNA, 14 bp, Homo sapiens
ggctacagtgagcc

SEQ ID NO: 5036707 - DNA, 16 bp, Homo sapiens
ggctgaggcaggagga

SEQ ID NO: 5036708 - DNA, 13 bp, Homo sapiens
ggtcaagatcagc

SEQ ID NO: 5036709 - DNA, 22 bp, Homo sapiens
ggtcctgctgaaactgcccact

SEQ ID NO: 5036710 - DNA, 20 bp, Homo sapiens
ggtgggcagatcacttgagc

SEQ ID NO: 5036711 - DNA, 23 bp, Homo sapiens
gtactccagccagggcaagagag

SEQ ID NO: 5036712 - DNA, 18 bp, Homo sapiens
gtgagacactgtctctac

SEQ ID NO: 5036713 - DNA, 11 bp, Homo sapiens
gtgtgttcaag

SEQ ID NO: 5036714 - DNA, 18 bp, Homo sapiens
gttgattaagaaaggaag

SEQ ID NO: 5036715 - DNA, 15 bp, Homo sapiens
taaaaattaaaacct

SEQ ID NO: 5036716 - DNA, 17 bp, Homo sapiens
taaataaaaacaaagtt

SEQ ID NO: 5036717 - DNA, 17 bp, Homo sapiens
tacatatagcagctctt

SEQ ID NO: 5036718 - DNA, 17 bp, Homo sapiens
taccaaaaaaaggaagg

SEQ ID NO: 5036719 - DNA, 20 bp, Homo sapiens
tacccatcagttccagcctt

SEQ ID NO: 5036720 - DNA, 14 bp, Homo sapiens
tagagcaaagccat

SEQ ID NO: 5036721 - DNA, 15 bp, Homo sapiens
tagcaaataagtcat

SEQ ID NO: 5036722 - DNA, 23 bp, Homo sapiens
taggatgggaacaaggaaggaaa

SEQ ID NO: 5036723 - DNA, 16 bp, Homo sapiens
tcaacatagtgagaca

SEQ ID NO: 5036724 - DNA, 13 bp, Homo sapiens
tcaaggagaggca

SEQ ID NO: 5036725 - DNA, 20 bp, Homo sapiens
tcaaggagaggcaaagaaag

SEQ ID NO: 5036726 - DNA, 18 bp, Homo sapiens
tcagttccagccttctct

SEQ ID NO: 5036727 - DNA, 19 bp, Homo sapiens
tctacataaaatacaaaaa

SEQ ID NO: 5036728 - DNA, 17 bp, Homo sapiens
tctaccaaaaaaaggaa

SEQ ID NO: 5036729 - DNA, 18 bp, Homo sapiens
tctaccaaaaaaaggaag

SEQ ID NO: 5036730 - DNA, 19 bp, Homo sapiens
tctaccaaaaaaaggaagg

SEQ ID NO: 5036731 - DNA, 20 bp, Homo sapiens
tctggaaagttttctccact

SEQ ID NO: 5036732 - DNA, 22 bp, Homo sapiens
tgaaactgcccactctgcaaga

SEQ ID NO: 5036733 - DNA, 16 bp, Homo sapiens
tgactgacaaagacat

SEQ ID NO: 5036734 - DNA, 15 bp, Homo sapiens
tgagacactgtctct

SEQ ID NO: 5036735 - DNA, 17 bp, Homo sapiens
tgagattttgcttgagc

SEQ ID NO: 5036736 - DNA, 21 bp, Homo sapiens
tgatgctttgagaacatactt

SEQ ID NO: 5036737 - DNA, 22 bp, Homo sapiens
tgatggagtttctctagaagct

SEQ ID NO: 5036738 - DNA, 16 bp, Homo sapiens
tgatgtatgtaataca

SEQ ID NO: 5036739 - DNA, 16 bp, Homo sapiens
tggaaggctgaggcag

SEQ ID NO: 5036740 - DNA, 18 bp, Homo sapiens
tgggaacaaggaaggaaa

SEQ ID NO: 5036741 - DNA, 16 bp, Homo sapiens
tgggcagatcacttga

SEQ ID NO: 5036742 - DNA, 21 bp, Homo sapiens
tgtaactgtcttctagcagtg

SEQ ID NO: 5036743 - DNA, 22 bp, Homo sapiens
tgtctagagaacactgtgctct

SEQ ID NO: 5036744 - DNA, 21 bp, Homo sapiens
tgtttttatatttctgttaaa

SEQ ID NO: 5036745 - DNA, 22 bp, Homo sapiens
ttacgcctataatcccagcatt

SEQ ID NO: 5036746 - DNA, 20 bp, Homo sapiens
ttatgttccttttaaagaaa

SEQ ID NO: 5036747 - DNA, 16 bp, Homo sapiens
ttatgttctaagtgcc

SEQ ID NO: 5036748 - DNA, 13 bp, Homo sapiens
ttcagaaaaccta

SEQ ID NO: 5036749 - DNA, 17 bp, Homo sapiens
ttctagcagtgagccaa

SEQ ID NO: 5036750 - DNA, 17 bp, Homo sapiens
aaaaaccaatttaccca

SEQ ID NO: 5036751 - DNA, 18 bp, Homo sapiens
aaaacctaagcaaactta

SEQ ID NO: 5036752 - DNA, 18 bp, Homo sapiens
aaaaggaaggaagggaca

SEQ ID NO: 5036753 - DNA, 22 bp, Homo sapiens
aaagccatccccgctcctggtt

SEQ ID NO: 5036754 - DNA, 22 bp, Homo sapiens
aactaaaaattaaaacctcttt

SEQ ID NO: 5036755 - DNA, 23 bp, Homo sapiens
aagatttgatgtatgtaatacat

SEQ ID NO: 5036756 - DNA, 23 bp, Homo sapiens
aagcaaacttacaggtcctgctg

SEQ ID NO: 5036757 - DNA, 16 bp, Homo sapiens
aaggcaggaggatcac

SEQ ID NO: 5036758 - DNA, 23 bp, Homo sapiens
aaggctgaggcaggaggatcact

SEQ ID NO: 5036759 - DNA, 18 bp, Homo sapiens
aagttgattaagaaagga

SEQ ID NO: 5036760 - DNA, 20 bp, Homo sapiens
aagttgattaagaaaggaag

SEQ ID NO: 5036761 - DNA, 20 bp, Homo sapiens
aataaagtcattattaggaa

SEQ ID NO: 5036762 - DNA, 16 bp, Homo sapiens
aatacaaaaacttaga

SEQ ID NO: 5036763 - DNA, 21 bp, Homo sapiens
aataggctgatgggcaaaaaa

SEQ ID NO: 5036764 - DNA, 23 bp, Homo sapiens
aatcagagataaagcttaggtca

SEQ ID NO: 5036765 - DNA, 21 bp, Homo sapiens
aatggaacagatttcaaaaaa

SEQ ID NO: 5036766 - DNA, 22 bp, Homo sapiens
acaaagttgattaagaaaggaa

SEQ ID NO: 5036767 - DNA, 16 bp, Homo sapiens
acagaatgactgacaa

SEQ ID NO: 5036768 - DNA, 15 bp, Homo sapiens
acatcaggaaagaga

SEQ ID NO: 5036769 - DNA, 19 bp, Homo sapiens
acccatcagttccagcctt

SEQ ID NO: 5036770 - DNA, 14 bp, Homo sapiens
accctgcccccact

SEQ ID NO: 5036771 - DNA, 21 bp, Homo sapiens
acgaaatacgttaggaggaca

SEQ ID NO: 5036772 - DNA, 17 bp, Homo sapiens
actgctactatctgttt

SEQ ID NO: 5036773 - DNA, 21 bp, Homo sapiens
agagataaagcttaggtcaaa

SEQ ID NO: 5036774 - DNA, 18 bp, Homo sapiens
agaggcaaagaaaggaga

SEQ ID NO: 5036775 - DNA, 14 bp, Homo sapiens
agataaagcttagg

SEQ ID NO: 5036776 - DNA, 18 bp, Homo sapiens
agataaagcttaggtcaa

SEQ ID NO: 5036777 - DNA, 18 bp, Homo sapiens
agatacagtggagacatc

SEQ ID NO: 5036778 - DNA, 20 bp, Homo sapiens
agatctacatgtctagagaa

SEQ ID NO: 5036779 - DNA, 21 bp, Homo sapiens
agcaaataagtcatctgatga

SEQ ID NO: 5036780 - DNA, 15 bp, Homo sapiens
agcgttaatgtaaag

SEQ ID NO: 5036781 - DNA, 15 bp, Homo sapiens
agctgccctttctca

SEQ ID NO: 5036782 - DNA, 13 bp, Homo sapiens
agcttaggtcaaa

SEQ ID NO: 5036783 - DNA, 19 bp, Homo sapiens
aggatgggaacaaggaagg

SEQ ID NO: 5036784 - DNA, 16 bp, Homo sapiens
aggcaaagaaaggaga

SEQ ID NO: 5036785 - DNA, 14 bp, Homo sapiens
aggctacagaacta

SEQ ID NO: 5036786 - DNA, 18 bp, Homo sapiens
aggctgatgggcaaaaaa

SEQ ID NO: 5036787 - DNA, 17 bp, Homo sapiens
aggtcgaggctacagtg

SEQ ID NO: 5036788 - DNA, 20 bp, Homo sapiens
aggtgggcagatcacttgag

SEQ ID NO: 5036789 - DNA, 18 bp, Homo sapiens
agtgagccaaatgtaaaa

SEQ ID NO: 5036790 - DNA, 17 bp, Homo sapiens
agtttctctagaagctc

SEQ ID NO: 5036791 - DNA, 21 bp, Homo sapiens
ataaagtcattattaggaagt

SEQ ID NO: 5036792 - DNA, 14 bp, Homo sapiens
atagtgagacactg

SEQ ID NO: 5036793 - DNA, 13 bp, Homo sapiens
atcaaactgaaac

SEQ ID NO: 5036794 - DNA, 20 bp, Homo sapiens
atcacttgagctcaggaggt

SEQ ID NO: 5036795 - DNA, 14 bp, Homo sapiens
atcagcctgggcaa

SEQ ID NO: 5036796 - DNA, 20 bp, Homo sapiens
atcagcctgggcaacatggt

SEQ ID NO: 5036797 - DNA, 16 bp, Homo sapiens
atctagagcaaagcca

SEQ ID NO: 5036798 - DNA, 21 bp, Homo sapiens
atggtgaaacctggtctctac

SEQ ID NO: 5036799 - DNA, 21 bp, Homo sapiens
atgtaatacatatagcagctc

SEQ ID NO: 5036800 - DNA, 15 bp, Homo sapiens
atgtggcagatctac

SEQ ID NO: 5036801 - DNA, 18 bp, Homo sapiens
atgttccttttaaagaaa

SEQ ID NO: 5036802 - DNA, 19 bp, Homo sapiens
atttccctcccaagtaaat

SEQ ID NO: 5036803 - DNA, 20 bp, Homo sapiens
atttctgttaaaatatatga

SEQ ID NO: 5036804 - DNA, 13 bp, Homo sapiens
caaaaaaaggaag

SEQ ID NO: 5036805 - DNA, 13 bp, Homo sapiens
caaagaaaggaga

SEQ ID NO: 5036806 - DNA, 22 bp, Homo sapiens
caaagttgattaagaaaggaag

SEQ ID NO: 5036807 - DNA, 20 bp, Homo sapiens
caacacatcaggaaagagag

SEQ ID NO: 5036808 - DNA, 18 bp, Homo sapiens
cacatatcaaactgaaac

SEQ ID NO: 5036809 - DNA, 14 bp, Homo sapiens
cacatcaggaaaga

SEQ ID NO: 5036810 - DNA, 19 bp, Homo sapiens
cacttgagccccggaggtc

SEQ ID NO: 5036811 - DNA, 16 bp, Homo sapiens
cagaatctagagcaaa

SEQ ID NO: 5036812 - DNA, 21 bp, Homo sapiens
tccagccttctctcaaggaga

SEQ ID NO: 5036813 - DNA, 15 bp, Homo sapiens
tcctggttggtcaca

SEQ ID NO: 5036814 - DNA, 14 bp, Homo sapiens
tccttttaaagaaa

SEQ ID NO: 5036815 - DNA, 18 bp, Homo sapiens
tctaggatgggaacaagg

SEQ ID NO: 5036816 - DNA, 22 bp, Homo sapiens
tctcaaggagaggcaaagaaag

SEQ ID NO: 5036817 - DNA, 23 bp, Homo sapiens
tctctgtagaaggagtagctgcc

SEQ ID NO: 5036818 - DNA, 17 bp, Homo sapiens
tctgatgagaacaagct

SEQ ID NO: 5036819 - DNA, 12 bp, Homo sapiens
tgaaatggaaca

SEQ ID NO: 5036820 - DNA, 14 bp, Homo sapiens
tgagaacaagctat

SEQ ID NO: 5036821 - DNA, 16 bp, Homo sapiens
tgatgctttgagaaca

SEQ ID NO: 5036822 - DNA, 13 bp, Homo sapiens
tgattaagaaagg

SEQ ID NO: 5036823 - DNA, 17 bp, Homo sapiens
tgattaagaaaggaagt

SEQ ID NO: 5036824 - DNA, 16 bp, Homo sapiens
tgcctccaagttcaaa

SEQ ID NO: 5036825 - DNA, 13 bp, Homo sapiens
tgctgaaactgcc

SEQ ID NO: 5036826 - DNA, 12 bp, Homo sapiens
tggaacagattt

SEQ ID NO: 5036827 - DNA, 20 bp, Homo sapiens
tggagtttctctagaagctc

SEQ ID NO: 5036828 - DNA, 14 bp, Homo sapiens
tggctcacacctgt

SEQ ID NO: 5036829 - DNA, 15 bp, Homo sapiens
tgggaacaaggaagg

SEQ ID NO: 5036830 - DNA, 22 bp, Homo sapiens
tggtcaacatagtgagacactg

SEQ ID NO: 5036831 - DNA, 21 bp, Homo sapiens
tggttggtcacagaatgactg

SEQ ID NO: 5036832 - DNA, 21 bp, Homo sapiens
tgtaattatgttctaagtgcc

SEQ ID NO: 5036833 - DNA, 23 bp, Homo sapiens
tgtctctaccaaaaaaaggaagg

SEQ ID NO: 5036834 - DNA, 15 bp, Homo sapiens
tgtgctctattacca

SEQ ID NO: 5036835 - DNA, 19 bp, Homo sapiens
ttaaggccaggcatggtgg

SEQ ID NO: 5036836 - DNA, 21 bp, Homo sapiens
ttaggcctggtgtgttcaaga

SEQ ID NO: 5036837 - DNA, 19 bp, Homo sapiens
ttaggtcaaagttcataga

SEQ ID NO: 5036838 - DNA, 15 bp, Homo sapiens
ttctctagaagctcc

SEQ ID NO: 5036839 - DNA, 18 bp, Homo sapiens
ttgattaagaaaggaagt

SEQ ID NO: 5036840 - DNA, 12 bp, Homo sapiens
tttatgttcctt

SEQ ID NO: 5036841 - DNA, 22 bp, Homo sapiens
tttctatgcttgtaactgtctt

SEQ ID NO: 5036842 - DNA, 16 bp, Homo sapiens
taagtgcctccaagtt

SEQ ID NO: 5036843 - DNA, 20 bp, Homo sapiens
taagtgcctccaagttcaaa

SEQ ID NO: 5036844 - DNA, 16 bp, Homo sapiens
tacctcttcacctgac

SEQ ID NO: 5036845 - DNA, 22 bp, Homo sapiens
tacgaaatacgttaggaggaca

SEQ ID NO: 5036846 - DNA, 23 bp, Homo sapiens
tacgttaggaggacaaaaggaat

SEQ ID NO: 5036847 - DNA, 17 bp, Homo sapiens
tatatgaggctacagaa

SEQ ID NO: 5036848 - DNA, 12 bp, Homo sapiens
tatcatagcaaa

SEQ ID NO: 5036849 - DNA, 18 bp, Homo sapiens
tcaaggagaggcaaagaa

SEQ ID NO: 5036850 - DNA, 23 bp, Homo sapiens
tcagagataaagcttaggtcaaa

SEQ ID NO: 5036851 - DNA, 17 bp, Homo sapiens
tcatctgatgagaacaa

SEQ ID NO: 5036852 - DNA, 14 bp, Homo sapiens
tctacatgtctaga

SEQ ID NO: 5036853 - DNA, 15 bp, Homo sapiens
tctcaaggagaggca

SEQ ID NO: 5036854 - DNA, 20 bp, Homo sapiens
tctctaccaaaaaaaggaag

SEQ ID NO: 5036855 - DNA, 14 bp, Homo sapiens
tgagctcaggaggt

SEQ ID NO: 5036856 - DNA, 19 bp, Homo sapiens
tgagctcaggaggtcaaga

SEQ ID NO: 5036857 - DNA, 16 bp, Homo sapiens
tgatggagtttctcta

SEQ ID NO: 5036858 - DNA, 15 bp, Homo sapiens
tgattaagaaaggaa

SEQ ID NO: 5036859 - DNA, 16 bp, Homo sapiens
tgattaagaaaggaag

SEQ ID NO: 5036860 - DNA, 20 bp, Homo sapiens
tgcaagaagaaatcatgata

SEQ ID NO: 5036861 - DNA, 17 bp, Homo sapiens
tgcattttggaaggctg

SEQ ID NO: 5036862 - DNA, 17 bp, Homo sapiens
tgctgaaactgcccact

SEQ ID NO: 5036863 - DNA, 16 bp, Homo sapiens
tggaaagttttctcca

SEQ ID NO: 5036864 - DNA, 15 bp, Homo sapiens
tggaacagatttcaa

SEQ ID NO: 5036865 - DNA, 18 bp, Homo sapiens
tggagtttctctagaagc

SEQ ID NO: 5036866 - DNA, 19 bp, Homo sapiens
tggagtttctctagaagct

SEQ ID NO: 5036867 - DNA, 14 bp, Homo sapiens
tgggaacaaggaag

SEQ ID NO: 5036868 - DNA, 19 bp, Homo sapiens
tgtagaaggagtagctgcc

SEQ ID NO: 5036869 - DNA, 22 bp, Homo sapiens
tgtctctaccaaaaaaaggaag

SEQ ID NO: 5036870 - DNA, 15 bp, Homo sapiens
tgtctgaaatggaac

SEQ ID NO: 5036871 - DNA, 18 bp, Homo sapiens
tgtgcctatagtcccact

SEQ ID NO: 5036872 - DNA, 17 bp, Homo sapiens
tgtgtcccttggtcctg

SEQ ID NO: 5036873 - DNA, 19 bp, Homo sapiens
tgttcaagaccagcctggt

SEQ ID NO: 5036874 - DNA, 11 bp, Homo sapiens
ttaaggattct

SEQ ID NO: 5036875 - DNA, 21 bp, Homo sapiens
ttacccatcagttccagcctt

SEQ ID NO: 5036876 - DNA, 19 bp, Homo sapiens
ttaggaggacaaaaggaat

SEQ ID NO: 5036877 - DNA, 11 bp, Homo sapiens
ttatgttcctt

SEQ ID NO: 5036878 - DNA, 20 bp, Homo sapiens
ttcatagagttcccatgaac

SEQ ID NO: 5036879 - DNA, 14 bp, Homo sapiens
ttctctcaaggaga

SEQ ID NO: 5036880 - DNA, 18 bp, Homo sapiens
ttgagcaggattagataa

SEQ ID NO: 5036881 - DNA, 16 bp, Homo sapiens
ttgcttgagcaggatt

SEQ ID NO: 5036882 - DNA, 19 bp, Homo sapiens
tttgtatttaaggattctg

SEQ ID NO: 5036883 - DNA, 11 bp, Homo sapiens
aaaaaaaggaa

SEQ ID NO: 5036884 - DNA, 12 bp, Homo sapiens
aaatacaaaaac

SEQ ID NO: 5036885 - DNA, 21 bp, Homo sapiens
aacacatcaggaaagagagca

SEQ ID NO: 5036886 - DNA, 16 bp, Homo sapiens
aacatagtgagacact

SEQ ID NO: 5036887 - DNA, 20 bp, Homo sapiens
aacctggtctctacataaaa

SEQ ID NO: 5036888 - DNA, 12 bp, Homo sapiens
aagaaaggaagt

SEQ ID NO: 5036889 - DNA, 16 bp, Homo sapiens
aagatttgatgtatgt

SEQ ID NO: 5036890 - DNA, 14 bp, Homo sapiens
aaggagaggcaaag

SEQ ID NO: 5036891 - DNA, 22 bp, Homo sapiens
aaggctgaggcaggaggatcac

SEQ ID NO: 5036892 - DNA, 22 bp, Homo sapiens
aataggctgatgggcaaaaaac

SEQ ID NO: 5036893 - DNA, 14 bp, Homo sapiens
aatcaaactttaca

SEQ ID NO: 5036894 - DNA, 17 bp, Homo sapiens
aatgccgatatcttcag

SEQ ID NO: 5036895 - DNA, 19 bp, Homo sapiens
aatggaacagatttcaaaa

SEQ ID NO: 5036896 - DNA, 15 bp, Homo sapiens
aatgtctgaaatgga

SEQ ID NO: 5036897 - DNA, 21 bp, Homo sapiens
acaaaaggaatgtgtaagtct

SEQ ID NO: 5036898 - DNA, 12 bp, Homo sapiens
acagaactaaaa

SEQ ID NO: 5036899 - DNA, 16 bp, Homo sapiens
acagtgagccaagagt

SEQ ID NO: 5036900 - DNA, 22 bp, Homo sapiens
acatttatgttccttttaaaga

SEQ ID NO: 5036901 - DNA, 22 bp, Homo sapiens
acgttaggaggacaaaaggaat

SEQ ID NO: 5036902 - DNA, 18 bp, Homo sapiens
actccagccagggcaaga

SEQ ID NO: 5036903 - DNA, 16 bp, Homo sapiens
actgcccactctgcaa

SEQ ID NO: 5036904 - DNA, 17 bp, Homo sapiens
acttgtggggctaaggc

SEQ ID NO: 5036905 - DNA, 22 bp, Homo sapiens
actttggccattacccccagct

SEQ ID NO: 5036906 - DNA, 19 bp, Homo sapiens
agaaaacctaagcaaactt

SEQ ID NO: 5036907 - DNA, 11 bp, Homo sapiens
agaaaggaagt

SEQ ID NO: 5036908 - DNA, 23 bp, Homo sapiens
agacactgtctctaccaaaaaaa

SEQ ID NO: 5036909 - DNA, 19 bp, Homo sapiens
agagcgagaccctgtctca

SEQ ID NO: 5036910 - DNA, 16 bp, Homo sapiens
agagtgcactactgta

SEQ ID NO: 5036911 - DNA, 18 bp, Homo sapiens
agcaaagccatccccgct

SEQ ID NO: 5036912 - DNA, 21 bp, Homo sapiens
agcagtgagccaaatgtaaaa

SEQ ID NO: 5036913 - DNA, 16 bp, Homo sapiens
agctcaggaggtcaag

SEQ ID NO: 5036914 - DNA, 16 bp, Homo sapiens
aggaggacaaaaggaa

SEQ ID NO: 5036915 - DNA, 17 bp, Homo sapiens
aggcaattcctacctct

SEQ ID NO: 5036916 - DNA, 16 bp, Homo sapiens
aggcaggaggatcact

SEQ ID NO: 5036917 - DNA, 14 bp, Homo sapiens
aggctgatgggcaa

SEQ ID NO: 5036918 - DNA, 15 bp, Homo sapiens
aggctgatgggcaaa

SEQ ID NO: 5036919 - DNA, 19 bp, Homo sapiens
aggctgatgggcaaaaaac

SEQ ID NO: 5036920 - DNA, 16 bp, Homo sapiens
aggctgttctttaaat

SEQ ID NO: 5036921 - DNA, 16 bp, Homo sapiens
agttccagccttctct

SEQ ID NO: 5036922 - DNA, 21 bp, Homo sapiens
atagtgagacactgtctctac

SEQ ID NO: 5036923 - DNA, 23 bp, Homo sapiens
atcagagataaagcttaggtcaa

SEQ ID NO: 5036924 - DNA, 22 bp, Homo sapiens
atcagttccagccttctctcaa

SEQ ID NO: 5036925 - DNA, 23 bp, Homo sapiens
atctaggatgggaacaaggaagg

SEQ ID NO: 5036926 - DNA, 18 bp, Homo sapiens
atgactgacaaagacatc

SEQ ID NO: 5036927 - DNA, 19 bp, Homo sapiens
atgtaaaggggcagcagtg

SEQ ID NO: 5036928 - DNA, 17 bp, Homo sapiens
atgtaattatgttctaa

SEQ ID NO: 5036929 - DNA, 22 bp, Homo sapiens
atgtggcagatctacatgtcta

SEQ ID NO: 5036930 - DNA, 14 bp, Homo sapiens
caaaaaaaggaagg

SEQ ID NO: 5036931 - DNA, 15 bp, Homo sapiens
caaaattagaaatgt

SEQ ID NO: 5036932 - DNA, 23 bp, Homo sapiens
caaagttgattaagaaaggaagt

SEQ ID NO: 5036933 - DNA, 19 bp, Homo sapiens
caaataagtcatctgatga

SEQ ID NO: 5036934 - DNA, 20 bp, Homo sapiens
caacatagtgagacactgtc

SEQ ID NO: 5036935 - DNA, 19 bp, Homo sapiens
cacagtggctcacacctgt

SEQ ID NO: 5036936 - DNA, 19 bp, Homo sapiens
cactactgtactccagcca

SEQ ID NO: 5036937 - DNA, 17 bp, Homo sapiens
cagccagggcaagagag

SEQ ID NO: 5036938 - DNA, 22 bp, Homo sapiens
caggaggtcaagatcagcctgg

SEQ ID NO: 5036939 - DNA, 19 bp, Homo sapiens
caggattagataaggctgt

SEQ ID NO: 5036940 - DNA, 20 bp, Homo sapiens
cagtggctcacacctgtaat

SEQ ID NO: 5036941 - DNA, 19 bp, Homo sapiens
catctggaaagttttctcc

SEQ ID NO: 5036942 - DNA, 17 bp, Homo sapiens
cccatcagttccagcct

SEQ ID NO: 5036943 - DNA, 17 bp, Homo sapiens
cccgctcctggttggtc

SEQ ID NO: 5036944 - DNA, 20 bp, Homo sapiens
ccgaggtgggcagatcactt

SEQ ID NO: 5036945 - DNA, 17 bp, Homo sapiens
cctatagtcccactact

SEQ ID NO: 5036946 - DNA, 12 bp, Homo sapiens
ctagagaacact

SEQ ID NO: 5036947 - DNA, 17 bp, Homo sapiens
ctataatcccagcattt

SEQ ID NO: 5036948 - DNA, 22 bp, Homo sapiens
ctcaaggagaggcaaagaaagg

SEQ ID NO: 5036949 - DNA, 17 bp, Homo sapiens
ctctgcaagaagaaatc

SEQ ID NO: 5036950 - DNA, 15 bp, Homo sapiens
ctgaaactgcccact

SEQ ID NO: 5036951 - DNA, 22 bp, Homo sapiens
ctgaaactgcccactctgcaag

SEQ ID NO: 5036952 - DNA, 15 bp, Homo sapiens
ctgccctttctcagg

SEQ ID NO: 5036953 - DNA, 14 bp, Homo sapiens
ctgctgaaactgcc

SEQ ID NO: 5036954 - DNA, 17 bp, Homo sapiens
ctggccacacaggatct

SEQ ID NO: 5036955 - DNA, 22 bp, Homo sapiens
ctgtctctaccaaaaaaaggaa

SEQ ID NO: 5036956 - DNA, 20 bp, Homo sapiens
gaacaaggaaggaaagatgt

SEQ ID NO: 5036957 - DNA, 14 bp, Homo sapiens
gaacagatttcaaa

SEQ ID NO: 5036958 - DNA, 14 bp, Homo sapiens
gagacactgtctct

SEQ ID NO: 5036959 - DNA, 15 bp, Homo sapiens
gagatctctgtagaa

SEQ ID NO: 5036960 - DNA, 15 bp, Homo sapiens
gagcgagaccctgtc

SEQ ID NO: 5036961 - DNA, 16 bp, Homo sapiens
gatatcttcagaaaac

SEQ ID NO: 5036962 - DNA, 18 bp, Homo sapiens
gatctctgtagaaggagt

SEQ ID NO: 5036963 - DNA, 20 bp, Homo sapiens
gcaaataagtcatctgatga

SEQ ID NO: 5036964 - DNA, 18 bp, Homo sapiens
gccagaatctagagcaaa

SEQ ID NO: 5036965 - DNA, 19 bp, Homo sapiens
gccagaatctagagcaaag

SEQ ID NO: 5036966 - DNA, 17 bp, Homo sapiens
gccagggcaagagagcg

SEQ ID NO: 5036967 - DNA, 15 bp, Homo sapiens
gcctatagtcccact

SEQ ID NO: 5036968 - DNA, 18 bp, Homo sapiens
gctaaggcaggaggatca

SEQ ID NO: 5036969 - DNA, 13 bp, Homo sapiens
gctcacacctgta

SEQ ID NO: 5036970 - DNA, 18 bp, Homo sapiens
gctgaggcaggaggatca

SEQ ID NO: 5036971 - DNA, 14 bp, Homo sapiens
gctgccctttctca

SEQ ID NO: 5036972 - DNA, 16 bp, Homo sapiens
ggaacagatttcaaaa

SEQ ID NO: 5036973 - DNA, 18 bp, Homo sapiens
ggaaggctgaggcaggag

SEQ ID NO: 5036974 - DNA, 17 bp, Homo sapiens
ggagaggcaaagaaagg

SEQ ID NO: 5036975 - DNA, 14 bp, Homo sapiens
ggagatacagtgga

SEQ ID NO: 5036976 - DNA, 17 bp, Homo sapiens
ggaggacaaaaggaatg

SEQ ID NO: 5036977 - DNA, 20 bp, Homo sapiens
ggaggtcaagatcagcctgg

SEQ ID NO: 5036978 - DNA, 22 bp, Homo sapiens
ggatcacttgagccccggaggt

SEQ ID NO: 5036979 - DNA, 15 bp, Homo sapiens
ggcaaagaaaggaga

SEQ ID NO: 5036980 - DNA, 14 bp, Homo sapiens
gggaacaaggaagg

SEQ ID NO: 5036981 - DNA, 19 bp, Homo sapiens
ggtggtttacgcctataat

SEQ ID NO: 5036982 - DNA, 21 bp, Homo sapiens
gtcatctgatgagaacaagct

SEQ ID NO: 5036983 - DNA, 21 bp, Homo sapiens
gtctctaccaaaaaaaggaag

SEQ ID NO: 5036984 - DNA, 22 bp, Homo sapiens
gtctctaccaaaaaaaggaagg

SEQ ID NO: 5036985 - DNA, 18 bp, Homo sapiens
gtgaaacctggtctctac

SEQ ID NO: 5036986 - DNA, 23 bp, Homo sapiens
gtgatggagtttctctagaagct

SEQ ID NO: 5036987 - DNA, 19 bp, Homo sapiens
gttgattaagaaaggaagt

SEQ ID NO: 5036988 - DNA, 16 bp, Homo sapiens
taaagcttaggtcaaa

SEQ ID NO: 5036989 - DNA, 13 bp, Homo sapiens
taagaaaggaagt

SEQ ID NO: 5036990 - DNA, 13 bp, Homo sapiens
cagccttctctca

SEQ ID NO: 5036991 - DNA, 15 bp, Homo sapiens
cagctcttgaagtat

SEQ ID NO: 5036992 - DNA, 16 bp, Homo sapiens
caggattagataaggc

SEQ ID NO: 5036993 - DNA, 17 bp, Homo sapiens
cagttccagccttctct

SEQ ID NO: 5036994 - DNA, 17 bp, Homo sapiens
catagtgagacactgtc

SEQ ID NO: 5036995 - DNA, 20 bp, Homo sapiens
catagtgagacactgtctct

SEQ ID NO: 5036996 - DNA, 22 bp, Homo sapiens
catctggaaagttttctccact

SEQ ID NO: 5036997 - DNA, 12 bp, Homo sapiens
aaaaaaggaagg

SEQ ID NO: 5036998 - DNA, 11 bp, Homo sapiens
aaaaaggaagg

SEQ ID NO: 5036999 - DNA, 15 bp, Homo sapiens
aaagcttaggtcaaa

SEQ ID NO: 5037000 - DNA, 14 bp, Homo sapiens
aaaggaatgtgtaa

SEQ ID NO: 5037001 - DNA, 11 bp, Homo sapiens
aacaaggaagg

SEQ ID NO: 5037002 - DNA, 17 bp, Homo sapiens
aacatagtgagacactg

SEQ ID NO: 5037003 - DNA, 18 bp, Homo sapiens
aacatagtgagacactgt

SEQ ID NO: 5037004 - DNA, 14 bp, Homo sapiens
aagaaacaaaaatc

SEQ ID NO: 5037005 - DNA, 23 bp, Homo sapiens
aaggagaggcaaagaaaggagat

SEQ ID NO: 5037006 - DNA, 17 bp, Homo sapiens
aaggcaggaggatcact

SEQ ID NO: 5037007 - DNA, 23 bp, Homo sapiens
aaggctgttctttaaatgtctga

SEQ ID NO: 5037008 - DNA, 21 bp, Homo sapiens
aatctaggatgggaacaagga

SEQ ID NO: 5037009 - DNA, 16 bp, Homo sapiens
aatgactgacaaagac

SEQ ID NO: 5037010 - DNA, 22 bp, Homo sapiens
aattcctacctcttcacctgac

SEQ ID NO: 5037011 - DNA, 19 bp, Homo sapiens
acaaagttgattaagaaag

SEQ ID NO: 5037012 - DNA, 19 bp, Homo sapiens
acagatttcaaaaaaaaac

SEQ ID NO: 5037013 - DNA, 16 bp, Homo sapiens
acatcaggaaagagag

SEQ ID NO: 5037014 - DNA, 18 bp, Homo sapiens
acatcaggaaagagagca

SEQ ID NO: 5037015 - DNA, 15 bp, Homo sapiens
acatttatgttcctt

SEQ ID NO: 5037016 - DNA, 15 bp, Homo sapiens
accaaaaaaaggaag

SEQ ID NO: 5037017 - DNA, 16 bp, Homo sapiens
accaaaaaaaggaagg

SEQ ID NO: 5037018 - DNA, 14 bp, Homo sapiens
accagcctggtcaa

SEQ ID NO: 5037019 - DNA, 20 bp, Homo sapiens
accattatggataaagatga

SEQ ID NO: 5037020 - DNA, 15 bp, Homo sapiens
acctcttcacctgac

SEQ ID NO: 5037021 - DNA, 20 bp, Homo sapiens
acgttaggaggacaaaagga

SEQ ID NO: 5037022 - DNA, 23 bp, Homo sapiens
actacttgtggggctaaggcagg

SEQ ID NO: 5037023 - DNA, 23 bp, Homo sapiens
actggaaaactgctactatctgt

SEQ ID NO: 5037024 - DNA, 19 bp, Homo sapiens
acttagatgggcatggtgg

SEQ ID NO: 5037025 - DNA, 19 bp, Homo sapiens
agaaacaaaaatcaaactt

SEQ ID NO: 5037026 - DNA, 20 bp, Homo sapiens
agaaatgtaattatgttcta

SEQ ID NO: 5037027 - DNA, 19 bp, Homo sapiens
agataaagcttaggtcaaa

SEQ ID NO: 5037028 - DNA, 16 bp, Homo sapiens
agatcagcctgggcaa

SEQ ID NO: 5037029 - DNA, 14 bp, Homo sapiens
agatttcaaaaaaa

SEQ ID NO: 5037030 - DNA, 17 bp, Homo sapiens
agcagtgagccaaatgt

SEQ ID NO: 5037031 - DNA, 20 bp, Homo sapiens
agcagtgagccaaatgtaaa

SEQ ID NO: 5037032 - DNA, 13 bp, Homo sapiens
agccaaatgtaaa

SEQ ID NO: 5037033 - DNA, 16 bp, Homo sapiens
agccagggcaagagag

SEQ ID NO: 5037034 - DNA, 13 bp, Homo sapiens
agccttctctcaa

SEQ ID NO: 5037035 - DNA, 14 bp, Homo sapiens
agcgttaatgtaaa

SEQ ID NO: 5037036 - DNA, 22 bp, Homo sapiens
agcttaggtcaaagttcataga

SEQ ID NO: 5037037 - DNA, 14 bp, Homo sapiens
aggacaaaaggaat

SEQ ID NO: 5037038 - DNA, 19 bp, Homo sapiens
aggagaggcaaagaaagga

SEQ ID NO: 5037039 - DNA, 16 bp, Homo sapiens
aggaggatcacttgag

SEQ ID NO: 5037040 - DNA, 19 bp, Homo sapiens
aggatcactttaggcctgg

SEQ ID NO: 5037041 - DNA, 20 bp, Homo sapiens
aggatgggaacaaggaagga

SEQ ID NO: 5037042 - DNA, 17 bp, Homo sapiens
aggattagataaggctg

SEQ ID NO: 5037043 - DNA, 17 bp, Homo sapiens
aggctgaggcaggagga

SEQ ID NO: 5037044 - DNA, 15 bp, Homo sapiens
agtcatctgatgaga

SEQ ID NO: 5037045 - DNA, 20 bp, Homo sapiens
agttgattaagaaaggaagt

SEQ ID NO: 5037046 - DNA, 14 bp, Homo sapiens
ataagtcatctgat

SEQ ID NO: 5037047 - DNA, 14 bp, Homo sapiens
ataatcccagcatt

SEQ ID NO: 5037048 - DNA, 18 bp, Homo sapiens
atacatatagcagctctt

SEQ ID NO: 5037049 - DNA, 17 bp, Homo sapiens
atcagagataaagctta

SEQ ID NO: 5037050 - DNA, 14 bp, Homo sapiens
atcaggaaagagag

SEQ ID NO: 5037051 - DNA, 17 bp, Homo sapiens
atgaactatatgactgg

SEQ ID NO: 5037052 - DNA, 16 bp, Homo sapiens
atgggaacaaggaagg

SEQ ID NO: 5037053 - DNA, 22 bp, Homo sapiens
atttatgttccttttaaagaaa

SEQ ID NO: 5037054 - DNA, 21 bp, Homo sapiens
caaacttacaggtcctgctga

SEQ ID NO: 5037055 - DNA, 22 bp, Homo sapiens
caacacatcaggaaagagagca

SEQ ID NO: 5037056 - DNA, 17 bp, Homo sapiens
caacatagtgagacact

SEQ ID NO: 5037057 - DNA, 18 bp, Homo sapiens
caaggagaggcaaagaaa

SEQ ID NO: 5037058 - DNA, 23 bp, Homo sapiens
caattcctacctcttcacctgac

SEQ ID NO: 5037059 - DNA, 23 bp, Homo sapiens
cagagataaagcttaggtcaaag

SEQ ID NO: 5037060 - DNA, 21 bp, Homo sapiens
cagatgatgctttgagaacat

SEQ ID NO: 5037061 - DNA, 15 bp, Homo sapiens
cataaaatacaaaaa

SEQ ID NO: 5037062 - DNA, 19 bp, Homo sapiens
cattttggaaggctgaggc

SEQ ID NO: 5037063 - DNA, 21 bp, Homo sapiens
ccactacttgtggggctaagg

SEQ ID NO: 5037064 - DNA, 13 bp, Homo sapiens
ccactctgcaaga

SEQ ID NO: 5037065 - DNA, 20 bp, Homo sapiens
ccagaatctagagcaaagcc

SEQ ID NO: 5037066 - DNA, 15 bp, Homo sapiens
ccagccttctctcaa

SEQ ID NO: 5037067 - DNA, 17 bp, Homo sapiens
ccagccttctctcaagg

SEQ ID NO: 5037068 - DNA, 19 bp, Homo sapiens
cctgggcaacatggtgaaa

SEQ ID NO: 5037069 - DNA, 15 bp, Homo sapiens
cgagaccctgtctca

SEQ ID NO: 5037070 - DNA, 18 bp, Homo sapiens
cgttaggaggacaaaagg

SEQ ID NO: 5037071 - DNA, 14 bp, Homo sapiens
ctaaggcaggagga

SEQ ID NO: 5037072 - DNA, 20 bp, Homo sapiens
ctacatgtctagagaacact

SEQ ID NO: 5037073 - DNA, 12 bp, Homo sapiens
ctcacacctgta

SEQ ID NO: 5037074 - DNA, 20 bp, Homo sapiens
ctctaccaaaaaaaggaagg

SEQ ID NO: 5037075 - DNA, 14 bp, Homo sapiens
ctctgcaagaagaa

SEQ ID NO: 5037076 - DNA, 17 bp, Homo sapiens
ctgaccctgcccccact

SEQ ID NO: 5037077 - DNA, 14 bp, Homo sapiens
ctgaggcaggagga

SEQ ID NO: 5037078 - DNA, 17 bp, Homo sapiens
ctgatgagaacaagcta

SEQ ID NO: 5037079 - DNA, 16 bp, Homo sapiens
ctgccagaatctagag

SEQ ID NO: 5037080 - DNA, 13 bp, Homo sapiens
ctgccctttctca

SEQ ID NO: 5037081 - DNA, 19 bp, Homo sapiens
ctggaaagttttctccact

SEQ ID NO: 5037082 - DNA, 18 bp, Homo sapiens
ctggtctctacataaaat

SEQ ID NO: 5037083 - DNA, 14 bp, Homo sapiens
cttgagcaggatta

SEQ ID NO: 5037084 - DNA, 15 bp, Homo sapiens
cttgagcaggattag

SEQ ID NO: 5037085 - DNA, 19 bp, Homo sapiens
cttgtggggctaaggcagg

SEQ ID NO: 5037086 - DNA, 20 bp, Homo sapiens
gaaagagagcaccacgtgat

SEQ ID NO: 5037087 - DNA, 20 bp, Homo sapiens
gaaatggaacagatttcaaa

SEQ ID NO: 5037088 - DNA, 12 bp, Homo sapiens
gaacaaggaagg

SEQ ID NO: 5037089 - DNA, 15 bp, Homo sapiens
gaacaaggaaggaaa

SEQ ID NO: 5037090 - DNA, 20 bp, Homo sapiens
gaataggctgatgggcaaaa

SEQ ID NO: 5037091 - DNA, 14 bp, Homo sapiens
gagacatctggaaa

SEQ ID NO: 5037092 - DNA, 17 bp, Homo sapiens
gagaccctgtctcaata

SEQ ID NO: 5037093 - DNA, 18 bp, Homo sapiens
gagtttctctagaagctc

SEQ ID NO: 5037094 - DNA, 22 bp, Homo sapiens
gatggagtttctctagaagctc

SEQ ID NO: 5037095 - DNA, 14 bp, Homo sapiens
gcaaagaaaggaga

SEQ ID NO: 5037096 - DNA, 20 bp, Homo sapiens
gcagatcacttgagctcagg

SEQ ID NO: 5037097 - DNA, 10 bp, Homo sapiens
gcagtgagcc

SEQ ID NO: 5037098 - DNA, 17 bp, Homo sapiens
gccaaaatataatcaga

SEQ ID NO: 5037099 - DNA, 18 bp, Homo sapiens
gcctataatcccagcatt

SEQ ID NO: 5037100 - DNA, 15 bp, Homo sapiens
gctaaggcaggagga

SEQ ID NO: 5037101 - DNA, 22 bp, Homo sapiens
ggaaagttttctccactggaaa

SEQ ID NO: 5037102 - DNA, 12 bp, Homo sapiens
ggaacaaggaag

SEQ ID NO: 5037103 - DNA, 13 bp, Homo sapiens
ggaaggctgaggc

SEQ ID NO: 5037104 - DNA, 21 bp, Homo sapiens
ggaagtataggccaggcacag

SEQ ID NO: 5037105 - DNA, 13 bp, Homo sapiens
ggacaaaaggaat

SEQ ID NO: 5037106 - DNA, 12 bp, Homo sapiens
ggagaggcaaag

SEQ ID NO: 5037107 - DNA, 12 bp, Homo sapiens
ggataaagatga

SEQ ID NO: 5037108 - DNA, 14 bp, Homo sapiens
ggataaagatgaga

SEQ ID NO: 5037109 - DNA, 14 bp, Homo sapiens
ggctaaggcaggag

SEQ ID NO: 5037110 - DNA, 21 bp, Homo sapiens
gggcaagagagcgagaccctg

SEQ ID NO: 5037111 - DNA, 22 bp, Homo sapiens
gtcaacatagtgagacactgtc

SEQ ID NO: 5037112 - DNA, 14 bp, Homo sapiens
gtcatctgatgaga

SEQ ID NO: 5037113 - DNA, 24 bp, Homo sapiens
gtcccactacttgtggggctaagg

SEQ ID NO: 5037114 - DNA, 15 bp, Homo sapiens
gtccttgggtccatt

SEQ ID NO: 5037115 - DNA, 21 bp, Homo sapiens
gttcaaaacttattggaatgt

SEQ ID NO: 5037116 - DNA, 20 bp, Homo sapiens
gttccagccttctctcaagg

SEQ ID NO: 5037117 - DNA, 16 bp, Homo sapiens
taaaatatatgaggct

SEQ ID NO: 5037118 - DNA, 12 bp, Homo sapiens
taagaaaggaag

SEQ ID NO: 5037119 - DNA, 21 bp, Homo sapiens
taaggcaggaggatcacttga

SEQ ID NO: 5037120 - DNA, 20 bp, Homo sapiens
taagtcatctgatgagaaca

SEQ ID NO: 5037121 - DNA, 15 bp, Homo sapiens
tacatgtctagagaa

SEQ ID NO: 5037122 - DNA, 15 bp, Homo sapiens
taccaaaaaaaggaa

SEQ ID NO: 5037123 - DNA, 23 bp, Homo sapiens
taccattatggataaagatgaga

SEQ ID NO: 5037124 - DNA, 13 bp, Homo sapiens
tagtgagacactg

SEQ ID NO: 5037125 - DNA, 20 bp, Homo sapiens
tcaacatagtgagacactgt

SEQ ID NO: 5037126 - DNA, 19 bp, Homo sapiens
tcaaggagaggcaaagaaa

SEQ ID NO: 5037127 - DNA, 13 bp, Homo sapiens
tcagagataaagc

SEQ ID NO: 5037128 - DNA, 15 bp, Homo sapiens
tcaggaaagagagca

SEQ ID NO: 5037129 - DNA, 20 bp, Homo sapiens
tccagccagggcaagagagc

SEQ ID NO: 5037130 - DNA, 15 bp, Homo sapiens
tccagccttctctca

SEQ ID NO: 5037131 - DNA, 17 bp, Homo sapiens
tccttttaaagaaacaa

SEQ ID NO: 5037132 - DNA, 12 bp, Homo sapiens
tctagaagctcc

SEQ ID NO: 5037133 - DNA, 22 bp, Homo sapiens
tctaggatgggaacaaggaagg

SEQ ID NO: 5037134 - DNA, 21 bp, Homo sapiens
tctcaaggagaggcaaagaaa

SEQ ID NO: 5037135 - DNA, 19 bp, Homo sapiens
tgactggccacacaggatc

SEQ ID NO: 5037136 - DNA, 19 bp, Homo sapiens
tgagccccggaggtcgagg

SEQ ID NO: 5037137 - DNA, 16 bp, Homo sapiens
tgcccactctgcaaga

SEQ ID NO: 5037138 - DNA, 18 bp, Homo sapiens
tgccgatatcttcagaaa

SEQ ID NO: 5037139 - DNA, 16 bp, Homo sapiens
tgcctatagtcccact

SEQ ID NO: 5037140 - DNA, 17 bp, Homo sapiens
tgcctccaagttcaaaa

SEQ ID NO: 5037141 - DNA, 14 bp, Homo sapiens
tggtcaacatagtg

SEQ ID NO: 5037142 - DNA, 17 bp, Homo sapiens
tggtggtttacgcctat

SEQ ID NO: 5037143 - DNA, 23 bp, Homo sapiens
tggtgtgttcaagaccagcctgg

SEQ ID NO: 5037144 - DNA, 21 bp, Homo sapiens
tggtttacgcctataatccca

SEQ ID NO: 5037145 - DNA, 12 bp, Homo sapiens
tgtagaaggagt

SEQ ID NO: 5037146 - DNA, 22 bp, Homo sapiens
tgtatgtaatacatatagcagc

SEQ ID NO: 5037147 - DNA, 13 bp, Homo sapiens
tgttctaagtgcc

SEQ ID NO: 5037148 - DNA, 22 bp, Homo sapiens
tgtttttcagcgttaatgtaaa

SEQ ID NO: 5037149 - DNA, 13 bp, Homo sapiens
ttaagaaaggaag

SEQ ID NO: 5037150 - DNA, 14 bp, Homo sapiens
ttaagaaaggaagt

SEQ ID NO: 5037151 - DNA, 19 bp, Homo sapiens
ttacaggtcctgctgaaac

SEQ ID NO: 5037152 - DNA, 20 bp, Homo sapiens
ttacccccagctttgaggaa

SEQ ID NO: 5037153 - DNA, 18 bp, Homo sapiens
ttaggaggacaaaaggaa

SEQ ID NO: 5037154 - DNA, 15 bp, Homo sapiens
ttcaagaccagcctg

SEQ ID NO: 5037155 - DNA, 19 bp, Homo sapiens
ttctctcaaggagaggcaa

SEQ ID NO: 5037156 - DNA, 19 bp, Homo sapiens
ttgagctcaggaggtcaag

SEQ ID NO: 5037157 - DNA, 16 bp, Homo sapiens
ttgattaagaaaggaa

SEQ ID NO: 5037158 - DNA, 17 bp, Homo sapiens
ttgattaagaaaggaag

SEQ ID NO: 5037159 - DNA, 15 bp, Homo sapiens
ttgtatttaaggatt

SEQ ID NO: 5037160 - DNA, 18 bp, Homo sapiens
ttgtgtcccttggtcctg

SEQ ID NO: 5037161 - DNA, 23 bp, Homo sapiens
agcaattctcctgcctcagcctc

SEQ ID NO: 5037162 - DNA, 20 bp, Homo sapiens
aggcttccctgacttgcttt

SEQ ID NO: 5037163 - DNA, 22 bp, Homo sapiens
aaaaatgggagacagcctctta

SEQ ID NO: 5037164 - DNA, 15 bp, Homo sapiens
aaaacactgccctct

SEQ ID NO: 5037165 - DNA, 20 bp, Homo sapiens
aaaaggttgcctgaaaaatg

SEQ ID NO: 5037166 - DNA, 17 bp, Homo sapiens
aaatctcttctttgctg

SEQ ID NO: 5037167 - DNA, 17 bp, Homo sapiens
aaatgggagacagcctc

SEQ ID NO: 5037168 - DNA, 17 bp, Homo sapiens
aagagatgagaaatgat

SEQ ID NO: 5037169 - DNA, 23 bp, Homo sapiens
aagaggccacttagggaaagatg

SEQ ID NO: 5037170 - DNA, 13 bp, Homo sapiens
aaggaataaatga

SEQ ID NO: 5037171 - DNA, 18 bp, Homo sapiens
aagggacttaacttgttt

SEQ ID NO: 5037172 - DNA, 14 bp, Homo sapiens
aatactttatttct

SEQ ID NO: 5037173 - DNA, 12 bp, Homo sapiens
aatcttctactt

SEQ ID NO: 5037174 - DNA, 18 bp, Homo sapiens
aatgggagacagcctctt

SEQ ID NO: 5037175 - DNA, 12 bp, Homo sapiens
acaaaaaatact

SEQ ID NO: 5037176 - DNA, 17 bp, Homo sapiens
acaaattttcagaaggt

SEQ ID NO: 5037177 - DNA, 13 bp, Homo sapiens
acaaggaataaat

SEQ ID NO: 5037178 - DNA, 12 bp, Homo sapiens
acacattccttt

SEQ ID NO: 5037179 - DNA, 15 bp, Homo sapiens
acactgccctcttgt

SEQ ID NO: 5037180 - DNA, 20 bp, Homo sapiens
acccaggctggagtgcagtg

SEQ ID NO: 5037181 - DNA, 19 bp, Homo sapiens
acctctctgtagtttatgg

SEQ ID NO: 5037182 - DNA, 13 bp, Homo sapiens
actaatttttgta

SEQ ID NO: 5037183 - DNA, 19 bp, Homo sapiens
actctccaatgttctatta

SEQ ID NO: 5037184 - DNA, 23 bp, Homo sapiens
actggcactggtggtttttgctc

SEQ ID NO: 5037185 - DNA, 11 bp, Homo sapiens
agaaaatgaag

SEQ ID NO: 5037186 - DNA, 19 bp, Homo sapiens
agaagagatgagaaatgat

SEQ ID NO: 5037187 - DNA, 13 bp, Homo sapiens
agaatatgataaa

SEQ ID NO: 5037188 - DNA, 16 bp, Homo sapiens
agagaaggaaaagact

SEQ ID NO: 5037189 - DNA, 14 bp, Homo sapiens
agagctaataaatc

SEQ ID NO: 5037190 - DNA, 18 bp, Homo sapiens
agataccttgaaaggaag

SEQ ID NO: 5037191 - DNA, 20 bp, Homo sapiens
agatgagaaatgatgaaaag

SEQ ID NO: 5037192 - DNA, 16 bp, Homo sapiens
agatgctagaaaaatg

SEQ ID NO: 5037193 - DNA, 23 bp, Homo sapiens
agccatctaatgcttgtttatga

SEQ ID NO: 5037194 - DNA, 13 bp, Homo sapiens
agcttttgttgtt

SEQ ID NO: 5037195 - DNA, 21 bp, Homo sapiens
aggaaatagtaccttcaatac

SEQ ID NO: 5037196 - DNA, 21 bp, Homo sapiens
aggaataaatgagagggaatc

SEQ ID NO: 5037197 - DNA, 12 bp, Homo sapiens
aggcgtgatcca

SEQ ID NO: 5037198 - DNA, 19 bp, Homo sapiens
agggaaagatgtagaaaga

SEQ ID NO: 5037199 - DNA, 13 bp, Homo sapiens
agggaattgctca

SEQ ID NO: 5037200 - DNA, 20 bp, Homo sapiens
agggattggaccgagctgga

SEQ ID NO: 5037201 - DNA, 16 bp, Homo sapiens
agtcatctactttttt

SEQ ID NO: 5037202 - DNA, 23 bp, Homo sapiens
agttagccatctaatgcttgttt

SEQ ID NO: 5037203 - DNA, 20 bp, Homo sapiens
agttttagggtacagtttgg

SEQ ID NO: 5037204 - DNA, 14 bp, Homo sapiens
ataaatctcttctt

SEQ ID NO: 5037205 - DNA, 16 bp, Homo sapiens
ataatagtcaatttct

SEQ ID NO: 5037206 - DNA, 17 bp, Homo sapiens
atagtcaatttctactt

SEQ ID NO: 5037207 - DNA, 14 bp, Homo sapiens
atatttcttgcttt

SEQ ID NO: 5037208 - DNA, 18 bp, Homo sapiens
atccgcctacctcagcct

SEQ ID NO: 5037209 - DNA, 17 bp, Homo sapiens
atctaatgcttgtttat

SEQ ID NO: 5037210 - DNA, 19 bp, Homo sapiens
atctcggctcactgcaacc

SEQ ID NO: 5037211 - DNA, 17 bp, Homo sapiens
atctgaattaaataaat

SEQ ID NO: 5037212 - DNA, 22 bp, Homo sapiens
atcttcactgcaattttgtgta

SEQ ID NO: 5037213 - DNA, 23 bp, Homo sapiens
atctttccaggcttccctgactt

SEQ ID NO: 5037214 - DNA, 21 bp, Homo sapiens
atgaaaaggttgcctgaaaaa

SEQ ID NO: 5037215 - DNA, 19 bp, Homo sapiens
atgaattcaagaaaggaaa

SEQ ID NO: 5037216 - DNA, 18 bp, Homo sapiens
atgatgaaaaggttgcct

SEQ ID NO: 5037217 - DNA, 12 bp, Homo sapiens
atgcttgtttat

SEQ ID NO: 5037218 - DNA, 17 bp, Homo sapiens
atgcttgtttatgatat

SEQ ID NO: 5037219 - DNA, 14 bp, Homo sapiens
atggcagaagggaa

SEQ ID NO: 5037220 - DNA, 13 bp, Homo sapiens
attcaagaaagga

SEQ ID NO: 5037221 - DNA, 20 bp, Homo sapiens
attcgtgcatttttggatca

SEQ ID NO: 5037222 - DNA, 20 bp, Homo sapiens
attctcctgcctcagcctcc

SEQ ID NO: 5037223 - DNA, 20 bp, Homo sapiens
atttctcaaagatctgaatt

SEQ ID NO: 5037224 - DNA, 11 bp, Homo sapiens
atttcttgctt

SEQ ID NO: 5037225 - DNA, 23 bp, Homo sapiens
caaagatctgaattaaataaata

SEQ ID NO: 5037226 - DNA, 20 bp, Homo sapiens
caaatctgggtatctttcca

SEQ ID NO: 5037227 - DNA, 20 bp, Homo sapiens
caacctctgcctcccaggtt

SEQ ID NO: 5037228 - DNA, 22 bp, Homo sapiens
caagaggccacttagggaaaga

SEQ ID NO: 5037229 - DNA, 14 bp, Homo sapiens
caaggaataaatga

SEQ ID NO: 5037230 - DNA, 14 bp, Homo sapiens
caataaatccacac

SEQ ID NO: 5037231 - DNA, 16 bp, Homo sapiens
caattctcctgcctca

SEQ ID NO: 5037232 - DNA, 15 bp, Homo sapiens
cacaaggaataaatg

SEQ ID NO: 5037233 - DNA, 19 bp, Homo sapiens
cactggtggtttttgctct

SEQ ID NO: 5037234 - DNA, 17 bp, Homo sapiens
cagggaacacattcctt

SEQ ID NO: 5037235 - DNA, 18 bp, Homo sapiens
cagtttgaaaatattttg

SEQ ID NO: 5037236 - DNA, 14 bp, Homo sapiens
catataaccaaaat

SEQ ID NO: 5037237 - DNA, 17 bp, Homo sapiens
catctaatgcttgttta

SEQ ID NO: 5037238 - DNA, 19 bp, Homo sapiens
catctaatgcttgtttatg

SEQ ID NO: 5037239 - DNA, 18 bp, Homo sapiens
ccaacatctccagctgga

SEQ ID NO: 5037240 - DNA, 19 bp, Homo sapiens
ccaattacacacagcggga

SEQ ID NO: 5037241 - DNA, 19 bp, Homo sapiens
ccatctaatgcttgtttat

SEQ ID NO: 5037242 - DNA, 14 bp, Homo sapiens
ccgactgggctcaa

SEQ ID NO: 5037243 - DNA, 14 bp, Homo sapiens
ccgagctggaaaac

SEQ ID NO: 5037244 - DNA, 23 bp, Homo sapiens
cctctctgtagtttatggcagaa

SEQ ID NO: 5037245 - DNA, 14 bp, Homo sapiens
cctgacttgcttta

SEQ ID NO: 5037246 - DNA, 13 bp, Homo sapiens
cctgcctcagcct

SEQ ID NO: 5037247 - DNA, 13 bp, Homo sapiens
ccttgaaaggaag

SEQ ID NO: 5037248 - DNA, 11 bp, Homo sapiens
cgcctgccatc

SEQ ID NO: 5037249 - DNA, 14 bp, Homo sapiens
cgtacatctgcaat

SEQ ID NO: 5037250 - DNA, 17 bp, Homo sapiens
ctaatgcttgtttatga

SEQ ID NO: 5037251 - DNA, 13 bp, Homo sapiens
ctaatttttgtat

SEQ ID NO: 5037252 - DNA, 13 bp, Homo sapiens
ctacctcagcctc

SEQ ID NO: 5037253 - DNA, 20 bp, Homo sapiens
ctcagagaaggaaaagactg

SEQ ID NO: 5037254 - DNA, 22 bp, Homo sapiens
ctcagcctcccaaagtgctggg

SEQ ID NO: 5037255 - DNA, 16 bp, Homo sapiens
ctcctgcctcagcctc

SEQ ID NO: 5037256 - DNA, 18 bp, Homo sapiens
ctctgtagtttatggcag

SEQ ID NO: 5037257 - DNA, 15 bp, Homo sapiens
ctctgttacccaggc

SEQ ID NO: 5037258 - DNA, 16 bp, Homo sapiens
ctgcaacctctgcctc

SEQ ID NO: 5037259 - DNA, 14 bp, Homo sapiens
ctgcctcccaggtt

SEQ ID NO: 5037260 - DNA, 22 bp, Homo sapiens
ctgggatgacaggcgcctgcca

SEQ ID NO: 5037261 - DNA, 14 bp, Homo sapiens
cttagggaaagatg

SEQ ID NO: 5037262 - DNA, 19 bp, Homo sapiens
cttcactgcaattttgtgt

SEQ ID NO: 5037263 - DNA, 17 bp, Homo sapiens
cttccctgacttgcttt

SEQ ID NO: 5037264 - DNA, 18 bp, Homo sapiens
cttgggcaactgcagtga

SEQ ID NO: 5037265 - DNA, 11 bp, Homo sapiens
ctttatttctg

SEQ ID NO: 5037266 - DNA, 14 bp, Homo sapiens
cttttgttgtttat

SEQ ID NO: 5037267 - DNA, 14 bp, Homo sapiens
gaaaatgaagggat

SEQ ID NO: 5037268 - DNA, 19 bp, Homo sapiens
gaaatagtaccttcaatac

SEQ ID NO: 5037269 - DNA, 17 bp, Homo sapiens
gaattcaagaaaggaaa

SEQ ID NO: 5037270 - DNA, 11 bp, Homo sapiens
gacttgcttta

SEQ ID NO: 5037271 - DNA, 18 bp, Homo sapiens
gagatgagaaatgatgaa

SEQ ID NO: 5037272 - DNA, 22 bp, Homo sapiens
gagatgagaaatgatgaaaagg

SEQ ID NO: 5037273 - DNA, 16 bp, Homo sapiens
gatatttcttgctttc

SEQ ID NO: 5037274 - DNA, 21 bp, Homo sapiens
gatccgcctacctcagcctcc

SEQ ID NO: 5037275 - DNA, 20 bp, Homo sapiens
gatgacaggcgcctgccatc

SEQ ID NO: 5037276 - DNA, 13 bp, Homo sapiens
gcagaagggaatt

SEQ ID NO: 5037277 - DNA, 14 bp, Homo sapiens
gcagtcatctactt

SEQ ID NO: 5037278 - DNA, 14 bp, Homo sapiens
gcagtcttgctctg

SEQ ID NO: 5037279 - DNA, 16 bp, Homo sapiens
gcataatagtcaattt

SEQ ID NO: 5037280 - DNA, 21 bp, Homo sapiens
gcattgaaagaagagatgaga

SEQ ID NO: 5037281 - DNA, 18 bp, Homo sapiens
gccaagaaaatgaaggga

SEQ ID NO: 5037282 - DNA, 18 bp, Homo sapiens
gccatctaatgcttgttt

SEQ ID NO: 5037283 - DNA, 22 bp, Homo sapiens
gcccacagggaacacattcctt

SEQ ID NO: 5037284 - DNA, 11 bp, Homo sapiens
gctaataaatc

SEQ ID NO: 5037285 - DNA, 17 bp, Homo sapiens
gctaataaatctcttct

SEQ ID NO: 5037286 - DNA, 18 bp, Homo sapiens
gcttccctgacttgcttt

SEQ ID NO: 5037287 - DNA, 21 bp, Homo sapiens
ggaagtgccaaagcctggggc

SEQ ID NO: 5037288 - DNA, 19 bp, Homo sapiens
ggatgacaggcgcctgcca

SEQ ID NO: 5037289 - DNA, 20 bp, Homo sapiens
ggctgggtgtttcagtttga

SEQ ID NO: 5037290 - DNA, 12 bp, Homo sapiens
gggagaacgcag

SEQ ID NO: 5037291 - DNA, 15 bp, Homo sapiens
gggcaactgcagtga

SEQ ID NO: 5037292 - DNA, 13 bp, Homo sapiens
ggtttttgctctc

SEQ ID NO: 5037293 - DNA, 18 bp, Homo sapiens
gtacatctgcaatatgaa

SEQ ID NO: 5037294 - DNA, 16 bp, Homo sapiens
gtatcattcaactctc

SEQ ID NO: 5037295 - DNA, 20 bp, Homo sapiens
gttacccaggctggagtgca

SEQ ID NO: 5037296 - DNA, 21 bp, Homo sapiens
gtttatgatatttcttgcttt

SEQ ID NO: 5037297 - DNA, 14 bp, Homo sapiens
taaaattcatttct

SEQ ID NO: 5037298 - DNA, 17 bp, Homo sapiens
taaataaaattcatttc

SEQ ID NO: 5037299 - DNA, 19 bp, Homo sapiens
taagggacttaacttgttt

SEQ ID NO: 5037300 - DNA, 19 bp, Homo sapiens
tacatctgcaatatgaatt

SEQ ID NO: 5037301 - DNA, 15 bp, Homo sapiens
taccttgaaaggaag

SEQ ID NO: 5037302 - DNA, 16 bp, Homo sapiens
tagtcaatttctactt

SEQ ID NO: 5037303 - DNA, 20 bp, Homo sapiens
tatccacaatagctgacggc

SEQ ID NO: 5037304 - DNA, 19 bp, Homo sapiens
tatgatatttcttgctttc

SEQ ID NO: 5037305 - DNA, 14 bp, Homo sapiens
tatttcttgctttc

SEQ ID NO: 5037306 - DNA, 18 bp, Homo sapiens
tcactgcaacctctgcct

SEQ ID NO: 5037307 - DNA, 13 bp, Homo sapiens
tcatctacttttt

SEQ ID NO: 5037308 - DNA, 21 bp, Homo sapiens
tcatcttcactgcaattttgt

SEQ ID NO: 5037309 - DNA, 18 bp, Homo sapiens
tccacaaggaataaatga

SEQ ID NO: 5037310 - DNA, 18 bp, Homo sapiens
tccagcaattctcctgcc

SEQ ID NO: 5037311 - DNA, 15 bp, Homo sapiens
tcccaggttccagca

SEQ ID NO: 5037312 - DNA, 16 bp, Homo sapiens
tccctgacttgcttta

SEQ ID NO: 5037313 - DNA, 14 bp, Homo sapiens
tctaatgcttgttt

SEQ ID NO: 5037314 - DNA, 16 bp, Homo sapiens
tctgggtatctttcca

SEQ ID NO: 5037315 - DNA, 15 bp, Homo sapiens
tcttcactgcaattt

SEQ ID NO: 5037316 - DNA, 20 bp, Homo sapiens
tcttcactgcaattttgtgt

SEQ ID NO: 5037317 - DNA, 12 bp, Homo sapiens
tctttccaggct

SEQ ID NO: 5037318 - DNA, 17 bp, Homo sapiens
tgatatttcttgctttc

SEQ ID NO: 5037319 - DNA, 19 bp, Homo sapiens
tgatccgcctacctcagcc

SEQ ID NO: 5037320 - DNA, 20 bp, Homo sapiens
tgcatttttggatcattttt

SEQ ID NO: 5037321 - DNA, 16 bp, Homo sapiens
tgccaagaaaatgaag

SEQ ID NO: 5037322 - DNA, 16 bp, Homo sapiens
tgccatcatgcctgac

SEQ ID NO: 5037323 - DNA, 13 bp, Homo sapiens
tgccctaagggac

SEQ ID NO: 5037324 - DNA, 14 bp, Homo sapiens
tgctcagagaagga

SEQ ID NO: 5037325 - DNA, 17 bp, Homo sapiens
tgctctgttacccaggc

SEQ ID NO: 5037326 - DNA, 18 bp, Homo sapiens
tgctgcagtcatctactt

SEQ ID NO: 5037327 - DNA, 13 bp, Homo sapiens
tgcttgtttatga

SEQ ID NO: 5037328 - DNA, 14 bp, Homo sapiens
tgcttgtttatgat

SEQ ID NO: 5037329 - DNA, 19 bp, Homo sapiens
tgctttcaattacaaagca

SEQ ID NO: 5037330 - DNA, 15 bp, Homo sapiens
tggcagaagggaatt

SEQ ID NO: 5037331 - DNA, 20 bp, Homo sapiens
tggcataatagtcaatttct

SEQ ID NO: 5037332 - DNA, 15 bp, Homo sapiens
tggtcagcttttgtt

SEQ ID NO: 5037333 - DNA, 16 bp, Homo sapiens
tggtggtttttgctct

SEQ ID NO: 5037334 - DNA, 14 bp, Homo sapiens
tggtttttgctctc

SEQ ID NO: 5037335 - DNA, 16 bp, Homo sapiens
tgtgtttttctttttc

SEQ ID NO: 5037336 - DNA, 21 bp, Homo sapiens
tgttctattaatcacctctct

SEQ ID NO: 5037337 - DNA, 22 bp, Homo sapiens
tgttctattaatcacctctctg

SEQ ID NO: 5037338 - DNA, 16 bp, Homo sapiens
tgttgccttcatcttc

SEQ ID NO: 5037339 - DNA, 21 bp, Homo sapiens
tgtttatatacagtacacaga

SEQ ID NO: 5037340 - DNA, 19 bp, Homo sapiens
ttaacttgtttggtagtta

SEQ ID NO: 5037341 - DNA, 23 bp, Homo sapiens
ttatatacagtacacagatacct

SEQ ID NO: 5037342 - DNA, 14 bp, Homo sapiens
ttatgatatttctt

SEQ ID NO: 5037343 - DNA, 18 bp, Homo sapiens
ttcaaggagaatatgata

SEQ ID NO: 5037344 - DNA, 21 bp, Homo sapiens
ttcaattacaaagcagttact

SEQ ID NO: 5037345 - DNA, 21 bp, Homo sapiens
ttcagtttgaaaatattttgt

SEQ ID NO: 5037346 - DNA, 22 bp, Homo sapiens
ttccagcaattctcctgcctca

SEQ ID NO: 5037347 - DNA, 23 bp, Homo sapiens
ttccaggcttccctgacttgctt

SEQ ID NO: 5037348 - DNA, 17 bp, Homo sapiens
ttccctgacttgcttta

SEQ ID NO: 5037349 - DNA, 18 bp, Homo sapiens
ttctcaaagatctgaatt

SEQ ID NO: 5037350 - DNA, 15 bp, Homo sapiens
ttgccaagaaaatga

SEQ ID NO: 5037351 - DNA, 13 bp, Homo sapiens
ttgctaaactgat

SEQ ID NO: 5037352 - DNA, 17 bp, Homo sapiens
ttgctcagagaaggaaa

SEQ ID NO: 5037353 - DNA, 16 bp, Homo sapiens
ttggggtacaattgta

SEQ ID NO: 5037354 - DNA, 12 bp, Homo sapiens
ttggtcagcttt

SEQ ID NO: 5037355 - DNA, 18 bp, Homo sapiens
ttgtttatgatatttctt

SEQ ID NO: 5037356 - DNA, 16 bp, Homo sapiens
tttggtgaacagtttt

SEQ ID NO: 5037357 - DNA, 15 bp, Homo sapiens
ttttaagatttgtgt

SEQ ID NO: 5037358 - DNA, 12 bp, Homo sapiens
tttttaactgat

SEQ ID NO: 5037359 - DNA, 21 bp, Homo sapiens
tttttccacaaggaataaatg

SEQ ID NO: 5037360 - DNA, 17 bp, Homo sapiens
ctcttggtcagcttttg

SEQ ID NO: 5037361 - DNA, 23 bp, Homo sapiens
ctcttgtggtgcattgaaagaag

SEQ ID NO: 5037362 - DNA, 13 bp, Homo sapiens
ctgaaaaatggga

SEQ ID NO: 5037363 - DNA, 13 bp, Homo sapiens
ctgacttgcttta

SEQ ID NO: 5037364 - DNA, 17 bp, Homo sapiens
ctggtggtttttgctct

SEQ ID NO: 5037365 - DNA, 13 bp, Homo sapiens
ctgtagtttatgg

SEQ ID NO: 5037366 - DNA, 12 bp, Homo sapiens
cttagggaaaga

SEQ ID NO: 5037367 - DNA, 17 bp, Homo sapiens
cttcaatacttaaaaat

SEQ ID NO: 5037368 - DNA, 18 bp, Homo sapiens
cttccctgacttgcttta

SEQ ID NO: 5037369 - DNA, 17 bp, Homo sapiens
cttgcaatcttctactt

SEQ ID NO: 5037370 - DNA, 15 bp, Homo sapiens
ctttatcattgctaa

SEQ ID NO: 5037371 - DNA, 12 bp, Homo sapiens
ctttttccacaa

SEQ ID NO: 5037372 - DNA, 20 bp, Homo sapiens
gaaaaatgggagacagcctc

SEQ ID NO: 5037373 - DNA, 15 bp, Homo sapiens
gaaaaatgttcttta

SEQ ID NO: 5037374 - DNA, 13 bp, Homo sapiens
gaacacattcctt

SEQ ID NO: 5037375 - DNA, 15 bp, Homo sapiens
gaagcagtcttgctc

SEQ ID NO: 5037376 - DNA, 23 bp, Homo sapiens
gaagggaattgctcagagaagga

SEQ ID NO: 5037377 - DNA, 23 bp, Homo sapiens
gacggctgggtgtttcagtttga

SEQ ID NO: 5037378 - DNA, 20 bp, Homo sapiens
gagataaaccaataaatcca

SEQ ID NO: 5037379 - DNA, 17 bp, Homo sapiens
gcaccggctgcccacag

SEQ ID NO: 5037380 - DNA, 19 bp, Homo sapiens
gccatctaatgcttgttta

SEQ ID NO: 5037381 - DNA, 20 bp, Homo sapiens
gcccttgcaatcttctactt

SEQ ID NO: 5037382 - DNA, 17 bp, Homo sapiens
gcctcccagcccaacat

SEQ ID NO: 5037383 - DNA, 12 bp, Homo sapiens
gcctcccaggtt

SEQ ID NO: 5037384 - DNA, 14 bp, Homo sapiens
gcgcctctcctggg

SEQ ID NO: 5037385 - DNA, 20 bp, Homo sapiens
gcgtttcaccatgttggcca

SEQ ID NO: 5037386 - DNA, 18 bp, Homo sapiens
gctagaaaaatgttcttt

SEQ ID NO: 5037387 - DNA, 12 bp, Homo sapiens
ggagaatatgat

SEQ ID NO: 5037388 - DNA, 14 bp, Homo sapiens
ggcagaagggaatt

SEQ ID NO: 5037389 - DNA, 23 bp, Homo sapiens
ggctaggtatcattcaactctcc

SEQ ID NO: 5037390 - DNA, 14 bp, Homo sapiens
gggcaaagctgtgt

SEQ ID NO: 5037391 - DNA, 23 bp, Homo sapiens
gggcaactgcagtgaccaggggc

SEQ ID NO: 5037392 - DNA, 20 bp, Homo sapiens
ggtgatccgcctacctcagc

SEQ ID NO: 5037393 - DNA, 19 bp, Homo sapiens
gtcagcttttgttgtttat

SEQ ID NO: 5037394 - DNA, 17 bp, Homo sapiens
gtcatctcattccactg

SEQ ID NO: 5037395 - DNA, 20 bp, Homo sapiens
gtgctgggattacaggcgtg

SEQ ID NO: 5037396 - DNA, 15 bp, Homo sapiens
gttacccaggctgga

SEQ ID NO: 5037397 - DNA, 18 bp, Homo sapiens
gtttttctttttccacaa

SEQ ID NO: 5037398 - DNA, 23 bp, Homo sapiens
taagatttgtgtttttctttttc

SEQ ID NO: 5037399 - DNA, 19 bp, Homo sapiens
tacctgccctaagggactt

SEQ ID NO: 5037400 - DNA, 15 bp, Homo sapiens
taccttcaatactta

SEQ ID NO: 5037401 - DNA, 14 bp, Homo sapiens
tactttatttctga

SEQ ID NO: 5037402 - DNA, 19 bp, Homo sapiens
tagtcaatttctacttctg

SEQ ID NO: 5037403 - DNA, 20 bp, Homo sapiens
tagttagccatctaatgctt

SEQ ID NO: 5037404 - DNA, 23 bp, Homo sapiens
tatacaaattttcagaaggttat

SEQ ID NO: 5037405 - DNA, 18 bp, Homo sapiens
tatgaattcaagaaagga

SEQ ID NO: 5037406 - DNA, 13 bp, Homo sapiens
tatgatatttctt

SEQ ID NO: 5037407 - DNA, 20 bp, Homo sapiens
tcaaactcctgacctcaggt

SEQ ID NO: 5037408 - DNA, 16 bp, Homo sapiens
tcaaggagaatatgat

SEQ ID NO: 5037409 - DNA, 18 bp, Homo sapiens
tcactgcaattttgtgta

SEQ ID NO: 5037410 - DNA, 21 bp, Homo sapiens
tcagtttgaaaatattttgtt

SEQ ID NO: 5037411 - DNA, 23 bp, Homo sapiens
tcattcaactctccaatgttcta

SEQ ID NO: 5037412 - DNA, 16 bp, Homo sapiens
tcattgctaaactgat

SEQ ID NO: 5037413 - DNA, 17 bp, Homo sapiens
tcattgctaaactgatg

SEQ ID NO: 5037414 - DNA, 21 bp, Homo sapiens
tccagcaattctcctgcctca

SEQ ID NO: 5037415 - DNA, 14 bp, Homo sapiens
tccctgacttgctt

SEQ ID NO: 5037416 - DNA, 15 bp, Homo sapiens
tccctgacttgcttt

SEQ ID NO: 5037417 - DNA, 18 bp, Homo sapiens
tccgcctacctcagcctc

SEQ ID NO: 5037418 - DNA, 20 bp, Homo sapiens
tctaatgcttgtttatgata

SEQ ID NO: 5037419 - DNA, 16 bp, Homo sapiens
tctacacaatttaatt

SEQ ID NO: 5037420 - DNA, 15 bp, Homo sapiens
tctcctgcctcagcc

SEQ ID NO: 5037421 - DNA, 20 bp, Homo sapiens
tcttccacaaaaaatacttt

SEQ ID NO: 5037422 - DNA, 22 bp, Homo sapiens
tctttgctgcagtcatctactt

SEQ ID NO: 5037423 - DNA, 17 bp, Homo sapiens
tgaaaaggttgcctgaa

SEQ ID NO: 5037424 - DNA, 22 bp, Homo sapiens
tgaaaggaagagctaataaatc

SEQ ID NO: 5037425 - DNA, 13 bp, Homo sapiens
tgaagcagtcttg

SEQ ID NO: 5037426 - DNA, 12 bp, Homo sapiens
tgacttgcttta

SEQ ID NO: 5037427 - DNA, 15 bp, Homo sapiens
tgacttgctttagtt

SEQ ID NO: 5037428 - DNA, 16 bp, Homo sapiens
tgatatttcttgcttt

SEQ ID NO: 5037429 - DNA, 16 bp, Homo sapiens
tgcaacctctgcctcc

SEQ ID NO: 5037430 - DNA, 14 bp, Homo sapiens
tgccaagaaaatga

SEQ ID NO: 5037431 - DNA, 15 bp, Homo sapiens
tgccatcatgcctga

SEQ ID NO: 5037432 - DNA, 16 bp, Homo sapiens
tgcctgactaattttt

SEQ ID NO: 5037433 - DNA, 20 bp, Homo sapiens
tgcctgactaatttttgtat

SEQ ID NO: 5037434 - DNA, 18 bp, Homo sapiens
tgccttcatcttcactgc

SEQ ID NO: 5037435 - DNA, 18 bp, Homo sapiens
tgcttgtttatgatattt

SEQ ID NO: 5037436 - DNA, 14 bp, Homo sapiens
tggaaaacctcctt

SEQ ID NO: 5037437 - DNA, 23 bp, Homo sapiens
tgggatgacaggcgcctgccatc

SEQ ID NO: 5037438 - DNA, 14 bp, Homo sapiens
tgtgtaaatttctc

SEQ ID NO: 5037439 - DNA, 14 bp, Homo sapiens
tgtgtttttctttt

SEQ ID NO: 5037440 - DNA, 14 bp, Homo sapiens
tgttggccaggctg

SEQ ID NO: 5037441 - DNA, 22 bp, Homo sapiens
tgtttatgatatttcttgcttt

SEQ ID NO: 5037442 - DNA, 23 bp, Homo sapiens
tgtttatgatatttcttgctttc

SEQ ID NO: 5037443 - DNA, 19 bp, Homo sapiens
tgtttttctttttccacaa

SEQ ID NO: 5037444 - DNA, 20 bp, Homo sapiens
ttagccatctaatgcttgtt

SEQ ID NO: 5037445 - DNA, 16 bp, Homo sapiens
ttatggcagaagggaa

SEQ ID NO: 5037446 - DNA, 13 bp, Homo sapiens
ttcaagaaaggaa

SEQ ID NO: 5037447 - DNA, 15 bp, Homo sapiens
ttcactgcaattttg

SEQ ID NO: 5037448 - DNA, 14 bp, Homo sapiens
ttccagcaattctc

SEQ ID NO: 5037449 - DNA, 19 bp, Homo sapiens
ttccaggcttccctgactt

SEQ ID NO: 5037450 - DNA, 13 bp, Homo sapiens
ttcgtgcattttt

SEQ ID NO: 5037451 - DNA, 15 bp, Homo sapiens
ttcttgctttcaatt

SEQ ID NO: 5037452 - DNA, 23 bp, Homo sapiens
ttctttgctgcagtcatctactt

SEQ ID NO: 5037453 - DNA, 19 bp, Homo sapiens
ttgctgcagtcatctactt

SEQ ID NO: 5037454 - DNA, 20 bp, Homo sapiens
ttggcataatagtcaatttc

SEQ ID NO: 5037455 - DNA, 15 bp, Homo sapiens
ttggtcagcttttgt

SEQ ID NO: 5037456 - DNA, 21 bp, Homo sapiens
tttaactgattcttatgatta

SEQ ID NO: 5037457 - DNA, 15 bp, Homo sapiens
tttaagatttgtgtt

SEQ ID NO: 5037458 - DNA, 15 bp, Homo sapiens
tttatcaactttggt

SEQ ID NO: 5037459 - DNA, 21 bp, Homo sapiens
tttggatcatttttaactgat

SEQ ID NO: 5037460 - DNA, 21 bp, Homo sapiens
ttttcagaaggttattttctt

SEQ ID NO: 5037461 - DNA, 16 bp, Homo sapiens
tttttaactgattctt

SEQ ID NO: 5037462 - DNA, 21 bp, Homo sapiens
aggcttccctgacttgcttta

SEQ ID NO: 5037463 - DNA, 12 bp, Homo sapiens
agggaattgctc

SEQ ID NO: 5037464 - DNA, 20 bp, Homo sapiens
agtggtgtgatctcggctca

SEQ ID NO: 5037465 - DNA, 23 bp, Homo sapiens
ataatagtcaatttctacttctg

SEQ ID NO: 5037466 - DNA, 18 bp, Homo sapiens
atagtaccttcaatactt

SEQ ID NO: 5037467 - DNA, 13 bp, Homo sapiens
atatgataaaaca

SEQ ID NO: 5037468 - DNA, 13 bp, Homo sapiens
atatttcttgctt

SEQ ID NO: 5037469 - DNA, 13 bp, Homo sapiens
atcacctctctgt

SEQ ID NO: 5037470 - DNA, 22 bp, Homo sapiens
atcacctctctgtagtttatgg

SEQ ID NO: 5037471 - DNA, 19 bp, Homo sapiens
atccgcctacctcagcctc

SEQ ID NO: 5037472 - DNA, 23 bp, Homo sapiens
atctaatgcttgtttatgatatt

SEQ ID NO: 5037473 - DNA, 13 bp, Homo sapiens
atctacttttttt

SEQ ID NO: 5037474 - DNA, 20 bp, Homo sapiens
atgaattcaagaaaggaaat

SEQ ID NO: 5037475 - DNA, 15 bp, Homo sapiens
atgatatttcttgct

SEQ ID NO: 5037476 - DNA, 18 bp, Homo sapiens
atgatatttcttgctttc

SEQ ID NO: 5037477 - DNA, 11 bp, Homo sapiens
atgttctatta

SEQ ID NO: 5037478 - DNA, 17 bp, Homo sapiens
atgttggccaggctggt

SEQ ID NO: 5037479 - DNA, 18 bp, Homo sapiens
attcaaggagaatatgat

SEQ ID NO: 5037480 - DNA, 19 bp, Homo sapiens
attcaaggagaatatgata

SEQ ID NO: 5037481 - DNA, 13 bp, Homo sapiens
attctcctgcctc

SEQ ID NO: 5037482 - DNA, 15 bp, Homo sapiens
attctcctgcctcag

SEQ ID NO: 5037483 - DNA, 19 bp, Homo sapiens
atttgtgtttttctttttc

SEQ ID NO: 5037484 - DNA, 17 bp, Homo sapiens
caacatctccagctgga

SEQ ID NO: 5037485 - DNA, 15 bp, Homo sapiens
caacctctgcctccc

SEQ ID NO: 5037486 - DNA, 21 bp, Homo sapiens
caaggagaatatgataaaaca

SEQ ID NO: 5037487 - DNA, 21 bp, Homo sapiens
caattctcctgcctcagcctc

SEQ ID NO: 5037488 - DNA, 22 bp, Homo sapiens
caccgtacatctgcaatatgaa

SEQ ID NO: 5037489 - DNA, 14 bp, Homo sapiens
cactgcaacctctg

SEQ ID NO: 5037490 - DNA, 11 bp, Homo sapiens
cagaagggaat

SEQ ID NO: 5037491 - DNA, 18 bp, Homo sapiens
cagaagggaattgctcag

SEQ ID NO: 5037492 - DNA, 19 bp, Homo sapiens
cagataccttgaaaggaag

SEQ ID NO: 5037493 - DNA, 13 bp, Homo sapiens
cagcctcttactt

SEQ ID NO: 5037494 - DNA, 17 bp, Homo sapiens
catctccagctggatcc

SEQ ID NO: 5037495 - DNA, 15 bp, Homo sapiens
catcttcactgcaat

SEQ ID NO: 5037496 - DNA, 12 bp, Homo sapiens
cattgaaagaag

SEQ ID NO: 5037497 - DNA, 18 bp, Homo sapiens
cattgaaagaagagatga

SEQ ID NO: 5037498 - DNA, 14 bp, Homo sapiens
ccaagaaaatgaag

SEQ ID NO: 5037499 - DNA, 15 bp, Homo sapiens
ccacaaaaaatactt

SEQ ID NO: 5037500 - DNA, 24 bp, Homo sapiens
ccacaaggaataaatgagagggaa

SEQ ID NO: 5037501 - DNA, 19 bp, Homo sapiens
cctctctgtagtttatggc

SEQ ID NO: 5037502 - DNA, 20 bp, Homo sapiens
cgtacatctgcaatatgaat

SEQ ID NO: 5037503 - DNA, 16 bp, Homo sapiens
ctaatgcttgtttatg

SEQ ID NO: 5037504 - DNA, 15 bp, Homo sapiens
ctaatttttgtattt

SEQ ID NO: 5037505 - DNA, 20 bp, Homo sapiens
ctacttctggaagtcatctc

SEQ ID NO: 5037506 - DNA, 22 bp, Homo sapiens
ctaggtatcattcaactctcca

SEQ ID NO: 5037507 - DNA, 21 bp, Homo sapiens
ctatacaaattttcagaaggt

SEQ ID NO: 5037508 - DNA, 19 bp, Homo sapiens
ctattaatcacctctctgt

SEQ ID NO: 5037509 - DNA, 17 bp, Homo sapiens
ctcattccactgttggt

SEQ ID NO: 5037510 - DNA, 12 bp, Homo sapiens
ctgacttgcttt

SEQ ID NO: 5037511 - DNA, 15 bp, Homo sapiens
ctgcaacctctgcct

SEQ ID NO: 5037512 - DNA, 14 bp, Homo sapiens
ctggaaaacctcct

SEQ ID NO: 5037513 - DNA, 18 bp, Homo sapiens
cttagcctggatttcctt

SEQ ID NO: 5037514 - DNA, 22 bp, Homo sapiens
cttagggaaagatgtagaaaga

SEQ ID NO: 5037515 - DNA, 17 bp, Homo sapiens
cttgccaagaaaatgaa

SEQ ID NO: 5037516 - DNA, 19 bp, Homo sapiens
cttgctctgttacccaggc

SEQ ID NO: 5037517 - DNA, 16 bp, Homo sapiens
cttgtttatgatattt

SEQ ID NO: 5037518 - DNA, 23 bp, Homo sapiens
cttgtttatgatatttcttgctt

SEQ ID NO: 5037519 - DNA, 21 bp, Homo sapiens
ctttaaaggcatctacacaat

SEQ ID NO: 5037520 - DNA, 21 bp, Homo sapiens
ctttccaggcttccctgactt

SEQ ID NO: 5037521 - DNA, 18 bp, Homo sapiens
ctttggtgaacagttttg

SEQ ID NO: 5037522 - DNA, 15 bp, Homo sapiens
gacaggcgcctgcca

SEQ ID NO: 5037523 - DNA, 17 bp, Homo sapiens
gacggcgtttcaccatg

SEQ ID NO: 5037524 - DNA, 14 bp, Homo sapiens
gagatgagaaatga

SEQ ID NO: 5037525 - DNA, 14 bp, Homo sapiens
gagctaataaatct

SEQ ID NO: 5037526 - DNA, 16 bp, Homo sapiens
gaggccacttagggaa

SEQ ID NO: 5037527 - DNA, 14 bp, Homo sapiens
gatatttcttgctt

SEQ ID NO: 5037528 - DNA, 16 bp, Homo sapiens
gatctgaattaaataa

SEQ ID NO: 5037529 - DNA, 19 bp, Homo sapiens
gatgacaggcgcctgccat

SEQ ID NO: 5037530 - DNA, 18 bp, Homo sapiens
gatttgtgtttttctttt

SEQ ID NO: 5037531 - DNA, 13 bp, Homo sapiens
gcaacctctgcct

SEQ ID NO: 5037532 - DNA, 23 bp, Homo sapiens
gcaacctctgcctcccaggttcc

SEQ ID NO: 5037533 - DNA, 14 bp, Homo sapiens
gcaatcttctactt

SEQ ID NO: 5037534 - DNA, 12 bp, Homo sapiens
gcagtcttgctc

SEQ ID NO: 5037535 - DNA, 15 bp, Homo sapiens
gcctcttacttgcca

SEQ ID NO: 5037536 - DNA, 15 bp, Homo sapiens
gcctgaaaaatggga

SEQ ID NO: 5037537 - DNA, 21 bp, Homo sapiens
gcctgactaatttttgtattt

SEQ ID NO: 5037538 - DNA, 17 bp, Homo sapiens
gctcagagaaggaaaag

SEQ ID NO: 5037539 - DNA, 17 bp, Homo sapiens
gctctgttacccaggct

SEQ ID NO: 5037540 - DNA, 20 bp, Homo sapiens
gctggagtgcagtggtgtga

SEQ ID NO: 5037541 - DNA, 17 bp, Homo sapiens
gcttccctgacttgctt

SEQ ID NO: 5037542 - DNA, 19 bp, Homo sapiens
gcttccctgacttgcttta

SEQ ID NO: 5037543 - DNA, 14 bp, Homo sapiens
gcttttgttgttta

SEQ ID NO: 5037544 - DNA, 11 bp, Homo sapiens
ggcagaaggga

SEQ ID NO: 5037545 - DNA, 20 bp, Homo sapiens
ggctggagtgcagtggtgtg

SEQ ID NO: 5037546 - DNA, 20 bp, Homo sapiens
ggcttccctgacttgcttta

SEQ ID NO: 5037547 - DNA, 20 bp, Homo sapiens
gggattggaccgagctggaa

SEQ ID NO: 5037548 - DNA, 19 bp, Homo sapiens
ggtatcattcaactctcca

SEQ ID NO: 5037549 - DNA, 20 bp, Homo sapiens
ggttccagcaattctcctgc

SEQ ID NO: 5037550 - DNA, 12 bp, Homo sapiens
ggtttttgctct

SEQ ID NO: 5037551 - DNA, 15 bp, Homo sapiens
gtacatctgcaatat

SEQ ID NO: 5037552 - DNA, 17 bp, Homo sapiens
gtagctgggatgacagg

SEQ ID NO: 5037553 - DNA, 18 bp, Homo sapiens
gtagctgggatgacaggc

SEQ ID NO: 5037554 - DNA, 21 bp, Homo sapiens
gtagtttatggcagaagggaa

SEQ ID NO: 5037555 - DNA, 18 bp, Homo sapiens
gtcagcttttgttgttta

SEQ ID NO: 5037556 - DNA, 18 bp, Homo sapiens
gtcatctcattccactgt

SEQ ID NO: 5037557 - DNA, 22 bp, Homo sapiens
gtgatccgcctacctcagcctc

SEQ ID NO: 5037558 - DNA, 20 bp, Homo sapiens
gtgcatttttggatcatttt

SEQ ID NO: 5037559 - DNA, 17 bp, Homo sapiens
gtgccaaagcctggggc

SEQ ID NO: 5037560 - DNA, 16 bp, Homo sapiens
gttactaatatgccta

SEQ ID NO: 5037561 - DNA, 16 bp, Homo sapiens
gtttatggcagaaggg

SEQ ID NO: 5037562 - DNA, 16 bp, Homo sapiens
gtttggtagttagcca

SEQ ID NO: 5037563 - DNA, 14 bp, Homo sapiens
taaagttttagggt

SEQ ID NO: 5037564 - DNA, 15 bp, Homo sapiens
taaatctcttctttg

SEQ ID NO: 5037565 - DNA, 20 bp, Homo sapiens
taattcaaggagaatatgat

SEQ ID NO: 5037566 - DNA, 18 bp, Homo sapiens
tacagtacacagatacct

SEQ ID NO: 5037567 - DNA, 13 bp, Homo sapiens
tactttatttctg

SEQ ID NO: 5037568 - DNA, 21 bp, Homo sapiens
tatgaattcaagaaaggaaat

SEQ ID NO: 5037569 - DNA, 23 bp, Homo sapiens
tatggcagaagggaattgctcag

SEQ ID NO: 5037570 - DNA, 13 bp, Homo sapiens
tatttctgatcta

SEQ ID NO: 5037571 - DNA, 20 bp, Homo sapiens
tcaactctccaatgttctat

SEQ ID NO: 5037572 - DNA, 13 bp, Homo sapiens
tcaagaaaggaaa

SEQ ID NO: 5037573 - DNA, 17 bp, Homo sapiens
tcactgcaacctctgcc

SEQ ID NO: 5037574 - DNA, 21 bp, Homo sapiens
tcactgcaacctctgcctccc

SEQ ID NO: 5037575 - DNA, 21 bp, Homo sapiens
tcagagaaggaaaagactgaa

SEQ ID NO: 5037576 - DNA, 20 bp, Homo sapiens
tcagtttgaaaatattttgt

SEQ ID NO: 5037577 - DNA, 17 bp, Homo sapiens
tccacaaggaataaatg

SEQ ID NO: 5037578 - DNA, 20 bp, Homo sapiens
tccagctggatcccagggaa

SEQ ID NO: 5037579 - DNA, 22 bp, Homo sapiens
tcccagggaaatatcagccttg

SEQ ID NO: 5037580 - DNA, 15 bp, Homo sapiens
aagagctaataaatc

SEQ ID NO: 5037581 - DNA, 14 bp, Homo sapiens
aagcagtcttgctc

SEQ ID NO: 5037582 - DNA, 16 bp, Homo sapiens
aaggagaatatgataa

SEQ ID NO: 5037583 - DNA, 14 bp, Homo sapiens
aagggaattgctca

SEQ ID NO: 5037584 - DNA, 22 bp, Homo sapiens
aataaatctcttctttgctgca

SEQ ID NO: 5037585 - DNA, 19 bp, Homo sapiens
aattctcctgcctcagcct

SEQ ID NO: 5037586 - DNA, 23 bp, Homo sapiens
acacaatttaattcctcttttta

SEQ ID NO: 5037587 - DNA, 19 bp, Homo sapiens
acagggaacacattccttt

SEQ ID NO: 5037588 - DNA, 20 bp, Homo sapiens
acatctgcaatatgaattca

SEQ ID NO: 5037589 - DNA, 21 bp, Homo sapiens
acatgttatcaaatctgggta

SEQ ID NO: 5037590 - DNA, 16 bp, Homo sapiens
actgcaacctctgcct

SEQ ID NO: 5037591 - DNA, 13 bp, Homo sapiens
agaaaaatgttct

SEQ ID NO: 5037592 - DNA, 13 bp, Homo sapiens
agagaaggaaaag

SEQ ID NO: 5037593 - DNA, 16 bp, Homo sapiens
agagttttatcaactt

SEQ ID NO: 5037594 - DNA, 19 bp, Homo sapiens
agataccttgaaaggaaga

SEQ ID NO: 5037595 - DNA, 15 bp, Homo sapiens
agatgctgactggca

SEQ ID NO: 5037596 - DNA, 13 bp, Homo sapiens
agcagtcttgctc

SEQ ID NO: 5037597 - DNA, 15 bp, Homo sapiens
agcagtcttgctctg

SEQ ID NO: 5037598 - DNA, 12 bp, Homo sapiens
agctaataaatc

SEQ ID NO: 5037599 - DNA, 19 bp, Homo sapiens
agctaataaatctcttctt

SEQ ID NO: 5037600 - DNA, 20 bp, Homo sapiens
agctaataaatctcttcttt

SEQ ID NO: 5037601 - DNA, 19 bp, Homo sapiens
agggaacacattcctttgc

SEQ ID NO: 5037602 - DNA, 14 bp, Homo sapiens
agggtacagtttgg

SEQ ID NO: 5037603 - DNA, 17 bp, Homo sapiens
aggttgcctgaaaaatg

SEQ ID NO: 5037604 - DNA, 15 bp, Homo sapiens
agtaccactcttggt

SEQ ID NO: 5037605 - DNA, 13 bp, Homo sapiens
agtagctgggatg

SEQ ID NO: 5037606 - DNA, 20 bp, Homo sapiens
agtgctgggattacaggcgt

SEQ ID NO: 5037607 - DNA, 16 bp, Homo sapiens
ataaaattcatttcta

SEQ ID NO: 5037608 - DNA, 19 bp, Homo sapiens
atacaaattttcagaaggt

SEQ ID NO: 5037609 - DNA, 13 bp, Homo sapiens
atactttatttct

SEQ ID NO: 5037610 - DNA, 14 bp, Homo sapiens
atactttatttctg

SEQ ID NO: 5037611 - DNA, 15 bp, Homo sapiens
atatttcttgctttc

SEQ ID NO: 5037612 - DNA, 21 bp, Homo sapiens
atattttgttgccttcatctt

SEQ ID NO: 5037613 - DNA, 18 bp, Homo sapiens
atctgaattaaataaata

SEQ ID NO: 5037614 - DNA, 14 bp, Homo sapiens
atctgcaatatgaa

SEQ ID NO: 5037615 - DNA, 15 bp, Homo sapiens
atctgcaatatgaat

SEQ ID NO: 5037616 - DNA, 17 bp, Homo sapiens
atgaattcaagaaagga

SEQ ID NO: 5037617 - DNA, 12 bp, Homo sapiens
atgatatttctt

SEQ ID NO: 5037618 - DNA, 19 bp, Homo sapiens
atgcctagcacaagtacca

SEQ ID NO: 5037619 - DNA, 19 bp, Homo sapiens
atgcctgactaatttttgt

SEQ ID NO: 5037620 - DNA, 12 bp, Homo sapiens
atggcagaaggg

SEQ ID NO: 5037621 - DNA, 13 bp, Homo sapiens
atggcagaaggga

SEQ ID NO: 5037622 - DNA, 16 bp, Homo sapiens
atggcagaagggaatt

SEQ ID NO: 5037623 - DNA, 13 bp, Homo sapiens
attcctcttttta

SEQ ID NO: 5037624 - DNA, 18 bp, Homo sapiens
atttaattcctcttttta

SEQ ID NO: 5037625 - DNA, 23 bp, Homo sapiens
atttaattcctctttttagggct

SEQ ID NO: 5037626 - DNA, 13 bp, Homo sapiens
atttcttgctttc

SEQ ID NO: 5037627 - DNA, 18 bp, Homo sapiens
attttctttatcattgct

SEQ ID NO: 5037628 - DNA, 19 bp, Homo sapiens
caaagtgctgggattacag

SEQ ID NO: 5037629 - DNA, 16 bp, Homo sapiens
caaattttcagaaggt

SEQ ID NO: 5037630 - DNA, 16 bp, Homo sapiens
caaggaataaatgaga

SEQ ID NO: 5037631 - DNA, 21 bp, Homo sapiens
caatatgaattcaagaaagga

SEQ ID NO: 5037632 - DNA, 18 bp, Homo sapiens
cacaaggaataaatgaga

SEQ ID NO: 5037633 - DNA, 19 bp, Homo sapiens
cacagcgggagaacgcagt

SEQ ID NO: 5037634 - DNA, 15 bp, Homo sapiens
cagaagggaattgct

SEQ ID NO: 5037635 - DNA, 22 bp, Homo sapiens
cagagaaggaaaagactgaatc

SEQ ID NO: 5037636 - DNA, 20 bp, Homo sapiens
caggcttccctgacttgctt

SEQ ID NO: 5037637 - DNA, 11 bp, Homo sapiens
cagtcttgctc

SEQ ID NO: 5037638 - DNA, 18 bp, Homo sapiens
catctaatgcttgtttat

SEQ ID NO: 5037639 - DNA, 17 bp, Homo sapiens
catctgcaatatgaatt

SEQ ID NO: 5037640 - DNA, 17 bp, Homo sapiens
cattgaaagaagagatg

SEQ ID NO: 5037641 - DNA, 18 bp, Homo sapiens
ccaagaaaatgaagggat

SEQ ID NO: 5037642 - DNA, 17 bp, Homo sapiens
ccacagggcctcccagc

SEQ ID NO: 5037643 - DNA, 15 bp, Homo sapiens
ccaggctggtctcaa

SEQ ID NO: 5037644 - DNA, 19 bp, Homo sapiens
ccatgaccttggggtacaa

SEQ ID NO: 5037645 - DNA, 19 bp, Homo sapiens
cccaggctggagtgcagtg

SEQ ID NO: 5037646 - DNA, 20 bp, Homo sapiens
ccttctaacatgttatcaaa

SEQ ID NO: 5037647 - DNA, 20 bp, Homo sapiens
ctaacatgttatcaaatctg

SEQ ID NO: 5037648 - DNA, 16 bp, Homo sapiens
ctagagttttatcaac

SEQ ID NO: 5037649 - DNA, 11 bp, Homo sapiens
ctaggtatcat

SEQ ID NO: 5037650 - DNA, 21 bp, Homo sapiens
ctcaaactcctgacctcaggt

SEQ ID NO: 5037651 - DNA, 16 bp, Homo sapiens
ctcaaagatctgaatt

SEQ ID NO: 5037652 - DNA, 13 bp, Homo sapiens
ctccagctggatc

SEQ ID NO: 5037653 - DNA, 17 bp, Homo sapiens
ctctccaatgttctatt

SEQ ID NO: 5037654 - DNA, 15 bp, Homo sapiens
ctctgcctcccaggt

SEQ ID NO: 5037655 - DNA, 16 bp, Homo sapiens
ctctgcctcccaggtt

SEQ ID NO: 5037656 - DNA, 18 bp, Homo sapiens
aaaaatagtcttccacaa

SEQ ID NO: 5037657 - DNA, 20 bp, Homo sapiens
aaaaatgggagacagcctct

SEQ ID NO: 5037658 - DNA, 13 bp, Homo sapiens
aaaatgaagggat

SEQ ID NO: 5037659 - DNA, 18 bp, Homo sapiens
aaagatgctagaaaaatg

SEQ ID NO: 5037660 - DNA, 19 bp, Homo sapiens
aaatctgggtatctttcca

SEQ ID NO: 5037661 - DNA, 13 bp, Homo sapiens
aacacattccttt

SEQ ID NO: 5037662 - DNA, 15 bp, Homo sapiens
aacacattcctttgc

SEQ ID NO: 5037663 - DNA, 13 bp, Homo sapiens
aagtgctgggatt

SEQ ID NO: 5037664 - DNA, 23 bp, Homo sapiens
aataaataaaattcatttctaca

SEQ ID NO: 5037665 - DNA, 19 bp, Homo sapiens
aataaatctcttctttgct

SEQ ID NO: 5037666 - DNA, 22 bp, Homo sapiens
aatatgaattcaagaaaggaaa

SEQ ID NO: 5037667 - DNA, 20 bp, Homo sapiens
aattctcctgcctcagcctc

SEQ ID NO: 5037668 - DNA, 20 bp, Homo sapiens
aatttaattcctctttttag

SEQ ID NO: 5037669 - DNA, 14 bp, Homo sapiens
acaaggaataaatg

SEQ ID NO: 5037670 - DNA, 19 bp, Homo sapiens
acccaggctggagtgcagt

SEQ ID NO: 5037671 - DNA, 20 bp, Homo sapiens
acctctctgtagtttatggc

SEQ ID NO: 5037672 - DNA, 16 bp, Homo sapiens
actctccaatgttcta

SEQ ID NO: 5037673 - DNA, 17 bp, Homo sapiens
actgcaacctctgcctc

SEQ ID NO: 5037674 - DNA, 18 bp, Homo sapiens
actgcaacctctgcctcc

SEQ ID NO: 5037675 - DNA, 11 bp, Homo sapiens
agacagcctct

SEQ ID NO: 5037676 - DNA, 23 bp, Homo sapiens
agagaaggaaaagactgaatcta

SEQ ID NO: 5037677 - DNA, 21 bp, Homo sapiens
agagctaataaatctcttctt

SEQ ID NO: 5037678 - DNA, 16 bp, Homo sapiens
agcaattctcctgcct

SEQ ID NO: 5037679 - DNA, 18 bp, Homo sapiens
agcaattctcctgcctca

SEQ ID NO: 5037680 - DNA, 15 bp, Homo sapiens
agccacactgaaccc

SEQ ID NO: 5037681 - DNA, 19 bp, Homo sapiens
agccatctaatgcttgttt

SEQ ID NO: 5037682 - DNA, 16 bp, Homo sapiens
aggaagagctaataaa

SEQ ID NO: 5037683 - DNA, 14 bp, Homo sapiens
aggaataaatgaga

SEQ ID NO: 5037684 - DNA, 16 bp, Homo sapiens
agggacttaacttgtt

SEQ ID NO: 5037685 - DNA, 17 bp, Homo sapiens
agggcctcccagcccaa

SEQ ID NO: 5037686 - DNA, 23 bp, Homo sapiens
aggttattttctttatcattgct

SEQ ID NO: 5037687 - DNA, 12 bp, Homo sapiens
aggttgcctgaa

SEQ ID NO: 5037688 - DNA, 21 bp, Homo sapiens
agtagctgggatgacaggcgc

SEQ ID NO: 5037689 - DNA, 17 bp, Homo sapiens
agtttatggcagaaggg

SEQ ID NO: 5037690 - DNA, 15 bp, Homo sapiens
ataaaccaataaatc

SEQ ID NO: 5037691 - DNA, 19 bp, Homo sapiens
ataaataaaattcatttct

SEQ ID NO: 5037692 - DNA, 12 bp, Homo sapiens
atacagtacaca

SEQ ID NO: 5037693 - DNA, 15 bp, Homo sapiens
atactttatttctga

SEQ ID NO: 5037694 - DNA, 14 bp, Homo sapiens
atagtcttccacaa

SEQ ID NO: 5037695 - DNA, 22 bp, Homo sapiens
atatcagccttgggcaactgca

SEQ ID NO: 5037696 - DNA, 20 bp, Homo sapiens
atatttcttgctttcaatta

SEQ ID NO: 5037697 - DNA, 15 bp, Homo sapiens
atctgggtatctttc

SEQ ID NO: 5037698 - DNA, 21 bp, Homo sapiens
atgacaggcgcctgccatcat

SEQ ID NO: 5037699 - DNA, 17 bp, Homo sapiens
atgaccttggggtacaa

SEQ ID NO: 5037700 - DNA, 20 bp, Homo sapiens
atgcctgactaatttttgta

SEQ ID NO: 5037701 - DNA, 19 bp, Homo sapiens
atgctagaaaaatgttctt

SEQ ID NO: 5037702 - DNA, 22 bp, Homo sapiens
atgcttgtttatgatatttctt

SEQ ID NO: 5037703 - DNA, 18 bp, Homo sapiens
atgttctattaatcacct

SEQ ID NO: 5037704 - DNA, 14 bp, Homo sapiens
attaaataaataaa

SEQ ID NO: 5037705 - DNA, 18 bp, Homo sapiens
attaatcacctctctgta

SEQ ID NO: 5037706 - DNA, 20 bp, Homo sapiens
attcaaggagaatatgataa

SEQ ID NO: 5037707 - DNA, 12 bp, Homo sapiens
atttcttgcttt

SEQ ID NO: 5037708 - DNA, 13 bp, Homo sapiens
atttgtgtttttc

SEQ ID NO: 5037709 - DNA, 20 bp, Homo sapiens
attttgtgtaaatttctcaa

SEQ ID NO: 5037710 - DNA, 13 bp, Homo sapiens
attttgttgcctt

SEQ ID NO: 5037711 - DNA, 22 bp, Homo sapiens
caaagatctgaattaaataaat

SEQ ID NO: 5037712 - DNA, 14 bp, Homo sapiens
caacctctgcctcc

SEQ ID NO: 5037713 - DNA, 20 bp, Homo sapiens
caaggaataaatgagaggga

SEQ ID NO: 5037714 - DNA, 13 bp, Homo sapiens
caatttaattcct

SEQ ID NO: 5037715 - DNA, 19 bp, Homo sapiens
cacagataccttgaaagga

SEQ ID NO: 5037716 - DNA, 17 bp, Homo sapiens
cagaagggaattgctca

SEQ ID NO: 5037717 - DNA, 14 bp, Homo sapiens
cagagaaggaaaag

SEQ ID NO: 5037718 - DNA, 15 bp, Homo sapiens
cagagaaggaaaaga

SEQ ID NO: 5037719 - DNA, 20 bp, Homo sapiens
cagagataaaccaataaatc

SEQ ID NO: 5037720 - DNA, 17 bp, Homo sapiens
cagataccttgaaagga

SEQ ID NO: 5037721 - DNA, 18 bp, Homo sapiens
cagataccttgaaaggaa

SEQ ID NO: 5037722 - DNA, 18 bp, Homo sapiens
cagcttttgttgtttata

SEQ ID NO: 5037723 - DNA, 15 bp, Homo sapiens
caggcgcctgccatc

SEQ ID NO: 5037724 - DNA, 13 bp, Homo sapiens
catcatgcctgac

SEQ ID NO: 5037725 - DNA, 16 bp, Homo sapiens
catcttcactgcaatt

SEQ ID NO: 5037726 - DNA, 17 bp, Homo sapiens
ctctgtagtttatggca

SEQ ID NO: 5037727 - DNA, 14 bp, Homo sapiens
ctcttacttgccaa

SEQ ID NO: 5037728 - DNA, 14 bp, Homo sapiens
ctgaattaaataaa

SEQ ID NO: 5037729 - DNA, 15 bp, Homo sapiens
ctgaattaaataaat

SEQ ID NO: 5037730 - DNA, 16 bp, Homo sapiens
ctgaattaaataaata

SEQ ID NO: 5037731 - DNA, 23 bp, Homo sapiens
ctggaagtcatctcattccactg

SEQ ID NO: 5037732 - DNA, 21 bp, Homo sapiens
ctgtagtttatggcagaaggg

SEQ ID NO: 5037733 - DNA, 23 bp, Homo sapiens
ctgtagtttatggcagaagggaa

SEQ ID NO: 5037734 - DNA, 16 bp, Homo sapiens
ctgtattcgtgcattt

SEQ ID NO: 5037735 - DNA, 12 bp, Homo sapiens
cttaacttgttt

SEQ ID NO: 5037736 - DNA, 22 bp, Homo sapiens
cttacttgccaagaaaatgaag

SEQ ID NO: 5037737 - DNA, 13 bp, Homo sapiens
cttgtttatgata

SEQ ID NO: 5037738 - DNA, 19 bp, Homo sapiens
cttgtttatgatatttctt

SEQ ID NO: 5037739 - DNA, 19 bp, Homo sapiens
cttgtttggtagttagcca

SEQ ID NO: 5037740 - DNA, 18 bp, Homo sapiens
gaccttggggtacaattg

SEQ ID NO: 5037741 - DNA, 19 bp, Homo sapiens
gagataaaccaataaatcc

SEQ ID NO: 5037742 - DNA, 16 bp, Homo sapiens
gataaaccaataaatc

SEQ ID NO: 5037743 - DNA, 13 bp, Homo sapiens
gatatttcttgct

SEQ ID NO: 5037744 - DNA, 17 bp, Homo sapiens
gatatttcttgctttca

SEQ ID NO: 5037745 - DNA, 21 bp, Homo sapiens
gatcatttttaactgattctt

SEQ ID NO: 5037746 - DNA, 20 bp, Homo sapiens
gatccgcctacctcagcctc

SEQ ID NO: 5037747 - DNA, 20 bp, Homo sapiens
gatgctagaaaaatgttctt

SEQ ID NO: 5037748 - DNA, 23 bp, Homo sapiens
gcaattctcctgcctcagcctcc

SEQ ID NO: 5037749 - DNA, 17 bp, Homo sapiens
gcagtcatctacttttt

SEQ ID NO: 5037750 - DNA, 14 bp, Homo sapiens
gccctaagggactt

SEQ ID NO: 5037751 - DNA, 16 bp, Homo sapiens
gcctacctcagcctcc

SEQ ID NO: 5037752 - DNA, 16 bp, Homo sapiens
gcgcctctcctggggc

SEQ ID NO: 5037753 - DNA, 19 bp, Homo sapiens
gctcactgcaacctctgcc

SEQ ID NO: 5037754 - DNA, 14 bp, Homo sapiens
gctgcagtcatcta

SEQ ID NO: 5037755 - DNA, 13 bp, Homo sapiens
gctgggtgtttca

SEQ ID NO: 5037756 - DNA, 15 bp, Homo sapiens
ggcctcccagcccaa

SEQ ID NO: 5037757 - DNA, 12 bp, Homo sapiens
ggtacagtttgg

SEQ ID NO: 5037758 - DNA, 23 bp, Homo sapiens
ggtctcaaactcctgacctcagg

SEQ ID NO: 5037759 - DNA, 22 bp, Homo sapiens
ggttcagcgcctctcctggggc

SEQ ID NO: 5037760 - DNA, 19 bp, Homo sapiens
gtagtttatggcagaaggg

SEQ ID NO: 5037761 - DNA, 15 bp, Homo sapiens
gtatctttccaggct

SEQ ID NO: 5037762 - DNA, 11 bp, Homo sapiens
gtcttccacaa

SEQ ID NO: 5037763 - DNA, 21 bp, Homo sapiens
gttattttctttatcattgct

SEQ ID NO: 5037764 - DNA, 22 bp, Homo sapiens
gttctattaatcacctctctgt

SEQ ID NO: 5037765 - DNA, 15 bp, Homo sapiens
gttgcctgaaaaatg

SEQ ID NO: 5037766 - DNA, 22 bp, Homo sapiens
gtttatatacagtacacagata

SEQ ID NO: 5037767 - DNA, 15 bp, Homo sapiens
gtttatgatatttct

SEQ ID NO: 5037768 - DNA, 17 bp, Homo sapiens
gtttatgatatttcttg

SEQ ID NO: 5037769 - DNA, 14 bp, Homo sapiens
gtttatggcagaag

SEQ ID NO: 5037770 - DNA, 12 bp, Homo sapiens
gtttcagtttga

SEQ ID NO: 5037771 - DNA, 12 bp, Homo sapiens
gtttttgctctc

SEQ ID NO: 5037772 - DNA, 19 bp, Homo sapiens
taatgcttgtttatgatat

SEQ ID NO: 5037773 - DNA, 17 bp, Homo sapiens
taattcaaggagaatat

SEQ ID NO: 5037774 - DNA, 15 bp, Homo sapiens
taattcctcttttta

SEQ ID NO: 5037775 - DNA, 20 bp, Homo sapiens
tacccaggctggagtgcagt

SEQ ID NO: 5037776 - DNA, 23 bp, Homo sapiens
tacttaaaaatagtcttccacaa

SEQ ID NO: 5037777 - DNA, 22 bp, Homo sapiens
tagtcttccacaaaaaatactt

SEQ ID NO: 5037778 - DNA, 20 bp, Homo sapiens
tatacaaattttcagaaggt

SEQ ID NO: 5037779 - DNA, 13 bp, Homo sapiens
tatgaattcaaga

SEQ ID NO: 5037780 - DNA, 15 bp, Homo sapiens
tatgataaaacactg

SEQ ID NO: 5037781 - DNA, 20 bp, Homo sapiens
tcagagaaggaaaagactga

SEQ ID NO: 5037782 - DNA, 20 bp, Homo sapiens
tcagcctccctagtagctgg

SEQ ID NO: 5037783 - DNA, 18 bp, Homo sapiens
tcagcttttgttgtttat

SEQ ID NO: 5037784 - DNA, 19 bp, Homo sapiens
tccagcaattctcctgcct

SEQ ID NO: 5037785 - DNA, 18 bp, Homo sapiens
tctactttttttttaatt

SEQ ID NO: 5037786 - DNA, 13 bp, Homo sapiens
tctgatctataca

SEQ ID NO: 5037787 - DNA, 15 bp, Homo sapiens
tctgttacccaggct

SEQ ID NO: 5037788 - DNA, 13 bp, Homo sapiens
tcttggtcagctt

SEQ ID NO: 5037789 - DNA, 13 bp, Homo sapiens
tctttccaggctt

SEQ ID NO: 5037790 - DNA, 17 bp, Homo sapiens
tgaagcagtcttgctct

SEQ ID NO: 5037791 - DNA, 20 bp, Homo sapiens
tgaagcagtcttgctctgtt

SEQ ID NO: 5037792 - DNA, 15 bp, Homo sapiens
tgaattaaataaata

SEQ ID NO: 5037793 - DNA, 20 bp, Homo sapiens
tgacctcaggtgatccgcct

SEQ ID NO: 5037794 - DNA, 21 bp, Homo sapiens
tgacggctgggtgtttcagtt

SEQ ID NO: 5037795 - DNA, 13 bp, Homo sapiens
tgagaaatgatga

SEQ ID NO: 5037796 - DNA, 15 bp, Homo sapiens
tgatatttcttgctt

SEQ ID NO: 5037797 - DNA, 16 bp, Homo sapiens
tgccaaagcctggggc

SEQ ID NO: 5037798 - DNA, 20 bp, Homo sapiens
tgcttgtttatgatatttct

SEQ ID NO: 5037799 - DNA, 20 bp, Homo sapiens
tggatttccttctaacatgt

SEQ ID NO: 5037800 - DNA, 21 bp, Homo sapiens
tggcagaagggaattgctcag

SEQ ID NO: 5037801 - DNA, 15 bp, Homo sapiens
tgggtgtttcagttt

SEQ ID NO: 5037802 - DNA, 16 bp, Homo sapiens
tggtctcaaactcctg

SEQ ID NO: 5037803 - DNA, 17 bp, Homo sapiens
tgtattcgtgcattttt

SEQ ID NO: 5037804 - DNA, 14 bp, Homo sapiens
tgtgtttcagccac

SEQ ID NO: 5037805 - DNA, 19 bp, Homo sapiens
tgtttatgatatttcttgc

SEQ ID NO: 5037806 - DNA, 16 bp, Homo sapiens
ttacaaagcagttact

SEQ ID NO: 5037807 - DNA, 19 bp, Homo sapiens
ttaccagatgctgactggc

SEQ ID NO: 5037808 - DNA, 11 bp, Homo sapiens
ttagggtacag

SEQ ID NO: 5037809 - DNA, 16 bp, Homo sapiens
ttcaaggagaatatga

SEQ ID NO: 5037810 - DNA, 13 bp, Homo sapiens
ttcactgcaattt

SEQ ID NO: 5037811 - DNA, 19 bp, Homo sapiens
ttcagaaggttattttctt

SEQ ID NO: 5037812 - DNA, 23 bp, Homo sapiens
ttcagaaggttattttctttatc

SEQ ID NO: 5037813 - DNA, 18 bp, Homo sapiens
ttccttctaacatgttat

SEQ ID NO: 5037814 - DNA, 12 bp, Homo sapiens
ttcttgctttca

SEQ ID NO: 5037815 - DNA, 18 bp, Homo sapiens
ttgaagcagtcttgctct

SEQ ID NO: 5037816 - DNA, 21 bp, Homo sapiens
ttgccaagaaaatgaagggat

SEQ ID NO: 5037817 - DNA, 22 bp, Homo sapiens
ttgccaagaaaatgaagggatt

SEQ ID NO: 5037818 - DNA, 23 bp, Homo sapiens
ttgctcagagaaggaaaagactg

SEQ ID NO: 5037819 - DNA, 21 bp, Homo sapiens
ttggtattatataattcaagg

SEQ ID NO: 5037820 - DNA, 18 bp, Homo sapiens
tttctttatcattgctaa

SEQ ID NO: 5037821 - DNA, 20 bp, Homo sapiens
tttgaagcagtcttgctctg

SEQ ID NO: 5037822 - DNA, 21 bp, Homo sapiens
ttttgaagcagtcttgctctg

SEQ ID NO: 5037823 - DNA, 20 bp, Homo sapiens
aaaatattttgttgccttca

SEQ ID NO: 5037824 - DNA, 19 bp, Homo sapiens
aaaggaagagctaataaat

SEQ ID NO: 5037825 - DNA, 13 bp, Homo sapiens
aacctctgcctcc

SEQ ID NO: 5037826 - DNA, 19 bp, Homo sapiens
aactgattcttatgattac

SEQ ID NO: 5037827 - DNA, 12 bp, Homo sapiens
aagaaaatgaag

SEQ ID NO: 5037828 - DNA, 16 bp, Homo sapiens
aagaaaatgaagggat

SEQ ID NO: 5037829 - DNA, 22 bp, Homo sapiens
aagatttgtgtttttctttttc

SEQ ID NO: 5037830 - DNA, 16 bp, Homo sapiens
aataaaattcatttct

SEQ ID NO: 5037831 - DNA, 18 bp, Homo sapiens
aatacttaaaaatagtct

SEQ ID NO: 5037832 - DNA, 23 bp, Homo sapiens
acaaggaataaatgagagggaat

SEQ ID NO: 5037833 - DNA, 21 bp, Homo sapiens
acacaatttaattcctctttt

SEQ ID NO: 5037834 - DNA, 11 bp, Homo sapiens
acacattcctt

SEQ ID NO: 5037835 - DNA, 18 bp, Homo sapiens
acaccgtacatctgcaat

SEQ ID NO: 5037836 - DNA, 14 bp, Homo sapiens
acagcctcttactt

SEQ ID NO: 5037837 - DNA, 14 bp, Homo sapiens
acctctctgtagtt

SEQ ID NO: 5037838 - DNA, 18 bp, Homo sapiens
acctctgcctcccaggtt

SEQ ID NO: 5037839 - DNA, 22 bp, Homo sapiens
acggctgggtgtttcagtttga

SEQ ID NO: 5037840 - DNA, 20 bp, Homo sapiens
actcttggtcagcttttgtt

SEQ ID NO: 5037841 - DNA, 15 bp, Homo sapiens
actgatgacttacta

SEQ ID NO: 5037842 - DNA, 17 bp, Homo sapiens
actggtggtttttgctc

SEQ ID NO: 5037843 - DNA, 20 bp, Homo sapiens
actgtattcgtgcatttttg

SEQ ID NO: 5037844 - DNA, 12 bp, Homo sapiens
actttatttctg

SEQ ID NO: 5037845 - DNA, 21 bp, Homo sapiens
agagataaaccaataaatcca

SEQ ID NO: 5037846 - DNA, 15 bp, Homo sapiens
agagatgagaaatga

SEQ ID NO: 5037847 - DNA, 20 bp, Homo sapiens
agagctaataaatctcttct

SEQ ID NO: 5037848 - DNA, 22 bp, Homo sapiens
agcaattctcctgcctcagcct

SEQ ID NO: 5037849 - DNA, 14 bp, Homo sapiens
tcctgcctcagcct

SEQ ID NO: 5037850 - DNA, 19 bp, Homo sapiens
tctattaatcacctctctg

SEQ ID NO: 5037851 - DNA, 22 bp, Homo sapiens
tctttccaggcttccctgactt

SEQ ID NO: 5037852 - DNA, 16 bp, Homo sapiens
tgaagcagtcttgctc

SEQ ID NO: 5037853 - DNA, 17 bp, Homo sapiens
tgaattcaagaaaggaa

SEQ ID NO: 5037854 - DNA, 19 bp, Homo sapiens
tgacctcaggtgatccgcc

SEQ ID NO: 5037855 - DNA, 14 bp, Homo sapiens
tgcaacctctgcct

SEQ ID NO: 5037856 - DNA, 21 bp, Homo sapiens
tgcaacctctgcctcccaggt

SEQ ID NO: 5037857 - DNA, 16 bp, Homo sapiens
tgcctcccaggttcca

SEQ ID NO: 5037858 - DNA, 22 bp, Homo sapiens
tgcctgactaatttttgtattt

SEQ ID NO: 5037859 - DNA, 19 bp, Homo sapiens
tggcagaagggaattgctc

SEQ ID NO: 5037860 - DNA, 16 bp, Homo sapiens
tgggcaactgcagtga

SEQ ID NO: 5037861 - DNA, 11 bp, Homo sapiens
tggtgaacagt

SEQ ID NO: 5037862 - DNA, 18 bp, Homo sapiens
tgtgtttttctttttcca

SEQ ID NO: 5037863 - DNA, 20 bp, Homo sapiens
ttaatcacctctctgtagtt

SEQ ID NO: 5037864 - DNA, 14 bp, Homo sapiens
ttacaaagcagtta

SEQ ID NO: 5037865 - DNA, 19 bp, Homo sapiens
ttctcaaagatctgaatta

SEQ ID NO: 5037866 - DNA, 20 bp, Homo sapiens
ttgctctgttacccaggctg

SEQ ID NO: 5037867 - DNA, 12 bp, Homo sapiens
ttgctttcaatt

SEQ ID NO: 5037868 - DNA, 15 bp, Homo sapiens
ttggtgaacagtttt

SEQ ID NO: 5037869 - DNA, 16 bp, Homo sapiens
tttccttctaacatgt

SEQ ID NO: 5037870 - DNA, 18 bp, Homo sapiens
tttgtgtaaatttctcaa

SEQ ID NO: 5037871 - DNA, 12 bp, Homo sapiens
tttgttgtttat

SEQ ID NO: 5037872 - DNA, 23 bp, Homo sapiens
tttttaactgattcttatgatta

SEQ ID NO: 5037873 - DNA, 18 bp, Homo sapiens
cattccactgttggtatt

SEQ ID NO: 5037874 - DNA, 20 bp, Homo sapiens
ccacagggaacacattcctt

SEQ ID NO: 5037875 - DNA, 22 bp, Homo sapiens
ccacagggaacacattcctttg

SEQ ID NO: 5037876 - DNA, 12 bp, Homo sapiens
ccagctggatcc

SEQ ID NO: 5037877 - DNA, 18 bp, Homo sapiens
ccaggctggagtgcagtg

SEQ ID NO: 5037878 - DNA, 15 bp, Homo sapiens
ccctgacttgcttta

SEQ ID NO: 5037879 - DNA, 20 bp, Homo sapiens
cctagtagctgggatgacag

SEQ ID NO: 5037880 - DNA, 20 bp, Homo sapiens
cctgactaatttttgtattt

SEQ ID NO: 5037881 - DNA, 16 bp, Homo sapiens
cctgccatcatgcctg

SEQ ID NO: 5037882 - DNA, 17 bp, Homo sapiens
cctggggcaaagctgtg

SEQ ID NO: 5037883 - DNA, 15 bp, Homo sapiens
ctaacatgttatcaa

SEQ ID NO: 5037884 - DNA, 20 bp, Homo sapiens
ctaggtatcattcaactctc

SEQ ID NO: 5037885 - DNA, 13 bp, Homo sapiens
ctatcatggcata

SEQ ID NO: 5037886 - DNA, 17 bp, Homo sapiens
ctcagagaaggaaaaga

SEQ ID NO: 5037887 - DNA, 15 bp, Homo sapiens
ctccagctggatccc

SEQ ID NO: 5037888 - DNA, 14 bp, Homo sapiens
ctctgtagtttatg

SEQ ID NO: 5037889 - DNA, 18 bp, Homo sapiens
aacttctcttctgagcct

SEQ ID NO: 5037890 - DNA, 14 bp, Homo sapiens
aactttatgtgtaa

SEQ ID NO: 5037891 - DNA, 17 bp, Homo sapiens
aactttatgtgtaaata

SEQ ID NO: 5037892 - DNA, 22 bp, Homo sapiens
aactttgaggaggaagcagaat

SEQ ID NO: 5037893 - DNA, 16 bp, Homo sapiens
aagaaaagtggttgtt

SEQ ID NO: 5037894 - DNA, 22 bp, Homo sapiens
aagaaagtcagacctgtttctt

SEQ ID NO: 5037895 - DNA, 17 bp, Homo sapiens
aagacctccctgtgaga

SEQ ID NO: 5037896 - DNA, 20 bp, Homo sapiens
aagagccatataagtttgaa

SEQ ID NO: 5037897 - DNA, 22 bp, Homo sapiens
aagcaaaaactagtaaagacat

SEQ ID NO: 5037898 - DNA, 18 bp, Homo sapiens
aagcacagtttgaacaaa

SEQ ID NO: 5037899 - DNA, 14 bp, Homo sapiens
aagcttcattctca

SEQ ID NO: 5037900 - DNA, 16 bp, Homo sapiens
aaggatttactttttg

SEQ ID NO: 5037901 - DNA, 18 bp, Homo sapiens
aaggcaactagtggagag

SEQ ID NO: 5037902 - DNA, 22 bp, Homo sapiens
aaggcaactagtggagagaact

SEQ ID NO: 5037903 - DNA, 21 bp, Homo sapiens
aaggcactctgttatttagac

SEQ ID NO: 5037904 - DNA, 20 bp, Homo sapiens
aaggcatcagtccctatgta

SEQ ID NO: 5037905 - DNA, 19 bp, Homo sapiens
aaggcctccctagccagca

SEQ ID NO: 5037906 - DNA, 19 bp, Homo sapiens
aaggttccaactgtatata

SEQ ID NO: 5037907 - DNA, 21 bp, Homo sapiens
aaggttccaactgtatatatt

SEQ ID NO: 5037908 - DNA, 16 bp, Homo sapiens
aaggtttcgtttctgt

SEQ ID NO: 5037909 - DNA, 21 bp, Homo sapiens
aaggtttcgtttctgtataca

SEQ ID NO: 5037910 - DNA, 22 bp, Homo sapiens
aaggtttcgtttctgtatacaa

SEQ ID NO: 5037911 - DNA, 16 bp, Homo sapiens
aagtcctttatgtgga

SEQ ID NO: 5037912 - DNA, 20 bp, Homo sapiens
aataccattttttaaggaaa

SEQ ID NO: 5037913 - DNA, 16 bp, Homo sapiens
aatatggttgatagtt

SEQ ID NO: 5037914 - DNA, 13 bp, Homo sapiens
aatattcccaagc

SEQ ID NO: 5037915 - DNA, 21 bp, Homo sapiens
aatattttttatatatacagt

SEQ ID NO: 5037916 - DNA, 19 bp, Homo sapiens
aatcccggtttcagaagct

SEQ ID NO: 5037917 - DNA, 15 bp, Homo sapiens
aatctggttgtgatt

SEQ ID NO: 5037918 - DNA, 17 bp, Homo sapiens
aatgatccttatgatgt

SEQ ID NO: 5037919 - DNA, 16 bp, Homo sapiens
aatgatctcttctttt

SEQ ID NO: 5037920 - DNA, 17 bp, Homo sapiens
aatgtcttttgaatatt

SEQ ID NO: 5037921 - DNA, 19 bp, Homo sapiens
aatgtgccctcttaagtgt

SEQ ID NO: 5037922 - DNA, 18 bp, Homo sapiens
aattgttgacagttctga

SEQ ID NO: 5037923 - DNA, 18 bp, Homo sapiens
aattttaccctttagact

SEQ ID NO: 5037924 - DNA, 21 bp, Homo sapiens
aattttaccctttagactgta

SEQ ID NO: 5037925 - DNA, 16 bp, Homo sapiens
acaaagcacagtttga

SEQ ID NO: 5037926 - DNA, 17 bp, Homo sapiens
acagaacatcattagaa

SEQ ID NO: 5037927 - DNA, 15 bp, Homo sapiens
acagatacacataca

SEQ ID NO: 5037928 - DNA, 22 bp, Homo sapiens
acagattttggggttgtgttgt

SEQ ID NO: 5037929 - DNA, 21 bp, Homo sapiens
acaggggctatcccttctcag

SEQ ID NO: 5037930 - DNA, 19 bp, Homo sapiens
acagtaactttatgtgtaa

SEQ ID NO: 5037931 - DNA, 21 bp, Homo sapiens
acatttagagaactgtggccg

SEQ ID NO: 5037932 - DNA, 14 bp, Homo sapiens
accacaatatgtat

SEQ ID NO: 5037933 - DNA, 20 bp, Homo sapiens
accatagaagaacagcagat

SEQ ID NO: 5037934 - DNA, 12 bp, Homo sapiens
acccctccagga

SEQ ID NO: 5037935 - DNA, 23 bp, Homo sapiens
accgacctggtttttaaatagag

SEQ ID NO: 5037936 - DNA, 18 bp, Homo sapiens
acctaagtcctttatgtg

SEQ ID NO: 5037937 - DNA, 13 bp, Homo sapiens
acctccctgtgag

SEQ ID NO: 5037938 - DNA, 18 bp, Homo sapiens
acctgggctttctggaat

SEQ ID NO: 5037939 - DNA, 18 bp, Homo sapiens
acctgtttcttgtaactg

SEQ ID NO: 5037940 - DNA, 13 bp, Homo sapiens
acgtttgtatgtg

SEQ ID NO: 5037941 - DNA, 14 bp, Homo sapiens
actagtaaagacat

SEQ ID NO: 5037942 - DNA, 16 bp, Homo sapiens
actagtaaagacatag

SEQ ID NO: 5037943 - DNA, 21 bp, Homo sapiens
actccagcctgggcaacagag

SEQ ID NO: 5037944 - DNA, 13 bp, Homo sapiens
actctgctttgca

SEQ ID NO: 5037945 - DNA, 21 bp, Homo sapiens
actcttgagccctcctggaat

SEQ ID NO: 5037946 - DNA, 19 bp, Homo sapiens
actggagttctatgctctc

SEQ ID NO: 5037947 - DNA, 14 bp, Homo sapiens
actgggttcaaaaa

SEQ ID NO: 5037948 - DNA, 15 bp, Homo sapiens
actgggttcaaaaag

SEQ ID NO: 5037949 - DNA, 17 bp, Homo sapiens
actgtggccgttatctg

SEQ ID NO: 5037950 - DNA, 20 bp, Homo sapiens
actgtggccgttatctggaa

SEQ ID NO: 5037951 - DNA, 23 bp, Homo sapiens
actgtggccgttatctggaagta

SEQ ID NO: 5037952 - DNA, 11 bp, Homo sapiens
acttctcttct

SEQ ID NO: 5037953 - DNA, 21 bp, Homo sapiens
actttaatcccggtttcagaa

SEQ ID NO: 5037954 - DNA, 13 bp, Homo sapiens
actttatgtgtaa

SEQ ID NO: 5037955 - DNA, 16 bp, Homo sapiens
actttatgtgtaaata

SEQ ID NO: 5037956 - DNA, 20 bp, Homo sapiens
actttgaggaggaagcagaa

SEQ ID NO: 5037957 - DNA, 20 bp, Homo sapiens
agaaaacttctcttctgagc

SEQ ID NO: 5037958 - DNA, 16 bp, Homo sapiens
agaaaattatgcagct

SEQ ID NO: 5037959 - DNA, 14 bp, Homo sapiens
agaacaaaggacag

SEQ ID NO: 5037960 - DNA, 22 bp, Homo sapiens
agaacaaaggacagagtatgaa

SEQ ID NO: 5037961 - DNA, 20 bp, Homo sapiens
agaacactcgaaaagagcac

SEQ ID NO: 5037962 - DNA, 14 bp, Homo sapiens
agaacatcattaga

SEQ ID NO: 5037963 - DNA, 16 bp, Homo sapiens
agaacatcattagaac

SEQ ID NO: 5037964 - DNA, 20 bp, Homo sapiens
agaacatcattagaacaaag

SEQ ID NO: 5037965 - DNA, 19 bp, Homo sapiens
agaagacctccctgtgaga

SEQ ID NO: 5037966 - DNA, 14 bp, Homo sapiens
agaagctgcagctg

SEQ ID NO: 5037967 - DNA, 20 bp, Homo sapiens
agaagtagattaagagccat

SEQ ID NO: 5037968 - DNA, 18 bp, Homo sapiens
agacataggccatgaaaa

SEQ ID NO: 5037969 - DNA, 22 bp, Homo sapiens
agacatcctcaaaagaaagaga

SEQ ID NO: 5037970 - DNA, 20 bp, Homo sapiens
agacctccctgtgagagagt

SEQ ID NO: 5037971 - DNA, 22 bp, Homo sapiens
agaccttccataatgctactgt

SEQ ID NO: 5037972 - DNA, 23 bp, Homo sapiens
agaccttccataatgctactgtc

SEQ ID NO: 5037973 - DNA, 23 bp, Homo sapiens
agactttaatcccggtttcagaa

SEQ ID NO: 5037974 - DNA, 14 bp, Homo sapiens
agagaatcagacct

SEQ ID NO: 5037975 - DNA, 17 bp, Homo sapiens
agagattgaactttgag

SEQ ID NO: 5037976 - DNA, 16 bp, Homo sapiens
agagcacttcacacag

SEQ ID NO: 5037977 - DNA, 19 bp, Homo sapiens
agagccatataagtttgaa

SEQ ID NO: 5037978 - DNA, 16 bp, Homo sapiens
agagtggtggcagctc

SEQ ID NO: 5037979 - DNA, 16 bp, Homo sapiens
agagttgctcctcagg

SEQ ID NO: 5037980 - DNA, 14 bp, Homo sapiens
agagttttgtcttg

SEQ ID NO: 5037981 - DNA, 20 bp, Homo sapiens
agatggcggtgatcagcaga

SEQ ID NO: 5037982 - DNA, 15 bp, Homo sapiens
agattgttgtttgcc

SEQ ID NO: 5037983 - DNA, 19 bp, Homo sapiens
agcagaatctttgcaagaa

SEQ ID NO: 5037984 - DNA, 23 bp, Homo sapiens
agcatattttctccgaaaggcaa

SEQ ID NO: 5037985 - DNA, 15 bp, Homo sapiens
agccagcacttgtat

SEQ ID NO: 5037986 - DNA, 21 bp, Homo sapiens
agccatataagtttgaaggaa

SEQ ID NO: 5037987 - DNA, 14 bp, Homo sapiens
agctagttatgtga

SEQ ID NO: 5037988 - DNA, 19 bp, Homo sapiens
agctgtataactgtgcaga

SEQ ID NO: 5037989 - DNA, 20 bp, Homo sapiens
agcttaccagaagcttccat

SEQ ID NO: 5037990 - DNA, 12 bp, Homo sapiens
aggaaacagtta

SEQ ID NO: 5037991 - DNA, 13 bp, Homo sapiens
aggaggaagcaga

SEQ ID NO: 5037992 - DNA, 21 bp, Homo sapiens
aggagtgggaaaacactgcca

SEQ ID NO: 5037993 - DNA, 14 bp, Homo sapiens
aggcaaatgtgtac

SEQ ID NO: 5037994 - DNA, 13 bp, Homo sapiens
aggcacctgggct

SEQ ID NO: 5037995 - DNA, 19 bp, Homo sapiens
aggcactctgttatttaga

SEQ ID NO: 5037996 - DNA, 12 bp, Homo sapiens
aggcatgtcctg

SEQ ID NO: 5037997 - DNA, 13 bp, Homo sapiens
aggccatgaaaaa

SEQ ID NO: 5037998 - DNA, 19 bp, Homo sapiens
aggctctgaggggatgcaa

SEQ ID NO: 5037999 - DNA, 19 bp, Homo sapiens
aggggcacttcattgagag

SEQ ID NO: 5038000 - DNA, 16 bp, Homo sapiens
aggggtcaccttgaga

SEQ ID NO: 5038001 - DNA, 20 bp, Homo sapiens
aggtatgttgcctttatggt

SEQ ID NO: 5038002 - DNA, 13 bp, Homo sapiens
aggttgccgtgag

SEQ ID NO: 5038003 - DNA, 17 bp, Homo sapiens
aggtttcgtttctgtat

SEQ ID NO: 5038004 - DNA, 13 bp, Homo sapiens
agtaaagacatag

SEQ ID NO: 5038005 - DNA, 15 bp, Homo sapiens
agtaacttggctttc

SEQ ID NO: 5038006 - DNA, 18 bp, Homo sapiens
agtaacttggctttcatt

SEQ ID NO: 5038007 - DNA, 14 bp, Homo sapiens
agtaactttatgtg

SEQ ID NO: 5038008 - DNA, 16 bp, Homo sapiens
agtagacgaacagctg

SEQ ID NO: 5038009 - DNA, 17 bp, Homo sapiens
agtagacgaacagctga

SEQ ID NO: 5038010 - DNA, 15 bp, Homo sapiens
agtccctatgtattt

SEQ ID NO: 5038011 - DNA, 16 bp, Homo sapiens
agtccttgaaaatatt

SEQ ID NO: 5038012 - DNA, 17 bp, Homo sapiens
agtcctttatgtggaaa

SEQ ID NO: 5038013 - DNA, 14 bp, Homo sapiens
agtgagatattttt

SEQ ID NO: 5038014 - DNA, 17 bp, Homo sapiens
agtgcatttttatctgt

SEQ ID NO: 5038015 - DNA, 23 bp, Homo sapiens
agtgcctgtacaagctgatgttt

SEQ ID NO: 5038016 - DNA, 15 bp, Homo sapiens
agtggtggcagctca

SEQ ID NO: 5038017 - DNA, 13 bp, Homo sapiens
agtgtgaacaaaa

SEQ ID NO: 5038018 - DNA, 13 bp, Homo sapiens
agtgtgcacagat

SEQ ID NO: 5038019 - DNA, 11 bp, Homo sapiens
tgggctttctg

SEQ ID NO: 5038020 - DNA, 12 bp, Homo sapiens
tgggctttctgg

SEQ ID NO: 5038021 - DNA, 18 bp, Homo sapiens
tgggtcacccctccagga

SEQ ID NO: 5038022 - DNA, 23 bp, Homo sapiens
tggtctgtttccaggtcagaaac

SEQ ID NO: 5038023 - DNA, 18 bp, Homo sapiens
tgtaaatgtcttttcaaa

SEQ ID NO: 5038024 - DNA, 17 bp, Homo sapiens
tgtacctgttccttaga

SEQ ID NO: 5038025 - DNA, 15 bp, Homo sapiens
tgtagattctgtgga

SEQ ID NO: 5038026 - DNA, 20 bp, Homo sapiens
tgtagcatattttctccgaa

SEQ ID NO: 5038027 - DNA, 17 bp, Homo sapiens
tgtagttttacttggtg

SEQ ID NO: 5038028 - DNA, 16 bp, Homo sapiens
tgtataactgtgcaga

SEQ ID NO: 5038029 - DNA, 17 bp, Homo sapiens
tgtatatacgcatctat

SEQ ID NO: 5038030 - DNA, 15 bp, Homo sapiens
tgtcatcagccacca

SEQ ID NO: 5038031 - DNA, 18 bp, Homo sapiens
tgtcatcagccaccatcc

SEQ ID NO: 5038032 - DNA, 21 bp, Homo sapiens
tgtcatcagccaccatcctat

SEQ ID NO: 5038033 - DNA, 13 bp, Homo sapiens
tgtccactgtgta

SEQ ID NO: 5038034 - DNA, 14 bp, Homo sapiens
tgtctagagtagct

SEQ ID NO: 5038035 - DNA, 12 bp, Homo sapiens
tgtctgaaaaat

SEQ ID NO: 5038036 - DNA, 14 bp, Homo sapiens
tgtcttttgaatat

SEQ ID NO: 5038037 - DNA, 20 bp, Homo sapiens
tgtgaacaaaagatgctctt

SEQ ID NO: 5038038 - DNA, 19 bp, Homo sapiens
tgtggaccactgcatgagc

SEQ ID NO: 5038039 - DNA, 18 bp, Homo sapiens
tgtggccgttatctggaa

SEQ ID NO: 5038040 - DNA, 19 bp, Homo sapiens
tgtgtacatggcagagttt

SEQ ID NO: 5038041 - DNA, 16 bp, Homo sapiens
tgtgtagacaaatatt

SEQ ID NO: 5038042 - DNA, 21 bp, Homo sapiens
tgtgtagacaaatatttggag

SEQ ID NO: 5038043 - DNA, 17 bp, Homo sapiens
tgttatttagactcatc

SEQ ID NO: 5038044 - DNA, 16 bp, Homo sapiens
tgttgacagttctgaa

SEQ ID NO: 5038045 - DNA, 15 bp, Homo sapiens
tgttgagaggctgag

SEQ ID NO: 5038046 - DNA, 14 bp, Homo sapiens
tgttgccaggcagg

SEQ ID NO: 5038047 - DNA, 18 bp, Homo sapiens
tgttgcctttatggtttc

SEQ ID NO: 5038048 - DNA, 12 bp, Homo sapiens
tgttgtcttgaa

SEQ ID NO: 5038049 - DNA, 20 bp, Homo sapiens
tgtttccaggtcagaaacca

SEQ ID NO: 5038050 - DNA, 19 bp, Homo sapiens
tgtttctattgacttcaat

SEQ ID NO: 5038051 - DNA, 22 bp, Homo sapiens
tgtttgacaaagttactgattc

SEQ ID NO: 5038052 - DNA, 12 bp, Homo sapiens
ttaaaagcatac

SEQ ID NO: 5038053 - DNA, 23 bp, Homo sapiens
ttaaattttaccctttagactgt

SEQ ID NO: 5038054 - DNA, 23 bp, Homo sapiens
ttaacagagtttgatatgggctt

SEQ ID NO: 5038055 - DNA, 12 bp, Homo sapiens
ttaaggaaacaa

SEQ ID NO: 5038056 - DNA, 13 bp, Homo sapiens
ttactgtacctgt

SEQ ID NO: 5038057 - DNA, 14 bp, Homo sapiens
ttagactacattta

SEQ ID NO: 5038058 - DNA, 16 bp, Homo sapiens
ttagttatagatgtct

SEQ ID NO: 5038059 - DNA, 14 bp, Homo sapiens
ttagtttggattct

SEQ ID NO: 5038060 - DNA, 17 bp, Homo sapiens
ttatgtccactgtgtat

SEQ ID NO: 5038061 - DNA, 18 bp, Homo sapiens
ttatttctacctttctga

SEQ ID NO: 5038062 - DNA, 16 bp, Homo sapiens
ttcagaaccatccata

SEQ ID NO: 5038063 - DNA, 13 bp, Homo sapiens
ttcagaagacctc

SEQ ID NO: 5038064 - DNA, 22 bp, Homo sapiens
ttcattattagtactgctcttg

SEQ ID NO: 5038065 - DNA, 14 bp, Homo sapiens
ttccaaagttaaca

SEQ ID NO: 5038066 - DNA, 22 bp, Homo sapiens
ttccaactgtatatattcccaa

SEQ ID NO: 5038067 - DNA, 13 bp, Homo sapiens
ttccaaggcttct

SEQ ID NO: 5038068 - DNA, 14 bp, Homo sapiens
ttcgtttctgtata

SEQ ID NO: 5038069 - DNA, 16 bp, Homo sapiens
ttctacatttcttaga

SEQ ID NO: 5038070 - DNA, 22 bp, Homo sapiens
ttctaccatgaacagaaaacat

SEQ ID NO: 5038071 - DNA, 13 bp, Homo sapiens
ttctgtagattct

SEQ ID NO: 5038072 - DNA, 23 bp, Homo sapiens
ttctgtatacaaccctggcatta

SEQ ID NO: 5038073 - DNA, 21 bp, Homo sapiens
ttcttagactacatttagaga

SEQ ID NO: 5038074 - DNA, 12 bp, Homo sapiens
ttcttgttcaaa

SEQ ID NO: 5038075 - DNA, 22 bp, Homo sapiens
ttgaaagattcaggtatgttgc

SEQ ID NO: 5038076 - DNA, 16 bp, Homo sapiens
ttgacaactgaagaga

SEQ ID NO: 5038077 - DNA, 18 bp, Homo sapiens
ttgcatccaactccagga

SEQ ID NO: 5038078 - DNA, 14 bp, Homo sapiens
ttgctattagagca

SEQ ID NO: 5038079 - DNA, 17 bp, Homo sapiens
ttgctattagagcattg

SEQ ID NO: 5038080 - DNA, 15 bp, Homo sapiens
ttggggttgtgttgt

SEQ ID NO: 5038081 - DNA, 16 bp, Homo sapiens
ttggggttgtgttgtc

SEQ ID NO: 5038082 - DNA, 17 bp, Homo sapiens
ttgtatgtgtgtagaca

SEQ ID NO: 5038083 - DNA, 11 bp, Homo sapiens
ttgtgttgtca

SEQ ID NO: 5038084 - DNA, 21 bp, Homo sapiens
ttgttgtttgccatactttgt

SEQ ID NO: 5038085 - DNA, 15 bp, Homo sapiens
ttgtttgccatactt

SEQ ID NO: 5038086 - DNA, 18 bp, Homo sapiens
tttaaattttacccttta

SEQ ID NO: 5038087 - DNA, 12 bp, Homo sapiens
tttaaggaaaca

SEQ ID NO: 5038088 - DNA, 15 bp, Homo sapiens
tttagactgtagcct

SEQ ID NO: 5038089 - DNA, 21 bp, Homo sapiens
tttagtacctgaaaagtaact

SEQ ID NO: 5038090 - DNA, 15 bp, Homo sapiens
tttatatatacagta

SEQ ID NO: 5038091 - DNA, 16 bp, Homo sapiens
tttattcctgtatgtt

SEQ ID NO: 5038092 - DNA, 16 bp, Homo sapiens
tttccaggtcagaaac

SEQ ID NO: 5038093 - DNA, 16 bp, Homo sapiens
tttcccccttctacat

SEQ ID NO: 5038094 - DNA, 14 bp, Homo sapiens
tttcgtttctgtat

SEQ ID NO: 5038095 - DNA, 16 bp, Homo sapiens
tttctgagcacacttt

SEQ ID NO: 5038096 - DNA, 16 bp, Homo sapiens
tttgaggggaaaacac

SEQ ID NO: 5038097 - DNA, 20 bp, Homo sapiens
tttggattcttatgtagcag

SEQ ID NO: 5038098 - DNA, 15 bp, Homo sapiens
ttttatctgtgagtt

SEQ ID NO: 5038099 - DNA, 22 bp, Homo sapiens
cagtgtctgaaccaccctggaa

SEQ ID NO: 5038100 - DNA, 13 bp, Homo sapiens
cagtttgaacaaa

SEQ ID NO: 5038101 - DNA, 19 bp, Homo sapiens
cataagcggcgtaagttta

SEQ ID NO: 5038102 - DNA, 21 bp, Homo sapiens
cataaggtttcgtttctgtat

SEQ ID NO: 5038103 - DNA, 18 bp, Homo sapiens
catactttgtctgaaaaa

SEQ ID NO: 5038104 - DNA, 13 bp, Homo sapiens
gaggcatgacagc

SEQ ID NO: 5038105 - DNA, 15 bp, Homo sapiens
gaggccgaggcacga

SEQ ID NO: 5038106 - DNA, 20 bp, Homo sapiens
gaggttgccgtgagccaaga

SEQ ID NO: 5038107 - DNA, 22 bp, Homo sapiens
gagttctgttgtgtttgtcaaa

SEQ ID NO: 5038108 - DNA, 19 bp, Homo sapiens
gatgaacttattctgtaga

SEQ ID NO: 5038109 - DNA, 18 bp, Homo sapiens
gatgatacaagattagaa

SEQ ID NO: 5038110 - DNA, 21 bp, Homo sapiens
gatgatacaagattagaagct

SEQ ID NO: 5038111 - DNA, 14 bp, Homo sapiens
gatgatttttgtca

SEQ ID NO: 5038112 - DNA, 15 bp, Homo sapiens
gatgctcttctgtgg

SEQ ID NO: 5038113 - DNA, 13 bp, Homo sapiens
gatgctgtttgac

SEQ ID NO: 5038114 - DNA, 15 bp, Homo sapiens
gattctgtggaacaa

SEQ ID NO: 5038115 - DNA, 17 bp, Homo sapiens
gatttatttatttctac

SEQ ID NO: 5038116 - DNA, 14 bp, Homo sapiens
gcaatcctgtcttt

SEQ ID NO: 5038117 - DNA, 12 bp, Homo sapiens
gcacagtttgaa

SEQ ID NO: 5038118 - DNA, 23 bp, Homo sapiens
gcaccatagaagaacagcagatg

SEQ ID NO: 5038119 - DNA, 15 bp, Homo sapiens
gcacttgtatatacg

SEQ ID NO: 5038120 - DNA, 23 bp, Homo sapiens
gcagaatctttgcaagaaagtca

SEQ ID NO: 5038121 - DNA, 20 bp, Homo sapiens
gcagagtttgtgtgttgtct

SEQ ID NO: 5038122 - DNA, 14 bp, Homo sapiens
gcatgatctgtcaa

SEQ ID NO: 5038123 - DNA, 20 bp, Homo sapiens
gccaagatcacgccactgca

SEQ ID NO: 5038124 - DNA, 17 bp, Homo sapiens
gccagagtcctttccaa

SEQ ID NO: 5038125 - DNA, 10 bp, Homo sapiens
gccaggcagg

SEQ ID NO: 5038126 - DNA, 16 bp, Homo sapiens
gccatactttgtctga

SEQ ID NO: 5038127 - DNA, 17 bp, Homo sapiens
gccatataagtttgaag

SEQ ID NO: 5038128 - DNA, 15 bp, Homo sapiens
gcctgggcaacagag

SEQ ID NO: 5038129 - DNA, 19 bp, Homo sapiens
gcctgtacaagctgatgtt

SEQ ID NO: 5038130 - DNA, 17 bp, Homo sapiens
gccttcagaaccatcca

SEQ ID NO: 5038131 - DNA, 16 bp, Homo sapiens
gctatcccttctcaga

SEQ ID NO: 5038132 - DNA, 20 bp, Homo sapiens
gctgaaaacctaagtccttt

SEQ ID NO: 5038133 - DNA, 22 bp, Homo sapiens
gctgtataactgtgcagagact

SEQ ID NO: 5038134 - DNA, 17 bp, Homo sapiens
gctgtccccttccaggg

SEQ ID NO: 5038135 - DNA, 22 bp, Homo sapiens
ggaaaacagaacatcattagaa

SEQ ID NO: 5038136 - DNA, 18 bp, Homo sapiens
ggaactatgggagcctca

SEQ ID NO: 5038137 - DNA, 15 bp, Homo sapiens
ggaatgggggcagaa

SEQ ID NO: 5038138 - DNA, 15 bp, Homo sapiens
ggacaccgggccagt

SEQ ID NO: 5038139 - DNA, 21 bp, Homo sapiens
ggaccactgcatgagctttta

SEQ ID NO: 5038140 - DNA, 21 bp, Homo sapiens
ggactcttgagccctcctgga

SEQ ID NO: 5038141 - DNA, 16 bp, Homo sapiens
ggaggccgaggcacga

SEQ ID NO: 5038142 - DNA, 18 bp, Homo sapiens
ggcaaaagacatcctcaa

SEQ ID NO: 5038143 - DNA, 20 bp, Homo sapiens
ggcagatcatttgaggccag

SEQ ID NO: 5038144 - DNA, 18 bp, Homo sapiens
ggcatcagtccctatgta

SEQ ID NO: 5038145 - DNA, 20 bp, Homo sapiens
ggcattatgtccactgtgta

SEQ ID NO: 5038146 - DNA, 21 bp, Homo sapiens
ggccagtatctatatatgtgt

SEQ ID NO: 5038147 - DNA, 15 bp, Homo sapiens
ggctatcccttctca

SEQ ID NO: 5038148 - DNA, 17 bp, Homo sapiens
ggctatcccttctcaga

SEQ ID NO: 5038149 - DNA, 13 bp, Homo sapiens
gggtcaccttgag

SEQ ID NO: 5038150 - DNA, 15 bp, Homo sapiens
ggtgatcagcagaga

SEQ ID NO: 5038151 - DNA, 15 bp, Homo sapiens
ggttccactggagaa

SEQ ID NO: 5038152 - DNA, 12 bp, Homo sapiens
ggtttcagaagc

SEQ ID NO: 5038153 - DNA, 13 bp, Homo sapiens
ggtttcagaagct

SEQ ID NO: 5038154 - DNA, 17 bp, Homo sapiens
ggtttcgtttctgtata

SEQ ID NO: 5038155 - DNA, 12 bp, Homo sapiens
gtaactttatgt

SEQ ID NO: 5038156 - DNA, 21 bp, Homo sapiens
gtaagtttaaaggatgttggt

SEQ ID NO: 5038157 - DNA, 13 bp, Homo sapiens
gtaatctttcata

SEQ ID NO: 5038158 - DNA, 16 bp, Homo sapiens
gtacatggcagagttt

SEQ ID NO: 5038159 - DNA, 19 bp, Homo sapiens
gtacctgttccttagacct

SEQ ID NO: 5038160 - DNA, 18 bp, Homo sapiens
gtacttcaggggcacttc

SEQ ID NO: 5038161 - DNA, 16 bp, Homo sapiens
gtagattctgtggaac

SEQ ID NO: 5038162 - DNA, 22 bp, Homo sapiens
gtagcttaccagaagcttccat

SEQ ID NO: 5038163 - DNA, 19 bp, Homo sapiens
gtataactgtgcagagact

SEQ ID NO: 5038164 - DNA, 19 bp, Homo sapiens
gtatacaaccctggcatta

SEQ ID NO: 5038165 - DNA, 14 bp, Homo sapiens
gtatatattcccaa

SEQ ID NO: 5038166 - DNA, 13 bp, Homo sapiens
gtatgtgtgtaga

SEQ ID NO: 5038167 - DNA, 11 bp, Homo sapiens
gtatgttgtcc

SEQ ID NO: 5038168 - DNA, 21 bp, Homo sapiens
gtatgttgtccaattgttgac

SEQ ID NO: 5038169 - DNA, 14 bp, Homo sapiens
gtcatcagccacca

SEQ ID NO: 5038170 - DNA, 23 bp, Homo sapiens
gtccactgtgtatagaagtagat

SEQ ID NO: 5038171 - DNA, 16 bp, Homo sapiens
gtccccttccaggggt

SEQ ID NO: 5038172 - DNA, 11 bp, Homo sapiens
gtccttgaaaa

SEQ ID NO: 5038173 - DNA, 18 bp, Homo sapiens
gtcctttccaaggcttct

SEQ ID NO: 5038174 - DNA, 15 bp, Homo sapiens
gtctcactgaaacat

SEQ ID NO: 5038175 - DNA, 21 bp, Homo sapiens
gtctcactgaaacatttaaat

SEQ ID NO: 5038176 - DNA, 22 bp, Homo sapiens
gtctgtttccaggtcagaaacc

SEQ ID NO: 5038177 - DNA, 14 bp, Homo sapiens
gtcttttgaatatt

SEQ ID NO: 5038178 - DNA, 18 bp, Homo sapiens
gtgaacaaaagatgctct

SEQ ID NO: 5038179 - DNA, 19 bp, Homo sapiens
gtgaacaaaagatgctctt

SEQ ID NO: 5038180 - DNA, 13 bp, Homo sapiens
gtgatcagcagag

SEQ ID NO: 5038181 - DNA, 14 bp, Homo sapiens
gtgatcagcagaga

SEQ ID NO: 5038182 - DNA, 23 bp, Homo sapiens
gtgattgacaactgaagagacac

SEQ ID NO: 5038183 - DNA, 23 bp, Homo sapiens
gtgcagaggaagtggaaggcatc

SEQ ID NO: 5038184 - DNA, 21 bp, Homo sapiens
gtgcatttttatctgtgagtt

SEQ ID NO: 5038185 - DNA, 19 bp, Homo sapiens
gtgcctgtacaagctgatg

SEQ ID NO: 5038186 - DNA, 18 bp, Homo sapiens
gtgtatagaagtagatta

SEQ ID NO: 5038187 - DNA, 19 bp, Homo sapiens
gtgtctgaaccaccctgga

SEQ ID NO: 5038188 - DNA, 16 bp, Homo sapiens
gtgtgttgtcttgaaa

SEQ ID NO: 5038189 - DNA, 12 bp, Homo sapiens
gtgttcctcttt

SEQ ID NO: 5038190 - DNA, 16 bp, Homo sapiens
gtgttgtcttgaaaga

SEQ ID NO: 5038191 - DNA, 17 bp, Homo sapiens
gtgtttctattgacttc

SEQ ID NO: 5038192 - DNA, 14 bp, Homo sapiens
gtgtttgtcaaaaa

SEQ ID NO: 5038193 - DNA, 17 bp, Homo sapiens
gttagttatagatgtct

SEQ ID NO: 5038194 - DNA, 19 bp, Homo sapiens
gttagttatagatgtctag

SEQ ID NO: 5038195 - DNA, 12 bp, Homo sapiens
gttcagaagacc

SEQ ID NO: 5038196 - DNA, 16 bp, Homo sapiens
gttccacgtgttttat

SEQ ID NO: 5038197 - DNA, 14 bp, Homo sapiens
gttccactggagaa

SEQ ID NO: 5038198 - DNA, 15 bp, Homo sapiens
gttcctctttgcatg

SEQ ID NO: 5038199 - DNA, 13 bp, Homo sapiens
gttccttagacct

SEQ ID NO: 5038200 - DNA, 12 bp, Homo sapiens
gttgtgttgtca

SEQ ID NO: 5038201 - DNA, 22 bp, Homo sapiens
gtttaaaagcatactctatgtg

SEQ ID NO: 5038202 - DNA, 18 bp, Homo sapiens
gtttggattcttatgtag

SEQ ID NO: 5038203 - DNA, 20 bp, Homo sapiens
gtttgtatgtgtgtagacaa

SEQ ID NO: 5038204 - DNA, 14 bp, Homo sapiens
gttttgtcttgaat

SEQ ID NO: 5038205 - DNA, 23 bp, Homo sapiens
gtttttaaatagagtttgctatt

SEQ ID NO: 5038206 - DNA, 22 bp, Homo sapiens
taaaagcatactctatgtgatt

SEQ ID NO: 5038207 - DNA, 14 bp, Homo sapiens
taaagacataggaa

SEQ ID NO: 5038208 - DNA, 18 bp, Homo sapiens
taaattttaccctttaga

SEQ ID NO: 5038209 - DNA, 22 bp, Homo sapiens
taacagagtttgatatgggctt

SEQ ID NO: 5038210 - DNA, 22 bp, Homo sapiens
taacagattttggggttgtgtt

SEQ ID NO: 5038211 - DNA, 13 bp, Homo sapiens
taacagctttctc

SEQ ID NO: 5038212 - DNA, 17 bp, Homo sapiens
taacagctttctccaga

SEQ ID NO: 5038213 - DNA, 17 bp, Homo sapiens
taactgggttcaaaaag

SEQ ID NO: 5038214 - DNA, 16 bp, Homo sapiens
taactttatgtgtaaa

SEQ ID NO: 5038215 - DNA, 18 bp, Homo sapiens
taactttatgtgtaaata

SEQ ID NO: 5038216 - DNA, 24 bp, Homo sapiens
taagaaatctagtatttcatgctg

SEQ ID NO: 5038217 - DNA, 23 bp, Homo sapiens
taagaagatgttttgaaatgtac

SEQ ID NO: 5038218 - DNA, 12 bp, Homo sapiens
taagtttgaagg

SEQ ID NO: 5038219 - DNA, 15 bp, Homo sapiens
taattcaagctttcc

SEQ ID NO: 5038220 - DNA, 19 bp, Homo sapiens
tacagatcctctggggttt

SEQ ID NO: 5038221 - DNA, 13 bp, Homo sapiens
tacagtaacttta

SEQ ID NO: 5038222 - DNA, 18 bp, Homo sapiens
tacagtaactttatgtgt

SEQ ID NO: 5038223 - DNA, 20 bp, Homo sapiens
tacagtaactttatgtgtaa

SEQ ID NO: 5038224 - DNA, 22 bp, Homo sapiens
taccatcaaatgttaacagagt

SEQ ID NO: 5038225 - DNA, 14 bp, Homo sapiens
taccatgaacagaa

SEQ ID NO: 5038226 - DNA, 21 bp, Homo sapiens
taccattttttaaggaaacaa

SEQ ID NO: 5038227 - DNA, 13 bp, Homo sapiens
tacctgttcctta

SEQ ID NO: 5038228 - DNA, 16 bp, Homo sapiens
tacctttctgagtctc

SEQ ID NO: 5038229 - DNA, 14 bp, Homo sapiens
tacgtttgtatgtg

SEQ ID NO: 5038230 - DNA, 20 bp, Homo sapiens
tacgtttgtatgtgtgtaga

SEQ ID NO: 5038231 - DNA, 19 bp, Homo sapiens
tacttgggaggccgaggca

SEQ ID NO: 5038232 - DNA, 14 bp, Homo sapiens
tactttgtctgaaa

SEQ ID NO: 5038233 - DNA, 16 bp, Homo sapiens
tactttgtctgaaaaa

SEQ ID NO: 5038234 - DNA, 17 bp, Homo sapiens
tagaaaattatgcagct

SEQ ID NO: 5038235 - DNA, 16 bp, Homo sapiens
tagaagaacagcagat

SEQ ID NO: 5038236 - DNA, 16 bp, Homo sapiens
tagaggacgaaggcct

SEQ ID NO: 5038237 - DNA, 19 bp, Homo sapiens
tagccagcacttgtatata

SEQ ID NO: 5038238 - DNA, 14 bp, Homo sapiens
taggccatgaaaaa

SEQ ID NO: 5038239 - DNA, 16 bp, Homo sapiens
tagtacctgaaaagta

SEQ ID NO: 5038240 - DNA, 13 bp, Homo sapiens
tagtactgctctt

SEQ ID NO: 5038241 - DNA, 18 bp, Homo sapiens
tagtgggcaccccactgc

SEQ ID NO: 5038242 - DNA, 16 bp, Homo sapiens
tagttatgtgagaaag

SEQ ID NO: 5038243 - DNA, 17 bp, Homo sapiens
tagtttacctctttaaa

SEQ ID NO: 5038244 - DNA, 19 bp, Homo sapiens
tataaaaggcaaatgtgta

SEQ ID NO: 5038245 - DNA, 19 bp, Homo sapiens
tataatcccagcatgttga

SEQ ID NO: 5038246 - DNA, 22 bp, Homo sapiens
tatacaaccctggcattatgtc

SEQ ID NO: 5038247 - DNA, 19 bp, Homo sapiens
tatacagtaactttatgtg

SEQ ID NO: 5038248 - DNA, 20 bp, Homo sapiens
tatacagtaactttatgtgt

SEQ ID NO: 5038249 - DNA, 18 bp, Homo sapiens
tatatacgcatctataaa

SEQ ID NO: 5038250 - DNA, 13 bp, Homo sapiens
tatatatacagta

SEQ ID NO: 5038251 - DNA, 14 bp, Homo sapiens
tatatgtgtatgta

SEQ ID NO: 5038252 - DNA, 13 bp, Homo sapiens
tatctatatatgt

SEQ ID NO: 5038253 - DNA, 16 bp, Homo sapiens
tatctatatatgtgta

SEQ ID NO: 5038254 - DNA, 17 bp, Homo sapiens
tatctatatatgtgtat

SEQ ID NO: 5038255 - DNA, 13 bp, Homo sapiens
tatgatgtttaaa

SEQ ID NO: 5038256 - DNA, 19 bp, Homo sapiens
tatgatgtttaaaagcata

SEQ ID NO: 5038257 - DNA, 14 bp, Homo sapiens
tatggagtgcctgt

SEQ ID NO: 5038258 - DNA, 18 bp, Homo sapiens
tatgggctttctctttgg

SEQ ID NO: 5038259 - DNA, 12 bp, Homo sapiens
tatgtgtatgta

SEQ ID NO: 5038260 - DNA, 18 bp, Homo sapiens
tatgttgcctttatggtt

SEQ ID NO: 5038261 - DNA, 20 bp, Homo sapiens
tattcccaagcccatgagtc

SEQ ID NO: 5038262 - DNA, 14 bp, Homo sapiens
tattcctgtatgtt

SEQ ID NO: 5038263 - DNA, 21 bp, Homo sapiens
tattgcaaaggttccaactgt

SEQ ID NO: 5038264 - DNA, 22 bp, Homo sapiens
tattgcaaaggttccaactgta

SEQ ID NO: 5038265 - DNA, 20 bp, Homo sapiens
tatttctacctttctgagtc

SEQ ID NO: 5038266 - DNA, 18 bp, Homo sapiens
tatttgcagttcacctgc

SEQ ID NO: 5038267 - DNA, 15 bp, Homo sapiens
tattttctccgaaag

SEQ ID NO: 5038268 - DNA, 11 bp, Homo sapiens
tcaaaaagaaa

SEQ ID NO: 5038269 - DNA, 13 bp, Homo sapiens
tcaaaaagtcatt

SEQ ID NO: 5038270 - DNA, 20 bp, Homo sapiens
tcaaaaggatttactttttg

SEQ ID NO: 5038271 - DNA, 19 bp, Homo sapiens
tcaacttgcatccaactcc

SEQ ID NO: 5038272 - DNA, 17 bp, Homo sapiens
tcacagttggccttcag

SEQ ID NO: 5038273 - DNA, 22 bp, Homo sapiens
tcagaaaccattgttcagaaga

SEQ ID NO: 5038274 - DNA, 23 bp, Homo sapiens
tcagcttcagaatggcattgtac

SEQ ID NO: 5038275 - DNA, 16 bp, Homo sapiens
tcaggtatgttgcctt

SEQ ID NO: 5038276 - DNA, 17 bp, Homo sapiens
tcagtccctatgtattt

SEQ ID NO: 5038277 - DNA, 16 bp, Homo sapiens
tcatagccatacctgg

SEQ ID NO: 5038278 - DNA, 12 bp, Homo sapiens
tcatcttactgt

SEQ ID NO: 5038279 - DNA, 16 bp, Homo sapiens
tcatcttactgtacct

SEQ ID NO: 5038280 - DNA, 20 bp, Homo sapiens
tccaactgtatatattccca

SEQ ID NO: 5038281 - DNA, 14 bp, Homo sapiens
tccacaggggctat

SEQ ID NO: 5038282 - DNA, 24 bp, Homo sapiens
tccacaggggctatcccttctcag

SEQ ID NO: 5038283 - DNA, 19 bp, Homo sapiens
tccaggggtcaccttgaga

SEQ ID NO: 5038284 - DNA, 16 bp, Homo sapiens
tccataatgctactgt

SEQ ID NO: 5038285 - DNA, 22 bp, Homo sapiens
tcccaatagcaacgtagcttct

SEQ ID NO: 5038286 - DNA, 20 bp, Homo sapiens
tcccagcatgttgagaggct

SEQ ID NO: 5038287 - DNA, 16 bp, Homo sapiens
tccccttcctcactgc

SEQ ID NO: 5038288 - DNA, 13 bp, Homo sapiens
tccctatgtattt

SEQ ID NO: 5038289 - DNA, 15 bp, Homo sapiens
tccctatgtatttgc

SEQ ID NO: 5038290 - DNA, 19 bp, Homo sapiens
tcccttctcagaaaacttc

SEQ ID NO: 5038291 - DNA, 14 bp, Homo sapiens
tcctattgcaaagg

SEQ ID NO: 5038292 - DNA, 22 bp, Homo sapiens
tcctcaaaagaaagagaaatga

SEQ ID NO: 5038293 - DNA, 19 bp, Homo sapiens
tcctcagggtccctcagga

SEQ ID NO: 5038294 - DNA, 15 bp, Homo sapiens
tcctgtctttctgag

SEQ ID NO: 5038295 - DNA, 17 bp, Homo sapiens
tccttagaccttccata

SEQ ID NO: 5038296 - DNA, 21 bp, Homo sapiens
tcctttatgtggaaaacagaa

SEQ ID NO: 5038297 - DNA, 18 bp, Homo sapiens
tcctttccaaggcttctc

SEQ ID NO: 5038298 - DNA, 19 bp, Homo sapiens
tctaccatgaacagaaaac

SEQ ID NO: 5038299 - DNA, 15 bp, Homo sapiens
tctacctttctgagt

SEQ ID NO: 5038300 - DNA, 16 bp, Homo sapiens
tctataaattgtccgt

SEQ ID NO: 5038301 - DNA, 16 bp, Homo sapiens
tctatatatgtgtatg

SEQ ID NO: 5038302 - DNA, 22 bp, Homo sapiens
tctattgacttcaatgatagta

SEQ ID NO: 5038303 - DNA, 17 bp, Homo sapiens
tctcctgctcctcagga

SEQ ID NO: 5038304 - DNA, 19 bp, Homo sapiens
tctgcccaaaaatatggtt

SEQ ID NO: 5038305 - DNA, 12 bp, Homo sapiens
tctgggcatggt

SEQ ID NO: 5038306 - DNA, 16 bp, Homo sapiens
tctgtagattctgtgg

SEQ ID NO: 5038307 - DNA, 23 bp, Homo sapiens
tctgtagattctgtggaacaagc

SEQ ID NO: 5038308 - DNA, 18 bp, Homo sapiens
tctgttatttagactcat

SEQ ID NO: 5038309 - DNA, 20 bp, Homo sapiens
tcttagactacatttagaga

SEQ ID NO: 5038310 - DNA, 16 bp, Homo sapiens
tcttagtttggattct

SEQ ID NO: 5038311 - DNA, 14 bp, Homo sapiens
tcttgaatgtcttt

SEQ ID NO: 5038312 - DNA, 16 bp, Homo sapiens
tcttggactaagaaga

SEQ ID NO: 5038313 - DNA, 22 bp, Homo sapiens
tcttgtttcttttcacatagct

SEQ ID NO: 5038314 - DNA, 18 bp, Homo sapiens
tctttcaacttgcatcca

SEQ ID NO: 5038315 - DNA, 23 bp, Homo sapiens
tcttttgaatattcccaagccca

SEQ ID NO: 5038316 - DNA, 23 bp, Homo sapiens
tgaaaatattttttatatataca

SEQ ID NO: 5038317 - DNA, 22 bp, Homo sapiens
tgaaatgtaccatcaaatgtta

SEQ ID NO: 5038318 - DNA, 17 bp, Homo sapiens
tgaacaatcaaggcaac

SEQ ID NO: 5038319 - DNA, 16 bp, Homo sapiens
tgaacttattctgtag

SEQ ID NO: 5038320 - DNA, 15 bp, Homo sapiens
tgaatgtcttttgaa

SEQ ID NO: 5038321 - DNA, 22 bp, Homo sapiens
tgacaactgaagagacacgtgg

SEQ ID NO: 5038322 - DNA, 22 bp, Homo sapiens
tgacagctgttccacaggggct

SEQ ID NO: 5038323 - DNA, 17 bp, Homo sapiens
tgacagttctgaagaat

SEQ ID NO: 5038324 - DNA, 14 bp, Homo sapiens
tgacatggagttcc

SEQ ID NO: 5038325 - DNA, 17 bp, Homo sapiens
tgacttcaatgatagta

SEQ ID NO: 5038326 - DNA, 20 bp, Homo sapiens
tgagagagttgctcctcagg

SEQ ID NO: 5038327 - DNA, 20 bp, Homo sapiens
tgagaggcatgacagctgtt

SEQ ID NO: 5038328 - DNA, 19 bp, Homo sapiens
tgagaggctgaggtgggca

SEQ ID NO: 5038329 - DNA, 18 bp, Homo sapiens
tgagatatttttacctgc

SEQ ID NO: 5038330 - DNA, 22 bp, Homo sapiens
tgagccctcctggaatggagct

SEQ ID NO: 5038331 - DNA, 23 bp, Homo sapiens
tgagcctctttaacagctttctc

SEQ ID NO: 5038332 - DNA, 17 bp, Homo sapiens
tgaggccaggagttcaa

SEQ ID NO: 5038333 - DNA, 15 bp, Homo sapiens
tgaggttcagcaagg

SEQ ID NO: 5038334 - DNA, 24 bp, Homo sapiens
tgaggttcagcaaggtgagagagg

SEQ ID NO: 5038335 - DNA, 18 bp, Homo sapiens
tgagtccttgaaaatatt

SEQ ID NO: 5038336 - DNA, 17 bp, Homo sapiens
tgatacaagattagaag

SEQ ID NO: 5038337 - DNA, 18 bp, Homo sapiens
tgatccccaagtgtgaac

SEQ ID NO: 5038338 - DNA, 17 bp, Homo sapiens
tgatgaacttattctgt

SEQ ID NO: 5038339 - DNA, 15 bp, Homo sapiens
tgatgatacaagatt

SEQ ID NO: 5038340 - DNA, 12 bp, Homo sapiens
tgattcactgca

SEQ ID NO: 5038341 - DNA, 13 bp, Homo sapiens
tgattcactgcat

SEQ ID NO: 5038342 - DNA, 17 bp, Homo sapiens
tgattcactgcatggct

SEQ ID NO: 5038343 - DNA, 23 bp, Homo sapiens
tgcacgttaaaaattaaaagaag

SEQ ID NO: 5038344 - DNA, 17 bp, Homo sapiens
tgcatccaactccagga

SEQ ID NO: 5038345 - DNA, 15 bp, Homo sapiens
tgcatgagcttttat

SEQ ID NO: 5038346 - DNA, 20 bp, Homo sapiens
tgcatgatctgtcaaagtga

SEQ ID NO: 5038347 - DNA, 19 bp, Homo sapiens
tgccaatagttgctgtccc

SEQ ID NO: 5038348 - DNA, 18 bp, Homo sapiens
tgccatactttgtctgaa

SEQ ID NO: 5038349 - DNA, 19 bp, Homo sapiens
tgccatatttttgagggct

SEQ ID NO: 5038350 - DNA, 14 bp, Homo sapiens
tgcctaaaatatga

SEQ ID NO: 5038351 - DNA, 12 bp, Homo sapiens
tgctcctcagga

SEQ ID NO: 5038352 - DNA, 22 bp, Homo sapiens
tgctcctcagggtccctcagga

SEQ ID NO: 5038353 - DNA, 22 bp, Homo sapiens
tgctctcgcacctttccaaagt

SEQ ID NO: 5038354 - DNA, 13 bp, Homo sapiens
tgctcttctgtgg

SEQ ID NO: 5038355 - DNA, 21 bp, Homo sapiens
tggaactctcctgctcctcag

SEQ ID NO: 5038356 - DNA, 23 bp, Homo sapiens
tggaactctcctgctcctcagga

SEQ ID NO: 5038357 - DNA, 20 bp, Homo sapiens
tggaagtaaccatttgcact

SEQ ID NO: 5038358 - DNA, 12 bp, Homo sapiens
tggaccactgca

SEQ ID NO: 5038359 - DNA, 15 bp, Homo sapiens
tggagagaaggcctc

SEQ ID NO: 5038360 - DNA, 20 bp, Homo sapiens
tggcaaaagacatcctcaaa

SEQ ID NO: 5038361 - DNA, 18 bp, Homo sapiens
tggcagagtttgtgtgtt

SEQ ID NO: 5038362 - DNA, 23 bp, Homo sapiens
tggcattatgtccactgtgtata

SEQ ID NO: 5038363 - DNA, 14 bp, Homo sapiens
tggccgggcatggt

SEQ ID NO: 5038364 - DNA, 17 bp, Homo sapiens
tggccgggcatggtagc

SEQ ID NO: 5038365 - DNA, 21 bp, Homo sapiens
tggctagggttccactggaga

SEQ ID NO: 5038366 - DNA, 16 bp, Homo sapiens
tgggaaaacactgcca

SEQ ID NO: 5038367 - DNA, 15 bp, Homo sapiens
tgggaatgagacata

SEQ ID NO: 5038368 - DNA, 16 bp, Homo sapiens
tgggagcctcagactc

SEQ ID NO: 5038369 - DNA, 16 bp, Homo sapiens
tgggcaccccactgca

SEQ ID NO: 5038370 - DNA, 16 bp, Homo sapiens
tgggcatggtggggca

SEQ ID NO: 5038371 - DNA, 16 bp, Homo sapiens
aacagattttggggtt

SEQ ID NO: 5038372 - DNA, 17 bp, Homo sapiens
aacagctttctccagaa

SEQ ID NO: 5038373 - DNA, 20 bp, Homo sapiens
aacagctttctccagaacca

SEQ ID NO: 5038374 - DNA, 19 bp, Homo sapiens
aacagttaataccattttt

SEQ ID NO: 5038375 - DNA, 17 bp, Homo sapiens
aacattctgatttggaa

SEQ ID NO: 5038376 - DNA, 11 bp, Homo sapiens
aactgtggccg

SEQ ID NO: 5038377 - DNA, 20 bp, Homo sapiens
aactgtggccgttatctgga

SEQ ID NO: 5038378 - DNA, 23 bp, Homo sapiens
aacttattctgtagattctgtgg

SEQ ID NO: 5038379 - DNA, 15 bp, Homo sapiens
aacttctcttctgag

SEQ ID NO: 5038380 - DNA, 13 bp, Homo sapiens
aactttatgtgta

SEQ ID NO: 5038381 - DNA, 21 bp, Homo sapiens
aactttgaggaggaagcagaa

SEQ ID NO: 5038382 - DNA, 12 bp, Homo sapiens
aagaaagtcaga

SEQ ID NO: 5038383 - DNA, 20 bp, Homo sapiens
aagagaaatgaaatattttt

SEQ ID NO: 5038384 - DNA, 15 bp, Homo sapiens
aagatgctcttctgt

SEQ ID NO: 5038385 - DNA, 14 bp, Homo sapiens
aagcacagtttgaa

SEQ ID NO: 5038386 - DNA, 15 bp, Homo sapiens
aagcacagtttgaac

SEQ ID NO: 5038387 - DNA, 16 bp, Homo sapiens
aagcacagtttgaaca

SEQ ID NO: 5038388 - DNA, 22 bp, Homo sapiens
aagcccatgagtccttgaaaat

SEQ ID NO: 5038389 - DNA, 17 bp, Homo sapiens
aaggacagagtatgaac

SEQ ID NO: 5038390 - DNA, 21 bp, Homo sapiens
aaggatttactttttgtaaaa

SEQ ID NO: 5038391 - DNA, 18 bp, Homo sapiens
aaggcaaatgtgtacatg

SEQ ID NO: 5038392 - DNA, 13 bp, Homo sapiens
aagtcctttatgt

SEQ ID NO: 5038393 - DNA, 22 bp, Homo sapiens
aagtgcatttttatctgtgagt

SEQ ID NO: 5038394 - DNA, 17 bp, Homo sapiens
aagtgtgaacaaaagat

SEQ ID NO: 5038395 - DNA, 16 bp, Homo sapiens
aagttcttaggcacca

SEQ ID NO: 5038396 - DNA, 23 bp, Homo sapiens
aataccattttttaaggaaacaa

SEQ ID NO: 5038397 - DNA, 14 bp, Homo sapiens
aatataaaaggcaa

SEQ ID NO: 5038398 - DNA, 19 bp, Homo sapiens
aatattttttatatataca

SEQ ID NO: 5038399 - DNA, 12 bp, Homo sapiens
aatcctgtcttt

SEQ ID NO: 5038400 - DNA, 20 bp, Homo sapiens
aatgatccccaagtgtgaac

SEQ ID NO: 5038401 - DNA, 21 bp, Homo sapiens
aatggatttgatgctgtttga

SEQ ID NO: 5038402 - DNA, 23 bp, Homo sapiens
aatggtagtaatcacagttggcc

SEQ ID NO: 5038403 - DNA, 17 bp, Homo sapiens
aatgtcttttcaaaagg

SEQ ID NO: 5038404 - DNA, 18 bp, Homo sapiens
aatgtcttttcaaaagga

SEQ ID NO: 5038405 - DNA, 15 bp, Homo sapiens
aatgtcttttgaata

SEQ ID NO: 5038406 - DNA, 21 bp, Homo sapiens
aatgtgcccttttggccgggc

SEQ ID NO: 5038407 - DNA, 14 bp, Homo sapiens
aattgaaaaggact

SEQ ID NO: 5038408 - DNA, 17 bp, Homo sapiens
acaaagcacagtttgaa

SEQ ID NO: 5038409 - DNA, 18 bp, Homo sapiens
acaaagcacagtttgaac

SEQ ID NO: 5038410 - DNA, 19 bp, Homo sapiens
acaaagcacagtttgaaca

SEQ ID NO: 5038411 - DNA, 21 bp, Homo sapiens
acaatataaccacaaagcaca

SEQ ID NO: 5038412 - DNA, 16 bp, Homo sapiens
acaatatgtatagcat

SEQ ID NO: 5038413 - DNA, 20 bp, Homo sapiens
acacatacacggtattccca

SEQ ID NO: 5038414 - DNA, 22 bp, Homo sapiens
acactgccatcttagtttggat

SEQ ID NO: 5038415 - DNA, 22 bp, Homo sapiens
acagaaaacattctgatttgga

SEQ ID NO: 5038416 - DNA, 23 bp, Homo sapiens
acagagtatgaacacctgggctt

SEQ ID NO: 5038417 - DNA, 14 bp, Homo sapiens
acagatcctctggg

SEQ ID NO: 5038418 - DNA, 15 bp, Homo sapiens
acagctttctccaga

SEQ ID NO: 5038419 - DNA, 16 bp, Homo sapiens
acagctttctccagaa

SEQ ID NO: 5038420 - DNA, 10 bp, Homo sapiens
acagtaactt

SEQ ID NO: 5038421 - DNA, 21 bp, Homo sapiens
acagtaactttatgtgtaaat

SEQ ID NO: 5038422 - DNA, 16 bp, Homo sapiens
acagttggccttcaga

SEQ ID NO: 5038423 - DNA, 14 bp, Homo sapiens
acatcctcaaaaga

SEQ ID NO: 5038424 - DNA, 20 bp, Homo sapiens
accacaaagcacagtttgaa

SEQ ID NO: 5038425 - DNA, 23 bp, Homo sapiens
accatgaacagaaaacattctga

SEQ ID NO: 5038426 - DNA, 22 bp, Homo sapiens
accgggccagtatctatatatg

SEQ ID NO: 5038427 - DNA, 13 bp, Homo sapiens
acctgggctttct

SEQ ID NO: 5038428 - DNA, 12 bp, Homo sapiens
acctttctgagt

SEQ ID NO: 5038429 - DNA, 15 bp, Homo sapiens
actatgggagcctca

SEQ ID NO: 5038430 - DNA, 19 bp, Homo sapiens
actcatcttactgtacctg

SEQ ID NO: 5038431 - DNA, 17 bp, Homo sapiens
actctcctgctcctcag

SEQ ID NO: 5038432 - DNA, 18 bp, Homo sapiens
actctcctgctcctcagg

SEQ ID NO: 5038433 - DNA, 19 bp, Homo sapiens
actctcctgctcctcagga

SEQ ID NO: 5038434 - DNA, 20 bp, Homo sapiens
actctcctgctcctcaggaa

SEQ ID NO: 5038435 - DNA, 15 bp, Homo sapiens
actctgctttgcatc

SEQ ID NO: 5038436 - DNA, 16 bp, Homo sapiens
actctgttatttagac

SEQ ID NO: 5038437 - DNA, 13 bp, Homo sapiens
actgaagagacac

SEQ ID NO: 5038438 - DNA, 19 bp, Homo sapiens
actgcactccagcctgggc

SEQ ID NO: 5038439 - DNA, 18 bp, Homo sapiens
actggagaattgaaaagg

SEQ ID NO: 5038440 - DNA, 15 bp, Homo sapiens
actggagttctatgc

SEQ ID NO: 5038441 - DNA, 18 bp, Homo sapiens
actgggttcaaaaagaaa

SEQ ID NO: 5038442 - DNA, 12 bp, Homo sapiens
actgtctcactg

SEQ ID NO: 5038443 - DNA, 14 bp, Homo sapiens
actgtgcagagact

SEQ ID NO: 5038444 - DNA, 22 bp, Homo sapiens
acttacttgggaggccgaggca

SEQ ID NO: 5038445 - DNA, 21 bp, Homo sapiens
acttcattgagagttttgtct

SEQ ID NO: 5038446 - DNA, 14 bp, Homo sapiens
acttctcttctgag

SEQ ID NO: 5038447 - DNA, 19 bp, Homo sapiens
acttctcttctgagcctct

SEQ ID NO: 5038448 - DNA, 13 bp, Homo sapiens
acttggctttcat

SEQ ID NO: 5038449 - DNA, 14 bp, Homo sapiens
actttgaggaggaa

SEQ ID NO: 5038450 - DNA, 13 bp, Homo sapiens
agaacagcagatg

SEQ ID NO: 5038451 - DNA, 15 bp, Homo sapiens
agaacatcattagaa

SEQ ID NO: 5038452 - DNA, 19 bp, Homo sapiens
agaaccagtgtctgaacca

SEQ ID NO: 5038453 - DNA, 13 bp, Homo sapiens
agaagctgcagct

SEQ ID NO: 5038454 - DNA, 16 bp, Homo sapiens
agaatctttgcaagaa

SEQ ID NO: 5038455 - DNA, 16 bp, Homo sapiens
agacaaatatttggag

SEQ ID NO: 5038456 - DNA, 13 bp, Homo sapiens
agaccttccataa

SEQ ID NO: 5038457 - DNA, 16 bp, Homo sapiens
agagagaatcagacct

SEQ ID NO: 5038458 - DNA, 19 bp, Homo sapiens
agagagaatcagacctggg

SEQ ID NO: 5038459 - DNA, 17 bp, Homo sapiens
agagagggaggtatgga

SEQ ID NO: 5038460 - DNA, 23 bp, Homo sapiens
agagattgaactttgaggaggaa

SEQ ID NO: 5038461 - DNA, 20 bp, Homo sapiens
agagcaagactctgtctcaa

SEQ ID NO: 5038462 - DNA, 17 bp, Homo sapiens
agagcacttcacacaga

SEQ ID NO: 5038463 - DNA, 19 bp, Homo sapiens
agagcattgaattggagag

SEQ ID NO: 5038464 - DNA, 16 bp, Homo sapiens
agaggcatgacagctg

SEQ ID NO: 5038465 - DNA, 17 bp, Homo sapiens
agagtacagatcctctg

SEQ ID NO: 5038466 - DNA, 14 bp, Homo sapiens
agagtatgaacacc

SEQ ID NO: 5038467 - DNA, 22 bp, Homo sapiens
agagtggtggcagctcaaaatg

SEQ ID NO: 5038468 - DNA, 16 bp, Homo sapiens
agagtttgtgtgttgt

SEQ ID NO: 5038469 - DNA, 19 bp, Homo sapiens
agagtttgtgtgttgtctt

SEQ ID NO: 5038470 - DNA, 16 bp, Homo sapiens
agagttttgtcttgaa

SEQ ID NO: 5038471 - DNA, 19 bp, Homo sapiens
agattcaggtatgttgcct

SEQ ID NO: 5038472 - DNA, 12 bp, Homo sapiens
agcacttgtata

SEQ ID NO: 5038473 - DNA, 21 bp, Homo sapiens
agcagaatctttgcaagaaag

SEQ ID NO: 5038474 - DNA, 14 bp, Homo sapiens
agcatactctatgt

SEQ ID NO: 5038475 - DNA, 19 bp, Homo sapiens
agccaagatcacgccactg

SEQ ID NO: 5038476 - DNA, 21 bp, Homo sapiens
agcctctttaacagctttctc

SEQ ID NO: 5038477 - DNA, 16 bp, Homo sapiens
agcctgggcaacagag

SEQ ID NO: 5038478 - DNA, 23 bp, Homo sapiens
agctgatgttttgtattttgtgt

SEQ ID NO: 5038479 - DNA, 20 bp, Homo sapiens
agctggtctgtttccaggtc

SEQ ID NO: 5038480 - DNA, 14 bp, Homo sapiens
agctgttccacagg

SEQ ID NO: 5038481 - DNA, 22 bp, Homo sapiens
agcttaccagaagcttccatag

SEQ ID NO: 5038482 - DNA, 22 bp, Homo sapiens
agcttcattctcactctgcttt

SEQ ID NO: 5038483 - DNA, 15 bp, Homo sapiens
aggaccaaagaacac

SEQ ID NO: 5038484 - DNA, 17 bp, Homo sapiens
aggagttcaagaccagt

SEQ ID NO: 5038485 - DNA, 17 bp, Homo sapiens
aggcaaatgtgtacatg

SEQ ID NO: 5038486 - DNA, 17 bp, Homo sapiens
aggcaactagtggagag

SEQ ID NO: 5038487 - DNA, 23 bp, Homo sapiens
aggcaccatagaagaacagcaga

SEQ ID NO: 5038488 - DNA, 18 bp, Homo sapiens
aggcacctgggctttctg

SEQ ID NO: 5038489 - DNA, 19 bp, Homo sapiens
aggcatcagtccctatgta

SEQ ID NO: 5038490 - DNA, 23 bp, Homo sapiens
aggcctgtgtgttgccaggcagg

SEQ ID NO: 5038491 - DNA, 17 bp, Homo sapiens
aggctgaggtgggcaga

SEQ ID NO: 5038492 - DNA, 22 bp, Homo sapiens
aggcttctccaattctgcccaa

SEQ ID NO: 5038493 - DNA, 16 bp, Homo sapiens
aggggctatcccttct

SEQ ID NO: 5038494 - DNA, 19 bp, Homo sapiens
aggggctatcccttctcag

SEQ ID NO: 5038495 - DNA, 17 bp, Homo sapiens
aggttccaactgtatat

SEQ ID NO: 5038496 - DNA, 14 bp, Homo sapiens
agtaaccatttgca

SEQ ID NO: 5038497 - DNA, 19 bp, Homo sapiens
agtaactttatgtgtaaat

SEQ ID NO: 5038498 - DNA, 13 bp, Homo sapiens
agtaagaaaagtg

SEQ ID NO: 5038499 - DNA, 14 bp, Homo sapiens
agtacagatcctct

SEQ ID NO: 5038500 - DNA, 14 bp, Homo sapiens
agtacctgaaaagt

SEQ ID NO: 5038501 - DNA, 18 bp, Homo sapiens
gagaatcagacctgggtg

SEQ ID NO: 5038502 - DNA, 15 bp, Homo sapiens
gagagagaatcagac

SEQ ID NO: 5038503 - DNA, 17 bp, Homo sapiens
gagaggctgaggtgggc

SEQ ID NO: 5038504 - DNA, 16 bp, Homo sapiens
gagagttgctcctcag

SEQ ID NO: 5038505 - DNA, 20 bp, Homo sapiens
gagcacactttagtggccga

SEQ ID NO: 5038506 - DNA, 18 bp, Homo sapiens
gagcacttcacacagaca

SEQ ID NO: 5038507 - DNA, 12 bp, Homo sapiens
gagcctcagact

SEQ ID NO: 5038508 - DNA, 15 bp, Homo sapiens
gaggttcagcaaggt

SEQ ID NO: 5038509 - DNA, 15 bp, Homo sapiens
gatatgggctttctc

SEQ ID NO: 5038510 - DNA, 21 bp, Homo sapiens
gatatgggctttctctttggt

SEQ ID NO: 5038511 - DNA, 18 bp, Homo sapiens
gatccccaagtgtgaaca

SEQ ID NO: 5038512 - DNA, 20 bp, Homo sapiens
gatccccaagtgtgaacaaa

SEQ ID NO: 5038513 - DNA, 17 bp, Homo sapiens
gatctgtcaaagtgaga

SEQ ID NO: 5038514 - DNA, 14 bp, Homo sapiens
gatgctgtttgaca

SEQ ID NO: 5038515 - DNA, 17 bp, Homo sapiens
gatggttattttctttt

SEQ ID NO: 5038516 - DNA, 21 bp, Homo sapiens
gcaaaggttccaactgtatat

SEQ ID NO: 5038517 - DNA, 16 bp, Homo sapiens
gcaactagtggagaga

SEQ ID NO: 5038518 - DNA, 16 bp, Homo sapiens
gcaaggtgagagaggt

SEQ ID NO: 5038519 - DNA, 14 bp, Homo sapiens
gcacagtttgaaca

SEQ ID NO: 5038520 - DNA, 19 bp, Homo sapiens
gcacttaaggcactctgtt

SEQ ID NO: 5038521 - DNA, 12 bp, Homo sapiens
gcacttgtatat

SEQ ID NO: 5038522 - DNA, 22 bp, Homo sapiens
gcagatggcggtgatcagcaga

SEQ ID NO: 5038523 - DNA, 16 bp, Homo sapiens
gcaggcatgtcctgga

SEQ ID NO: 5038524 - DNA, 19 bp, Homo sapiens
gcatggtggggcatgcctg

SEQ ID NO: 5038525 - DNA, 23 bp, Homo sapiens
gcattatgtccactgtgtataga

SEQ ID NO: 5038526 - DNA, 19 bp, Homo sapiens
gccactgcactccagcctg

SEQ ID NO: 5038527 - DNA, 15 bp, Homo sapiens
gccagcacttgtata

SEQ ID NO: 5038528 - DNA, 18 bp, Homo sapiens
gccatataagtttgaagg

SEQ ID NO: 5038529 - DNA, 14 bp, Homo sapiens
gcctttatggtttc

SEQ ID NO: 5038530 - DNA, 19 bp, Homo sapiens
gcggtgatcagcagagaga

SEQ ID NO: 5038531 - DNA, 12 bp, Homo sapiens
gctactgtctca

SEQ ID NO: 5038532 - DNA, 20 bp, Homo sapiens
gctagggttccactggagaa

SEQ ID NO: 5038533 - DNA, 14 bp, Homo sapiens
gctgtccccttcca

SEQ ID NO: 5038534 - DNA, 15 bp, Homo sapiens
gctttgaaggaacca

SEQ ID NO: 5038535 - DNA, 16 bp, Homo sapiens
ggacagagtatgaaca

SEQ ID NO: 5038536 - DNA, 14 bp, Homo sapiens
ggagcctcagactc

SEQ ID NO: 5038537 - DNA, 23 bp, Homo sapiens
ggagctgtataactgtgcagaga

SEQ ID NO: 5038538 - DNA, 16 bp, Homo sapiens
ggcaaaaatgtgccct

SEQ ID NO: 5038539 - DNA, 23 bp, Homo sapiens
ggcaccatagaagaacagcagat

SEQ ID NO: 5038540 - DNA, 21 bp, Homo sapiens
ggcagagtttgtgtgttgtct

SEQ ID NO: 5038541 - DNA, 16 bp, Homo sapiens
gggcatggtagctcaa

SEQ ID NO: 5038542 - DNA, 15 bp, Homo sapiens
gggcttaagaaatct

SEQ ID NO: 5038543 - DNA, 15 bp, Homo sapiens
ggggcatgcctgtag

SEQ ID NO: 5038544 - DNA, 22 bp, Homo sapiens
ggggtcaccttgagaggcatga

SEQ ID NO: 5038545 - DNA, 20 bp, Homo sapiens
ggtacttcaggggcacttca

SEQ ID NO: 5038546 - DNA, 18 bp, Homo sapiens
ggtatttttgccctgagt

SEQ ID NO: 5038547 - DNA, 11 bp, Homo sapiens
gtaaaaagctt

SEQ ID NO: 5038548 - DNA, 20 bp, Homo sapiens
gtaatctttcatagccatac

SEQ ID NO: 5038549 - DNA, 14 bp, Homo sapiens
gtacgtttgtatgt

SEQ ID NO: 5038550 - DNA, 15 bp, Homo sapiens
gtcacccctccagga

SEQ ID NO: 5038551 - DNA, 13 bp, Homo sapiens
gtccccttccagg

SEQ ID NO: 5038552 - DNA, 20 bp, Homo sapiens
gtcctggacaccgggccagt

SEQ ID NO: 5038553 - DNA, 14 bp, Homo sapiens
gtccttgaaaatat

SEQ ID NO: 5038554 - DNA, 21 bp, Homo sapiens
gtcctttatgtggaaaacaga

SEQ ID NO: 5038555 - DNA, 17 bp, Homo sapiens
gtcttgaatgtcttttg

SEQ ID NO: 5038556 - DNA, 16 bp, Homo sapiens
gtcttttcaaaaggat

SEQ ID NO: 5038557 - DNA, 19 bp, Homo sapiens
gtcttttgaatattcccaa

SEQ ID NO: 5038558 - DNA, 14 bp, Homo sapiens
gtgagaaagttaga

SEQ ID NO: 5038559 - DNA, 12 bp, Homo sapiens
gtgggaaaacac

SEQ ID NO: 5038560 - DNA, 17 bp, Homo sapiens
gtgtgtagacaaatatt

SEQ ID NO: 5038561 - DNA, 12 bp, Homo sapiens
gtgttcatacat

SEQ ID NO: 5038562 - DNA, 17 bp, Homo sapiens
gtgttcatacatttgag

SEQ ID NO: 5038563 - DNA, 13 bp, Homo sapiens
gtgttcctctttg

SEQ ID NO: 5038564 - DNA, 23 bp, Homo sapiens
gtgttgccaggcaggcacctggg

SEQ ID NO: 5038565 - DNA, 16 bp, Homo sapiens
gttcatacatttgagg

SEQ ID NO: 5038566 - DNA, 16 bp, Homo sapiens
gttcctctttgcatga

SEQ ID NO: 5038567 - DNA, 17 bp, Homo sapiens
gttgacagttctgaaga

SEQ ID NO: 5038568 - DNA, 12 bp, Homo sapiens
gttgatagttta

SEQ ID NO: 5038569 - DNA, 18 bp, Homo sapiens
gttggtgttccacgtgtt

SEQ ID NO: 5038570 - DNA, 16 bp, Homo sapiens
gtttacctgaataaat

SEQ ID NO: 5038571 - DNA, 11 bp, Homo sapiens
gtttcagaagc

SEQ ID NO: 5038572 - DNA, 14 bp, Homo sapiens
gtttcgtttctgta

SEQ ID NO: 5038573 - DNA, 15 bp, Homo sapiens
gtttcgtttctgtat

SEQ ID NO: 5038574 - DNA, 15 bp, Homo sapiens
gtttgaaggaaacag

SEQ ID NO: 5038575 - DNA, 14 bp, Homo sapiens
gtttgccatacttt

SEQ ID NO: 5038576 - DNA, 15 bp, Homo sapiens
gtttgccatactttg

SEQ ID NO: 5038577 - DNA, 22 bp, Homo sapiens
gtttgccatactttgtctgaaa

SEQ ID NO: 5038578 - DNA, 13 bp, Homo sapiens
gtttgtatgtgtg

SEQ ID NO: 5038579 - DNA, 15 bp, Homo sapiens
gtttgtgtgttgtct

SEQ ID NO: 5038580 - DNA, 14 bp, Homo sapiens
gttttattcctgta

SEQ ID NO: 5038581 - DNA, 18 bp, Homo sapiens
gtttttaaatagagtttg

SEQ ID NO: 5038582 - DNA, 20 bp, Homo sapiens
taaaagcatactctatgtga

SEQ ID NO: 5038583 - DNA, 18 bp, Homo sapiens
taaaaggcaaatgtgtac

SEQ ID NO: 5038584 - DNA, 19 bp, Homo sapiens
taaatgtcttttcaaaagg

SEQ ID NO: 5038585 - DNA, 23 bp, Homo sapiens
taacagagtttgatatgggcttt

SEQ ID NO: 5038586 - DNA, 19 bp, Homo sapiens
taaccacaaagcacagttt

SEQ ID NO: 5038587 - DNA, 23 bp, Homo sapiens
taaccacaaagcacagtttgaac

SEQ ID NO: 5038588 - DNA, 16 bp, Homo sapiens
taactgtgcagagact

SEQ ID NO: 5038589 - DNA, 14 bp, Homo sapiens
taactttatgtgta

SEQ ID NO: 5038590 - DNA, 15 bp, Homo sapiens
taactttatgtgtaa

SEQ ID NO: 5038591 - DNA, 20 bp, Homo sapiens
taaggtttcgtttctgtata

SEQ ID NO: 5038592 - DNA, 22 bp, Homo sapiens
taagtgtccattatttaccttg

SEQ ID NO: 5038593 - DNA, 21 bp, Homo sapiens
tacaagattagaagctgaaaa

SEQ ID NO: 5038594 - DNA, 16 bp, Homo sapiens
tacagtaactttatgt

SEQ ID NO: 5038595 - DNA, 17 bp, Homo sapiens
tacagtaactttatgtg

SEQ ID NO: 5038596 - DNA, 23 bp, Homo sapiens
tacagtaactttatgtgtaaata

SEQ ID NO: 5038597 - DNA, 20 bp, Homo sapiens
taccatgaacagaaaacatt

SEQ ID NO: 5038598 - DNA, 15 bp, Homo sapiens
tacctgcctaaaata

SEQ ID NO: 5038599 - DNA, 14 bp, Homo sapiens
tactcaaacatgtt

SEQ ID NO: 5038600 - DNA, 15 bp, Homo sapiens
tactctatgtgattt

SEQ ID NO: 5038601 - DNA, 14 bp, Homo sapiens
tactgtctcactga

SEQ ID NO: 5038602 - DNA, 22 bp, Homo sapiens
tactgtctcactgaaacattta

SEQ ID NO: 5038603 - DNA, 22 bp, Homo sapiens
tacttcaggggcacttcattga

SEQ ID NO: 5038604 - DNA, 16 bp, Homo sapiens
tagaacaaaggacaga

SEQ ID NO: 5038605 - DNA, 20 bp, Homo sapiens
tagaacaaaggacagagtat

SEQ ID NO: 5038606 - DNA, 17 bp, Homo sapiens
tagactcatcttactgt

SEQ ID NO: 5038607 - DNA, 21 bp, Homo sapiens
tagactcatcttactgtacct

SEQ ID NO: 5038608 - DNA, 19 bp, Homo sapiens
tagagcattgaattggaga

SEQ ID NO: 5038609 - DNA, 21 bp, Homo sapiens
tagatgtctaggtacttcagg

SEQ ID NO: 5038610 - DNA, 19 bp, Homo sapiens
tagcctccttcgcaggcat

SEQ ID NO: 5038611 - DNA, 21 bp, Homo sapiens
tagctgatgaacttattctgt

SEQ ID NO: 5038612 - DNA, 14 bp, Homo sapiens
tagtaatcacagtt

SEQ ID NO: 5038613 - DNA, 15 bp, Homo sapiens
tagtaatcacagttg

SEQ ID NO: 5038614 - DNA, 18 bp, Homo sapiens
tagtacctgaaaagtaac

SEQ ID NO: 5038615 - DNA, 13 bp, Homo sapiens
tagtttgcagagg

SEQ ID NO: 5038616 - DNA, 13 bp, Homo sapiens
tataagtttgaag

SEQ ID NO: 5038617 - DNA, 16 bp, Homo sapiens
tataagtttgaaggaa

SEQ ID NO: 5038618 - DNA, 21 bp, Homo sapiens
tatacaaccctggcattatgt

SEQ ID NO: 5038619 - DNA, 18 bp, Homo sapiens
tatacagtaactttatgt

SEQ ID NO: 5038620 - DNA, 21 bp, Homo sapiens
tatacagtaactttatgtgta

SEQ ID NO: 5038621 - DNA, 14 bp, Homo sapiens
tatatatgtgtatg

SEQ ID NO: 5038622 - DNA, 15 bp, Homo sapiens
tatctgtgagttctg

SEQ ID NO: 5038623 - DNA, 19 bp, Homo sapiens
tatgctctcgcacctttcc

SEQ ID NO: 5038624 - DNA, 19 bp, Homo sapiens
tatgggctttctctttggt

SEQ ID NO: 5038625 - DNA, 20 bp, Homo sapiens
tatggttgatagtttacctg

SEQ ID NO: 5038626 - DNA, 22 bp, Homo sapiens
tatggttgatagtttacctgaa

SEQ ID NO: 5038627 - DNA, 18 bp, Homo sapiens
tatgtacgtttgtatgtg

SEQ ID NO: 5038628 - DNA, 17 bp, Homo sapiens
tatgtccactgtgtata

SEQ ID NO: 5038629 - DNA, 23 bp, Homo sapiens
tatgtccactgtgtatagaagta

SEQ ID NO: 5038630 - DNA, 14 bp, Homo sapiens
tatgtgtgtagaca

SEQ ID NO: 5038631 - DNA, 17 bp, Homo sapiens
aaaaagtcattgtaatc

SEQ ID NO: 5038632 - DNA, 18 bp, Homo sapiens
aaaacactgccatcttag

SEQ ID NO: 5038633 - DNA, 22 bp, Homo sapiens
aaaacagaacatcattagaaca

SEQ ID NO: 5038634 - DNA, 21 bp, Homo sapiens
aaaacctaagtcctttatgtg

SEQ ID NO: 5038635 - DNA, 23 bp, Homo sapiens
aaaatattttttatatatacagt

SEQ ID NO: 5038636 - DNA, 20 bp, Homo sapiens
aaacctaagtcctttatgtg

SEQ ID NO: 5038637 - DNA, 17 bp, Homo sapiens
aaagatgctcttctgtg

SEQ ID NO: 5038638 - DNA, 19 bp, Homo sapiens
aaagattcaggtatgttgc

SEQ ID NO: 5038639 - DNA, 16 bp, Homo sapiens
aaagcacagtttgaac

SEQ ID NO: 5038640 - DNA, 17 bp, Homo sapiens
aaaggcaaatgtgtaca

SEQ ID NO: 5038641 - DNA, 16 bp, Homo sapiens
aaagttaacagatttt

SEQ ID NO: 5038642 - DNA, 16 bp, Homo sapiens
aaataaaagagagaga

SEQ ID NO: 5038643 - DNA, 22 bp, Homo sapiens
aaatattttttatatatacagt

SEQ ID NO: 5038644 - DNA, 12 bp, Homo sapiens
aaatgtgtacat

SEQ ID NO: 5038645 - DNA, 22 bp, Homo sapiens
aaattctgccttattatttctt

SEQ ID NO: 5038646 - DNA, 20 bp, Homo sapiens
aacaaaatctcctcttttag

SEQ ID NO: 5038647 - DNA, 22 bp, Homo sapiens
aacacaaaaattatctgggcat

SEQ ID NO: 5038648 - DNA, 22 bp, Homo sapiens
aacactgccatcttagtttgga

SEQ ID NO: 5038649 - DNA, 12 bp, Homo sapiens
aacagctttctc

SEQ ID NO: 5038650 - DNA, 18 bp, Homo sapiens
aacattctgatttggaaa

SEQ ID NO: 5038651 - DNA, 19 bp, Homo sapiens
aactccccttcctcactgc

SEQ ID NO: 5038652 - DNA, 23 bp, Homo sapiens
aactccccttcctcactgcccaa

SEQ ID NO: 5038653 - DNA, 15 bp, Homo sapiens
aactctcctgctcct

SEQ ID NO: 5038654 - DNA, 16 bp, Homo sapiens
aacttcttgttcaaaa

SEQ ID NO: 5038655 - DNA, 21 bp, Homo sapiens
aacttgcatccaactccagga

SEQ ID NO: 5038656 - DNA, 20 bp, Homo sapiens
aactttgaggaggaagcaga

SEQ ID NO: 5038657 - DNA, 18 bp, Homo sapiens
aagacctccctgtgagag

SEQ ID NO: 5038658 - DNA, 17 bp, Homo sapiens
aagagcacttcacacag

SEQ ID NO: 5038659 - DNA, 19 bp, Homo sapiens
aagagccatataagtttga

SEQ ID NO: 5038660 - DNA, 17 bp, Homo sapiens
aagatgctcttctgtgg

SEQ ID NO: 5038661 - DNA, 17 bp, Homo sapiens
aagcacagtttgaacaa

SEQ ID NO: 5038662 - DNA, 19 bp, Homo sapiens
aagcccatgagtccttgaa

SEQ ID NO: 5038663 - DNA, 21 bp, Homo sapiens
aagctttccgagtcaagtgat

SEQ ID NO: 5038664 - DNA, 15 bp, Homo sapiens
aaggatgttggtgtt

SEQ ID NO: 5038665 - DNA, 21 bp, Homo sapiens
aagtgattgacaactgaagag

SEQ ID NO: 5038666 - DNA, 17 bp, Homo sapiens
aagtttgaaggaaacag

SEQ ID NO: 5038667 - DNA, 13 bp, Homo sapiens
aataaaagagaga

SEQ ID NO: 5038668 - DNA, 23 bp, Homo sapiens
aatagttgctgtccccttccagg

SEQ ID NO: 5038669 - DNA, 23 bp, Homo sapiens
aatataaaaggcaaatgtgtaca

SEQ ID NO: 5038670 - DNA, 17 bp, Homo sapiens
aatattttttatatata

SEQ ID NO: 5038671 - DNA, 15 bp, Homo sapiens
aatcacagttggcct

SEQ ID NO: 5038672 - DNA, 19 bp, Homo sapiens
aatctagtatttcatgctg

SEQ ID NO: 5038673 - DNA, 18 bp, Homo sapiens
aatgatagtaagaaaagt

SEQ ID NO: 5038674 - DNA, 13 bp, Homo sapiens
aatgtcttttgaa

SEQ ID NO: 5038675 - DNA, 22 bp, Homo sapiens
aattatgcagcttgcacaccca

SEQ ID NO: 5038676 - DNA, 17 bp, Homo sapiens
aattgtccgtgttcata

SEQ ID NO: 5038677 - DNA, 13 bp, Homo sapiens
aattgttgacagt

SEQ ID NO: 5038678 - DNA, 14 bp, Homo sapiens
acaaaatctcctct

SEQ ID NO: 5038679 - DNA, 16 bp, Homo sapiens
acaacaccccacagga

SEQ ID NO: 5038680 - DNA, 18 bp, Homo sapiens
acactcgaaaagagcact

SEQ ID NO: 5038681 - DNA, 16 bp, Homo sapiens
acagatacacatacac

SEQ ID NO: 5038682 - DNA, 14 bp, Homo sapiens
acagctttctccag

SEQ ID NO: 5038683 - DNA, 15 bp, Homo sapiens
acagtaactttatgt

SEQ ID NO: 5038684 - DNA, 15 bp, Homo sapiens
acagtttgaacaaaa

SEQ ID NO: 5038685 - DNA, 22 bp, Homo sapiens
acataagcggcgtaagtttaaa

SEQ ID NO: 5038686 - DNA, 13 bp, Homo sapiens
acatggagttccc

SEQ ID NO: 5038687 - DNA, 16 bp, Homo sapiens
acattctgatttggaa

SEQ ID NO: 5038688 - DNA, 19 bp, Homo sapiens
acattctgatttggaaaaa

SEQ ID NO: 5038689 - DNA, 22 bp, Homo sapiens
accataaggtttcgtttctgta

SEQ ID NO: 5038690 - DNA, 18 bp, Homo sapiens
acccaaggtcacatagct

SEQ ID NO: 5038691 - DNA, 12 bp, Homo sapiens
acctgaaaagta

SEQ ID NO: 5038692 - DNA, 20 bp, Homo sapiens
acgagaattgcttgaacccg

SEQ ID NO: 5038693 - DNA, 15 bp, Homo sapiens
actagtaaagacata

SEQ ID NO: 5038694 - DNA, 16 bp, Homo sapiens
actcaatggatttgat

SEQ ID NO: 5038695 - DNA, 23 bp, Homo sapiens
actccagcctgggcaacagagca

SEQ ID NO: 5038696 - DNA, 20 bp, Homo sapiens
actgcaatcctgtctttctg

SEQ ID NO: 5038697 - DNA, 21 bp, Homo sapiens
actgcaatcctgtctttctga

SEQ ID NO: 5038698 - DNA, 17 bp, Homo sapiens
actgtagcctggatatt

SEQ ID NO: 5038699 - DNA, 15 bp, Homo sapiens
acttcaatgatagta

SEQ ID NO: 5038700 - DNA, 18 bp, Homo sapiens
acttcacacagacaagtg

SEQ ID NO: 5038701 - DNA, 19 bp, Homo sapiens
acttgcatccaactccagg

SEQ ID NO: 5038702 - DNA, 21 bp, Homo sapiens
actttatgtgtaaatacataa

SEQ ID NO: 5038703 - DNA, 14 bp, Homo sapiens
actttgtctgaaaa

SEQ ID NO: 5038704 - DNA, 15 bp, Homo sapiens
actttgtctgaaaaa

SEQ ID NO: 5038705 - DNA, 20 bp, Homo sapiens
agaaaccattgttcagaaga

SEQ ID NO: 5038706 - DNA, 21 bp, Homo sapiens
agaacaaaggacagagtatga

SEQ ID NO: 5038707 - DNA, 22 bp, Homo sapiens
agaacactcgaaaagagcactt

SEQ ID NO: 5038708 - DNA, 18 bp, Homo sapiens
agaaccagtgtctgaacc

SEQ ID NO: 5038709 - DNA, 14 bp, Homo sapiens
agaagaacagcaga

SEQ ID NO: 5038710 - DNA, 13 bp, Homo sapiens
agaagtagattaa

SEQ ID NO: 5038711 - DNA, 19 bp, Homo sapiens
agaagtagattaagagcca

SEQ ID NO: 5038712 - DNA, 17 bp, Homo sapiens
agacctccctgtgagag

SEQ ID NO: 5038713 - DNA, 16 bp, Homo sapiens
agactcatcttactgt

SEQ ID NO: 5038714 - DNA, 14 bp, Homo sapiens
agagaactgtggcc

SEQ ID NO: 5038715 - DNA, 19 bp, Homo sapiens
agagagattgaactttgag

SEQ ID NO: 5038716 - DNA, 15 bp, Homo sapiens
agaggcatgacagct

SEQ ID NO: 5038717 - DNA, 22 bp, Homo sapiens
agaggctgaggtgggcagatca

SEQ ID NO: 5038718 - DNA, 15 bp, Homo sapiens
agagtggtggcagct

SEQ ID NO: 5038719 - DNA, 15 bp, Homo sapiens
agagttgctcctcag

SEQ ID NO: 5038720 - DNA, 19 bp, Homo sapiens
agagttttgtcttgaatgt

SEQ ID NO: 5038721 - DNA, 17 bp, Homo sapiens
agatcacgccactgcac

SEQ ID NO: 5038722 - DNA, 21 bp, Homo sapiens
agatggcggtgatcagcagag

SEQ ID NO: 5038723 - DNA, 15 bp, Homo sapiens
agattagaagctgaa

SEQ ID NO: 5038724 - DNA, 18 bp, Homo sapiens
agattcaggtatgttgcc

SEQ ID NO: 5038725 - DNA, 20 bp, Homo sapiens
agattcaggtatgttgcctt

SEQ ID NO: 5038726 - DNA, 22 bp, Homo sapiens
agattgttgtttgccatacttt

SEQ ID NO: 5038727 - DNA, 23 bp, Homo sapiens
agattgttgtttgccatactttg

SEQ ID NO: 5038728 - DNA, 21 bp, Homo sapiens
agcaaaaactagtaaagacat

SEQ ID NO: 5038729 - DNA, 20 bp, Homo sapiens
agcaacgtagcttctaccat

SEQ ID NO: 5038730 - DNA, 16 bp, Homo sapiens
caggtatgttgccttt

SEQ ID NO: 5038731 - DNA, 24 bp, Homo sapiens
caggtcagaaaccattgttcagaa

SEQ ID NO: 5038732 - DNA, 14 bp, Homo sapiens
cagtaactttatgt

SEQ ID NO: 5038733 - DNA, 18 bp, Homo sapiens
cagtaactttatgtgtaa

SEQ ID NO: 5038734 - DNA, 23 bp, Homo sapiens
cagtatctatatatgtgtatgta

SEQ ID NO: 5038735 - DNA, 15 bp, Homo sapiens
cagtccctatgtatt

SEQ ID NO: 5038736 - DNA, 20 bp, Homo sapiens
cagtgtctgaaccaccctgg

SEQ ID NO: 5038737 - DNA, 14 bp, Homo sapiens
cagttctgaagaat

SEQ ID NO: 5038738 - DNA, 22 bp, Homo sapiens
cataaggtttcgtttctgtata

SEQ ID NO: 5038739 - DNA, 14 bp, Homo sapiens
cataatgctactgt

SEQ ID NO: 5038740 - DNA, 16 bp, Homo sapiens
cataatgctactgtct

SEQ ID NO: 5038741 - DNA, 14 bp, Homo sapiens
catactttgtctga

SEQ ID NO: 5038742 - DNA, 16 bp, Homo sapiens
catactttgtctgaaa

SEQ ID NO: 5038743 - DNA, 20 bp, Homo sapiens
catagctagttatgtgagaa

SEQ ID NO: 5038744 - DNA, 14 bp, Homo sapiens
catataagtttgaa

SEQ ID NO: 5038745 - DNA, 19 bp, Homo sapiens
tatctggaagtaaccattt

SEQ ID NO: 5038746 - DNA, 21 bp, Homo sapiens
tatggttgatagtttacctga

SEQ ID NO: 5038747 - DNA, 14 bp, Homo sapiens
tatgttgcctttat

SEQ ID NO: 5038748 - DNA, 20 bp, Homo sapiens
tatgttgcctttatggtttc

SEQ ID NO: 5038749 - DNA, 16 bp, Homo sapiens
tatgttgtccaattgt

SEQ ID NO: 5038750 - DNA, 16 bp, Homo sapiens
tattagagcattgaat

SEQ ID NO: 5038751 - DNA, 17 bp, Homo sapiens
tattcctgtatgttgtc

SEQ ID NO: 5038752 - DNA, 22 bp, Homo sapiens
tattctgtagattctgtggaac

SEQ ID NO: 5038753 - DNA, 21 bp, Homo sapiens
tatttcatgctgggaatgaga

SEQ ID NO: 5038754 - DNA, 13 bp, Homo sapiens
tatttttgccctg

SEQ ID NO: 5038755 - DNA, 19 bp, Homo sapiens
tcaagaccagtctggccaa

SEQ ID NO: 5038756 - DNA, 20 bp, Homo sapiens
tcaatggatttgatgctgtt

SEQ ID NO: 5038757 - DNA, 17 bp, Homo sapiens
tcacatttgtaaatgtc

SEQ ID NO: 5038758 - DNA, 23 bp, Homo sapiens
tcaccttgagaggcatgacagct

SEQ ID NO: 5038759 - DNA, 22 bp, Homo sapiens
tcagaaccatccatagtagtat

SEQ ID NO: 5038760 - DNA, 19 bp, Homo sapiens
tcagaagacctccctgtga

SEQ ID NO: 5038761 - DNA, 17 bp, Homo sapiens
tcaggaactatgggagc

SEQ ID NO: 5038762 - DNA, 15 bp, Homo sapiens
tcaggtatgttgcct

SEQ ID NO: 5038763 - DNA, 13 bp, Homo sapiens
tcagtccctatgt

SEQ ID NO: 5038764 - DNA, 10 bp, Homo sapiens
tcattagaac

SEQ ID NO: 5038765 - DNA, 14 bp, Homo sapiens
tcattgagagtttt

SEQ ID NO: 5038766 - DNA, 18 bp, Homo sapiens
tcatttgaggccaggagt

SEQ ID NO: 5038767 - DNA, 19 bp, Homo sapiens
tccaagagggtcctttagt

SEQ ID NO: 5038768 - DNA, 21 bp, Homo sapiens
tccaattgttgacagttctga

SEQ ID NO: 5038769 - DNA, 23 bp, Homo sapiens
tccactggagaattgaaaaggac

SEQ ID NO: 5038770 - DNA, 12 bp, Homo sapiens
tccactgtgtat

SEQ ID NO: 5038771 - DNA, 22 bp, Homo sapiens
tccagaaccagtgtctgaacca

SEQ ID NO: 5038772 - DNA, 20 bp, Homo sapiens
tcccaagagtggtggcagct

SEQ ID NO: 5038773 - DNA, 16 bp, Homo sapiens
tcccggtttcagaagc

SEQ ID NO: 5038774 - DNA, 14 bp, Homo sapiens
tcccgtgcacctac

SEQ ID NO: 5038775 - DNA, 16 bp, Homo sapiens
tccctagccagcactt

SEQ ID NO: 5038776 - DNA, 17 bp, Homo sapiens
tccctagccagcacttg

SEQ ID NO: 5038777 - DNA, 20 bp, Homo sapiens
tccctagccagcacttgtat

SEQ ID NO: 5038778 - DNA, 22 bp, Homo sapiens
tccctagccagcacttgtatat

SEQ ID NO: 5038779 - DNA, 18 bp, Homo sapiens
tccctatgtatttgcagt

SEQ ID NO: 5038780 - DNA, 20 bp, Homo sapiens
tccctgtgagagagttgctc

SEQ ID NO: 5038781 - DNA, 20 bp, Homo sapiens
tcctcagggtccctcaggac

SEQ ID NO: 5038782 - DNA, 22 bp, Homo sapiens
tcctgtctttctgagcacactt

SEQ ID NO: 5038783 - DNA, 15 bp, Homo sapiens
tcctttgtgtttcta

SEQ ID NO: 5038784 - DNA, 14 bp, Homo sapiens
tctacatttcttag

SEQ ID NO: 5038785 - DNA, 15 bp, Homo sapiens
tctatatatgtgtat

SEQ ID NO: 5038786 - DNA, 22 bp, Homo sapiens
tctcatcacatttgtaaatgtc

SEQ ID NO: 5038787 - DNA, 16 bp, Homo sapiens
tctccagaaccagtgt

SEQ ID NO: 5038788 - DNA, 16 bp, Homo sapiens
tctcttcttttggctt

SEQ ID NO: 5038789 - DNA, 14 bp, Homo sapiens
tctctttggtttct

SEQ ID NO: 5038790 - DNA, 15 bp, Homo sapiens
tctgagtctcttgga

SEQ ID NO: 5038791 - DNA, 14 bp, Homo sapiens
tctgtctcaaaaaa

SEQ ID NO: 5038792 - DNA, 18 bp, Homo sapiens
tctgtgagttctgttgtg

SEQ ID NO: 5038793 - DNA, 22 bp, Homo sapiens
tctgtggaccactgcatgagct

SEQ ID NO: 5038794 - DNA, 20 bp, Homo sapiens
tctgttgtgtttgtcaaaaa

SEQ ID NO: 5038795 - DNA, 18 bp, Homo sapiens
tcttactgtacctgttcc

SEQ ID NO: 5038796 - DNA, 14 bp, Homo sapiens
tcttagactacatt

SEQ ID NO: 5038797 - DNA, 23 bp, Homo sapiens
tcttagtttggattcttatgtag

SEQ ID NO: 5038798 - DNA, 13 bp, Homo sapiens
tcttctgtggacc

SEQ ID NO: 5038799 - DNA, 16 bp, Homo sapiens
tcttgaatgtcttttg

SEQ ID NO: 5038800 - DNA, 19 bp, Homo sapiens
tcttgagccctcctggaat

SEQ ID NO: 5038801 - DNA, 23 bp, Homo sapiens
tcttgtaactgggttcaaaaaga

SEQ ID NO: 5038802 - DNA, 17 bp, Homo sapiens
tcttttagctgatgaac

SEQ ID NO: 5038803 - DNA, 15 bp, Homo sapiens
tgaaaaggactcttg

SEQ ID NO: 5038804 - DNA, 21 bp, Homo sapiens
tgaaaaggactcttgagccct

SEQ ID NO: 5038805 - DNA, 22 bp, Homo sapiens
tgaaaaggactcttgagccctc

SEQ ID NO: 5038806 - DNA, 12 bp, Homo sapiens
tgaaggaaacag

SEQ ID NO: 5038807 - DNA, 14 bp, Homo sapiens
tgaaggaaacagtt

SEQ ID NO: 5038808 - DNA, 14 bp, Homo sapiens
tgacaaagttactg

SEQ ID NO: 5038809 - DNA, 13 bp, Homo sapiens
tgacagctgttcc

SEQ ID NO: 5038810 - DNA, 14 bp, Homo sapiens
tgacagctgttcca

SEQ ID NO: 5038811 - DNA, 20 bp, Homo sapiens
tgagcacactttagtggccg

SEQ ID NO: 5038812 - DNA, 20 bp, Homo sapiens
tgagcctctttaacagcttt

SEQ ID NO: 5038813 - DNA, 22 bp, Homo sapiens
tgagcctctttaacagctttct

SEQ ID NO: 5038814 - DNA, 17 bp, Homo sapiens
tgaggaggaagcagaat

SEQ ID NO: 5038815 - DNA, 16 bp, Homo sapiens
tgagtccttgaaaata

SEQ ID NO: 5038816 - DNA, 12 bp, Homo sapiens
tgatcagcagag

SEQ ID NO: 5038817 - DNA, 23 bp, Homo sapiens
tgatctcttcttttggcttccat

SEQ ID NO: 5038818 - DNA, 15 bp, Homo sapiens
tgcacagatacacat

SEQ ID NO: 5038819 - DNA, 16 bp, Homo sapiens
tgcacttaaggcactc

SEQ ID NO: 5038820 - DNA, 23 bp, Homo sapiens
tgcagagactttatccatgccaa

SEQ ID NO: 5038821 - DNA, 13 bp, Homo sapiens
tgcatccaactcc

SEQ ID NO: 5038822 - DNA, 22 bp, Homo sapiens
tgcatttttatctgtgagttct

SEQ ID NO: 5038823 - DNA, 19 bp, Homo sapiens
tgcccaaaaatatggttga

SEQ ID NO: 5038824 - DNA, 12 bp, Homo sapiens
tgcctgtacaag

SEQ ID NO: 5038825 - DNA, 22 bp, Homo sapiens
tgctactgtctcactgaaacat

SEQ ID NO: 5038826 - DNA, 19 bp, Homo sapiens
tgctctcgcacctttccaa

SEQ ID NO: 5038827 - DNA, 20 bp, Homo sapiens
tgctgtccccttccaggggt

SEQ ID NO: 5038828 - DNA, 13 bp, Homo sapiens
tgctgtttgacaa

SEQ ID NO: 5038829 - DNA, 22 bp, Homo sapiens
tggaaagttcttaggcaccata

SEQ ID NO: 5038830 - DNA, 20 bp, Homo sapiens
tggagttcccgtgcacctac

SEQ ID NO: 5038831 - DNA, 17 bp, Homo sapiens
tggattcttatgtagca

SEQ ID NO: 5038832 - DNA, 13 bp, Homo sapiens
tggatttgatgct

SEQ ID NO: 5038833 - DNA, 22 bp, Homo sapiens
tggcagagtttgtgtgttgtct

SEQ ID NO: 5038834 - DNA, 13 bp, Homo sapiens
tggcattatgtcc

SEQ ID NO: 5038835 - DNA, 14 bp, Homo sapiens
tggccgttatctgg

SEQ ID NO: 5038836 - DNA, 22 bp, Homo sapiens
tggctagggttccactggagaa

SEQ ID NO: 5038837 - DNA, 16 bp, Homo sapiens
tggcttccatgatggt

SEQ ID NO: 5038838 - DNA, 17 bp, Homo sapiens
tgggaggccgaggcacg

SEQ ID NO: 5038839 - DNA, 16 bp, Homo sapiens
tgggcaacagagcaag

SEQ ID NO: 5038840 - DNA, 14 bp, Homo sapiens
tgggcttaagaaat

SEQ ID NO: 5038841 - DNA, 19 bp, Homo sapiens
aaaaattaaaagaaggaat

SEQ ID NO: 5038842 - DNA, 21 bp, Homo sapiens
aaaacagaacatcattagaac

SEQ ID NO: 5038843 - DNA, 15 bp, Homo sapiens
aaaacttctcttctg

SEQ ID NO: 5038844 - DNA, 17 bp, Homo sapiens
aaaacttctcttctgag

SEQ ID NO: 5038845 - DNA, 19 bp, Homo sapiens
aaaagcatactctatgtga

SEQ ID NO: 5038846 - DNA, 22 bp, Homo sapiens
aaaattcctttgtgtttctatt

SEQ ID NO: 5038847 - DNA, 23 bp, Homo sapiens
aaacactgccatcttagtttgga

SEQ ID NO: 5038848 - DNA, 21 bp, Homo sapiens
aaacagaacatcattagaaca

SEQ ID NO: 5038849 - DNA, 23 bp, Homo sapiens
aaacattctgatttggaaaaaga

SEQ ID NO: 5038850 - DNA, 18 bp, Homo sapiens
aaaccattgttcagaaga

SEQ ID NO: 5038851 - DNA, 15 bp, Homo sapiens
aaagcacagtttgaa

SEQ ID NO: 5038852 - DNA, 16 bp, Homo sapiens
aaaggatgttggtgtt

SEQ ID NO: 5038853 - DNA, 19 bp, Homo sapiens
aaagtggtggcaaaagaca

SEQ ID NO: 5038854 - DNA, 19 bp, Homo sapiens
aaatagagtttgctattag

SEQ ID NO: 5038855 - DNA, 18 bp, Homo sapiens
aacaatcaaggcaactag

SEQ ID NO: 5038856 - DNA, 19 bp, Homo sapiens
aacacctgggcttaagaaa

SEQ ID NO: 5038857 - DNA, 20 bp, Homo sapiens
aacagaacatcattagaaca

SEQ ID NO: 5038858 - DNA, 15 bp, Homo sapiens
aacatcattagaaca

SEQ ID NO: 5038859 - DNA, 16 bp, Homo sapiens
aacattctgatttgga

SEQ ID NO: 5038860 - DNA, 13 bp, Homo sapiens
aaccagtgtctga

SEQ ID NO: 5038861 - DNA, 17 bp, Homo sapiens
aaccattgttcagaaga

SEQ ID NO: 5038862 - DNA, 16 bp, Homo sapiens
aactctagtttgcaga

SEQ ID NO: 5038863 - DNA, 19 bp, Homo sapiens
aactgggttcaaaaagaaa

SEQ ID NO: 5038864 - DNA, 13 bp, Homo sapiens
agttctgaagaat

SEQ ID NO: 5038865 - DNA, 16 bp, Homo sapiens
agtttacctctttaaa

SEQ ID NO: 5038866 - DNA, 16 bp, Homo sapiens
agtttgaaggaaacag

SEQ ID NO: 5038867 - DNA, 19 bp, Homo sapiens
agtttgtgtgttgtcttga

SEQ ID NO: 5038868 - DNA, 17 bp, Homo sapiens
ataactgtgcagagact

SEQ ID NO: 5038869 - DNA, 20 bp, Homo sapiens
ataaggtttcgtttctgtat

SEQ ID NO: 5038870 - DNA, 23 bp, Homo sapiens
ataaggtttcgtttctgtataca

SEQ ID NO: 5038871 - DNA, 17 bp, Homo sapiens
atacagtaactttatgt

SEQ ID NO: 5038872 - DNA, 20 bp, Homo sapiens
ataccattttttaaggaaac

SEQ ID NO: 5038873 - DNA, 13 bp, Homo sapiens
atactttgtctga

SEQ ID NO: 5038874 - DNA, 18 bp, Homo sapiens
atagatgtctaggtactt

SEQ ID NO: 5038875 - DNA, 15 bp, Homo sapiens
atagttgctgtcccc

SEQ ID NO: 5038876 - DNA, 20 bp, Homo sapiens
atagttgctgtccccttcca

SEQ ID NO: 5038877 - DNA, 17 bp, Homo sapiens
atagtttacctgaataa

SEQ ID NO: 5038878 - DNA, 20 bp, Homo sapiens
atataaaaggcaaatgtgta

SEQ ID NO: 5038879 - DNA, 21 bp, Homo sapiens
atataaaaggcaaatgtgtac

SEQ ID NO: 5038880 - DNA, 23 bp, Homo sapiens
atataaccacaaagcacagtttg

SEQ ID NO: 5038881 - DNA, 17 bp, Homo sapiens
atataagtttgaaggaa

SEQ ID NO: 5038882 - DNA, 14 bp, Homo sapiens
atatacagtaactt

SEQ ID NO: 5038883 - DNA, 17 bp, Homo sapiens
atatacagtaactttat

SEQ ID NO: 5038884 - DNA, 23 bp, Homo sapiens
atatacagtaactttatgtgtaa

SEQ ID NO: 5038885 - DNA, 16 bp, Homo sapiens
atatatacagtaactt

SEQ ID NO: 5038886 - DNA, 20 bp, Homo sapiens
atatatacagtaactttatg

SEQ ID NO: 5038887 - DNA, 23 bp, Homo sapiens
atatatacagtaactttatgtgt

SEQ ID NO: 5038888 - DNA, 12 bp, Homo sapiens
atatatgtgtat

SEQ ID NO: 5038889 - DNA, 13 bp, Homo sapiens
atatatgtgtatg

SEQ ID NO: 5038890 - DNA, 14 bp, Homo sapiens
atatgtgtatgtac

SEQ ID NO: 5038891 - DNA, 20 bp, Homo sapiens
atattttttatatatacagt

SEQ ID NO: 5038892 - DNA, 12 bp, Homo sapiens
atcagcagagag

SEQ ID NO: 5038893 - DNA, 14 bp, Homo sapiens
atccccaagtgtga

SEQ ID NO: 5038894 - DNA, 16 bp, Homo sapiens
atccccaagtgtgaac

SEQ ID NO: 5038895 - DNA, 17 bp, Homo sapiens
atccttatgatgtccaa

SEQ ID NO: 5038896 - DNA, 16 bp, Homo sapiens
atctatatatgtgtat

SEQ ID NO: 5038897 - DNA, 22 bp, Homo sapiens
atcttagtttggattcttatgt

SEQ ID NO: 5038898 - DNA, 16 bp, Homo sapiens
atgaacttattctgta

SEQ ID NO: 5038899 - DNA, 18 bp, Homo sapiens
atgaacttattctgtaga

SEQ ID NO: 5038900 - DNA, 17 bp, Homo sapiens
atgatacaagattagaa

SEQ ID NO: 5038901 - DNA, 17 bp, Homo sapiens
atgatagtaagaaaagt

SEQ ID NO: 5038902 - DNA, 12 bp, Homo sapiens
atgatctgtcaa

SEQ ID NO: 5038903 - DNA, 14 bp, Homo sapiens
atgatctgtcaaag

SEQ ID NO: 5038904 - DNA, 15 bp, Homo sapiens
atgatttttgtcatc

SEQ ID NO: 5038905 - DNA, 22 bp, Homo sapiens
atggagaaaccttgtctctact

SEQ ID NO: 5038906 - DNA, 17 bp, Homo sapiens
atggctcccacaggagt

SEQ ID NO: 5038907 - DNA, 15 bp, Homo sapiens
atgggctttctcttt

SEQ ID NO: 5038908 - DNA, 16 bp, Homo sapiens
atgtcttttcaaaagg

SEQ ID NO: 5038909 - DNA, 17 bp, Homo sapiens
atgtcttttcaaaagga

SEQ ID NO: 5038910 - DNA, 15 bp, Homo sapiens
atgtcttttgaatat

SEQ ID NO: 5038911 - DNA, 16 bp, Homo sapiens
atgtgtacatggcaga

SEQ ID NO: 5038912 - DNA, 20 bp, Homo sapiens
atgtgtatgtacgtttgtat

SEQ ID NO: 5038913 - DNA, 22 bp, Homo sapiens
atgttgtccaattgttgacagt

SEQ ID NO: 5038914 - DNA, 24 bp, Homo sapiens
atgtttaaaagcatactctatgtg

SEQ ID NO: 5038915 - DNA, 19 bp, Homo sapiens
attatgtccactgtgtata

SEQ ID NO: 5038916 - DNA, 12 bp, Homo sapiens
attattcttgta

SEQ ID NO: 5038917 - DNA, 18 bp, Homo sapiens
attcaggtatgttgcctt

SEQ ID NO: 5038918 - DNA, 20 bp, Homo sapiens
attcaggtatgttgccttta

SEQ ID NO: 5038919 - DNA, 23 bp, Homo sapiens
attcaggtatgttgcctttatgg

SEQ ID NO: 5038920 - DNA, 22 bp, Homo sapiens
attcccaagagtggtggcagct

SEQ ID NO: 5038921 - DNA, 13 bp, Homo sapiens
attcctgtatgtt

SEQ ID NO: 5038922 - DNA, 16 bp, Homo sapiens
attcctgtatgttgtc

SEQ ID NO: 5038923 - DNA, 17 bp, Homo sapiens
attcctgtatgttgtcc

SEQ ID NO: 5038924 - DNA, 18 bp, Homo sapiens
attcctgtatgttgtcca

SEQ ID NO: 5038925 - DNA, 22 bp, Homo sapiens
attcttatgtagcaggaaataa

SEQ ID NO: 5038926 - DNA, 18 bp, Homo sapiens
attgacttcaatgatagt

SEQ ID NO: 5038927 - DNA, 18 bp, Homo sapiens
attgttgacagttctgaa

SEQ ID NO: 5038928 - DNA, 15 bp, Homo sapiens
atttatattttaaag

SEQ ID NO: 5038929 - DNA, 13 bp, Homo sapiens
atttcctttggct

SEQ ID NO: 5038930 - DNA, 17 bp, Homo sapiens
atttgaggggaaaacac

SEQ ID NO: 5038931 - DNA, 22 bp, Homo sapiens
atttgaggggaaaacaccataa

SEQ ID NO: 5038932 - DNA, 20 bp, Homo sapiens
attttcttttctttcaactt

SEQ ID NO: 5038933 - DNA, 17 bp, Homo sapiens
attttttaaggaaacaa

SEQ ID NO: 5038934 - DNA, 19 bp, Homo sapiens
caaaaactagtaaagacat

SEQ ID NO: 5038935 - DNA, 14 bp, Homo sapiens
caaaaagtcattgt

SEQ ID NO: 5038936 - DNA, 11 bp, Homo sapiens
caaaagacatc

SEQ ID NO: 5038937 - DNA, 16 bp, Homo sapiens
caaaagacatcctcaa

SEQ ID NO: 5038938 - DNA, 16 bp, Homo sapiens
caaacttcttgttcaa

SEQ ID NO: 5038939 - DNA, 15 bp, Homo sapiens
caaatgttaacagag

SEQ ID NO: 5038940 - DNA, 19 bp, Homo sapiens
caaccctggcattatgtcc

SEQ ID NO: 5038941 - DNA, 15 bp, Homo sapiens
caacgtagcttctac

SEQ ID NO: 5038942 - DNA, 16 bp, Homo sapiens
caactagtggagagaa

SEQ ID NO: 5038943 - DNA, 13 bp, Homo sapiens
caactgtatatat

SEQ ID NO: 5038944 - DNA, 15 bp, Homo sapiens
caactgtatatattc

SEQ ID NO: 5038945 - DNA, 20 bp, Homo sapiens
caagagtggtggcagctcaa

SEQ ID NO: 5038946 - DNA, 12 bp, Homo sapiens
caagattagaag

SEQ ID NO: 5038947 - DNA, 20 bp, Homo sapiens
caagattagaagctgaaaac

SEQ ID NO: 5038948 - DNA, 22 bp, Homo sapiens
caagtgattgacaactgaagag

SEQ ID NO: 5038949 - DNA, 23 bp, Homo sapiens
caagtgcatttttatctgtgagt

SEQ ID NO: 5038950 - DNA, 19 bp, Homo sapiens
caagtggctaagtgtccat

SEQ ID NO: 5038951 - DNA, 19 bp, Homo sapiens
caagtgtgaacaaaagatg

SEQ ID NO: 5038952 - DNA, 23 bp, Homo sapiens
caatataaaaggcaaatgtgtac

SEQ ID NO: 5038953 - DNA, 18 bp, Homo sapiens
cacaaagcacagtttgaa

SEQ ID NO: 5038954 - DNA, 22 bp, Homo sapiens
cacaaagcacagtttgaacaaa

SEQ ID NO: 5038955 - DNA, 15 bp, Homo sapiens
cacagatacacatac

SEQ ID NO: 5038956 - DNA, 22 bp, Homo sapiens
cacaggggctatcccttctcag

SEQ ID NO: 5038957 - DNA, 15 bp, Homo sapiens
cacagttggccttca

SEQ ID NO: 5038958 - DNA, 23 bp, Homo sapiens
cacagttggccttcagaaccatc

SEQ ID NO: 5038959 - DNA, 21 bp, Homo sapiens
caccatagaagaacagcagat

SEQ ID NO: 5038960 - DNA, 23 bp, Homo sapiens
cacctgcacttaaggcactctgt

SEQ ID NO: 5038961 - DNA, 16 bp, Homo sapiens
cacctgggcttaagaa

SEQ ID NO: 5038962 - DNA, 21 bp, Homo sapiens
cacgttaaaaattaaaagaag

SEQ ID NO: 5038963 - DNA, 16 bp, Homo sapiens
cactgccatcttagtt

SEQ ID NO: 5038964 - DNA, 22 bp, Homo sapiens
cactggagaattgaaaaggact

SEQ ID NO: 5038965 - DNA, 16 bp, Homo sapiens
cacttgtatatacgca

SEQ ID NO: 5038966 - DNA, 21 bp, Homo sapiens
cacttgtatatacgcatctat

SEQ ID NO: 5038967 - DNA, 20 bp, Homo sapiens
cagaaaccattgttcagaag

SEQ ID NO: 5038968 - DNA, 21 bp, Homo sapiens
cagaaaccattgttcagaaga

SEQ ID NO: 5038969 - DNA, 15 bp, Homo sapiens
cagaacatcattaga

SEQ ID NO: 5038970 - DNA, 15 bp, Homo sapiens
cagaaccatccatag

SEQ ID NO: 5038971 - DNA, 21 bp, Homo sapiens
cagaagctgcagctggtctgt

SEQ ID NO: 5038972 - DNA, 17 bp, Homo sapiens
cagaatgccatattttt

SEQ ID NO: 5038973 - DNA, 21 bp, Homo sapiens
cagagtatgaacacctgggct

SEQ ID NO: 5038974 - DNA, 19 bp, Homo sapiens
cagagtttgatatgggctt

SEQ ID NO: 5038975 - DNA, 18 bp, Homo sapiens
cagatcatttgaggccag

SEQ ID NO: 5038976 - DNA, 21 bp, Homo sapiens
cagattttggggttgtgttgt

SEQ ID NO: 5038977 - DNA, 15 bp, Homo sapiens
cagctgttccacagg

SEQ ID NO: 5038978 - DNA, 18 bp, Homo sapiens
caggggtcaccttgagag

SEQ ID NO: 5038979 - DNA, 16 bp, Homo sapiens
cagggtccctcaggac

SEQ ID NO: 5038980 - DNA, 20 bp, Homo sapiens
caggtatgttgcctttatgg

SEQ ID NO: 5038981 - DNA, 20 bp, Homo sapiens
cagtaactttatgtgtaaat

SEQ ID NO: 5038982 - DNA, 19 bp, Homo sapiens
cagtatctatatatgtgta

SEQ ID NO: 5038983 - DNA, 21 bp, Homo sapiens
cagtatctatatatgtgtatg

SEQ ID NO: 5038984 - DNA, 20 bp, Homo sapiens
cagtctggccaatatggaga

SEQ ID NO: 5038985 - DNA, 19 bp, Homo sapiens
catagctagttatgtgaga

SEQ ID NO: 5038986 - DNA, 14 bp, Homo sapiens
catagctgtctaga

SEQ ID NO: 5038987 - DNA, 18 bp, Homo sapiens
cataggaacatgtagttt

SEQ ID NO: 5038988 - DNA, 22 bp, Homo sapiens
catataagtttgaaggaaacag

SEQ ID NO: 5038989 - DNA, 24 bp, Homo sapiens
catataagtttgaaggaaacagtt

SEQ ID NO: 5038990 - DNA, 21 bp, Homo sapiens
catatggagtgcctgtacaag

SEQ ID NO: 5038991 - DNA, 17 bp, Homo sapiens
catcagtccctatgtat

SEQ ID NO: 5038992 - DNA, 10 bp, Homo sapiens
catcattaga

SEQ ID NO: 5038993 - DNA, 14 bp, Homo sapiens
catcattagaacaa

SEQ ID NO: 5038994 - DNA, 18 bp, Homo sapiens
catccatagtagtatgat

SEQ ID NO: 5038995 - DNA, 23 bp, Homo sapiens
catgaacagaaaacattctgatt

SEQ ID NO: 5038996 - DNA, 17 bp, Homo sapiens
catgagtccttgaaaat

SEQ ID NO: 5038997 - DNA, 21 bp, Homo sapiens
catgagtccttgaaaatattt

SEQ ID NO: 5038998 - DNA, 13 bp, Homo sapiens
catgatctgtcaa

SEQ ID NO: 5038999 - DNA, 23 bp, Homo sapiens
catgatggttattttcttttctt

SEQ ID NO: 5039000 - DNA, 17 bp, Homo sapiens
catggcagagtttgtgt

SEQ ID NO: 5039001 - DNA, 19 bp, Homo sapiens
catggtggggcatgcctgt

SEQ ID NO: 5039002 - DNA, 14 bp, Homo sapiens
catgttgagaggct

SEQ ID NO: 5039003 - DNA, 17 bp, Homo sapiens
cattatgtccactgtgt

SEQ ID NO: 5039004 - DNA, 21 bp, Homo sapiens
cattatgtccactgtgtatag

SEQ ID NO: 5039005 - DNA, 19 bp, Homo sapiens
cattattagtactgctctt

SEQ ID NO: 5039006 - DNA, 20 bp, Homo sapiens
cattctgatttggaaaaaga

SEQ ID NO: 5039007 - DNA, 23 bp, Homo sapiens
catttaaattttaccctttagac

SEQ ID NO: 5039008 - DNA, 12 bp, Homo sapiens
catttcttagac

SEQ ID NO: 5039009 - DNA, 20 bp, Homo sapiens
catttgcactggagttctat

SEQ ID NO: 5039010 - DNA, 21 bp, Homo sapiens
catttgcactggagttctatg

SEQ ID NO: 5039011 - DNA, 12 bp, Homo sapiens
ccaactccagga

SEQ ID NO: 5039012 - DNA, 13 bp, Homo sapiens
ccaactgtatata

SEQ ID NO: 5039013 - DNA, 22 bp, Homo sapiens
ccaaggcttctccaattctgcc

SEQ ID NO: 5039014 - DNA, 22 bp, Homo sapiens
ccaagtgcatttttatctgtga

SEQ ID NO: 5039015 - DNA, 16 bp, Homo sapiens
ccagaagcttccatag

SEQ ID NO: 5039016 - DNA, 14 bp, Homo sapiens
ccagtatctatata

SEQ ID NO: 5039017 - DNA, 19 bp, Homo sapiens
ccatagaagaacagcagat

SEQ ID NO: 5039018 - DNA, 21 bp, Homo sapiens
ccatgaaaaaaatgatcccca

SEQ ID NO: 5039019 - DNA, 16 bp, Homo sapiens
ccatgaacagaaaaca

SEQ ID NO: 5039020 - DNA, 17 bp, Homo sapiens
ccattttttaaggaaac

SEQ ID NO: 5039021 - DNA, 16 bp, Homo sapiens
cccaagtgtgaacaaa

SEQ ID NO: 5039022 - DNA, 18 bp, Homo sapiens
cccactgcaatcctgtct

SEQ ID NO: 5039023 - DNA, 15 bp, Homo sapiens
ccccaaacttcttgt

SEQ ID NO: 5039024 - DNA, 23 bp, Homo sapiens
cccggtttcagaagctgcagctg

SEQ ID NO: 5039025 - DNA, 23 bp, Homo sapiens
ccctggcattatgtccactgtgt

SEQ ID NO: 5039026 - DNA, 13 bp, Homo sapiens
ccgtgagccaaga

SEQ ID NO: 5039027 - DNA, 18 bp, Homo sapiens
cctcagggtccctcagga

SEQ ID NO: 5039028 - DNA, 15 bp, Homo sapiens
cctcttaagtgtgca

SEQ ID NO: 5039029 - DNA, 12 bp, Homo sapiens
cctgctcctcag

SEQ ID NO: 5039030 - DNA, 14 bp, Homo sapiens
cctggaatggagct

SEQ ID NO: 5039031 - DNA, 18 bp, Homo sapiens
cctggatattattcttgt

SEQ ID NO: 5039032 - DNA, 13 bp, Homo sapiens
cctgggctttctg

SEQ ID NO: 5039033 - DNA, 14 bp, Homo sapiens
cctgtatgttgtcc

SEQ ID NO: 5039034 - DNA, 16 bp, Homo sapiens
ccttagaccttccata

SEQ ID NO: 5039035 - DNA, 18 bp, Homo sapiens
ccttcagaaccatccata

SEQ ID NO: 5039036 - DNA, 18 bp, Homo sapiens
cctttagtacctgaaaag

SEQ ID NO: 5039037 - DNA, 22 bp, Homo sapiens
cgaaaagagcacttcacacaga

SEQ ID NO: 5039038 - DNA, 21 bp, Homo sapiens
cgagaattgcttgaacccggg

SEQ ID NO: 5039039 - DNA, 13 bp, Homo sapiens
cggtttcagaagc

SEQ ID NO: 5039040 - DNA, 20 bp, Homo sapiens
ctaagaagatgttttgaaat

SEQ ID NO: 5039041 - DNA, 19 bp, Homo sapiens
ctaccatgaacagaaaaca

SEQ ID NO: 5039042 - DNA, 14 bp, Homo sapiens
ctaggtacttcagg

SEQ ID NO: 5039043 - DNA, 13 bp, Homo sapiens
ctagtggagagaa

SEQ ID NO: 5039044 - DNA, 17 bp, Homo sapiens
ctatatatgtgtatgta

SEQ ID NO: 5039045 - DNA, 21 bp, Homo sapiens
ctattgcaaaggttccaactg

SEQ ID NO: 5039046 - DNA, 13 bp, Homo sapiens
ctcactctgcttt

SEQ ID NO: 5039047 - DNA, 17 bp, Homo sapiens
ctcagaaaacttctctt

SEQ ID NO: 5039048 - DNA, 23 bp, Homo sapiens
ctcagaaaacttctcttctgagc

SEQ ID NO: 5039049 - DNA, 15 bp, Homo sapiens
ctcctgctcctcagg

SEQ ID NO: 5039050 - DNA, 19 bp, Homo sapiens
ctccttcgcaggcatgtcc

SEQ ID NO: 5039051 - DNA, 17 bp, Homo sapiens
ctctagtttgcagagga

SEQ ID NO: 5039052 - DNA, 16 bp, Homo sapiens
ctctcctgctcctcag

SEQ ID NO: 5039053 - DNA, 18 bp, Homo sapiens
ctctcgcacctttccaaa

SEQ ID NO: 5039054 - DNA, 19 bp, Homo sapiens
ctcttcttttggcttccat

SEQ ID NO: 5039055 - DNA, 19 bp, Homo sapiens
ctgaaaacctaagtccttt

SEQ ID NO: 5039056 - DNA, 10 bp, Homo sapiens
ctgagcctct

SEQ ID NO: 5039057 - DNA, 20 bp, Homo sapiens
ctgatgaacttattctgtag

SEQ ID NO: 5039058 - DNA, 13 bp, Homo sapiens
ctgattcactgca

SEQ ID NO: 5039059 - DNA, 20 bp, Homo sapiens
ctgattcactgcatggctcc

SEQ ID NO: 5039060 - DNA, 23 bp, Homo sapiens
ctgcaatcctgtctttctgagca

SEQ ID NO: 5039061 - DNA, 19 bp, Homo sapiens
ctgccatcttagtttggat

SEQ ID NO: 5039062 - DNA, 22 bp, Homo sapiens
ctgccatcttagtttggattct

SEQ ID NO: 5039063 - DNA, 17 bp, Homo sapiens
ctgcccaaaaatatggt

SEQ ID NO: 5039064 - DNA, 13 bp, Homo sapiens
ctgctcctcagga

SEQ ID NO: 5039065 - DNA, 16 bp, Homo sapiens
ctggaaattctgcctt

SEQ ID NO: 5039066 - DNA, 22 bp, Homo sapiens
ctggagaattgaaaaggactct

SEQ ID NO: 5039067 - DNA, 18 bp, Homo sapiens
ctgggcaacagagcaaga

SEQ ID NO: 5039068 - DNA, 11 bp, Homo sapiens
ctgggctttct

SEQ ID NO: 5039069 - DNA, 23 bp, Homo sapiens
ctgggtggaactctcctgctcct

SEQ ID NO: 5039070 - DNA, 19 bp, Homo sapiens
ctgtatacaaccctggcat

SEQ ID NO: 5039071 - DNA, 15 bp, Homo sapiens
ctgtccccttccagg

SEQ ID NO: 5039072 - DNA, 23 bp, Homo sapiens
ctgtctttctgagcacactttag

SEQ ID NO: 5039073 - DNA, 20 bp, Homo sapiens
ctgtgagttctgttgtgttt

SEQ ID NO: 5039074 - DNA, 13 bp, Homo sapiens
ctgtgcagagact

SEQ ID NO: 5039075 - DNA, 17 bp, Homo sapiens
ctgtttccaggtcagaa

SEQ ID NO: 5039076 - DNA, 15 bp, Homo sapiens
cttactgtacctgtt

SEQ ID NO: 5039077 - DNA, 23 bp, Homo sapiens
cttactgtacctgttccttagac

SEQ ID NO: 5039078 - DNA, 16 bp, Homo sapiens
cttagaccttccataa

SEQ ID NO: 5039079 - DNA, 24 bp, Homo sapiens
cttaggcaccatagaagaacagca

SEQ ID NO: 5039080 - DNA, 12 bp, Homo sapiens
cttattctgtag

SEQ ID NO: 5039081 - DNA, 19 bp, Homo sapiens
cttcacacagacaagtggc

SEQ ID NO: 5039082 - DNA, 19 bp, Homo sapiens
cttcaggggcacttcattg

SEQ ID NO: 5039083 - DNA, 21 bp, Homo sapiens
cttcattgagagttttgtctt

SEQ ID NO: 5039084 - DNA, 13 bp, Homo sapiens
cttcctcactgcc

SEQ ID NO: 5039085 - DNA, 16 bp, Homo sapiens
cttcgcaggcatgtcc

SEQ ID NO: 5039086 - DNA, 20 bp, Homo sapiens
cttgaacaatcaaggcaact

SEQ ID NO: 5039087 - DNA, 19 bp, Homo sapiens
cttgcatccaactccagga

SEQ ID NO: 5039088 - DNA, 17 bp, Homo sapiens
cttggtagtttggaaag

SEQ ID NO: 5039089 - DNA, 23 bp, Homo sapiens
cttgtaactgggttcaaaaagaa

SEQ ID NO: 5039090 - DNA, 17 bp, Homo sapiens
ctttagtacctgaaaag

SEQ ID NO: 5039091 - DNA, 19 bp, Homo sapiens
ctttagtacctgaaaagta

SEQ ID NO: 5039092 - DNA, 22 bp, Homo sapiens
ctttagtacctgaaaagtaact

SEQ ID NO: 5039093 - DNA, 18 bp, Homo sapiens
ctttatgtggaaaacaga

SEQ ID NO: 5039094 - DNA, 14 bp, Homo sapiens
ctttatgtgtaaat

SEQ ID NO: 5039095 - DNA, 15 bp, Homo sapiens
cttttggcttccatg

SEQ ID NO: 5039096 - DNA, 21 bp, Homo sapiens
gaaaacagaacatcattagaa

SEQ ID NO: 5039097 - DNA, 20 bp, Homo sapiens
gaaaacattctgatttggaa

SEQ ID NO: 5039098 - DNA, 19 bp, Homo sapiens
gaaagtcagacctgtttct

SEQ ID NO: 5039099 - DNA, 16 bp, Homo sapiens
gaactctcctgctcct

SEQ ID NO: 5039100 - DNA, 15 bp, Homo sapiens
gaacttattctgtag

SEQ ID NO: 5039101 - DNA, 19 bp, Homo sapiens
gaagtaaccatttgcactg

SEQ ID NO: 5039102 - DNA, 16 bp, Homo sapiens
gaattgaaaaggactc

SEQ ID NO: 5039103 - DNA, 23 bp, Homo sapiens
gacaaagttactgattcactgca

SEQ ID NO: 5039104 - DNA, 19 bp, Homo sapiens
gacaactgaagagacacgt

SEQ ID NO: 5039105 - DNA, 19 bp, Homo sapiens
gacaccgggccagtatcta

SEQ ID NO: 5039106 - DNA, 22 bp, Homo sapiens
gacaccgggccagtatctatat

SEQ ID NO: 5039107 - DNA, 20 bp, Homo sapiens
gacatcctcaaaagaaagag

SEQ ID NO: 5039108 - DNA, 21 bp, Homo sapiens
gaccactgcatgagcttttat

SEQ ID NO: 5039109 - DNA, 15 bp, Homo sapiens
gagagaatcagacct

SEQ ID NO: 5039110 - DNA, 17 bp, Homo sapiens
gagagaatcagacctgg

SEQ ID NO: 5039111 - DNA, 17 bp, Homo sapiens
gagagttgctcctcagg

SEQ ID NO: 5039112 - DNA, 20 bp, Homo sapiens
gagccctcctggaatggagc

SEQ ID NO: 5039113 - DNA, 12 bp, Homo sapiens
gaggaagcagaa

SEQ ID NO: 5039114 - DNA, 17 bp, Homo sapiens
agtatctatatatgtgt

SEQ ID NO: 5039115 - DNA, 21 bp, Homo sapiens
agtctcttggactaagaagat

SEQ ID NO: 5039116 - DNA, 21 bp, Homo sapiens
agtgcatttttatctgtgagt

SEQ ID NO: 5039117 - DNA, 19 bp, Homo sapiens
agtggtggcaaaagacatc

SEQ ID NO: 5039118 - DNA, 22 bp, Homo sapiens
agtgtgaacaaaagatgctctt

SEQ ID NO: 5039119 - DNA, 18 bp, Homo sapiens
agttactgattcactgca

SEQ ID NO: 5039120 - DNA, 19 bp, Homo sapiens
agttatagatgtctaggta

SEQ ID NO: 5039121 - DNA, 22 bp, Homo sapiens
agttctgttgtgtttgtcaaaa

SEQ ID NO: 5039122 - DNA, 14 bp, Homo sapiens
agttgctcctcagg

SEQ ID NO: 5039123 - DNA, 18 bp, Homo sapiens
agtttgaaggaaacagtt

SEQ ID NO: 5039124 - DNA, 19 bp, Homo sapiens
agtttgatatgggctttct

SEQ ID NO: 5039125 - DNA, 14 bp, Homo sapiens
agtttgctattaga

SEQ ID NO: 5039126 - DNA, 12 bp, Homo sapiens
agttttgtcttg

SEQ ID NO: 5039127 - DNA, 20 bp, Homo sapiens
ataaaaggcaaatgtgtaca

SEQ ID NO: 5039128 - DNA, 18 bp, Homo sapiens
ataagcggcgtaagttta

SEQ ID NO: 5039129 - DNA, 13 bp, Homo sapiens
ataagtttgaagg

SEQ ID NO: 5039130 - DNA, 15 bp, Homo sapiens
ataagtttgaaggaa

SEQ ID NO: 5039131 - DNA, 21 bp, Homo sapiens
ataagtttgaaggaaacagtt

SEQ ID NO: 5039132 - DNA, 15 bp, Homo sapiens
ataatgctactgtct

SEQ ID NO: 5039133 - DNA, 18 bp, Homo sapiens
atacagtaactttatgtg

SEQ ID NO: 5039134 - DNA, 20 bp, Homo sapiens
atacagtaactttatgtgta

SEQ ID NO: 5039135 - DNA, 19 bp, Homo sapiens
atacatttgaggggaaaac

SEQ ID NO: 5039136 - DNA, 22 bp, Homo sapiens
ataccattttttaaggaaacaa

SEQ ID NO: 5039137 - DNA, 14 bp, Homo sapiens
atagaagaacagca

SEQ ID NO: 5039138 - DNA, 18 bp, Homo sapiens
atagctagttatgtgaga

SEQ ID NO: 5039139 - DNA, 13 bp, Homo sapiens
atagtagtatgat

SEQ ID NO: 5039140 - DNA, 21 bp, Homo sapiens
atataagtttgaaggaaacag

SEQ ID NO: 5039141 - DNA, 16 bp, Homo sapiens
atatacagtaacttta

SEQ ID NO: 5039142 - DNA, 20 bp, Homo sapiens
atatgatgtttaaaagcata

SEQ ID NO: 5039143 - DNA, 12 bp, Homo sapiens
atatgtgtatgt

SEQ ID NO: 5039144 - DNA, 16 bp, Homo sapiens
atatgtgtatgtacgt

SEQ ID NO: 5039145 - DNA, 14 bp, Homo sapiens
atcacatttgtaaa

SEQ ID NO: 5039146 - DNA, 16 bp, Homo sapiens
atcagtccctatgtat

SEQ ID NO: 5039147 - DNA, 21 bp, Homo sapiens
atcagtccctatgtatttgca

SEQ ID NO: 5039148 - DNA, 14 bp, Homo sapiens
atcccttctcagaa

SEQ ID NO: 5039149 - DNA, 15 bp, Homo sapiens
atcctgtctttctga

SEQ ID NO: 5039150 - DNA, 18 bp, Homo sapiens
atcctgtctttctgagca

SEQ ID NO: 5039151 - DNA, 23 bp, Homo sapiens
atcctgtctttctgagcacactt

SEQ ID NO: 5039152 - DNA, 18 bp, Homo sapiens
atcgtctttaaccccaaa

SEQ ID NO: 5039153 - DNA, 15 bp, Homo sapiens
atctatatatgtgta

SEQ ID NO: 5039154 - DNA, 17 bp, Homo sapiens
atctatatatgtgtatg

SEQ ID NO: 5039155 - DNA, 18 bp, Homo sapiens
atctatatatgtgtatgt

SEQ ID NO: 5039156 - DNA, 13 bp, Homo sapiens
atctgtgagttct

SEQ ID NO: 5039157 - DNA, 23 bp, Homo sapiens
atcttagtttggattcttatgta

SEQ ID NO: 5039158 - DNA, 14 bp, Homo sapiens
atgaaatatttttg

SEQ ID NO: 5039159 - DNA, 22 bp, Homo sapiens
atgagacataggccatgaaaaa

SEQ ID NO: 5039160 - DNA, 20 bp, Homo sapiens
atgagtccttgaaaatattt

SEQ ID NO: 5039161 - DNA, 21 bp, Homo sapiens
atgagtccttgaaaatatttt

SEQ ID NO: 5039162 - DNA, 18 bp, Homo sapiens
atgatgtccaacaaggaa

SEQ ID NO: 5039163 - DNA, 14 bp, Homo sapiens
atgccatatttttg

SEQ ID NO: 5039164 - DNA, 23 bp, Homo sapiens
atgctactgtctcactgaaacat

SEQ ID NO: 5039165 - DNA, 15 bp, Homo sapiens
atgctcttctgtgga

SEQ ID NO: 5039166 - DNA, 19 bp, Homo sapiens
atggcagagtttgtgtgtt

SEQ ID NO: 5039167 - DNA, 23 bp, Homo sapiens
atggcagagtttgtgtgttgtct

SEQ ID NO: 5039168 - DNA, 12 bp, Homo sapiens
atgggctttctc

SEQ ID NO: 5039169 - DNA, 22 bp, Homo sapiens
atgggctttctctttggtttct

SEQ ID NO: 5039170 - DNA, 18 bp, Homo sapiens
atggttgcacgttaaaaa

SEQ ID NO: 5039171 - DNA, 21 bp, Homo sapiens
atgtacgtttgtatgtgtgta

SEQ ID NO: 5039172 - DNA, 14 bp, Homo sapiens
atgtccactgtgta

SEQ ID NO: 5039173 - DNA, 13 bp, Homo sapiens
atgtggaaaacag

SEQ ID NO: 5039174 - DNA, 19 bp, Homo sapiens
attagtactgctcttgttt

SEQ ID NO: 5039175 - DNA, 17 bp, Homo sapiens
attatgtccactgtgta

SEQ ID NO: 5039176 - DNA, 15 bp, Homo sapiens
attattagtactgct

SEQ ID NO: 5039177 - DNA, 13 bp, Homo sapiens
attcaggtatgtt

SEQ ID NO: 5039178 - DNA, 19 bp, Homo sapiens
attctcactctgctttgca

SEQ ID NO: 5039179 - DNA, 16 bp, Homo sapiens
attctgcccaaaaata

SEQ ID NO: 5039180 - DNA, 19 bp, Homo sapiens
attctgcccaaaaatatgg

SEQ ID NO: 5039181 - DNA, 15 bp, Homo sapiens
attctgtagattctg

SEQ ID NO: 5039182 - DNA, 16 bp, Homo sapiens
attgacaactgaagag

SEQ ID NO: 5039183 - DNA, 16 bp, Homo sapiens
attgagagttttgtct

SEQ ID NO: 5039184 - DNA, 20 bp, Homo sapiens
attgagagttttgtcttgaa

SEQ ID NO: 5039185 - DNA, 23 bp, Homo sapiens
attgcaaaggttccaactgtata

SEQ ID NO: 5039186 - DNA, 20 bp, Homo sapiens
attgtaattcaagctttccg

SEQ ID NO: 5039187 - DNA, 18 bp, Homo sapiens
attgtactcaatggattt

SEQ ID NO: 5039188 - DNA, 22 bp, Homo sapiens
attgttgtttgccatactttgt

SEQ ID NO: 5039189 - DNA, 23 bp, Homo sapiens
atttgatgctgtttgacaaagtt

SEQ ID NO: 5039190 - DNA, 21 bp, Homo sapiens
atttgcactggagttctatgc

SEQ ID NO: 5039191 - DNA, 13 bp, Homo sapiens
attttcttttctt

SEQ ID NO: 5039192 - DNA, 20 bp, Homo sapiens
attttggggttgtgttgtca

SEQ ID NO: 5039193 - DNA, 22 bp, Homo sapiens
atttttgccctgagtccaagag

SEQ ID NO: 5039194 - DNA, 22 bp, Homo sapiens
caaaagacatcctcaaaagaaa

SEQ ID NO: 5039195 - DNA, 19 bp, Homo sapiens
caaaagatgctcttctgtg

SEQ ID NO: 5039196 - DNA, 20 bp, Homo sapiens
caaaagatgctcttctgtgg

SEQ ID NO: 5039197 - DNA, 17 bp, Homo sapiens
caaagcacagtttgaac

SEQ ID NO: 5039198 - DNA, 16 bp, Homo sapiens
caaagttaacagattt

SEQ ID NO: 5039199 - DNA, 20 bp, Homo sapiens
caaatgtgtacatggcagag

SEQ ID NO: 5039200 - DNA, 23 bp, Homo sapiens
caaatgtgtacatggcagagttt

SEQ ID NO: 5039201 - DNA, 12 bp, Homo sapiens
caacaaggaaat

SEQ ID NO: 5039202 - DNA, 16 bp, Homo sapiens
caacagagcaagactc

SEQ ID NO: 5039203 - DNA, 12 bp, Homo sapiens
caactgtatata

SEQ ID NO: 5039204 - DNA, 14 bp, Homo sapiens
caaggaaatagagg

SEQ ID NO: 5039205 - DNA, 18 bp, Homo sapiens
caaggcaactagtggaga

SEQ ID NO: 5039206 - DNA, 16 bp, Homo sapiens
caaggtgagagaggta

SEQ ID NO: 5039207 - DNA, 23 bp, Homo sapiens
caagtgattgacaactgaagaga

SEQ ID NO: 5039208 - DNA, 23 bp, Homo sapiens
caatagttgctgtccccttccag

SEQ ID NO: 5039209 - DNA, 22 bp, Homo sapiens
caatataaaaggcaaatgtgta

SEQ ID NO: 5039210 - DNA, 12 bp, Homo sapiens
caatatggagaa

SEQ ID NO: 5039211 - DNA, 18 bp, Homo sapiens
caatgatagtaagaaaag

SEQ ID NO: 5039212 - DNA, 13 bp, Homo sapiens
caatggatttgat

SEQ ID NO: 5039213 - DNA, 23 bp, Homo sapiens
caattgttgacagttctgaagaa

SEQ ID NO: 5039214 - DNA, 17 bp, Homo sapiens
cacaggagggtaatttt

SEQ ID NO: 5039215 - DNA, 13 bp, Homo sapiens
cacatagctgtct

SEQ ID NO: 5039216 - DNA, 19 bp, Homo sapiens
cacatttgtaaatgtcttt

SEQ ID NO: 5039217 - DNA, 13 bp, Homo sapiens
cacccctccagga

SEQ ID NO: 5039218 - DNA, 15 bp, Homo sapiens
cacctgggctttctg

SEQ ID NO: 5039219 - DNA, 23 bp, Homo sapiens
caccttgagaggcatgacagctg

SEQ ID NO: 5039220 - DNA, 20 bp, Homo sapiens
cacgtggctagggttccact

SEQ ID NO: 5039221 - DNA, 22 bp, Homo sapiens
cacgtgttttattcctgtatgt

SEQ ID NO: 5039222 - DNA, 23 bp, Homo sapiens
cacgtgttttattcctgtatgtt

SEQ ID NO: 5039223 - DNA, 16 bp, Homo sapiens
cactgcaatcctgtct

SEQ ID NO: 5039224 - DNA, 19 bp, Homo sapiens
cactgcaatcctgtctttc

SEQ ID NO: 5039225 - DNA, 18 bp, Homo sapiens
cactgcatgagcttttat

SEQ ID NO: 5039226 - DNA, 19 bp, Homo sapiens
cactgcatggctcccacag

SEQ ID NO: 5039227 - DNA, 22 bp, Homo sapiens
cacttcattgagagttttgtct

SEQ ID NO: 5039228 - DNA, 23 bp, Homo sapiens
cagaaaacttctcttctgagcct

SEQ ID NO: 5039229 - DNA, 18 bp, Homo sapiens
cagaagacctccctgtga

SEQ ID NO: 5039230 - DNA, 15 bp, Homo sapiens
cagaagctgcagctg

SEQ ID NO: 5039231 - DNA, 14 bp, Homo sapiens
cagaatctttgcaa

SEQ ID NO: 5039232 - DNA, 20 bp, Homo sapiens
cagagcaagactctgtctca

SEQ ID NO: 5039233 - DNA, 13 bp, Homo sapiens
cagagtatgaaca

SEQ ID NO: 5039234 - DNA, 22 bp, Homo sapiens
cagagtttgatatgggctttct

SEQ ID NO: 5039235 - DNA, 23 bp, Homo sapiens
cagagtttgatatgggctttctc

SEQ ID NO: 5039236 - DNA, 19 bp, Homo sapiens
cagagtttgtgtgttgtct

SEQ ID NO: 5039237 - DNA, 20 bp, Homo sapiens
cagattttggggttgtgttg

SEQ ID NO: 5039238 - DNA, 13 bp, Homo sapiens
cagcacttgtata

SEQ ID NO: 5039239 - DNA, 15 bp, Homo sapiens
cagctgacatggagt

SEQ ID NO: 5039240 - DNA, 22 bp, Homo sapiens
cagcttgcacacccatcgtctt

SEQ ID NO: 5039241 - DNA, 20 bp, Homo sapiens
caggaactatgggagcctca

SEQ ID NO: 5039242 - DNA, 15 bp, Homo sapiens
caggcacctgggctt

SEQ ID NO: 5039243 - DNA, 22 bp, Homo sapiens
tattcccaagcccatgagtcct

SEQ ID NO: 5039244 - DNA, 23 bp, Homo sapiens
tattgcaaaggttccaactgtat

SEQ ID NO: 5039245 - DNA, 21 bp, Homo sapiens
tatttagactcatcttactgt

SEQ ID NO: 5039246 - DNA, 23 bp, Homo sapiens
tatttgcagttcacctgcactta

SEQ ID NO: 5039247 - DNA, 11 bp, Homo sapiens
tcaaaaagtca

SEQ ID NO: 5039248 - DNA, 14 bp, Homo sapiens
tcaagctttccgag

SEQ ID NO: 5039249 - DNA, 21 bp, Homo sapiens
tcaaggcaactagtggagaga

SEQ ID NO: 5039250 - DNA, 18 bp, Homo sapiens
tcacatttgtaaatgtct

SEQ ID NO: 5039251 - DNA, 19 bp, Homo sapiens
tcacccaagagattgttgt

SEQ ID NO: 5039252 - DNA, 13 bp, Homo sapiens
tcacccctccagg

SEQ ID NO: 5039253 - DNA, 14 bp, Homo sapiens
tcacccctccagga

SEQ ID NO: 5039254 - DNA, 19 bp, Homo sapiens
tcagaaaccattgttcaga

SEQ ID NO: 5039255 - DNA, 20 bp, Homo sapiens
tcaggaactatgggagcctc

SEQ ID NO: 5039256 - DNA, 17 bp, Homo sapiens
tcaggaccaaagaacac

SEQ ID NO: 5039257 - DNA, 16 bp, Homo sapiens
tcagggtccctcagga

SEQ ID NO: 5039258 - DNA, 16 bp, Homo sapiens
tcagtccctatgtatt

SEQ ID NO: 5039259 - DNA, 23 bp, Homo sapiens
tcagtccctatgtatttgcagtt

SEQ ID NO: 5039260 - DNA, 22 bp, Homo sapiens
tcagtgtttgggtcacccctcc

SEQ ID NO: 5039261 - DNA, 19 bp, Homo sapiens
tcattgagagttttgtctt

SEQ ID NO: 5039262 - DNA, 22 bp, Homo sapiens
tccaattgttgacagttctgaa

SEQ ID NO: 5039263 - DNA, 20 bp, Homo sapiens
tccactgtgtatagaagtag

SEQ ID NO: 5039264 - DNA, 18 bp, Homo sapiens
tccataatgctactgtct

SEQ ID NO: 5039265 - DNA, 18 bp, Homo sapiens
tccatagtagtatgatga

SEQ ID NO: 5039266 - DNA, 14 bp, Homo sapiens
tccccttccagggg

SEQ ID NO: 5039267 - DNA, 17 bp, Homo sapiens
tcccggtttcagaagct

SEQ ID NO: 5039268 - DNA, 13 bp, Homo sapiens
tcccttctcagaa

SEQ ID NO: 5039269 - DNA, 16 bp, Homo sapiens
tcctgctcctcaggaa

SEQ ID NO: 5039270 - DNA, 13 bp, Homo sapiens
tcgtttctgtata

SEQ ID NO: 5039271 - DNA, 19 bp, Homo sapiens
tctatatatgtgtatgtac

SEQ ID NO: 5039272 - DNA, 22 bp, Homo sapiens
tctcagaaaacttctcttctga

SEQ ID NO: 5039273 - DNA, 23 bp, Homo sapiens
tctgaaaaattcctttgtgtttc

SEQ ID NO: 5039274 - DNA, 15 bp, Homo sapiens
tctgagcacacttta

SEQ ID NO: 5039275 - DNA, 14 bp, Homo sapiens
tctgagtctcttgg

SEQ ID NO: 5039276 - DNA, 15 bp, Homo sapiens
tctttcaacttgcat

SEQ ID NO: 5039277 - DNA, 19 bp, Homo sapiens
tctttctgagcacacttta

SEQ ID NO: 5039278 - DNA, 20 bp, Homo sapiens
tgaactttgaggaggaagca

SEQ ID NO: 5039279 - DNA, 16 bp, Homo sapiens
tgaaggaaacagttaa

SEQ ID NO: 5039280 - DNA, 23 bp, Homo sapiens
tgaatgtcttttgaatattccca

SEQ ID NO: 5039281 - DNA, 19 bp, Homo sapiens
tgagagagttgctcctcag

SEQ ID NO: 5039282 - DNA, 19 bp, Homo sapiens
tgagaggcatgacagctgt

SEQ ID NO: 5039283 - DNA, 21 bp, Homo sapiens
tgagagttttgtcttgaatgt

SEQ ID NO: 5039284 - DNA, 21 bp, Homo sapiens
tgaggttcagcaaggtgagag

SEQ ID NO: 5039285 - DNA, 15 bp, Homo sapiens
tgagtccttgaaaat

SEQ ID NO: 5039286 - DNA, 16 bp, Homo sapiens
tgatacaagattagaa

SEQ ID NO: 5039287 - DNA, 15 bp, Homo sapiens
tgatatgggctttct

SEQ ID NO: 5039288 - DNA, 16 bp, Homo sapiens
tgatatgggctttctc

SEQ ID NO: 5039289 - DNA, 12 bp, Homo sapiens
tgatctgtcaaa

SEQ ID NO: 5039290 - DNA, 16 bp, Homo sapiens
tgcacagatacacata

SEQ ID NO: 5039291 - DNA, 16 bp, Homo sapiens
tgcatccaactccagg

SEQ ID NO: 5039292 - DNA, 16 bp, Homo sapiens
tgccaggcaggcacct

SEQ ID NO: 5039293 - DNA, 17 bp, Homo sapiens
tgccatactttgtctga

SEQ ID NO: 5039294 - DNA, 22 bp, Homo sapiens
tgccatactttgtctgaaaaat

SEQ ID NO: 5039295 - DNA, 15 bp, Homo sapiens
tgccttattatttct

SEQ ID NO: 5039296 - DNA, 13 bp, Homo sapiens
tggaatggagctg

SEQ ID NO: 5039297 - DNA, 21 bp, Homo sapiens
tggagagaaggcctccctagc

SEQ ID NO: 5039298 - DNA, 14 bp, Homo sapiens
tggcaaaagacatc

SEQ ID NO: 5039299 - DNA, 17 bp, Homo sapiens
tggcagagtttgtgtgt

SEQ ID NO: 5039300 - DNA, 18 bp, Homo sapiens
tggcggtgatcagcagag

SEQ ID NO: 5039301 - DNA, 16 bp, Homo sapiens
tggctcccacaggagt

SEQ ID NO: 5039302 - DNA, 21 bp, Homo sapiens
tggtctgtttccaggtcagaa

SEQ ID NO: 5039303 - DNA, 17 bp, Homo sapiens
tggttgcacgttaaaaa

SEQ ID NO: 5039304 - DNA, 17 bp, Homo sapiens
tggtttcccccttctac

SEQ ID NO: 5039305 - DNA, 20 bp, Homo sapiens
tggtttcccccttctacatt

SEQ ID NO: 5039306 - DNA, 15 bp, Homo sapiens
tgtagttttacttgg

SEQ ID NO: 5039307 - DNA, 17 bp, Homo sapiens
tgtctcactgaaacatt

SEQ ID NO: 5039308 - DNA, 19 bp, Homo sapiens
tgtcttgaaagattcaggt

SEQ ID NO: 5039309 - DNA, 22 bp, Homo sapiens
tgtgagagagttgctcctcagg

SEQ ID NO: 5039310 - DNA, 17 bp, Homo sapiens
tgtggaccactgcatga

SEQ ID NO: 5039311 - DNA, 14 bp, Homo sapiens
tgtgttgtcttgaa

SEQ ID NO: 5039312 - DNA, 18 bp, Homo sapiens
tgtgttgtcttgaaagat

SEQ ID NO: 5039313 - DNA, 17 bp, Homo sapiens
tgttagttatagatgtc

SEQ ID NO: 5039314 - DNA, 16 bp, Homo sapiens
tgttgtcttgaaagat

SEQ ID NO: 5039315 - DNA, 12 bp, Homo sapiens
tgttgtttgcca

SEQ ID NO: 5039316 - DNA, 21 bp, Homo sapiens
tgtttatgttgcaatctggtt

SEQ ID NO: 5039317 - DNA, 15 bp, Homo sapiens
tgtttcttttcacat

SEQ ID NO: 5039318 - DNA, 15 bp, Homo sapiens
tgtttgccatacttt

SEQ ID NO: 5039319 - DNA, 22 bp, Homo sapiens
tgtttgccatactttgtctgaa

SEQ ID NO: 5039320 - DNA, 14 bp, Homo sapiens
tgttttattcctgt

SEQ ID NO: 5039321 - DNA, 18 bp, Homo sapiens
ttaaatagagtttgctat

SEQ ID NO: 5039322 - DNA, 19 bp, Homo sapiens
ttaacagctttctccagaa

SEQ ID NO: 5039323 - DNA, 20 bp, Homo sapiens
ttaacagctttctccagaac

SEQ ID NO: 5039324 - DNA, 23 bp, Homo sapiens
ttaagagccatataagtttgaag

SEQ ID NO: 5039325 - DNA, 18 bp, Homo sapiens
ttaatcccggtttcagaa

SEQ ID NO: 5039326 - DNA, 20 bp, Homo sapiens
ttaatcccggtttcagaagc

SEQ ID NO: 5039327 - DNA, 15 bp, Homo sapiens
ttatagatgtctagg

SEQ ID NO: 5039328 - DNA, 23 bp, Homo sapiens
ttatttagactcatcttactgta

SEQ ID NO: 5039329 - DNA, 14 bp, Homo sapiens
ttcacacagacaag

SEQ ID NO: 5039330 - DNA, 22 bp, Homo sapiens
ttcattgagagttttgtcttga

SEQ ID NO: 5039331 - DNA, 22 bp, Homo sapiens
ttccaggggtcaccttgagagg

SEQ ID NO: 5039332 - DNA, 23 bp, Homo sapiens
ttcccaatagcaacgtagcttct

SEQ ID NO: 5039333 - DNA, 16 bp, Homo sapiens
ttcctgtatgttgtcc

SEQ ID NO: 5039334 - DNA, 18 bp, Homo sapiens
ttcctttgtgtttctatt

SEQ ID NO: 5039335 - DNA, 18 bp, Homo sapiens
ttctcactctgctttgca

SEQ ID NO: 5039336 - DNA, 15 bp, Homo sapiens
ttctcatcacatttg

SEQ ID NO: 5039337 - DNA, 22 bp, Homo sapiens
ttctgagcctctttaacagctt

SEQ ID NO: 5039338 - DNA, 19 bp, Homo sapiens
ttctgcccaaaaatatggt

SEQ ID NO: 5039339 - DNA, 13 bp, Homo sapiens
ttctgtatacaac

SEQ ID NO: 5039340 - DNA, 24 bp, Homo sapiens
ttctgtatacaaccctggcattat

SEQ ID NO: 5039341 - DNA, 13 bp, Homo sapiens
ttgaaggaaacag

SEQ ID NO: 5039342 - DNA, 15 bp, Homo sapiens
ttgacagttctgaag

SEQ ID NO: 5039343 - DNA, 17 bp, Homo sapiens
ttgacagttctgaagaa

SEQ ID NO: 5039344 - DNA, 17 bp, Homo sapiens
ttgcactggagttctat

SEQ ID NO: 5039345 - DNA, 21 bp, Homo sapiens
ttgcatgatctgtcaaagtga

SEQ ID NO: 5039346 - DNA, 18 bp, Homo sapiens
ttgccatactttgtctga

SEQ ID NO: 5039347 - DNA, 23 bp, Homo sapiens
ttgctcctcagggtccctcagga

SEQ ID NO: 5039348 - DNA, 22 bp, Homo sapiens
ttggccttcagaaccatccata

SEQ ID NO: 5039349 - DNA, 21 bp, Homo sapiens
ttggcttccatgatggttatt

SEQ ID NO: 5039350 - DNA, 19 bp, Homo sapiens
ttgggtcacccctccagga

SEQ ID NO: 5039351 - DNA, 13 bp, Homo sapiens
ttgtagtttacct

SEQ ID NO: 5039352 - DNA, 22 bp, Homo sapiens
ttgtccaattgttgacagttct

SEQ ID NO: 5039353 - DNA, 18 bp, Homo sapiens
ttgtccgtgttcatacat

SEQ ID NO: 5039354 - DNA, 14 bp, Homo sapiens
ttgtcttgaaagat

SEQ ID NO: 5039355 - DNA, 22 bp, Homo sapiens
ttgtcttgaatgtcttttgaat

SEQ ID NO: 5039356 - DNA, 18 bp, Homo sapiens
ttgtgttcctctttgcat

SEQ ID NO: 5039357 - DNA, 21 bp, Homo sapiens
ttgttgacagttctgaagaat

SEQ ID NO: 5039358 - DNA, 14 bp, Homo sapiens
ttgttgtttgccat

SEQ ID NO: 5039359 - DNA, 14 bp, Homo sapiens
tttaacagctttct

SEQ ID NO: 5039360 - DNA, 18 bp, Homo sapiens
tttagagaactgtggccg

SEQ ID NO: 5039361 - DNA, 21 bp, Homo sapiens
tttagctgatgaacttattct

SEQ ID NO: 5039362 - DNA, 13 bp, Homo sapiens
tttatatatacag

SEQ ID NO: 5039363 - DNA, 21 bp, Homo sapiens
tttatatatacagtaacttta

SEQ ID NO: 5039364 - DNA, 16 bp, Homo sapiens
tttcacatagctgtct

SEQ ID NO: 5039365 - DNA, 18 bp, Homo sapiens
tttcacatagctgtctag

SEQ ID NO: 5039366 - DNA, 21 bp, Homo sapiens
tttcattattagtactgctct

SEQ ID NO: 5039367 - DNA, 13 bp, Homo sapiens
tttccgagtcaag

SEQ ID NO: 5039368 - DNA, 19 bp, Homo sapiens
tttctttcaacttgcatcc

SEQ ID NO: 5039369 - DNA, 14 bp, Homo sapiens
tttcttttcacata

SEQ ID NO: 5039370 - DNA, 15 bp, Homo sapiens
tttgaggaggaagca

SEQ ID NO: 5039371 - DNA, 23 bp, Homo sapiens
tttgatatgggctttctctttgg

SEQ ID NO: 5039372 - DNA, 15 bp, Homo sapiens
gaaaccttgtctcta

SEQ ID NO: 5039373 - DNA, 14 bp, Homo sapiens
gaaagagaaatgaa

SEQ ID NO: 5039374 - DNA, 22 bp, Homo sapiens
gaacaaaggacagagtatgaac

SEQ ID NO: 5039375 - DNA, 15 bp, Homo sapiens
gaacatcattagaac

SEQ ID NO: 5039376 - DNA, 21 bp, Homo sapiens
gaactctcctgctcctcagga

SEQ ID NO: 5039377 - DNA, 22 bp, Homo sapiens
gaagctgaaaacctaagtcctt

SEQ ID NO: 5039378 - DNA, 17 bp, Homo sapiens
gaaggcatcagtcccta

SEQ ID NO: 5039379 - DNA, 12 bp, Homo sapiens
gaatctttgcaa

SEQ ID NO: 5039380 - DNA, 16 bp, Homo sapiens
gaatgtcttttgaata

SEQ ID NO: 5039381 - DNA, 14 bp, Homo sapiens
gacaactgaagaga

SEQ ID NO: 5039382 - DNA, 14 bp, Homo sapiens
gacagttctgaaga

SEQ ID NO: 5039383 - DNA, 15 bp, Homo sapiens
gacagttctgaagaa

SEQ ID NO: 5039384 - DNA, 23 bp, Homo sapiens
gacataggccatgaaaaaaatga

SEQ ID NO: 5039385 - DNA, 12 bp, Homo sapiens
gaccactgcatg

SEQ ID NO: 5039386 - DNA, 16 bp, Homo sapiens
gacctccctgtgagag

SEQ ID NO: 5039387 - DNA, 13 bp, Homo sapiens
gacctggttttta

SEQ ID NO: 5039388 - DNA, 13 bp, Homo sapiens
gagaatcagacct

SEQ ID NO: 5039389 - DNA, 18 bp, Homo sapiens
gagaattgaaaaggactc

SEQ ID NO: 5039390 - DNA, 14 bp, Homo sapiens
gagagaatcagacc

SEQ ID NO: 5039391 - DNA, 17 bp, Homo sapiens
gagaggcatgacagctg

SEQ ID NO: 5039392 - DNA, 15 bp, Homo sapiens
gagagttttgtcttg

SEQ ID NO: 5039393 - DNA, 22 bp, Homo sapiens
gagagttttgtcttgaatgtct

SEQ ID NO: 5039394 - DNA, 17 bp, Homo sapiens
agcacagtttgaacaaa

SEQ ID NO: 5039395 - DNA, 14 bp, Homo sapiens
agccctcctggaat

SEQ ID NO: 5039396 - DNA, 16 bp, Homo sapiens
agctagttatgtgaga

SEQ ID NO: 5039397 - DNA, 22 bp, Homo sapiens
agctgaaaacctaagtccttta

SEQ ID NO: 5039398 - DNA, 20 bp, Homo sapiens
agctgatgaacttattctgt

SEQ ID NO: 5039399 - DNA, 22 bp, Homo sapiens
agctgatgaacttattctgtag

SEQ ID NO: 5039400 - DNA, 22 bp, Homo sapiens
agctgtataactgtgcagagac

SEQ ID NO: 5039401 - DNA, 15 bp, Homo sapiens
tgggttcaaaaagaa

SEQ ID NO: 5039402 - DNA, 22 bp, Homo sapiens
tggtagtaatcacagttggcct

SEQ ID NO: 5039403 - DNA, 22 bp, Homo sapiens
tggttgttagttatagatgtct

SEQ ID NO: 5039404 - DNA, 12 bp, Homo sapiens
tgtaaatacata

SEQ ID NO: 5039405 - DNA, 21 bp, Homo sapiens
tgtaatctttcatagccatac

SEQ ID NO: 5039406 - DNA, 13 bp, Homo sapiens
tgtaattcaagct

SEQ ID NO: 5039407 - DNA, 17 bp, Homo sapiens
tgtacatggcagagttt

SEQ ID NO: 5039408 - DNA, 16 bp, Homo sapiens
tgtacgtttgtatgtg

SEQ ID NO: 5039409 - DNA, 19 bp, Homo sapiens
tgtacgtttgtatgtgtgt

SEQ ID NO: 5039410 - DNA, 20 bp, Homo sapiens
tgtacgtttgtatgtgtgta

SEQ ID NO: 5039411 - DNA, 19 bp, Homo sapiens
tgtagtcccacttacttgg

SEQ ID NO: 5039412 - DNA, 19 bp, Homo sapiens
tgtagtttacctctttaaa

SEQ ID NO: 5039413 - DNA, 16 bp, Homo sapiens
tgtatacaaccctggc

SEQ ID NO: 5039414 - DNA, 21 bp, Homo sapiens
tgtatatacgcatctataaat

SEQ ID NO: 5039415 - DNA, 15 bp, Homo sapiens
tgtccccttccaggg

SEQ ID NO: 5039416 - DNA, 17 bp, Homo sapiens
tgtcttgaatgtctttt

SEQ ID NO: 5039417 - DNA, 20 bp, Homo sapiens
tgtcttgaatgtcttttgaa

SEQ ID NO: 5039418 - DNA, 15 bp, Homo sapiens
tgtctttctgagcac

SEQ ID NO: 5039419 - DNA, 13 bp, Homo sapiens
tgtggaaaacaga

SEQ ID NO: 5039420 - DNA, 19 bp, Homo sapiens
tgtgttcctctttgcatga

SEQ ID NO: 5039421 - DNA, 12 bp, Homo sapiens
ttaaagcttggt

SEQ ID NO: 5039422 - DNA, 16 bp, Homo sapiens
ttaaattttacccttt

SEQ ID NO: 5039423 - DNA, 20 bp, Homo sapiens
ttaaattttaccctttagac

SEQ ID NO: 5039424 - DNA, 14 bp, Homo sapiens
ttaacagctttctc

SEQ ID NO: 5039425 - DNA, 22 bp, Homo sapiens
ttaagagccatataagtttgaa

SEQ ID NO: 5039426 - DNA, 13 bp, Homo sapiens
ttaccctttagac

SEQ ID NO: 5039427 - DNA, 20 bp, Homo sapiens
ttagactgtagcctggatat

SEQ ID NO: 5039428 - DNA, 18 bp, Homo sapiens
ttagtttggattcttatg

SEQ ID NO: 5039429 - DNA, 15 bp, Homo sapiens
ttatgtccactgtgt

SEQ ID NO: 5039430 - DNA, 15 bp, Homo sapiens
ttatgtgtaaataca

SEQ ID NO: 5039431 - DNA, 13 bp, Homo sapiens
ttattcctgtatg

SEQ ID NO: 5039432 - DNA, 17 bp, Homo sapiens
ttattcctgtatgttgt

SEQ ID NO: 5039433 - DNA, 19 bp, Homo sapiens
ttattcctgtatgttgtcc

SEQ ID NO: 5039434 - DNA, 20 bp, Homo sapiens
ttattctgtagattctgtgg

SEQ ID NO: 5039435 - DNA, 15 bp, Homo sapiens
ttcacatagctgtct

SEQ ID NO: 5039436 - DNA, 19 bp, Homo sapiens
ttcattgagagttttgtct

SEQ ID NO: 5039437 - DNA, 19 bp, Homo sapiens
ttccacgtgttttattcct

SEQ ID NO: 5039438 - DNA, 13 bp, Homo sapiens
ttccactggagaa

SEQ ID NO: 5039439 - DNA, 16 bp, Homo sapiens
catatggagtgcctgt

SEQ ID NO: 5039440 - DNA, 21 bp, Homo sapiens
catcacatttgtaaatgtctt

SEQ ID NO: 5039441 - DNA, 16 bp, Homo sapiens
catccatagtagtatg

SEQ ID NO: 5039442 - DNA, 19 bp, Homo sapiens
catgagtccttgaaaatat

SEQ ID NO: 5039443 - DNA, 14 bp, Homo sapiens
catgatctgtcaaa

SEQ ID NO: 5039444 - DNA, 19 bp, Homo sapiens
cattatgtccactgtgtat

SEQ ID NO: 5039445 - DNA, 22 bp, Homo sapiens
cattatgtccactgtgtataga

SEQ ID NO: 5039446 - DNA, 22 bp, Homo sapiens
cattgtaatctttcatagccat

SEQ ID NO: 5039447 - DNA, 23 bp, Homo sapiens
catttagagaactgtggccgtta

SEQ ID NO: 5039448 - DNA, 17 bp, Homo sapiens
cattttttaaggaaaca

SEQ ID NO: 5039449 - DNA, 19 bp, Homo sapiens
ccaagagtggtggcagctc

SEQ ID NO: 5039450 - DNA, 17 bp, Homo sapiens
ccaatagttgctgtccc

SEQ ID NO: 5039451 - DNA, 19 bp, Homo sapiens
ccaatagttgctgtcccct

SEQ ID NO: 5039452 - DNA, 20 bp, Homo sapiens
ccaattgttgacagttctga

SEQ ID NO: 5039453 - DNA, 23 bp, Homo sapiens
ccacaggggctatcccttctcag

SEQ ID NO: 5039454 - DNA, 11 bp, Homo sapiens
ccactggagaa

SEQ ID NO: 5039455 - DNA, 15 bp, Homo sapiens
ccagcacttgtatat

SEQ ID NO: 5039456 - DNA, 17 bp, Homo sapiens
ccaggcaggcacctggg

SEQ ID NO: 5039457 - DNA, 18 bp, Homo sapiens
ccaggggtcaccttgaga

SEQ ID NO: 5039458 - DNA, 18 bp, Homo sapiens
ccagtatctatatatgtg

SEQ ID NO: 5039459 - DNA, 20 bp, Homo sapiens
ccataaggtttcgtttctgt

SEQ ID NO: 5039460 - DNA, 22 bp, Homo sapiens
ccataaggtttcgtttctgtat

SEQ ID NO: 5039461 - DNA, 19 bp, Homo sapiens
ccatactttgtctgaaaaa

SEQ ID NO: 5039462 - DNA, 15 bp, Homo sapiens
ccatataagtttgaa

SEQ ID NO: 5039463 - DNA, 23 bp, Homo sapiens
ccatataagtttgaaggaaacag

SEQ ID NO: 5039464 - DNA, 16 bp, Homo sapiens
cccaagagtggtggca

SEQ ID NO: 5039465 - DNA, 15 bp, Homo sapiens
cccactgcaatcctg

SEQ ID NO: 5039466 - DNA, 16 bp, Homo sapiens
cccggtttcagaagct

SEQ ID NO: 5039467 - DNA, 18 bp, Homo sapiens
cctaagtcctttatgtgg

SEQ ID NO: 5039468 - DNA, 14 bp, Homo sapiens
cctatgtatttgca

SEQ ID NO: 5039469 - DNA, 23 bp, Homo sapiens
cctcaggaactatgggagcctca

SEQ ID NO: 5039470 - DNA, 21 bp, Homo sapiens
cctccctagccagcacttgta

SEQ ID NO: 5039471 - DNA, 15 bp, Homo sapiens
cctcctggaatggag

SEQ ID NO: 5039472 - DNA, 23 bp, Homo sapiens
cctgagtccaagagggtccttta

SEQ ID NO: 5039473 - DNA, 19 bp, Homo sapiens
cctgggcaacagagcaaga

SEQ ID NO: 5039474 - DNA, 22 bp, Homo sapiens
cctgggcaacagagcaagactc

SEQ ID NO: 5039475 - DNA, 13 bp, Homo sapiens
cctgtatgttgtc

SEQ ID NO: 5039476 - DNA, 18 bp, Homo sapiens
ccttgaacaatcaaggca

SEQ ID NO: 5039477 - DNA, 16 bp, Homo sapiens
ccttgagaggcatgac

SEQ ID NO: 5039478 - DNA, 21 bp, Homo sapiens
ccttgagaggcatgacagctg

SEQ ID NO: 5039479 - DNA, 19 bp, Homo sapiens
cctttatgtggaaaacaga

SEQ ID NO: 5039480 - DNA, 16 bp, Homo sapiens
cctttccaaggcttct

SEQ ID NO: 5039481 - DNA, 18 bp, Homo sapiens
cgacctggtttttaaata

SEQ ID NO: 5039482 - DNA, 16 bp, Homo sapiens
cggtgatcagcagaga

SEQ ID NO: 5039483 - DNA, 12 bp, Homo sapiens
cggtttcagaag

SEQ ID NO: 5039484 - DNA, 13 bp, Homo sapiens
ctaaaccacaata

SEQ ID NO: 5039485 - DNA, 14 bp, Homo sapiens
ctagtaaagacata

SEQ ID NO: 5039486 - DNA, 15 bp, Homo sapiens
ctagttatgtgagaa

SEQ ID NO: 5039487 - DNA, 13 bp, Homo sapiens
ctatatatgtgta

SEQ ID NO: 5039488 - DNA, 13 bp, Homo sapiens
ctatgtatttgca

SEQ ID NO: 5039489 - DNA, 14 bp, Homo sapiens
ctattgacttcaat

SEQ ID NO: 5039490 - DNA, 17 bp, Homo sapiens
ctcagggtccctcagga

SEQ ID NO: 5039491 - DNA, 15 bp, Homo sapiens
ctcgaaaagagcact

SEQ ID NO: 5039492 - DNA, 14 bp, Homo sapiens
ctcgcacctttcca

SEQ ID NO: 5039493 - DNA, 16 bp, Homo sapiens
ctcttcttttggcttc

SEQ ID NO: 5039494 - DNA, 17 bp, Homo sapiens
ctctttaacagctttct

SEQ ID NO: 5039495 - DNA, 12 bp, Homo sapiens
ctgaataaatgg

SEQ ID NO: 5039496 - DNA, 15 bp, Homo sapiens
ctgattcactgcatg

SEQ ID NO: 5039497 - DNA, 18 bp, Homo sapiens
ctgattcactgcatggct

SEQ ID NO: 5039498 - DNA, 15 bp, Homo sapiens
ctgcaatcctgtctt

SEQ ID NO: 5039499 - DNA, 16 bp, Homo sapiens
ctgcaatcctgtcttt

SEQ ID NO: 5039500 - DNA, 19 bp, Homo sapiens
ctgcactccagcctgggca

SEQ ID NO: 5039501 - DNA, 23 bp, Homo sapiens
ctgccatcttagtttggattctt

SEQ ID NO: 5039502 - DNA, 15 bp, Homo sapiens
ctggaatggagctgt

SEQ ID NO: 5039503 - DNA, 19 bp, Homo sapiens
ctggaatggagctgtataa

SEQ ID NO: 5039504 - DNA, 22 bp, Homo sapiens
ctggacaccgggccagtatcta

SEQ ID NO: 5039505 - DNA, 19 bp, Homo sapiens
ctggcattatgtccactgt

SEQ ID NO: 5039506 - DNA, 15 bp, Homo sapiens
ctgggcaacagagca

SEQ ID NO: 5039507 - DNA, 11 bp, Homo sapiens
ctgggcatggt

SEQ ID NO: 5039508 - DNA, 13 bp, Homo sapiens
ctgtagattctgt

SEQ ID NO: 5039509 - DNA, 15 bp, Homo sapiens
ctgtagattctgtgg

SEQ ID NO: 5039510 - DNA, 20 bp, Homo sapiens
ctgtagattctgtggaacaa

SEQ ID NO: 5039511 - DNA, 23 bp, Homo sapiens
ctgtagtcccacttacttgggag

SEQ ID NO: 5039512 - DNA, 13 bp, Homo sapiens
ctgtatgttgtcc

SEQ ID NO: 5039513 - DNA, 15 bp, Homo sapiens
ctgtatgttgtccaa

SEQ ID NO: 5039514 - DNA, 13 bp, Homo sapiens
ctgtccccttcca

SEQ ID NO: 5039515 - DNA, 15 bp, Homo sapiens
ctgtgcagagacttt

SEQ ID NO: 5039516 - DNA, 19 bp, Homo sapiens
ctgtgtgttgccaggcagg

SEQ ID NO: 5039517 - DNA, 14 bp, Homo sapiens
ctgttatttagact

SEQ ID NO: 5039518 - DNA, 13 bp, Homo sapiens
cttaccagaagct

SEQ ID NO: 5039519 - DNA, 14 bp, Homo sapiens
cttactcaaacatg

SEQ ID NO: 5039520 - DNA, 18 bp, Homo sapiens
cttactgtacctgttcct

SEQ ID NO: 5039521 - DNA, 18 bp, Homo sapiens
cttagaccttccataatg

SEQ ID NO: 5039522 - DNA, 22 bp, Homo sapiens
cttaggcaccatagaagaacag

SEQ ID NO: 5039523 - DNA, 19 bp, Homo sapiens
cttatgtagcaggaaataa

SEQ ID NO: 5039524 - DNA, 16 bp, Homo sapiens
cttcattctcactctg

SEQ ID NO: 5039525 - DNA, 23 bp, Homo sapiens
cttcattgagagttttgtcttga

SEQ ID NO: 5039526 - DNA, 19 bp, Homo sapiens
cttccaggggtcaccttga

SEQ ID NO: 5039527 - DNA, 16 bp, Homo sapiens
cttcctcactgcccaa

SEQ ID NO: 5039528 - DNA, 14 bp, Homo sapiens
cttctcttctgagc

SEQ ID NO: 5039529 - DNA, 13 bp, Homo sapiens
cttgaatgtcttt

SEQ ID NO: 5039530 - DNA, 16 bp, Homo sapiens
cttgagccctcctgga

SEQ ID NO: 5039531 - DNA, 22 bp, Homo sapiens
cttggctttcattattagtact

SEQ ID NO: 5039532 - DNA, 20 bp, Homo sapiens
cttgtatatacgcatctata

SEQ ID NO: 5039533 - DNA, 14 bp, Homo sapiens
cttgtttcttttca

SEQ ID NO: 5039534 - DNA, 20 bp, Homo sapiens
ctttaatcccggtttcagaa

SEQ ID NO: 5039535 - DNA, 14 bp, Homo sapiens
ctttcaacttgcat

SEQ ID NO: 5039536 - DNA, 23 bp, Homo sapiens
ctttctccagaaccagtgtctga

SEQ ID NO: 5039537 - DNA, 17 bp, Homo sapiens
ctttctgagcacacttt

SEQ ID NO: 5039538 - DNA, 20 bp, Homo sapiens
ctttctgagcacactttagt

SEQ ID NO: 5039539 - DNA, 16 bp, Homo sapiens
ctttgcaagaaagtca

SEQ ID NO: 5039540 - DNA, 15 bp, Homo sapiens
ctttgcatgatctgt

SEQ ID NO: 5039541 - DNA, 14 bp, Homo sapiens
ctttgtgtttctat

SEQ ID NO: 5039542 - DNA, 23 bp, Homo sapiens
ctttgtgtttctattgacttcaa

SEQ ID NO: 5039543 - DNA, 13 bp, Homo sapiens
cttttgaatattc

SEQ ID NO: 5039544 - DNA, 21 bp, Homo sapiens
gaaaacctaagtcctttatgt

SEQ ID NO: 5039545 - DNA, 21 bp, Homo sapiens
gaaaacttctcttctgagcct

SEQ ID NO: 5039546 - DNA, 23 bp, Homo sapiens
gaaaacttctcttctgagcctct

SEQ ID NO: 5039547 - DNA, 23 bp, Homo sapiens
gaaaagagcacttcacacagaca

SEQ ID NO: 5039548 - DNA, 20 bp, Homo sapiens
gaaaaggactcttgagccct

SEQ ID NO: 5039549 - DNA, 18 bp, Homo sapiens
gaaaatattttttatata

SEQ ID NO: 5039550 - DNA, 19 bp, Homo sapiens
gaaaccattgttcagaaga

SEQ ID NO: 5039551 - DNA, 23 bp, Homo sapiens
gagattgttgtttgccatacttt

SEQ ID NO: 5039552 - DNA, 23 bp, Homo sapiens
gagccctcctggaatggagctgt

SEQ ID NO: 5039553 - DNA, 21 bp, Homo sapiens
gagctgtataactgtgcagag

SEQ ID NO: 5039554 - DNA, 22 bp, Homo sapiens
gagctgtataactgtgcagaga

SEQ ID NO: 5039555 - DNA, 17 bp, Homo sapiens
gaggtgggcagatcatt

SEQ ID NO: 5039556 - DNA, 14 bp, Homo sapiens
gagttgctcctcag

SEQ ID NO: 5039557 - DNA, 18 bp, Homo sapiens
gagtttgctattagagca

SEQ ID NO: 5039558 - DNA, 18 bp, Homo sapiens
gagtttgtgtgttgtctt

SEQ ID NO: 5039559 - DNA, 16 bp, Homo sapiens
gatacaagattagaag

SEQ ID NO: 5039560 - DNA, 23 bp, Homo sapiens
gatagtgggcaccccactgcaat

SEQ ID NO: 5039561 - DNA, 14 bp, Homo sapiens
gatatgggctttct

SEQ ID NO: 5039562 - DNA, 15 bp, Homo sapiens
gatattattcttgta

SEQ ID NO: 5039563 - DNA, 14 bp, Homo sapiens
gatccccaagtgtg

SEQ ID NO: 5039564 - DNA, 17 bp, Homo sapiens
gatgaacttattctgta

SEQ ID NO: 5039565 - DNA, 23 bp, Homo sapiens
gatggttattttcttttctttca

SEQ ID NO: 5039566 - DNA, 16 bp, Homo sapiens
gatgtccaacaaggaa

SEQ ID NO: 5039567 - DNA, 17 bp, Homo sapiens
gattcaggtatgttgcc

SEQ ID NO: 5039568 - DNA, 23 bp, Homo sapiens
gattcttatgtagcaggaaataa

SEQ ID NO: 5039569 - DNA, 13 bp, Homo sapiens
gattgttgtttgc

SEQ ID NO: 5039570 - DNA, 12 bp, Homo sapiens
gatttggaaaaa

SEQ ID NO: 5039571 - DNA, 12 bp, Homo sapiens
gcaaatgtgtac

SEQ ID NO: 5039572 - DNA, 16 bp, Homo sapiens
gcaagactctgtctca

SEQ ID NO: 5039573 - DNA, 17 bp, Homo sapiens
gcaagactctgtctcaa

SEQ ID NO: 5039574 - DNA, 20 bp, Homo sapiens
gcacctgggctttctggaat

SEQ ID NO: 5039575 - DNA, 22 bp, Homo sapiens
gcacgttaaaaattaaaagaag

SEQ ID NO: 5039576 - DNA, 19 bp, Homo sapiens
gcactctgttatttagact

SEQ ID NO: 5039577 - DNA, 23 bp, Homo sapiens
gcacttcattgagagttttgtct

SEQ ID NO: 5039578 - DNA, 24 bp, Homo sapiens
gcagagtttgtgtgttgtcttgaa

SEQ ID NO: 5039579 - DNA, 13 bp, Homo sapiens
gcagttcacctgc

SEQ ID NO: 5039580 - DNA, 16 bp, Homo sapiens
gcatattttctccgaa

SEQ ID NO: 5039581 - DNA, 23 bp, Homo sapiens
gccagtatctatatatgtgtatg

SEQ ID NO: 5039582 - DNA, 19 bp, Homo sapiens
gccatataagtttgaagga

SEQ ID NO: 5039583 - DNA, 22 bp, Homo sapiens
gccatataagtttgaaggaaac

SEQ ID NO: 5039584 - DNA, 13 bp, Homo sapiens
gcctcagactcat

SEQ ID NO: 5039585 - DNA, 20 bp, Homo sapiens
gcctgggcaacagagcaaga

SEQ ID NO: 5039586 - DNA, 21 bp, Homo sapiens
gcctgtgtgttgccaggcagg

SEQ ID NO: 5039587 - DNA, 21 bp, Homo sapiens
gctactgtctcactgaaacat

SEQ ID NO: 5039588 - DNA, 15 bp, Homo sapiens
gctatcccttctcag

SEQ ID NO: 5039589 - DNA, 17 bp, Homo sapiens
gctatcccttctcagaa

SEQ ID NO: 5039590 - DNA, 22 bp, Homo sapiens
gctcaaaatgatatgtttgagt

SEQ ID NO: 5039591 - DNA, 23 bp, Homo sapiens
gctgatgttttgtattttgtgtt

SEQ ID NO: 5039592 - DNA, 17 bp, Homo sapiens
gctgttccacaggggct

SEQ ID NO: 5039593 - DNA, 20 bp, Homo sapiens
gcttcattctcactctgctt

SEQ ID NO: 5039594 - DNA, 17 bp, Homo sapiens
gcttctaccatgaacag

SEQ ID NO: 5039595 - DNA, 12 bp, Homo sapiens
ggaaacaatata

SEQ ID NO: 5039596 - DNA, 20 bp, Homo sapiens
ggaactctcctgctcctcag

SEQ ID NO: 5039597 - DNA, 21 bp, Homo sapiens
ggaactctcctgctcctcagg

SEQ ID NO: 5039598 - DNA, 15 bp, Homo sapiens
ggactgggggccaga

SEQ ID NO: 5039599 - DNA, 17 bp, Homo sapiens
ggaggccgaggcacgag

SEQ ID NO: 5039600 - DNA, 21 bp, Homo sapiens
ggaggttgccgtgagccaaga

SEQ ID NO: 5039601 - DNA, 18 bp, Homo sapiens
ggcggtgatcagcagaga

SEQ ID NO: 5039602 - DNA, 18 bp, Homo sapiens
ggctatcccttctcagaa

SEQ ID NO: 5039603 - DNA, 20 bp, Homo sapiens
gggcatggtagctcaagcct

SEQ ID NO: 5039604 - DNA, 18 bp, Homo sapiens
gggctatcccttctcaga

SEQ ID NO: 5039605 - DNA, 12 bp, Homo sapiens
ggttccactgga

SEQ ID NO: 5039606 - DNA, 14 bp, Homo sapiens
gtaactttatgtgt

SEQ ID NO: 5039607 - DNA, 17 bp, Homo sapiens
gtaagaaaagtggttgt

SEQ ID NO: 5039608 - DNA, 14 bp, Homo sapiens
gtacctgaaaagta

SEQ ID NO: 5039609 - DNA, 18 bp, Homo sapiens
gtacctgaaaagtaactt

SEQ ID NO: 5039610 - DNA, 18 bp, Homo sapiens
gtagacgaacagctgaca

SEQ ID NO: 5039611 - DNA, 19 bp, Homo sapiens
gtagattctgtggaacaag

SEQ ID NO: 5039612 - DNA, 17 bp, Homo sapiens
gtagcttaccagaagct

SEQ ID NO: 5039613 - DNA, 18 bp, Homo sapiens
gtatgttgtccaattgtt

SEQ ID NO: 5039614 - DNA, 20 bp, Homo sapiens
gtcacccctccaggaatgat

SEQ ID NO: 5039615 - DNA, 23 bp, Homo sapiens
gtcagaaaccattgttcagaaga

SEQ ID NO: 5039616 - DNA, 14 bp, Homo sapiens
gtccactgtgtata

SEQ ID NO: 5039617 - DNA, 13 bp, Homo sapiens
gtcctttatgtgg

SEQ ID NO: 5039618 - DNA, 20 bp, Homo sapiens
gtcctttccaaggcttctcc

SEQ ID NO: 5039619 - DNA, 22 bp, Homo sapiens
gtcctttccaaggcttctccaa

SEQ ID NO: 5039620 - DNA, 20 bp, Homo sapiens
gtctgaaccaccctggaaat

SEQ ID NO: 5039621 - DNA, 22 bp, Homo sapiens
gtctggccaatatggagaaacc

SEQ ID NO: 5039622 - DNA, 12 bp, Homo sapiens
gtcttgaaagat

SEQ ID NO: 5039623 - DNA, 15 bp, Homo sapiens
gtcttgaatgtcttt

SEQ ID NO: 5039624 - DNA, 19 bp, Homo sapiens
gtcttgaatgtcttttgaa

SEQ ID NO: 5039625 - DNA, 15 bp, Homo sapiens
gtgagttctgttgtg

SEQ ID NO: 5039626 - DNA, 17 bp, Homo sapiens
gtgcctgtacaagctga

SEQ ID NO: 5039627 - DNA, 22 bp, Homo sapiens
gtggaactctcctgctcctcag

SEQ ID NO: 5039628 - DNA, 23 bp, Homo sapiens
gtggaactctcctgctcctcagg

SEQ ID NO: 5039629 - DNA, 22 bp, Homo sapiens
gtgtctgaaccaccctggaaat

SEQ ID NO: 5039630 - DNA, 19 bp, Homo sapiens
gtgtgtagacaaatatttg

SEQ ID NO: 5039631 - DNA, 13 bp, Homo sapiens
gtgtgttgtcttg

SEQ ID NO: 5039632 - DNA, 18 bp, Homo sapiens
gtgtgttgtcttgaaaga

SEQ ID NO: 5039633 - DNA, 18 bp, Homo sapiens
gtgttgtcttgaaagatt

SEQ ID NO: 5039634 - DNA, 13 bp, Homo sapiens
gttcaaaaagaaa

SEQ ID NO: 5039635 - DNA, 14 bp, Homo sapiens
gttcatacatttga

SEQ ID NO: 5039636 - DNA, 22 bp, Homo sapiens
gttgtccaattgttgacagttc

SEQ ID NO: 5039637 - DNA, 22 bp, Homo sapiens
gtttacctgaataaatggtagt

SEQ ID NO: 5039638 - DNA, 16 bp, Homo sapiens
gtttcgtttctgtata

SEQ ID NO: 5039639 - DNA, 16 bp, Homo sapiens
gtttgaaggaaacagt

SEQ ID NO: 5039640 - DNA, 17 bp, Homo sapiens
gtttgctattagagcat

SEQ ID NO: 5039641 - DNA, 20 bp, Homo sapiens
gtttggattcttatgtagca

SEQ ID NO: 5039642 - DNA, 17 bp, Homo sapiens
taaaatatgatgtttaa

SEQ ID NO: 5039643 - DNA, 17 bp, Homo sapiens
taaaggatgttggtgtt

SEQ ID NO: 5039644 - DNA, 16 bp, Homo sapiens
taaattttacccttta

SEQ ID NO: 5039645 - DNA, 14 bp, Homo sapiens
taaccatttgcact

SEQ ID NO: 5039646 - DNA, 14 bp, Homo sapiens
taactgggttcaaa

SEQ ID NO: 5039647 - DNA, 15 bp, Homo sapiens
taacttggctttcat

SEQ ID NO: 5039648 - DNA, 22 bp, Homo sapiens
taagagccatataagtttgaag

SEQ ID NO: 5039649 - DNA, 11 bp, Homo sapiens
taaggaaacaa

SEQ ID NO: 5039650 - DNA, 22 bp, Homo sapiens
taaggtttcgtttctgtataca

SEQ ID NO: 5039651 - DNA, 15 bp, Homo sapiens
taagtcctttatgtg

SEQ ID NO: 5039652 - DNA, 17 bp, Homo sapiens
taagtcctttatgtgga

SEQ ID NO: 5039653 - DNA, 20 bp, Homo sapiens
taagtcctttatgtggaaaa

SEQ ID NO: 5039654 - DNA, 19 bp, Homo sapiens
aaaaattcctttgtgtttc

SEQ ID NO: 5039655 - DNA, 11 bp, Homo sapiens
aaaagaaggaa

SEQ ID NO: 5039656 - DNA, 16 bp, Homo sapiens
aaaaggcaaatgtgta

SEQ ID NO: 5039657 - DNA, 12 bp, Homo sapiens
aaaagtaacttg

SEQ ID NO: 5039658 - DNA, 20 bp, Homo sapiens
aaaatattttttatatatac

SEQ ID NO: 5039659 - DNA, 13 bp, Homo sapiens
aaacactgccatc

SEQ ID NO: 5039660 - DNA, 19 bp, Homo sapiens
aaacctaagtcctttatgt

SEQ ID NO: 5039661 - DNA, 16 bp, Homo sapiens
aaactagtaaagacat

SEQ ID NO: 5039662 - DNA, 10 bp, Homo sapiens
aaacttcttg

SEQ ID NO: 5039663 - DNA, 13 bp, Homo sapiens
aaagagagagaga

SEQ ID NO: 5039664 - DNA, 20 bp, Homo sapiens
aaagttagagtacagatcct

SEQ ID NO: 5039665 - DNA, 21 bp, Homo sapiens
aaatatgatgtttaaaagcat

SEQ ID NO: 5039666 - DNA, 12 bp, Homo sapiens
aaatatttggag

SEQ ID NO: 5039667 - DNA, 21 bp, Homo sapiens
aaatgtaccatcaaatgttaa

SEQ ID NO: 5039668 - DNA, 21 bp, Homo sapiens
aaatgttaacagagtttgata

SEQ ID NO: 5039669 - DNA, 19 bp, Homo sapiens
aaattgaggttcagcaagg

SEQ ID NO: 5039670 - DNA, 19 bp, Homo sapiens
aacagaaaacattctgatt

SEQ ID NO: 5039671 - DNA, 12 bp, Homo sapiens
aacagagcaaga

SEQ ID NO: 5039672 - DNA, 16 bp, Homo sapiens
caggcaggcacctggg

SEQ ID NO: 5039673 - DNA, 16 bp, Homo sapiens
caggggtcaccttgag

SEQ ID NO: 5039674 - DNA, 16 bp, Homo sapiens
cagtaactttatgtgt

SEQ ID NO: 5039675 - DNA, 19 bp, Homo sapiens
cagtaactttatgtgtaaa

SEQ ID NO: 5039676 - DNA, 22 bp, Homo sapiens
cagtatctatatatgtgtatgt

SEQ ID NO: 5039677 - DNA, 16 bp, Homo sapiens
cagttcacctgcactt

SEQ ID NO: 5039678 - DNA, 15 bp, Homo sapiens
cataaggtttcgttt

SEQ ID NO: 5039679 - DNA, 15 bp, Homo sapiens
cataatgctactgtc

SEQ ID NO: 5039680 - DNA, 11 bp, Homo sapiens
catagccatac

SEQ ID NO: 5039681 - DNA, 15 bp, Homo sapiens
cataggaacatgtag

SEQ ID NO: 5039682 - DNA, 15 bp, Homo sapiens
catagtggtgcagag

SEQ ID NO: 5039683 - DNA, 20 bp, Homo sapiens
catatggagtgcctgtacaa

SEQ ID NO: 5039684 - DNA, 15 bp, Homo sapiens
catattttctccgaa

SEQ ID NO: 5039685 - DNA, 15 bp, Homo sapiens
catccaactccagga

SEQ ID NO: 5039686 - DNA, 15 bp, Homo sapiens
catcctcaaaagaaa

SEQ ID NO: 5039687 - DNA, 14 bp, Homo sapiens
catctataaattgt

SEQ ID NO: 5039688 - DNA, 22 bp, Homo sapiens
catcttactgtacctgttcctt

SEQ ID NO: 5039689 - DNA, 14 bp, Homo sapiens
catgacagctgttc

SEQ ID NO: 5039690 - DNA, 14 bp, Homo sapiens
catgagcttttata

SEQ ID NO: 5039691 - DNA, 18 bp, Homo sapiens
catgagtccttgaaaata

SEQ ID NO: 5039692 - DNA, 16 bp, Homo sapiens
cattctcactctgctt

SEQ ID NO: 5039693 - DNA, 18 bp, Homo sapiens
cattgagagttttgtctt

SEQ ID NO: 5039694 - DNA, 18 bp, Homo sapiens
cattttttaaggaaacaa

SEQ ID NO: 5039695 - DNA, 20 bp, Homo sapiens
ccaagtgcatttttatctgt

SEQ ID NO: 5039696 - DNA, 14 bp, Homo sapiens
ccaagtgtgaacaa

SEQ ID NO: 5039697 - DNA, 21 bp, Homo sapiens
ccaattgttgacagttctgaa

SEQ ID NO: 5039698 - DNA, 20 bp, Homo sapiens
ccacaggagtgggaaaacac

SEQ ID NO: 5039699 - DNA, 20 bp, Homo sapiens
ccactgcactccagcctggg

SEQ ID NO: 5039700 - DNA, 12 bp, Homo sapiens
ccactgtgtata

SEQ ID NO: 5039701 - DNA, 15 bp, Homo sapiens
ccaggcaggcacctg

SEQ ID NO: 5039702 - DNA, 18 bp, Homo sapiens
ccatagaagaacagcaga

SEQ ID NO: 5039703 - DNA, 14 bp, Homo sapiens
ccatagtagtatga

SEQ ID NO: 5039704 - DNA, 19 bp, Homo sapiens
ccatataagtttgaaggaa

SEQ ID NO: 5039705 - DNA, 22 bp, Homo sapiens
ccatataagtttgaaggaaaca

SEQ ID NO: 5039706 - DNA, 17 bp, Homo sapiens
ccatgagtccttgaaaa

SEQ ID NO: 5039707 - DNA, 15 bp, Homo sapiens
ccattgttcagaaga

SEQ ID NO: 5039708 - DNA, 11 bp, Homo sapiens
cccctccagga

SEQ ID NO: 5039709 - DNA, 17 bp, Homo sapiens
ccctagccagcacttgt

SEQ ID NO: 5039710 - DNA, 18 bp, Homo sapiens
ccctggaaattctgcctt

SEQ ID NO: 5039711 - DNA, 21 bp, Homo sapiens
cccttccaggggtcaccttga

SEQ ID NO: 5039712 - DNA, 22 bp, Homo sapiens
cctattgcaaaggttccaactg

SEQ ID NO: 5039713 - DNA, 12 bp, Homo sapiens
cctcaaaagaaa

SEQ ID NO: 5039714 - DNA, 15 bp, Homo sapiens
cctccctagccagca

SEQ ID NO: 5039715 - DNA, 14 bp, Homo sapiens
cctgctcctcagga

SEQ ID NO: 5039716 - DNA, 22 bp, Homo sapiens
cctggatattattcttgtagtt

SEQ ID NO: 5039717 - DNA, 16 bp, Homo sapiens
cctgggcaacagagca

SEQ ID NO: 5039718 - DNA, 12 bp, Homo sapiens
cctgggctttct

SEQ ID NO: 5039719 - DNA, 22 bp, Homo sapiens
cctggtttttaaatagagtttg

SEQ ID NO: 5039720 - DNA, 20 bp, Homo sapiens
cctgtgtgttgccaggcagg

SEQ ID NO: 5039721 - DNA, 21 bp, Homo sapiens
cctgtgtgttgccaggcaggc

SEQ ID NO: 5039722 - DNA, 14 bp, Homo sapiens
ccttcctcactgcc

SEQ ID NO: 5039723 - DNA, 15 bp, Homo sapiens
ccttgaaaatatttt

SEQ ID NO: 5039724 - DNA, 18 bp, Homo sapiens
ccttgtctctactaaaaa

SEQ ID NO: 5039725 - DNA, 19 bp, Homo sapiens
cctttagtacctgaaaagt

SEQ ID NO: 5039726 - DNA, 11 bp, Homo sapiens
cctttctgagt

SEQ ID NO: 5039727 - DNA, 13 bp, Homo sapiens
cctttgtgtttct

SEQ ID NO: 5039728 - DNA, 19 bp, Homo sapiens
ccttttggccgggcatggt

SEQ ID NO: 5039729 - DNA, 21 bp, Homo sapiens
cggaaggggacgctttgaagg

SEQ ID NO: 5039730 - DNA, 15 bp, Homo sapiens
cggtgatcagcagag

SEQ ID NO: 5039731 - DNA, 14 bp, Homo sapiens
cggtttcagaagct

SEQ ID NO: 5039732 - DNA, 22 bp, Homo sapiens
cgtagcttctaccatgaacaga

SEQ ID NO: 5039733 - DNA, 21 bp, Homo sapiens
cgtgttttattcctgtatgtt

SEQ ID NO: 5039734 - DNA, 21 bp, Homo sapiens
ctaactctagtttgcagagga

SEQ ID NO: 5039735 - DNA, 20 bp, Homo sapiens
ctactgtctcactgaaacat

SEQ ID NO: 5039736 - DNA, 18 bp, Homo sapiens
ctagggttccactggaga

SEQ ID NO: 5039737 - DNA, 19 bp, Homo sapiens
ctagggttccactggagaa

SEQ ID NO: 5039738 - DNA, 21 bp, Homo sapiens
ctagtaaagacataggaacat

SEQ ID NO: 5039739 - DNA, 21 bp, Homo sapiens
ctagtatttcatgctgggaat

SEQ ID NO: 5039740 - DNA, 13 bp, Homo sapiens
ctatcccttctca

SEQ ID NO: 5039741 - DNA, 15 bp, Homo sapiens
ctatgggagcctcag

SEQ ID NO: 5039742 - DNA, 22 bp, Homo sapiens
ctatgtatttgcagttcacctg

SEQ ID NO: 5039743 - DNA, 13 bp, Homo sapiens
ctattgacttcaa

SEQ ID NO: 5039744 - DNA, 22 bp, Homo sapiens
ctattgcaaaggttccaactgt

SEQ ID NO: 5039745 - DNA, 21 bp, Homo sapiens
ctcaaaatgatatgtttgagt

SEQ ID NO: 5039746 - DNA, 19 bp, Homo sapiens
ctcaggaccaaagaacact

SEQ ID NO: 5039747 - DNA, 18 bp, Homo sapiens
ctcatcacatttgtaaat

SEQ ID NO: 5039748 - DNA, 13 bp, Homo sapiens
ctcatcttactgt

SEQ ID NO: 5039749 - DNA, 16 bp, Homo sapiens
ctccctgtgagagagt

SEQ ID NO: 5039750 - DNA, 16 bp, Homo sapiens
ctcctggaatggagct

SEQ ID NO: 5039751 - DNA, 17 bp, Homo sapiens
ctctcctgctcctcagg

SEQ ID NO: 5039752 - DNA, 19 bp, Homo sapiens
ctctcgcacctttccaaag

SEQ ID NO: 5039753 - DNA, 11 bp, Homo sapiens
ctcttctgagc

SEQ ID NO: 5039754 - DNA, 13 bp, Homo sapiens
ctctttaaaaaca

SEQ ID NO: 5039755 - DNA, 15 bp, Homo sapiens
ctgaaaaattccttt

SEQ ID NO: 5039756 - DNA, 14 bp, Homo sapiens
ctgaataaatggta

SEQ ID NO: 5039757 - DNA, 14 bp, Homo sapiens
ctgacatggagttc

SEQ ID NO: 5039758 - DNA, 21 bp, Homo sapiens
ctgagtccaagagggtccttt

SEQ ID NO: 5039759 - DNA, 18 bp, Homo sapiens
ctgatgttttgtattttg

SEQ ID NO: 5039760 - DNA, 20 bp, Homo sapiens
ctggagaattgaaaaggact

SEQ ID NO: 5039761 - DNA, 16 bp, Homo sapiens
ctgtccccttccaggg

SEQ ID NO: 5039762 - DNA, 12 bp, Homo sapiens
ctgtctagagta

SEQ ID NO: 5039763 - DNA, 22 bp, Homo sapiens
ctgtgagagagttgctcctcag

SEQ ID NO: 5039764 - DNA, 20 bp, Homo sapiens
ctgtggccgttatctggaag

SEQ ID NO: 5039765 - DNA, 21 bp, Homo sapiens
ctgtggccgttatctggaagt

SEQ ID NO: 5039766 - DNA, 15 bp, Homo sapiens
ctgttccttagacct

SEQ ID NO: 5039767 - DNA, 22 bp, Homo sapiens
cttagtttggattcttatgtag

SEQ ID NO: 5039768 - DNA, 15 bp, Homo sapiens
cttattgtagcatat

SEQ ID NO: 5039769 - DNA, 17 bp, Homo sapiens
cttcaggggcacttcat

SEQ ID NO: 5039770 - DNA, 14 bp, Homo sapiens
cttcattgagagtt

SEQ ID NO: 5039771 - DNA, 21 bp, Homo sapiens
cttccaggggtcaccttgaga

SEQ ID NO: 5039772 - DNA, 18 bp, Homo sapiens
cttccataatgctactgt

SEQ ID NO: 5039773 - DNA, 22 bp, Homo sapiens
cttccataatgctactgtctca

SEQ ID NO: 5039774 - DNA, 17 bp, Homo sapiens
cttctaccatgaacaga

SEQ ID NO: 5039775 - DNA, 23 bp, Homo sapiens
cttgaaaatattttttatatata

SEQ ID NO: 5039776 - DNA, 14 bp, Homo sapiens
cttgaacccgggag

SEQ ID NO: 5039777 - DNA, 20 bp, Homo sapiens
cttgagaggcatgacagctg

SEQ ID NO: 5039778 - DNA, 15 bp, Homo sapiens
cttgcatccaactcc

SEQ ID NO: 5039779 - DNA, 21 bp, Homo sapiens
cttgtagtttacctctttaaa

SEQ ID NO: 5039780 - DNA, 15 bp, Homo sapiens
ctttccaaggcttct

SEQ ID NO: 5039781 - DNA, 13 bp, Homo sapiens
ctttctctttggt

SEQ ID NO: 5039782 - DNA, 18 bp, Homo sapiens
ctttgcatgatctgtcaa

SEQ ID NO: 5039783 - DNA, 19 bp, Homo sapiens
ctttgcatgatctgtcaaa

SEQ ID NO: 5039784 - DNA, 15 bp, Homo sapiens
ctttgtctgaaaaat

SEQ ID NO: 5039785 - DNA, 20 bp, Homo sapiens
cttttcacatagctgtctag

SEQ ID NO: 5039786 - DNA, 22 bp, Homo sapiens
cttttggccgggcatggtagct

SEQ ID NO: 5039787 - DNA, 17 bp, Homo sapiens
gaaaccattgttcagaa

SEQ ID NO: 5039788 - DNA, 13 bp, Homo sapiens
gaaatatttttga

SEQ ID NO: 5039789 - DNA, 15 bp, Homo sapiens
gaaatctagtatttc

SEQ ID NO: 5039790 - DNA, 20 bp, Homo sapiens
gaaatgtaccatcaaatgtt

SEQ ID NO: 5039791 - DNA, 15 bp, Homo sapiens
gaaccagtgtctgaa

SEQ ID NO: 5039792 - DNA, 18 bp, Homo sapiens
gaaccagtgtctgaacca

SEQ ID NO: 5039793 - DNA, 16 bp, Homo sapiens
gaactttgaggaggaa

SEQ ID NO: 5039794 - DNA, 13 bp, Homo sapiens
gaagaacagcaga

SEQ ID NO: 5039795 - DNA, 18 bp, Homo sapiens
gaagctgcagctggtctg

SEQ ID NO: 5039796 - DNA, 18 bp, Homo sapiens
gaatattcccaagcccat

SEQ ID NO: 5039797 - DNA, 16 bp, Homo sapiens
gaatcagacctgggtg

SEQ ID NO: 5039798 - DNA, 14 bp, Homo sapiens
gacagctgttccac

SEQ ID NO: 5039799 - DNA, 14 bp, Homo sapiens
gaccagtctggcca

SEQ ID NO: 5039800 - DNA, 17 bp, Homo sapiens
gacctccctgtgagaga

SEQ ID NO: 5039801 - DNA, 14 bp, Homo sapiens
gactacatttagag

SEQ ID NO: 5039802 - DNA, 15 bp, Homo sapiens
gagaactgtggccgt

SEQ ID NO: 5039803 - DNA, 15 bp, Homo sapiens
tttgatgctgtttga

SEQ ID NO: 5039804 - DNA, 21 bp, Homo sapiens
tttgcatcccccaaacttctt

SEQ ID NO: 5039805 - DNA, 13 bp, Homo sapiens
tttgtatgtgtgt

SEQ ID NO: 5039806 - DNA, 17 bp, Homo sapiens
tttgtcatcagccacca

SEQ ID NO: 5039807 - DNA, 14 bp, Homo sapiens
tttgtctgaaaaat

SEQ ID NO: 5039808 - DNA, 16 bp, Homo sapiens
tttgtcttgaatgtct

SEQ ID NO: 5039809 - DNA, 15 bp, Homo sapiens
tttgtgtgttgtctt

SEQ ID NO: 5039810 - DNA, 17 bp, Homo sapiens
tttgtgtgttgtcttga

SEQ ID NO: 5039811 - DNA, 12 bp, Homo sapiens
ttttaaggaaac

SEQ ID NO: 5039812 - DNA, 15 bp, Homo sapiens
ttttatatatacagt

SEQ ID NO: 5039813 - DNA, 19 bp, Homo sapiens
ttttggggttgtgttgtca

SEQ ID NO: 5039814 - DNA, 12 bp, Homo sapiens
ttttgtcttgaa

SEQ ID NO: 5039815 - DNA, 17 bp, Homo sapiens
ttccaggtcagaaacca

SEQ ID NO: 5039816 - DNA, 21 bp, Homo sapiens
ttcccaagagtggtggcagct

SEQ ID NO: 5039817 - DNA, 15 bp, Homo sapiens
ttcctctttgcatga

SEQ ID NO: 5039818 - DNA, 20 bp, Homo sapiens
ttctaactctagtttgcaga

SEQ ID NO: 5039819 - DNA, 17 bp, Homo sapiens
ttctacatttcttagac

SEQ ID NO: 5039820 - DNA, 22 bp, Homo sapiens
ttctccagaaccagtgtctgaa

SEQ ID NO: 5039821 - DNA, 21 bp, Homo sapiens
ttctccgaaaggcaaaaatgt

SEQ ID NO: 5039822 - DNA, 21 bp, Homo sapiens
ttctgtatacaaccctggcat

SEQ ID NO: 5039823 - DNA, 19 bp, Homo sapiens
ttctgttgtgtttgtcaaa

SEQ ID NO: 5039824 - DNA, 11 bp, Homo sapiens
ttgaaatgtac

SEQ ID NO: 5039825 - DNA, 14 bp, Homo sapiens
ttgaaggaaacagt

SEQ ID NO: 5039826 - DNA, 12 bp, Homo sapiens
ttgaatgtcttt

SEQ ID NO: 5039827 - DNA, 18 bp, Homo sapiens
ttgacagttctgaagaat

SEQ ID NO: 5039828 - DNA, 17 bp, Homo sapiens
ttgagaggcatgacagc

SEQ ID NO: 5039829 - DNA, 18 bp, Homo sapiens
ttgagaggcatgacagct

SEQ ID NO: 5039830 - DNA, 22 bp, Homo sapiens
ttgagccctcctggaatggagc

SEQ ID NO: 5039831 - DNA, 16 bp, Homo sapiens
ttgatatgggctttct

SEQ ID NO: 5039832 - DNA, 17 bp, Homo sapiens
ttgctgtccccttccag

SEQ ID NO: 5039833 - DNA, 15 bp, Homo sapiens
ttggattcttatgta

SEQ ID NO: 5039834 - DNA, 17 bp, Homo sapiens
ttgtagtttacctcttt

SEQ ID NO: 5039835 - DNA, 13 bp, Homo sapiens
ttgtcttgaaaga

SEQ ID NO: 5039836 - DNA, 13 bp, Homo sapiens
ttgtgtgttgtct

SEQ ID NO: 5039837 - DNA, 22 bp, Homo sapiens
tttaaattttaccctttagact

SEQ ID NO: 5039838 - DNA, 17 bp, Homo sapiens
tttcagaagctgcagct

SEQ ID NO: 5039839 - DNA, 13 bp, Homo sapiens
tttcattattagt

SEQ ID NO: 5039840 - DNA, 15 bp, Homo sapiens
tttctacctttctga

SEQ ID NO: 5039841 - DNA, 13 bp, Homo sapiens
tttcttactcaaa

SEQ ID NO: 5039842 - DNA, 13 bp, Homo sapiens
tttctttcaactt

SEQ ID NO: 5039843 - DNA, 13 bp, Homo sapiens
tttgaaggaaaca

SEQ ID NO: 5039844 - DNA, 23 bp, Homo sapiens
tttgcatcccccaaacttcttgt

SEQ ID NO: 5039845 - DNA, 22 bp, Homo sapiens
tttggctattaaaaaagtggtg

SEQ ID NO: 5039846 - DNA, 14 bp, Homo sapiens
tttggcttccatga

SEQ ID NO: 5039847 - DNA, 18 bp, Homo sapiens
tttgtgtgttgtcttgaa

SEQ ID NO: 5039848 - DNA, 19 bp, Homo sapiens
tttgtgtgttgtcttgaaa

SEQ ID NO: 5039849 - DNA, 20 bp, Homo sapiens
ttttagctgatgaacttatt

SEQ ID NO: 5039850 - DNA, 21 bp, Homo sapiens
ttttagctgatgaacttattc

SEQ ID NO: 5039851 - DNA, 15 bp, Homo sapiens
ttttattcctgtatg

SEQ ID NO: 5039852 - DNA, 18 bp, Homo sapiens
ttttattcctgtatgttg

SEQ ID NO: 5039853 - DNA, 13 bp, Homo sapiens
ttttgtcttgaat

SEQ ID NO: 5039854 - DNA, 17 bp, Homo sapiens
ttttgtgttcctctttg

SEQ ID NO: 5039855 - DNA, 12 bp, Homo sapiens
tttttgtcatca

SEQ ID NO: 5039856 - DNA, 18 bp, Homo sapiens
agctgttccacaggggct

SEQ ID NO: 5039857 - DNA, 17 bp, Homo sapiens
agcttctaccatgaaca

SEQ ID NO: 5039858 - DNA, 18 bp, Homo sapiens
agcttctaccatgaacag

SEQ ID NO: 5039859 - DNA, 13 bp, Homo sapiens
agctttctccaga

SEQ ID NO: 5039860 - DNA, 15 bp, Homo sapiens
aggaggaagcagaat

SEQ ID NO: 5039861 - DNA, 14 bp, Homo sapiens
aggatttacttttt

SEQ ID NO: 5039862 - DNA, 13 bp, Homo sapiens
aggcaaatgtgta

SEQ ID NO: 5039863 - DNA, 13 bp, Homo sapiens
aggcaggcacctg

SEQ ID NO: 5039864 - DNA, 20 bp, Homo sapiens
aggcatcagtccctatgtat

SEQ ID NO: 5039865 - DNA, 14 bp, Homo sapiens
aggcatgtcctgga

SEQ ID NO: 5039866 - DNA, 15 bp, Homo sapiens
aggccaggagttcaa

SEQ ID NO: 5039867 - DNA, 15 bp, Homo sapiens
aggcctccctagcca

SEQ ID NO: 5039868 - DNA, 19 bp, Homo sapiens
aggggacgctttgaaggaa

SEQ ID NO: 5039869 - DNA, 15 bp, Homo sapiens
aggggctatcccttc

SEQ ID NO: 5039870 - DNA, 17 bp, Homo sapiens
aggggtcaccttgagag

SEQ ID NO: 5039871 - DNA, 16 bp, Homo sapiens
agggtaattttctaac

SEQ ID NO: 5039872 - DNA, 18 bp, Homo sapiens
aggtacccaaggtcacat

SEQ ID NO: 5039873 - DNA, 14 bp, Homo sapiens
aggtatgttgcctt

SEQ ID NO: 5039874 - DNA, 17 bp, Homo sapiens
aggttgccgtgagccaa

SEQ ID NO: 5039875 - DNA, 14 bp, Homo sapiens
agtaacttggcttt

SEQ ID NO: 5039876 - DNA, 16 bp, Homo sapiens
agtaactttatgtgta

SEQ ID NO: 5039877 - DNA, 20 bp, Homo sapiens
agtaactttatgtgtaaata

SEQ ID NO: 5039878 - DNA, 15 bp, Homo sapiens
agtacctgaaaagta

SEQ ID NO: 5039879 - DNA, 17 bp, Homo sapiens
agtactgctcttgtttc

SEQ ID NO: 5039880 - DNA, 18 bp, Homo sapiens
agtatctatatatgtgta

SEQ ID NO: 5039881 - DNA, 19 bp, Homo sapiens
agtatctatatatgtgtat

SEQ ID NO: 5039882 - DNA, 22 bp, Homo sapiens
agtatctatatatgtgtatgta

SEQ ID NO: 5039883 - DNA, 16 bp, Homo sapiens
agtcattgtaatcttt

SEQ ID NO: 5039884 - DNA, 19 bp, Homo sapiens
agtccaagagggtccttta

SEQ ID NO: 5039885 - DNA, 14 bp, Homo sapiens
agtccttgaaaata

SEQ ID NO: 5039886 - DNA, 17 bp, Homo sapiens
agtccttgaaaatattt

SEQ ID NO: 5039887 - DNA, 20 bp, Homo sapiens
agtgcatttttatctgtgag

SEQ ID NO: 5039888 - DNA, 14 bp, Homo sapiens
agtggtggcagctc

SEQ ID NO: 5039889 - DNA, 15 bp, Homo sapiens
agttatagatgtcta

SEQ ID NO: 5039890 - DNA, 15 bp, Homo sapiens
agtttgaaggaaaca

SEQ ID NO: 5039891 - DNA, 20 bp, Homo sapiens
agtttgatatgggctttctc

SEQ ID NO: 5039892 - DNA, 13 bp, Homo sapiens
agtttgcagagga

SEQ ID NO: 5039893 - DNA, 18 bp, Homo sapiens
agtttgtgtgttgtcttg

SEQ ID NO: 5039894 - DNA, 20 bp, Homo sapiens
agtttgtgtgttgtcttgaa

SEQ ID NO: 5039895 - DNA, 13 bp, Homo sapiens
agttttgtcttga

SEQ ID NO: 5039896 - DNA, 14 bp, Homo sapiens
agttttgtcttgaa

SEQ ID NO: 5039897 - DNA, 23 bp, Homo sapiens
ataaccacaaagcacagtttgaa

SEQ ID NO: 5039898 - DNA, 21 bp, Homo sapiens
atacataagcggcgtaagttt

SEQ ID NO: 5039899 - DNA, 16 bp, Homo sapiens
atagaagaacagcaga

SEQ ID NO: 5039900 - DNA, 20 bp, Homo sapiens
atagtgggcaccccactgca

SEQ ID NO: 5039901 - DNA, 23 bp, Homo sapiens
atataaaaggcaaatgtgtacat

SEQ ID NO: 5039902 - DNA, 14 bp, Homo sapiens
atataagtttgaag

SEQ ID NO: 5039903 - DNA, 19 bp, Homo sapiens
atataagtttgaaggaaac

SEQ ID NO: 5039904 - DNA, 21 bp, Homo sapiens
atatatacagtaactttatgt

SEQ ID NO: 5039905 - DNA, 18 bp, Homo sapiens
atatgatgtttaaaagca

SEQ ID NO: 5039906 - DNA, 19 bp, Homo sapiens
atatgggctttctctttgg

SEQ ID NO: 5039907 - DNA, 17 bp, Homo sapiens
atcccggtttcagaagc

SEQ ID NO: 5039908 - DNA, 20 bp, Homo sapiens
atctcttcttttggcttcca

SEQ ID NO: 5039909 - DNA, 14 bp, Homo sapiens
atgacagctgttcc

SEQ ID NO: 5039910 - DNA, 16 bp, Homo sapiens
atgagtccttgaaaat

SEQ ID NO: 5039911 - DNA, 14 bp, Homo sapiens
atgctactgtctca

SEQ ID NO: 5039912 - DNA, 13 bp, Homo sapiens
atgctcttctgtg

SEQ ID NO: 5039913 - DNA, 23 bp, Homo sapiens
atggagctgtataactgtgcaga

SEQ ID NO: 5039914 - DNA, 17 bp, Homo sapiens
atggatttgatgctgtt

SEQ ID NO: 5039915 - DNA, 20 bp, Homo sapiens
atggcggtgatcagcagaga

SEQ ID NO: 5039916 - DNA, 16 bp, Homo sapiens
atgtccactgtgtata

SEQ ID NO: 5039917 - DNA, 18 bp, Homo sapiens
atgtcttttcaaaaggat

SEQ ID NO: 5039918 - DNA, 16 bp, Homo sapiens
atgtcttttgaatatt

SEQ ID NO: 5039919 - DNA, 20 bp, Homo sapiens
atgtgatttatttatttcta

SEQ ID NO: 5039920 - DNA, 22 bp, Homo sapiens
atgtgtacatggcagagtttgt

SEQ ID NO: 5039921 - DNA, 19 bp, Homo sapiens
atgtgtgtagacaaatatt

SEQ ID NO: 5039922 - DNA, 14 bp, Homo sapiens
attagagcattgaa

SEQ ID NO: 5039923 - DNA, 17 bp, Homo sapiens
attcaggtatgttgcct

SEQ ID NO: 5039924 - DNA, 18 bp, Homo sapiens
attcctttgtgtttctat

SEQ ID NO: 5039925 - DNA, 16 bp, Homo sapiens
attctcactctgcttt

SEQ ID NO: 5039926 - DNA, 18 bp, Homo sapiens
attctgcccaaaaatatg

SEQ ID NO: 5039927 - DNA, 17 bp, Homo sapiens
attctgtagattctgtg

SEQ ID NO: 5039928 - DNA, 20 bp, Homo sapiens
attgacaactgaagagacac

SEQ ID NO: 5039929 - DNA, 14 bp, Homo sapiens
attgacttcaatga

SEQ ID NO: 5039930 - DNA, 14 bp, Homo sapiens
attgagagttttgt

SEQ ID NO: 5039931 - DNA, 21 bp, Homo sapiens
attgtaatctttcatagccat

SEQ ID NO: 5039932 - DNA, 22 bp, Homo sapiens
attgtactcaatggatttgatg

SEQ ID NO: 5039933 - DNA, 13 bp, Homo sapiens
attgttcagaaga

SEQ ID NO: 5039934 - DNA, 22 bp, Homo sapiens
attgttgacagttctgaagaat

SEQ ID NO: 5039935 - DNA, 19 bp, Homo sapiens
attgttgtttgccatactt

SEQ ID NO: 5039936 - DNA, 16 bp, Homo sapiens
caaagcacagtttgaa

SEQ ID NO: 5039937 - DNA, 15 bp, Homo sapiens
caactgaagagacac

SEQ ID NO: 5039938 - DNA, 22 bp, Homo sapiens
caacttgcatccaactccagga

SEQ ID NO: 5039939 - DNA, 14 bp, Homo sapiens
caagactctgtctc

SEQ ID NO: 5039940 - DNA, 18 bp, Homo sapiens
caagagtggtggcagctc

SEQ ID NO: 5039941 - DNA, 20 bp, Homo sapiens
caagtgattgacaactgaag

SEQ ID NO: 5039942 - DNA, 14 bp, Homo sapiens
caagtgtgaacaaa

SEQ ID NO: 5039943 - DNA, 19 bp, Homo sapiens
caatagcaacgtagcttct

SEQ ID NO: 5039944 - DNA, 17 bp, Homo sapiens
caatcctgtctttctga

SEQ ID NO: 5039945 - DNA, 20 bp, Homo sapiens
caatgatagtaagaaaagtg

SEQ ID NO: 5039946 - DNA, 17 bp, Homo sapiens
caatggatttgatgctg

SEQ ID NO: 5039947 - DNA, 21 bp, Homo sapiens
caattgttgacagttctgaag

SEQ ID NO: 5039948 - DNA, 12 bp, Homo sapiens
cacaggagggta

SEQ ID NO: 5039949 - DNA, 12 bp, Homo sapiens
cacagttggcct

SEQ ID NO: 5039950 - DNA, 12 bp, Homo sapiens
cacagtttgaac

SEQ ID NO: 5039951 - DNA, 21 bp, Homo sapiens
cacatagctagttatgtgaga

SEQ ID NO: 5039952 - DNA, 13 bp, Homo sapiens
caccatagaagaa

SEQ ID NO: 5039953 - DNA, 20 bp, Homo sapiens
caccatagaagaacagcaga

SEQ ID NO: 5039954 - DNA, 19 bp, Homo sapiens
cacccaagagattgttgtt

SEQ ID NO: 5039955 - DNA, 22 bp, Homo sapiens
caccccactgcaatcctgtctt

SEQ ID NO: 5039956 - DNA, 17 bp, Homo sapiens
cacctgggctttctgga

SEQ ID NO: 5039957 - DNA, 20 bp, Homo sapiens
cacggtattcccaagagtgg

SEQ ID NO: 5039958 - DNA, 15 bp, Homo sapiens
cactctgctttgcat

SEQ ID NO: 5039959 - DNA, 20 bp, Homo sapiens
cactctgttatttagactca

SEQ ID NO: 5039960 - DNA, 20 bp, Homo sapiens
cactgccatcttagtttgga

SEQ ID NO: 5039961 - DNA, 22 bp, Homo sapiens
cactgccatcttagtttggatt

SEQ ID NO: 5039962 - DNA, 18 bp, Homo sapiens
cagaacatcattagaaca

SEQ ID NO: 5039963 - DNA, 20 bp, Homo sapiens
cagaaccagtgtctgaacca

SEQ ID NO: 5039964 - DNA, 22 bp, Homo sapiens
cagacaagtggctaagtgtcca

SEQ ID NO: 5039965 - DNA, 17 bp, Homo sapiens
cagagtttgtgtgttgt

SEQ ID NO: 5039966 - DNA, 22 bp, Homo sapiens
cagagtttgtgtgttgtcttga

SEQ ID NO: 5039967 - DNA, 23 bp, Homo sapiens
cagattttggggttgtgttgtca

SEQ ID NO: 5039968 - DNA, 14 bp, Homo sapiens
cagctggtctgttt

SEQ ID NO: 5039969 - DNA, 14 bp, Homo sapiens
caggcaggcacctg

SEQ ID NO: 5039970 - DNA, 15 bp, Homo sapiens
caggcaggcacctgg

SEQ ID NO: 5039971 - DNA, 23 bp, Homo sapiens
caggggctatcccttctcagaaa

SEQ ID NO: 5039972 - DNA, 15 bp, Homo sapiens
cagggtccctcagga

SEQ ID NO: 5039973 - DNA, 14 bp, Homo sapiens
caggtatgttgcct

SEQ ID NO: 5039974 - DNA, 15 bp, Homo sapiens
caggtatgttgcctt

SEQ ID NO: 5039975 - DNA, 18 bp, Homo sapiens
taagtttgaaggaaacag

SEQ ID NO: 5039976 - DNA, 15 bp, Homo sapiens
taatgctactgtctc

SEQ ID NO: 5039977 - DNA, 16 bp, Homo sapiens
tacatggcagagtttg

SEQ ID NO: 5039978 - DNA, 20 bp, Homo sapiens
taccctttagactgtagcct

SEQ ID NO: 5039979 - DNA, 19 bp, Homo sapiens
tacttcaggggcacttcat

SEQ ID NO: 5039980 - DNA, 18 bp, Homo sapiens
tactttttgtaaaaagct

SEQ ID NO: 5039981 - DNA, 15 bp, Homo sapiens
tagaagaacagcaga

SEQ ID NO: 5039982 - DNA, 18 bp, Homo sapiens
tagactcatcttactgta

SEQ ID NO: 5039983 - DNA, 19 bp, Homo sapiens
tagactcatcttactgtac

SEQ ID NO: 5039984 - DNA, 16 bp, Homo sapiens
tagagaactgtggccg

SEQ ID NO: 5039985 - DNA, 22 bp, Homo sapiens
tagcctggatattattcttgta

SEQ ID NO: 5039986 - DNA, 18 bp, Homo sapiens
tagctagttatgtgagaa

SEQ ID NO: 5039987 - DNA, 20 bp, Homo sapiens
tagctagttatgtgagaaag

SEQ ID NO: 5039988 - DNA, 23 bp, Homo sapiens
tagctgatgaacttattctgtag

SEQ ID NO: 5039989 - DNA, 15 bp, Homo sapiens
tagctgtctagagta

SEQ ID NO: 5039990 - DNA, 16 bp, Homo sapiens
tagcttaccagaagct

SEQ ID NO: 5039991 - DNA, 21 bp, Homo sapiens
tagcttctaccatgaacagaa

SEQ ID NO: 5039992 - DNA, 11 bp, Homo sapiens
taggagacttt

SEQ ID NO: 5039993 - DNA, 20 bp, Homo sapiens
taggccatgaaaaaaatgat

SEQ ID NO: 5039994 - DNA, 15 bp, Homo sapiens
tagtacctgaaaagt

SEQ ID NO: 5039995 - DNA, 18 bp, Homo sapiens
tagtagtatgatgataca

SEQ ID NO: 5039996 - DNA, 22 bp, Homo sapiens
tagtttacctgaataaatggta

SEQ ID NO: 5039997 - DNA, 11 bp, Homo sapiens
tagtttggatt

SEQ ID NO: 5039998 - DNA, 20 bp, Homo sapiens
tataaaaggcaaatgtgtac

SEQ ID NO: 5039999 - DNA, 12 bp, Homo sapiens
tatagatgtcta

SEQ ID NO: 5040000 - DNA, 22 bp, Homo sapiens
tatatacagtaactttatgtgt

SEQ ID NO: 5040001 - DNA, 23 bp, Homo sapiens
tatatacagtaactttatgtgta

SEQ ID NO: 5040002 - DNA, 12 bp, Homo sapiens
tatatatgtgta

SEQ ID NO: 5040003 - DNA, 15 bp, Homo sapiens
tatcccttctcagaa

SEQ ID NO: 5040004 - DNA, 22 bp, Homo sapiens
tatctatatatgtgtatgtacg

SEQ ID NO: 5040005 - DNA, 15 bp, Homo sapiens
aaaaagtcattgtaa

SEQ ID NO: 5040006 - DNA, 18 bp, Homo sapiens
aaaacagaacatcattag

SEQ ID NO: 5040007 - DNA, 20 bp, Homo sapiens
aaaacctaagtcctttatgt

SEQ ID NO: 5040008 - DNA, 14 bp, Homo sapiens
aaaaggactcttga

SEQ ID NO: 5040009 - DNA, 13 bp, Homo sapiens
aaacagaacatca

SEQ ID NO: 5040010 - DNA, 22 bp, Homo sapiens
aaagagcacttcacacagacaa

SEQ ID NO: 5040011 - DNA, 17 bp, Homo sapiens
aaagcacagtttgaaca

SEQ ID NO: 5040012 - DNA, 19 bp, Homo sapiens
aaaggacagagtatgaaca

SEQ ID NO: 5040013 - DNA, 16 bp, Homo sapiens
aaaggcaaatgtgtac

SEQ ID NO: 5040014 - DNA, 20 bp, Homo sapiens
aaagtggtggcaaaagacat

SEQ ID NO: 5040015 - DNA, 14 bp, Homo sapiens
aaagtggttgttag

SEQ ID NO: 5040016 - DNA, 22 bp, Homo sapiens
aaagttactgattcactgcatg

SEQ ID NO: 5040017 - DNA, 22 bp, Homo sapiens
aaatctagtatttcatgctggg

SEQ ID NO: 5040018 - DNA, 22 bp, Homo sapiens
aaatgatccccaagtgtgaaca

SEQ ID NO: 5040019 - DNA, 13 bp, Homo sapiens
aaattaaaagaag

SEQ ID NO: 5040020 - DNA, 23 bp, Homo sapiens
aaattgtccgtgttcatacattt

SEQ ID NO: 5040021 - DNA, 18 bp, Homo sapiens
aacactcgaaaagagcac

SEQ ID NO: 5040022 - DNA, 14 bp, Homo sapiens
aacagaaaacattc

SEQ ID NO: 5040023 - DNA, 14 bp, Homo sapiens
aacatcattagaac

SEQ ID NO: 5040024 - DNA, 16 bp, Homo sapiens
aaccagtgtctgaacc

SEQ ID NO: 5040025 - DNA, 14 bp, Homo sapiens
aactgtatatattc

SEQ ID NO: 5040026 - DNA, 13 bp, Homo sapiens
aacttattctgta

SEQ ID NO: 5040027 - DNA, 14 bp, Homo sapiens
aacttattctgtag

SEQ ID NO: 5040028 - DNA, 12 bp, Homo sapiens
aagaacagcaga

SEQ ID NO: 5040029 - DNA, 17 bp, Homo sapiens
aagactctgtctcaaaa

SEQ ID NO: 5040030 - DNA, 17 bp, Homo sapiens
aagagattgttgtttgc

SEQ ID NO: 5040031 - DNA, 22 bp, Homo sapiens
aagatcacgccactgcactcca

SEQ ID NO: 5040032 - DNA, 11 bp, Homo sapiens
aagattagaag

SEQ ID NO: 5040033 - DNA, 13 bp, Homo sapiens
aagattagaagct

SEQ ID NO: 5040034 - DNA, 15 bp, Homo sapiens
aagattcaggtatgt

SEQ ID NO: 5040035 - DNA, 20 bp, Homo sapiens
aagcccatgagtccttgaaa

SEQ ID NO: 5040036 - DNA, 18 bp, Homo sapiens
aaggttccaactgtatat

SEQ ID NO: 5040037 - DNA, 22 bp, Homo sapiens
aataccattttttaaggaaaca

SEQ ID NO: 5040038 - DNA, 22 bp, Homo sapiens
aatagagtttgctattagagca

SEQ ID NO: 5040039 - DNA, 22 bp, Homo sapiens
aatataaaaggcaaatgtgtac

SEQ ID NO: 5040040 - DNA, 18 bp, Homo sapiens
aatcccggtttcagaagc

SEQ ID NO: 5040041 - DNA, 15 bp, Homo sapiens
aattatctgggcatg

SEQ ID NO: 5040042 - DNA, 20 bp, Homo sapiens
aattgttgacagttctgaag

SEQ ID NO: 5040043 - DNA, 17 bp, Homo sapiens
aattttaccctttagac

SEQ ID NO: 5040044 - DNA, 15 bp, Homo sapiens
acaaaaaactcccct

SEQ ID NO: 5040045 - DNA, 17 bp, Homo sapiens
acacctgggcttaagaa

SEQ ID NO: 5040046 - DNA, 20 bp, Homo sapiens
acagattttggggttgtgtt

SEQ ID NO: 5040047 - DNA, 20 bp, Homo sapiens
acaggggctatcccttctca

SEQ ID NO: 5040048 - DNA, 16 bp, Homo sapiens
acagtaactttatgtg

SEQ ID NO: 5040049 - DNA, 18 bp, Homo sapiens
acagtaactttatgtgta

SEQ ID NO: 5040050 - DNA, 13 bp, Homo sapiens
acagttctgaaga

SEQ ID NO: 5040051 - DNA, 15 bp, Homo sapiens
acagttctgaagaat

SEQ ID NO: 5040052 - DNA, 16 bp, Homo sapiens
acatcctcaaaagaaa

SEQ ID NO: 5040053 - DNA, 14 bp, Homo sapiens
acatggagttcccg

SEQ ID NO: 5040054 - DNA, 23 bp, Homo sapiens
acatttaaattttaccctttaga

SEQ ID NO: 5040055 - DNA, 23 bp, Homo sapiens
acatttcttagactacatttaga

SEQ ID NO: 5040056 - DNA, 16 bp, Homo sapiens
accagtgtctgaacca

SEQ ID NO: 5040057 - DNA, 18 bp, Homo sapiens
accatgaacagaaaacat

SEQ ID NO: 5040058 - DNA, 16 bp, Homo sapiens
accattgttcagaaga

SEQ ID NO: 5040059 - DNA, 20 bp, Homo sapiens
accattttttaaggaaacaa

SEQ ID NO: 5040060 - DNA, 22 bp, Homo sapiens
accattttttaaggaaacaata

SEQ ID NO: 5040061 - DNA, 15 bp, Homo sapiens
accctggcattatgt

SEQ ID NO: 5040062 - DNA, 14 bp, Homo sapiens
acctccctgtgaga

SEQ ID NO: 5040063 - DNA, 22 bp, Homo sapiens
acctgcctaaaatatgatgttt

SEQ ID NO: 5040064 - DNA, 23 bp, Homo sapiens
acctttccaaagttaacagattt

SEQ ID NO: 5040065 - DNA, 24 bp, Homo sapiens
acgtagcttctaccatgaacagaa

SEQ ID NO: 5040066 - DNA, 22 bp, Homo sapiens
acgtgttttattcctgtatgtt

SEQ ID NO: 5040067 - DNA, 20 bp, Homo sapiens
actaagaagatgttttgaaa

SEQ ID NO: 5040068 - DNA, 15 bp, Homo sapiens
actccagcctgggca

SEQ ID NO: 5040069 - DNA, 15 bp, Homo sapiens
actcgaaaagagcac

SEQ ID NO: 5040070 - DNA, 13 bp, Homo sapiens
actctgtctcaaa

SEQ ID NO: 5040071 - DNA, 15 bp, Homo sapiens
actctgttatttaga

SEQ ID NO: 5040072 - DNA, 20 bp, Homo sapiens
actgcactccagcctgggca

SEQ ID NO: 5040073 - DNA, 15 bp, Homo sapiens
actgctcttgtttct

SEQ ID NO: 5040074 - DNA, 18 bp, Homo sapiens
actgctcttgtttctttt

SEQ ID NO: 5040075 - DNA, 13 bp, Homo sapiens
actggagttctat

SEQ ID NO: 5040076 - DNA, 19 bp, Homo sapiens
actgggttcaaaaagaaaa

SEQ ID NO: 5040077 - DNA, 12 bp, Homo sapiens
actgtgtataga

SEQ ID NO: 5040078 - DNA, 16 bp, Homo sapiens
acttctcttctgagcc

SEQ ID NO: 5040079 - DNA, 17 bp, Homo sapiens
actttgtctgaaaaatt

SEQ ID NO: 5040080 - DNA, 14 bp, Homo sapiens
agaaagtcagacct

SEQ ID NO: 5040081 - DNA, 23 bp, Homo sapiens
agaaatctagtatttcatgctgg

SEQ ID NO: 5040082 - DNA, 18 bp, Homo sapiens
agaacatcattagaacaa

SEQ ID NO: 5040083 - DNA, 22 bp, Homo sapiens
agaatgccatatttttgagggc

SEQ ID NO: 5040084 - DNA, 12 bp, Homo sapiens
agacaaatattt

SEQ ID NO: 5040085 - DNA, 15 bp, Homo sapiens
agacaaatatttgga

SEQ ID NO: 5040086 - DNA, 19 bp, Homo sapiens
agacataggccatgaaaaa

SEQ ID NO: 5040087 - DNA, 14 bp, Homo sapiens
agaccagtctggcc

SEQ ID NO: 5040088 - DNA, 15 bp, Homo sapiens
agaccagtctggcca

SEQ ID NO: 5040089 - DNA, 17 bp, Homo sapiens
agactcatcttactgta

SEQ ID NO: 5040090 - DNA, 18 bp, Homo sapiens
agactcatcttactgtac

SEQ ID NO: 5040091 - DNA, 18 bp, Homo sapiens
agactgtagcctggatat

SEQ ID NO: 5040092 - DNA, 18 bp, Homo sapiens
agagaaggcctccctagc

SEQ ID NO: 5040093 - DNA, 20 bp, Homo sapiens
agagccatataagtttgaag

SEQ ID NO: 5040094 - DNA, 22 bp, Homo sapiens
agagccatataagtttgaagga

SEQ ID NO: 5040095 - DNA, 18 bp, Homo sapiens
agaggagcaaattgaggt

SEQ ID NO: 5040096 - DNA, 18 bp, Homo sapiens
agaggtacccaaggtcac

SEQ ID NO: 5040097 - DNA, 22 bp, Homo sapiens
agagtttgatatgggctttctc

SEQ ID NO: 5040098 - DNA, 13 bp, Homo sapiens
agagtttgtgtgt

SEQ ID NO: 5040099 - DNA, 18 bp, Homo sapiens
agagtttgtgtgttgtct

SEQ ID NO: 5040100 - DNA, 22 bp, Homo sapiens
agagtttgtgtgttgtcttgaa

SEQ ID NO: 5040101 - DNA, 13 bp, Homo sapiens
agagttttgtctt

SEQ ID NO: 5040102 - DNA, 15 bp, Homo sapiens
agatgctcttctgtg

SEQ ID NO: 5040103 - DNA, 22 bp, Homo sapiens
agatggcggtgatcagcagaga

SEQ ID NO: 5040104 - DNA, 16 bp, Homo sapiens
agattaagagccatat

SEQ ID NO: 5040105 - DNA, 14 bp, Homo sapiens
agcacagtttgaac

SEQ ID NO: 5040106 - DNA, 17 bp, Homo sapiens
agcacttcacacagaca

SEQ ID NO: 5040107 - DNA, 13 bp, Homo sapiens
agcacttgtatat

SEQ ID NO: 5040108 - DNA, 21 bp, Homo sapiens
agcatatggagtgcctgtaca

SEQ ID NO: 5040109 - DNA, 17 bp, Homo sapiens
agcccatgagtccttga

SEQ ID NO: 5040110 - DNA, 21 bp, Homo sapiens
agccctcctggaatggagctg

SEQ ID NO: 5040111 - DNA, 17 bp, Homo sapiens
agcctcagactcattgt

SEQ ID NO: 5040112 - DNA, 18 bp, Homo sapiens
agcctgggcaacagagca

SEQ ID NO: 5040113 - DNA, 14 bp, Homo sapiens
aggaggaagcagaa

SEQ ID NO: 5040114 - DNA, 20 bp, Homo sapiens
aggcaactagtggagagaac

SEQ ID NO: 5040115 - DNA, 22 bp, Homo sapiens
aggcaactagtggagagaactg

SEQ ID NO: 5040116 - DNA, 16 bp, Homo sapiens
aggcaccatagaagaa

SEQ ID NO: 5040117 - DNA, 19 bp, Homo sapiens
aggcaccatagaagaacag

SEQ ID NO: 5040118 - DNA, 16 bp, Homo sapiens
aggcactctgttattt

SEQ ID NO: 5040119 - DNA, 20 bp, Homo sapiens
aggcactctgttatttagac

SEQ ID NO: 5040120 - DNA, 22 bp, Homo sapiens
aggcaggcacctgggctttctg

SEQ ID NO: 5040121 - DNA, 14 bp, Homo sapiens
aggcatgacagctg

SEQ ID NO: 5040122 - DNA, 19 bp, Homo sapiens
aggcatgacagctgttcca

SEQ ID NO: 5040123 - DNA, 19 bp, Homo sapiens
aggccatgaaaaaaatgat

SEQ ID NO: 5040124 - DNA, 18 bp, Homo sapiens
agggtcctttagtacctg

SEQ ID NO: 5040125 - DNA, 20 bp, Homo sapiens
agggtcctttagtacctgaa

SEQ ID NO: 5040126 - DNA, 17 bp, Homo sapiens
agggttccactggagaa

SEQ ID NO: 5040127 - DNA, 22 bp, Homo sapiens
aggttcagcaaggtgagagagg

SEQ ID NO: 5040128 - DNA, 18 bp, Homo sapiens
aggttccaactgtatata

SEQ ID NO: 5040129 - DNA, 17 bp, Homo sapiens
agtaactttatgtgtaa

SEQ ID NO: 5040130 - DNA, 23 bp, Homo sapiens
agtatctatatatgtgtatgtac

SEQ ID NO: 5040131 - DNA, 16 bp, Homo sapiens
agtatttcatgctggg

SEQ ID NO: 5040132 - DNA, 20 bp, Homo sapiens
agtccctatgtatttgcagt

SEQ ID NO: 5040133 - DNA, 22 bp, Homo sapiens
agtccttgaaaatattttttat

SEQ ID NO: 5040134 - DNA, 14 bp, Homo sapiens
agtcctttatgtgg

SEQ ID NO: 5040135 - DNA, 19 bp, Homo sapiens
agtctggccaatatggaga

SEQ ID NO: 5040136 - DNA, 23 bp, Homo sapiens
agtgcatttttatctgtgagttc

SEQ ID NO: 5040137 - DNA, 19 bp, Homo sapiens
agtggttgttagttataga

SEQ ID NO: 5040138 - DNA, 17 bp, Homo sapiens
agttatagatgtctagg

SEQ ID NO: 5040139 - DNA, 16 bp, Homo sapiens
agttgctgtccccttc

SEQ ID NO: 5040140 - DNA, 20 bp, Homo sapiens
agttgctgtccccttccagg

SEQ ID NO: 5040141 - DNA, 20 bp, Homo sapiens
agtttacctctttaaaaaca

SEQ ID NO: 5040142 - DNA, 18 bp, Homo sapiens
agtttggattcttatgta

SEQ ID NO: 5040143 - DNA, 16 bp, Homo sapiens
agtttgtgtgttgtct

SEQ ID NO: 5040144 - DNA, 16 bp, Homo sapiens
ataaaaataaaagaga

SEQ ID NO: 5040145 - DNA, 19 bp, Homo sapiens
ataaaaggcaaatgtgtac

SEQ ID NO: 5040146 - DNA, 19 bp, Homo sapiens
ataaggtttcgtttctgta

SEQ ID NO: 5040147 - DNA, 19 bp, Homo sapiens
ataagtttgaaggaaacag

SEQ ID NO: 5040148 - DNA, 20 bp, Homo sapiens
ataagtttgaaggaaacagt

SEQ ID NO: 5040149 - DNA, 22 bp, Homo sapiens
atacaaccctggcattatgtcc

SEQ ID NO: 5040150 - DNA, 19 bp, Homo sapiens
atacagtaactttatgtgt

SEQ ID NO: 5040151 - DNA, 15 bp, Homo sapiens
atagagtttgctatt

SEQ ID NO: 5040152 - DNA, 22 bp, Homo sapiens
atatacagtaactttatgtgta

SEQ ID NO: 5040153 - DNA, 18 bp, Homo sapiens
atatatacagtaacttta

SEQ ID NO: 5040154 - DNA, 15 bp, Homo sapiens
atatatgtgtatgta

SEQ ID NO: 5040155 - DNA, 15 bp, Homo sapiens
atatattcccaatag

SEQ ID NO: 5040156 - DNA, 14 bp, Homo sapiens
atatgatgtttaaa

SEQ ID NO: 5040157 - DNA, 22 bp, Homo sapiens
atatgtgtatgtacgtttgtat

SEQ ID NO: 5040158 - DNA, 20 bp, Homo sapiens
atcagacctgggtggaactc

SEQ ID NO: 5040159 - DNA, 13 bp, Homo sapiens
atcagcagagaga

SEQ ID NO: 5040160 - DNA, 11 bp, Homo sapiens
atcattagaac

SEQ ID NO: 5040161 - DNA, 14 bp, Homo sapiens
atccaactccagga

SEQ ID NO: 5040162 - DNA, 16 bp, Homo sapiens
atccatagtagtatga

SEQ ID NO: 5040163 - DNA, 16 bp, Homo sapiens
atcccggtttcagaag

SEQ ID NO: 5040164 - DNA, 18 bp, Homo sapiens
atcccggtttcagaagct

SEQ ID NO: 5040165 - DNA, 13 bp, Homo sapiens
atcctcaaaagaa

SEQ ID NO: 5040166 - DNA, 19 bp, Homo sapiens
atctatatatgtgtatgta

SEQ ID NO: 5040167 - DNA, 14 bp, Homo sapiens
atcttagtttggat

SEQ ID NO: 5040168 - DNA, 20 bp, Homo sapiens
atctttgcaagaaagtcaga

SEQ ID NO: 5040169 - DNA, 17 bp, Homo sapiens
atgaacttattctgtag

SEQ ID NO: 5040170 - DNA, 18 bp, Homo sapiens
atgagtccttgaaaatat

SEQ ID NO: 5040171 - DNA, 22 bp, Homo sapiens
atgatctcttcttttggcttcc

SEQ ID NO: 5040172 - DNA, 13 bp, Homo sapiens
atgatctgtcaaa

SEQ ID NO: 5040173 - DNA, 20 bp, Homo sapiens
atgctactgtctcactgaaa

SEQ ID NO: 5040174 - DNA, 14 bp, Homo sapiens
atgctcttctgtgg

SEQ ID NO: 5040175 - DNA, 19 bp, Homo sapiens
atggatttgatgctgtttg

SEQ ID NO: 5040176 - DNA, 20 bp, Homo sapiens
atggcagagtttgtgtgttg

SEQ ID NO: 5040177 - DNA, 22 bp, Homo sapiens
atggcagagtttgtgtgttgtc

SEQ ID NO: 5040178 - DNA, 14 bp, Homo sapiens
atgtacgtttgtat

SEQ ID NO: 5040179 - DNA, 17 bp, Homo sapiens
atgtccactgtgtatag

SEQ ID NO: 5040180 - DNA, 14 bp, Homo sapiens
atgtgtacatggca

SEQ ID NO: 5040181 - DNA, 20 bp, Homo sapiens
atgtgtgtagacaaatattt

SEQ ID NO: 5040182 - DNA, 14 bp, Homo sapiens
atgttggtgttcca

SEQ ID NO: 5040183 - DNA, 13 bp, Homo sapiens
attattcttgtag

SEQ ID NO: 5040184 - DNA, 23 bp, Homo sapiens
attcccaagagtggtggcagctc

SEQ ID NO: 5040185 - DNA, 19 bp, Homo sapiens
attctgatttggaaaaaga

SEQ ID NO: 5040186 - DNA, 17 bp, Homo sapiens
attctgtggaacaagcc

SEQ ID NO: 5040187 - DNA, 12 bp, Homo sapiens
attgaaaaggac

SEQ ID NO: 5040188 - DNA, 12 bp, Homo sapiens
attgttcagaag

SEQ ID NO: 5040189 - DNA, 21 bp, Homo sapiens
attgttcagaagacctccctg

SEQ ID NO: 5040190 - DNA, 17 bp, Homo sapiens
attgttgacagttctga

SEQ ID NO: 5040191 - DNA, 21 bp, Homo sapiens
attgttgacagttctgaagaa

SEQ ID NO: 5040192 - DNA, 19 bp, Homo sapiens
atttaaattttacccttta

SEQ ID NO: 5040193 - DNA, 14 bp, Homo sapiens
atttaccttgaaca

SEQ ID NO: 5040194 - DNA, 20 bp, Homo sapiens
atttagagaactgtggccgt

SEQ ID NO: 5040195 - DNA, 17 bp, Homo sapiens
atttctacctttctgag

SEQ ID NO: 5040196 - DNA, 14 bp, Homo sapiens
atttcttactcaaa

SEQ ID NO: 5040197 - DNA, 16 bp, Homo sapiens
atttgatgctgtttga

SEQ ID NO: 5040198 - DNA, 16 bp, Homo sapiens
attttttaaggaaaca

SEQ ID NO: 5040199 - DNA, 13 bp, Homo sapiens
attttttatatat

SEQ ID NO: 5040200 - DNA, 18 bp, Homo sapiens
attttttatatatacagt

SEQ ID NO: 5040201 - DNA, 16 bp, Homo sapiens
caaaagaaagagaaat

SEQ ID NO: 5040202 - DNA, 23 bp, Homo sapiens
caaacatgtttagagtggataga

SEQ ID NO: 5040203 - DNA, 15 bp, Homo sapiens
caaagttaacagatt

SEQ ID NO: 5040204 - DNA, 13 bp, Homo sapiens
caaatatttggag

SEQ ID NO: 5040205 - DNA, 15 bp, Homo sapiens
caacaaggaaataga

SEQ ID NO: 5040206 - DNA, 15 bp, Homo sapiens
caacaccccacagga

SEQ ID NO: 5040207 - DNA, 18 bp, Homo sapiens
caacaccccacaggaggg

SEQ ID NO: 5040208 - DNA, 14 bp, Homo sapiens
caacagagcaagac

SEQ ID NO: 5040209 - DNA, 15 bp, Homo sapiens
caactagtggagaga

SEQ ID NO: 5040210 - DNA, 22 bp, Homo sapiens
caagagggtcctttagtacctg

SEQ ID NO: 5040211 - DNA, 18 bp, Homo sapiens
caagatcacgccactgca

SEQ ID NO: 5040212 - DNA, 23 bp, Homo sapiens
caaggcaactagtggagagaact

SEQ ID NO: 5040213 - DNA, 14 bp, Homo sapiens
caaggtgagagagg

SEQ ID NO: 5040214 - DNA, 21 bp, Homo sapiens
caagtgattgacaactgaaga

SEQ ID NO: 5040215 - DNA, 19 bp, Homo sapiens
caatggatttgatgctgtt

SEQ ID NO: 5040216 - DNA, 22 bp, Homo sapiens
caatggatttgatgctgtttga

SEQ ID NO: 5040217 - DNA, 11 bp, Homo sapiens
caatgtgccct

SEQ ID NO: 5040218 - DNA, 14 bp, Homo sapiens
caattgttgacagt

SEQ ID NO: 5040219 - DNA, 24 bp, Homo sapiens
caattgttgacagttctgaagaat

SEQ ID NO: 5040220 - DNA, 18 bp, Homo sapiens
cacaggagtgggaaaaca

SEQ ID NO: 5040221 - DNA, 23 bp, Homo sapiens
cacaggggctatcccttctcaga

SEQ ID NO: 5040222 - DNA, 16 bp, Homo sapiens
cacatagctgtctaga

SEQ ID NO: 5040223 - DNA, 19 bp, Homo sapiens
cacctgggcttaagaaatc

SEQ ID NO: 5040224 - DNA, 16 bp, Homo sapiens
cacctgggctttctgg

SEQ ID NO: 5040225 - DNA, 13 bp, Homo sapiens
cactctgttattt

SEQ ID NO: 5040226 - DNA, 17 bp, Homo sapiens
cactctgttatttagac

SEQ ID NO: 5040227 - DNA, 22 bp, Homo sapiens
cactgcatgagcttttatacta

SEQ ID NO: 5040228 - DNA, 17 bp, Homo sapiens
cacttaaggcactctgt

SEQ ID NO: 5040229 - DNA, 15 bp, Homo sapiens
cacttacttgggagg

SEQ ID NO: 5040230 - DNA, 16 bp, Homo sapiens
cacttcattgagagtt

SEQ ID NO: 5040231 - DNA, 13 bp, Homo sapiens
cacttgtatatac

SEQ ID NO: 5040232 - DNA, 16 bp, Homo sapiens
cagaacatcattagaa

SEQ ID NO: 5040233 - DNA, 17 bp, Homo sapiens
cagaacatcattagaac

SEQ ID NO: 5040234 - DNA, 20 bp, Homo sapiens
cagaagacctccctgtgaga

SEQ ID NO: 5040235 - DNA, 21 bp, Homo sapiens
cagaagacctccctgtgagag

SEQ ID NO: 5040236 - DNA, 22 bp, Homo sapiens
cagaagacctccctgtgagaga

SEQ ID NO: 5040237 - DNA, 16 bp, Homo sapiens
cagaagctgcagctgg

SEQ ID NO: 5040238 - DNA, 21 bp, Homo sapiens
cagagcaagactctgtctcaa

SEQ ID NO: 5040239 - DNA, 23 bp, Homo sapiens
cagaggagcaaattgaggttcag

SEQ ID NO: 5040240 - DNA, 14 bp, Homo sapiens
cagagtcctttcca

SEQ ID NO: 5040241 - DNA, 15 bp, Homo sapiens
cagagtcctttccaa

SEQ ID NO: 5040242 - DNA, 22 bp, Homo sapiens
cagatggcggtgatcagcagag

SEQ ID NO: 5040243 - DNA, 23 bp, Homo sapiens
cagatggcggtgatcagcagaga

SEQ ID NO: 5040244 - DNA, 19 bp, Homo sapiens
cagctgttccacaggggct

SEQ ID NO: 5040245 - DNA, 13 bp, Homo sapiens
caggaaataaagt

SEQ ID NO: 5040246 - DNA, 14 bp, Homo sapiens
caggaatgatctct

SEQ ID NO: 5040247 - DNA, 22 bp, Homo sapiens
caggagtgggaaaacactgcca

SEQ ID NO: 5040248 - DNA, 14 bp, Homo sapiens
caggcacctgggct

SEQ ID NO: 5040249 - DNA, 21 bp, Homo sapiens
caggggctatcccttctcaga

SEQ ID NO: 5040250 - DNA, 14 bp, Homo sapiens
caggggtcaccttg

SEQ ID NO: 5040251 - DNA, 17 bp, Homo sapiens
cagtaactttatgtgta

SEQ ID NO: 5040252 - DNA, 16 bp, Homo sapiens
cagtatctatatatgt

SEQ ID NO: 5040253 - DNA, 18 bp, Homo sapiens
cagtatctatatatgtgt

SEQ ID NO: 5040254 - DNA, 20 bp, Homo sapiens
cagtatctatatatgtgtat

SEQ ID NO: 5040255 - DNA, 16 bp, Homo sapiens
cagttggccttcagaa

SEQ ID NO: 5040256 - DNA, 12 bp, Homo sapiens
catactttgtct

SEQ ID NO: 5040257 - DNA, 13 bp, Homo sapiens
catactttgtctg

SEQ ID NO: 5040258 - DNA, 18 bp, Homo sapiens
catagaagaacagcagat

SEQ ID NO: 5040259 - DNA, 15 bp, Homo sapiens
catagctgtctagag

SEQ ID NO: 5040260 - DNA, 20 bp, Homo sapiens
catagtagtatgatgataca

SEQ ID NO: 5040261 - DNA, 15 bp, Homo sapiens
catataagtttgaag

SEQ ID NO: 5040262 - DNA, 20 bp, Homo sapiens
catataagtttgaaggaaac

SEQ ID NO: 5040263 - DNA, 21 bp, Homo sapiens
catataagtttgaaggaaaca

SEQ ID NO: 5040264 - DNA, 23 bp, Homo sapiens
catataagtttgaaggaaacagt

SEQ ID NO: 5040265 - DNA, 15 bp, Homo sapiens
catcagtccctatgt

SEQ ID NO: 5040266 - DNA, 13 bp, Homo sapiens
catcattagaaca

SEQ ID NO: 5040267 - DNA, 22 bp, Homo sapiens
catgaacagaaaacattctgat

SEQ ID NO: 5040268 - DNA, 20 bp, Homo sapiens
catgagtccttgaaaatatt

SEQ ID NO: 5040269 - DNA, 22 bp, Homo sapiens
catgatggttattttcttttct

SEQ ID NO: 5040270 - DNA, 20 bp, Homo sapiens
catgccaatagttgctgtcc

SEQ ID NO: 5040271 - DNA, 18 bp, Homo sapiens
catggcagagtttgtgtg

SEQ ID NO: 5040272 - DNA, 20 bp, Homo sapiens
cattatgtccactgtgtata

SEQ ID NO: 5040273 - DNA, 13 bp, Homo sapiens
cattgttcagaag

SEQ ID NO: 5040274 - DNA, 14 bp, Homo sapiens
cattgttcagaaga

SEQ ID NO: 5040275 - DNA, 18 bp, Homo sapiens
cattgttcagaagacctc

SEQ ID NO: 5040276 - DNA, 16 bp, Homo sapiens
ccaacaaggaaataga

SEQ ID NO: 5040277 - DNA, 19 bp, Homo sapiens
ccaagagggtcctttagta

SEQ ID NO: 5040278 - DNA, 22 bp, Homo sapiens
ccaattgttgacagttctgaag

SEQ ID NO: 5040279 - DNA, 20 bp, Homo sapiens
ccacaaagcacagtttgaac

SEQ ID NO: 5040280 - DNA, 24 bp, Homo sapiens
ccacaggggctatcccttctcaga

SEQ ID NO: 5040281 - DNA, 19 bp, Homo sapiens
ccactgcactccagcctgg

SEQ ID NO: 5040282 - DNA, 15 bp, Homo sapiens
ccagaagcttccata

SEQ ID NO: 5040283 - DNA, 16 bp, Homo sapiens
ccagagtcctttccaa

SEQ ID NO: 5040284 - DNA, 21 bp, Homo sapiens
ccagagtcctttccaaggctt

SEQ ID NO: 5040285 - DNA, 23 bp, Homo sapiens
ccaggatagtgggcaccccactg

SEQ ID NO: 5040286 - DNA, 22 bp, Homo sapiens
ccagtgtctgaaccaccctgga

SEQ ID NO: 5040287 - DNA, 21 bp, Homo sapiens
ccataatgctactgtctcact

SEQ ID NO: 5040288 - DNA, 16 bp, Homo sapiens
ccatataagtttgaag

SEQ ID NO: 5040289 - DNA, 15 bp, Homo sapiens
ccatcttagtttgga

SEQ ID NO: 5040290 - DNA, 22 bp, Homo sapiens
ccatgaacagaaaacattctga

SEQ ID NO: 5040291 - DNA, 22 bp, Homo sapiens
ccatgccaatagttgctgtccc

SEQ ID NO: 5040292 - DNA, 19 bp, Homo sapiens
ccattttttaaggaaacaa

SEQ ID NO: 5040293 - DNA, 19 bp, Homo sapiens
cccaagagtggtggcagct

SEQ ID NO: 5040294 - DNA, 15 bp, Homo sapiens
cccaagtgtgaacaa

SEQ ID NO: 5040295 - DNA, 21 bp, Homo sapiens
ccccttctacatttcttagac

SEQ ID NO: 5040296 - DNA, 15 bp, Homo sapiens
cccggtttcagaagc

SEQ ID NO: 5040297 - DNA, 22 bp, Homo sapiens
cccggtttcagaagctgcagct

SEQ ID NO: 5040298 - DNA, 22 bp, Homo sapiens
cccttctcagaaaacttctctt

SEQ ID NO: 5040299 - DNA, 16 bp, Homo sapiens
cctaagtcctttatgt

SEQ ID NO: 5040300 - DNA, 15 bp, Homo sapiens
cctcagactcattgt

SEQ ID NO: 5040301 - DNA, 22 bp, Homo sapiens
cctccaggaatgatctcttctt

SEQ ID NO: 5040302 - DNA, 22 bp, Homo sapiens
cctgaaaagtaacttggctttc

SEQ ID NO: 5040303 - DNA, 15 bp, Homo sapiens
cctggaaattctgcc

SEQ ID NO: 5040304 - DNA, 19 bp, Homo sapiens
cctggcattatgtccactg

SEQ ID NO: 5040305 - DNA, 15 bp, Homo sapiens
cctgggctttctgga

SEQ ID NO: 5040306 - DNA, 23 bp, Homo sapiens
ccttccaggggtcaccttgagag

SEQ ID NO: 5040307 - DNA, 20 bp, Homo sapiens
ccttgagaggcatgacagct

SEQ ID NO: 5040308 - DNA, 23 bp, Homo sapiens
cctttatgtggaaaacagaacat

SEQ ID NO: 5040309 - DNA, 17 bp, Homo sapiens
cggtgatcagcagagag

SEQ ID NO: 5040310 - DNA, 16 bp, Homo sapiens
cgtaagtttaaaggat

SEQ ID NO: 5040311 - DNA, 23 bp, Homo sapiens
cgtggctagggttccactggaga

SEQ ID NO: 5040312 - DNA, 14 bp, Homo sapiens
cgtttgtatgtgtg

SEQ ID NO: 5040313 - DNA, 15 bp, Homo sapiens
cgtttgtatgtgtgt

SEQ ID NO: 5040314 - DNA, 15 bp, Homo sapiens
ctaagtcctttatgt

SEQ ID NO: 5040315 - DNA, 20 bp, Homo sapiens
ctagccagcacttgtatata

SEQ ID NO: 5040316 - DNA, 21 bp, Homo sapiens
ctaggtttatctcatttaagc

SEQ ID NO: 5040317 - DNA, 15 bp, Homo sapiens
ctatatatgtgtatg

SEQ ID NO: 5040318 - DNA, 15 bp, Homo sapiens
ctatcccttctcaga

SEQ ID NO: 5040319 - DNA, 16 bp, Homo sapiens
ctattgacttcaatga

SEQ ID NO: 5040320 - DNA, 20 bp, Homo sapiens
ctcagggtccctcaggacca

SEQ ID NO: 5040321 - DNA, 19 bp, Homo sapiens
ctccccttcctcactgccc

SEQ ID NO: 5040322 - DNA, 21 bp, Homo sapiens
ctccctagccagcacttgtat

SEQ ID NO: 5040323 - DNA, 20 bp, Homo sapiens
ctcctcagggtccctcagga

SEQ ID NO: 5040324 - DNA, 16 bp, Homo sapiens
ctcctgctcctcagga

SEQ ID NO: 5040325 - DNA, 15 bp, Homo sapiens
ctcgcacctttccaa

SEQ ID NO: 5040326 - DNA, 17 bp, Homo sapiens
ctctcgcacctttccaa

SEQ ID NO: 5040327 - DNA, 13 bp, Homo sapiens
ctctgctttgcat

SEQ ID NO: 5040328 - DNA, 20 bp, Homo sapiens
ctcttgagccctcctggaat

SEQ ID NO: 5040329 - DNA, 15 bp, Homo sapiens
ctgaaccaccctgga

SEQ ID NO: 5040330 - DNA, 17 bp, Homo sapiens
ctgaataaatggtagta

SEQ ID NO: 5040331 - DNA, 18 bp, Homo sapiens
ctgacatggagttcccgt

SEQ ID NO: 5040332 - DNA, 17 bp, Homo sapiens
ctgagcacactttagtg

SEQ ID NO: 5040333 - DNA, 14 bp, Homo sapiens
ctgatttggaaaaa

SEQ ID NO: 5040334 - DNA, 14 bp, Homo sapiens
ctgctcctcaggaa

SEQ ID NO: 5040335 - DNA, 14 bp, Homo sapiens
ctgctcttgtttct

SEQ ID NO: 5040336 - DNA, 17 bp, Homo sapiens
ctggacaccgggccagt

SEQ ID NO: 5040337 - DNA, 21 bp, Homo sapiens
ctggcattatgtccactgtgt

SEQ ID NO: 5040338 - DNA, 16 bp, Homo sapiens
ctgggcaacagagcaa

SEQ ID NO: 5040339 - DNA, 12 bp, Homo sapiens
ctggtaagcaaa

SEQ ID NO: 5040340 - DNA, 21 bp, Homo sapiens
ctgtacctgttccttagacct

SEQ ID NO: 5040341 - DNA, 18 bp, Homo sapiens
ctgtatgttgtccaattg

SEQ ID NO: 5040342 - DNA, 14 bp, Homo sapiens
ctgtgagagagttg

SEQ ID NO: 5040343 - DNA, 12 bp, Homo sapiens
ctgtgcagagac

SEQ ID NO: 5040344 - DNA, 19 bp, Homo sapiens
ctgtggccgttatctggaa

SEQ ID NO: 5040345 - DNA, 16 bp, Homo sapiens
ctgttatttagactca

SEQ ID NO: 5040346 - DNA, 16 bp, Homo sapiens
ctgttccttagacctt

SEQ ID NO: 5040347 - DNA, 17 bp, Homo sapiens
ctgttgtgtttgtcaaa

SEQ ID NO: 5040348 - DNA, 16 bp, Homo sapiens
cttaaggcactctgtt

SEQ ID NO: 5040349 - DNA, 19 bp, Homo sapiens
cttagtttggattcttatg

SEQ ID NO: 5040350 - DNA, 14 bp, Homo sapiens
cttattctgtagat

SEQ ID NO: 5040351 - DNA, 19 bp, Homo sapiens
cttctccaattctgcccaa

SEQ ID NO: 5040352 - DNA, 15 bp, Homo sapiens
cttcttttggcttcc

SEQ ID NO: 5040353 - DNA, 15 bp, Homo sapiens
ctttaacagctttct

SEQ ID NO: 5040354 - DNA, 16 bp, Homo sapiens
ctttaacagctttctc

SEQ ID NO: 5040355 - DNA, 20 bp, Homo sapiens
ctttaacagctttctccaga

SEQ ID NO: 5040356 - DNA, 23 bp, Homo sapiens
ctttatgtggaaaacagaacatc

SEQ ID NO: 5040357 - DNA, 12 bp, Homo sapiens
ctttatgtgtaa

SEQ ID NO: 5040358 - DNA, 21 bp, Homo sapiens
ctttctgagcacactttagtg

SEQ ID NO: 5040359 - DNA, 16 bp, Homo sapiens
ctttgaggaggaagca

SEQ ID NO: 5040360 - DNA, 19 bp, Homo sapiens
ctttgaggaggaagcagaa

SEQ ID NO: 5040361 - DNA, 14 bp, Homo sapiens
cttttggcttccat

SEQ ID NO: 5040362 - DNA, 22 bp, Homo sapiens
gaaatgtaccatcaaatgttaa

SEQ ID NO: 5040363 - DNA, 17 bp, Homo sapiens
gaactatgggagcctca

SEQ ID NO: 5040364 - DNA, 20 bp, Homo sapiens
gaaggcctccctagccagca

SEQ ID NO: 5040365 - DNA, 16 bp, Homo sapiens
gaatgatctcttcttt

SEQ ID NO: 5040366 - DNA, 17 bp, Homo sapiens
gaatgatctcttctttt

SEQ ID NO: 5040367 - DNA, 16 bp, Homo sapiens
gacaactgaagagaca

SEQ ID NO: 5040368 - DNA, 16 bp, Homo sapiens
gacagagtatgaacac

SEQ ID NO: 5040369 - DNA, 13 bp, Homo sapiens
gacagctgttcca

SEQ ID NO: 5040370 - DNA, 18 bp, Homo sapiens
gacagctgttccacaggg

SEQ ID NO: 5040371 - DNA, 22 bp, Homo sapiens
gaccttccataatgctactgtc

SEQ ID NO: 5040372 - DNA, 22 bp, Homo sapiens
gactcttgagccctcctggaat

SEQ ID NO: 5040373 - DNA, 14 bp, Homo sapiens
gactgggggccaga

SEQ ID NO: 5040374 - DNA, 23 bp, Homo sapiens
gagaaagttagagtacagatcct

SEQ ID NO: 5040375 - DNA, 14 bp, Homo sapiens
gagagagaatcaga

SEQ ID NO: 5040376 - DNA, 17 bp, Homo sapiens
gagagttttgtcttgaa

SEQ ID NO: 5040377 - DNA, 23 bp, Homo sapiens
gagcacttcacacagacaagtgg

SEQ ID NO: 5040378 - DNA, 19 bp, Homo sapiens
gagccatataagtttgaag

SEQ ID NO: 5040379 - DNA, 23 bp, Homo sapiens
gagccatataagtttgaaggaaa

SEQ ID NO: 5040380 - DNA, 15 bp, Homo sapiens
gagccctcctggaat

SEQ ID NO: 5040381 - DNA, 21 bp, Homo sapiens
gagccctcctggaatggagct

SEQ ID NO: 5040382 - DNA, 14 bp, Homo sapiens
gaggaggaagcaga

SEQ ID NO: 5040383 - DNA, 20 bp, Homo sapiens
gaggcatgacagctgttcca

SEQ ID NO: 5040384 - DNA, 17 bp, Homo sapiens
gaggtacccaaggtcac

SEQ ID NO: 5040385 - DNA, 13 bp, Homo sapiens
gagtggtggcagc

SEQ ID NO: 5040386 - DNA, 15 bp, Homo sapiens
gagtggtggcagctc

SEQ ID NO: 5040387 - DNA, 14 bp, Homo sapiens
gagttcaagaccag

SEQ ID NO: 5040388 - DNA, 14 bp, Homo sapiens
gatgtccaacaagg

SEQ ID NO: 5040389 - DNA, 13 bp, Homo sapiens
gattaagagccat

SEQ ID NO: 5040390 - DNA, 17 bp, Homo sapiens
gattagaagctgaaaac

SEQ ID NO: 5040391 - DNA, 17 bp, Homo sapiens
gattgacaactgaagag

SEQ ID NO: 5040392 - DNA, 18 bp, Homo sapiens
gatttgatgctgtttgac

SEQ ID NO: 5040393 - DNA, 21 bp, Homo sapiens
gattttggggttgtgttgtca

SEQ ID NO: 5040394 - DNA, 19 bp, Homo sapiens
gcaaaggttccaactgtat

SEQ ID NO: 5040395 - DNA, 17 bp, Homo sapiens
gcacagatacacataca

SEQ ID NO: 5040396 - DNA, 13 bp, Homo sapiens
gcacagtttgaac

SEQ ID NO: 5040397 - DNA, 15 bp, Homo sapiens
gcacagtttgaacaa

SEQ ID NO: 5040398 - DNA, 21 bp, Homo sapiens
gcaccatagaagaacagcaga

SEQ ID NO: 5040399 - DNA, 16 bp, Homo sapiens
gcacctgggctttctg

SEQ ID NO: 5040400 - DNA, 14 bp, Homo sapiens
gcactctgttattt

SEQ ID NO: 5040401 - DNA, 16 bp, Homo sapiens
gcaggcacctgggctt

SEQ ID NO: 5040402 - DNA, 21 bp, Homo sapiens
gcatatggagtgcctgtacaa

SEQ ID NO: 5040403 - DNA, 19 bp, Homo sapiens
gcatcagtccctatgtatt

SEQ ID NO: 5040404 - DNA, 14 bp, Homo sapiens
gcatgacagctgtt

SEQ ID NO: 5040405 - DNA, 15 bp, Homo sapiens
gcatgttgagaggct

SEQ ID NO: 5040406 - DNA, 19 bp, Homo sapiens
gcattatgtccactgtgta

SEQ ID NO: 5040407 - DNA, 21 bp, Homo sapiens
gcattatgtccactgtgtata

SEQ ID NO: 5040408 - DNA, 22 bp, Homo sapiens
gcattatgtccactgtgtatag

SEQ ID NO: 5040409 - DNA, 18 bp, Homo sapiens
gccaccatcctattgcaa

SEQ ID NO: 5040410 - DNA, 16 bp, Homo sapiens
gccagcacttgtatat

SEQ ID NO: 5040411 - DNA, 21 bp, Homo sapiens
gccagtatctatatatgtgta

SEQ ID NO: 5040412 - DNA, 22 bp, Homo sapiens
gccagtatctatatatgtgtat

SEQ ID NO: 5040413 - DNA, 16 bp, Homo sapiens
gccatataagtttgaa

SEQ ID NO: 5040414 - DNA, 23 bp, Homo sapiens
gccatataagtttgaaggaaaca

SEQ ID NO: 5040415 - DNA, 18 bp, Homo sapiens
gcccaaaaatatggttga

SEQ ID NO: 5040416 - DNA, 17 bp, Homo sapiens
gcccatgagtccttgaa

SEQ ID NO: 5040417 - DNA, 20 bp, Homo sapiens
gcctataatcccagcatgtt

SEQ ID NO: 5040418 - DNA, 16 bp, Homo sapiens
gcctccctagccagca

SEQ ID NO: 5040419 - DNA, 17 bp, Homo sapiens
gcctctttaacagcttt

SEQ ID NO: 5040420 - DNA, 20 bp, Homo sapiens
gcctctttaacagctttctc

SEQ ID NO: 5040421 - DNA, 21 bp, Homo sapiens
gcctggatattattcttgtag

SEQ ID NO: 5040422 - DNA, 16 bp, Homo sapiens
gcggtgatcagcagag

SEQ ID NO: 5040423 - DNA, 16 bp, Homo sapiens
gctactgtctcactga

SEQ ID NO: 5040424 - DNA, 21 bp, Homo sapiens
gctgatgaacttattctgtag

SEQ ID NO: 5040425 - DNA, 16 bp, Homo sapiens
gctggtctgtttccag

SEQ ID NO: 5040426 - DNA, 20 bp, Homo sapiens
gcttaagaaatctagtattt

SEQ ID NO: 5040427 - DNA, 19 bp, Homo sapiens
gcttctaccatgaacagaa

SEQ ID NO: 5040428 - DNA, 19 bp, Homo sapiens
gctttctccagaaccagtg

SEQ ID NO: 5040429 - DNA, 22 bp, Homo sapiens
gctttctctttggtttctcatc

SEQ ID NO: 5040430 - DNA, 19 bp, Homo sapiens
gctttgaaggaaccaagtg

SEQ ID NO: 5040431 - DNA, 12 bp, Homo sapiens
ggaatggagctg

SEQ ID NO: 5040432 - DNA, 20 bp, Homo sapiens
ggaggtggaggttgccgtga

SEQ ID NO: 5040433 - DNA, 16 bp, Homo sapiens
ggagttctatgctctc

SEQ ID NO: 5040434 - DNA, 22 bp, Homo sapiens
ggatagaaaattatgcagcttg

SEQ ID NO: 5040435 - DNA, 12 bp, Homo sapiens
ggcaaaagacat

SEQ ID NO: 5040436 - DNA, 20 bp, Homo sapiens
ggcaacagagcaagactctg

SEQ ID NO: 5040437 - DNA, 20 bp, Homo sapiens
ggcaccatagaagaacagca

SEQ ID NO: 5040438 - DNA, 22 bp, Homo sapiens
ggcactctgttatttagactca

SEQ ID NO: 5040439 - DNA, 15 bp, Homo sapiens
ggccgaggcacgaga

SEQ ID NO: 5040440 - DNA, 22 bp, Homo sapiens
ggcctgtgtgttgccaggcagg

SEQ ID NO: 5040441 - DNA, 23 bp, Homo sapiens
ggcctgtgtgttgccaggcaggc

SEQ ID NO: 5040442 - DNA, 19 bp, Homo sapiens
ggcttaagaaatctagtat

SEQ ID NO: 5040443 - DNA, 22 bp, Homo sapiens
ggctttcattattagtactgct

SEQ ID NO: 5040444 - DNA, 13 bp, Homo sapiens
ggctttctggaat

SEQ ID NO: 5040445 - DNA, 15 bp, Homo sapiens
ggggttgtgttgtca

SEQ ID NO: 5040446 - DNA, 14 bp, Homo sapiens
ggtttcagaagctg

SEQ ID NO: 5040447 - DNA, 17 bp, Homo sapiens
gtaactgggttcaaaaa

SEQ ID NO: 5040448 - DNA, 15 bp, Homo sapiens
gtaactttatgtgta

SEQ ID NO: 5040449 - DNA, 16 bp, Homo sapiens
gtaactttatgtgtaa

SEQ ID NO: 5040450 - DNA, 12 bp, Homo sapiens
gtacctgaaaag

SEQ ID NO: 5040451 - DNA, 23 bp, Homo sapiens
gtacctgaaaagtaacttggctt

SEQ ID NO: 5040452 - DNA, 17 bp, Homo sapiens
gtacgtttgtatgtgtg

SEQ ID NO: 5040453 - DNA, 13 bp, Homo sapiens
gtagattctgtgg

SEQ ID NO: 5040454 - DNA, 22 bp, Homo sapiens
gtagcctggatattattcttgt

SEQ ID NO: 5040455 - DNA, 16 bp, Homo sapiens
gtatatacgcatctat

SEQ ID NO: 5040456 - DNA, 13 bp, Homo sapiens
gtatatattccca

SEQ ID NO: 5040457 - DNA, 20 bp, Homo sapiens
gtatctatatatgtgtatgt

SEQ ID NO: 5040458 - DNA, 13 bp, Homo sapiens
gtatttgcagttc

SEQ ID NO: 5040459 - DNA, 21 bp, Homo sapiens
gtattttgtgttcctctttgc

SEQ ID NO: 5040460 - DNA, 21 bp, Homo sapiens
gtcagaaaccattgttcagaa

SEQ ID NO: 5040461 - DNA, 22 bp, Homo sapiens
gtccctatgtatttgcagttca

SEQ ID NO: 5040462 - DNA, 14 bp, Homo sapiens
gtcctttagtacct

SEQ ID NO: 5040463 - DNA, 16 bp, Homo sapiens
gtcctttatgtggaaa

SEQ ID NO: 5040464 - DNA, 20 bp, Homo sapiens
gtcctttatgtggaaaacag

SEQ ID NO: 5040465 - DNA, 22 bp, Homo sapiens
gtcctttatgtggaaaacagaa

SEQ ID NO: 5040466 - DNA, 15 bp, Homo sapiens
gtgattgacaactga

SEQ ID NO: 5040467 - DNA, 20 bp, Homo sapiens
gtggaaggcatcagtcccta

SEQ ID NO: 5040468 - DNA, 16 bp, Homo sapiens
gtgttcctctttgcat

SEQ ID NO: 5040469 - DNA, 15 bp, Homo sapiens
gtgttgccaggcagg

SEQ ID NO: 5040470 - DNA, 21 bp, Homo sapiens
gtgtttgggtcacccctccag

SEQ ID NO: 5040471 - DNA, 21 bp, Homo sapiens
gttaaaaattaaaagaaggaa

SEQ ID NO: 5040472 - DNA, 12 bp, Homo sapiens
gttaacagattt

SEQ ID NO: 5040473 - DNA, 12 bp, Homo sapiens
gttatttagact

SEQ ID NO: 5040474 - DNA, 23 bp, Homo sapiens
gttccactggagaattgaaaagg

SEQ ID NO: 5040475 - DNA, 22 bp, Homo sapiens
gttcttaggcaccatagaagaa

SEQ ID NO: 5040476 - DNA, 16 bp, Homo sapiens
gttgacagttctgaag

SEQ ID NO: 5040477 - DNA, 22 bp, Homo sapiens
gttgccgtgagccaagatcacg

SEQ ID NO: 5040478 - DNA, 14 bp, Homo sapiens
gttgtgttgtcacc

SEQ ID NO: 5040479 - DNA, 17 bp, Homo sapiens
gtttgaaggaaacagtt

SEQ ID NO: 5040480 - DNA, 23 bp, Homo sapiens
gtttgatatgggctttctctttg

SEQ ID NO: 5040481 - DNA, 16 bp, Homo sapiens
gtttgcagaggagcaa

SEQ ID NO: 5040482 - DNA, 21 bp, Homo sapiens
gtttgtgtgttgtcttgaaag

SEQ ID NO: 5040483 - DNA, 20 bp, Homo sapiens
gttttattcctgtatgttgt

SEQ ID NO: 5040484 - DNA, 19 bp, Homo sapiens
taaaaggcaaatgtgtaca

SEQ ID NO: 5040485 - DNA, 18 bp, Homo sapiens
taaatagagtttgctatt

SEQ ID NO: 5040486 - DNA, 16 bp, Homo sapiens
taaatgtcttttcaaa

SEQ ID NO: 5040487 - DNA, 23 bp, Homo sapiens
taaattgtccgtgttcatacatt

SEQ ID NO: 5040488 - DNA, 14 bp, Homo sapiens
taactgtgcagaga

SEQ ID NO: 5040489 - DNA, 19 bp, Homo sapiens
taaggtttcgtttctgtat

SEQ ID NO: 5040490 - DNA, 20 bp, Homo sapiens
taagtgtgcacagatacaca

SEQ ID NO: 5040491 - DNA, 18 bp, Homo sapiens
taataaaaataaaagaga

SEQ ID NO: 5040492 - DNA, 22 bp, Homo sapiens
taataccattttttaaggaaac

SEQ ID NO: 5040493 - DNA, 18 bp, Homo sapiens
taatcccggtttcagaag

SEQ ID NO: 5040494 - DNA, 19 bp, Homo sapiens
taatcccggtttcagaagc

SEQ ID NO: 5040495 - DNA, 13 bp, Homo sapiens
taatgctactgtc

SEQ ID NO: 5040496 - DNA, 13 bp, Homo sapiens
tacaagattagaa

SEQ ID NO: 5040497 - DNA, 22 bp, Homo sapiens
tacataagcggcgtaagtttaa

SEQ ID NO: 5040498 - DNA, 19 bp, Homo sapiens
tacatggcagagtttgtgt

SEQ ID NO: 5040499 - DNA, 22 bp, Homo sapiens
tacatggcagagtttgtgtgtt

SEQ ID NO: 5040500 - DNA, 22 bp, Homo sapiens
tacatttcttagactacattta

SEQ ID NO: 5040501 - DNA, 20 bp, Homo sapiens
taccattttttaaggaaaca

SEQ ID NO: 5040502 - DNA, 12 bp, Homo sapiens
tacctttctgag

SEQ ID NO: 5040503 - DNA, 20 bp, Homo sapiens
tacctttctgagtctcttgg

SEQ ID NO: 5040504 - DNA, 13 bp, Homo sapiens
tacgtttgtatgt

SEQ ID NO: 5040505 - DNA, 14 bp, Homo sapiens
tactcaatggattt

SEQ ID NO: 5040506 - DNA, 17 bp, Homo sapiens
tactctatgtgatttat

SEQ ID NO: 5040507 - DNA, 18 bp, Homo sapiens
tactgattcactgcatgg

SEQ ID NO: 5040508 - DNA, 15 bp, Homo sapiens
tactttttgtaaaaa

SEQ ID NO: 5040509 - DNA, 19 bp, Homo sapiens
tagacaaatatttggaggg

SEQ ID NO: 5040510 - DNA, 17 bp, Homo sapiens
tagagtttgctattaga

SEQ ID NO: 5040511 - DNA, 14 bp, Homo sapiens
tagctcaagcctat

SEQ ID NO: 5040512 - DNA, 17 bp, Homo sapiens
tagctgtctagagtagc

SEQ ID NO: 5040513 - DNA, 21 bp, Homo sapiens
taggagactttaatcccggtt

SEQ ID NO: 5040514 - DNA, 15 bp, Homo sapiens
tagtactgctcttgt

SEQ ID NO: 5040515 - DNA, 14 bp, Homo sapiens
tagtggagagaact

SEQ ID NO: 5040516 - DNA, 20 bp, Homo sapiens
tataaccacaaagcacagtt

SEQ ID NO: 5040517 - DNA, 16 bp, Homo sapiens
tatacagtaactttat

SEQ ID NO: 5040518 - DNA, 22 bp, Homo sapiens
tatacagtaactttatgtgtaa

SEQ ID NO: 5040519 - DNA, 14 bp, Homo sapiens
tatatacagtaact

SEQ ID NO: 5040520 - DNA, 17 bp, Homo sapiens
tatatacagtaacttta

SEQ ID NO: 5040521 - DNA, 16 bp, Homo sapiens
tatatatgtgtatgta

SEQ ID NO: 5040522 - DNA, 18 bp, Homo sapiens
tatattcccaatagcaac

SEQ ID NO: 5040523 - DNA, 14 bp, Homo sapiens
tatcagcttcagaa

SEQ ID NO: 5040524 - DNA, 17 bp, Homo sapiens
tatcccttctcagaaaa

SEQ ID NO: 5040525 - DNA, 15 bp, Homo sapiens
tatctatatatgtgt

SEQ ID NO: 5040526 - DNA, 22 bp, Homo sapiens
tatgatgatacaagattagaag

SEQ ID NO: 5040527 - DNA, 16 bp, Homo sapiens
tatgtacgtttgtatg

SEQ ID NO: 5040528 - DNA, 19 bp, Homo sapiens
tatgtacgtttgtatgtgt

SEQ ID NO: 5040529 - DNA, 21 bp, Homo sapiens
tatgtacgtttgtatgtgtgt

SEQ ID NO: 5040530 - DNA, 22 bp, Homo sapiens
tatgtacgtttgtatgtgtgta

SEQ ID NO: 5040531 - DNA, 21 bp, Homo sapiens
tatgtagcaggaaataaagta

SEQ ID NO: 5040532 - DNA, 14 bp, Homo sapiens
tatgtgtaaataca

SEQ ID NO: 5040533 - DNA, 13 bp, Homo sapiens
tatgtgtatgtac

SEQ ID NO: 5040534 - DNA, 21 bp, Homo sapiens
tatgttgtccaattgttgaca

SEQ ID NO: 5040535 - DNA, 21 bp, Homo sapiens
tattagtactgctcttgtttc

SEQ ID NO: 5040536 - DNA, 19 bp, Homo sapiens
tattctgtagattctgtgg

SEQ ID NO: 5040537 - DNA, 19 bp, Homo sapiens
tattgacttcaatgatagt

SEQ ID NO: 5040538 - DNA, 22 bp, Homo sapiens
tattttaaagcttggtgctaaa

SEQ ID NO: 5040539 - DNA, 16 bp, Homo sapiens
tattttttatatatac

SEQ ID NO: 5040540 - DNA, 14 bp, Homo sapiens
tcaaaagaaagaga

SEQ ID NO: 5040541 - DNA, 20 bp, Homo sapiens
tcagaaaacttctcttctga

SEQ ID NO: 5040542 - DNA, 12 bp, Homo sapiens
tcagacctgggt

SEQ ID NO: 5040543 - DNA, 23 bp, Homo sapiens
tcagcaaggtgagagaggtaccc

SEQ ID NO: 5040544 - DNA, 23 bp, Homo sapiens
tcagccaccatcctattgcaaag

SEQ ID NO: 5040545 - DNA, 21 bp, Homo sapiens
tcaggtatgttgcctttatgg

SEQ ID NO: 5040546 - DNA, 18 bp, Homo sapiens
tcagtccctatgtatttg

SEQ ID NO: 5040547 - DNA, 16 bp, Homo sapiens
tcatcagccaccatcc

SEQ ID NO: 5040548 - DNA, 18 bp, Homo sapiens
tcatcagccaccatccta

SEQ ID NO: 5040549 - DNA, 18 bp, Homo sapiens
tcattgagagttttgtct

SEQ ID NO: 5040550 - DNA, 13 bp, Homo sapiens
tccaactccagga

SEQ ID NO: 5040551 - DNA, 16 bp, Homo sapiens
tccaattgttgacagt

SEQ ID NO: 5040552 - DNA, 22 bp, Homo sapiens
tccacaggggctatcccttctc

SEQ ID NO: 5040553 - DNA, 12 bp, Homo sapiens
tccactggagaa

SEQ ID NO: 5040554 - DNA, 23 bp, Homo sapiens
tccaggggtcaccttgagaggca

SEQ ID NO: 5040555 - DNA, 13 bp, Homo sapiens
tcctgtatgttgt

SEQ ID NO: 5040556 - DNA, 17 bp, Homo sapiens
tcctttccaaggcttct

SEQ ID NO: 5040557 - DNA, 20 bp, Homo sapiens
tcctttgtgtttctattgac

SEQ ID NO: 5040558 - DNA, 14 bp, Homo sapiens
tcgaaaagagcact

SEQ ID NO: 5040559 - DNA, 12 bp, Homo sapiens
tcgtttctgtat

SEQ ID NO: 5040560 - DNA, 22 bp, Homo sapiens
tctactaaaaacacaaaaatta

SEQ ID NO: 5040561 - DNA, 14 bp, Homo sapiens
tctatatatgtgta

SEQ ID NO: 5040562 - DNA, 12 bp, Homo sapiens
tctatgctctcg

SEQ ID NO: 5040563 - DNA, 15 bp, Homo sapiens
tctcactctgctttg

SEQ ID NO: 5040564 - DNA, 23 bp, Homo sapiens
tctcagaaaacttctcttctgag

SEQ ID NO: 5040565 - DNA, 21 bp, Homo sapiens
tctccagaaccagtgtctgaa

SEQ ID NO: 5040566 - DNA, 18 bp, Homo sapiens
tctcttcttttggcttcc

SEQ ID NO: 5040567 - DNA, 19 bp, Homo sapiens
tctgtagattctgtggaac

SEQ ID NO: 5040568 - DNA, 15 bp, Homo sapiens
tctgtatacaaccct

SEQ ID NO: 5040569 - DNA, 14 bp, Homo sapiens
tctgtgagttctgt

SEQ ID NO: 5040570 - DNA, 13 bp, Homo sapiens
tcttaggggcttg

SEQ ID NO: 5040571 - DNA, 21 bp, Homo sapiens
tcttagtttggattcttatgt

SEQ ID NO: 5040572 - DNA, 12 bp, Homo sapiens
tcttctgagcct

SEQ ID NO: 5040573 - DNA, 16 bp, Homo sapiens
tcttcttttggcttcc

SEQ ID NO: 5040574 - DNA, 18 bp, Homo sapiens
tcttcttttggcttccat

SEQ ID NO: 5040575 - DNA, 23 bp, Homo sapiens
tcttgaaagattcaggtatgttg

SEQ ID NO: 5040576 - DNA, 16 bp, Homo sapiens
tcttgagccctcctgg

SEQ ID NO: 5040577 - DNA, 17 bp, Homo sapiens
tctttaacagctttctc

SEQ ID NO: 5040578 - DNA, 18 bp, Homo sapiens
tctttctgagcacacttt

SEQ ID NO: 5040579 - DNA, 21 bp, Homo sapiens
tctttctgagcacactttagt

SEQ ID NO: 5040580 - DNA, 22 bp, Homo sapiens
tcttttcacatagctgtctaga

SEQ ID NO: 5040581 - DNA, 13 bp, Homo sapiens
tcttttggcttcc

SEQ ID NO: 5040582 - DNA, 19 bp, Homo sapiens
tgaaaaattcctttgtgtt

SEQ ID NO: 5040583 - DNA, 16 bp, Homo sapiens
tgaaaaggactcttga

SEQ ID NO: 5040584 - DNA, 19 bp, Homo sapiens
tgaaaaggactcttgagcc

SEQ ID NO: 5040585 - DNA, 21 bp, Homo sapiens
tgaaaatattttttatatata

SEQ ID NO: 5040586 - DNA, 21 bp, Homo sapiens
tgaaagattcaggtatgttgc

SEQ ID NO: 5040587 - DNA, 20 bp, Homo sapiens
tgaacagaaaacattctgat

SEQ ID NO: 5040588 - DNA, 14 bp, Homo sapiens
tgacaactgaagag

SEQ ID NO: 5040589 - DNA, 17 bp, Homo sapiens
tgacaactgaagagaca

SEQ ID NO: 5040590 - DNA, 18 bp, Homo sapiens
tgacaactgaagagacac

SEQ ID NO: 5040591 - DNA, 16 bp, Homo sapiens
tgacagttctgaagaa

SEQ ID NO: 5040592 - DNA, 23 bp, Homo sapiens
tgacttcaatgatagtaagaaaa

SEQ ID NO: 5040593 - DNA, 15 bp, Homo sapiens
tgagaggcatgacag

SEQ ID NO: 5040594 - DNA, 18 bp, Homo sapiens
tgagaggcatgacagctg

SEQ ID NO: 5040595 - DNA, 18 bp, Homo sapiens
tgagagttttgtcttgaa

SEQ ID NO: 5040596 - DNA, 13 bp, Homo sapiens
tgagcacacttta

SEQ ID NO: 5040597 - DNA, 14 bp, Homo sapiens
tgaggaggaagcag

SEQ ID NO: 5040598 - DNA, 15 bp, Homo sapiens
tgaggaggaagcaga

SEQ ID NO: 5040599 - DNA, 14 bp, Homo sapiens
tgaggttcagcaag

SEQ ID NO: 5040600 - DNA, 13 bp, Homo sapiens
tgatcagcagaga

SEQ ID NO: 5040601 - DNA, 18 bp, Homo sapiens
tgatccttatgatgtcca

SEQ ID NO: 5040602 - DNA, 19 bp, Homo sapiens
tgcaatcctgtctttctga

SEQ ID NO: 5040603 - DNA, 21 bp, Homo sapiens
tgcacttaaggcactctgtta

SEQ ID NO: 5040604 - DNA, 22 bp, Homo sapiens
tgcagctggtctgtttccaggt

SEQ ID NO: 5040605 - DNA, 16 bp, Homo sapiens
tgcatgatctgtcaaa

SEQ ID NO: 5040606 - DNA, 19 bp, Homo sapiens
tgcatttttatctgtgagt

SEQ ID NO: 5040607 - DNA, 11 bp, Homo sapiens
tgccaggcagg

SEQ ID NO: 5040608 - DNA, 15 bp, Homo sapiens
tgccatactttgtct

SEQ ID NO: 5040609 - DNA, 14 bp, Homo sapiens
tgccatatttttga

SEQ ID NO: 5040610 - DNA, 16 bp, Homo sapiens
tgcctgtacaagctga

SEQ ID NO: 5040611 - DNA, 12 bp, Homo sapiens
tgctcctcaggg

SEQ ID NO: 5040612 - DNA, 13 bp, Homo sapiens
tgctcctcagggt

SEQ ID NO: 5040613 - DNA, 23 bp, Homo sapiens
tgctcttctgtggaccactgcat

SEQ ID NO: 5040614 - DNA, 22 bp, Homo sapiens
tggaactctcctgctcctcagg

SEQ ID NO: 5040615 - DNA, 20 bp, Homo sapiens
tggaccactgcatgagcttt

SEQ ID NO: 5040616 - DNA, 13 bp, Homo sapiens
tggactaagaaga

SEQ ID NO: 5040617 - DNA, 22 bp, Homo sapiens
tggagagaactgattgtgagct

SEQ ID NO: 5040618 - DNA, 21 bp, Homo sapiens
tggaggttgccgtgagccaag

SEQ ID NO: 5040619 - DNA, 15 bp, Homo sapiens
tggagttcccgtgca

SEQ ID NO: 5040620 - DNA, 22 bp, Homo sapiens
tggatagaaaattatgcagctt

SEQ ID NO: 5040621 - DNA, 18 bp, Homo sapiens
tggcattatgtccactgt

SEQ ID NO: 5040622 - DNA, 13 bp, Homo sapiens
tggctattaaaaa

SEQ ID NO: 5040623 - DNA, 17 bp, Homo sapiens
tggctttcattattagt

SEQ ID NO: 5040624 - DNA, 22 bp, Homo sapiens
tgggcagatcatttgaggccag

SEQ ID NO: 5040625 - DNA, 14 bp, Homo sapiens
tggggttgtgttgt

SEQ ID NO: 5040626 - DNA, 21 bp, Homo sapiens
tggttgttagttatagatgtc

SEQ ID NO: 5040627 - DNA, 13 bp, Homo sapiens
tgtaaatacataa

SEQ ID NO: 5040628 - DNA, 16 bp, Homo sapiens
tgtaactgggttcaaa

SEQ ID NO: 5040629 - DNA, 19 bp, Homo sapiens
tgtacatggcagagtttgt

SEQ ID NO: 5040630 - DNA, 23 bp, Homo sapiens
tgtagcctggatattattcttgt

SEQ ID NO: 5040631 - DNA, 16 bp, Homo sapiens
tgtagttttacttggt

SEQ ID NO: 5040632 - DNA, 23 bp, Homo sapiens
tgtccaattgttgacagttctga

SEQ ID NO: 5040633 - DNA, 22 bp, Homo sapiens
tgtctgaaaaattcctttgtgt

SEQ ID NO: 5040634 - DNA, 12 bp, Homo sapiens
tgtctttctgag

SEQ ID NO: 5040635 - DNA, 13 bp, Homo sapiens
tgtcttttgaata

SEQ ID NO: 5040636 - DNA, 18 bp, Homo sapiens
tgtgtgttgtcttgaaag

SEQ ID NO: 5040637 - DNA, 11 bp, Homo sapiens
tgttcagaaga

SEQ ID NO: 5040638 - DNA, 12 bp, Homo sapiens
tgttcatacatt

SEQ ID NO: 5040639 - DNA, 19 bp, Homo sapiens
tgttccttagaccttccat

SEQ ID NO: 5040640 - DNA, 17 bp, Homo sapiens
tgtttccaggtcagaaa

SEQ ID NO: 5040641 - DNA, 15 bp, Homo sapiens
tgttttattcctgta

SEQ ID NO: 5040642 - DNA, 17 bp, Homo sapiens
ttaaaggatgttggtgt

SEQ ID NO: 5040643 - DNA, 14 bp, Homo sapiens
ttaaggaaacaata

SEQ ID NO: 5040644 - DNA, 17 bp, Homo sapiens
ttaccagaagcttccat

SEQ ID NO: 5040645 - DNA, 16 bp, Homo sapiens
ttaccctttagactgt

SEQ ID NO: 5040646 - DNA, 12 bp, Homo sapiens
ttacctctttaa

SEQ ID NO: 5040647 - DNA, 18 bp, Homo sapiens
ttagactacatttagaga

SEQ ID NO: 5040648 - DNA, 19 bp, Homo sapiens
ttagactcatcttactgta

SEQ ID NO: 5040649 - DNA, 14 bp, Homo sapiens
ttagactgtagcct

SEQ ID NO: 5040650 - DNA, 23 bp, Homo sapiens
ttagctgatgaacttattctgta

SEQ ID NO: 5040651 - DNA, 15 bp, Homo sapiens
ttatatatacagtaa

SEQ ID NO: 5040652 - DNA, 20 bp, Homo sapiens
ttatattttaaagcttggtg

SEQ ID NO: 5040653 - DNA, 15 bp, Homo sapiens
ttattcctgtatgtt

SEQ ID NO: 5040654 - DNA, 17 bp, Homo sapiens
ttatttagactcatctt

SEQ ID NO: 5040655 - DNA, 18 bp, Homo sapiens
ttatttagactcatctta

SEQ ID NO: 5040656 - DNA, 16 bp, Homo sapiens
ttcaatgatagtaaga

SEQ ID NO: 5040657 - DNA, 13 bp, Homo sapiens
ttcacacagacaa

SEQ ID NO: 5040658 - DNA, 18 bp, Homo sapiens
ttcacatagctgtctaga

SEQ ID NO: 5040659 - DNA, 20 bp, Homo sapiens
ttcactgcatggctcccaca

SEQ ID NO: 5040660 - DNA, 16 bp, Homo sapiens
ttcaggtatgttgcct

SEQ ID NO: 5040661 - DNA, 17 bp, Homo sapiens
ttcattgagagttttgt

SEQ ID NO: 5040662 - DNA, 20 bp, Homo sapiens
ttcccaatagcaacgtagct

SEQ ID NO: 5040663 - DNA, 16 bp, Homo sapiens
ttcgtttctgtataca

SEQ ID NO: 5040664 - DNA, 17 bp, Homo sapiens
ttctattgacttcaatg

SEQ ID NO: 5040665 - DNA, 23 bp, Homo sapiens
ttctattgacttcaatgatagta

SEQ ID NO: 5040666 - DNA, 20 bp, Homo sapiens
ttcttaggcaccatagaaga

SEQ ID NO: 5040667 - DNA, 14 bp, Homo sapiens
ttcttttggcttcc

SEQ ID NO: 5040668 - DNA, 15 bp, Homo sapiens
ttgaaagattcaggt

SEQ ID NO: 5040669 - DNA, 11 bp, Homo sapiens
ttgaaggaaac

SEQ ID NO: 5040670 - DNA, 18 bp, Homo sapiens
ttgaaggaaccaagtgca

SEQ ID NO: 5040671 - DNA, 16 bp, Homo sapiens
ttgaatgtcttttgaa

SEQ ID NO: 5040672 - DNA, 17 bp, Homo sapiens
ttgaatgtcttttgaat

SEQ ID NO: 5040673 - DNA, 18 bp, Homo sapiens
ttgagagttttgtcttga

SEQ ID NO: 5040674 - DNA, 12 bp, Homo sapiens
ttgaggaggaag

SEQ ID NO: 5040675 - DNA, 17 bp, Homo sapiens
ttgcacgttaaaaatta

SEQ ID NO: 5040676 - DNA, 13 bp, Homo sapiens
ttgcagttcacct

SEQ ID NO: 5040677 - DNA, 22 bp, Homo sapiens
ttgccatactttgtctgaaaaa

SEQ ID NO: 5040678 - DNA, 19 bp, Homo sapiens
ttgtccaattgttgacagt

SEQ ID NO: 5040679 - DNA, 15 bp, Homo sapiens
ttgtcttgaatgtct

SEQ ID NO: 5040680 - DNA, 18 bp, Homo sapiens
ttgttgacagttctgaag

SEQ ID NO: 5040681 - DNA, 23 bp, Homo sapiens
ttgttgtttgccatactttgtct

SEQ ID NO: 5040682 - DNA, 16 bp, Homo sapiens
ttgtttgccatacttt

SEQ ID NO: 5040683 - DNA, 15 bp, Homo sapiens
tttaacagctttctc

SEQ ID NO: 5040684 - DNA, 21 bp, Homo sapiens
tttaatcccggtttcagaagc

SEQ ID NO: 5040685 - DNA, 19 bp, Homo sapiens
tttaccttgaacaatcaag

SEQ ID NO: 5040686 - DNA, 23 bp, Homo sapiens
tttagctgatgaacttattctgt

SEQ ID NO: 5040687 - DNA, 21 bp, Homo sapiens
tttatggtttcccccttctac

SEQ ID NO: 5040688 - DNA, 23 bp, Homo sapiens
tttctccagaaccagtgtctgaa

SEQ ID NO: 5040689 - DNA, 20 bp, Homo sapiens
tttgaaggaaacagttaata

SEQ ID NO: 5040690 - DNA, 22 bp, Homo sapiens
tttgatatgggctttctctttg

SEQ ID NO: 5040691 - DNA, 20 bp, Homo sapiens
tttgcactggagttctatgc

SEQ ID NO: 5040692 - DNA, 18 bp, Homo sapiens
tttggattcttatgtagc

SEQ ID NO: 5040693 - DNA, 21 bp, Homo sapiens
tttgtgttcctctttgcatga

SEQ ID NO: 5040694 - DNA, 14 bp, Homo sapiens
tttttatatataca

SEQ ID NO: 5040695 - DNA, 18 bp, Homo sapiens
aaatccacaccagtccac

SEQ ID NO: 5040696 - DNA, 15 bp, Homo sapiens
aacaggagtgactct

SEQ ID NO: 5040697 - DNA, 20 bp, Homo sapiens
aacaggagtgactctggctg

SEQ ID NO: 5040698 - DNA, 16 bp, Homo sapiens
aacgctgacttgcaga

SEQ ID NO: 5040699 - DNA, 21 bp, Homo sapiens
aagaaccaggaggcctgggag

SEQ ID NO: 5040700 - DNA, 17 bp, Homo sapiens
aagacaccttcccagct

SEQ ID NO: 5040701 - DNA, 15 bp, Homo sapiens
aagccaggccctctc

SEQ ID NO: 5040702 - DNA, 19 bp, Homo sapiens
aagccaggccctctctgca

SEQ ID NO: 5040703 - DNA, 13 bp, Homo sapiens
acacaggctgccg

SEQ ID NO: 5040704 - DNA, 14 bp, Homo sapiens
accacgtctccctg

SEQ ID NO: 5040705 - DNA, 17 bp, Homo sapiens
accagtccacgccgggt

SEQ ID NO: 5040706 - DNA, 19 bp, Homo sapiens
accccaccctgtctgcagg

SEQ ID NO: 5040707 - DNA, 20 bp, Homo sapiens
accccaccctgtctgcaggc

SEQ ID NO: 5040708 - DNA, 17 bp, Homo sapiens
acccccacctccctgca

SEQ ID NO: 5040709 - DNA, 18 bp, Homo sapiens
acccccacctccctgcag

SEQ ID NO: 5040710 - DNA, 19 bp, Homo sapiens
acccccacctccctgcagc

SEQ ID NO: 5040711 - DNA, 19 bp, Homo sapiens
acccctgaactggccccag

SEQ ID NO: 5040712 - DNA, 23 bp, Homo sapiens
acccctgaactggccccagctcc

SEQ ID NO: 5040713 - DNA, 12 bp, Homo sapiens
accctcccaggt

SEQ ID NO: 5040714 - DNA, 23 bp, Homo sapiens
accctgtctgcaggccaccccca

SEQ ID NO: 5040715 - DNA, 13 bp, Homo sapiens
accgggcttcctc

SEQ ID NO: 5040716 - DNA, 18 bp, Homo sapiens
accgggtggcagcgccca

SEQ ID NO: 5040717 - DNA, 20 bp, Homo sapiens
accgggtggcagcgcccagc

SEQ ID NO: 5040718 - DNA, 15 bp, Homo sapiens
acctgccccaggctc

SEQ ID NO: 5040719 - DNA, 16 bp, Homo sapiens
acctgccccaggctca

SEQ ID NO: 5040720 - DNA, 12 bp, Homo sapiens
accttcccagct

SEQ ID NO: 5040721 - DNA, 17 bp, Homo sapiens
accttcccagctgctcc

SEQ ID NO: 5040722 - DNA, 19 bp, Homo sapiens
acgtcctgggtgctgtcat

SEQ ID NO: 5040723 - DNA, 16 bp, Homo sapiens
acgtggccgctgccca

SEQ ID NO: 5040724 - DNA, 17 bp, Homo sapiens
acgtggccgctgcccac

SEQ ID NO: 5040725 - DNA, 14 bp, Homo sapiens
actcagtcagccca

SEQ ID NO: 5040726 - DNA, 14 bp, Homo sapiens
actctgaccgggct

SEQ ID NO: 5040727 - DNA, 14 bp, Homo sapiens
acttcccaggccga

SEQ ID NO: 5040728 - DNA, 16 bp, Homo sapiens
agaaggccccagggca

SEQ ID NO: 5040729 - DNA, 21 bp, Homo sapiens
agaccccaccctgtctgcagg

SEQ ID NO: 5040730 - DNA, 12 bp, Homo sapiens
agaccctgccag

SEQ ID NO: 5040731 - DNA, 14 bp, Homo sapiens
agaccctgccaggg

SEQ ID NO: 5040732 - DNA, 11 bp, Homo sapiens
agagcctgggc

SEQ ID NO: 5040733 - DNA, 19 bp, Homo sapiens
agaggggacaagccaggcc

SEQ ID NO: 5040734 - DNA, 15 bp, Homo sapiens
agcaggagcatggcc

SEQ ID NO: 5040735 - DNA, 19 bp, Homo sapiens
agcagggctgggcgcctct

SEQ ID NO: 5040736 - DNA, 21 bp, Homo sapiens
agccaggccctctctgcagtc

SEQ ID NO: 5040737 - DNA, 17 bp, Homo sapiens
atggggcggcctgcaga

SEQ ID NO: 5040738 - DNA, 18 bp, Homo sapiens
atggggtgggagccacag

SEQ ID NO: 5040739 - DNA, 14 bp, Homo sapiens
caaaccaggctgca

SEQ ID NO: 5040740 - DNA, 16 bp, Homo sapiens
caaaccaggctgcagg

SEQ ID NO: 5040741 - DNA, 16 bp, Homo sapiens
caacttcccaggccga

SEQ ID NO: 5040742 - DNA, 21 bp, Homo sapiens
cacagccccaaacaagcgcca

SEQ ID NO: 5040743 - DNA, 14 bp, Homo sapiens
cacaggctgccgct

SEQ ID NO: 5040744 - DNA, 17 bp, Homo sapiens
cacagggacgacccggg

SEQ ID NO: 5040745 - DNA, 18 bp, Homo sapiens
caccagtccacgccgggt

SEQ ID NO: 5040746 - DNA, 19 bp, Homo sapiens
caccagtccacgccgggtc

SEQ ID NO: 5040747 - DNA, 16 bp, Homo sapiens
caccctgtctgcaggc

SEQ ID NO: 5040748 - DNA, 13 bp, Homo sapiens
cacctccctgcag

SEQ ID NO: 5040749 - DNA, 12 bp, Homo sapiens
cacctgccaggc

SEQ ID NO: 5040750 - DNA, 15 bp, Homo sapiens
cacctgccaggctgc

SEQ ID NO: 5040751 - DNA, 13 bp, Homo sapiens
cacctgccccagg

SEQ ID NO: 5040752 - DNA, 14 bp, Homo sapiens
cacctgccccaggc

SEQ ID NO: 5040753 - DNA, 22 bp, Homo sapiens
cacctgccccaggctcaggctg

SEQ ID NO: 5040754 - DNA, 16 bp, Homo sapiens
cacgtcccgggcactg

SEQ ID NO: 5040755 - DNA, 16 bp, Homo sapiens
cacgtctccctggccc

SEQ ID NO: 5040756 - DNA, 15 bp, Homo sapiens
cactctgaccgggct

SEQ ID NO: 5040757 - DNA, 18 bp, Homo sapiens
cactgagaaggccccagg

SEQ ID NO: 5040758 - DNA, 21 bp, Homo sapiens
cactgagaaggccccagggca

SEQ ID NO: 5040759 - DNA, 16 bp, Homo sapiens
cactgcccacctgcca

SEQ ID NO: 5040760 - DNA, 19 bp, Homo sapiens
cactgcccacctgccaggc

SEQ ID NO: 5040761 - DNA, 22 bp, Homo sapiens
cactgcccacctgccaggctgc

SEQ ID NO: 5040762 - DNA, 23 bp, Homo sapiens
cactggccggcccacgtcctggg

SEQ ID NO: 5040763 - DNA, 23 bp, Homo sapiens
cacttccctgcaaggtgcacctg

SEQ ID NO: 5040764 - DNA, 13 bp, Homo sapiens
cactttggccaca

SEQ ID NO: 5040765 - DNA, 21 bp, Homo sapiens
cagaccccaccctgtctgcag

SEQ ID NO: 5040766 - DNA, 23 bp, Homo sapiens
cagaccccaccctgtctgcaggc

SEQ ID NO: 5040767 - DNA, 13 bp, Homo sapiens
cagaccctgccag

SEQ ID NO: 5040768 - DNA, 13 bp, Homo sapiens
cagagcctgggcg

SEQ ID NO: 5040769 - DNA, 13 bp, Homo sapiens
cagcctggcccca

SEQ ID NO: 5040770 - DNA, 16 bp, Homo sapiens
cagcgcccagcctggc

SEQ ID NO: 5040771 - DNA, 17 bp, Homo sapiens
cagcggctcttcctgga

SEQ ID NO: 5040772 - DNA, 21 bp, Homo sapiens
cagctccggaaggacacagtc

SEQ ID NO: 5040773 - DNA, 14 bp, Homo sapiens
cagcttggagtgcc

SEQ ID NO: 5040774 - DNA, 17 bp, Homo sapiens
caggacagatcaggtca

SEQ ID NO: 5040775 - DNA, 23 bp, Homo sapiens
caggagcatggccgcaacttccc

SEQ ID NO: 5040776 - DNA, 18 bp, Homo sapiens
caggcggtcactgcccac

SEQ ID NO: 5040777 - DNA, 14 bp, Homo sapiens
caggctcaggctgc

SEQ ID NO: 5040778 - DNA, 18 bp, Homo sapiens
caggctcaggctgcccag

SEQ ID NO: 5040779 - DNA, 19 bp, Homo sapiens
caggctcaggctgcccagc

SEQ ID NO: 5040780 - DNA, 22 bp, Homo sapiens
caggctgccgctgctctcccag

SEQ ID NO: 5040781 - DNA, 21 bp, Homo sapiens
cagggctgggcgcctctgtcc

SEQ ID NO: 5040782 - DNA, 18 bp, Homo sapiens
caggggcccctcctccag

SEQ ID NO: 5040783 - DNA, 16 bp, Homo sapiens
caggtcagagcccagg

SEQ ID NO: 5040784 - DNA, 17 bp, Homo sapiens
caggtgttttccttcac

SEQ ID NO: 5040785 - DNA, 14 bp, Homo sapiens
cagtaaatccacag

SEQ ID NO: 5040786 - DNA, 17 bp, Homo sapiens
cagtaaatccacagtga

SEQ ID NO: 5040787 - DNA, 18 bp, Homo sapiens
cagtcattctagagggat

SEQ ID NO: 5040788 - DNA, 13 bp, Homo sapiens
cagtgagagcagg

SEQ ID NO: 5040789 - DNA, 15 bp, Homo sapiens
cagttgggtgtgaga

SEQ ID NO: 5040790 - DNA, 15 bp, Homo sapiens
catgcccagcttgga

SEQ ID NO: 5040791 - DNA, 17 bp, Homo sapiens
catggccgcaacttccc

SEQ ID NO: 5040792 - DNA, 12 bp, Homo sapiens
catggcttgggc

SEQ ID NO: 5040793 - DNA, 20 bp, Homo sapiens
cattgaagggggatgcaggc

SEQ ID NO: 5040794 - DNA, 16 bp, Homo sapiens
ccaccctgtctgcagg

SEQ ID NO: 5040795 - DNA, 18 bp, Homo sapiens
ccacctgccaggctgcag

SEQ ID NO: 5040796 - DNA, 15 bp, Homo sapiens
ccacgtctccctggc

SEQ ID NO: 5040797 - DNA, 16 bp, Homo sapiens
ccacttccctgcaagg

SEQ ID NO: 5040798 - DNA, 17 bp, Homo sapiens
ccacttccctgcaaggt

SEQ ID NO: 5040799 - DNA, 16 bp, Homo sapiens
ccagagcctgggcgca

SEQ ID NO: 5040800 - DNA, 17 bp, Homo sapiens
ccaggccctctctgcag

SEQ ID NO: 5040801 - DNA, 15 bp, Homo sapiens
ccaggctcaggctgc

SEQ ID NO: 5040802 - DNA, 18 bp, Homo sapiens
ccaggctcaggctgccca

SEQ ID NO: 5040803 - DNA, 13 bp, Homo sapiens
ccaggctgcaggg

SEQ ID NO: 5040804 - DNA, 18 bp, Homo sapiens
ccaggtttcccactgcgg

SEQ ID NO: 5040805 - DNA, 18 bp, Homo sapiens
ccatggccaggagtgggt

SEQ ID NO: 5040806 - DNA, 21 bp, Homo sapiens
ccattgaagggggatgcaggc

SEQ ID NO: 5040807 - DNA, 16 bp, Homo sapiens
cccacctccctgcagc

SEQ ID NO: 5040808 - DNA, 17 bp, Homo sapiens
cccagcggctcttcctg

SEQ ID NO: 5040809 - DNA, 22 bp, Homo sapiens
gtcttagggtacagcccaggcg

SEQ ID NO: 5040810 - DNA, 23 bp, Homo sapiens
gtgacaggcagtgttcttggggg

SEQ ID NO: 5040811 - DNA, 18 bp, Homo sapiens
gtgaccgggggaagctga

SEQ ID NO: 5040812 - DNA, 21 bp, Homo sapiens
gtgaccgggggaagctgagcc

SEQ ID NO: 5040813 - DNA, 13 bp, Homo sapiens
gtgactctggctg

SEQ ID NO: 5040814 - DNA, 16 bp, Homo sapiens
gtgactctggctgcca

SEQ ID NO: 5040815 - DNA, 17 bp, Homo sapiens
gtgactctggctgccaa

SEQ ID NO: 5040816 - DNA, 15 bp, Homo sapiens
gtgagttggggcgac

SEQ ID NO: 5040817 - DNA, 16 bp, Homo sapiens
gtgcacctgccccagg

SEQ ID NO: 5040818 - DNA, 17 bp, Homo sapiens
gtgcacctgccccaggc

SEQ ID NO: 5040819 - DNA, 23 bp, Homo sapiens
gtgggatcttacccacttccctg

SEQ ID NO: 5040820 - DNA, 14 bp, Homo sapiens
gtggggctgcatcc

SEQ ID NO: 5040821 - DNA, 18 bp, Homo sapiens
gtggggttttcacttcct

SEQ ID NO: 5040822 - DNA, 19 bp, Homo sapiens
gtggggttttcacttccta

SEQ ID NO: 5040823 - DNA, 20 bp, Homo sapiens
gtgggtccctgcgtctcctg

SEQ ID NO: 5040824 - DNA, 17 bp, Homo sapiens
gtgggtttccctgcgtc

SEQ ID NO: 5040825 - DNA, 18 bp, Homo sapiens
gtgtcgtaacagcaggag

SEQ ID NO: 5040826 - DNA, 14 bp, Homo sapiens
gtgtgagggcaaac

SEQ ID NO: 5040827 - DNA, 20 bp, Homo sapiens
gtgtgagggcaaaccaggct

SEQ ID NO: 5040828 - DNA, 15 bp, Homo sapiens
gtgttcttgggggtg

SEQ ID NO: 5040829 - DNA, 19 bp, Homo sapiens
gttcacccagcgccctcta

SEQ ID NO: 5040830 - DNA, 18 bp, Homo sapiens
gttggctagtctgtgcct

SEQ ID NO: 5040831 - DNA, 15 bp, Homo sapiens
taaatccacagtgag

SEQ ID NO: 5040832 - DNA, 16 bp, Homo sapiens
tactcagtcagcccag

SEQ ID NO: 5040833 - DNA, 21 bp, Homo sapiens
tactcagtcagcccagtggga

SEQ ID NO: 5040834 - DNA, 19 bp, Homo sapiens
tactttgtcttgatcctca

SEQ ID NO: 5040835 - DNA, 20 bp, Homo sapiens
tagaggggacaagccaggcc

SEQ ID NO: 5040836 - DNA, 18 bp, Homo sapiens
tagggtacagcccaggcg

SEQ ID NO: 5040837 - DNA, 16 bp, Homo sapiens
tagtctgtgcctcagt

SEQ ID NO: 5040838 - DNA, 14 bp, Homo sapiens
tagtgccatggcca

SEQ ID NO: 5040839 - DNA, 15 bp, Homo sapiens
tagtgccatggccag

SEQ ID NO: 5040840 - DNA, 16 bp, Homo sapiens
tagtgccatggccagg

SEQ ID NO: 5040841 - DNA, 17 bp, Homo sapiens
tcaaagaaccaggaggc

SEQ ID NO: 5040842 - DNA, 22 bp, Homo sapiens
tcactgagaaggccccagggca

SEQ ID NO: 5040843 - DNA, 17 bp, Homo sapiens
tcactgcccacctgcca

SEQ ID NO: 5040844 - DNA, 18 bp, Homo sapiens
tcactgcccacctgccag

SEQ ID NO: 5040845 - DNA, 14 bp, Homo sapiens
tcacttcctagggt

SEQ ID NO: 5040846 - DNA, 14 bp, Homo sapiens
tcaggctgcccagc

SEQ ID NO: 5040847 - DNA, 16 bp, Homo sapiens
tcaggtcagagcccag

SEQ ID NO: 5040848 - DNA, 14 bp, Homo sapiens
tcagtcagcccagt

SEQ ID NO: 5040849 - DNA, 13 bp, Homo sapiens
tcagtcagctccg

SEQ ID NO: 5040850 - DNA, 13 bp, Homo sapiens
tcccccatgggct

SEQ ID NO: 5040851 - DNA, 19 bp, Homo sapiens
tcccgagggcgcctgggtc

SEQ ID NO: 5040852 - DNA, 20 bp, Homo sapiens
tccctgcaaggtgcacctgc

SEQ ID NO: 5040853 - DNA, 18 bp, Homo sapiens
tccggaaaaatggggttt

SEQ ID NO: 5040854 - DNA, 22 bp, Homo sapiens
tcctagaggggacaagccaggc

SEQ ID NO: 5040855 - DNA, 20 bp, Homo sapiens
tcctcactgagaaggcccca

SEQ ID NO: 5040856 - DNA, 23 bp, Homo sapiens
tcctcactgagaaggccccaggg

SEQ ID NO: 5040857 - DNA, 18 bp, Homo sapiens
tcctccagagcctgggcg

SEQ ID NO: 5040858 - DNA, 13 bp, Homo sapiens
tcctcggcagctc

SEQ ID NO: 5040859 - DNA, 17 bp, Homo sapiens
tcctcttcctgcctctc

SEQ ID NO: 5040860 - DNA, 19 bp, Homo sapiens
tcctggacagtgagagcag

SEQ ID NO: 5040861 - DNA, 16 bp, Homo sapiens
tcctgggtgctgtcat

SEQ ID NO: 5040862 - DNA, 22 bp, Homo sapiens
tcctgggtgctgtcatgcccag

SEQ ID NO: 5040863 - DNA, 16 bp, Homo sapiens
tccttctgatctgaga

SEQ ID NO: 5040864 - DNA, 21 bp, Homo sapiens
tctccctacttagacccagtc

SEQ ID NO: 5040865 - DNA, 16 bp, Homo sapiens
tctctggacctgacca

SEQ ID NO: 5040866 - DNA, 15 bp, Homo sapiens
tctggacctgaccag

SEQ ID NO: 5040867 - DNA, 13 bp, Homo sapiens
tctgtcccgggta

SEQ ID NO: 5040868 - DNA, 14 bp, Homo sapiens
tctgtgcctcagtg

SEQ ID NO: 5040869 - DNA, 15 bp, Homo sapiens
tctgtggcctggggc

SEQ ID NO: 5040870 - DNA, 15 bp, Homo sapiens
tcttacccacttccc

SEQ ID NO: 5040871 - DNA, 19 bp, Homo sapiens
tcttagggtacagcccagg

SEQ ID NO: 5040872 - DNA, 21 bp, Homo sapiens
tcttagggtacagcccaggcg

SEQ ID NO: 5040873 - DNA, 17 bp, Homo sapiens
tcttcctgcctctctca

SEQ ID NO: 5040874 - DNA, 18 bp, Homo sapiens
tcttcctggacagtgaga

SEQ ID NO: 5040875 - DNA, 23 bp, Homo sapiens
tcttcctggacagtgagagcagg

SEQ ID NO: 5040876 - DNA, 14 bp, Homo sapiens
tcttgagagcccca

SEQ ID NO: 5040877 - DNA, 22 bp, Homo sapiens
tgaccagactgtgggtccctgc

SEQ ID NO: 5040878 - DNA, 23 bp, Homo sapiens
tgacggcagtaaatccacagtga

SEQ ID NO: 5040879 - DNA, 18 bp, Homo sapiens
tgactctggctgccaaga

SEQ ID NO: 5040880 - DNA, 14 bp, Homo sapiens
tgagaaggccccag

SEQ ID NO: 5040881 - DNA, 14 bp, Homo sapiens
tgagagcagggctg

SEQ ID NO: 5040882 - DNA, 19 bp, Homo sapiens
tgagagcagggctgggcgc

SEQ ID NO: 5040883 - DNA, 16 bp, Homo sapiens
tgaggaccctcccagg

SEQ ID NO: 5040884 - DNA, 17 bp, Homo sapiens
tgaggaccctcccaggt

SEQ ID NO: 5040885 - DNA, 19 bp, Homo sapiens
tgaggctggcggggtctgc

SEQ ID NO: 5040886 - DNA, 20 bp, Homo sapiens
tgagggcaaaccaggctgca

SEQ ID NO: 5040887 - DNA, 17 bp, Homo sapiens
tgcaaggtgcacctgcc

SEQ ID NO: 5040888 - DNA, 18 bp, Homo sapiens
tgcaaggtgcacctgccc

SEQ ID NO: 5040889 - DNA, 16 bp, Homo sapiens
tgcagaccctgccagg

SEQ ID NO: 5040890 - DNA, 21 bp, Homo sapiens
tgcaggccacccccacctccc

SEQ ID NO: 5040891 - DNA, 15 bp, Homo sapiens
tgcagggacagttgg

SEQ ID NO: 5040892 - DNA, 20 bp, Homo sapiens
tgcagggacagttgggtgtg

SEQ ID NO: 5040893 - DNA, 23 bp, Homo sapiens
tgcaggtggggttttcacttcct

SEQ ID NO: 5040894 - DNA, 17 bp, Homo sapiens
tgccacatggccgctgc

SEQ ID NO: 5040895 - DNA, 17 bp, Homo sapiens
tgccacgtggccgctgc

SEQ ID NO: 5040896 - DNA, 13 bp, Homo sapiens
tgccaggctgcag

SEQ ID NO: 5040897 - DNA, 15 bp, Homo sapiens
tgccaggctgcaggg

SEQ ID NO: 5040898 - DNA, 19 bp, Homo sapiens
tgcccacgtcccgggcact

SEQ ID NO: 5040899 - DNA, 18 bp, Homo sapiens
ctcggcctcttgagagcc

SEQ ID NO: 5040900 - DNA, 16 bp, Homo sapiens
ctctcatggcttgggc

SEQ ID NO: 5040901 - DNA, 22 bp, Homo sapiens
ctctctggacctgaccagactg

SEQ ID NO: 5040902 - DNA, 20 bp, Homo sapiens
ctctgcagtcctcggcagct

SEQ ID NO: 5040903 - DNA, 17 bp, Homo sapiens
ctctggacctgaccaga

SEQ ID NO: 5040904 - DNA, 15 bp, Homo sapiens
ctgaactggccccag

SEQ ID NO: 5040905 - DNA, 16 bp, Homo sapiens
ctgagaaggccccagg

SEQ ID NO: 5040906 - DNA, 17 bp, Homo sapiens
ctgagaaggccccaggg

SEQ ID NO: 5040907 - DNA, 18 bp, Homo sapiens
ctgagcccctccctcctg

SEQ ID NO: 5040908 - DNA, 23 bp, Homo sapiens
ctgagctactgcttctaacacct

SEQ ID NO: 5040909 - DNA, 19 bp, Homo sapiens
ctgcagctttgaggctggc

SEQ ID NO: 5040910 - DNA, 14 bp, Homo sapiens
ctgcatccaaggct

SEQ ID NO: 5040911 - DNA, 13 bp, Homo sapiens
ctgccaggctgca

SEQ ID NO: 5040912 - DNA, 19 bp, Homo sapiens
ctgccaggctgcagggaca

SEQ ID NO: 5040913 - DNA, 13 bp, Homo sapiens
ctgcccacctgcc

SEQ ID NO: 5040914 - DNA, 15 bp, Homo sapiens
ctgcccacctgccag

SEQ ID NO: 5040915 - DNA, 22 bp, Homo sapiens
ctgcccactctgaccgggcttc

SEQ ID NO: 5040916 - DNA, 21 bp, Homo sapiens
ctgcccagcggctcttcctgg

SEQ ID NO: 5040917 - DNA, 12 bp, Homo sapiens
ctgccccaggct

SEQ ID NO: 5040918 - DNA, 22 bp, Homo sapiens
ctgccccaggctcaggctgccc

SEQ ID NO: 5040919 - DNA, 17 bp, Homo sapiens
ctgcctctctcatggct

SEQ ID NO: 5040920 - DNA, 12 bp, Homo sapiens
ctgctcctggga

SEQ ID NO: 5040921 - DNA, 13 bp, Homo sapiens
ctgctctcccagg

SEQ ID NO: 5040922 - DNA, 18 bp, Homo sapiens
ctggacagtgagagcagg

SEQ ID NO: 5040923 - DNA, 21 bp, Homo sapiens
ctggaccacgtctccctggcc

SEQ ID NO: 5040924 - DNA, 15 bp, Homo sapiens
ctggacctgaccaga

SEQ ID NO: 5040925 - DNA, 23 bp, Homo sapiens
ctggccccagctcctcttcctgc

SEQ ID NO: 5040926 - DNA, 14 bp, Homo sapiens
ctggccccagtgac

SEQ ID NO: 5040927 - DNA, 17 bp, Homo sapiens
ctggcccgggagccgca

SEQ ID NO: 5040928 - DNA, 23 bp, Homo sapiens
ctggccggcccacgtcctgggtg

SEQ ID NO: 5040929 - DNA, 20 bp, Homo sapiens
ctggcggggtctgctcctgg

SEQ ID NO: 5040930 - DNA, 23 bp, Homo sapiens
ctggctttgggtagtgccatggc

SEQ ID NO: 5040931 - DNA, 15 bp, Homo sapiens
ctgggagatgcagct

SEQ ID NO: 5040932 - DNA, 19 bp, Homo sapiens
ctgggagatgcagctggat

SEQ ID NO: 5040933 - DNA, 18 bp, Homo sapiens
ctgggcgcctctgtcctg

SEQ ID NO: 5040934 - DNA, 16 bp, Homo sapiens
ctgggtcctcccagct

SEQ ID NO: 5040935 - DNA, 17 bp, Homo sapiens
ctgggtcctcccagctg

SEQ ID NO: 5040936 - DNA, 19 bp, Homo sapiens
ctggtcccccatgggctgc

SEQ ID NO: 5040937 - DNA, 16 bp, Homo sapiens
ctgtcatgcccagctt

SEQ ID NO: 5040938 - DNA, 13 bp, Homo sapiens
ctgtcctggcccg

SEQ ID NO: 5040939 - DNA, 23 bp, Homo sapiens
ctgtcctggcccgggagccgcag

SEQ ID NO: 5040940 - DNA, 14 bp, Homo sapiens
ctgtctgcaggcca

SEQ ID NO: 5040941 - DNA, 23 bp, Homo sapiens
ctgtgggtccctgcgtctcctgc

SEQ ID NO: 5040942 - DNA, 22 bp, Homo sapiens
cttacccacttccctgcaaggt

SEQ ID NO: 5040943 - DNA, 18 bp, Homo sapiens
cttagggtacagcccagg

SEQ ID NO: 5040944 - DNA, 17 bp, Homo sapiens
cttcaccgccgtggggt

SEQ ID NO: 5040945 - DNA, 14 bp, Homo sapiens
cttctaacacctct

SEQ ID NO: 5040946 - DNA, 19 bp, Homo sapiens
cttcttgggggcagaccag

SEQ ID NO: 5040947 - DNA, 16 bp, Homo sapiens
cttgggggcagaccag

SEQ ID NO: 5040948 - DNA, 21 bp, Homo sapiens
ctttgataattactttccagc

SEQ ID NO: 5040949 - DNA, 21 bp, Homo sapiens
ctttgggtagtgccatggcca

SEQ ID NO: 5040950 - DNA, 20 bp, Homo sapiens
gaacaggagtgactctggct

SEQ ID NO: 5040951 - DNA, 16 bp, Homo sapiens
gaactggccccagctc

SEQ ID NO: 5040952 - DNA, 13 bp, Homo sapiens
gaaggccccaggg

SEQ ID NO: 5040953 - DNA, 18 bp, Homo sapiens
gacaagccaggccctctc

SEQ ID NO: 5040954 - DNA, 16 bp, Homo sapiens
gacacaggctgccgct

SEQ ID NO: 5040955 - DNA, 16 bp, Homo sapiens
gacacagtcaggggcc

SEQ ID NO: 5040956 - DNA, 12 bp, Homo sapiens
gacaccttccca

SEQ ID NO: 5040957 - DNA, 17 bp, Homo sapiens
gacagttgggtgtgaga

SEQ ID NO: 5040958 - DNA, 19 bp, Homo sapiens
gacatgaacgttttctctt

SEQ ID NO: 5040959 - DNA, 22 bp, Homo sapiens
gacatgaacgttttctcttcac

SEQ ID NO: 5040960 - DNA, 20 bp, Homo sapiens
gaccccaccctgtctgcagg

SEQ ID NO: 5040961 - DNA, 13 bp, Homo sapiens
gaccctcccaggt

SEQ ID NO: 5040962 - DNA, 13 bp, Homo sapiens
gacgacccggggc

SEQ ID NO: 5040963 - DNA, 17 bp, Homo sapiens
gagaaggccccagggca

SEQ ID NO: 5040964 - DNA, 13 bp, Homo sapiens
gagagcagggctg

SEQ ID NO: 5040965 - DNA, 16 bp, Homo sapiens
gagagcagggctgggc

SEQ ID NO: 5040966 - DNA, 23 bp, Homo sapiens
gagagccccacccctgaactggc

SEQ ID NO: 5040967 - DNA, 19 bp, Homo sapiens
gagagctcaagtttcagag

SEQ ID NO: 5040968 - DNA, 14 bp, Homo sapiens
gagatgcagctgga

SEQ ID NO: 5040969 - DNA, 21 bp, Homo sapiens
gagatgcatctgtggcctggg

SEQ ID NO: 5040970 - DNA, 20 bp, Homo sapiens
gagcatggccgcaacttccc

SEQ ID NO: 5040971 - DNA, 21 bp, Homo sapiens
gagcatggccgcaacttccca

SEQ ID NO: 5040972 - DNA, 14 bp, Homo sapiens
gagccacagggacg

SEQ ID NO: 5040973 - DNA, 22 bp, Homo sapiens
gagccccacccctgaactggcc

SEQ ID NO: 5040974 - DNA, 13 bp, Homo sapiens
gagccgcaggggc

SEQ ID NO: 5040975 - DNA, 18 bp, Homo sapiens
gagccgcaggggcccctc

SEQ ID NO: 5040976 - DNA, 13 bp, Homo sapiens
gaggaccctccca

SEQ ID NO: 5040977 - DNA, 16 bp, Homo sapiens
gaggaccctcccaggt

SEQ ID NO: 5040978 - DNA, 14 bp, Homo sapiens
gaggctgctgtcac

SEQ ID NO: 5040979 - DNA, 20 bp, Homo sapiens
gagggcaaaccaggctgcag

SEQ ID NO: 5040980 - DNA, 21 bp, Homo sapiens
gagggcaaaccaggctgcagg

SEQ ID NO: 5040981 - DNA, 15 bp, Homo sapiens
gagtgccacgtggcc

SEQ ID NO: 5040982 - DNA, 18 bp, Homo sapiens
gagtgccacgtggccgct

SEQ ID NO: 5040983 - DNA, 19 bp, Homo sapiens
gagtgccacgtggccgctg

SEQ ID NO: 5040984 - DNA, 16 bp, Homo sapiens
gatcttacccacttcc

SEQ ID NO: 5040985 - DNA, 20 bp, Homo sapiens
gatgcatctgtggcctgggg

SEQ ID NO: 5040986 - DNA, 14 bp, Homo sapiens
gcaaaccaggctgc

SEQ ID NO: 5040987 - DNA, 16 bp, Homo sapiens
gcaaaccaggctgcag

SEQ ID NO: 5040988 - DNA, 15 bp, Homo sapiens
gcaacttcccaggcc

SEQ ID NO: 5040989 - DNA, 19 bp, Homo sapiens
gcaagacaccttcccagct

SEQ ID NO: 5040990 - DNA, 23 bp, Homo sapiens
gcaaggtgcacctgccccaggct

SEQ ID NO: 5040991 - DNA, 20 bp, Homo sapiens
gcactgtcatgcccagcttg

SEQ ID NO: 5040992 - DNA, 23 bp, Homo sapiens
gcacttggagcgtttttgctggc

SEQ ID NO: 5040993 - DNA, 22 bp, Homo sapiens
gcagaccccaccctgtctgcag

SEQ ID NO: 5040994 - DNA, 15 bp, Homo sapiens
agcgacacaggctgc

SEQ ID NO: 5040995 - DNA, 16 bp, Homo sapiens
agcgacacaggctgcc

SEQ ID NO: 5040996 - DNA, 18 bp, Homo sapiens
agcgacacaggctgccgc

SEQ ID NO: 5040997 - DNA, 12 bp, Homo sapiens
agctgctcctag

SEQ ID NO: 5040998 - DNA, 15 bp, Homo sapiens
agctggatggggcgg

SEQ ID NO: 5040999 - DNA, 17 bp, Homo sapiens
agcttggagtgccacgt

SEQ ID NO: 5041000 - DNA, 23 bp, Homo sapiens
aggaagggcccccggctcggcct

SEQ ID NO: 5041001 - DNA, 14 bp, Homo sapiens
aggaccctcccagg

SEQ ID NO: 5041002 - DNA, 12 bp, Homo sapiens
aggagaggctgc

SEQ ID NO: 5041003 - DNA, 15 bp, Homo sapiens
aggaggcctgggaga

SEQ ID NO: 5041004 - DNA, 22 bp, Homo sapiens
aggagtgactctggctgccaag

SEQ ID NO: 5041005 - DNA, 16 bp, Homo sapiens
aggccacccccacctc

SEQ ID NO: 5041006 - DNA, 15 bp, Homo sapiens
aggcccggagatgca

SEQ ID NO: 5041007 - DNA, 18 bp, Homo sapiens
aggctcaggctgcccagc

SEQ ID NO: 5041008 - DNA, 18 bp, Homo sapiens
aggctgcccagcggctct

SEQ ID NO: 5041009 - DNA, 21 bp, Homo sapiens
aggctgcccagcggctcttcc

SEQ ID NO: 5041010 - DNA, 18 bp, Homo sapiens
aggctgccgctgctctcc

SEQ ID NO: 5041011 - DNA, 23 bp, Homo sapiens
aggctgccgctgctctcccaggt

SEQ ID NO: 5041012 - DNA, 16 bp, Homo sapiens
agggcaaaccaggctg

SEQ ID NO: 5041013 - DNA, 13 bp, Homo sapiens
agggcgcctgggt

SEQ ID NO: 5041014 - DNA, 19 bp, Homo sapiens
agggctgggcgcctctgtc

SEQ ID NO: 5041015 - DNA, 18 bp, Homo sapiens
aggggcccctcctccaga

SEQ ID NO: 5041016 - DNA, 17 bp, Homo sapiens
agggtacagcccaggcg

SEQ ID NO: 5041017 - DNA, 16 bp, Homo sapiens
agggtctgtcccgggt

SEQ ID NO: 5041018 - DNA, 15 bp, Homo sapiens
aggtgcacctgcccc

SEQ ID NO: 5041019 - DNA, 18 bp, Homo sapiens
aggtgcacctgccccagg

SEQ ID NO: 5041020 - DNA, 18 bp, Homo sapiens
agtaaatccacagtgagt

SEQ ID NO: 5041021 - DNA, 14 bp, Homo sapiens
agtcagcccagtgg

SEQ ID NO: 5041022 - DNA, 17 bp, Homo sapiens
agtcattctagagggat

SEQ ID NO: 5041023 - DNA, 22 bp, Homo sapiens
agtccacgccgggtcgcctgcc

SEQ ID NO: 5041024 - DNA, 15 bp, Homo sapiens
agtcctcggcagctc

SEQ ID NO: 5041025 - DNA, 14 bp, Homo sapiens
agtctgtgcctcag

SEQ ID NO: 5041026 - DNA, 15 bp, Homo sapiens
agtctgtgcctcagt

SEQ ID NO: 5041027 - DNA, 16 bp, Homo sapiens
agtgactctggctgcc

SEQ ID NO: 5041028 - DNA, 17 bp, Homo sapiens
agtgactctggctgcca

SEQ ID NO: 5041029 - DNA, 18 bp, Homo sapiens
agtgactctggctgccaa

SEQ ID NO: 5041030 - DNA, 23 bp, Homo sapiens
agtgccacatggccgctgcccac

SEQ ID NO: 5041031 - DNA, 17 bp, Homo sapiens
agtgccacgtggccgct

SEQ ID NO: 5041032 - DNA, 18 bp, Homo sapiens
agtgccacgtggccgctg

SEQ ID NO: 5041033 - DNA, 23 bp, Homo sapiens
agtgccacgtggccgctgcccac

SEQ ID NO: 5041034 - DNA, 17 bp, Homo sapiens
atcaggtcagagcccag

SEQ ID NO: 5041035 - DNA, 22 bp, Homo sapiens
atcctcactgagaaggccccag

SEQ ID NO: 5041036 - DNA, 13 bp, Homo sapiens
atcgccctgagct

SEQ ID NO: 5041037 - DNA, 14 bp, Homo sapiens
atctgtggcctggg

SEQ ID NO: 5041038 - DNA, 20 bp, Homo sapiens
atgcccagcttggagtgcca

SEQ ID NO: 5041039 - DNA, 21 bp, Homo sapiens
atggccgcaacttcccaggcc

SEQ ID NO: 5041040 - DNA, 22 bp, Homo sapiens
atggccgcaacttcccaggccg

SEQ ID NO: 5041041 - DNA, 18 bp, Homo sapiens
atggggcggcctgcagac

SEQ ID NO: 5041042 - DNA, 16 bp, Homo sapiens
atgtcttcttgggggc

SEQ ID NO: 5041043 - DNA, 19 bp, Homo sapiens
attgactggtcccccatgg

SEQ ID NO: 5041044 - DNA, 12 bp, Homo sapiens
caaaatgcagga

SEQ ID NO: 5041045 - DNA, 15 bp, Homo sapiens
caaaccaggctgcag

SEQ ID NO: 5041046 - DNA, 15 bp, Homo sapiens
caaagaaccaggagg

SEQ ID NO: 5041047 - DNA, 14 bp, Homo sapiens
caaccattgaaggg

SEQ ID NO: 5041048 - DNA, 22 bp, Homo sapiens
caacccctaatcgccctgagct

SEQ ID NO: 5041049 - DNA, 15 bp, Homo sapiens
caacttcccaggccg

SEQ ID NO: 5041050 - DNA, 17 bp, Homo sapiens
caagacaccttcccagc

SEQ ID NO: 5041051 - DNA, 18 bp, Homo sapiens
caagacaccttcccagct

SEQ ID NO: 5041052 - DNA, 12 bp, Homo sapiens
caagccaggccc

SEQ ID NO: 5041053 - DNA, 17 bp, Homo sapiens
caagcgacacaggctgc

SEQ ID NO: 5041054 - DNA, 18 bp, Homo sapiens
caagcgacacaggctgcc

SEQ ID NO: 5041055 - DNA, 21 bp, Homo sapiens
caatgttggctagtctgtgcc

SEQ ID NO: 5041056 - DNA, 23 bp, Homo sapiens
cacatggccgctgcccacgtccc

SEQ ID NO: 5041057 - DNA, 16 bp, Homo sapiens
caccagtccacgccgg

SEQ ID NO: 5041058 - DNA, 18 bp, Homo sapiens
cacctccctgcagctttg

SEQ ID NO: 5041059 - DNA, 14 bp, Homo sapiens
cacctgccaggctg

SEQ ID NO: 5041060 - DNA, 15 bp, Homo sapiens
cacctgccccaggct

SEQ ID NO: 5041061 - DNA, 18 bp, Homo sapiens
cacctgccccaggctcag

SEQ ID NO: 5041062 - DNA, 19 bp, Homo sapiens
caccttcccagctgctcct

SEQ ID NO: 5041063 - DNA, 20 bp, Homo sapiens
cacgcttagggtctgtcccg

SEQ ID NO: 5041064 - DNA, 13 bp, Homo sapiens
cacgtcctgggtg

SEQ ID NO: 5041065 - DNA, 13 bp, Homo sapiens
cactctgaccggg

SEQ ID NO: 5041066 - DNA, 17 bp, Homo sapiens
cactgcccacctgccag

SEQ ID NO: 5041067 - DNA, 18 bp, Homo sapiens
cactgcggaacaggagtg

SEQ ID NO: 5041068 - DNA, 19 bp, Homo sapiens
cactgcggaacaggagtga

SEQ ID NO: 5041069 - DNA, 13 bp, Homo sapiens
cactggctttggg

SEQ ID NO: 5041070 - DNA, 20 bp, Homo sapiens
cactgtcatgcccagcttgg

SEQ ID NO: 5041071 - DNA, 22 bp, Homo sapiens
cactgtcatgcccagcttggag

SEQ ID NO: 5041072 - DNA, 13 bp, Homo sapiens
cacttccctgcaa

SEQ ID NO: 5041073 - DNA, 14 bp, Homo sapiens
cactttggccacag

SEQ ID NO: 5041074 - DNA, 22 bp, Homo sapiens
cagaccccaccctgtctgcagg

SEQ ID NO: 5041075 - DNA, 15 bp, Homo sapiens
cagaccctgccaggg

SEQ ID NO: 5041076 - DNA, 21 bp, Homo sapiens
cagactgtgggtccctgcgtc

SEQ ID NO: 5041077 - DNA, 23 bp, Homo sapiens
cagagcccaggaattctcacagg

SEQ ID NO: 5041078 - DNA, 19 bp, Homo sapiens
cagcgcccagcctggcccc

SEQ ID NO: 5041079 - DNA, 15 bp, Homo sapiens
cagcggctcttcctg

SEQ ID NO: 5041080 - DNA, 15 bp, Homo sapiens
cagctcctcttcctg

SEQ ID NO: 5041081 - DNA, 21 bp, Homo sapiens
cagctcctcttcctgcctctc

SEQ ID NO: 5041082 - DNA, 16 bp, Homo sapiens
caggaggcctgggaga

SEQ ID NO: 5041083 - DNA, 23 bp, Homo sapiens
caggaggcctgggagatgcagct

SEQ ID NO: 5041084 - DNA, 17 bp, Homo sapiens
caggcaagacaccttcc

SEQ ID NO: 5041085 - DNA, 17 bp, Homo sapiens
caggccctctctgcagt

SEQ ID NO: 5041086 - DNA, 12 bp, Homo sapiens
caggctgcccag

SEQ ID NO: 5041087 - DNA, 17 bp, Homo sapiens
cagggacagttgggtgt

SEQ ID NO: 5041088 - DNA, 14 bp, Homo sapiens
cagggacgacccgg

SEQ ID NO: 5041089 - DNA, 18 bp, Homo sapiens
cagggcagcggtcttctc

SEQ ID NO: 5041090 - DNA, 18 bp, Homo sapiens
cagggctgggcgcctctg

SEQ ID NO: 5041091 - DNA, 23 bp, Homo sapiens
cagggctgggcgcctctgtcctg

SEQ ID NO: 5041092 - DNA, 15 bp, Homo sapiens
caggggcccctcctc

SEQ ID NO: 5041093 - DNA, 20 bp, Homo sapiens
cagggggtttgaggaccctc

SEQ ID NO: 5041094 - DNA, 13 bp, Homo sapiens
caggtcagagccc

SEQ ID NO: 5041095 - DNA, 18 bp, Homo sapiens
caggtcagagcccaggaa

SEQ ID NO: 5041096 - DNA, 16 bp, Homo sapiens
cagtcagcccagtggg

SEQ ID NO: 5041097 - DNA, 17 bp, Homo sapiens
cagtgagagcagggctg

SEQ ID NO: 5041098 - DNA, 22 bp, Homo sapiens
cagtgggatcttacccacttcc

SEQ ID NO: 5041099 - DNA, 12 bp, Homo sapiens
catgcccagctt

SEQ ID NO: 5041100 - DNA, 13 bp, Homo sapiens
catggccaggagt

SEQ ID NO: 5041101 - DNA, 17 bp, Homo sapiens
catggccaggagtgggt

SEQ ID NO: 5041102 - DNA, 14 bp, Homo sapiens
catggccgctgccc

SEQ ID NO: 5041103 - DNA, 15 bp, Homo sapiens
catggcttgggctgg

SEQ ID NO: 5041104 - DNA, 19 bp, Homo sapiens
cattactcaaaatgcagga

SEQ ID NO: 5041105 - DNA, 21 bp, Homo sapiens
cattactcaaaatgcaggaca

SEQ ID NO: 5041106 - DNA, 14 bp, Homo sapiens
ccacaccagtccac

SEQ ID NO: 5041107 - DNA, 11 bp, Homo sapiens
ccacagggacg

SEQ ID NO: 5041108 - DNA, 18 bp, Homo sapiens
ccacatggccgctgccca

SEQ ID NO: 5041109 - DNA, 14 bp, Homo sapiens
ccacctccctgcag

SEQ ID NO: 5041110 - DNA, 15 bp, Homo sapiens
ccacctccctgcagc

SEQ ID NO: 5041111 - DNA, 17 bp, Homo sapiens
ccacctccctgcagctt

SEQ ID NO: 5041112 - DNA, 13 bp, Homo sapiens
ccacctgccaggc

SEQ ID NO: 5041113 - DNA, 17 bp, Homo sapiens
ccacctgccaggctgca

SEQ ID NO: 5041114 - DNA, 14 bp, Homo sapiens
ccacgtcccgggca

SEQ ID NO: 5041115 - DNA, 14 bp, Homo sapiens
ccacgtcctgggtg

SEQ ID NO: 5041116 - DNA, 15 bp, Homo sapiens
ccacgtcctgggtgc

SEQ ID NO: 5041117 - DNA, 19 bp, Homo sapiens
ccacgtggccgctgctgtg

SEQ ID NO: 5041118 - DNA, 18 bp, Homo sapiens
ccacttccctgcaaggtg

SEQ ID NO: 5041119 - DNA, 14 bp, Homo sapiens
ccagagcctgggcg

SEQ ID NO: 5041120 - DNA, 15 bp, Homo sapiens
ccagagcctgggcgc

SEQ ID NO: 5041121 - DNA, 14 bp, Homo sapiens
ccagcctggcccca

SEQ ID NO: 5041122 - DNA, 22 bp, Homo sapiens
ccagcggctcttcctggacagt

SEQ ID NO: 5041123 - DNA, 13 bp, Homo sapiens
ccaggaggcctgg

SEQ ID NO: 5041124 - DNA, 15 bp, Homo sapiens
ccaggaggcctggga

SEQ ID NO: 5041125 - DNA, 19 bp, Homo sapiens
ccaggccctctctgcagtc

SEQ ID NO: 5041126 - DNA, 20 bp, Homo sapiens
ccaggccctctctgcagtcc

SEQ ID NO: 5041127 - DNA, 14 bp, Homo sapiens
ccaggctcaggctg

SEQ ID NO: 5041128 - DNA, 20 bp, Homo sapiens
ccaggctcaggctgcccagc

SEQ ID NO: 5041129 - DNA, 18 bp, Homo sapiens
ccaggctgcagggacagt

SEQ ID NO: 5041130 - DNA, 14 bp, Homo sapiens
ccaggctgcaggtg

SEQ ID NO: 5041131 - DNA, 14 bp, Homo sapiens
ccatggccaggagt

SEQ ID NO: 5041132 - DNA, 13 bp, Homo sapiens
cccacctgccagg

SEQ ID NO: 5041133 - DNA, 22 bp, Homo sapiens
cccacctgccaggctgcaggga

SEQ ID NO: 5041134 - DNA, 18 bp, Homo sapiens
cccacgtcccgggcactg

SEQ ID NO: 5041135 - DNA, 16 bp, Homo sapiens
cccacgtcctgggtgc

SEQ ID NO: 5041136 - DNA, 17 bp, Homo sapiens
cccacttccctgcaagg

SEQ ID NO: 5041137 - DNA, 19 bp, Homo sapiens
cccagcctggccccaagca

SEQ ID NO: 5041138 - DNA, 14 bp, Homo sapiens
cccagcgccctcta

SEQ ID NO: 5041139 - DNA, 16 bp, Homo sapiens
cccagctcctcttcct

SEQ ID NO: 5041140 - DNA, 19 bp, Homo sapiens
cccagctcctcttcctgcc

SEQ ID NO: 5041141 - DNA, 17 bp, Homo sapiens
cccagcttggagtgcca

SEQ ID NO: 5041142 - DNA, 15 bp, Homo sapiens
cccaggccgaggaag

SEQ ID NO: 5041143 - DNA, 20 bp, Homo sapiens
cccaggctcaggctgcccag

SEQ ID NO: 5041144 - DNA, 21 bp, Homo sapiens
cccaggctcaggctgcccagc

SEQ ID NO: 5041145 - DNA, 12 bp, Homo sapiens
cccagggcagcg

SEQ ID NO: 5041146 - DNA, 17 bp, Homo sapiens
ccccacctccctgcagc

SEQ ID NO: 5041147 - DNA, 22 bp, Homo sapiens
ccccaggctcaggctgcccagc

SEQ ID NO: 5041148 - DNA, 22 bp, Homo sapiens
cccccggctcggcctcttgaga

SEQ ID NO: 5041149 - DNA, 22 bp, Homo sapiens
cccctcctccagagcctgggcg

SEQ ID NO: 5041150 - DNA, 21 bp, Homo sapiens
cccctgaactggccccagctc

SEQ ID NO: 5041151 - DNA, 23 bp, Homo sapiens
cccctgaactggccccagctcct

SEQ ID NO: 5041152 - DNA, 18 bp, Homo sapiens
cccgggcactgtcatgcc

SEQ ID NO: 5041153 - DNA, 19 bp, Homo sapiens
cccgggcactgtcatgccc

SEQ ID NO: 5041154 - DNA, 23 bp, Homo sapiens
cccgggtactcagtcagcccagt

SEQ ID NO: 5041155 - DNA, 12 bp, Homo sapiens
ccctctctgcag

SEQ ID NO: 5041156 - DNA, 18 bp, Homo sapiens
ccctgaactggccccagc

SEQ ID NO: 5041157 - DNA, 15 bp, Homo sapiens
ccctgcaaggtgcac

SEQ ID NO: 5041158 - DNA, 15 bp, Homo sapiens
ccctgcagctttgag

SEQ ID NO: 5041159 - DNA, 14 bp, Homo sapiens
ccctgtctgcaggc

SEQ ID NO: 5041160 - DNA, 14 bp, Homo sapiens
ccgcaggggcccct

SEQ ID NO: 5041161 - DNA, 17 bp, Homo sapiens
ccgctgctgtgacaggc

SEQ ID NO: 5041162 - DNA, 17 bp, Homo sapiens
ccgctgttttggggtct

SEQ ID NO: 5041163 - DNA, 21 bp, Homo sapiens
ccgggtactcagtcagcccag

SEQ ID NO: 5041164 - DNA, 18 bp, Homo sapiens
ccgggtggcagcgcccag

SEQ ID NO: 5041165 - DNA, 17 bp, Homo sapiens
cctaatcgccctgagct

SEQ ID NO: 5041166 - DNA, 21 bp, Homo sapiens
cctagaggggacaagccaggc

SEQ ID NO: 5041167 - DNA, 23 bp, Homo sapiens
cctagaggggacaagccaggccc

SEQ ID NO: 5041168 - DNA, 20 bp, Homo sapiens
cctcagtgagatcagtcagc

SEQ ID NO: 5041169 - DNA, 23 bp, Homo sapiens
cctcagtgagatcagtcagctcc

SEQ ID NO: 5041170 - DNA, 12 bp, Homo sapiens
cctccctgcagc

SEQ ID NO: 5041171 - DNA, 13 bp, Homo sapiens
cctccctgcagct

SEQ ID NO: 5041172 - DNA, 19 bp, Homo sapiens
cctcctccagagcctgggc

SEQ ID NO: 5041173 - DNA, 21 bp, Homo sapiens
cctcctccagagcctgggcgc

SEQ ID NO: 5041174 - DNA, 22 bp, Homo sapiens
cctcgtcccgagggcgcctggg

SEQ ID NO: 5041175 - DNA, 15 bp, Homo sapiens
cctctctgcagtcct

SEQ ID NO: 5041176 - DNA, 13 bp, Homo sapiens
cctctgtcctggc

SEQ ID NO: 5041177 - DNA, 19 bp, Homo sapiens
cctctgtcctggcccggga

SEQ ID NO: 5041178 - DNA, 21 bp, Homo sapiens
cctgccaggctgcagggacag

SEQ ID NO: 5041179 - DNA, 13 bp, Homo sapiens
cctgccccaggct

SEQ ID NO: 5041180 - DNA, 17 bp, Homo sapiens
cctgcctctctcatggc

SEQ ID NO: 5041181 - DNA, 14 bp, Homo sapiens
cctggccccagtga

SEQ ID NO: 5041182 - DNA, 19 bp, Homo sapiens
cctggcccgggagccgcag

SEQ ID NO: 5041183 - DNA, 16 bp, Homo sapiens
cctgggagatgcagct

SEQ ID NO: 5041184 - DNA, 17 bp, Homo sapiens
cctgggagatgcagctg

SEQ ID NO: 5041185 - DNA, 18 bp, Homo sapiens
cctgggagatgcagctgg

SEQ ID NO: 5041186 - DNA, 19 bp, Homo sapiens
cctgggagatgcagctgga

SEQ ID NO: 5041187 - DNA, 22 bp, Homo sapiens
cctgggcgcaagcgacacaggc

SEQ ID NO: 5041188 - DNA, 16 bp, Homo sapiens
cctgggtcctcccagc

SEQ ID NO: 5041189 - DNA, 20 bp, Homo sapiens
cctgggtgctgtcatgccca

SEQ ID NO: 5041190 - DNA, 22 bp, Homo sapiens
cctgggtgctgtcatgcccagc

SEQ ID NO: 5041191 - DNA, 23 bp, Homo sapiens
cctgtctccctacttagacccag

SEQ ID NO: 5041192 - DNA, 13 bp, Homo sapiens
cctgtctgcaggc

SEQ ID NO: 5041193 - DNA, 18 bp, Homo sapiens
cgagggcgcctgggtcct

SEQ ID NO: 5041194 - DNA, 22 bp, Homo sapiens
cgcaagcgacacaggctgccgc

SEQ ID NO: 5041195 - DNA, 16 bp, Homo sapiens
cgcccagcctggcccc

SEQ ID NO: 5041196 - DNA, 19 bp, Homo sapiens
cgcctctgtcctggcccgg

SEQ ID NO: 5041197 - DNA, 18 bp, Homo sapiens
cgcctgggtcctcccagc

SEQ ID NO: 5041198 - DNA, 21 bp, Homo sapiens
cgcctgggtcctcccagctga

SEQ ID NO: 5041199 - DNA, 14 bp, Homo sapiens
cgctgctctcccag

SEQ ID NO: 5041200 - DNA, 17 bp, Homo sapiens
cggaaggacacagtcag

SEQ ID NO: 5041201 - DNA, 20 bp, Homo sapiens
cggaaggacacagtcagggg

SEQ ID NO: 5041202 - DNA, 18 bp, Homo sapiens
cggagatgcatctgtggc

SEQ ID NO: 5041203 - DNA, 20 bp, Homo sapiens
cggagatgcatctgtggcct

SEQ ID NO: 5041204 - DNA, 17 bp, Homo sapiens
cggcccacgtcctgggt

SEQ ID NO: 5041205 - DNA, 13 bp, Homo sapiens
cggcctcttgaga

SEQ ID NO: 5041206 - DNA, 19 bp, Homo sapiens
cggcctcttgagagcccca

SEQ ID NO: 5041207 - DNA, 20 bp, Homo sapiens
cggcctgcagaccctgccag

SEQ ID NO: 5041208 - DNA, 21 bp, Homo sapiens
cggcctgcagaccctgccagg

SEQ ID NO: 5041209 - DNA, 16 bp, Homo sapiens
cgggagccgcaggggc

SEQ ID NO: 5041210 - DNA, 21 bp, Homo sapiens
cgggcactgtcatgcccagct

SEQ ID NO: 5041211 - DNA, 21 bp, Homo sapiens
aaacactttggccacagcccc

SEQ ID NO: 5041212 - DNA, 21 bp, Homo sapiens
aagctgagcccctccctcctg

SEQ ID NO: 5041213 - DNA, 22 bp, Homo sapiens
aagggcccccggctcggcctct

SEQ ID NO: 5041214 - DNA, 18 bp, Homo sapiens
aaggtgcacctgccccag

SEQ ID NO: 5041215 - DNA, 13 bp, Homo sapiens
aatacgcttgagc

SEQ ID NO: 5041216 - DNA, 14 bp, Homo sapiens
acaagccaggccct

SEQ ID NO: 5041217 - DNA, 17 bp, Homo sapiens
acaagccaggccctctc

SEQ ID NO: 5041218 - DNA, 14 bp, Homo sapiens
acacaggctgccgc

SEQ ID NO: 5041219 - DNA, 14 bp, Homo sapiens
acaccttcccagct

SEQ ID NO: 5041220 - DNA, 22 bp, Homo sapiens
acaccttcccagctgctcctag

SEQ ID NO: 5041221 - DNA, 23 bp, Homo sapiens
acactggctttgggtagtgccat

SEQ ID NO: 5041222 - DNA, 16 bp, Homo sapiens
acagcaggagcatggc

SEQ ID NO: 5041223 - DNA, 12 bp, Homo sapiens
acagcccaggcg

SEQ ID NO: 5041224 - DNA, 23 bp, Homo sapiens
acaggagtgactctggctgccaa

SEQ ID NO: 5041225 - DNA, 16 bp, Homo sapiens
acatggccgctgccca

SEQ ID NO: 5041226 - DNA, 24 bp, Homo sapiens
accacgtctccctggccccagtga

SEQ ID NO: 5041227 - DNA, 14 bp, Homo sapiens
accaggctgcaggt

SEQ ID NO: 5041228 - DNA, 21 bp, Homo sapiens
accagtccacgccgggtcgcc

SEQ ID NO: 5041229 - DNA, 17 bp, Homo sapiens
acccacttccctgcaag

SEQ ID NO: 5041230 - DNA, 20 bp, Homo sapiens
acccctaatcgccctgagct

SEQ ID NO: 5041231 - DNA, 11 bp, Homo sapiens
accctgccagg

SEQ ID NO: 5041232 - DNA, 12 bp, Homo sapiens
accctgccaggg

SEQ ID NO: 5041233 - DNA, 13 bp, Homo sapiens
accctgccagggg

SEQ ID NO: 5041234 - DNA, 17 bp, Homo sapiens
accctgtctgcaggcca

SEQ ID NO: 5041235 - DNA, 13 bp, Homo sapiens
acctccctgcagc

SEQ ID NO: 5041236 - DNA, 15 bp, Homo sapiens
acctgccaggctgca

SEQ ID NO: 5041237 - DNA, 14 bp, Homo sapiens
acctgccccaggct

SEQ ID NO: 5041238 - DNA, 14 bp, Homo sapiens
accttcccagctgc

SEQ ID NO: 5041239 - DNA, 18 bp, Homo sapiens
acgccgggtcgcctgccc

SEQ ID NO: 5041240 - DNA, 15 bp, Homo sapiens
acgtggccgctgccc

SEQ ID NO: 5041241 - DNA, 15 bp, Homo sapiens
actcaaaatgcagga

SEQ ID NO: 5041242 - DNA, 15 bp, Homo sapiens
actcagtcagcccag

SEQ ID NO: 5041243 - DNA, 18 bp, Homo sapiens
actcagtcagcccagtgg

SEQ ID NO: 5041244 - DNA, 14 bp, Homo sapiens
actctggctgccaa

SEQ ID NO: 5041245 - DNA, 15 bp, Homo sapiens
actctggctgccaag

SEQ ID NO: 5041246 - DNA, 16 bp, Homo sapiens
actgagaaggccccag

SEQ ID NO: 5041247 - DNA, 16 bp, Homo sapiens
actgcccacctgccag

SEQ ID NO: 5041248 - DNA, 18 bp, Homo sapiens
actgcccacctgccaggc

SEQ ID NO: 5041249 - DNA, 16 bp, Homo sapiens
actgcggaacaggagt

SEQ ID NO: 5041250 - DNA, 24 bp, Homo sapiens
actggctttgggtagtgccatggc

SEQ ID NO: 5041251 - DNA, 18 bp, Homo sapiens
actggtcccccatgggct

SEQ ID NO: 5041252 - DNA, 18 bp, Homo sapiens
actgtcatgcccagcttg

SEQ ID NO: 5041253 - DNA, 14 bp, Homo sapiens
acttccctgcaagg

SEQ ID NO: 5041254 - DNA, 18 bp, Homo sapiens
agaaccaggaggcctggg

SEQ ID NO: 5041255 - DNA, 19 bp, Homo sapiens
agacaccttcccagctgct

SEQ ID NO: 5041256 - DNA, 21 bp, Homo sapiens
agactgtgggtccctgcgtct

SEQ ID NO: 5041257 - DNA, 16 bp, Homo sapiens
agagcctgggcgcaag

SEQ ID NO: 5041258 - DNA, 15 bp, Homo sapiens
agaggctgctgtcac

SEQ ID NO: 5041259 - DNA, 23 bp, Homo sapiens
agagggatccaccgccacactgg

SEQ ID NO: 5041260 - DNA, 13 bp, Homo sapiens
agatgcatctgtg

SEQ ID NO: 5041261 - DNA, 15 bp, Homo sapiens
agatgcatctgtggc

SEQ ID NO: 5041262 - DNA, 18 bp, Homo sapiens
agatgcatctgtggcctg

SEQ ID NO: 5041263 - DNA, 21 bp, Homo sapiens
agatgcatctgtggcctgggg

SEQ ID NO: 5041264 - DNA, 19 bp, Homo sapiens
agccaggccctctctgcag

SEQ ID NO: 5041265 - DNA, 20 bp, Homo sapiens
agccaggccctctctgcagt

SEQ ID NO: 5041266 - DNA, 20 bp, Homo sapiens
agctgagcccctccctcctg

SEQ ID NO: 5041267 - DNA, 13 bp, Homo sapiens
agctgctcctaga

SEQ ID NO: 5041268 - DNA, 15 bp, Homo sapiens
agctttgaggctggc

SEQ ID NO: 5041269 - DNA, 15 bp, Homo sapiens
aggagtgactctggc

SEQ ID NO: 5041270 - DNA, 15 bp, Homo sapiens
aggccctctctgcag

SEQ ID NO: 5041271 - DNA, 16 bp, Homo sapiens
aggccctctctgcagt

SEQ ID NO: 5041272 - DNA, 17 bp, Homo sapiens
aggccctctctgcagtc

SEQ ID NO: 5041273 - DNA, 18 bp, Homo sapiens
aggccctctctgcagtcc

SEQ ID NO: 5041274 - DNA, 11 bp, Homo sapiens
aggctgcccag

SEQ ID NO: 5041275 - DNA, 21 bp, Homo sapiens
aggctgccgctgctctcccag

SEQ ID NO: 5041276 - DNA, 13 bp, Homo sapiens
aggctgctgtcac

SEQ ID NO: 5041277 - DNA, 18 bp, Homo sapiens
aggctggcggggtctgct

SEQ ID NO: 5041278 - DNA, 20 bp, Homo sapiens
agggacagttgggtgtgaga

SEQ ID NO: 5041279 - DNA, 15 bp, Homo sapiens
agggcaaaccaggct

SEQ ID NO: 5041280 - DNA, 18 bp, Homo sapiens
agggcccccggctcggcc

SEQ ID NO: 5041281 - DNA, 12 bp, Homo sapiens
agggcgcctggg

SEQ ID NO: 5041282 - DNA, 14 bp, Homo sapiens
aggggcccctcctc

SEQ ID NO: 5041283 - DNA, 16 bp, Homo sapiens
agtcagcccagtggga

SEQ ID NO: 5041284 - DNA, 16 bp, Homo sapiens
agtcattctagaggga

SEQ ID NO: 5041285 - DNA, 12 bp, Homo sapiens
agtctgtgcctc

SEQ ID NO: 5041286 - DNA, 16 bp, Homo sapiens
agtgagagcagggctg

SEQ ID NO: 5041287 - DNA, 17 bp, Homo sapiens
agtgccacatggccgct

SEQ ID NO: 5041288 - DNA, 18 bp, Homo sapiens
agtgccacatggccgctg

SEQ ID NO: 5041289 - DNA, 15 bp, Homo sapiens
agtgccatggccagg

SEQ ID NO: 5041290 - DNA, 16 bp, Homo sapiens
agtgccatggccagga

SEQ ID NO: 5041291 - DNA, 21 bp, Homo sapiens
atcctcactgagaaggcccca

SEQ ID NO: 5041292 - DNA, 23 bp, Homo sapiens
atgcagaccccaccctgtctgca

SEQ ID NO: 5041293 - DNA, 18 bp, Homo sapiens
atgcatctgtggcctggg

SEQ ID NO: 5041294 - DNA, 19 bp, Homo sapiens
atgcccagcttggagtgcc

SEQ ID NO: 5041295 - DNA, 21 bp, Homo sapiens
atgcccagcttggagtgccac

SEQ ID NO: 5041296 - DNA, 23 bp, Homo sapiens
atgcccagcttggagtgccacgt

SEQ ID NO: 5041297 - DNA, 13 bp, Homo sapiens
atggccaggagtg

SEQ ID NO: 5041298 - DNA, 15 bp, Homo sapiens
atggccgctgcccac

SEQ ID NO: 5041299 - DNA, 22 bp, Homo sapiens
atgtcttcttgggggcagacca

SEQ ID NO: 5041300 - DNA, 16 bp, Homo sapiens
attgactggtccccca

SEQ ID NO: 5041301 - DNA, 13 bp, Homo sapiens
caaaccaggctgc

SEQ ID NO: 5041302 - DNA, 17 bp, Homo sapiens
caaaccaggctgcaggt

SEQ ID NO: 5041303 - DNA, 20 bp, Homo sapiens
caagcgacacaggctgccgc

SEQ ID NO: 5041304 - DNA, 20 bp, Homo sapiens
caaggtgcacctgccccagg

SEQ ID NO: 5041305 - DNA, 15 bp, Homo sapiens
caagtttcagagtca

SEQ ID NO: 5041306 - DNA, 21 bp, Homo sapiens
caataaacgctgacttgcaga

SEQ ID NO: 5041307 - DNA, 22 bp, Homo sapiens
caatgttggctagtctgtgcct

SEQ ID NO: 5041308 - DNA, 16 bp, Homo sapiens
cacaggttcacccagc

SEQ ID NO: 5041309 - DNA, 18 bp, Homo sapiens
cacccctgaactggcccc

SEQ ID NO: 5041310 - DNA, 19 bp, Homo sapiens
cacccctgaactggcccca

SEQ ID NO: 5041311 - DNA, 18 bp, Homo sapiens
caccgccacactggccgg

SEQ ID NO: 5041312 - DNA, 16 bp, Homo sapiens
cacctccctgcagctt

SEQ ID NO: 5041313 - DNA, 17 bp, Homo sapiens
cacctgccaggctgcag

SEQ ID NO: 5041314 - DNA, 12 bp, Homo sapiens
cacctgccccag

SEQ ID NO: 5041315 - DNA, 17 bp, Homo sapiens
cacctgccccaggctca

SEQ ID NO: 5041316 - DNA, 14 bp, Homo sapiens
caccttcccagctg

SEQ ID NO: 5041317 - DNA, 14 bp, Homo sapiens
cactctgaccgggc

SEQ ID NO: 5041318 - DNA, 16 bp, Homo sapiens
cactgagaaggcccca

SEQ ID NO: 5041319 - DNA, 19 bp, Homo sapiens
cactgagaaggccccaggg

SEQ ID NO: 5041320 - DNA, 14 bp, Homo sapiens
cactggccggccca

SEQ ID NO: 5041321 - DNA, 21 bp, Homo sapiens
cactggctttgggtagtgcca

SEQ ID NO: 5041322 - DNA, 17 bp, Homo sapiens
cactgtcatgcccagct

SEQ ID NO: 5041323 - DNA, 12 bp, Homo sapiens
cagagcctgggc

SEQ ID NO: 5041324 - DNA, 17 bp, Homo sapiens
cagcctggccccaagca

SEQ ID NO: 5041325 - DNA, 20 bp, Homo sapiens
cagcgcccagcctggcccca

SEQ ID NO: 5041326 - DNA, 23 bp, Homo sapiens
cagcgccctctacctcctagcaa

SEQ ID NO: 5041327 - DNA, 19 bp, Homo sapiens
cagctccggaaggacacag

SEQ ID NO: 5041328 - DNA, 16 bp, Homo sapiens
cagctcctcttcctgc

SEQ ID NO: 5041329 - DNA, 17 bp, Homo sapiens
cagctcctcttcctgcc

SEQ ID NO: 5041330 - DNA, 14 bp, Homo sapiens
cagctgctcctaga

SEQ ID NO: 5041331 - DNA, 17 bp, Homo sapiens
cagcttggagtgccaca

SEQ ID NO: 5041332 - DNA, 15 bp, Homo sapiens
cagctttgaggctgg

SEQ ID NO: 5041333 - DNA, 16 bp, Homo sapiens
cagctttgaggctggc

SEQ ID NO: 5041334 - DNA, 14 bp, Homo sapiens
caggaggcctggga

SEQ ID NO: 5041335 - DNA, 14 bp, Homo sapiens
caggagtgactctg

SEQ ID NO: 5041336 - DNA, 15 bp, Homo sapiens
caggagtgactctgg

SEQ ID NO: 5041337 - DNA, 21 bp, Homo sapiens
caggagtgactctggctgcca

SEQ ID NO: 5041338 - DNA, 23 bp, Homo sapiens
caggagtgactctggctgccaag

SEQ ID NO: 5041339 - DNA, 23 bp, Homo sapiens
caggcaagacaccttcccagctg

SEQ ID NO: 5041340 - DNA, 16 bp, Homo sapiens
caggcggtcactgccc

SEQ ID NO: 5041341 - DNA, 15 bp, Homo sapiens
caggctcaggctgcc

SEQ ID NO: 5041342 - DNA, 17 bp, Homo sapiens
caggctcaggctgccca

SEQ ID NO: 5041343 - DNA, 15 bp, Homo sapiens
cagggacagttgggt

SEQ ID NO: 5041344 - DNA, 16 bp, Homo sapiens
cagggctgggcgcctc

SEQ ID NO: 5041345 - DNA, 15 bp, Homo sapiens
cagggggtttgagga

SEQ ID NO: 5041346 - DNA, 14 bp, Homo sapiens
caggtcagagccca

SEQ ID NO: 5041347 - DNA, 15 bp, Homo sapiens
caggtcagagcccag

SEQ ID NO: 5041348 - DNA, 21 bp, Homo sapiens
caggtgaaatccacaccagtc

SEQ ID NO: 5041349 - DNA, 22 bp, Homo sapiens
caggtggggttttcacttccta

SEQ ID NO: 5041350 - DNA, 15 bp, Homo sapiens
caggttcacccagcg

SEQ ID NO: 5041351 - DNA, 15 bp, Homo sapiens
cagtcagcccagtgg

SEQ ID NO: 5041352 - DNA, 18 bp, Homo sapiens
cagtcctcggcagctccg

SEQ ID NO: 5041353 - DNA, 20 bp, Homo sapiens
cagtgagagcagggctgggc

SEQ ID NO: 5041354 - DNA, 22 bp, Homo sapiens
cagtgagagcagggctgggcgc

SEQ ID NO: 5041355 - DNA, 23 bp, Homo sapiens
cagtgggatcttacccacttccc

SEQ ID NO: 5041356 - DNA, 15 bp, Homo sapiens
catctgtggcctggg

SEQ ID NO: 5041357 - DNA, 21 bp, Homo sapiens
catggccgcaacttcccaggc

SEQ ID NO: 5041358 - DNA, 15 bp, Homo sapiens
catggccgctgccca

SEQ ID NO: 5041359 - DNA, 16 bp, Homo sapiens
catggccgctgcccac

SEQ ID NO: 5041360 - DNA, 21 bp, Homo sapiens
catggccgctgcccacgtccc

SEQ ID NO: 5041361 - DNA, 15 bp, Homo sapiens
ccaccctgtctgcag

SEQ ID NO: 5041362 - DNA, 16 bp, Homo sapiens
ccacctccctgcagct

SEQ ID NO: 5041363 - DNA, 15 bp, Homo sapiens
ccacctgccaggctg

SEQ ID NO: 5041364 - DNA, 14 bp, Homo sapiens
ccacgtctccctgg

SEQ ID NO: 5041365 - DNA, 17 bp, Homo sapiens
ccactgcggaacaggag

SEQ ID NO: 5041366 - DNA, 20 bp, Homo sapiens
ccagacgcggaaaccgggtg

SEQ ID NO: 5041367 - DNA, 18 bp, Homo sapiens
ccagcggctcttcctgga

SEQ ID NO: 5041368 - DNA, 16 bp, Homo sapiens
ccagcttggagtgcca

SEQ ID NO: 5041369 - DNA, 17 bp, Homo sapiens
ccagcttggagtgccac

SEQ ID NO: 5041370 - DNA, 20 bp, Homo sapiens
ccagcttggagtgccacgtg

SEQ ID NO: 5041371 - DNA, 23 bp, Homo sapiens
ccagcttggagtgccacgtggcc

SEQ ID NO: 5041372 - DNA, 16 bp, Homo sapiens
ccaggaattctcacag

SEQ ID NO: 5041373 - DNA, 14 bp, Homo sapiens
ccaggccgaggaag

SEQ ID NO: 5041374 - DNA, 19 bp, Homo sapiens
ccaggcggtcactgcccac

SEQ ID NO: 5041375 - DNA, 16 bp, Homo sapiens
ccaggctcaggctgcc

SEQ ID NO: 5041376 - DNA, 17 bp, Homo sapiens
ccaggctcaggctgccc

SEQ ID NO: 5041377 - DNA, 11 bp, Homo sapiens
ccaggctgcag

SEQ ID NO: 5041378 - DNA, 12 bp, Homo sapiens
ccaggctgcagg

SEQ ID NO: 5041379 - DNA, 14 bp, Homo sapiens
ccatctccgctgtt

SEQ ID NO: 5041380 - DNA, 19 bp, Homo sapiens
ccatctccgctgttttggg

SEQ ID NO: 5041381 - DNA, 14 bp, Homo sapiens
ccatgggctgctgg

SEQ ID NO: 5041382 - DNA, 18 bp, Homo sapiens
cccaccctgtctgcaggc

SEQ ID NO: 5041383 - DNA, 15 bp, Homo sapiens
cccacctgccaggct

SEQ ID NO: 5041384 - DNA, 15 bp, Homo sapiens
cccacgtcccgggca

SEQ ID NO: 5041385 - DNA, 14 bp, Homo sapiens
cccacgtcctgggt

SEQ ID NO: 5041386 - DNA, 15 bp, Homo sapiens
cccacgtcctgggtg

SEQ ID NO: 5041387 - DNA, 16 bp, Homo sapiens
cccagcggctcttcct

SEQ ID NO: 5041388 - DNA, 17 bp, Homo sapiens
cccagctcctcttcctg

SEQ ID NO: 5041389 - DNA, 18 bp, Homo sapiens
cccagctcctcttcctgc

SEQ ID NO: 5041390 - DNA, 13 bp, Homo sapiens
cccagcttggagt

SEQ ID NO: 5041391 - DNA, 14 bp, Homo sapiens
cccatgggctgctg

SEQ ID NO: 5041392 - DNA, 21 bp, Homo sapiens
cccattactcaaaatgcagga

SEQ ID NO: 5041393 - DNA, 13 bp, Homo sapiens
cccccatgggctg

SEQ ID NO: 5041394 - DNA, 18 bp, Homo sapiens
cccctgaactggccccag

SEQ ID NO: 5041395 - DNA, 18 bp, Homo sapiens
cccgagggcgcctgggtc

SEQ ID NO: 5041396 - DNA, 20 bp, Homo sapiens
cccgggcactgtcatgccca

SEQ ID NO: 5041397 - DNA, 22 bp, Homo sapiens
cccgggcactgtcatgcccagc

SEQ ID NO: 5041398 - DNA, 17 bp, Homo sapiens
ccctgaactggccccag

SEQ ID NO: 5041399 - DNA, 18 bp, Homo sapiens
ccctgccagggggtttga

SEQ ID NO: 5041400 - DNA, 18 bp, Homo sapiens
ccctgcgtctcctcgtcc

SEQ ID NO: 5041401 - DNA, 16 bp, Homo sapiens
ccctgcgtctcctgcc

SEQ ID NO: 5041402 - DNA, 12 bp, Homo sapiens
ccctggccccag

SEQ ID NO: 5041403 - DNA, 20 bp, Homo sapiens
ccctggccccagtgaccggg

SEQ ID NO: 5041404 - DNA, 15 bp, Homo sapiens
ccctgtctgcaggcc

SEQ ID NO: 5041405 - DNA, 16 bp, Homo sapiens
ccctgtctgcaggcca

SEQ ID NO: 5041406 - DNA, 16 bp, Homo sapiens
ccgagggcgcctgggt

SEQ ID NO: 5041407 - DNA, 16 bp, Homo sapiens
ccgcaacttcccaggc

SEQ ID NO: 5041408 - DNA, 17 bp, Homo sapiens
ccgcaacttcccaggcc

SEQ ID NO: 5041409 - DNA, 23 bp, Homo sapiens
ccgcaggggcccctcctccagag

SEQ ID NO: 5041410 - DNA, 21 bp, Homo sapiens
ccggagatgcatctgtggcct

SEQ ID NO: 5041411 - DNA, 19 bp, Homo sapiens
ccggctcggcctcttgaga

SEQ ID NO: 5041412 - DNA, 21 bp, Homo sapiens
ccgggcactgtcatgcccagc

SEQ ID NO: 5041413 - DNA, 20 bp, Homo sapiens
ccgggtactcagtcagccca

SEQ ID NO: 5041414 - DNA, 13 bp, Homo sapiens
ccgggtggcagcg

SEQ ID NO: 5041415 - DNA, 21 bp, Homo sapiens
ccgtgggagaggagaggctgc

SEQ ID NO: 5041416 - DNA, 19 bp, Homo sapiens
cctcagtgagatcagtcag

SEQ ID NO: 5041417 - DNA, 18 bp, Homo sapiens
cctccagagcctgggcgc

SEQ ID NO: 5041418 - DNA, 19 bp, Homo sapiens
cctccctgcagctttgagg

SEQ ID NO: 5041419 - DNA, 18 bp, Homo sapiens
cctcggcagctccggaag

SEQ ID NO: 5041420 - DNA, 20 bp, Homo sapiens
cctgaactggccccagctcc

SEQ ID NO: 5041421 - DNA, 16 bp, Homo sapiens
cctgcaaggtgcacct

SEQ ID NO: 5041422 - DNA, 23 bp, Homo sapiens
cctgcaaggtgcacctgccccag

SEQ ID NO: 5041423 - DNA, 15 bp, Homo sapiens
cctgcagaccctgcc

SEQ ID NO: 5041424 - DNA, 18 bp, Homo sapiens
cctgcagaccctgccagg

SEQ ID NO: 5041425 - DNA, 19 bp, Homo sapiens
cctgcagaccctgccaggg

SEQ ID NO: 5041426 - DNA, 14 bp, Homo sapiens
cctgcgtctcctgc

SEQ ID NO: 5041427 - DNA, 15 bp, Homo sapiens
cctggccccagtgac

SEQ ID NO: 5041428 - DNA, 16 bp, Homo sapiens
cctggccccagtgacc

SEQ ID NO: 5041429 - DNA, 17 bp, Homo sapiens
cctgggtcctcccagct

SEQ ID NO: 5041430 - DNA, 15 bp, Homo sapiens
cctgtctgcaggcca

SEQ ID NO: 5041431 - DNA, 21 bp, Homo sapiens
ccttctgatctgagaagacat

SEQ ID NO: 5041432 - DNA, 16 bp, Homo sapiens
cgagggcgcctgggtc

SEQ ID NO: 5041433 - DNA, 21 bp, Homo sapiens
cgcaggggcccctcctccaga

SEQ ID NO: 5041434 - DNA, 15 bp, Homo sapiens
cgcctctgtcctggc

SEQ ID NO: 5041435 - DNA, 14 bp, Homo sapiens
cgctgacttgcaga

SEQ ID NO: 5041436 - DNA, 18 bp, Homo sapiens
cgctgctctcccaggtga

SEQ ID NO: 5041437 - DNA, 13 bp, Homo sapiens
cggaacaggagtg

SEQ ID NO: 5041438 - DNA, 14 bp, Homo sapiens
cggcctgcagaccc

SEQ ID NO: 5041439 - DNA, 15 bp, Homo sapiens
cggctcttcctggac

SEQ ID NO: 5041440 - DNA, 18 bp, Homo sapiens
cggctggaccacgtctcc

SEQ ID NO: 5041441 - DNA, 22 bp, Homo sapiens
cggtcactgcccacctgccagg

SEQ ID NO: 5041442 - DNA, 23 bp, Homo sapiens
cggtcactgcccacctgccaggc

SEQ ID NO: 5041443 - DNA, 20 bp, Homo sapiens
cgtcccgagggcgcctgggt

SEQ ID NO: 5041444 - DNA, 18 bp, Homo sapiens
cgtcccgggcactgtcat

SEQ ID NO: 5041445 - DNA, 12 bp, Homo sapiens
cgtcctgggtgc

SEQ ID NO: 5041446 - DNA, 24 bp, Homo sapiens
cgtcctgggtgctgtcatgcccag

SEQ ID NO: 5041447 - DNA, 16 bp, Homo sapiens
cgtctccctggcccca

SEQ ID NO: 5041448 - DNA, 14 bp, Homo sapiens
cgtggccgctgccc

SEQ ID NO: 5041449 - DNA, 16 bp, Homo sapiens
ctacatttttgtttaa

SEQ ID NO: 5041450 - DNA, 16 bp, Homo sapiens
ctacttagacccagtc

SEQ ID NO: 5041451 - DNA, 17 bp, Homo sapiens
ctagagggatccaccgc

SEQ ID NO: 5041452 - DNA, 13 bp, Homo sapiens
ctcaggctgccca

SEQ ID NO: 5041453 - DNA, 22 bp, Homo sapiens
ctcagtgagatcagtcagctcc

SEQ ID NO: 5041454 - DNA, 20 bp, Homo sapiens
ctcatggcttgggctggagt

SEQ ID NO: 5041455 - DNA, 13 bp, Homo sapiens
ctccctgcagctt

SEQ ID NO: 5041456 - DNA, 14 bp, Homo sapiens
ctccctggccccag

SEQ ID NO: 5041457 - DNA, 16 bp, Homo sapiens
ctccctggccccagtg

SEQ ID NO: 5041458 - DNA, 18 bp, Homo sapiens
ctccctggccccagtgac

SEQ ID NO: 5041459 - DNA, 23 bp, Homo sapiens
ctcctagaggggacaagccaggc

SEQ ID NO: 5041460 - DNA, 19 bp, Homo sapiens
ctcctccagagcctgggcg

SEQ ID NO: 5041461 - DNA, 19 bp, Homo sapiens
ctcgtcccgagggcgcctg

SEQ ID NO: 5041462 - DNA, 23 bp, Homo sapiens
ctcgtcccgagggcgcctgggtc

SEQ ID NO: 5041463 - DNA, 23 bp, Homo sapiens
ctctctgcagtcctcggcagctc

SEQ ID NO: 5041464 - DNA, 15 bp, Homo sapiens
ctctggctgccaaga

SEQ ID NO: 5041465 - DNA, 19 bp, Homo sapiens
ctcttcaccgccgtggggt

SEQ ID NO: 5041466 - DNA, 14 bp, Homo sapiens
ctcttcctgcctct

SEQ ID NO: 5041467 - DNA, 12 bp, Homo sapiens
ctgacttgcaga

SEQ ID NO: 5041468 - DNA, 15 bp, Homo sapiens
ctgagaaggccccag

SEQ ID NO: 5041469 - DNA, 19 bp, Homo sapiens
ctgagaaggccccagggca

SEQ ID NO: 5041470 - DNA, 21 bp, Homo sapiens
ctgagaaggccccagggcagc

SEQ ID NO: 5041471 - DNA, 18 bp, Homo sapiens
ctgcagaccctgccaggg

SEQ ID NO: 5041472 - DNA, 18 bp, Homo sapiens
ctgcagggacagttgggt

SEQ ID NO: 5041473 - DNA, 20 bp, Homo sapiens
ctgcagggacagttgggtgt

SEQ ID NO: 5041474 - DNA, 19 bp, Homo sapiens
ctgcagtcctcggcagctc

SEQ ID NO: 5041475 - DNA, 21 bp, Homo sapiens
ctgcagtcctcggcagctccg

SEQ ID NO: 5041476 - DNA, 22 bp, Homo sapiens
ctgcagtcctcggcagctccgg

SEQ ID NO: 5041477 - DNA, 23 bp, Homo sapiens
ctgccagggggtttgaggaccct

SEQ ID NO: 5041478 - DNA, 14 bp, Homo sapiens
ctgcccacctgcca

SEQ ID NO: 5041479 - DNA, 18 bp, Homo sapiens
ctgcccacctgccaggct

SEQ ID NO: 5041480 - DNA, 18 bp, Homo sapiens
ctgcccacgtcccgggca

SEQ ID NO: 5041481 - DNA, 23 bp, Homo sapiens
ctgcccacgtcccgggcactgtc

SEQ ID NO: 5041482 - DNA, 20 bp, Homo sapiens
ctgcccagcggctcttcctg

SEQ ID NO: 5041483 - DNA, 18 bp, Homo sapiens
ctgccccaggctcaggct

SEQ ID NO: 5041484 - DNA, 18 bp, Homo sapiens
ctgccgctgctctcccag

SEQ ID NO: 5041485 - DNA, 21 bp, Homo sapiens
ctgcggaacaggagtgactct

SEQ ID NO: 5041486 - DNA, 22 bp, Homo sapiens
ctggacagtgagagcagggctg

SEQ ID NO: 5041487 - DNA, 14 bp, Homo sapiens
ctggacctgaccag

SEQ ID NO: 5041488 - DNA, 20 bp, Homo sapiens
ctggatggggcggcctgcag

SEQ ID NO: 5041489 - DNA, 13 bp, Homo sapiens
ctggccccagctc

SEQ ID NO: 5041490 - DNA, 14 bp, Homo sapiens
ctggccccagctcc

SEQ ID NO: 5041491 - DNA, 22 bp, Homo sapiens
ctggccccagctcctcttcctg

SEQ ID NO: 5041492 - DNA, 19 bp, Homo sapiens
ctggccggcccacgtcctg

SEQ ID NO: 5041493 - DNA, 20 bp, Homo sapiens
ctggccggcccacgtcctgg

SEQ ID NO: 5041494 - DNA, 22 bp, Homo sapiens
ctggccggcccacgtcctgggt

SEQ ID NO: 5041495 - DNA, 22 bp, Homo sapiens
ctggcggggtctgctcctggga

SEQ ID NO: 5041496 - DNA, 19 bp, Homo sapiens
ctgggcgcaagcgacacag

SEQ ID NO: 5041497 - DNA, 21 bp, Homo sapiens
ctgtcatgcccagcttggagt

SEQ ID NO: 5041498 - DNA, 18 bp, Homo sapiens
ctgtcctggcccgggagc

SEQ ID NO: 5041499 - DNA, 20 bp, Homo sapiens
ctgtcctggcccgggagccg

SEQ ID NO: 5041500 - DNA, 14 bp, Homo sapiens
ctgtgggtccctgc

SEQ ID NO: 5041501 - DNA, 22 bp, Homo sapiens
ctgtgggtccctgcgtctcctg

SEQ ID NO: 5041502 - DNA, 14 bp, Homo sapiens
cttagacccagtca

SEQ ID NO: 5041503 - DNA, 14 bp, Homo sapiens
cttagggtctgtcc

SEQ ID NO: 5041504 - DNA, 19 bp, Homo sapiens
cttattttcttattttaga

SEQ ID NO: 5041505 - DNA, 14 bp, Homo sapiens
cttccctgcaaggt

SEQ ID NO: 5041506 - DNA, 21 bp, Homo sapiens
cttccctgcaaggtgcacctg

SEQ ID NO: 5041507 - DNA, 22 bp, Homo sapiens
cttcctggacagtgagagcagg

SEQ ID NO: 5041508 - DNA, 13 bp, Homo sapiens
cttcttgggggca

SEQ ID NO: 5041509 - DNA, 22 bp, Homo sapiens
cttggagcgtttttgctggctt

SEQ ID NO: 5041510 - DNA, 20 bp, Homo sapiens
cttggagtgccacatggccg

SEQ ID NO: 5041511 - DNA, 16 bp, Homo sapiens
cttgggggtggggctg

SEQ ID NO: 5041512 - DNA, 19 bp, Homo sapiens
cttgggggtggggctgcat

SEQ ID NO: 5041513 - DNA, 21 bp, Homo sapiens
cttgggggtggggctgcatcc

SEQ ID NO: 5041514 - DNA, 12 bp, Homo sapiens
cttgtgtgaggg

SEQ ID NO: 5041515 - DNA, 14 bp, Homo sapiens
cttgtgtgagggca

SEQ ID NO: 5041516 - DNA, 19 bp, Homo sapiens
ctttccttctgatctgaga

SEQ ID NO: 5041517 - DNA, 21 bp, Homo sapiens
ctttgtaaaccggctggacca

SEQ ID NO: 5041518 - DNA, 15 bp, Homo sapiens
gaaccaggaggcctg

SEQ ID NO: 5041519 - DNA, 13 bp, Homo sapiens
gaactggccccag

SEQ ID NO: 5041520 - DNA, 18 bp, Homo sapiens
gacaccttcccagctgct

SEQ ID NO: 5041521 - DNA, 14 bp, Homo sapiens
gacagttgggtgtg

SEQ ID NO: 5041522 - DNA, 16 bp, Homo sapiens
gaccacgtctccctgg

SEQ ID NO: 5041523 - DNA, 20 bp, Homo sapiens
gaccagactgtgggtccctg

SEQ ID NO: 5041524 - DNA, 19 bp, Homo sapiens
gaccccaccctgtctgcag

SEQ ID NO: 5041525 - DNA, 21 bp, Homo sapiens
gaccccaccctgtctgcaggc

SEQ ID NO: 5041526 - DNA, 13 bp, Homo sapiens
gaccctgccaggg

SEQ ID NO: 5041527 - DNA, 14 bp, Homo sapiens
gactctggctgcca

SEQ ID NO: 5041528 - DNA, 19 bp, Homo sapiens
gactggtcccccatgggct

SEQ ID NO: 5041529 - DNA, 20 bp, Homo sapiens
gagaaggccccagggcagcg

SEQ ID NO: 5041530 - DNA, 22 bp, Homo sapiens
gagatgcatctgtggcctgggg

SEQ ID NO: 5041531 - DNA, 19 bp, Homo sapiens
gagcagggctgggcgcctc

SEQ ID NO: 5041532 - DNA, 16 bp, Homo sapiens
gagcccctccctcctg

SEQ ID NO: 5041533 - DNA, 20 bp, Homo sapiens
gagcccctccctcctgtgtt

SEQ ID NO: 5041534 - DNA, 15 bp, Homo sapiens
gaggaagggcccccg

SEQ ID NO: 5041535 - DNA, 16 bp, Homo sapiens
gaggaagggcccccgg

SEQ ID NO: 5041536 - DNA, 13 bp, Homo sapiens
gagggcgcctggg

SEQ ID NO: 5041537 - DNA, 15 bp, Homo sapiens
gagggcgcctgggtc

SEQ ID NO: 5041538 - DNA, 22 bp, Homo sapiens
gagggcgcctgggtcctcccag

SEQ ID NO: 5041539 - DNA, 23 bp, Homo sapiens
gagtgccacatggccgctgccca

SEQ ID NO: 5041540 - DNA, 14 bp, Homo sapiens
gagtggctcccgtg

SEQ ID NO: 5041541 - DNA, 20 bp, Homo sapiens
gatccaccgccacactggcc

SEQ ID NO: 5041542 - DNA, 22 bp, Homo sapiens
gatgcaggcaagacaccttccc

SEQ ID NO: 5041543 - DNA, 14 bp, Homo sapiens
gcaacttcccaggc

SEQ ID NO: 5041544 - DNA, 16 bp, Homo sapiens
gcaagcgacacaggct

SEQ ID NO: 5041545 - DNA, 19 bp, Homo sapiens
gcaagcgacacaggctgcc

SEQ ID NO: 5041546 - DNA, 14 bp, Homo sapiens
gcacctgccccagg

SEQ ID NO: 5041547 - DNA, 18 bp, Homo sapiens
gcactgtcatgcccagct

SEQ ID NO: 5041548 - DNA, 21 bp, Homo sapiens
gcactgtcatgcccagcttgg

SEQ ID NO: 5041549 - DNA, 14 bp, Homo sapiens
gcagaccagagagc

SEQ ID NO: 5041550 - DNA, 15 bp, Homo sapiens
gcagcgcccagcctg

SEQ ID NO: 5041551 - DNA, 17 bp, Homo sapiens
gcagcgcccagcctggc

SEQ ID NO: 5041552 - DNA, 21 bp, Homo sapiens
gcagctccggaaggacacagt

SEQ ID NO: 5041553 - DNA, 21 bp, Homo sapiens
gcagctggatggggcggcctg

SEQ ID NO: 5041554 - DNA, 20 bp, Homo sapiens
gcaggcaagacaccttccca

SEQ ID NO: 5041555 - DNA, 22 bp, Homo sapiens
gcaggcaagacaccttcccagc

SEQ ID NO: 5041556 - DNA, 20 bp, Homo sapiens
gcaggggcccctcctccaga

SEQ ID NO: 5041557 - DNA, 15 bp, Homo sapiens
gcagtaaatccacag

SEQ ID NO: 5041558 - DNA, 17 bp, Homo sapiens
gcatctgtggcctgggg

SEQ ID NO: 5041559 - DNA, 18 bp, Homo sapiens
gccacatggccgctgccc

SEQ ID NO: 5041560 - DNA, 15 bp, Homo sapiens
gccacgtggccgctg

SEQ ID NO: 5041561 - DNA, 13 bp, Homo sapiens
gccaggccctctc

SEQ ID NO: 5041562 - DNA, 17 bp, Homo sapiens
gccaggccctctctgca

SEQ ID NO: 5041563 - DNA, 12 bp, Homo sapiens
gccaggctgcag

SEQ ID NO: 5041564 - DNA, 14 bp, Homo sapiens
gccaggctgcaggg

SEQ ID NO: 5041565 - DNA, 16 bp, Homo sapiens
gccaggctgcagggac

SEQ ID NO: 5041566 - DNA, 17 bp, Homo sapiens
gccaggctgcagggaca

SEQ ID NO: 5041567 - DNA, 18 bp, Homo sapiens
gcccacctgccaggctgc

SEQ ID NO: 5041568 - DNA, 19 bp, Homo sapiens
gcccacctgccaggctgca

SEQ ID NO: 5041569 - DNA, 23 bp, Homo sapiens
gcccacctgccaggctgcaggga

SEQ ID NO: 5041570 - DNA, 16 bp, Homo sapiens
gcccacgtcccgggca

SEQ ID NO: 5041571 - DNA, 16 bp, Homo sapiens
gcccacgtcctgggtg

SEQ ID NO: 5041572 - DNA, 22 bp, Homo sapiens
gcccacgtcctgggtgctgtca

SEQ ID NO: 5041573 - DNA, 23 bp, Homo sapiens
gcccacgtcctgggtgctgtcat

SEQ ID NO: 5041574 - DNA, 14 bp, Homo sapiens
gcccactctgaccg

SEQ ID NO: 5041575 - DNA, 20 bp, Homo sapiens
gcccagcggctcttcctgga

SEQ ID NO: 5041576 - DNA, 17 bp, Homo sapiens
gcccagcttggagtgcc

SEQ ID NO: 5041577 - DNA, 15 bp, Homo sapiens
gcccaggcggtcact

SEQ ID NO: 5041578 - DNA, 23 bp, Homo sapiens
gccccacccctgaactggcccca

SEQ ID NO: 5041579 - DNA, 16 bp, Homo sapiens
gccccagctcctcttc

SEQ ID NO: 5041580 - DNA, 22 bp, Homo sapiens
gccccaggctcaggctgcccag

SEQ ID NO: 5041581 - DNA, 12 bp, Homo sapiens
gccccagggcag

SEQ ID NO: 5041582 - DNA, 22 bp, Homo sapiens
gcccggagatgcatctgtggcc

SEQ ID NO: 5041583 - DNA, 14 bp, Homo sapiens
gccctctctgcagt

SEQ ID NO: 5041584 - DNA, 22 bp, Homo sapiens
gccctctctgcagtcctcggca

SEQ ID NO: 5041585 - DNA, 14 bp, Homo sapiens
gccgctgcccacgt

SEQ ID NO: 5041586 - DNA, 19 bp, Homo sapiens
gccggcccacgtcctgggt

SEQ ID NO: 5041587 - DNA, 14 bp, Homo sapiens
gcctctgtcctggc

SEQ ID NO: 5041588 - DNA, 18 bp, Homo sapiens
gcctcttgagagccccac

SEQ ID NO: 5041589 - DNA, 19 bp, Homo sapiens
gcctgggagatgcagctgg

SEQ ID NO: 5041590 - DNA, 12 bp, Homo sapiens
gcctgggtcctc

SEQ ID NO: 5041591 - DNA, 20 bp, Homo sapiens
gcggaaaccgggtggcagcg

SEQ ID NO: 5041592 - DNA, 14 bp, Homo sapiens
gcggcctgcagacc

SEQ ID NO: 5041593 - DNA, 21 bp, Homo sapiens
gcggcctgcagaccctgccag

SEQ ID NO: 5041594 - DNA, 14 bp, Homo sapiens
gcggctcttcctgg

SEQ ID NO: 5041595 - DNA, 15 bp, Homo sapiens
gcggtcactgcccac

SEQ ID NO: 5041596 - DNA, 16 bp, Homo sapiens
gctagtctgtgcctca

SEQ ID NO: 5041597 - DNA, 13 bp, Homo sapiens
gctcaggctgccc

SEQ ID NO: 5041598 - DNA, 20 bp, Homo sapiens
gctccgagtggctcccgtgt

SEQ ID NO: 5041599 - DNA, 13 bp, Homo sapiens
gctcggcctcttg

SEQ ID NO: 5041600 - DNA, 23 bp, Homo sapiens
gctcggcctcttgagagccccac

SEQ ID NO: 5041601 - DNA, 12 bp, Homo sapiens
gctctcccaggt

SEQ ID NO: 5041602 - DNA, 19 bp, Homo sapiens
gctgagcccctccctcctg

SEQ ID NO: 5041603 - DNA, 16 bp, Homo sapiens
gctgcccagcggctct

SEQ ID NO: 5041604 - DNA, 20 bp, Homo sapiens
gctgcccagcggctcttcct

SEQ ID NO: 5041605 - DNA, 14 bp, Homo sapiens
gctgccgctgctct

SEQ ID NO: 5041606 - DNA, 14 bp, Homo sapiens
gctgctctcccagg

SEQ ID NO: 5041607 - DNA, 18 bp, Homo sapiens
gctggagtgggctctctg

SEQ ID NO: 5041608 - DNA, 19 bp, Homo sapiens
gctgggcgcctctgtcctg

SEQ ID NO: 5041609 - DNA, 21 bp, Homo sapiens
gctgtcatgcccagcttggag

SEQ ID NO: 5041610 - DNA, 20 bp, Homo sapiens
ggaatggggtgggagccaca

SEQ ID NO: 5041611 - DNA, 13 bp, Homo sapiens
ggaccctcccagg

SEQ ID NO: 5041612 - DNA, 22 bp, Homo sapiens
ggaccctcccaggtttcccact

SEQ ID NO: 5041613 - DNA, 19 bp, Homo sapiens
ggagatgcatctgtggcct

SEQ ID NO: 5041614 - DNA, 22 bp, Homo sapiens
ggagatgcatctgtggcctggg

SEQ ID NO: 5041615 - DNA, 14 bp, Homo sapiens
ggagccacagggac

SEQ ID NO: 5041616 - DNA, 13 bp, Homo sapiens
ggaggcctgggag

SEQ ID NO: 5041617 - DNA, 14 bp, Homo sapiens
ggagtgactctggc

SEQ ID NO: 5041618 - DNA, 20 bp, Homo sapiens
ggagtgactctggctgccaa

SEQ ID NO: 5041619 - DNA, 22 bp, Homo sapiens
ggagtgactctggctgccaaga

SEQ ID NO: 5041620 - DNA, 12 bp, Homo sapiens
ggagtgccacat

SEQ ID NO: 5041621 - DNA, 17 bp, Homo sapiens
ggatcttacccacttcc

SEQ ID NO: 5041622 - DNA, 22 bp, Homo sapiens
ggatcttacccacttccctgca

SEQ ID NO: 5041623 - DNA, 17 bp, Homo sapiens
ggcaaaccaggctgcag

SEQ ID NO: 5041624 - DNA, 19 bp, Homo sapiens
ggcaaaccaggctgcaggt

SEQ ID NO: 5041625 - DNA, 20 bp, Homo sapiens
ggcactgtcatgcccagctt

SEQ ID NO: 5041626 - DNA, 15 bp, Homo sapiens
ggcagaccagagagc

SEQ ID NO: 5041627 - DNA, 18 bp, Homo sapiens
ggcagaccagagagctca

SEQ ID NO: 5041628 - DNA, 23 bp, Homo sapiens
ggcagcgcccagcctggccccaa

SEQ ID NO: 5041629 - DNA, 21 bp, Homo sapiens
ggccacccccacctccctgca

SEQ ID NO: 5041630 - DNA, 12 bp, Homo sapiens
ggccccagctcc

SEQ ID NO: 5041631 - DNA, 19 bp, Homo sapiens
ggccggcccacgtcctggg

SEQ ID NO: 5041632 - DNA, 19 bp, Homo sapiens
ggcctcttgagagccccac

SEQ ID NO: 5041633 - DNA, 18 bp, Homo sapiens
ggcgcctgggtcctccca

SEQ ID NO: 5041634 - DNA, 18 bp, Homo sapiens
ggcggcctgcagaccctg

SEQ ID NO: 5041635 - DNA, 16 bp, Homo sapiens
ggcggtcactgcccac

SEQ ID NO: 5041636 - DNA, 13 bp, Homo sapiens
ggctcaggctgcc

SEQ ID NO: 5041637 - DNA, 14 bp, Homo sapiens
ggctcggcctcttg

SEQ ID NO: 5041638 - DNA, 15 bp, Homo sapiens
ggctctctggacctg

SEQ ID NO: 5041639 - DNA, 21 bp, Homo sapiens
ggctctctggacctgaccaga

SEQ ID NO: 5041640 - DNA, 15 bp, Homo sapiens
ggctgatgtcttctt

SEQ ID NO: 5041641 - DNA, 20 bp, Homo sapiens
ggctgatgtcttcttggggg

SEQ ID NO: 5041642 - DNA, 23 bp, Homo sapiens
ggctgcccagcggctcttcctgg

SEQ ID NO: 5041643 - DNA, 20 bp, Homo sapiens
ggctgccgctgctctcccag

SEQ ID NO: 5041644 - DNA, 21 bp, Homo sapiens
ggctgccgctgctctcccagg

SEQ ID NO: 5041645 - DNA, 20 bp, Homo sapiens
ggctgctggaaaggcccgga

SEQ ID NO: 5041646 - DNA, 12 bp, Homo sapiens
ggctgctgtcac

SEQ ID NO: 5041647 - DNA, 14 bp, Homo sapiens
ggctggagtgggct

SEQ ID NO: 5041648 - DNA, 20 bp, Homo sapiens
ggctggcggggtctgctcct

SEQ ID NO: 5041649 - DNA, 22 bp, Homo sapiens
ggctgggcgcctctgtcctggc

SEQ ID NO: 5041650 - DNA, 19 bp, Homo sapiens
ggcttcctccctccacgct

SEQ ID NO: 5041651 - DNA, 19 bp, Homo sapiens
gggaagctgagcccctccc

SEQ ID NO: 5041652 - DNA, 20 bp, Homo sapiens
gggaagctgagcccctccct

SEQ ID NO: 5041653 - DNA, 19 bp, Homo sapiens
gggagccgcaggggcccct

SEQ ID NO: 5041654 - DNA, 20 bp, Homo sapiens
gggatccaccgccacactgg

SEQ ID NO: 5041655 - DNA, 19 bp, Homo sapiens
gggatcttacccacttccc

SEQ ID NO: 5041656 - DNA, 21 bp, Homo sapiens
gggcgcaagcgacacaggctg

SEQ ID NO: 5041657 - DNA, 13 bp, Homo sapiens
gggcgcctgggtc

SEQ ID NO: 5041658 - DNA, 15 bp, Homo sapiens
gggcggcctgcagac

SEQ ID NO: 5041659 - DNA, 15 bp, Homo sapiens
gggctctctggacct

SEQ ID NO: 5041660 - DNA, 12 bp, Homo sapiens
ggggatgcaggc

SEQ ID NO: 5041661 - DNA, 17 bp, Homo sapiens
gggtactcagtcagccc

SEQ ID NO: 5041662 - DNA, 22 bp, Homo sapiens
gggtccctgcgtctcctgccca

SEQ ID NO: 5041663 - DNA, 14 bp, Homo sapiens
gggtcgcctgccct

SEQ ID NO: 5041664 - DNA, 15 bp, Homo sapiens
gggtctgtcccgggt

SEQ ID NO: 5041665 - DNA, 19 bp, Homo sapiens
gggtcttagggtacagccc

SEQ ID NO: 5041666 - DNA, 19 bp, Homo sapiens
gggtgggagccacagggac

SEQ ID NO: 5041667 - DNA, 15 bp, Homo sapiens
gggttttcacttcct

SEQ ID NO: 5041668 - DNA, 18 bp, Homo sapiens
ggtactcagtcagcccag

SEQ ID NO: 5041669 - DNA, 23 bp, Homo sapiens
ggtctgtcccgggtactcagtca

SEQ ID NO: 5041670 - DNA, 19 bp, Homo sapiens
ggtgcacctgccccaggct

SEQ ID NO: 5041671 - DNA, 18 bp, Homo sapiens
ggtgctgtcatgcccagc

SEQ ID NO: 5041672 - DNA, 15 bp, Homo sapiens
ggtggcagcgcccag

SEQ ID NO: 5041673 - DNA, 18 bp, Homo sapiens
ggtggcagcgcccagcct

SEQ ID NO: 5041674 - DNA, 19 bp, Homo sapiens
ggtgggagccacagggacg

SEQ ID NO: 5041675 - DNA, 14 bp, Homo sapiens
ggttttcacttcct

SEQ ID NO: 5041676 - DNA, 14 bp, Homo sapiens
gtacagcccaggcg

SEQ ID NO: 5041677 - DNA, 12 bp, Homo sapiens
gtcactgcccac

SEQ ID NO: 5041678 - DNA, 15 bp, Homo sapiens
gtcactgcccacctg

SEQ ID NO: 5041679 - DNA, 20 bp, Homo sapiens
gtcactgcccacctgccagg

SEQ ID NO: 5041680 - DNA, 23 bp, Homo sapiens
gtcactggtaccggatgcagacc

SEQ ID NO: 5041681 - DNA, 14 bp, Homo sapiens
gtcagagcccagga

SEQ ID NO: 5041682 - DNA, 15 bp, Homo sapiens
gtcatgcccagcttg

SEQ ID NO: 5041683 - DNA, 22 bp, Homo sapiens
gtcccgggtactcagtcagccc

SEQ ID NO: 5041684 - DNA, 15 bp, Homo sapiens
gtcctcccagctgac

SEQ ID NO: 5041685 - DNA, 23 bp, Homo sapiens
gtcctggcccgggagccgcaggg

SEQ ID NO: 5041686 - DNA, 10 bp, Homo sapiens
gtcctgggtg

SEQ ID NO: 5041687 - DNA, 17 bp, Homo sapiens
gtcctgggtgctgtcat

SEQ ID NO: 5041688 - DNA, 20 bp, Homo sapiens
gtctccctacttagacccag

SEQ ID NO: 5041689 - DNA, 15 bp, Homo sapiens
gtctccctggcccca

SEQ ID NO: 5041690 - DNA, 15 bp, Homo sapiens
gtctcctgcccactc

SEQ ID NO: 5041691 - DNA, 14 bp, Homo sapiens
gtctgctcctggga

SEQ ID NO: 5041692 - DNA, 15 bp, Homo sapiens
gtctgctcctgggaa

SEQ ID NO: 5041693 - DNA, 12 bp, Homo sapiens
gtcttctccatc

SEQ ID NO: 5041694 - DNA, 13 bp, Homo sapiens
gtgacaggcagtg

SEQ ID NO: 5041695 - DNA, 20 bp, Homo sapiens
gtgaccgggggaagctgagc

SEQ ID NO: 5041696 - DNA, 15 bp, Homo sapiens
gtgactctggctgcc

SEQ ID NO: 5041697 - DNA, 18 bp, Homo sapiens
gtgactctggctgccaag

SEQ ID NO: 5041698 - DNA, 13 bp, Homo sapiens
gtgagatcagtca

SEQ ID NO: 5041699 - DNA, 17 bp, Homo sapiens
gtgagatcagtcagctc

SEQ ID NO: 5041700 - DNA, 17 bp, Homo sapiens
gtgccacgtggccgctg

SEQ ID NO: 5041701 - DNA, 21 bp, Homo sapiens
gtgccacgtggccgctgccca

SEQ ID NO: 5041702 - DNA, 15 bp, Homo sapiens
gtgccatggccagga

SEQ ID NO: 5041703 - DNA, 17 bp, Homo sapiens
gtgctgtcatgcccagc

SEQ ID NO: 5041704 - DNA, 21 bp, Homo sapiens
gtgctgtcatgcccagcttgg

SEQ ID NO: 5041705 - DNA, 19 bp, Homo sapiens
gtggcagcgcccagcctgg

SEQ ID NO: 5041706 - DNA, 21 bp, Homo sapiens
gtgggatcttacccacttccc

SEQ ID NO: 5041707 - DNA, 24 bp, Homo sapiens
gtgggctctctggacctgaccaga

SEQ ID NO: 5041708 - DNA, 19 bp, Homo sapiens
gttggctagtctgtgcctc

SEQ ID NO: 5041709 - DNA, 18 bp, Homo sapiens
gtttgaggaccctcccag

SEQ ID NO: 5041710 - DNA, 18 bp, Homo sapiens
taacacctcttttccctt

SEQ ID NO: 5041711 - DNA, 15 bp, Homo sapiens
tacccacttccctgc

SEQ ID NO: 5041712 - DNA, 17 bp, Homo sapiens
tagaggggacaagccag

SEQ ID NO: 5041713 - DNA, 16 bp, Homo sapiens
tcaccgccgtggggtg

SEQ ID NO: 5041714 - DNA, 19 bp, Homo sapiens
tcactgagaaggccccagg

SEQ ID NO: 5041715 - DNA, 20 bp, Homo sapiens
tcactgagaaggccccaggg

SEQ ID NO: 5041716 - DNA, 11 bp, Homo sapiens
tcactgcccac

SEQ ID NO: 5041717 - DNA, 20 bp, Homo sapiens
tcactgcccacctgccaggc

SEQ ID NO: 5041718 - DNA, 12 bp, Homo sapiens
tcagagcccagg

SEQ ID NO: 5041719 - DNA, 16 bp, Homo sapiens
tcaggctgcccagcgg

SEQ ID NO: 5041720 - DNA, 21 bp, Homo sapiens
tcaggctgcccagcggctctt

SEQ ID NO: 5041721 - DNA, 17 bp, Homo sapiens
tcaggtcagagcccagg

SEQ ID NO: 5041722 - DNA, 19 bp, Homo sapiens
tcaggtcagagcccaggaa

SEQ ID NO: 5041723 - DNA, 20 bp, Homo sapiens
tcaggtcagagcccaggaat

SEQ ID NO: 5041724 - DNA, 15 bp, Homo sapiens
tcatgcccagcttgg

SEQ ID NO: 5041725 - DNA, 19 bp, Homo sapiens
tccagcaggtgttttcctt

SEQ ID NO: 5041726 - DNA, 17 bp, Homo sapiens
tcccagctgctcctaga

SEQ ID NO: 5041727 - DNA, 22 bp, Homo sapiens
tcccattactcaaaatgcagga

SEQ ID NO: 5041728 - DNA, 18 bp, Homo sapiens
tcccgagggcgcctgggt

SEQ ID NO: 5041729 - DNA, 20 bp, Homo sapiens
tcccgtgtcgtaacagcagg

SEQ ID NO: 5041730 - DNA, 21 bp, Homo sapiens
tcccgtgtcgtaacagcagga

SEQ ID NO: 5041731 - DNA, 21 bp, Homo sapiens
tccctccacgcttagggtctg

SEQ ID NO: 5041732 - DNA, 12 bp, Homo sapiens
tccctgcaaggt

SEQ ID NO: 5041733 - DNA, 14 bp, Homo sapiens
tccctgcaaggtgc

SEQ ID NO: 5041734 - DNA, 11 bp, Homo sapiens
tccctgcagct

SEQ ID NO: 5041735 - DNA, 12 bp, Homo sapiens
tccctgcagctt

SEQ ID NO: 5041736 - DNA, 17 bp, Homo sapiens
tccctgcgtctcctgcc

SEQ ID NO: 5041737 - DNA, 20 bp, Homo sapiens
tcctcttcctgcctctctca

SEQ ID NO: 5041738 - DNA, 18 bp, Homo sapiens
tcctggacagtgagagca

SEQ ID NO: 5041739 - DNA, 18 bp, Homo sapiens
tctcacaggttcacccag

SEQ ID NO: 5041740 - DNA, 13 bp, Homo sapiens
tctcccaggtgaa

SEQ ID NO: 5041741 - DNA, 14 bp, Homo sapiens
tctccctggcccca

SEQ ID NO: 5041742 - DNA, 23 bp, Homo sapiens
tctctcatggcttgggctggagt

SEQ ID NO: 5041743 - DNA, 13 bp, Homo sapiens
tctctggacctga

SEQ ID NO: 5041744 - DNA, 13 bp, Homo sapiens
tctgctcctggga

SEQ ID NO: 5041745 - DNA, 17 bp, Homo sapiens
tctgtgcctcagtgaga

SEQ ID NO: 5041746 - DNA, 14 bp, Homo sapiens
tcttagggtacagc

SEQ ID NO: 5041747 - DNA, 23 bp, Homo sapiens
tcttgggggcagaccagagagct

SEQ ID NO: 5041748 - DNA, 20 bp, Homo sapiens
tgacaggcagtgttcttggg

SEQ ID NO: 5041749 - DNA, 16 bp, Homo sapiens
tgactctggctgccaa

SEQ ID NO: 5041750 - DNA, 17 bp, Homo sapiens
tgactctggctgccaag

SEQ ID NO: 5041751 - DNA, 17 bp, Homo sapiens
tgactggtcccccatgg

SEQ ID NO: 5041752 - DNA, 16 bp, Homo sapiens
tgagaaggccccaggg

SEQ ID NO: 5041753 - DNA, 20 bp, Homo sapiens
tgagcccctccctcctgtgt

SEQ ID NO: 5041754 - DNA, 19 bp, Homo sapiens
tgagggcaaaccaggctgc

SEQ ID NO: 5041755 - DNA, 16 bp, Homo sapiens
tgcaaggtgcacctgc

SEQ ID NO: 5041756 - DNA, 12 bp, Homo sapiens
tgcagaccctgc

SEQ ID NO: 5041757 - DNA, 17 bp, Homo sapiens
tgcagaccctgccaggg

SEQ ID NO: 5041758 - DNA, 15 bp, Homo sapiens
tgcaggacagatcag

SEQ ID NO: 5041759 - DNA, 20 bp, Homo sapiens
tgcaggcaagacaccttccc

SEQ ID NO: 5041760 - DNA, 18 bp, Homo sapiens
tgcatctgtggcctgggg

SEQ ID NO: 5041761 - DNA, 19 bp, Homo sapiens
tgcatctgtggcctggggc

SEQ ID NO: 5041762 - DNA, 21 bp, Homo sapiens
tgccacatggccgctgcccac

SEQ ID NO: 5041763 - DNA, 17 bp, Homo sapiens
tgccaggctgcagggac

SEQ ID NO: 5041764 - DNA, 19 bp, Homo sapiens
tgccaggctgcagggacag

SEQ ID NO: 5041765 - DNA, 23 bp, Homo sapiens
tgccagggggtttgaggaccctc

SEQ ID NO: 5041766 - DNA, 17 bp, Homo sapiens
tgcccacctgccaggct

SEQ ID NO: 5041767 - DNA, 18 bp, Homo sapiens
tgcccacctgccaggctg

SEQ ID NO: 5041768 - DNA, 16 bp, Homo sapiens
tgcccacgtcccgggc

SEQ ID NO: 5041769 - DNA, 18 bp, Homo sapiens
tgcccactctgaccgggc

SEQ ID NO: 5041770 - DNA, 15 bp, Homo sapiens
tgcccagcttggagt

SEQ ID NO: 5041771 - DNA, 18 bp, Homo sapiens
tgccgctgctctcccagg

SEQ ID NO: 5041772 - DNA, 13 bp, Homo sapiens
tgctctcccaggt

SEQ ID NO: 5041773 - DNA, 14 bp, Homo sapiens
tgctgtcatgccca

SEQ ID NO: 5041774 - DNA, 17 bp, Homo sapiens
tgctgtcatgcccagct

SEQ ID NO: 5041775 - DNA, 17 bp, Homo sapiens
tgctgtgacaggcagtg

SEQ ID NO: 5041776 - DNA, 13 bp, Homo sapiens
tggacctgaccag

SEQ ID NO: 5041777 - DNA, 20 bp, Homo sapiens
tggagcgtttttgctggctt

SEQ ID NO: 5041778 - DNA, 20 bp, Homo sapiens
tggccgcaacttcccaggcc

SEQ ID NO: 5041779 - DNA, 20 bp, Homo sapiens
tggccgctgctgtgacaggc

SEQ ID NO: 5041780 - DNA, 19 bp, Homo sapiens
tggcggggtctgctcctgg

SEQ ID NO: 5041781 - DNA, 15 bp, Homo sapiens
tggctagtctgtgcc

SEQ ID NO: 5041782 - DNA, 15 bp, Homo sapiens
tgggagaggagaggc

SEQ ID NO: 5041783 - DNA, 19 bp, Homo sapiens
tgggagaggagaggctgct

SEQ ID NO: 5041784 - DNA, 14 bp, Homo sapiens
tgggagatgcagct

SEQ ID NO: 5041785 - DNA, 15 bp, Homo sapiens
tgggagatgcagctg

SEQ ID NO: 5041786 - DNA, 17 bp, Homo sapiens
tgggagatgcagctgga

SEQ ID NO: 5041787 - DNA, 13 bp, Homo sapiens
tgggagccacagg

SEQ ID NO: 5041788 - DNA, 22 bp, Homo sapiens
tgggcgcctctgtcctggcccg

SEQ ID NO: 5041789 - DNA, 23 bp, Homo sapiens
tgggctctctggacctgaccaga

SEQ ID NO: 5041790 - DNA, 14 bp, Homo sapiens
tgggctggagtggg

SEQ ID NO: 5041791 - DNA, 18 bp, Homo sapiens
tggggtgggagccacagg

SEQ ID NO: 5041792 - DNA, 18 bp, Homo sapiens
tggggttttcacttccta

SEQ ID NO: 5041793 - DNA, 19 bp, Homo sapiens
tggggttttcacttcctag

SEQ ID NO: 5041794 - DNA, 16 bp, Homo sapiens
tgggtagtgccatggc

SEQ ID NO: 5041795 - DNA, 16 bp, Homo sapiens
tgggtcctcccagctg

SEQ ID NO: 5041796 - DNA, 19 bp, Homo sapiens
tgtcatgcccagcttggag

SEQ ID NO: 5041797 - DNA, 13 bp, Homo sapiens
tgtgggtccctgc

SEQ ID NO: 5041798 - DNA, 17 bp, Homo sapiens
tgtttaatacgcttgag

SEQ ID NO: 5041799 - DNA, 17 bp, Homo sapiens
tgtttctttccttctga

SEQ ID NO: 5041800 - DNA, 14 bp, Homo sapiens
tgttttccttcaca

SEQ ID NO: 5041801 - DNA, 19 bp, Homo sapiens
ttagggtacagcccaggcg

SEQ ID NO: 5041802 - DNA, 13 bp, Homo sapiens
ttagggtctgtcc

SEQ ID NO: 5041803 - DNA, 18 bp, Homo sapiens
ttcccagctgctcctaga

SEQ ID NO: 5041804 - DNA, 16 bp, Homo sapiens
ttcctggacagtgaga

SEQ ID NO: 5041805 - DNA, 17 bp, Homo sapiens
ttcctggacagtgagag

SEQ ID NO: 5041806 - DNA, 16 bp, Homo sapiens
ttgaagggggatgcag

SEQ ID NO: 5041807 - DNA, 23 bp, Homo sapiens
ttggagtgccacatggccgctgc

SEQ ID NO: 5041808 - DNA, 16 bp, Homo sapiens
ttggctagtctgtgcc

SEQ ID NO: 5041809 - DNA, 12 bp, Homo sapiens
ttgggggcagac

SEQ ID NO: 5041810 - DNA, 17 bp, Homo sapiens
ttgtcttgatcctcact

SEQ ID NO: 5041811 - DNA, 17 bp, Homo sapiens
tttgaggaccctcccag

SEQ ID NO: 5041812 - DNA, 13 bp, Homo sapiens
aaacaagcgccac

SEQ ID NO: 5041813 - DNA, 15 bp, Homo sapiens
aaaccaggctgcagg

SEQ ID NO: 5041814 - DNA, 16 bp, Homo sapiens
aaaccaggctgcaggt

SEQ ID NO: 5041815 - DNA, 15 bp, Homo sapiens
aaagaaccaggaggc

SEQ ID NO: 5041816 - DNA, 17 bp, Homo sapiens
aaccaggaggcctggga

SEQ ID NO: 5041817 - DNA, 18 bp, Homo sapiens
aagcgacacaggctgccg

SEQ ID NO: 5041818 - DNA, 21 bp, Homo sapiens
aaggtgcacctgccccaggct

SEQ ID NO: 5041819 - DNA, 23 bp, Homo sapiens
aatgttggctagtctgtgcctca

SEQ ID NO: 5041820 - DNA, 18 bp, Homo sapiens
acactggccggcccacgt

SEQ ID NO: 5041821 - DNA, 17 bp, Homo sapiens
acagcaggagcatggcc

SEQ ID NO: 5041822 - DNA, 22 bp, Homo sapiens
acagcccaggcggtcactgccc

SEQ ID NO: 5041823 - DNA, 20 bp, Homo sapiens
acagccccaaacaagcgcca

SEQ ID NO: 5041824 - DNA, 16 bp, Homo sapiens
accacgtctccctggc

SEQ ID NO: 5041825 - DNA, 18 bp, Homo sapiens
accagactgtgggtccct

SEQ ID NO: 5041826 - DNA, 15 bp, Homo sapiens
accaggaggcctggg

SEQ ID NO: 5041827 - DNA, 18 bp, Homo sapiens
accaggaggcctgggaga

SEQ ID NO: 5041828 - DNA, 15 bp, Homo sapiens
acccacttccctgca

SEQ ID NO: 5041829 - DNA, 18 bp, Homo sapiens
acccacttccctgcaagg

SEQ ID NO: 5041830 - DNA, 19 bp, Homo sapiens
acccacttccctgcaaggt

SEQ ID NO: 5041831 - DNA, 17 bp, Homo sapiens
accccaccctgtctgca

SEQ ID NO: 5041832 - DNA, 16 bp, Homo sapiens
accctgccagggggtt

SEQ ID NO: 5041833 - DNA, 15 bp, Homo sapiens
accctgtctgcaggc

SEQ ID NO: 5041834 - DNA, 14 bp, Homo sapiens
acctccctgcagct

SEQ ID NO: 5041835 - DNA, 15 bp, Homo sapiens
acctccctgcagctt

SEQ ID NO: 5041836 - DNA, 14 bp, Homo sapiens
acctgaccagactg

SEQ ID NO: 5041837 - DNA, 11 bp, Homo sapiens
acctgccaggc

SEQ ID NO: 5041838 - DNA, 16 bp, Homo sapiens
acctgccaggctgcag

SEQ ID NO: 5041839 - DNA, 18 bp, Homo sapiens
acctgccaggctgcaggg

SEQ ID NO: 5041840 - DNA, 13 bp, Homo sapiens
acctgccccaggc

SEQ ID NO: 5041841 - DNA, 23 bp, Homo sapiens
acggcagtaaatccacagtgagt

SEQ ID NO: 5041842 - DNA, 20 bp, Homo sapiens
acgtggccgctgctgtgaca

SEQ ID NO: 5041843 - DNA, 16 bp, Homo sapiens
actctggctgccaaga

SEQ ID NO: 5041844 - DNA, 15 bp, Homo sapiens
actgcccacctgcca

SEQ ID NO: 5041845 - DNA, 17 bp, Homo sapiens
actgcccacctgccagg

SEQ ID NO: 5041846 - DNA, 15 bp, Homo sapiens
actggccccagctcc

SEQ ID NO: 5041847 - DNA, 20 bp, Homo sapiens
actggtcccccatgggctgc

SEQ ID NO: 5041848 - DNA, 15 bp, Homo sapiens
actgtcatgcccagc

SEQ ID NO: 5041849 - DNA, 16 bp, Homo sapiens
actgtcatgcccagct

SEQ ID NO: 5041850 - DNA, 19 bp, Homo sapiens
actgtcatgcccagcttgg

SEQ ID NO: 5041851 - DNA, 18 bp, Homo sapiens
actgtgggtccctgcgtc

SEQ ID NO: 5041852 - DNA, 15 bp, Homo sapiens
acttagacccagtca

SEQ ID NO: 5041853 - DNA, 12 bp, Homo sapiens
acttcccaggcc

SEQ ID NO: 5041854 - DNA, 18 bp, Homo sapiens
actttggccacagcccca

SEQ ID NO: 5041855 - DNA, 16 bp, Homo sapiens
agacaccttcccagct

SEQ ID NO: 5041856 - DNA, 12 bp, Homo sapiens
agagagctcaag

SEQ ID NO: 5041857 - DNA, 23 bp, Homo sapiens
agagagctcaagtttcagagtca

SEQ ID NO: 5041858 - DNA, 14 bp, Homo sapiens
agaggagaggctgc

SEQ ID NO: 5041859 - DNA, 13 bp, Homo sapiens
agaggctgctgtc

SEQ ID NO: 5041860 - DNA, 20 bp, Homo sapiens
agatcaggtcagagcccagg

SEQ ID NO: 5041861 - DNA, 21 bp, Homo sapiens
agatcaggtcagagcccagga

SEQ ID NO: 5041862 - DNA, 16 bp, Homo sapiens
agatgcagctggatgg

SEQ ID NO: 5041863 - DNA, 20 bp, Homo sapiens
agatgcatctgtggcctggg

SEQ ID NO: 5041864 - DNA, 16 bp, Homo sapiens
agcaggagcatggccg

SEQ ID NO: 5041865 - DNA, 15 bp, Homo sapiens
agcagggctgggcgc

SEQ ID NO: 5041866 - DNA, 20 bp, Homo sapiens
agcccaggaattctcacagg

SEQ ID NO: 5041867 - DNA, 14 bp, Homo sapiens
agcctggccccaag

SEQ ID NO: 5041868 - DNA, 13 bp, Homo sapiens
agcgacacaggct

SEQ ID NO: 5041869 - DNA, 15 bp, Homo sapiens
agcggctcttcctgg

SEQ ID NO: 5041870 - DNA, 21 bp, Homo sapiens
agctccgagtggctcccgtgt

SEQ ID NO: 5041871 - DNA, 17 bp, Homo sapiens
agctgctcctagagggg

SEQ ID NO: 5041872 - DNA, 22 bp, Homo sapiens
agctggatggggcggcctgcag

SEQ ID NO: 5041873 - DNA, 19 bp, Homo sapiens
agcttggagtgccacgtgg

SEQ ID NO: 5041874 - DNA, 13 bp, Homo sapiens
aggaagggccccc

SEQ ID NO: 5041875 - DNA, 15 bp, Homo sapiens
aggaattctcacagg

SEQ ID NO: 5041876 - DNA, 14 bp, Homo sapiens
aggagaggctgctg

SEQ ID NO: 5041877 - DNA, 14 bp, Homo sapiens
aggaggcctgggag

SEQ ID NO: 5041878 - DNA, 20 bp, Homo sapiens
aggagtgactctggctgcca

SEQ ID NO: 5041879 - DNA, 21 bp, Homo sapiens
aggcaagacaccttcccagct

SEQ ID NO: 5041880 - DNA, 16 bp, Homo sapiens
aggcctgggagatgca

SEQ ID NO: 5041881 - DNA, 20 bp, Homo sapiens
aggcctgggagatgcagctg

SEQ ID NO: 5041882 - DNA, 16 bp, Homo sapiens
aggctgccgctgctct

SEQ ID NO: 5041883 - DNA, 22 bp, Homo sapiens
aggctgccgctgctctcccagg

SEQ ID NO: 5041884 - DNA, 14 bp, Homo sapiens
aggctggcggggtc

SEQ ID NO: 5041885 - DNA, 23 bp, Homo sapiens
agggacagttgggtgtgagaata

SEQ ID NO: 5041886 - DNA, 19 bp, Homo sapiens
agggcaaaccaggctgcag

SEQ ID NO: 5041887 - DNA, 21 bp, Homo sapiens
agggcaaaccaggctgcaggt

SEQ ID NO: 5041888 - DNA, 21 bp, Homo sapiens
agggcccccggctcggcctct

SEQ ID NO: 5041889 - DNA, 14 bp, Homo sapiens
agggcgcctgggtc

SEQ ID NO: 5041890 - DNA, 21 bp, Homo sapiens
agggcgcctgggtcctcccag

SEQ ID NO: 5041891 - DNA, 22 bp, Homo sapiens
agggcgcctgggtcctcccagc

SEQ ID NO: 5041892 - DNA, 22 bp, Homo sapiens
agggctgggcgcctctgtcctg

SEQ ID NO: 5041893 - DNA, 18 bp, Homo sapiens
aggggacaagccaggccc

SEQ ID NO: 5041894 - DNA, 15 bp, Homo sapiens
aggtcagagcccagg

SEQ ID NO: 5041895 - DNA, 20 bp, Homo sapiens
aggtgcacctgccccaggct

SEQ ID NO: 5041896 - DNA, 21 bp, Homo sapiens
aggtgcacctgccccaggctc

SEQ ID NO: 5041897 - DNA, 15 bp, Homo sapiens
aggttcacccagcgc

SEQ ID NO: 5041898 - DNA, 22 bp, Homo sapiens
agtcagctccgagtggctcccg

SEQ ID NO: 5041899 - DNA, 16 bp, Homo sapiens
agtcctcggcagctcc

SEQ ID NO: 5041900 - DNA, 22 bp, Homo sapiens
agtgaccgggggaagctgagcc

SEQ ID NO: 5041901 - DNA, 19 bp, Homo sapiens
agtgactctggctgccaag

SEQ ID NO: 5041902 - DNA, 20 bp, Homo sapiens
agtgactctggctgccaaga

SEQ ID NO: 5041903 - DNA, 19 bp, Homo sapiens
agtgagagcagggctgggc

SEQ ID NO: 5041904 - DNA, 20 bp, Homo sapiens
agtgttcttgggggtggggc

SEQ ID NO: 5041905 - DNA, 22 bp, Homo sapiens
atcaagatcaaagaaccaggag

SEQ ID NO: 5041906 - DNA, 18 bp, Homo sapiens
atcaggtcagagcccagg

SEQ ID NO: 5041907 - DNA, 17 bp, Homo sapiens
atccacagtgagttggg

SEQ ID NO: 5041908 - DNA, 19 bp, Homo sapiens
atcgccctgagctactgct

SEQ ID NO: 5041909 - DNA, 17 bp, Homo sapiens
atggaaacgcacaaccc

SEQ ID NO: 5041910 - DNA, 15 bp, Homo sapiens
atggccaggagtggg

SEQ ID NO: 5041911 - DNA, 13 bp, Homo sapiens
atggccgctgccc

SEQ ID NO: 5041912 - DNA, 20 bp, Homo sapiens
atggcttgggctggagtggg

SEQ ID NO: 5041913 - DNA, 20 bp, Homo sapiens
atggggtgggagccacaggg

SEQ ID NO: 5041914 - DNA, 22 bp, Homo sapiens
attctagagggatccaccgcca

SEQ ID NO: 5041915 - DNA, 20 bp, Homo sapiens
attctcacaggttcacccag

SEQ ID NO: 5041916 - DNA, 20 bp, Homo sapiens
cctcactgagaaggccccag

SEQ ID NO: 5041917 - DNA, 23 bp, Homo sapiens
cctcactgagaaggccccagggc

SEQ ID NO: 5041918 - DNA, 16 bp, Homo sapiens
cctccagagcctgggc

SEQ ID NO: 5041919 - DNA, 17 bp, Homo sapiens
cctccagagcctgggcg

SEQ ID NO: 5041920 - DNA, 11 bp, Homo sapiens
cctccctgcag

SEQ ID NO: 5041921 - DNA, 14 bp, Homo sapiens
cctccctgcagctt

SEQ ID NO: 5041922 - DNA, 23 bp, Homo sapiens
cctcgtcccgagggcgcctgggt

SEQ ID NO: 5041923 - DNA, 14 bp, Homo sapiens
cctctctcatggct

SEQ ID NO: 5041924 - DNA, 21 bp, Homo sapiens
cctcttttcccttgtgtgagg

SEQ ID NO: 5041925 - DNA, 18 bp, Homo sapiens
cctgaactggccccagct

SEQ ID NO: 5041926 - DNA, 17 bp, Homo sapiens
cctgcaaggtgcacctg

SEQ ID NO: 5041927 - DNA, 16 bp, Homo sapiens
cctgcagaccctgcca

SEQ ID NO: 5041928 - DNA, 14 bp, Homo sapiens
cctgccaggctgca

SEQ ID NO: 5041929 - DNA, 15 bp, Homo sapiens
cctgccccaggctca

SEQ ID NO: 5041930 - DNA, 23 bp, Homo sapiens
cctgcctctctcatggcttgggc

SEQ ID NO: 5041931 - DNA, 14 bp, Homo sapiens
cctggacagtgaga

SEQ ID NO: 5041932 - DNA, 15 bp, Homo sapiens
cctggacagtgagag

SEQ ID NO: 5041933 - DNA, 19 bp, Homo sapiens
cctggccccagtgaccggg

SEQ ID NO: 5041934 - DNA, 19 bp, Homo sapiens
cctgggtcctcccagctga

SEQ ID NO: 5041935 - DNA, 16 bp, Homo sapiens
cctgggtgctgtcatg

SEQ ID NO: 5041936 - DNA, 18 bp, Homo sapiens
ccttcccagctgctccta

SEQ ID NO: 5041937 - DNA, 15 bp, Homo sapiens
cgacacaggctgccg

SEQ ID NO: 5041938 - DNA, 16 bp, Homo sapiens
cgacacaggctgccgc

SEQ ID NO: 5041939 - DNA, 15 bp, Homo sapiens
cgagggcgcctgggt

SEQ ID NO: 5041940 - DNA, 17 bp, Homo sapiens
cgcaagcgacacaggct

SEQ ID NO: 5041941 - DNA, 16 bp, Homo sapiens
cgccacactggccggc

SEQ ID NO: 5041942 - DNA, 13 bp, Homo sapiens
cgcccagcctggc

SEQ ID NO: 5041943 - DNA, 16 bp, Homo sapiens
cgccctctacctccta

SEQ ID NO: 5041944 - DNA, 14 bp, Homo sapiens
cgcctctgtcctgg

SEQ ID NO: 5041945 - DNA, 19 bp, Homo sapiens
cgcctgggtcctcccagct

SEQ ID NO: 5041946 - DNA, 13 bp, Homo sapiens
cgctgctctccca

SEQ ID NO: 5041947 - DNA, 15 bp, Homo sapiens
cggcccacgtcctgg

SEQ ID NO: 5041948 - DNA, 18 bp, Homo sapiens
cggcccacgtcctgggtg

SEQ ID NO: 5041949 - DNA, 17 bp, Homo sapiens
cggcctcttgagagccc

SEQ ID NO: 5041950 - DNA, 19 bp, Homo sapiens
cggcctgcagaccctgcca

SEQ ID NO: 5041951 - DNA, 24 bp, Homo sapiens
cggctcggcctcttgagagcccca

SEQ ID NO: 5041952 - DNA, 17 bp, Homo sapiens
cgggtggcagcgcccag

SEQ ID NO: 5041953 - DNA, 21 bp, Homo sapiens
cgtcccgagggcgcctgggtc

SEQ ID NO: 5041954 - DNA, 17 bp, Homo sapiens
cgtctccctggccccag

SEQ ID NO: 5041955 - DNA, 16 bp, Homo sapiens
cgtggccgctgcccac

SEQ ID NO: 5041956 - DNA, 19 bp, Homo sapiens
cgtttttgctggcttgcac

SEQ ID NO: 5041957 - DNA, 16 bp, Homo sapiens
ctaatcgccctgagct

SEQ ID NO: 5041958 - DNA, 17 bp, Homo sapiens
ctaatcgccctgagcta

SEQ ID NO: 5041959 - DNA, 15 bp, Homo sapiens
ctacttagacccagt

SEQ ID NO: 5041960 - DNA, 15 bp, Homo sapiens
ctagtctgtgcctca

SEQ ID NO: 5041961 - DNA, 16 bp, Homo sapiens
ctagtctgtgcctcag

SEQ ID NO: 5041962 - DNA, 17 bp, Homo sapiens
ctcacaggttcacccag

SEQ ID NO: 5041963 - DNA, 22 bp, Homo sapiens
ctcactgagaaggccccagggc

SEQ ID NO: 5041964 - DNA, 12 bp, Homo sapiens
ctcaggctgccc

SEQ ID NO: 5041965 - DNA, 14 bp, Homo sapiens
ctcaggctgcccag

SEQ ID NO: 5041966 - DNA, 15 bp, Homo sapiens
ctcaggctgcccagc

SEQ ID NO: 5041967 - DNA, 14 bp, Homo sapiens
ctcagtcagcccag

SEQ ID NO: 5041968 - DNA, 15 bp, Homo sapiens
ctcagtcagcccagt

SEQ ID NO: 5041969 - DNA, 17 bp, Homo sapiens
ctcagtcagcccagtgg

SEQ ID NO: 5041970 - DNA, 13 bp, Homo sapiens
ctcatggcttggg

SEQ ID NO: 5041971 - DNA, 18 bp, Homo sapiens
ctccagagcctgggcgca

SEQ ID NO: 5041972 - DNA, 13 bp, Homo sapiens
ctccctcctgtgt

SEQ ID NO: 5041973 - DNA, 16 bp, Homo sapiens
ctccggaaggacacag

SEQ ID NO: 5041974 - DNA, 15 bp, Homo sapiens
ctcctgcccactctg

SEQ ID NO: 5041975 - DNA, 13 bp, Homo sapiens
ctctctgcagtcc

SEQ ID NO: 5041976 - DNA, 15 bp, Homo sapiens
ctctctggacctgac

SEQ ID NO: 5041977 - DNA, 21 bp, Homo sapiens
ctctgcagtcctcggcagctc

SEQ ID NO: 5041978 - DNA, 20 bp, Homo sapiens
ctctggacctgaccagactg

SEQ ID NO: 5041979 - DNA, 12 bp, Homo sapiens
ctctggctgcca

SEQ ID NO: 5041980 - DNA, 16 bp, Homo sapiens
ctctggctgccaagat

SEQ ID NO: 5041981 - DNA, 14 bp, Homo sapiens
ctctgtcctggccc

SEQ ID NO: 5041982 - DNA, 19 bp, Homo sapiens
ctgaactggccccagctcc

SEQ ID NO: 5041983 - DNA, 18 bp, Homo sapiens
ctgagaaggccccagggc

SEQ ID NO: 5041984 - DNA, 23 bp, Homo sapiens
ctgatgtcttcttgggggcagac

SEQ ID NO: 5041985 - DNA, 18 bp, Homo sapiens
ctgcaaggtgcacctgcc

SEQ ID NO: 5041986 - DNA, 17 bp, Homo sapiens
ctgcagctttgaggctg

SEQ ID NO: 5041987 - DNA, 14 bp, Homo sapiens
ctgcaggccacccc

SEQ ID NO: 5041988 - DNA, 20 bp, Homo sapiens
ctgcagtcctcggcagctcc

SEQ ID NO: 5041989 - DNA, 17 bp, Homo sapiens
ctgcccacctgccaggc

SEQ ID NO: 5041990 - DNA, 19 bp, Homo sapiens
ctgcccacctgccaggctg

SEQ ID NO: 5041991 - DNA, 22 bp, Homo sapiens
ctgcccacgtcccgggcactgt

SEQ ID NO: 5041992 - DNA, 14 bp, Homo sapiens
ctgcgtctcctgcc

SEQ ID NO: 5041993 - DNA, 17 bp, Homo sapiens
ctgcgtctcctgcccac

SEQ ID NO: 5041994 - DNA, 15 bp, Homo sapiens
ctggaaaggcccgga

SEQ ID NO: 5041995 - DNA, 20 bp, Homo sapiens
ctggaccacgtctccctggc

SEQ ID NO: 5041996 - DNA, 23 bp, Homo sapiens
ctggacctgaccagactgtgggt

SEQ ID NO: 5041997 - DNA, 16 bp, Homo sapiens
ctggagtgggctctct

SEQ ID NO: 5041998 - DNA, 23 bp, Homo sapiens
ctggagtgggctctctggacctg

SEQ ID NO: 5041999 - DNA, 13 bp, Homo sapiens
ctggccccagtga

SEQ ID NO: 5042000 - DNA, 18 bp, Homo sapiens
ctggccccagtgaccggg

SEQ ID NO: 5042001 - DNA, 14 bp, Homo sapiens
ctgggagatgcagc

SEQ ID NO: 5042002 - DNA, 16 bp, Homo sapiens
ctgggagatgcagctg

SEQ ID NO: 5042003 - DNA, 14 bp, Homo sapiens
ctgggcgcctctgt

SEQ ID NO: 5042004 - DNA, 20 bp, Homo sapiens
ctgggcgcctctgtcctggc

SEQ ID NO: 5042005 - DNA, 19 bp, Homo sapiens
ctgggtcctcccagctgac

SEQ ID NO: 5042006 - DNA, 11 bp, Homo sapiens
ctgtctgcagg

SEQ ID NO: 5042007 - DNA, 20 bp, Homo sapiens
ctgtctgcaggccaccccca

SEQ ID NO: 5042008 - DNA, 13 bp, Homo sapiens
ctgtgcctcagtg

SEQ ID NO: 5042009 - DNA, 16 bp, Homo sapiens
ctgtgcctcagtgaga

SEQ ID NO: 5042010 - DNA, 13 bp, Homo sapiens
ctgtggcctgggg

SEQ ID NO: 5042011 - DNA, 17 bp, Homo sapiens
ctgtgggtccctgcgtc

SEQ ID NO: 5042012 - DNA, 14 bp, Homo sapiens
cttacccacttccc

SEQ ID NO: 5042013 - DNA, 17 bp, Homo sapiens
cttagggtacagcccag

SEQ ID NO: 5042014 - DNA, 15 bp, Homo sapiens
cttcccagctgctcc

SEQ ID NO: 5042015 - DNA, 13 bp, Homo sapiens
cttcctgcctctc

SEQ ID NO: 5042016 - DNA, 17 bp, Homo sapiens
cttcctggacagtgaga

SEQ ID NO: 5042017 - DNA, 17 bp, Homo sapiens
cttgagagccccacccc

SEQ ID NO: 5042018 - DNA, 20 bp, Homo sapiens
cttggagtgccacgtggccg

SEQ ID NO: 5042019 - DNA, 12 bp, Homo sapiens
ctttggccacag

SEQ ID NO: 5042020 - DNA, 14 bp, Homo sapiens
cttttcccttgtgt

SEQ ID NO: 5042021 - DNA, 17 bp, Homo sapiens
gaacaggagtgactctg

SEQ ID NO: 5042022 - DNA, 19 bp, Homo sapiens
gaacaggagtgactctggc

SEQ ID NO: 5042023 - DNA, 20 bp, Homo sapiens
gaaccaggaggcctgggaga

SEQ ID NO: 5042024 - DNA, 14 bp, Homo sapiens
gaactggccccagc

SEQ ID NO: 5042025 - DNA, 19 bp, Homo sapiens
gaaggacacagtcaggggc

SEQ ID NO: 5042026 - DNA, 16 bp, Homo sapiens
gaaggccccagggcag

SEQ ID NO: 5042027 - DNA, 15 bp, Homo sapiens
gaagggcccccggct

SEQ ID NO: 5042028 - DNA, 12 bp, Homo sapiens
gacacaggctgc

SEQ ID NO: 5042029 - DNA, 16 bp, Homo sapiens
gacaccttcccagctg

SEQ ID NO: 5042030 - DNA, 17 bp, Homo sapiens
gaccacgtctccctggc

SEQ ID NO: 5042031 - DNA, 21 bp, Homo sapiens
gaccacgtctccctggcccca

SEQ ID NO: 5042032 - DNA, 14 bp, Homo sapiens
tgcaggtggggttt

SEQ ID NO: 5042033 - DNA, 15 bp, Homo sapiens
tgccacatggccgct

SEQ ID NO: 5042034 - DNA, 19 bp, Homo sapiens
tgccacgtggccgctgccc

SEQ ID NO: 5042035 - DNA, 21 bp, Homo sapiens
tgccacgtggccgctgcccac

SEQ ID NO: 5042036 - DNA, 16 bp, Homo sapiens
tgccaggctgcaggga

SEQ ID NO: 5042037 - DNA, 15 bp, Homo sapiens
tgccatggccaggag

SEQ ID NO: 5042038 - DNA, 15 bp, Homo sapiens
tgcccacctgccagg

SEQ ID NO: 5042039 - DNA, 17 bp, Homo sapiens
tgcccacgtcccgggca

SEQ ID NO: 5042040 - DNA, 15 bp, Homo sapiens
tgcccactctgaccg

SEQ ID NO: 5042041 - DNA, 18 bp, Homo sapiens
tgccccaggctcaggctg

SEQ ID NO: 5042042 - DNA, 21 bp, Homo sapiens
tgccccaggctcaggctgccc

SEQ ID NO: 5042043 - DNA, 19 bp, Homo sapiens
tgccgctgctctcccaggt

SEQ ID NO: 5042044 - DNA, 23 bp, Homo sapiens
tgcctctctcatggcttgggctg

SEQ ID NO: 5042045 - DNA, 15 bp, Homo sapiens
tgctctcccaggtga

SEQ ID NO: 5042046 - DNA, 13 bp, Homo sapiens
tgctggcttgcac

SEQ ID NO: 5042047 - DNA, 12 bp, Homo sapiens
tggacagtgaga

SEQ ID NO: 5042048 - DNA, 18 bp, Homo sapiens
tggagtgccacatggccg

SEQ ID NO: 5042049 - DNA, 21 bp, Homo sapiens
tggagtgccacatggccgctg

SEQ ID NO: 5042050 - DNA, 19 bp, Homo sapiens
tggatggggcggcctgcag

SEQ ID NO: 5042051 - DNA, 14 bp, Homo sapiens
tggccaggagtggg

SEQ ID NO: 5042052 - DNA, 22 bp, Homo sapiens
tggccccagctcctcttcctgc

SEQ ID NO: 5042053 - DNA, 12 bp, Homo sapiens
tggccccagtga

SEQ ID NO: 5042054 - DNA, 16 bp, Homo sapiens
tggccgcaacttccca

SEQ ID NO: 5042055 - DNA, 19 bp, Homo sapiens
tggccgcaacttcccaggc

SEQ ID NO: 5042056 - DNA, 21 bp, Homo sapiens
tggccgcaacttcccaggccg

SEQ ID NO: 5042057 - DNA, 18 bp, Homo sapiens
tggccgctgctgtgacag

SEQ ID NO: 5042058 - DNA, 21 bp, Homo sapiens
tggcggggtctgctcctggga

SEQ ID NO: 5042059 - DNA, 16 bp, Homo sapiens
tggctagtctgtgcct

SEQ ID NO: 5042060 - DNA, 13 bp, Homo sapiens
tgggaatggggtg

SEQ ID NO: 5042061 - DNA, 18 bp, Homo sapiens
tgggagaggagaggctgc

SEQ ID NO: 5042062 - DNA, 16 bp, Homo sapiens
tgggagatgcagctgg

SEQ ID NO: 5042063 - DNA, 19 bp, Homo sapiens
tgggctctctggacctgac

SEQ ID NO: 5042064 - DNA, 13 bp, Homo sapiens
tggggcggcctgc

SEQ ID NO: 5042065 - DNA, 13 bp, Homo sapiens
tggggctgcatcc

SEQ ID NO: 5042066 - DNA, 21 bp, Homo sapiens
tggggtcttagggtacagccc

SEQ ID NO: 5042067 - DNA, 20 bp, Homo sapiens
tggggttttcacttcctagg

SEQ ID NO: 5042068 - DNA, 18 bp, Homo sapiens
tgggtagtgccatggcca

SEQ ID NO: 5042069 - DNA, 21 bp, Homo sapiens
tgggtagtgccatggccagga

SEQ ID NO: 5042070 - DNA, 22 bp, Homo sapiens
tgggtagtgccatggccaggag

SEQ ID NO: 5042071 - DNA, 20 bp, Homo sapiens
tgggtccctgcgtctcctgc

SEQ ID NO: 5042072 - DNA, 19 bp, Homo sapiens
tgggtgctgtcatgcccag

SEQ ID NO: 5042073 - DNA, 14 bp, Homo sapiens
tgggtttccctgcg

SEQ ID NO: 5042074 - DNA, 18 bp, Homo sapiens
tgtcatgcccagcttgga

SEQ ID NO: 5042075 - DNA, 18 bp, Homo sapiens
tgtcccgggtactcagtc

SEQ ID NO: 5042076 - DNA, 19 bp, Homo sapiens
tgtcccgggtactcagtca

SEQ ID NO: 5042077 - DNA, 21 bp, Homo sapiens
tgttcttgggggtggggctgc

SEQ ID NO: 5042078 - DNA, 16 bp, Homo sapiens
ttcaaccattgaaggg

SEQ ID NO: 5042079 - DNA, 12 bp, Homo sapiens
ttcctccctcca

SEQ ID NO: 5042080 - DNA, 17 bp, Homo sapiens
ttccttctgatctgaga

SEQ ID NO: 5042081 - DNA, 18 bp, Homo sapiens
ttgaggaccctcccaggt

SEQ ID NO: 5042082 - DNA, 14 bp, Homo sapiens
ttggagtgccacgt

SEQ ID NO: 5042083 - DNA, 23 bp, Homo sapiens
ttggagtgccacgtggccgctgc

SEQ ID NO: 5042084 - DNA, 18 bp, Homo sapiens
tttccttctgatctgaga

SEQ ID NO: 5042085 - DNA, 21 bp, Homo sapiens
tttgaggctggcggggtctgc

SEQ ID NO: 5042086 - DNA, 21 bp, Homo sapiens
ttttgctggcttgcactttct

SEQ ID NO: 5042087 - DNA, 17 bp, Homo sapiens
cccaggaattctcacag

SEQ ID NO: 5042088 - DNA, 22 bp, Homo sapiens
cccaggccgaggaagggccccc

SEQ ID NO: 5042089 - DNA, 21 bp, Homo sapiens
cccagtgaccgggggaagctg

SEQ ID NO: 5042090 - DNA, 11 bp, Homo sapiens
ccccagctcct

SEQ ID NO: 5042091 - DNA, 19 bp, Homo sapiens
ccccagctcctcttcctgc

SEQ ID NO: 5042092 - DNA, 13 bp, Homo sapiens
ccccatgggctgc

SEQ ID NO: 5042093 - DNA, 13 bp, Homo sapiens
cccctcctccaga

SEQ ID NO: 5042094 - DNA, 21 bp, Homo sapiens
cccctcctccagagcctgggc

SEQ ID NO: 5042095 - DNA, 20 bp, Homo sapiens
cccggctcggcctcttgaga

SEQ ID NO: 5042096 - DNA, 21 bp, Homo sapiens
cccgggtactcagtcagccca

SEQ ID NO: 5042097 - DNA, 16 bp, Homo sapiens
ccctacttagacccag

SEQ ID NO: 5042098 - DNA, 10 bp, Homo sapiens
ccctcccagg

SEQ ID NO: 5042099 - DNA, 16 bp, Homo sapiens
ccctccctcctgtgtt

SEQ ID NO: 5042100 - DNA, 12 bp, Homo sapiens
ccctcctccaga

SEQ ID NO: 5042101 - DNA, 13 bp, Homo sapiens
ccctctctgcagt

SEQ ID NO: 5042102 - DNA, 20 bp, Homo sapiens
ccctgcagctttgaggctgg

SEQ ID NO: 5042103 - DNA, 13 bp, Homo sapiens
ccctgtctgcagg

SEQ ID NO: 5042104 - DNA, 15 bp, Homo sapiens
ccgagggcgcctggg

SEQ ID NO: 5042105 - DNA, 17 bp, Homo sapiens
ccgagggcgcctgggtc

SEQ ID NO: 5042106 - DNA, 18 bp, Homo sapiens
ccgcaggggcccctcctc

SEQ ID NO: 5042107 - DNA, 19 bp, Homo sapiens
ccgctgcccacgtcccggg

SEQ ID NO: 5042108 - DNA, 18 bp, Homo sapiens
ccgctgctctcccaggtg

SEQ ID NO: 5042109 - DNA, 18 bp, Homo sapiens
ccggaaggacacagtcag

SEQ ID NO: 5042110 - DNA, 15 bp, Homo sapiens
ccggagatgcatctg

SEQ ID NO: 5042111 - DNA, 15 bp, Homo sapiens
ccggcccacgtcctg

SEQ ID NO: 5042112 - DNA, 19 bp, Homo sapiens
ccggcccacgtcctgggtg

SEQ ID NO: 5042113 - DNA, 19 bp, Homo sapiens
ccggctggaccacgtctcc

SEQ ID NO: 5042114 - DNA, 19 bp, Homo sapiens
ccgggcactgtcatgccca

SEQ ID NO: 5042115 - DNA, 17 bp, Homo sapiens
ccgggggaagctgagcc

SEQ ID NO: 5042116 - DNA, 17 bp, Homo sapiens
ccgggtactcagtcagc

SEQ ID NO: 5042117 - DNA, 17 bp, Homo sapiens
ccgggtggcagcgccca

SEQ ID NO: 5042118 - DNA, 14 bp, Homo sapiens
cctcactgagaagg

SEQ ID NO: 5042119 - DNA, 21 bp, Homo sapiens
cctcactgagaaggccccagg

SEQ ID NO: 5042120 - DNA, 15 bp, Homo sapiens
cctccagagcctggg

SEQ ID NO: 5042121 - DNA, 14 bp, Homo sapiens
cctccctcctgtgt

SEQ ID NO: 5042122 - DNA, 16 bp, Homo sapiens
cctcctccagagcctg

SEQ ID NO: 5042123 - DNA, 13 bp, Homo sapiens
cctcggcagctcc

SEQ ID NO: 5042124 - DNA, 12 bp, Homo sapiens
cctctctgcagt

SEQ ID NO: 5042125 - DNA, 13 bp, Homo sapiens
cctctctgcagtc

SEQ ID NO: 5042126 - DNA, 21 bp, Homo sapiens
cctcttgagagccccacccct

SEQ ID NO: 5042127 - DNA, 14 bp, Homo sapiens
cctgaactggcccc

SEQ ID NO: 5042128 - DNA, 17 bp, Homo sapiens
cctgcagaccctgccag

SEQ ID NO: 5042129 - DNA, 20 bp, Homo sapiens
cctgcagctttgaggctggc

SEQ ID NO: 5042130 - DNA, 22 bp, Homo sapiens
cctgcagctttgaggctggcgg

SEQ ID NO: 5042131 - DNA, 13 bp, Homo sapiens
cctgccaggctgc

SEQ ID NO: 5042132 - DNA, 16 bp, Homo sapiens
cctgccaggctgcagg

SEQ ID NO: 5042133 - DNA, 20 bp, Homo sapiens
ctgctggaaaggcccggaga

SEQ ID NO: 5042134 - DNA, 17 bp, Homo sapiens
ctggagtgggctctctg

SEQ ID NO: 5042135 - DNA, 22 bp, Homo sapiens
ctggagtgggctctctggacct

SEQ ID NO: 5042136 - DNA, 22 bp, Homo sapiens
ctggatggggcggcctgcagac

SEQ ID NO: 5042137 - DNA, 14 bp, Homo sapiens
ctggcggggtctgc

SEQ ID NO: 5042138 - DNA, 13 bp, Homo sapiens
ctggcttgcactt

SEQ ID NO: 5042139 - DNA, 22 bp, Homo sapiens
ctgggaatggggtgggagccac

SEQ ID NO: 5042140 - DNA, 23 bp, Homo sapiens
ctgggaatggggtgggagccaca

SEQ ID NO: 5042141 - DNA, 24 bp, Homo sapiens
ctgggaatggggtgggagccacag

SEQ ID NO: 5042142 - DNA, 18 bp, Homo sapiens
ctgggagatgcagctgga

SEQ ID NO: 5042143 - DNA, 16 bp, Homo sapiens
ctgggcgcctctgtcc

SEQ ID NO: 5042144 - DNA, 15 bp, Homo sapiens
ctgggtcctcccagc

SEQ ID NO: 5042145 - DNA, 15 bp, Homo sapiens
ctggtcccccatggg

SEQ ID NO: 5042146 - DNA, 18 bp, Homo sapiens
ctggtcccccatgggctg

SEQ ID NO: 5042147 - DNA, 12 bp, Homo sapiens
ctgtctgcaggc

SEQ ID NO: 5042148 - DNA, 14 bp, Homo sapiens
ctgtggcctggggc

SEQ ID NO: 5042149 - DNA, 19 bp, Homo sapiens
cttagggtacagcccaggc

SEQ ID NO: 5042150 - DNA, 20 bp, Homo sapiens
cttagggtacagcccaggcg

SEQ ID NO: 5042151 - DNA, 11 bp, Homo sapiens
cttcccaggcc

SEQ ID NO: 5042152 - DNA, 14 bp, Homo sapiens
cttctgatctgaga

SEQ ID NO: 5042153 - DNA, 18 bp, Homo sapiens
cttcttgggggcagacca

SEQ ID NO: 5042154 - DNA, 13 bp, Homo sapiens
cttgagagcccca

SEQ ID NO: 5042155 - DNA, 22 bp, Homo sapiens
cttgagcaataaacgctgactt

SEQ ID NO: 5042156 - DNA, 20 bp, Homo sapiens
cttggagcgtttttgctggc

SEQ ID NO: 5042157 - DNA, 13 bp, Homo sapiens
ctttggccacagc

SEQ ID NO: 5042158 - DNA, 23 bp, Homo sapiens
ctttgggtagtgccatggccagg

SEQ ID NO: 5042159 - DNA, 17 bp, Homo sapiens
ctttgtcttgatcctca

SEQ ID NO: 5042160 - DNA, 22 bp, Homo sapiens
gaacaggagtgactctggctgc

SEQ ID NO: 5042161 - DNA, 18 bp, Homo sapiens
gaaccaggaggcctggga

SEQ ID NO: 5042162 - DNA, 12 bp, Homo sapiens
gaactggcccca

SEQ ID NO: 5042163 - DNA, 15 bp, Homo sapiens
gaactggccccagct

SEQ ID NO: 5042164 - DNA, 23 bp, Homo sapiens
gaagacatgaacgttttctcttc

SEQ ID NO: 5042165 - DNA, 11 bp, Homo sapiens
gaaggccccag

SEQ ID NO: 5042166 - DNA, 16 bp, Homo sapiens
gaagggggatgcaggc

SEQ ID NO: 5042167 - DNA, 19 bp, Homo sapiens
gaatggggtgggagccaca

SEQ ID NO: 5042168 - DNA, 22 bp, Homo sapiens
gaatggggtgggagccacaggg

SEQ ID NO: 5042169 - DNA, 13 bp, Homo sapiens
gacaagccaggcc

SEQ ID NO: 5042170 - DNA, 14 bp, Homo sapiens
gacacaggctgccg

SEQ ID NO: 5042171 - DNA, 15 bp, Homo sapiens
gacacaggctgccgc

SEQ ID NO: 5042172 - DNA, 15 bp, Homo sapiens
gacaccttcccagct

SEQ ID NO: 5042173 - DNA, 12 bp, Homo sapiens
gaccctgccagg

SEQ ID NO: 5042174 - DNA, 15 bp, Homo sapiens
gactctggctgccaa

SEQ ID NO: 5042175 - DNA, 17 bp, Homo sapiens
gactctggctgccaaga

SEQ ID NO: 5042176 - DNA, 19 bp, Homo sapiens
gactgtgggtccctgcgtc

SEQ ID NO: 5042177 - DNA, 18 bp, Homo sapiens
gagaaggccccagggcag

SEQ ID NO: 5042178 - DNA, 19 bp, Homo sapiens
gagaaggccccagggcagc

SEQ ID NO: 5042179 - DNA, 23 bp, Homo sapiens
gagatgcatctgtggcctggggc

SEQ ID NO: 5042180 - DNA, 22 bp, Homo sapiens
gagcatggccgcaacttcccag

SEQ ID NO: 5042181 - DNA, 14 bp, Homo sapiens
gagccgcaggggcc

SEQ ID NO: 5042182 - DNA, 21 bp, Homo sapiens
gagccgcaggggcccctcctc

SEQ ID NO: 5042183 - DNA, 15 bp, Homo sapiens
gaggaccctcccagg

SEQ ID NO: 5042184 - DNA, 17 bp, Homo sapiens
gcggaaaccgggtggca

SEQ ID NO: 5042185 - DNA, 23 bp, Homo sapiens
gcggaacaggagtgactctggct

SEQ ID NO: 5042186 - DNA, 22 bp, Homo sapiens
gcggtcactgcccacctgccag

SEQ ID NO: 5042187 - DNA, 12 bp, Homo sapiens
gctcaggctgcc

SEQ ID NO: 5042188 - DNA, 14 bp, Homo sapiens
gctcctcttcctgc

SEQ ID NO: 5042189 - DNA, 15 bp, Homo sapiens
gctcggcctcttgag

SEQ ID NO: 5042190 - DNA, 20 bp, Homo sapiens
gctctctggacctgaccaga

SEQ ID NO: 5042191 - DNA, 15 bp, Homo sapiens
gctgacttgcagacg

SEQ ID NO: 5042192 - DNA, 20 bp, Homo sapiens
gctgccaagataccttcatg

SEQ ID NO: 5042193 - DNA, 21 bp, Homo sapiens
gctgccaagataccttcatgg

SEQ ID NO: 5042194 - DNA, 15 bp, Homo sapiens
gctgctcctagaggg

SEQ ID NO: 5042195 - DNA, 15 bp, Homo sapiens
gctgctctcccaggt

SEQ ID NO: 5042196 - DNA, 21 bp, Homo sapiens
gctggaccacgtctccctggc

SEQ ID NO: 5042197 - DNA, 12 bp, Homo sapiens
gctggcttgcac

SEQ ID NO: 5042198 - DNA, 20 bp, Homo sapiens
gctgggcgcctctgtcctgg

SEQ ID NO: 5042199 - DNA, 23 bp, Homo sapiens
gctgggcgcctctgtcctggccc

SEQ ID NO: 5042200 - DNA, 18 bp, Homo sapiens
gctgtcatgcccagcttg

SEQ ID NO: 5042201 - DNA, 16 bp, Homo sapiens
gctgttttggggtctt

SEQ ID NO: 5042202 - DNA, 18 bp, Homo sapiens
ggaaaccgggtggcagcg

SEQ ID NO: 5042203 - DNA, 22 bp, Homo sapiens
ggaacaggagtgactctggctg

SEQ ID NO: 5042204 - DNA, 12 bp, Homo sapiens
ggaagctgagcc

SEQ ID NO: 5042205 - DNA, 15 bp, Homo sapiens
ggacaagccaggccc

SEQ ID NO: 5042206 - DNA, 22 bp, Homo sapiens
ggaccacgtctccctggcccca

SEQ ID NO: 5042207 - DNA, 18 bp, Homo sapiens
ggagaggagaggctgctg

SEQ ID NO: 5042208 - DNA, 17 bp, Homo sapiens
ggagaggctgctgtcac

SEQ ID NO: 5042209 - DNA, 14 bp, Homo sapiens
ggagccgcaggggc

SEQ ID NO: 5042210 - DNA, 21 bp, Homo sapiens
ggagtgactctggctgccaag

SEQ ID NO: 5042211 - DNA, 20 bp, Homo sapiens
ggagtgccacatggccgctg

SEQ ID NO: 5042212 - DNA, 16 bp, Homo sapiens
ggagtgccacgtggcc

SEQ ID NO: 5042213 - DNA, 23 bp, Homo sapiens
ggagtgggctctctggacctgac

SEQ ID NO: 5042214 - DNA, 17 bp, Homo sapiens
ggatggggcggcctgca

SEQ ID NO: 5042215 - DNA, 19 bp, Homo sapiens
ggatggggcggcctgcaga

SEQ ID NO: 5042216 - DNA, 20 bp, Homo sapiens
ggcaagacaccttcccagct

SEQ ID NO: 5042217 - DNA, 22 bp, Homo sapiens
ggcaagacaccttcccagctgc

SEQ ID NO: 5042218 - DNA, 15 bp, Homo sapiens
ggcagcgcccagcct

SEQ ID NO: 5042219 - DNA, 14 bp, Homo sapiens
ggccacagccccaa

SEQ ID NO: 5042220 - DNA, 22 bp, Homo sapiens
ggccaggagtgggtttccctgc

SEQ ID NO: 5042221 - DNA, 16 bp, Homo sapiens
ggcccacgtcctgggt

SEQ ID NO: 5042222 - DNA, 11 bp, Homo sapiens
ggccccagctc

SEQ ID NO: 5042223 - DNA, 14 bp, Homo sapiens
ggcccctcctccag

SEQ ID NO: 5042224 - DNA, 24 bp, Homo sapiens
ggcccggagatgcatctgtggcct

SEQ ID NO: 5042225 - DNA, 15 bp, Homo sapiens
ggccgcaacttccca

SEQ ID NO: 5042226 - DNA, 16 bp, Homo sapiens
ggccgctgctgtgaca

SEQ ID NO: 5042227 - DNA, 18 bp, Homo sapiens
ggcctgcagaccctgcca

SEQ ID NO: 5042228 - DNA, 21 bp, Homo sapiens
ggcctgcagaccctgccaggg

SEQ ID NO: 5042229 - DNA, 18 bp, Homo sapiens
ggcctgggagatgcagct

SEQ ID NO: 5042230 - DNA, 20 bp, Homo sapiens
ggcctgggagatgcagctgg

SEQ ID NO: 5042231 - DNA, 22 bp, Homo sapiens
ggcctgggagatgcagctggat

SEQ ID NO: 5042232 - DNA, 19 bp, Homo sapiens
ggcgcaagcgacacaggct

SEQ ID NO: 5042233 - DNA, 15 bp, Homo sapiens
ggcgggctgatgtct

SEQ ID NO: 5042234 - DNA, 16 bp, Homo sapiens
ggctcaggctgcccag

SEQ ID NO: 5042235 - DNA, 12 bp, Homo sapiens
ggctcttcctgg

SEQ ID NO: 5042236 - DNA, 12 bp, Homo sapiens
ggctgcagggac

SEQ ID NO: 5042237 - DNA, 13 bp, Homo sapiens
ggctgcccagcgg

SEQ ID NO: 5042238 - DNA, 15 bp, Homo sapiens
ggctggaccacgtct

SEQ ID NO: 5042239 - DNA, 17 bp, Homo sapiens
ggctgggcgcctctgtc

SEQ ID NO: 5042240 - DNA, 22 bp, Homo sapiens
gaccacgtctccctggccccag

SEQ ID NO: 5042241 - DNA, 23 bp, Homo sapiens
gaccacgtctccctggccccagt

SEQ ID NO: 5042242 - DNA, 18 bp, Homo sapiens
gaccccaccctgtctgca

SEQ ID NO: 5042243 - DNA, 12 bp, Homo sapiens
gaccctcccagg

SEQ ID NO: 5042244 - DNA, 18 bp, Homo sapiens
gacctgaccagactgtgg

SEQ ID NO: 5042245 - DNA, 16 bp, Homo sapiens
gactctggctgccaag

SEQ ID NO: 5042246 - DNA, 20 bp, Homo sapiens
gactggtcccccatgggctg

SEQ ID NO: 5042247 - DNA, 23 bp, Homo sapiens
gactggtcccccatgggctgctg

SEQ ID NO: 5042248 - DNA, 17 bp, Homo sapiens
gaggcctgggagatgca

SEQ ID NO: 5042249 - DNA, 17 bp, Homo sapiens
gaggctggcggggtctg

SEQ ID NO: 5042250 - DNA, 12 bp, Homo sapiens
gagggcaaacca

SEQ ID NO: 5042251 - DNA, 21 bp, Homo sapiens
gagggcgcctgggtcctccca

SEQ ID NO: 5042252 - DNA, 23 bp, Homo sapiens
gagggcgcctgggtcctcccagc

SEQ ID NO: 5042253 - DNA, 18 bp, Homo sapiens
gagtgactctggctgcca

SEQ ID NO: 5042254 - DNA, 23 bp, Homo sapiens
gagtgccacgtggccgctgccca

SEQ ID NO: 5042255 - DNA, 13 bp, Homo sapiens
gagtggctcccgt

SEQ ID NO: 5042256 - DNA, 23 bp, Homo sapiens
gagtgggctctctggacctgacc

SEQ ID NO: 5042257 - DNA, 20 bp, Homo sapiens
gatcaggtcagagcccagga

SEQ ID NO: 5042258 - DNA, 15 bp, Homo sapiens
gatgcatctgtggcc

SEQ ID NO: 5042259 - DNA, 17 bp, Homo sapiens
gatgcatctgtggcctg

SEQ ID NO: 5042260 - DNA, 23 bp, Homo sapiens
gatggggcggcctgcagaccctg

SEQ ID NO: 5042261 - DNA, 17 bp, Homo sapiens
gcaaaccaggctgcagg

SEQ ID NO: 5042262 - DNA, 15 bp, Homo sapiens
gcaagacaccttccc

SEQ ID NO: 5042263 - DNA, 22 bp, Homo sapiens
gcaagcgacacaggctgccgct

SEQ ID NO: 5042264 - DNA, 21 bp, Homo sapiens
gcaaggtgcacctgccccagg

SEQ ID NO: 5042265 - DNA, 13 bp, Homo sapiens
gcacctgccccag

SEQ ID NO: 5042266 - DNA, 16 bp, Homo sapiens
gcacctgccccaggct

SEQ ID NO: 5042267 - DNA, 15 bp, Homo sapiens
gcactgtcatgccca

SEQ ID NO: 5042268 - DNA, 16 bp, Homo sapiens
gcactgtcatgcccag

SEQ ID NO: 5042269 - DNA, 17 bp, Homo sapiens
gcactgtcatgcccagc

SEQ ID NO: 5042270 - DNA, 14 bp, Homo sapiens
gcagaccctgccag

SEQ ID NO: 5042271 - DNA, 16 bp, Homo sapiens
gcagaccctgccaggg

SEQ ID NO: 5042272 - DNA, 20 bp, Homo sapiens
gcagctggatggggcggcct

SEQ ID NO: 5042273 - DNA, 21 bp, Homo sapiens
gcaggcaagacaccttcccag

SEQ ID NO: 5042274 - DNA, 15 bp, Homo sapiens
gcagggacagttggg

SEQ ID NO: 5042275 - DNA, 16 bp, Homo sapiens
gcagggctgggcgcct

SEQ ID NO: 5042276 - DNA, 13 bp, Homo sapiens
gcaggggcccctc

SEQ ID NO: 5042277 - DNA, 16 bp, Homo sapiens
gcagtcctcggcagct

SEQ ID NO: 5042278 - DNA, 14 bp, Homo sapiens
gcatctgtggcctg

SEQ ID NO: 5042279 - DNA, 16 bp, Homo sapiens
gcatctgtggcctggg

SEQ ID NO: 5042280 - DNA, 20 bp, Homo sapiens
gcatggccgcaacttcccag

SEQ ID NO: 5042281 - DNA, 14 bp, Homo sapiens
gccacactggccgg

SEQ ID NO: 5042282 - DNA, 15 bp, Homo sapiens
gccacatggccgctg

SEQ ID NO: 5042283 - DNA, 19 bp, Homo sapiens
gccacgtggccgctgccca

SEQ ID NO: 5042284 - DNA, 15 bp, Homo sapiens
gccaggccctctctg

SEQ ID NO: 5042285 - DNA, 19 bp, Homo sapiens
gccaggccctctctgcagt

SEQ ID NO: 5042286 - DNA, 17 bp, Homo sapiens
gccagggggtttgagga

SEQ ID NO: 5042287 - DNA, 13 bp, Homo sapiens
gccatggccagga

SEQ ID NO: 5042288 - DNA, 15 bp, Homo sapiens
gcccacctgccaggc

SEQ ID NO: 5042289 - DNA, 20 bp, Homo sapiens
gcccacctgccaggctgcag

SEQ ID NO: 5042290 - DNA, 22 bp, Homo sapiens
gcccacctgccaggctgcaggg

SEQ ID NO: 5042291 - DNA, 17 bp, Homo sapiens
gcccactctgaccgggc

SEQ ID NO: 5042292 - DNA, 17 bp, Homo sapiens
gcccagcctggccccaa

SEQ ID NO: 5042293 - DNA, 17 bp, Homo sapiens
gccccaggctcaggctg

SEQ ID NO: 5042294 - DNA, 23 bp, Homo sapiens
gccccaggctcaggctgcccagc

SEQ ID NO: 5042295 - DNA, 18 bp, Homo sapiens
gcccccggctcggcctct

SEQ ID NO: 5042296 - DNA, 14 bp, Homo sapiens
gcccctccctcctg

SEQ ID NO: 5042297 - DNA, 17 bp, Homo sapiens
gcccctccctcctgtgt

SEQ ID NO: 5042298 - DNA, 14 bp, Homo sapiens
gcccctcctccaga

SEQ ID NO: 5042299 - DNA, 18 bp, Homo sapiens
gcccctcctccagagcct

SEQ ID NO: 5042300 - DNA, 20 bp, Homo sapiens
gcccggagatgcatctgtgg

SEQ ID NO: 5042301 - DNA, 21 bp, Homo sapiens
gccctctctgcagtcctcggc

SEQ ID NO: 5042302 - DNA, 15 bp, Homo sapiens
gccggcccacgtcct

SEQ ID NO: 5042303 - DNA, 22 bp, Homo sapiens
gcctctctcatggcttgggctg

SEQ ID NO: 5042304 - DNA, 20 bp, Homo sapiens
gcctgcagaccctgccaggg

SEQ ID NO: 5042305 - DNA, 11 bp, Homo sapiens
gcctggcccca

SEQ ID NO: 5042306 - DNA, 15 bp, Homo sapiens
gcctggccccaagca

SEQ ID NO: 5042307 - DNA, 17 bp, Homo sapiens
gcgacacaggctgccgc

SEQ ID NO: 5042308 - DNA, 23 bp, Homo sapiens
gcgcaagcgacacaggctgccgc

SEQ ID NO: 5042309 - DNA, 16 bp, Homo sapiens
gcgccaccgtgggaga

SEQ ID NO: 5042310 - DNA, 11 bp, Homo sapiens
gcgcctgggtc

SEQ ID NO: 5042311 - DNA, 14 bp, Homo sapiens
gcgcctgggtcctc

SEQ ID NO: 5042312 - DNA, 19 bp, Homo sapiens
gcgcctgggtcctcccagc

SEQ ID NO: 5042313 - DNA, 22 bp, Homo sapiens
gcgcctgggtcctcccagctga

SEQ ID NO: 5042314 - DNA, 14 bp, Homo sapiens
gcggaaaccgggtg

SEQ ID NO: 5042315 - DNA, 13 bp, Homo sapiens
gcggcctgcagac

SEQ ID NO: 5042316 - DNA, 18 bp, Homo sapiens
gcggcctgcagaccctgc

SEQ ID NO: 5042317 - DNA, 13 bp, Homo sapiens
gctagtctgtgcc

SEQ ID NO: 5042318 - DNA, 14 bp, Homo sapiens
gctagtctgtgcct

SEQ ID NO: 5042319 - DNA, 15 bp, Homo sapiens
gctagtctgtgcctc

SEQ ID NO: 5042320 - DNA, 18 bp, Homo sapiens
gctctctggacctgacca

SEQ ID NO: 5042321 - DNA, 15 bp, Homo sapiens
gctgcatccaaggct

SEQ ID NO: 5042322 - DNA, 16 bp, Homo sapiens
gctgcatccaaggctt

SEQ ID NO: 5042323 - DNA, 19 bp, Homo sapiens
gctgcccacgtcccgggca

SEQ ID NO: 5042324 - DNA, 13 bp, Homo sapiens
gctgctctcccag

SEQ ID NO: 5042325 - DNA, 14 bp, Homo sapiens
gctggaaaggcccg

SEQ ID NO: 5042326 - DNA, 16 bp, Homo sapiens
gctggatggggcggcc

SEQ ID NO: 5042327 - DNA, 22 bp, Homo sapiens
gctggatggggcggcctgcaga

SEQ ID NO: 5042328 - DNA, 16 bp, Homo sapiens
gctgggcgcctctgtc

SEQ ID NO: 5042329 - DNA, 14 bp, Homo sapiens
gctgtcatgcccag

SEQ ID NO: 5042330 - DNA, 19 bp, Homo sapiens
gctgtcatgcccagcttgg

SEQ ID NO: 5042331 - DNA, 14 bp, Homo sapiens
gcttggagtgccac

SEQ ID NO: 5042332 - DNA, 21 bp, Homo sapiens
gctttgtaaaccggctggacc

SEQ ID NO: 5042333 - DNA, 17 bp, Homo sapiens
ggaacaggagtgactct

SEQ ID NO: 5042334 - DNA, 21 bp, Homo sapiens
ggaaggacacagtcaggggcc

SEQ ID NO: 5042335 - DNA, 20 bp, Homo sapiens
ggacagtgagagcagggctg

SEQ ID NO: 5042336 - DNA, 18 bp, Homo sapiens
ggacagttgggtgtgaga

SEQ ID NO: 5042337 - DNA, 18 bp, Homo sapiens
ggaccacgtctccctggc

SEQ ID NO: 5042338 - DNA, 22 bp, Homo sapiens
ggagccgcaggggcccctcctc

SEQ ID NO: 5042339 - DNA, 21 bp, Homo sapiens
ggaggcctgggagatgcagct

SEQ ID NO: 5042340 - DNA, 13 bp, Homo sapiens
ggagtgggctctc

SEQ ID NO: 5042341 - DNA, 17 bp, Homo sapiens
ggagtgggctctctgga

SEQ ID NO: 5042342 - DNA, 18 bp, Homo sapiens
ggagtgggtttccctgcg

SEQ ID NO: 5042343 - DNA, 22 bp, Homo sapiens
ggcaaacactttggccacagcc

SEQ ID NO: 5042344 - DNA, 16 bp, Homo sapiens
ggcaaaccaggctgca

SEQ ID NO: 5042345 - DNA, 18 bp, Homo sapiens
ggcagcgcccagcctggc

SEQ ID NO: 5042346 - DNA, 22 bp, Homo sapiens
ggcagcgcccagcctggcccca

SEQ ID NO: 5042347 - DNA, 22 bp, Homo sapiens
ggccacccccacctccctgcag

SEQ ID NO: 5042348 - DNA, 17 bp, Homo sapiens
ggccaggagtgggtttc

SEQ ID NO: 5042349 - DNA, 20 bp, Homo sapiens
ggcccctcctccagagcctg

SEQ ID NO: 5042350 - DNA, 13 bp, Homo sapiens
ggccctctctgca

SEQ ID NO: 5042351 - DNA, 19 bp, Homo sapiens
ggccgcaacttcccaggcc

SEQ ID NO: 5042352 - DNA, 19 bp, Homo sapiens
ggccgctgctgtgacaggc

SEQ ID NO: 5042353 - DNA, 21 bp, Homo sapiens
ggccggcccacgtcctgggtg

SEQ ID NO: 5042354 - DNA, 23 bp, Homo sapiens
gcagaccccaccctgtctgcagg

SEQ ID NO: 5042355 - DNA, 23 bp, Homo sapiens
gcagctttgaggctggcggggtc

SEQ ID NO: 5042356 - DNA, 23 bp, Homo sapiens
gcaggccacccccacctccctgc

SEQ ID NO: 5042357 - DNA, 17 bp, Homo sapiens
gcagtcctcggcagctc

SEQ ID NO: 5042358 - DNA, 18 bp, Homo sapiens
gcagtcctcggcagctcc

SEQ ID NO: 5042359 - DNA, 19 bp, Homo sapiens
gcatctgtggcctggggcc

SEQ ID NO: 5042360 - DNA, 21 bp, Homo sapiens
gcatggccgcaacttcccagg

SEQ ID NO: 5042361 - DNA, 23 bp, Homo sapiens
gcatggccgcaacttcccaggcc

SEQ ID NO: 5042362 - DNA, 13 bp, Homo sapiens
gccacagccccaa

SEQ ID NO: 5042363 - DNA, 19 bp, Homo sapiens
gccacatggccgctgccca

SEQ ID NO: 5042364 - DNA, 23 bp, Homo sapiens
gccacccccacctccctgcagct

SEQ ID NO: 5042365 - DNA, 14 bp, Homo sapiens
gccacgtggccgct

SEQ ID NO: 5042366 - DNA, 21 bp, Homo sapiens
gccaggagtgggtttccctgc

SEQ ID NO: 5042367 - DNA, 18 bp, Homo sapiens
gccaggccctctctgcag

SEQ ID NO: 5042368 - DNA, 13 bp, Homo sapiens
gccaggctgcagg

SEQ ID NO: 5042369 - DNA, 22 bp, Homo sapiens
gccagggggtttgaggaccctc

SEQ ID NO: 5042370 - DNA, 13 bp, Homo sapiens
gcccacctgccag

SEQ ID NO: 5042371 - DNA, 21 bp, Homo sapiens
gcccacctgccaggctgcagg

SEQ ID NO: 5042372 - DNA, 15 bp, Homo sapiens
gcccacgtcctgggt

SEQ ID NO: 5042373 - DNA, 17 bp, Homo sapiens
gcccacgtcctgggtgc

SEQ ID NO: 5042374 - DNA, 20 bp, Homo sapiens
gcccagcctggccccaagca

SEQ ID NO: 5042375 - DNA, 21 bp, Homo sapiens
gcccagcttggagtgccacgt

SEQ ID NO: 5042376 - DNA, 18 bp, Homo sapiens
gccccaggctcaggctgc

SEQ ID NO: 5042377 - DNA, 21 bp, Homo sapiens
gccccaggctcaggctgccca

SEQ ID NO: 5042378 - DNA, 19 bp, Homo sapiens
gcccctcctccagagcctg

SEQ ID NO: 5042379 - DNA, 22 bp, Homo sapiens
gcccctcctccagagcctgggc

SEQ ID NO: 5042380 - DNA, 15 bp, Homo sapiens
gcccgggagccgcag

SEQ ID NO: 5042381 - DNA, 19 bp, Homo sapiens
gccctgagctactgcttct

SEQ ID NO: 5042382 - DNA, 15 bp, Homo sapiens
gccctgtctccctac

SEQ ID NO: 5042383 - DNA, 18 bp, Homo sapiens
gccgcaacttcccaggcc

SEQ ID NO: 5042384 - DNA, 18 bp, Homo sapiens
gccgctgctgtgacaggc

SEQ ID NO: 5042385 - DNA, 16 bp, Homo sapiens
gccggcccacgtcctg

SEQ ID NO: 5042386 - DNA, 23 bp, Homo sapiens
gccggcccacgtcctgggtgctg

SEQ ID NO: 5042387 - DNA, 18 bp, Homo sapiens
gccgggtcgcctgccctg

SEQ ID NO: 5042388 - DNA, 23 bp, Homo sapiens
gcctcagtgagatcagtcagctc

SEQ ID NO: 5042389 - DNA, 15 bp, Homo sapiens
gcctctgtcctggcc

SEQ ID NO: 5042390 - DNA, 15 bp, Homo sapiens
gcctgcagaccctgc

SEQ ID NO: 5042391 - DNA, 19 bp, Homo sapiens
gcctgcagaccctgccagg

SEQ ID NO: 5042392 - DNA, 16 bp, Homo sapiens
gcctgggagatgcagc

SEQ ID NO: 5042393 - DNA, 18 bp, Homo sapiens
gcctgggagatgcagctg

SEQ ID NO: 5042394 - DNA, 16 bp, Homo sapiens
gcctgggtcctcccag

SEQ ID NO: 5042395 - DNA, 17 bp, Homo sapiens
gcctgggtcctcccagc

SEQ ID NO: 5042396 - DNA, 18 bp, Homo sapiens
gcctgggtcctcccagct

SEQ ID NO: 5042397 - DNA, 19 bp, Homo sapiens
gcctgggtcctcccagctg

SEQ ID NO: 5042398 - DNA, 22 bp, Homo sapiens
gcgcaagcgacacaggctgccg

SEQ ID NO: 5042399 - DNA, 17 bp, Homo sapiens
gcggaacaggagtgact

SEQ ID NO: 5042400 - DNA, 15 bp, Homo sapiens
gcggctcttcctgga

SEQ ID NO: 5042401 - DNA, 17 bp, Homo sapiens
gcggggtctgctcctgg

SEQ ID NO: 5042402 - DNA, 23 bp, Homo sapiens
gcggtcactgcccacctgccagg

SEQ ID NO: 5042403 - DNA, 20 bp, Homo sapiens
gcgtctcctcgtcccgaggg

SEQ ID NO: 5042404 - DNA, 18 bp, Homo sapiens
gctagtctgtgcctcagt

SEQ ID NO: 5042405 - DNA, 19 bp, Homo sapiens
gctagtctgtgcctcagtg

SEQ ID NO: 5042406 - DNA, 18 bp, Homo sapiens
gctcaagtttcagagtca

SEQ ID NO: 5042407 - DNA, 15 bp, Homo sapiens
gctcaggctgcccag

SEQ ID NO: 5042408 - DNA, 16 bp, Homo sapiens
gctcaggctgcccagc

SEQ ID NO: 5042409 - DNA, 12 bp, Homo sapiens
gctctctggacc

SEQ ID NO: 5042410 - DNA, 13 bp, Homo sapiens
gctgacttgcaga

SEQ ID NO: 5042411 - DNA, 21 bp, Homo sapiens
gctgagcccctccctcctgtg

SEQ ID NO: 5042412 - DNA, 23 bp, Homo sapiens
gctggaccacgtctccctggccc

SEQ ID NO: 5042413 - DNA, 14 bp, Homo sapiens
gctggagtgggctc

SEQ ID NO: 5042414 - DNA, 14 bp, Homo sapiens
gctggcggggtctg

SEQ ID NO: 5042415 - DNA, 21 bp, Homo sapiens
gctgggcgcctctgtcctggc

SEQ ID NO: 5042416 - DNA, 16 bp, Homo sapiens
gctgtcatgcccagct

SEQ ID NO: 5042417 - DNA, 16 bp, Homo sapiens
gctttgaggctggcgg

SEQ ID NO: 5042418 - DNA, 20 bp, Homo sapiens
gctttgggtagtgccatggc

SEQ ID NO: 5042419 - DNA, 15 bp, Homo sapiens
ggaaggacacagtca

SEQ ID NO: 5042420 - DNA, 17 bp, Homo sapiens
ggacaagccaggccctc

SEQ ID NO: 5042421 - DNA, 14 bp, Homo sapiens
ggaccctcccaggt

SEQ ID NO: 5042422 - DNA, 20 bp, Homo sapiens
ggacgacccggggcgggctg

SEQ ID NO: 5042423 - DNA, 17 bp, Homo sapiens
ggagaggagaggctgct

SEQ ID NO: 5042424 - DNA, 14 bp, Homo sapiens
ggagatgcagctgg

SEQ ID NO: 5042425 - DNA, 20 bp, Homo sapiens
ggagtgccacgtggccgctg

SEQ ID NO: 5042426 - DNA, 23 bp, Homo sapiens
ggatcttacccacttccctgcaa

SEQ ID NO: 5042427 - DNA, 13 bp, Homo sapiens
ggcaaaccaggct

SEQ ID NO: 5042428 - DNA, 19 bp, Homo sapiens
ggcactgtcatgcccagct

SEQ ID NO: 5042429 - DNA, 21 bp, Homo sapiens
ggcactgtcatgcccagcttg

SEQ ID NO: 5042430 - DNA, 19 bp, Homo sapiens
ggcagtgttcttgggggtg

SEQ ID NO: 5042431 - DNA, 20 bp, Homo sapiens
ggccacccccacctccctgc

SEQ ID NO: 5042432 - DNA, 17 bp, Homo sapiens
ggcccacgtcctgggtg

SEQ ID NO: 5042433 - DNA, 15 bp, Homo sapiens
ggcccctcctccaga

SEQ ID NO: 5042434 - DNA, 20 bp, Homo sapiens
ggcccggagatgcatctgtg

SEQ ID NO: 5042435 - DNA, 14 bp, Homo sapiens
ggccctctctgcag

SEQ ID NO: 5042436 - DNA, 15 bp, Homo sapiens
ggccctctctgcagt

SEQ ID NO: 5042437 - DNA, 16 bp, Homo sapiens
ggccgcaacttcccag

SEQ ID NO: 5042438 - DNA, 18 bp, Homo sapiens
ggccgcaacttcccaggc

SEQ ID NO: 5042439 - DNA, 20 bp, Homo sapiens
ggccggcccacgtcctgggt

SEQ ID NO: 5042440 - DNA, 20 bp, Homo sapiens
ggcctgcagaccctgccagg

SEQ ID NO: 5042441 - DNA, 22 bp, Homo sapiens
ggcctgcagaccctgccagggg

SEQ ID NO: 5042442 - DNA, 13 bp, Homo sapiens
ggcgcctctgtcc

SEQ ID NO: 5042443 - DNA, 12 bp, Homo sapiens
ggcgcctgggtc

SEQ ID NO: 5042444 - DNA, 14 bp, Homo sapiens
ggcggcctgcagac

SEQ ID NO: 5042445 - DNA, 15 bp, Homo sapiens
ggctagtctgtgcct

SEQ ID NO: 5042446 - DNA, 17 bp, Homo sapiens
ggctagtctgtgcctca

SEQ ID NO: 5042447 - DNA, 19 bp, Homo sapiens
ggctgccgctgctctccca

SEQ ID NO: 5042448 - DNA, 22 bp, Homo sapiens
ggctggaccacgtctccctggc

SEQ ID NO: 5042449 - DNA, 13 bp, Homo sapiens
ggctggagtgggc

SEQ ID NO: 5042450 - DNA, 18 bp, Homo sapiens
ggctggcggggtctgctc

SEQ ID NO: 5042451 - DNA, 23 bp, Homo sapiens
gggacaagccaggccctctctgc

SEQ ID NO: 5042452 - DNA, 15 bp, Homo sapiens
gggagccgcaggggc

SEQ ID NO: 5042453 - DNA, 16 bp, Homo sapiens
gggagccgcaggggcc

SEQ ID NO: 5042454 - DNA, 14 bp, Homo sapiens
gggcaaaccaggct

SEQ ID NO: 5042455 - DNA, 22 bp, Homo sapiens
gggcactgtcatgcccagcttg

SEQ ID NO: 5042456 - DNA, 16 bp, Homo sapiens
gggcccctcctccaga

SEQ ID NO: 5042457 - DNA, 22 bp, Homo sapiens
gggcccctcctccagagcctgg

SEQ ID NO: 5042458 - DNA, 23 bp, Homo sapiens
gggcccctcctccagagcctggg

SEQ ID NO: 5042459 - DNA, 15 bp, Homo sapiens
gggctgggcgcctct

SEQ ID NO: 5042460 - DNA, 16 bp, Homo sapiens
ggggcagaccagagag

SEQ ID NO: 5042461 - DNA, 23 bp, Homo sapiens
gggggtttgaggaccctcccagg

SEQ ID NO: 5042462 - DNA, 16 bp, Homo sapiens
ggggtgggagccacag

SEQ ID NO: 5042463 - DNA, 16 bp, Homo sapiens
gggtacagcccaggcg

SEQ ID NO: 5042464 - DNA, 13 bp, Homo sapiens
gggtcctcccagc

SEQ ID NO: 5042465 - DNA, 21 bp, Homo sapiens
gggtgctgtcatgcccagctt

SEQ ID NO: 5042466 - DNA, 22 bp, Homo sapiens
gggtggcagcgcccagcctggc

SEQ ID NO: 5042467 - DNA, 14 bp, Homo sapiens
ggtacagcccaggc

SEQ ID NO: 5042468 - DNA, 19 bp, Homo sapiens
ggtagtgccatggccagga

SEQ ID NO: 5042469 - DNA, 22 bp, Homo sapiens
ggtcactgcccacctgccaggc

SEQ ID NO: 5042470 - DNA, 23 bp, Homo sapiens
ggtcactgcccacctgccaggct

SEQ ID NO: 5042471 - DNA, 18 bp, Homo sapiens
ggtccctgcgtctcctgc

SEQ ID NO: 5042472 - DNA, 13 bp, Homo sapiens
ggtcctcccagct

SEQ ID NO: 5042473 - DNA, 20 bp, Homo sapiens
ggtcttagggtacagcccag

SEQ ID NO: 5042474 - DNA, 13 bp, Homo sapiens
ggtcttctccatc

SEQ ID NO: 5042475 - DNA, 15 bp, Homo sapiens
ggtgggagccacagg

SEQ ID NO: 5042476 - DNA, 22 bp, Homo sapiens
ggtgtgagaataacactggctt

SEQ ID NO: 5042477 - DNA, 20 bp, Homo sapiens
ggtgttcatgacaagtggaa

SEQ ID NO: 5042478 - DNA, 23 bp, Homo sapiens
ggtttgaggaccctcccaggttt

SEQ ID NO: 5042479 - DNA, 21 bp, Homo sapiens
ggttttgtttctttccttctg

SEQ ID NO: 5042480 - DNA, 21 bp, Homo sapiens
gtaacagcaggagcatggccg

SEQ ID NO: 5042481 - DNA, 13 bp, Homo sapiens
gtacagcccaggc

SEQ ID NO: 5042482 - DNA, 12 bp, Homo sapiens
gtaccggatgca

SEQ ID NO: 5042483 - DNA, 18 bp, Homo sapiens
gtcactgcccacctgcca

SEQ ID NO: 5042484 - DNA, 12 bp, Homo sapiens
gtcatgcccagc

SEQ ID NO: 5042485 - DNA, 19 bp, Homo sapiens
gtcccgagggcgcctgggt

SEQ ID NO: 5042486 - DNA, 17 bp, Homo sapiens
gtccctgcgtctcctgc

SEQ ID NO: 5042487 - DNA, 14 bp, Homo sapiens
gtcctcggcagctc

SEQ ID NO: 5042488 - DNA, 16 bp, Homo sapiens
gtctccctggccccag

SEQ ID NO: 5042489 - DNA, 13 bp, Homo sapiens
gtctcctgcccac

SEQ ID NO: 5042490 - DNA, 20 bp, Homo sapiens
gtcttagggtacagcccagg

SEQ ID NO: 5042491 - DNA, 19 bp, Homo sapiens
agcgacacaggctgccgct

SEQ ID NO: 5042492 - DNA, 21 bp, Homo sapiens
agcgccaccgtgggagaggag

SEQ ID NO: 5042493 - DNA, 18 bp, Homo sapiens
agcgccctctacctccta

SEQ ID NO: 5042494 - DNA, 23 bp, Homo sapiens
agctggatggggcggcctgcaga

SEQ ID NO: 5042495 - DNA, 15 bp, Homo sapiens
agcttggagtgccac

SEQ ID NO: 5042496 - DNA, 15 bp, Homo sapiens
aggaccctcccaggt

SEQ ID NO: 5042497 - DNA, 23 bp, Homo sapiens
aggagtgactctggctgccaaga

SEQ ID NO: 5042498 - DNA, 22 bp, Homo sapiens
aggagtgggtttccctgcgtct

SEQ ID NO: 5042499 - DNA, 12 bp, Homo sapiens
aggccaccccca

SEQ ID NO: 5042500 - DNA, 19 bp, Homo sapiens
aggcctgggagatgcagct

SEQ ID NO: 5042501 - DNA, 17 bp, Homo sapiens
aggcggtcactgcccac

SEQ ID NO: 5042502 - DNA, 23 bp, Homo sapiens
aggcggtcactgcccacctgcca

SEQ ID NO: 5042503 - DNA, 14 bp, Homo sapiens
aggctcaggctgcc

SEQ ID NO: 5042504 - DNA, 15 bp, Homo sapiens
aggctcaggctgccc

SEQ ID NO: 5042505 - DNA, 17 bp, Homo sapiens
aggctcaggctgcccag

SEQ ID NO: 5042506 - DNA, 14 bp, Homo sapiens
aggctgcagggaca

SEQ ID NO: 5042507 - DNA, 12 bp, Homo sapiens
aggctgcccagc

SEQ ID NO: 5042508 - DNA, 20 bp, Homo sapiens
aggctgccgctgctctccca

SEQ ID NO: 5042509 - DNA, 22 bp, Homo sapiens
agggacgacccggggcgggctg

SEQ ID NO: 5042510 - DNA, 17 bp, Homo sapiens
agggcaaaccaggctgc

SEQ ID NO: 5042511 - DNA, 18 bp, Homo sapiens
agggcaaaccaggctgca

SEQ ID NO: 5042512 - DNA, 20 bp, Homo sapiens
agggcgcctgggtcctccca

SEQ ID NO: 5042513 - DNA, 23 bp, Homo sapiens
agggcgcctgggtcctcccagct

SEQ ID NO: 5042514 - DNA, 20 bp, Homo sapiens
agggctgggcgcctctgtcc

SEQ ID NO: 5042515 - DNA, 14 bp, Homo sapiens
agggtacagcccag

SEQ ID NO: 5042516 - DNA, 15 bp, Homo sapiens
agggtacagcccagg

SEQ ID NO: 5042517 - DNA, 22 bp, Homo sapiens
agggtagtttaattttaaaata

SEQ ID NO: 5042518 - DNA, 14 bp, Homo sapiens
aggtcagagcccag

SEQ ID NO: 5042519 - DNA, 16 bp, Homo sapiens
aggtcagagcccagga

SEQ ID NO: 5042520 - DNA, 17 bp, Homo sapiens
aggtgcacctgccccag

SEQ ID NO: 5042521 - DNA, 19 bp, Homo sapiens
agtcagctccgagtggctc

SEQ ID NO: 5042522 - DNA, 16 bp, Homo sapiens
agtctgtgcctcagtg

SEQ ID NO: 5042523 - DNA, 20 bp, Homo sapiens
agtgagagcagggctgggcg

SEQ ID NO: 5042524 - DNA, 15 bp, Homo sapiens
agtgagttggggcga

SEQ ID NO: 5042525 - DNA, 18 bp, Homo sapiens
agtgccatggccaggagt

SEQ ID NO: 5042526 - DNA, 22 bp, Homo sapiens
agtgggatcttacccacttccc

SEQ ID NO: 5042527 - DNA, 16 bp, Homo sapiens
atctgtggcctggggc

SEQ ID NO: 5042528 - DNA, 18 bp, Homo sapiens
atgaacgttttctcttca

SEQ ID NO: 5042529 - DNA, 19 bp, Homo sapiens
atgcatctgtggcctgggg

SEQ ID NO: 5042530 - DNA, 15 bp, Homo sapiens
gaggagaggctgctg

SEQ ID NO: 5042531 - DNA, 13 bp, Homo sapiens
gaggcctgggaga

SEQ ID NO: 5042532 - DNA, 22 bp, Homo sapiens
gaggcctgggagatgcagctgg

SEQ ID NO: 5042533 - DNA, 16 bp, Homo sapiens
gagggcaaaccaggct

SEQ ID NO: 5042534 - DNA, 14 bp, Homo sapiens
gagggcgcctgggt

SEQ ID NO: 5042535 - DNA, 14 bp, Homo sapiens
gagtgactctggct

SEQ ID NO: 5042536 - DNA, 16 bp, Homo sapiens
gagtgactctggctgc

SEQ ID NO: 5042537 - DNA, 19 bp, Homo sapiens
gagtgactctggctgccaa

SEQ ID NO: 5042538 - DNA, 18 bp, Homo sapiens
gagtgccacatggccgct

SEQ ID NO: 5042539 - DNA, 19 bp, Homo sapiens
gagtgccacatggccgctg

SEQ ID NO: 5042540 - DNA, 17 bp, Homo sapiens
gagtgggctctctggac

SEQ ID NO: 5042541 - DNA, 19 bp, Homo sapiens
gatggggcggcctgcagac

SEQ ID NO: 5042542 - DNA, 20 bp, Homo sapiens
gcaaacactttggccacagc

SEQ ID NO: 5042543 - DNA, 16 bp, Homo sapiens
gcaacttcccaggccg

SEQ ID NO: 5042544 - DNA, 19 bp, Homo sapiens
gcactgtcatgcccagctt

SEQ ID NO: 5042545 - DNA, 22 bp, Homo sapiens
gcactgtcatgcccagcttgga

SEQ ID NO: 5042546 - DNA, 17 bp, Homo sapiens
gcagaccagagagctca

SEQ ID NO: 5042547 - DNA, 15 bp, Homo sapiens
gcagaccctgccagg

SEQ ID NO: 5042548 - DNA, 17 bp, Homo sapiens
gcagaccctgccagggg

SEQ ID NO: 5042549 - DNA, 23 bp, Homo sapiens
gcaggcaagacaccttcccagct

SEQ ID NO: 5042550 - DNA, 16 bp, Homo sapiens
gcagggacagttgggt

SEQ ID NO: 5042551 - DNA, 14 bp, Homo sapiens
gcagggctgggcgc

SEQ ID NO: 5042552 - DNA, 23 bp, Homo sapiens
gcagggctgggcgcctctgtcct

SEQ ID NO: 5042553 - DNA, 16 bp, Homo sapiens
gcaggggcccctcctc

SEQ ID NO: 5042554 - DNA, 22 bp, Homo sapiens
gcaggtggggttttcacttcct

SEQ ID NO: 5042555 - DNA, 18 bp, Homo sapiens
gcatctgtggcctggggc

SEQ ID NO: 5042556 - DNA, 22 bp, Homo sapiens
gcatggccgcaacttcccaggc

SEQ ID NO: 5042557 - DNA, 21 bp, Homo sapiens
gccacactggccggcccacgt

SEQ ID NO: 5042558 - DNA, 22 bp, Homo sapiens
gccacatggccgctgcccacgt

SEQ ID NO: 5042559 - DNA, 21 bp, Homo sapiens
gccacgtggccgctgcccacg

SEQ ID NO: 5042560 - DNA, 13 bp, Homo sapiens
gccaggagtgggt

SEQ ID NO: 5042561 - DNA, 20 bp, Homo sapiens
gccaggagtgggtttccctg

SEQ ID NO: 5042562 - DNA, 16 bp, Homo sapiens
gccaggccctctctgc

SEQ ID NO: 5042563 - DNA, 20 bp, Homo sapiens
gccaggccctctctgcagtc

SEQ ID NO: 5042564 - DNA, 23 bp, Homo sapiens
gccaggccctctctgcagtcctc

SEQ ID NO: 5042565 - DNA, 14 bp, Homo sapiens
gcccacctgccagg

SEQ ID NO: 5042566 - DNA, 16 bp, Homo sapiens
gcccacctgccaggct

SEQ ID NO: 5042567 - DNA, 17 bp, Homo sapiens
gcccacctgccaggctg

SEQ ID NO: 5042568 - DNA, 13 bp, Homo sapiens
gcccagcggctct

SEQ ID NO: 5042569 - DNA, 13 bp, Homo sapiens
gcccagcttggag

SEQ ID NO: 5042570 - DNA, 19 bp, Homo sapiens
gcccagcttggagtgccac

SEQ ID NO: 5042571 - DNA, 20 bp, Homo sapiens
gccccagctcctcttcctgc

SEQ ID NO: 5042572 - DNA, 14 bp, Homo sapiens
gcccgggagccgca

SEQ ID NO: 5042573 - DNA, 13 bp, Homo sapiens
gccctctctgcag

SEQ ID NO: 5042574 - DNA, 19 bp, Homo sapiens
gccgaggaagggcccccgg

SEQ ID NO: 5042575 - DNA, 17 bp, Homo sapiens
gccgcaacttcccaggc

SEQ ID NO: 5042576 - DNA, 19 bp, Homo sapiens
gccgcaggggcccctcctc

SEQ ID NO: 5042577 - DNA, 12 bp, Homo sapiens
gccgctgcccac

SEQ ID NO: 5042578 - DNA, 17 bp, Homo sapiens
gccgctgctctcccagg

SEQ ID NO: 5042579 - DNA, 18 bp, Homo sapiens
gccggcccacgtcctggg

SEQ ID NO: 5042580 - DNA, 20 bp, Homo sapiens
gccggcccacgtcctgggtg

SEQ ID NO: 5042581 - DNA, 12 bp, Homo sapiens
gcctctgtcctg

SEQ ID NO: 5042582 - DNA, 20 bp, Homo sapiens
gcctctgtcctggcccggga

SEQ ID NO: 5042583 - DNA, 18 bp, Homo sapiens
gcctgcagaccctgccag

SEQ ID NO: 5042584 - DNA, 17 bp, Homo sapiens
gcctgggagatgcagct

SEQ ID NO: 5042585 - DNA, 20 bp, Homo sapiens
gcctgggagatgcagctgga

SEQ ID NO: 5042586 - DNA, 15 bp, Homo sapiens
gcgacacaggctgcc

SEQ ID NO: 5042587 - DNA, 18 bp, Homo sapiens
gcgactgtgaaactggaa

SEQ ID NO: 5042588 - DNA, 18 bp, Homo sapiens
gcgcccagcctggcccca

SEQ ID NO: 5042589 - DNA, 18 bp, Homo sapiens
gcgcctgggtcctcccag

SEQ ID NO: 5042590 - DNA, 17 bp, Homo sapiens
tggatggggcggcctgc

SEQ ID NO: 5042591 - DNA, 20 bp, Homo sapiens
tggatggggcggcctgcaga

SEQ ID NO: 5042592 - DNA, 18 bp, Homo sapiens
tggcagcgcccagcctgg

SEQ ID NO: 5042593 - DNA, 23 bp, Homo sapiens
tggccggcccacgtcctgggtgc

SEQ ID NO: 5042594 - DNA, 22 bp, Homo sapiens
tgggctctctggacctgaccag

SEQ ID NO: 5042595 - DNA, 23 bp, Homo sapiens
tgggctgctggaaaggcccggag

SEQ ID NO: 5042596 - DNA, 15 bp, Homo sapiens
tggggcggcctgcag

SEQ ID NO: 5042597 - DNA, 16 bp, Homo sapiens
tgggggtggggctgca

SEQ ID NO: 5042598 - DNA, 14 bp, Homo sapiens
tggggttttcactt

SEQ ID NO: 5042599 - DNA, 13 bp, Homo sapiens
tgggtcctcccag

SEQ ID NO: 5042600 - DNA, 15 bp, Homo sapiens
tggtaccggatgcag

SEQ ID NO: 5042601 - DNA, 17 bp, Homo sapiens
tggtcccccatgggctg

SEQ ID NO: 5042602 - DNA, 13 bp, Homo sapiens
tgtcatgcccagc

SEQ ID NO: 5042603 - DNA, 22 bp, Homo sapiens
tgtcatgcccagcttggagtgc

SEQ ID NO: 5042604 - DNA, 19 bp, Homo sapiens
tgtcgtaacagcaggagca

SEQ ID NO: 5042605 - DNA, 16 bp, Homo sapiens
tgtgagggcaaaccag

SEQ ID NO: 5042606 - DNA, 13 bp, Homo sapiens
tgtggcctggggc

SEQ ID NO: 5042607 - DNA, 23 bp, Homo sapiens
tgtgtgagggcaaaccaggctgc

SEQ ID NO: 5042608 - DNA, 15 bp, Homo sapiens
tgtgtttgctcccat

SEQ ID NO: 5042609 - DNA, 22 bp, Homo sapiens
ttcccactgcggaacaggagtg

SEQ ID NO: 5042610 - DNA, 17 bp, Homo sapiens
ttgaggaccctcccagg

SEQ ID NO: 5042611 - DNA, 19 bp, Homo sapiens
ttggctagtctgtgcctca

SEQ ID NO: 5042612 - DNA, 18 bp, Homo sapiens
tttcccttgtgtgagggc

SEQ ID NO: 5042613 - DNA, 18 bp, Homo sapiens
tttgaggaccctcccagg

SEQ ID NO: 5042614 - DNA, 16 bp, Homo sapiens
ggcttcctccctccac

SEQ ID NO: 5042615 - DNA, 14 bp, Homo sapiens
gggacaagccaggc

SEQ ID NO: 5042616 - DNA, 23 bp, Homo sapiens
gggagccacagggacgacccggg

SEQ ID NO: 5042617 - DNA, 13 bp, Homo sapiens
gggcgactgtgaa

SEQ ID NO: 5042618 - DNA, 22 bp, Homo sapiens
gggcgcaagcgacacaggctgc

SEQ ID NO: 5042619 - DNA, 23 bp, Homo sapiens
gggcgcaagcgacacaggctgcc

SEQ ID NO: 5042620 - DNA, 16 bp, Homo sapiens
gggcgcctctgtcctg

SEQ ID NO: 5042621 - DNA, 17 bp, Homo sapiens
gggctgggcgcctctgt

SEQ ID NO: 5042622 - DNA, 21 bp, Homo sapiens
gggggcagaccagagagctca

SEQ ID NO: 5042623 - DNA, 22 bp, Homo sapiens
gggtactcagtcagcccagtgg

SEQ ID NO: 5042624 - DNA, 16 bp, Homo sapiens
gggtggcagcgcccag

SEQ ID NO: 5042625 - DNA, 21 bp, Homo sapiens
gggtggcagcgcccagcctgg

SEQ ID NO: 5042626 - DNA, 15 bp, Homo sapiens
gggtgggagccacag

SEQ ID NO: 5042627 - DNA, 21 bp, Homo sapiens
gggtttgaggaccctcccagg

SEQ ID NO: 5042628 - DNA, 15 bp, Homo sapiens
ggtacagcccaggcg

SEQ ID NO: 5042629 - DNA, 13 bp, Homo sapiens
ggtcactgcccac

SEQ ID NO: 5042630 - DNA, 21 bp, Homo sapiens
ggtcactgcccacctgccagg

SEQ ID NO: 5042631 - DNA, 13 bp, Homo sapiens
ggtcagagcccag

SEQ ID NO: 5042632 - DNA, 15 bp, Homo sapiens
ggtcagagcccagga

SEQ ID NO: 5042633 - DNA, 16 bp, Homo sapiens
ggtcccccatgggctg

SEQ ID NO: 5042634 - DNA, 12 bp, Homo sapiens
ggtcctcccagc

SEQ ID NO: 5042635 - DNA, 15 bp, Homo sapiens
ggtctgctcctggga

SEQ ID NO: 5042636 - DNA, 15 bp, Homo sapiens
ggtggggctgcatcc

SEQ ID NO: 5042637 - DNA, 21 bp, Homo sapiens
ggtggggctgcatccaaggct

SEQ ID NO: 5042638 - DNA, 22 bp, Homo sapiens
ggtgttttccttcacaatggtt

SEQ ID NO: 5042639 - DNA, 21 bp, Homo sapiens
ggtttgaggaccctcccaggt

SEQ ID NO: 5042640 - DNA, 16 bp, Homo sapiens
gtagtgccatggccag

SEQ ID NO: 5042641 - DNA, 21 bp, Homo sapiens
gtcactgcccacctgccaggc

SEQ ID NO: 5042642 - DNA, 15 bp, Homo sapiens
gtcaggggccgggca

SEQ ID NO: 5042643 - DNA, 20 bp, Homo sapiens
gtcccgagggcgcctgggtc

SEQ ID NO: 5042644 - DNA, 19 bp, Homo sapiens
gtcccgggtactcagtcag

SEQ ID NO: 5042645 - DNA, 17 bp, Homo sapiens
gtcctggcccgggagcc

SEQ ID NO: 5042646 - DNA, 14 bp, Homo sapiens
gtcgtaacagcagg

SEQ ID NO: 5042647 - DNA, 17 bp, Homo sapiens
gtctccctggccccagt

SEQ ID NO: 5042648 - DNA, 19 bp, Homo sapiens
gtgagggcaaaccaggctg

SEQ ID NO: 5042649 - DNA, 20 bp, Homo sapiens
gtgagggcaaaccaggctgc

SEQ ID NO: 5042650 - DNA, 23 bp, Homo sapiens
gtgagggcaaaccaggctgcagg

SEQ ID NO: 5042651 - DNA, 18 bp, Homo sapiens
gtgcacctgccccaggct

SEQ ID NO: 5042652 - DNA, 21 bp, Homo sapiens
gtgcacctgccccaggctcag

SEQ ID NO: 5042653 - DNA, 17 bp, Homo sapiens
gtgccacatggccgctg

SEQ ID NO: 5042654 - DNA, 20 bp, Homo sapiens
gtgccacatggccgctgccc

SEQ ID NO: 5042655 - DNA, 21 bp, Homo sapiens
gtgccacatggccgctgccca

SEQ ID NO: 5042656 - DNA, 22 bp, Homo sapiens
gtgccacatggccgctgcccac

SEQ ID NO: 5042657 - DNA, 18 bp, Homo sapiens
gtgccatggccaggagtg

SEQ ID NO: 5042658 - DNA, 23 bp, Homo sapiens
gtgctgtcatgcccagcttggag

SEQ ID NO: 5042659 - DNA, 15 bp, Homo sapiens
gtggcagcgcccagc

SEQ ID NO: 5042660 - DNA, 13 bp, Homo sapiens
gtggccgctgccc

SEQ ID NO: 5042661 - DNA, 15 bp, Homo sapiens
gtggccgctgcccac

SEQ ID NO: 5042662 - DNA, 14 bp, Homo sapiens
gtgggagccacagg

SEQ ID NO: 5042663 - DNA, 13 bp, Homo sapiens
gtttttgctggct

SEQ ID NO: 5042664 - DNA, 16 bp, Homo sapiens
taccggatgcagaccc

SEQ ID NO: 5042665 - DNA, 16 bp, Homo sapiens
tactcaaaatgcagga

SEQ ID NO: 5042666 - DNA, 18 bp, Homo sapiens
tactcaaaatgcaggaca

SEQ ID NO: 5042667 - DNA, 16 bp, Homo sapiens
tagggtctgtcccggg

SEQ ID NO: 5042668 - DNA, 15 bp, Homo sapiens
tcaccgccgtggggt

SEQ ID NO: 5042669 - DNA, 23 bp, Homo sapiens
tcactgagaaggccccagggcag

SEQ ID NO: 5042670 - DNA, 19 bp, Homo sapiens
tcactgcccacctgccagg

SEQ ID NO: 5042671 - DNA, 21 bp, Homo sapiens
tcactgcccacctgccaggct

SEQ ID NO: 5042672 - DNA, 21 bp, Homo sapiens
tcatgcccagcttggagtgcc

SEQ ID NO: 5042673 - DNA, 22 bp, Homo sapiens
tcccgggcactgtcatgcccag

SEQ ID NO: 5042674 - DNA, 20 bp, Homo sapiens
tccctacttagacccagtca

SEQ ID NO: 5042675 - DNA, 22 bp, Homo sapiens
tccctccacgcttagggtctgt

SEQ ID NO: 5042676 - DNA, 20 bp, Homo sapiens
tccggaaggacacagtcagg

SEQ ID NO: 5042677 - DNA, 21 bp, Homo sapiens
tcctagaggggacaagccagg

SEQ ID NO: 5042678 - DNA, 21 bp, Homo sapiens
tcctcactgagaaggccccag

SEQ ID NO: 5042679 - DNA, 15 bp, Homo sapiens
tcctccagagcctgg

SEQ ID NO: 5042680 - DNA, 17 bp, Homo sapiens
tcctccagagcctgggc

SEQ ID NO: 5042681 - DNA, 14 bp, Homo sapiens
tcctgcccactctg

SEQ ID NO: 5042682 - DNA, 22 bp, Homo sapiens
tcctggacagtgagagcagggc

SEQ ID NO: 5042683 - DNA, 18 bp, Homo sapiens
tcctggcccgggagccgc

SEQ ID NO: 5042684 - DNA, 19 bp, Homo sapiens
tcctggcccgggagccgca

SEQ ID NO: 5042685 - DNA, 18 bp, Homo sapiens
tcctgtgtttgctcccat

SEQ ID NO: 5042686 - DNA, 16 bp, Homo sapiens
tcgtaacagcaggagc

SEQ ID NO: 5042687 - DNA, 14 bp, Homo sapiens
tctccatctccgct

SEQ ID NO: 5042688 - DNA, 15 bp, Homo sapiens
tctccctggccccag

SEQ ID NO: 5042689 - DNA, 16 bp, Homo sapiens
tctcctgcccactctg

SEQ ID NO: 5042690 - DNA, 23 bp, Homo sapiens
tctgaccgggcttcctccctcca

SEQ ID NO: 5042691 - DNA, 23 bp, Homo sapiens
tctgcaggccacccccacctccc

SEQ ID NO: 5042692 - DNA, 21 bp, Homo sapiens
tctgcagtcctcggcagctcc

SEQ ID NO: 5042693 - DNA, 22 bp, Homo sapiens
tctgcagtcctcggcagctccg

SEQ ID NO: 5042694 - DNA, 12 bp, Homo sapiens
tctggctgccaa

SEQ ID NO: 5042695 - DNA, 17 bp, Homo sapiens
tcttgggggcagaccag

SEQ ID NO: 5042696 - DNA, 16 bp, Homo sapiens
tgaccagactgtgggt

SEQ ID NO: 5042697 - DNA, 15 bp, Homo sapiens
tgactctggctgcca

SEQ ID NO: 5042698 - DNA, 21 bp, Homo sapiens
tgagcccctccctcctgtgtt

SEQ ID NO: 5042699 - DNA, 18 bp, Homo sapiens
tgagggcaaaccaggctg

SEQ ID NO: 5042700 - DNA, 15 bp, Homo sapiens
tgcacctgccccagg

SEQ ID NO: 5042701 - DNA, 16 bp, Homo sapiens
tgcacctgccccaggc

SEQ ID NO: 5042702 - DNA, 17 bp, Homo sapiens
tgcacctgccccaggct

SEQ ID NO: 5042703 - DNA, 15 bp, Homo sapiens
tgcagaccctgccag

SEQ ID NO: 5042704 - DNA, 17 bp, Homo sapiens
tgcagctttgaggctgg

SEQ ID NO: 5042705 - DNA, 16 bp, Homo sapiens
tgcaggcaagacacct

SEQ ID NO: 5042706 - DNA, 18 bp, Homo sapiens
tgcagtcctcggcagctc

SEQ ID NO: 5042707 - DNA, 19 bp, Homo sapiens
tgcagtcctcggcagctcc

SEQ ID NO: 5042708 - DNA, 20 bp, Homo sapiens
tgcagtcctcggcagctccg

SEQ ID NO: 5042709 - DNA, 13 bp, Homo sapiens
tgcatctgtggcc

SEQ ID NO: 5042710 - DNA, 19 bp, Homo sapiens
tgccacatggccgctgccc

SEQ ID NO: 5042711 - DNA, 15 bp, Homo sapiens
tgccacgtggccgct

SEQ ID NO: 5042712 - DNA, 12 bp, Homo sapiens
tgccaggctgca

SEQ ID NO: 5042713 - DNA, 14 bp, Homo sapiens
tgccaggctgcagg

SEQ ID NO: 5042714 - DNA, 15 bp, Homo sapiens
tgccagggggtttga

SEQ ID NO: 5042715 - DNA, 14 bp, Homo sapiens
tgcccacctgccag

SEQ ID NO: 5042716 - DNA, 16 bp, Homo sapiens
tgcccacctgccaggc

SEQ ID NO: 5042717 - DNA, 19 bp, Homo sapiens
tgcccacctgccaggctgc

SEQ ID NO: 5042718 - DNA, 24 bp, Homo sapiens
tgcccagcggctcttcctggacag

SEQ ID NO: 5042719 - DNA, 19 bp, Homo sapiens
tgcccagcttggagtgcca

SEQ ID NO: 5042720 - DNA, 15 bp, Homo sapiens
tgcggaacaggagtg

SEQ ID NO: 5042721 - DNA, 11 bp, Homo sapiens
tgctcctggga

SEQ ID NO: 5042722 - DNA, 12 bp, Homo sapiens
tgctctcccagg

SEQ ID NO: 5042723 - DNA, 13 bp, Homo sapiens
tgctgtgacaggc

SEQ ID NO: 5042724 - DNA, 22 bp, Homo sapiens
tgctgtgacaggcagtgttctt

SEQ ID NO: 5042725 - DNA, 11 bp, Homo sapiens
tggacagtgag

SEQ ID NO: 5042726 - DNA, 21 bp, Homo sapiens
tggacagtgagagcagggctg

SEQ ID NO: 5042727 - DNA, 14 bp, Homo sapiens
tggacctgaccaga

SEQ ID NO: 5042728 - DNA, 17 bp, Homo sapiens
tggacctgaccagactg

SEQ ID NO: 5042729 - DNA, 21 bp, Homo sapiens
tggagtgccacgtggccgctg

SEQ ID NO: 5042730 - DNA, 16 bp, Homo sapiens
cctgcccactctgacc

SEQ ID NO: 5042731 - DNA, 12 bp, Homo sapiens
cctgccccaggc

SEQ ID NO: 5042732 - DNA, 23 bp, Homo sapiens
cctggacagtgagagcagggctg

SEQ ID NO: 5042733 - DNA, 21 bp, Homo sapiens
cctgggtgctgtcatgcccag

SEQ ID NO: 5042734 - DNA, 12 bp, Homo sapiens
cctgtctgcagg

SEQ ID NO: 5042735 - DNA, 17 bp, Homo sapiens
cctgtgtttgctcccat

SEQ ID NO: 5042736 - DNA, 14 bp, Homo sapiens
ccttcccagctgct

SEQ ID NO: 5042737 - DNA, 16 bp, Homo sapiens
ccttcccagctgctcc

SEQ ID NO: 5042738 - DNA, 13 bp, Homo sapiens
cgacacaggctgc

SEQ ID NO: 5042739 - DNA, 17 bp, Homo sapiens
cgacacaggctgccgct

SEQ ID NO: 5042740 - DNA, 17 bp, Homo sapiens
cgacccggggcgggctg

SEQ ID NO: 5042741 - DNA, 17 bp, Homo sapiens
cgactgtgaaactggaa

SEQ ID NO: 5042742 - DNA, 16 bp, Homo sapiens
cgcaacttcccaggcc

SEQ ID NO: 5042743 - DNA, 21 bp, Homo sapiens
cgcaagcgacacaggctgccg

SEQ ID NO: 5042744 - DNA, 21 bp, Homo sapiens
cgcctctgtcctggcccggga

SEQ ID NO: 5042745 - DNA, 15 bp, Homo sapiens
cgctgctctcccagg

SEQ ID NO: 5042746 - DNA, 18 bp, Homo sapiens
cgctgctgtgacaggcag

SEQ ID NO: 5042747 - DNA, 21 bp, Homo sapiens
cgcttagggtctgtcccgggt

SEQ ID NO: 5042748 - DNA, 22 bp, Homo sapiens
cggcctgcagaccctgccaggg

SEQ ID NO: 5042749 - DNA, 17 bp, Homo sapiens
cgggggaagctgagccc

SEQ ID NO: 5042750 - DNA, 20 bp, Homo sapiens
cgggtggcagcgcccagcct

SEQ ID NO: 5042751 - DNA, 19 bp, Homo sapiens
cgtaacagcaggagcatgg

SEQ ID NO: 5042752 - DNA, 17 bp, Homo sapiens
cgtcccgagggcgcctg

SEQ ID NO: 5042753 - DNA, 11 bp, Homo sapiens
cgtcctgggtg

SEQ ID NO: 5042754 - DNA, 22 bp, Homo sapiens
cgtcctgggtgctgtcatgccc

SEQ ID NO: 5042755 - DNA, 15 bp, Homo sapiens
cgtctccctggcccc

SEQ ID NO: 5042756 - DNA, 15 bp, Homo sapiens
cgtggccgctgccca

SEQ ID NO: 5042757 - DNA, 21 bp, Homo sapiens
cgtggccgctgcccacgtccc

SEQ ID NO: 5042758 - DNA, 15 bp, Homo sapiens
cgtgggagaggagag

SEQ ID NO: 5042759 - DNA, 21 bp, Homo sapiens
cgtgggagaggagaggctgct

SEQ ID NO: 5042760 - DNA, 12 bp, Homo sapiens
ctagtctgtgcc

SEQ ID NO: 5042761 - DNA, 18 bp, Homo sapiens
ctcaagtttcagagtcag

SEQ ID NO: 5042762 - DNA, 21 bp, Homo sapiens
ctcacaggttcacccagcgcc

SEQ ID NO: 5042763 - DNA, 13 bp, Homo sapiens
ctcactgagaagg

SEQ ID NO: 5042764 - DNA, 20 bp, Homo sapiens
ctcactgagaaggccccagg

SEQ ID NO: 5042765 - DNA, 18 bp, Homo sapiens
ctcagtgagatcagtcag

SEQ ID NO: 5042766 - DNA, 15 bp, Homo sapiens
ctccagagcctgggc

SEQ ID NO: 5042767 - DNA, 23 bp, Homo sapiens
ctcccaggtgaaatccacaccag

SEQ ID NO: 5042768 - DNA, 14 bp, Homo sapiens
ctccctcctgtgtt

SEQ ID NO: 5042769 - DNA, 12 bp, Homo sapiens
ctccctgcagct

SEQ ID NO: 5042770 - DNA, 17 bp, Homo sapiens
ctccctggccccagtga

SEQ ID NO: 5042771 - DNA, 13 bp, Homo sapiens
ctcctccagagcc

SEQ ID NO: 5042772 - DNA, 18 bp, Homo sapiens
ctcctccagagcctgggc

SEQ ID NO: 5042773 - DNA, 23 bp, Homo sapiens
ctcctcttcctgcctctctcatg

SEQ ID NO: 5042774 - DNA, 23 bp, Homo sapiens
ctcctgggaatggggtgggagcc

SEQ ID NO: 5042775 - DNA, 22 bp, Homo sapiens
ctcggcctcttgagagccccac

SEQ ID NO: 5042776 - DNA, 22 bp, Homo sapiens
ctcgtcccgagggcgcctgggt

SEQ ID NO: 5042777 - DNA, 13 bp, Homo sapiens
ctctctggacctg

SEQ ID NO: 5042778 - DNA, 13 bp, Homo sapiens
ctctggctgccaa

SEQ ID NO: 5042779 - DNA, 21 bp, Homo sapiens
ctctgtcctggcccgggagcc

SEQ ID NO: 5042780 - DNA, 14 bp, Homo sapiens
ctctttcagtctac

SEQ ID NO: 5042781 - DNA, 12 bp, Homo sapiens
ctcttttccctt

SEQ ID NO: 5042782 - DNA, 22 bp, Homo sapiens
ctgaccgggcttcctccctcca

SEQ ID NO: 5042783 - DNA, 23 bp, Homo sapiens
ctgacggcagtaaatccacagtg

SEQ ID NO: 5042784 - DNA, 12 bp, Homo sapiens
ctgcagaccctg

SEQ ID NO: 5042785 - DNA, 15 bp, Homo sapiens
ctgcagaccctgcca

SEQ ID NO: 5042786 - DNA, 17 bp, Homo sapiens
ctgcagaccctgccagg

SEQ ID NO: 5042787 - DNA, 18 bp, Homo sapiens
ctgcagtcctcggcagct

SEQ ID NO: 5042788 - DNA, 22 bp, Homo sapiens
ctgccaagataccttcatggtg

SEQ ID NO: 5042789 - DNA, 16 bp, Homo sapiens
ctgcccacctgccagg

SEQ ID NO: 5042790 - DNA, 17 bp, Homo sapiens
ctgcccacgtcccgggc

SEQ ID NO: 5042791 - DNA, 19 bp, Homo sapiens
ctgccgctgctctcccagg

SEQ ID NO: 5042792 - DNA, 23 bp, Homo sapiens
ctgcctctctcatggcttgggct

SEQ ID NO: 5042793 - DNA, 16 bp, Homo sapiens
ctgcgtctcctcgtcc

SEQ ID NO: 5042794 - DNA, 13 bp, Homo sapiens
ctgcgtctcctgc

SEQ ID NO: 5042795 - DNA, 15 bp, Homo sapiens
ctgctctcccaggtg

SEQ ID NO: 5042796 - DNA, 14 bp, Homo sapiens
caaaatgcaggaca

SEQ ID NO: 5042797 - DNA, 22 bp, Homo sapiens
caaagaaccaggaggcctggga

SEQ ID NO: 5042798 - DNA, 13 bp, Homo sapiens
caacttcccaggc

SEQ ID NO: 5042799 - DNA, 14 bp, Homo sapiens
caacttcccaggcc

SEQ ID NO: 5042800 - DNA, 20 bp, Homo sapiens
caagacaccttcccagctgc

SEQ ID NO: 5042801 - DNA, 22 bp, Homo sapiens
caagccaggccctctctgcagt

SEQ ID NO: 5042802 - DNA, 22 bp, Homo sapiens
caaggtgcacctgccccaggct

SEQ ID NO: 5042803 - DNA, 20 bp, Homo sapiens
cacaccagtccacgccgggt

SEQ ID NO: 5042804 - DNA, 12 bp, Homo sapiens
cacaggctgccg

SEQ ID NO: 5042805 - DNA, 19 bp, Homo sapiens
cacaggctgccgctgctct

SEQ ID NO: 5042806 - DNA, 14 bp, Homo sapiens
caccctgtctgcag

SEQ ID NO: 5042807 - DNA, 15 bp, Homo sapiens
caccctgtctgcagg

SEQ ID NO: 5042808 - DNA, 15 bp, Homo sapiens
cacctccctgcagct

SEQ ID NO: 5042809 - DNA, 13 bp, Homo sapiens
cacctgccaggct

SEQ ID NO: 5042810 - DNA, 21 bp, Homo sapiens
cacctgccaggctgcagggac

SEQ ID NO: 5042811 - DNA, 19 bp, Homo sapiens
cacgccgggtcgcctgccc

SEQ ID NO: 5042812 - DNA, 14 bp, Homo sapiens
cacgtcccgggcac

SEQ ID NO: 5042813 - DNA, 19 bp, Homo sapiens
cacgtcccgggcactgtca

SEQ ID NO: 5042814 - DNA, 14 bp, Homo sapiens
cacgtcctgggtgc

SEQ ID NO: 5042815 - DNA, 18 bp, Homo sapiens
cacgtctccctggcccca

SEQ ID NO: 5042816 - DNA, 17 bp, Homo sapiens
cactgagaaggccccag

SEQ ID NO: 5042817 - DNA, 18 bp, Homo sapiens
cactgcccacctgccagg

SEQ ID NO: 5042818 - DNA, 20 bp, Homo sapiens
cactgcccacctgccaggct

SEQ ID NO: 5042819 - DNA, 14 bp, Homo sapiens
cactgtcatgccca

SEQ ID NO: 5042820 - DNA, 21 bp, Homo sapiens
cactgtcatgcccagcttgga

SEQ ID NO: 5042821 - DNA, 23 bp, Homo sapiens
cacttggagcgtttttgctggct

SEQ ID NO: 5042822 - DNA, 14 bp, Homo sapiens
cagaccctgccagg

SEQ ID NO: 5042823 - DNA, 16 bp, Homo sapiens
cagaccctgccagggg

SEQ ID NO: 5042824 - DNA, 20 bp, Homo sapiens
cagacgcggaaaccgggtgg

SEQ ID NO: 5042825 - DNA, 12 bp, Homo sapiens
cagagcccagga

SEQ ID NO: 5042826 - DNA, 14 bp, Homo sapiens
cagagcccaggaat

SEQ ID NO: 5042827 - DNA, 22 bp, Homo sapiens
cagagtcagaattaggcacttg

SEQ ID NO: 5042828 - DNA, 16 bp, Homo sapiens
cagcaggagcatggcc

SEQ ID NO: 5042829 - DNA, 20 bp, Homo sapiens
cagcggtcttctccatctcc

SEQ ID NO: 5042830 - DNA, 14 bp, Homo sapiens
cagctgacggcagt

SEQ ID NO: 5042831 - DNA, 22 bp, Homo sapiens
cagctggatggggcggcctgca

SEQ ID NO: 5042832 - DNA, 22 bp, Homo sapiens
cagcttggagtgccacgtggcc

SEQ ID NO: 5042833 - DNA, 20 bp, Homo sapiens
caggaattctcacaggttca

SEQ ID NO: 5042834 - DNA, 24 bp, Homo sapiens
caggacagatcaggtcagagccca

SEQ ID NO: 5042835 - DNA, 22 bp, Homo sapiens
caggagtgactctggctgccaa

SEQ ID NO: 5042836 - DNA, 22 bp, Homo sapiens
caggagtgggtttccctgcgtc

SEQ ID NO: 5042837 - DNA, 18 bp, Homo sapiens
caggccacccccacctcc

SEQ ID NO: 5042838 - DNA, 19 bp, Homo sapiens
caggccgaggaagggcccc

SEQ ID NO: 5042839 - DNA, 16 bp, Homo sapiens
caggctcaggctgccc

SEQ ID NO: 5042840 - DNA, 13 bp, Homo sapiens
caggctgcaggga

SEQ ID NO: 5042841 - DNA, 16 bp, Homo sapiens
caggctgcccagcggc

SEQ ID NO: 5042842 - DNA, 19 bp, Homo sapiens
caggctgcccagcggctct

SEQ ID NO: 5042843 - DNA, 23 bp, Homo sapiens
caggctgccgctgctctcccagg

SEQ ID NO: 5042844 - DNA, 21 bp, Homo sapiens
cagggacagttgggtgtgaga

SEQ ID NO: 5042845 - DNA, 14 bp, Homo sapiens
cagggctgggcgcc

SEQ ID NO: 5042846 - DNA, 17 bp, Homo sapiens
cagggctgggcgcctct

SEQ ID NO: 5042847 - DNA, 17 bp, Homo sapiens
caggtcagagcccagga

SEQ ID NO: 5042848 - DNA, 17 bp, Homo sapiens
caggtgaaatccacacc

SEQ ID NO: 5042849 - DNA, 20 bp, Homo sapiens
caggtggggttttcacttcc

SEQ ID NO: 5042850 - DNA, 21 bp, Homo sapiens
caggtggggttttcacttcct

SEQ ID NO: 5042851 - DNA, 12 bp, Homo sapiens
cagtcagcccag

SEQ ID NO: 5042852 - DNA, 14 bp, Homo sapiens
cagtcagcccagtg

SEQ ID NO: 5042853 - DNA, 12 bp, Homo sapiens
cagtcaggggcc

SEQ ID NO: 5042854 - DNA, 16 bp, Homo sapiens
cagtccacgccgggtc

SEQ ID NO: 5042855 - DNA, 12 bp, Homo sapiens
cagtgggatctt

SEQ ID NO: 5042856 - DNA, 16 bp, Homo sapiens
catctgtggcctgggg

SEQ ID NO: 5042857 - DNA, 17 bp, Homo sapiens
catctgtggcctggggc

SEQ ID NO: 5042858 - DNA, 12 bp, Homo sapiens
catgacaagtgg

SEQ ID NO: 5042859 - DNA, 13 bp, Homo sapiens
catgcccagcttg

SEQ ID NO: 5042860 - DNA, 22 bp, Homo sapiens
catgcccagcttggagtgccac

SEQ ID NO: 5042861 - DNA, 12 bp, Homo sapiens
catggccaggag

SEQ ID NO: 5042862 - DNA, 17 bp, Homo sapiens
catggtgttcatgacaa

SEQ ID NO: 5042863 - DNA, 20 bp, Homo sapiens
cattctagagggatccaccg

SEQ ID NO: 5042864 - DNA, 22 bp, Homo sapiens
cattgaagggggatgcaggcaa

SEQ ID NO: 5042865 - DNA, 15 bp, Homo sapiens
ccaaacaagcgccac

SEQ ID NO: 5042866 - DNA, 12 bp, Homo sapiens
ccacagccccaa

SEQ ID NO: 5042867 - DNA, 17 bp, Homo sapiens
ccacatggccgctgccc

SEQ ID NO: 5042868 - DNA, 21 bp, Homo sapiens
ccacccctgaactggccccag

SEQ ID NO: 5042869 - DNA, 15 bp, Homo sapiens
ccaccgtgggagagg

SEQ ID NO: 5042870 - DNA, 12 bp, Homo sapiens
ccacctgccagg

SEQ ID NO: 5042871 - DNA, 20 bp, Homo sapiens
ccacctgccaggctgcaggg

SEQ ID NO: 5042872 - DNA, 21 bp, Homo sapiens
ccacctgccaggctgcaggga

SEQ ID NO: 5042873 - DNA, 22 bp, Homo sapiens
ccacgccgggtcgcctgccctg

SEQ ID NO: 5042874 - DNA, 18 bp, Homo sapiens
ccacgtggccgctgccca

SEQ ID NO: 5042875 - DNA, 13 bp, Homo sapiens
ccagagcctgggc

SEQ ID NO: 5042876 - DNA, 18 bp, Homo sapiens
ccagcctggccccaagca

SEQ ID NO: 5042877 - DNA, 17 bp, Homo sapiens
ccagctcctcttcctgc

SEQ ID NO: 5042878 - DNA, 19 bp, Homo sapiens
ccagcttggagtgccacat

SEQ ID NO: 5042879 - DNA, 19 bp, Homo sapiens
ccagcttggagtgccacgt

SEQ ID NO: 5042880 - DNA, 17 bp, Homo sapiens
ccaggaattctcacagg

SEQ ID NO: 5042881 - DNA, 14 bp, Homo sapiens
ccaggaggcctggg

SEQ ID NO: 5042882 - DNA, 17 bp, Homo sapiens
ccaggaggcctgggaga

SEQ ID NO: 5042883 - DNA, 12 bp, Homo sapiens
ccaggccctctc

SEQ ID NO: 5042884 - DNA, 18 bp, Homo sapiens
ccaggccctctctgcagt

SEQ ID NO: 5042885 - DNA, 17 bp, Homo sapiens
ccaggcggtcactgccc

SEQ ID NO: 5042886 - DNA, 19 bp, Homo sapiens
ccaggctcaggctgcccag

SEQ ID NO: 5042887 - DNA, 21 bp, Homo sapiens
ccaggctcaggctgcccagcg

SEQ ID NO: 5042888 - DNA, 15 bp, Homo sapiens
ccaggctgcagggac

SEQ ID NO: 5042889 - DNA, 13 bp, Homo sapiens
ccaggctgcaggt

SEQ ID NO: 5042890 - DNA, 13 bp, Homo sapiens
ccatggccaggag

SEQ ID NO: 5042891 - DNA, 17 bp, Homo sapiens
cccacctccctgcagct

SEQ ID NO: 5042892 - DNA, 14 bp, Homo sapiens
cccacctgccaggc

SEQ ID NO: 5042893 - DNA, 19 bp, Homo sapiens
cccagcggctcttcctgga

SEQ ID NO: 5042894 - DNA, 19 bp, Homo sapiens
cccaggctcaggctgccca

SEQ ID NO: 5042895 - DNA, 18 bp, Homo sapiens
ccccacccctgaactggc

SEQ ID NO: 5042896 - DNA, 19 bp, Homo sapiens
ccccaccctgtctgcaggc

SEQ ID NO: 5042897 - DNA, 21 bp, Homo sapiens
ccccaccctgtctgcaggcca

SEQ ID NO: 5042898 - DNA, 19 bp, Homo sapiens
ccccacctccctgcagctt

SEQ ID NO: 5042899 - DNA, 19 bp, Homo sapiens
cccccacctccctgcagct

SEQ ID NO: 5042900 - DNA, 17 bp, Homo sapiens
cccccatgggctgctgg

SEQ ID NO: 5042901 - DNA, 19 bp, Homo sapiens
cccctgaactggccccagc

SEQ ID NO: 5042902 - DNA, 17 bp, Homo sapiens
cccgagggcgcctgggt

SEQ ID NO: 5042903 - DNA, 19 bp, Homo sapiens
cccgggtactcagtcagcc

SEQ ID NO: 5042904 - DNA, 19 bp, Homo sapiens
ccctcctccagagcctggg

SEQ ID NO: 5042905 - DNA, 13 bp, Homo sapiens
ccctggccccagt

SEQ ID NO: 5042906 - DNA, 15 bp, Homo sapiens
ccctggccccagtga

SEQ ID NO: 5042907 - DNA, 15 bp, Homo sapiens
ccgcaacttcccagg

SEQ ID NO: 5042908 - DNA, 16 bp, Homo sapiens
ccgctgctctcccagg

SEQ ID NO: 5042909 - DNA, 14 bp, Homo sapiens
ccgctgctgtgaca

SEQ ID NO: 5042910 - DNA, 20 bp, Homo sapiens
ccggcccacgtcctgggtgc

SEQ ID NO: 5042911 - DNA, 18 bp, Homo sapiens
ggcctcttgagagcccca

SEQ ID NO: 5042912 - DNA, 19 bp, Homo sapiens
ggcctgcagaccctgccag

SEQ ID NO: 5042913 - DNA, 12 bp, Homo sapiens
ggcgactgtgaa

SEQ ID NO: 5042914 - DNA, 22 bp, Homo sapiens
ggcgcaagcgacacaggctgcc

SEQ ID NO: 5042915 - DNA, 17 bp, Homo sapiens
ggcgcctctgtcctggc

SEQ ID NO: 5042916 - DNA, 13 bp, Homo sapiens
ggctagtctgtgc

SEQ ID NO: 5042917 - DNA, 13 bp, Homo sapiens
ggctcttcctgga

SEQ ID NO: 5042918 - DNA, 14 bp, Homo sapiens
ggctgggcgcctct

SEQ ID NO: 5042919 - DNA, 14 bp, Homo sapiens
ggctttgggtagtg

SEQ ID NO: 5042920 - DNA, 20 bp, Homo sapiens
ggctttgggtagtgccatgg

SEQ ID NO: 5042921 - DNA, 20 bp, Homo sapiens
gggacaagccaggccctctc

SEQ ID NO: 5042922 - DNA, 21 bp, Homo sapiens
gggacgacccggggcgggctg

SEQ ID NO: 5042923 - DNA, 17 bp, Homo sapiens
gggagaggagaggctgc

SEQ ID NO: 5042924 - DNA, 14 bp, Homo sapiens
gggagatgcagctg

SEQ ID NO: 5042925 - DNA, 13 bp, Homo sapiens
gggagccacaggg

SEQ ID NO: 5042926 - DNA, 16 bp, Homo sapiens
gggatcttacccactt

SEQ ID NO: 5042927 - DNA, 21 bp, Homo sapiens
gggcactgtcatgcccagctt

SEQ ID NO: 5042928 - DNA, 16 bp, Homo sapiens
gggcagaccagagagc

SEQ ID NO: 5042929 - DNA, 18 bp, Homo sapiens
gggcagaccagagagctc

SEQ ID NO: 5042930 - DNA, 19 bp, Homo sapiens
gggcagaccagagagctca

SEQ ID NO: 5042931 - DNA, 15 bp, Homo sapiens
gggcccctcctccag

SEQ ID NO: 5042932 - DNA, 15 bp, Homo sapiens
gggcgcctctgtcct

SEQ ID NO: 5042933 - DNA, 20 bp, Homo sapiens
gggcgcctgggtcctcccag

SEQ ID NO: 5042934 - DNA, 20 bp, Homo sapiens
gggcggcctgcagaccctgc

SEQ ID NO: 5042935 - DNA, 13 bp, Homo sapiens
gggggatgcaggc

SEQ ID NO: 5042936 - DNA, 14 bp, Homo sapiens
gggtagtgccatgg

SEQ ID NO: 5042937 - DNA, 23 bp, Homo sapiens
gggtccctgcgtctcctgcccac

SEQ ID NO: 5042938 - DNA, 15 bp, Homo sapiens
gggtcctcccagctg

SEQ ID NO: 5042939 - DNA, 16 bp, Homo sapiens
gggtcctcccagctga

SEQ ID NO: 5042940 - DNA, 15 bp, Homo sapiens
gggtcgcctgccctg

SEQ ID NO: 5042941 - DNA, 16 bp, Homo sapiens
gggtctgctcctggga

SEQ ID NO: 5042942 - DNA, 23 bp, Homo sapiens
gggtcttagggtacagcccaggc

SEQ ID NO: 5042943 - DNA, 20 bp, Homo sapiens
gggttttcacttcctagggt

SEQ ID NO: 5042944 - DNA, 20 bp, Homo sapiens
ggtagtgccatggccaggag

SEQ ID NO: 5042945 - DNA, 12 bp, Homo sapiens
ggtcgcctgccc

SEQ ID NO: 5042946 - DNA, 13 bp, Homo sapiens
ggtctgctcctgg

SEQ ID NO: 5042947 - DNA, 22 bp, Homo sapiens
ggtcttagggtacagcccaggc

SEQ ID NO: 5042948 - DNA, 23 bp, Homo sapiens
ggtcttagggtacagcccaggcg

SEQ ID NO: 5042949 - DNA, 19 bp, Homo sapiens
ggtgctgtcatgcccagct

SEQ ID NO: 5042950 - DNA, 20 bp, Homo sapiens
ggtgctgtcatgcccagctt

SEQ ID NO: 5042951 - DNA, 18 bp, Homo sapiens
gtactcagtcagcccagt

SEQ ID NO: 5042952 - DNA, 21 bp, Homo sapiens
gtactcagtcagcccagtggg

SEQ ID NO: 5042953 - DNA, 19 bp, Homo sapiens
gtagtgccatggccaggag

SEQ ID NO: 5042954 - DNA, 13 bp, Homo sapiens
gtcagagcccagg

SEQ ID NO: 5042955 - DNA, 13 bp, Homo sapiens
gtcagcccagtgg

SEQ ID NO: 5042956 - DNA, 14 bp, Homo sapiens
gtcagcccagtggg

SEQ ID NO: 5042957 - DNA, 16 bp, Homo sapiens
gtcatgcccagcttgg

SEQ ID NO: 5042958 - DNA, 22 bp, Homo sapiens
gtcatgcccagcttggagtgcc

SEQ ID NO: 5042959 - DNA, 22 bp, Homo sapiens
gtccacgccgggtcgcctgccc

SEQ ID NO: 5042960 - DNA, 16 bp, Homo sapiens
gtcccgggcactgtca

SEQ ID NO: 5042961 - DNA, 14 bp, Homo sapiens
gtcctcccagctga

SEQ ID NO: 5042962 - DNA, 19 bp, Homo sapiens
gtcctcccagctgacggca

SEQ ID NO: 5042963 - DNA, 15 bp, Homo sapiens
gtcctcggcagctcc

SEQ ID NO: 5042964 - DNA, 19 bp, Homo sapiens
gtctcctcgtcccgagggc

SEQ ID NO: 5042965 - DNA, 23 bp, Homo sapiens
gtctcctgcccactctgaccggg

SEQ ID NO: 5042966 - DNA, 14 bp, Homo sapiens
gtctgtgcctcagt

SEQ ID NO: 5042967 - DNA, 15 bp, Homo sapiens
gtctgtgcctcagtg

SEQ ID NO: 5042968 - DNA, 14 bp, Homo sapiens
gtgagatcagtcag

SEQ ID NO: 5042969 - DNA, 15 bp, Homo sapiens
gtgcacctgccccag

SEQ ID NO: 5042970 - DNA, 13 bp, Homo sapiens
gtgccacgtggcc

SEQ ID NO: 5042971 - DNA, 14 bp, Homo sapiens
gtgcctcagtgaga

SEQ ID NO: 5042972 - DNA, 21 bp, Homo sapiens
gtgggagaggagaggctgctg

SEQ ID NO: 5042973 - DNA, 19 bp, Homo sapiens
gtttgaggaccctcccagg

SEQ ID NO: 5042974 - DNA, 13 bp, Homo sapiens
gttttcacttcct

SEQ ID NO: 5042975 - DNA, 13 bp, Homo sapiens
tacagcccaggcg

SEQ ID NO: 5042976 - DNA, 19 bp, Homo sapiens
tacccacttccctgcaagg

SEQ ID NO: 5042977 - DNA, 21 bp, Homo sapiens
tagaggggacaagccaggccc

SEQ ID NO: 5042978 - DNA, 22 bp, Homo sapiens
tcaaccattgaagggggatgca

SEQ ID NO: 5042979 - DNA, 18 bp, Homo sapiens
tcactgagaaggccccag

SEQ ID NO: 5042980 - DNA, 24 bp, Homo sapiens
tcactgagaaggccccagggcagc

SEQ ID NO: 5042981 - DNA, 22 bp, Homo sapiens
tcactgcccacctgccaggctg

SEQ ID NO: 5042982 - DNA, 13 bp, Homo sapiens
tcagagcccagga

SEQ ID NO: 5042983 - DNA, 13 bp, Homo sapiens
tcaggctgcccag

SEQ ID NO: 5042984 - DNA, 15 bp, Homo sapiens
tcaggtcagagccca

SEQ ID NO: 5042985 - DNA, 19 bp, Homo sapiens
tcagtgagatcagtcagct

SEQ ID NO: 5042986 - DNA, 14 bp, Homo sapiens
tcatgcccagcttg

SEQ ID NO: 5042987 - DNA, 22 bp, Homo sapiens
tcatgcccagcttggagtgcca

SEQ ID NO: 5042988 - DNA, 18 bp, Homo sapiens
tccacgcttagggtctgt

SEQ ID NO: 5042989 - DNA, 22 bp, Homo sapiens
tccacgcttagggtctgtcccg

SEQ ID NO: 5042990 - DNA, 15 bp, Homo sapiens
tccagagcctgggcg

SEQ ID NO: 5042991 - DNA, 11 bp, Homo sapiens
tcccagctgct

SEQ ID NO: 5042992 - DNA, 12 bp, Homo sapiens
tcccgggcactg

SEQ ID NO: 5042993 - DNA, 21 bp, Homo sapiens
tccctgcagctttgaggctgg

SEQ ID NO: 5042994 - DNA, 12 bp, Homo sapiens
tccctggcccca

SEQ ID NO: 5042995 - DNA, 13 bp, Homo sapiens
tccctggccccag

SEQ ID NO: 5042996 - DNA, 15 bp, Homo sapiens
tccctggccccagtg

SEQ ID NO: 5042997 - DNA, 17 bp, Homo sapiens
tccctggccccagtgac

SEQ ID NO: 5042998 - DNA, 22 bp, Homo sapiens
tcctcactgagaaggccccagg

SEQ ID NO: 5042999 - DNA, 14 bp, Homo sapiens
tcctccagagcctg

SEQ ID NO: 5043000 - DNA, 19 bp, Homo sapiens
tcctccagagcctgggcgc

SEQ ID NO: 5043001 - DNA, 15 bp, Homo sapiens
tcctcggcagctccg

SEQ ID NO: 5043002 - DNA, 22 bp, Homo sapiens
tcctgcccactctgaccgggct

SEQ ID NO: 5043003 - DNA, 20 bp, Homo sapiens
tcggcctcttgagagcccca

SEQ ID NO: 5043004 - DNA, 14 bp, Homo sapiens
tctacatttttgtt

SEQ ID NO: 5043005 - DNA, 20 bp, Homo sapiens
tctagagggatccaccgcca

SEQ ID NO: 5043006 - DNA, 17 bp, Homo sapiens
tctctggacctgaccag

SEQ ID NO: 5043007 - DNA, 13 bp, Homo sapiens
tctggacctgacc

SEQ ID NO: 5043008 - DNA, 13 bp, Homo sapiens
tctgtgcctcagt

SEQ ID NO: 5043009 - DNA, 14 bp, Homo sapiens
tcttacccacttcc

SEQ ID NO: 5043010 - DNA, 20 bp, Homo sapiens
tcttacccacttccctgcaa

SEQ ID NO: 5043011 - DNA, 21 bp, Homo sapiens
tcttacccacttccctgcaag

SEQ ID NO: 5043012 - DNA, 22 bp, Homo sapiens
tcttacccacttccctgcaagg

SEQ ID NO: 5043013 - DNA, 18 bp, Homo sapiens
tcttagggtacagcccag

SEQ ID NO: 5043014 - DNA, 19 bp, Homo sapiens
tcttcttgggggcagacca

SEQ ID NO: 5043015 - DNA, 20 bp, Homo sapiens
tcttgggggtggggctgcat

SEQ ID NO: 5043016 - DNA, 22 bp, Homo sapiens
tcttgggggtggggctgcatcc

SEQ ID NO: 5043017 - DNA, 14 bp, Homo sapiens
tgaactggccccag

SEQ ID NO: 5043018 - DNA, 16 bp, Homo sapiens
tgaactggccccagct

SEQ ID NO: 5043019 - DNA, 15 bp, Homo sapiens
tgaccagactgtggg

SEQ ID NO: 5043020 - DNA, 21 bp, Homo sapiens
tgaccagactgtgggtccctg

SEQ ID NO: 5043021 - DNA, 17 bp, Homo sapiens
tgagggcaaaccaggct

SEQ ID NO: 5043022 - DNA, 14 bp, Homo sapiens
tgcacctgccccag

SEQ ID NO: 5043023 - DNA, 14 bp, Homo sapiens
tgcagaccctgcca

SEQ ID NO: 5043024 - DNA, 17 bp, Homo sapiens
tgcagggacagttgggt

SEQ ID NO: 5043025 - DNA, 23 bp, Homo sapiens
tgcagggacagttgggtgtgaga

SEQ ID NO: 5043026 - DNA, 21 bp, Homo sapiens
aaagaaccaggaggcctggga

SEQ ID NO: 5043027 - DNA, 12 bp, Homo sapiens
aacagcaggagc

SEQ ID NO: 5043028 - DNA, 21 bp, Homo sapiens
aacccctaatcgccctgagct

SEQ ID NO: 5043029 - DNA, 14 bp, Homo sapiens
aactggccccagct

SEQ ID NO: 5043030 - DNA, 13 bp, Homo sapiens
aacttcccaggcc

SEQ ID NO: 5043031 - DNA, 14 bp, Homo sapiens
aaggccccagggca

SEQ ID NO: 5043032 - DNA, 16 bp, Homo sapiens
aaggcccggagatgca

SEQ ID NO: 5043033 - DNA, 15 bp, Homo sapiens
aagggggatgcaggc

SEQ ID NO: 5043034 - DNA, 23 bp, Homo sapiens
acaagccaggccctctctgcagt

SEQ ID NO: 5043035 - DNA, 15 bp, Homo sapiens
acactggccggccca

SEQ ID NO: 5043036 - DNA, 22 bp, Homo sapiens
acactggctttgggtagtgcca

SEQ ID NO: 5043037 - DNA, 15 bp, Homo sapiens
acactttggccacag

SEQ ID NO: 5043038 - DNA, 21 bp, Homo sapiens
acagccccaaacaagcgccac

SEQ ID NO: 5043039 - DNA, 22 bp, Homo sapiens
acaggagtgactctggctgcca

SEQ ID NO: 5043040 - DNA, 22 bp, Homo sapiens
acaggctgccgctgctctccca

SEQ ID NO: 5043041 - DNA, 21 bp, Homo sapiens
acagtgagagcagggctgggc

SEQ ID NO: 5043042 - DNA, 15 bp, Homo sapiens
acatggccgctgccc

SEQ ID NO: 5043043 - DNA, 21 bp, Homo sapiens
accacgtctccctggccccag

SEQ ID NO: 5043044 - DNA, 16 bp, Homo sapiens
accaggaggcctggga

SEQ ID NO: 5043045 - DNA, 12 bp, Homo sapiens
accaggctgcag

SEQ ID NO: 5043046 - DNA, 13 bp, Homo sapiens
accaggctgcagg

SEQ ID NO: 5043047 - DNA, 20 bp, Homo sapiens
accaggctgcaggtggggtt

SEQ ID NO: 5043048 - DNA, 18 bp, Homo sapiens
accccaccctgtctgcag

SEQ ID NO: 5043049 - DNA, 13 bp, Homo sapiens
acccccacctccc

SEQ ID NO: 5043050 - DNA, 18 bp, Homo sapiens
acccctgaactggcccca

SEQ ID NO: 5043051 - DNA, 21 bp, Homo sapiens
acccctgaactggccccagct

SEQ ID NO: 5043052 - DNA, 11 bp, Homo sapiens
accctcccagg

SEQ ID NO: 5043053 - DNA, 22 bp, Homo sapiens
accctcccaggtttcccactgc

SEQ ID NO: 5043054 - DNA, 14 bp, Homo sapiens
accctgtctgcagg

SEQ ID NO: 5043055 - DNA, 19 bp, Homo sapiens
accgggtggcagcgcccag

SEQ ID NO: 5043056 - DNA, 13 bp, Homo sapiens
acctgccaggctg

SEQ ID NO: 5043057 - DNA, 17 bp, Homo sapiens
acctgccaggctgcagg

SEQ ID NO: 5043058 - DNA, 21 bp, Homo sapiens
accttcccagctgctcctaga

SEQ ID NO: 5043059 - DNA, 12 bp, Homo sapiens
acgtcctgggtg

SEQ ID NO: 5043060 - DNA, 22 bp, Homo sapiens
acgtggccgctgctgtgacagg

SEQ ID NO: 5043061 - DNA, 16 bp, Homo sapiens
actctgaccgggcttc

SEQ ID NO: 5043062 - DNA, 19 bp, Homo sapiens
actgcccacctgccaggct

SEQ ID NO: 5043063 - DNA, 22 bp, Homo sapiens
actggccggcccacgtcctggg

SEQ ID NO: 5043064 - DNA, 23 bp, Homo sapiens
actggccggcccacgtcctgggt

SEQ ID NO: 5043065 - DNA, 21 bp, Homo sapiens
actggctttgggtagtgccat

SEQ ID NO: 5043066 - DNA, 13 bp, Homo sapiens
actttccagcagg

SEQ ID NO: 5043067 - DNA, 13 bp, Homo sapiens
agaaggccccagg

SEQ ID NO: 5043068 - DNA, 12 bp, Homo sapiens
agaccagagagc

SEQ ID NO: 5043069 - DNA, 13 bp, Homo sapiens
agaccctgccagg

SEQ ID NO: 5043070 - DNA, 13 bp, Homo sapiens
agagcctgggcgc

SEQ ID NO: 5043071 - DNA, 15 bp, Homo sapiens
agaggagaggctgct

SEQ ID NO: 5043072 - DNA, 16 bp, Homo sapiens
agcaagtactttgtct

SEQ ID NO: 5043073 - DNA, 20 bp, Homo sapiens
agccgcaggggcccctcctc

SEQ ID NO: 5043074 - DNA, 16 bp, Homo sapiens
cgggggaagctgagcc

SEQ ID NO: 5043075 - DNA, 18 bp, Homo sapiens
cggggtctgctcctggga

SEQ ID NO: 5043076 - DNA, 20 bp, Homo sapiens
cggtcactgcccacctgcca

SEQ ID NO: 5043077 - DNA, 24 bp, Homo sapiens
cgtcccgggcactgtcatgcccag

SEQ ID NO: 5043078 - DNA, 19 bp, Homo sapiens
cgtggccgctgctgtgaca

SEQ ID NO: 5043079 - DNA, 23 bp, Homo sapiens
ctagaggggacaagccaggccct

SEQ ID NO: 5043080 - DNA, 20 bp, Homo sapiens
ctcacaggttcacccagcgc

SEQ ID NO: 5043081 - DNA, 16 bp, Homo sapiens
ctcagtcagcccagtg

SEQ ID NO: 5043082 - DNA, 18 bp, Homo sapiens
ctccacgcttagggtctg

SEQ ID NO: 5043083 - DNA, 16 bp, Homo sapiens
ctcccagctgacggca

SEQ ID NO: 5043084 - DNA, 19 bp, Homo sapiens
ctcccaggtttcccactgc

SEQ ID NO: 5043085 - DNA, 18 bp, Homo sapiens
ctccctacttagacccag

SEQ ID NO: 5043086 - DNA, 21 bp, Homo sapiens
ctccctacttagacccagtca

SEQ ID NO: 5043087 - DNA, 15 bp, Homo sapiens
ctcctccagagcctg

SEQ ID NO: 5043088 - DNA, 21 bp, Homo sapiens
ctcctcgtcccgagggcgcct

SEQ ID NO: 5043089 - DNA, 13 bp, Homo sapiens
ctcctgcccactc

SEQ ID NO: 5043090 - DNA, 20 bp, Homo sapiens
tgcccagcggctcttcctgg

SEQ ID NO: 5043091 - DNA, 16 bp, Homo sapiens
tgcccagcttggagtg

SEQ ID NO: 5043092 - DNA, 22 bp, Homo sapiens
tgcccagcttggagtgccacgt

SEQ ID NO: 5043093 - DNA, 23 bp, Homo sapiens
tgccccaggctcaggctgcccag

SEQ ID NO: 5043094 - DNA, 24 bp, Homo sapiens
tgccccaggctcaggctgcccagc

SEQ ID NO: 5043095 - DNA, 16 bp, Homo sapiens
tgcgtctcctgcccac

SEQ ID NO: 5043096 - DNA, 22 bp, Homo sapiens
tgctggaaaggcccggagatgc

SEQ ID NO: 5043097 - DNA, 19 bp, Homo sapiens
tgctgtcatgcccagcttg

SEQ ID NO: 5043098 - DNA, 14 bp, Homo sapiens
tggcagcgcccagc

SEQ ID NO: 5043099 - DNA, 16 bp, Homo sapiens
tggcagcgcccagcct

SEQ ID NO: 5043100 - DNA, 13 bp, Homo sapiens
tggccccagtgac

SEQ ID NO: 5043101 - DNA, 14 bp, Homo sapiens
tggccgctgcccac

SEQ ID NO: 5043102 - DNA, 20 bp, Homo sapiens
tggccggcccacgtcctggg

SEQ ID NO: 5043103 - DNA, 16 bp, Homo sapiens
tgggagccacagggac

SEQ ID NO: 5043104 - DNA, 19 bp, Homo sapiens
tgggcgcctctgtcctggc

SEQ ID NO: 5043105 - DNA, 22 bp, Homo sapiens
tggggcggcctgcagaccctgc

SEQ ID NO: 5043106 - DNA, 17 bp, Homo sapiens
tggggttttcacttcct

SEQ ID NO: 5043107 - DNA, 12 bp, Homo sapiens
tgggtccctgcg

SEQ ID NO: 5043108 - DNA, 14 bp, Homo sapiens
tgggtcctcccagc

SEQ ID NO: 5043109 - DNA, 21 bp, Homo sapiens
tgggtcctcccagctgacggc

SEQ ID NO: 5043110 - DNA, 23 bp, Homo sapiens
tgggtgctgtcatgcccagcttg

SEQ ID NO: 5043111 - DNA, 12 bp, Homo sapiens
tgggtttccctg

SEQ ID NO: 5043112 - DNA, 21 bp, Homo sapiens
tggtcccccatgggctgctgg

SEQ ID NO: 5043113 - DNA, 13 bp, Homo sapiens
tgtctgcaggcca

SEQ ID NO: 5043114 - DNA, 21 bp, Homo sapiens
tgtcttcttgggggcagacca

SEQ ID NO: 5043115 - DNA, 22 bp, Homo sapiens
tgtgagggcaaaccaggctgca

SEQ ID NO: 5043116 - DNA, 18 bp, Homo sapiens
ttactcaaaatgcaggac

SEQ ID NO: 5043117 - DNA, 20 bp, Homo sapiens
ttactcaaaatgcaggacag

SEQ ID NO: 5043118 - DNA, 17 bp, Homo sapiens
ttagggtacagcccagg

SEQ ID NO: 5043119 - DNA, 23 bp, Homo sapiens
ttcccactgcggaacaggagtga

SEQ ID NO: 5043120 - DNA, 17 bp, Homo sapiens
ttggagcgtttttgctg

SEQ ID NO: 5043121 - DNA, 22 bp, Homo sapiens
ttgtgtgagggcaaaccaggct

SEQ ID NO: 5043122 - DNA, 11 bp, Homo sapiens
tttcacttcct

SEQ ID NO: 5043123 - DNA, 16 bp, Homo sapiens
aaagggatggtcaggc

SEQ ID NO: 5043124 - DNA, 20 bp, Homo sapiens
aaatcctatttttgtagatc

SEQ ID NO: 5043125 - DNA, 13 bp, Homo sapiens
aacatagagaact

SEQ ID NO: 5043126 - DNA, 19 bp, Homo sapiens
aacccatgcccctgacaga

SEQ ID NO: 5043127 - DNA, 22 bp, Homo sapiens
aacccttagcttttagcctggc

SEQ ID NO: 5043128 - DNA, 13 bp, Homo sapiens
aacctggcaggcc

SEQ ID NO: 5043129 - DNA, 20 bp, Homo sapiens
aacctggcaggccctgccca

SEQ ID NO: 5043130 - DNA, 23 bp, Homo sapiens
aacctggcaggccctgcccagcc

SEQ ID NO: 5043131 - DNA, 21 bp, Homo sapiens
aactggcgatctcccagggct

SEQ ID NO: 5043132 - DNA, 12 bp, Homo sapiens
aactgtcccagc

SEQ ID NO: 5043133 - DNA, 13 bp, Homo sapiens
aactgtcccagcg

SEQ ID NO: 5043134 - DNA, 17 bp, Homo sapiens
aagaaatgggcctcagc

SEQ ID NO: 5043135 - DNA, 18 bp, Homo sapiens
aagaagttcaccagccct

SEQ ID NO: 5043136 - DNA, 20 bp, Homo sapiens
aagaagttcaccagccctga

SEQ ID NO: 5043137 - DNA, 18 bp, Homo sapiens
aagagtgtctatggagca

SEQ ID NO: 5043138 - DNA, 19 bp, Homo sapiens
aagcaacttcatcccagct

SEQ ID NO: 5043139 - DNA, 20 bp, Homo sapiens
aagcagcctttttcaccatg

SEQ ID NO: 5043140 - DNA, 21 bp, Homo sapiens
aagccccattcacggcctggc

SEQ ID NO: 5043141 - DNA, 22 bp, Homo sapiens
aagccccattcacggcctggca

SEQ ID NO: 5043142 - DNA, 23 bp, Homo sapiens
aagccccattcacggcctggcat

SEQ ID NO: 5043143 - DNA, 14 bp, Homo sapiens
aagcctgagcaggc

SEQ ID NO: 5043144 - DNA, 15 bp, Homo sapiens
aagcctgagcaggca

SEQ ID NO: 5043145 - DNA, 14 bp, Homo sapiens
aagggagacaggcc
